United States Patent 11,141,474 (ARTIFICIAL NUCLEIC ACID MOLECULES ENCODING A NOROVIRUS ANTIGEN AND USES THEREOF) - sequence listing, part 17

SEQ ID NO: 35881 - RNA, 1653 nt, Artificial Sequence
  derived and/or modified sequence opt11 from VP1__Norovirus__AFN06724
augaaaauggcaagcaacgacgcagcaccaagcaacgacggcgcagcgaaccucguacccgaagccaacaacgaaguaauggcccucgaaccugucgucggugccuccauagccgcccccguagugggccaacaaaacaucauagaccccuggaucagggaaaauuucguccaagcaccccagggcgaauuuaccguaucuccccgcaacuccccaggcgaaaugcuccucaaccucgaacucggcccugaacucaacccauaccuaagccaccugucacguauguacaacggcuacgccggcggaaugcaaguccaagucguacucgccggcaacgccuucacugccggaaaaauaaucuucgccgccgucccuccccacuuccccguagaaaacaucuccgcagcccaaauuacaaugugcccccacguaaucgucgacguacgccaacucgaacccguccuacucccacuacccgacauucguaaccgauucuuccacuacaaucaagaaagcacccccagaaugcgacuaauagcuaugcucuacaccccacuccgagcaaacagcggcgaagacgucuucacaguuagcugccgaguccuuacccgucccgccccagacuucgaguucaccuucuuagucccacccaccgucgaauccaaaaccaaacccuucacacuacccauccugacacucggcgaacuauccaacagccgcuuccccgcugcgaucgacaugcucuacacagaccccaacgaaucaauagucguccaaccucaaaacggccgaugcacccuagauggcacccuucaaggaaccacacagcuaguccccacacaaaucugcgcuuuccgcggaacccucauuucccaaaccgcccgugccgccgacuccacagacuccccacaacgcgcacgcgaccacccgcuacacguacaagucaagaaccucgacggcacacaauacgaccccaccgacgacauccccgccguccucggcgccaucgacuucaaaggcacaguauucggcguagccucacaacgcgacgucagcggccaacaagaacaaggccacuacgccacacgagcccacgaagcacacaucgauaccaccgacccgaaauacgccccaaaacucggcacaauccuaauaaaauccgaaucaaacgacuucaccaccaaucaacccauccgauuuacccccguaggaaugggagacaacaacuggcgacaaugggagcuccccgacuauucaggccgccucacucucaacaugaaccuugcccccgcaguaagccccucuuuucccggagagcgcauccucuucuuccgcucaaucguuccaucugccggcggcuucgggucgggcuacauagacugccucaucccucaagaauggguccaacacuucuaccaagaagccgcccccucacaaucagccgucgcccucguccgauacgucaauccagacacuggccgcaacaucuucgaagcaaaacuccaccgagaaggcuuccucacagucgccaacucgggaaacaacccaaucgucgucccucccaacggcuauuucagauucgaagccugggucaaccaauucuacacccucgcccccaugggauccggccaaggucgucgccgcgcccaguaa

SEQ ID NO: 35882 - RNA, 1653 nt, Artificial Sequence
  derived and/or modified sequence opt11 from VP1__Norovirus__AFN06725
augaaaauggccucaaacgacgcugccccaucgaacgacggagcagccaaucucguccccgaagccaacaacgaagucauggcucuagaacccguagucggcgcauccaucgcagcccccgucgucggacaacaaaacauaauagaccccuggauccgcgaaaacuucguccaagcuccccaaggcgaauuuaccgucuccccacgcaacucccccggcgaaaugcuacuaaaccucgaacucggccccgaacucaaccccuaccucucccaccucucccgaauguacaacggauaugcuggaggcaugcaaguccagguaguacuagcgggcaacgccuucacagcagguaaaaucauuuucgcagccgucccgccccacuuccccgucgaaaacaucuccgcagcccaaaucaccaugugcccccacgugaucgucgacguccgacaacucgaacccguccuccuuccacuacccgacauccgaaaccgauucuuccauuacaaccaggaaaacacccccagaaugcgccucaucgcaaugcuuuacacuccccuccgcgccaacucaggagaagaugucuucaccgucucaugcaggguccucacacgacccgcacccgacuucgaauuuaccuucuuaguacccccaaccguagaauccaaaacaaaacccuucacccuaccaauccucacccugggcgaacuaagcaacucacgauuccccgcagcaaucgacaugcuauauaccgacccaaacgaauccaucguaguacagccccaaaacggccguuguacccucgacggaacccuacaaggcacaacccagcuaguccccacccaaaucugcgccuuccggggcacccucauaucccaaacagcacgcgccgcugacuccacagauuccccacaacgcgcacgcgaccacccacuccacguccaaguuaaaaaccucgacggcacacaauacgaccccaccgacgacaucccagcuguccucggcgccauugacuucaaaggcacagucuucggagucgccucccaacgugacgucagcggccaacaagaacaaggucacuacgccacccgugcacacgaagcacacauugacaccaccgaccccaaauacgcaccaaaacucggcaccauccucaucaaaagcgaauccaacgacuuuacaaccaaucaacccauccgcuucacccccgucggaaugggcgauaacaacuggcgccaaugggaacuccccgauuacuccggccgccucacccucaacaugaaccucgccccagccguuagccccuccuucccaggcgaacguauccuuuucuuucguucaaucgucccauccgccggcggcuucggaucaggcuauauagacugccucaucccccaagaauggguccaacauuucuaccaagaagccgcacccucacagucagccgucgcccucguccgcuauguaaacccagacaccggucgcaacaucuucgaagcuaaacuccaccgcgaaggcuuccucaccgucgcaaacuccggaaacaacccgaucguuguacccccaaacgguuacuucagauucgaagccugggucaaccaauucuacacccucgcacccaugggcuccggccaaggaagacgacgcgcccaauaa

SEQ ID NO: 35883 - RNA, 1629 nt, Artificial Sequence
  derived and/or modified sequence opt11 from VP1__Norovirus__AFN06726
augaaaauggccagcaacgacgccgcacccucuaccgauggugccgccggccucguccccgaauccaacuccgaggucauggcacucgaaccgguagccggcgcggcccuugccgcccccgucacgggacaaacuaacauaaucgaccccuggaucagagcuaacuucguccaagcacccaacggcgaguucacagucucaccucggaacgccccaggcgaaguccuacuaaaccucgaacuugggcccgaacuaaaccccuaccucgcccaccucgcccgcauguacaacggcuaugcagggggcauggaaguccaaguuaugcuagccggaaacgccuucacugccggcaaacucgucuucgccgccgucccaccccacuuccccguagaaaaccucuccccacaacaaauaaccauguucccccacgucauuaucgacguccgaacacucgaacccguccuccuaccacuccccgacguucgcaacaacuucuuccacuacaaccaaaaagacgaccccaaaaugcggaucgucgccaugcuauacacaccccuacgcucaaacggcuccggcgacgacguguucaccguaagcugccgcguacucacccgucccucgcccgacuucgacuucaccuaccuggucccaccaacagucgaaucaaaaaccaagccauucacccuucccauauugacacuaggcgaacucuccaacuccagauucccaguaucaauagaccagauguacacauccccaaacgaaguaaucuccguccagugccaaaacggccgcugcacacuagacggcgaacuccaaggcacuacacaacuucaagucucaggaauaugcgcauucaaaggcgaagucaccgcccaccuccaagacaacgaccaccuauauaacaucacaaucaccaaccucaacggcucucccuucgacccuucagaagauaucccagccccacuuggcguccccgacuuccaaggccgagucuucggcguuaucacccaacgagauaaacaaaacgccgccggacaaucccaacccgccaaccgcggccacgacgcaguaguucccacauacaccgcccaauacacaccuaaacucggucaaguccaaaucggcaccuggcaaaccgacgaccuaaaagucaaccaacccguaaaauucaccccugucggccucaacgacaccgaacacuucaaucaguggguagucccacgauacgcaggagcauuaaaccuaaacacaaaccucgcacccucaguagcccccgucuuccccggcgaacgacuacucuucuuccgaucauaccuaccccucaaaggcggguacgggaaccccgcaaucgacugccuccucccccaggaguggguucaacauuucuaccaagaagccgccccaucuaugucagaagucgcucuaguccgguacaucaaccccgacaccggcagagcacucuucgaagccaaacuacacagagcaggauucaugacaguauccucaaacaccuccgcccccgucguaguucccgccaauggcuacuuccgguucgauagcuggguaaaccaauucuauucccuugcccccaugggcacaggaaacggccgccgccgcauccaauaa

SEQ ID NO: 35884 - RNA, 1617 nt, Artificial Sequence
  derived and/or modified sequence opt11 from VP1__Norovirus__AFN06727
augaaaauggcuucuaacgacgccacccccuccgacgacggagccgccggccucguccccgaaauuaacaacgaaguaauggcccucgagccugucgccggcgccuccaucgcagcccccgucgucggccaacaaaacaucaucgaccccuggauccgaaacaauuuuguacaagcucccgccggggaguucaccgucucgccccgcaacucccccggcgaauuacuacucgaccucgaacucgguccagaacucaaccccuaccucgcccaccuagcacgaauguacaacggccacgccggaggcauggaaguacaaauaguccuagccggcaacgccuucacggcaggcaaaauccucuucgccgccaucccucccuccuuccccuaugaaaaucucuccccagcccaacuuacaaugugcccacacguaaucguggacguccgacaacucgaaccagugcuucuaccaaugcccgacauccguaacguauucuaucacuacaaccaaaacaacucccccaaacuacgccucgucgcuaugcucuacacaccccuccgcgcaaacaauuccggagacgacgucuucaccguauccugccgaguccuuacccgcccaucgcccgauuuccaauucacuuuccucgucccacccaccgucgaauccaaaaccaaaaacuucacacuccccguccucagaguguccgaaaugacaaauagccgcuuccccguaguccuagaccaaauguacaccagccgcaacgaaaacauuaucguccaaccccaaaacggccgcugcaccacagacggugaacuacucggaacuaccauccuccaauccgucuccaucugcaacuucaaagguaccaugcaagccgaacuuuccgaccaaccccgcuaccaauaccaacuccaacuaaccaaccucgaugggucccccaucgaccccaccgacgacguucccgcaccccuaggcacccccgauuuccaagccaugcucuacggaguugccucccaacgcuccucccgcgacaacgccacccgagcccacgacgcccaaauugacaccgccggagacacuuucgcccccaaaaucggccaaguccgauucaagucaucuucaaacgacuucgaccuacacgaccccaccaaauuuacccccaucggcguaaacgucgaugaccaacaccccuuccgucaauggucccuccccaacuacggcggccaccuagcccuaaacaaccaccucgcccccgccguuacaccccuuuuccccggugaacaaauccucuucuuucgcuccuacauccccuccgccggaggacacaccgacggcgccauggacugcuuacucccgcaagaauggaucgaacacuucuaccaagaauccgccccuagccaauccgacaucgcccucguccgauucaucaaccccgacaccggacgcguccucuucgaagccaaacuccacaaacagggcuuccuuacaaucgccgccuccggagaccaccccaucgucaugccuacuaacggauacuuccguuuugaagcauggguaaaccccuuuuacacccuugccccuguaggcacaggaucaggccgccgacggauccaauaa

SEQ ID NO: 35885 - RNA, 1647 nt, Artificial Sequence
  derived and/or modified sequence opt11 from VP1__Norovirus__AFN06728
augaagauggccucaaacgacgccgcacccuccaacgacggcgccgcuggucucguacccgaaauaaacaacgaagccauggcccucgaacccguugccggcgccgccauagccgccccacucaccggccaacaaaacaucauagacccauggaucaugaacaacuucguacaagcucccggcggcgaguucaccgucucaccacgcaauucccccggcgaaguccuccucaaccucgaacucggcccagaaaucaaccccuaucucgcccaccucgcccgcauguacaacggcuaugcaggaggcuucgaaguccaagucguacucgccggcaacgccuucacagccggaaaagucaucuucgccgccaucccucccaacuuucccaucgauaaccucuccgcagcucaaauuacuaugugcccccacguuaucguagacguccgccaacucgaacccaucaaccuccccaugcccgacgugcgcaacaacuuuuuccacuacaaccaaggcuccgacuccagacuccgccuaauagccauguuauacacaccacuacgcgcuaacaacucaggcgacgacgucuuuaccgucuccugcagaguucuaacccgcccuucccccgacuucuccuucaacuuucuagucccaccuaccgucgaauccaaaacaaaaccauucacccucccaauccucaccaucuccgaaaugagcaacuccagauucccaguucccauagacucccuacacacauccccaacagaaaacaucguaguccaaugccaaaacggccgcgucacgcuagacggugaacucauggguaccacucaacuacuccccucucaaauaugcgccuuuagagguacucuuacccgcucaaccucccgcgccuccgaccaagccgacaccgccacccccagacucuucaacuauuacuggcacauacaacuugauaaccucaauggcaccccauacgacccagccgaagacauucccgccccucucggcacaccugacuuccgcggaaaggucuucggcguugccucccaacgaaaccccgacuccaccacccgcgcccacgaagccaaagucgacacgacauccggccguuucacucccaaacucggaucccucgaaauaucaaccgaaagcgacgacuucgaccccaaccaacccacccgcuucaccccagucggcaucggcgucgacaacgaagccgauuuccaacaauggucccugcccgacuacagcggccaauucacccacaacaugaaccucgcccccgcagucgccccuaacuuccccggcgaacaauuacucuucuuccgcagccaacuaccauccuccggcggucgcuccaacggcaucuuagauugccucgucccucaagaauggguucaacauuucuaucaagaaucugcccccgcccaaacacaagucgcacucguccgcuacgucaaccccgacaccggcagaguacucuucgaagcgaaacuccauaaacucggcuucaugacuaucgccaaaaacggcgacucacccaucacaguaccacccaacggauacuuccgauucgaaucuuggguaaaccccuucuacacccuagcccccauggggacaggaaacggucgccgacgcauccaauaa

SEQ ID NO: 35886 - RNA, 1647 nt, Artificial Sequence
  derived and/or modified sequence opt11 from VP1__Norovirus__AFN06729
augaaaauggccucaaacgaugccgcccccuccaacgacggcgccgccggccuaguccccgaaaucaacaacgaagcuauggcccucgaacccgucgucggugccgccaucgcggcaccccucaccggccaacaaaacauaaucgacccauggauaaugaacaacuucguccaagcccccggcggcgaguuuacagucucaccccgcaacuccccaggcgaaguccuccuaaaccucgaacuaggacccgagaucaaccccuaccucgcacaccucgcccgcauguacaacgguuacgccggaggauucgaaguccaaguuguacucgccggcaaugccuuuaccgcuggcaaaguaaucuucgccgccauaccucccaacuuccccaucgacaaccucucagccgcacaaaucacuaugugcccccacgucauagucgacguccgccaacucgaacccauaaaucucccaaugcccgacguaagaaacaacuucuuccacuacaaccaggguuccgacagccgccuucgacuuauagcaaugcucuacaccccacuucgcgccaacaacagcggcgacgacgucuucaccgucucaugccgcguacuaacccgcccaucccccgacuucuccuuuaacuuucuagucccucccaccgucgaaucaaaaaucaaacccuucacacuccccauccuuaccaucagcgaaaugagcaacucccgcuuccccgucccuaucgacucccuccacaccagucccacugaaaacaucguaguccaaugccaaaacggccgagucacucuagacggagaacuaauggggaccacccaacuccuacccucacaaauaugcgcauuccgagguacacuuacccgcuccaccucuagagcaucagaccaggccgacacugccaccccacgccucuucaacuacuauuggcacauccaacucgacaaucucaacggcacccccuaugaccccgccgaagacauccccgcaccccucgguacccccgauuuccgcggcaaagucuucggaguagcaucacaacgcaaccccgacagcacaacccgagcccacgaagcaaaagucgacacaaccucagggcgcuucacccccaaacucggcucccuagaaauauccaccgaauccggugacuucgacccuaaccaacccacucgcuucacccccgucggcauaggaguagauaaugaagccgacuuccaacaauggucucucccagacuauuccgggcaauucacacacaacaugcaccucgcccccgccguugcccccaacuuccccggugaacaacuacucuucuuccgcucccagcuacccuccagcggaggccgaucuaacggaauacucgacugccucgucccacaagaauggguccaacacuucuaccaagaauccgcacccgcccaaacccagguagcucucguaagauacgucaaccccgacaccggccgcgucuuauuugaggccaaacuacacaaacuaggcuucaugacaaucgcgaaaaacggcgauucccccaucaccguacccccaaacggcuacuuccgauucgaaucaugggucaaucccuucuacacacucgccccgaugggcacaggcaacggucgccgacgcauccaauga

SEQ ID NO: 35887 - RNA, 1644 nt, Artificial Sequence
  derived and/or modified sequence opt11 from VP1__Norovirus__AFN06730
augaaaauggccuccaacgacgccgcccccucaaacgacggcgccgcaaaccuaguaccagaagccaauaacgaagucauggcccuugaacccguaguaggcgcuucaaucgccgcccccgucguaggacaacaaaacaucaucgaccccuggauccgagaaaauuucguacaagcaccccaaggcgaauuuaccguuucaccccgcaacucccccggcgaaaugcuccuaaaccucgaacuuggccccgaacugaaccccuaucucucacaccucuccagaauguacaacggauacgcaggcggaaugcaaguucaagucguccucgcgggcaacgccuucacagccggcaaaaucaucuucgccgccguuccaccccacuuccccguagaaaacaucucagcagcccaaaucaccaugugcccacacgucaucgucgacguacgccaacucgaacccguccuucuaccccuaccagacauucgcaaccgcuucuuccacuacaaccaagaaaacaccccacgcaugcgacucgucgccaugcuauacacuccccuccgagccaauuccggcgaagauguuuucaccgucuccugccgaguccucaccagacccgcaccagacuucgaguucaccuuccuuguucccccuaccguagaaaguaaaaccaaacccuucacucuccccauccuuacccucggcgaacuuagcaacucgagguuccccgccccuaucgauaugcuauacacagacccaaacgaaacaaucgucguacaaccacaaaacggccgaugcacccucgacggcacacuacaaggcacaacucaacucguccccacccaaaucugcucuuuccguggcacacuuaucucgcaaaccucucgcucagccgaaucaaccgacuccgcaccccgcguccgcaaccacccccuccacguacaacucaaaaaucucgacggcacccccuaugaccccacagacgaaguacccgccguacucggcgcaaucgacuucaaaggcaccguauuuggaguugccucccaacgcaacaccacaggcucaucagccggagccacccgcgcacacgaaguacauaucgacaccacaaacccccgcuacacaccuaaacuaggauccguccucauguacucggaaucuaccgacuucgacgacgggcaacccacccgcuucacacccauugguaugggagccgacgacuggcgucaaugggaacuucccgaauauuccggccaccucacacucaacaugaaccucgccccagccguagcccccgcauucccaggcgaaagaauacuuuucuuccgcuccguaguacccucagccgguggauacggcuccggccaaauagacugucucauaccccaagaauggguccaacacuucuaccaagaagcagccccaucacagucagccguagcucucauucgcuaugucaaccccgacaccggccgcaacaucuucgaagccaaacuccaccgcgaaggcuucauaaccguagcgaacuccggcaacaacccgauagucgucccacccaauggauacuuccgguucgaagcauggguaaaccaauucuacacacuuaccccaaugggaaccggacaaggacguagacgaguccaguaa

SEQ ID NO: 35888 - RNA, 1623 nt, Artificial Sequence
  derived and/or modified sequence opt11 from VP1__Norovirus__AFN06731
augaaaauggccuccaacgacgccgcccccuccucggacggcgccgcaggccuuguccccgaaaucaacaacgaaguaaugccccuagaacccgucgcuggagccucacucgccacaccaguagucggccaacaaaacaucauagacccuuggauacgcaacaacuucguccaagcccccgcaggagaguucaccguuuccccacgcaacuccccuggcgaaauauuacuagaccuagaacuuggcccagaacucaaccccuaccucgcccaccuugccagaauguacaacggccacgcaggcggcauggaaguccaaaucguacucgcgggcaacgcauucaccgcaggcaaaaucauuuucgcagcuaucccacccggauuccccuacgaaaaccucucccccucccagauaaccaugugcccccacgucauaauagacguacgccaacuagaacccguccuccucccaaugcccgacauccgaaacaacuuuuuccacuacaaccaaggaaaugaccccaaacuacgacucguagcaaugcucuacacaccacuacgcgccaauaacucaggcgacgacgucuucaccguuagcugccgcguccuuacaaagcccagcccagacuucgaguucacuuuccucguacccccaaccgucgaaucaaaaacaaaacaauucacccuccccauucucaaaaucuccgaaaugaccaacucccgcuuccccgucccagucgacgucauguacacugcccgcaacgaaaaccaagucguacaaccccaaaacggccgcguaacccucgacggugaacuccuggguaccacaccccuucuagcagucaacaucugcaaauuuaagggcgaagucaucgccaaaaacggagacguaagauccuaccgcauggacauggaaauaacuaacaccgacggcacacccauagaucccacagaagauacgcccggccccaucggcucaccagacuuccaaggcauacuuuucggcguagcaucgcaaagaaacaaaaacgaacaaaaccccgccacccgagcgcacgaagcaaacauaaauacaggcggcgaccaauacgcccccaaacuugcacaagucaaauucuucuccgaaucacaagacuucgaaguccaccaaccaacaaucuuuacccccgucggcgucgccggcgacacaucccacccauuccgccaauggacccucccccgauacggcggucaucuaacaaacaacacccaccuugcacccgcugucgcaccacucuuccccggcgaacaacuccuauucuuccgcucccaaauucccucauccggcggacacgaacagggauacauggacugccucgucccccaagaauggguacaacacuucuaccaggaagcagccaccgcacaaucagaagucgcccuaauccgcuucaucaacccugacacaggccgcguccuauucgaagccaaacugcacaaacaaggcuuuaucaccgucgcccacacuggcgauaaccccaucgucaugccacccaacggcuacuuccgcuucgaagccugggucaaccaauucuacucacuagcccccguaggaaccggcaauggccgccgccgcguucaguaa

SEQ ID NO: 35889 - RNA, 1623 nt, Artificial Sequence
  derived and/or modified sequence opt11 from VP1__Norovirus__AFN06732
augaaaauggccucaaacgacgccgcuccaucuaacgacggcgccaccggccuagucccugaaauaaaccacgaaacccucccacuugaacccgucgccggagccgccaucgccgcccccguaaccggccaaaacaacauuaucgacccauggauccgcaccaacuucguccaagccccaaacggcgaauuuacagucucaccccgcaacucccccggagaaauacuccuaaacuuagaacucggcccugaccucaaccccuaccuggcccaccucucucgcauguacaacggcuacgcaggcgguguagaaguccaaguacuucuagccggaaacgccuucaccgccggcaaaauucuauucgcagcaguaccacccaacuuccccguagaguucuuaucgcccgcacaaaucaccaugcucccccaccucaucgucgacguacgaacccuagaacccauaaugaucccccuccccgacguccgcaacaccuucuuccacuacaacaaccaaccagccaaccgaaugcgacuugucgccaugcucuacacaccucuccguuccaacggcucaggcgacgacgucuucacagucucuugccgaguccuaaccagacccaccccagacuucgaguucacauacuuagugccaccuucugucgaaucaaaaaccaaaccauucucccuccccauucuaaccauaucugaacucacuaacuccagauuccccgcccccauagacucccuauacacagcacaaaacaacaaccucaacguacagugccaaaacggccgcugcacucucgacggcgaacugcaaggaacuacccaacuacuccccucuggaauaugcgcuuuccgaggaaaacucacagccgacguccaccaaucucacgacgaccgguggcacaugcaacucaccaaccucaacggcacccccuucgaccccaccgaagauguccccgcaccccucggaacccccgacuucacuggccuacucuucggcguugccucacagcgcaacgucgucucuaaccccaauaccacccgagcccacgaagccgucauauccaccaccaguucacaauucguacccaaacuaggcucaauaaacuucggaucaaccucagacgacuuccaacuacaacaaccaaccaaauucaccccagucggaauaaaagucgaauccggccacgacuucgaccaaugggcccucccacgcuacuccggacaccuaacccucaacaugaaccuagccccacccgucgcccccaacuuccccggagaacaacuccuauucuuccgcucuaacguacccugcgccggaggcgucuccgacggagucaucgacugccuucucccccaagaauggauccaacacuucuaccaagaaucugcccccucucaaucggacguagcccucauaagauacguaaaccccgacaccggccguacccucuuugaagccaaacuucaccgaacaggcuacaucaccguagcccacucaggcgacuacccccucguagucccaagcaacggguacuuccgauucgacuccugggucaaucaauucuauucacucgcccccaugggaaccgggaacggccgccgacgcguccaauaa

SEQ ID NO: 35890 - RNA, 1623 nt, Artificial Sequence
  derived and/or modified sequence opt11 from VP1__Norovirus__AFN06733
augaaaauggccuccaaugacgccgcuccaucaaacgacggugcggccggccucguccccgaauccagcaaugaagccauggcccucgaacccgucgucggcgcuucacucgccgcacccgucacuggccaaaccaacaucauagaccccuggauccguaccaacuucguccaagccccaaacggcgaauuuaccgucucaccccgcaacuccccaggugaaguccuaguaaaccucgaacuuggccccgaacucaaccccuaccuagcacaccuagccaugauguacaacggcuacgcgggaggcauggagguccaagugcuccuagcgggcaacgcauucaccgccggaaaaaucaucuucgcagccguacccccauauuuccccgucgaaaaucucucccccucccaaauuaccauguucccccacguaaucaucgacguccgcacccuagaaccaguccuacuuccaaugcccgacguccgguccacccucuuccacuuuaaccaaaaagacgaaccaaaaaugcgccucgucgccaugcucuauacuccccuccgcucaaacgguuccggagacgacgucuucaccgucuccugccgcauccuuaccagacccuccccagaguucgacuucacauaccucgucccacccacagucgaaucaaaaacaaaacccuuuacccuaccaguacucacccucggcgaacuaagcaacucccgcuucccccuaucaaucgacgaaauggucacuucccccaacgaauccaucguaguccaaccacaaaacggcagaguuacccuagacggcgaauuacuuggaaccacccaacuccaagcaugcaacauaugcuccauaaggggcaaagucaccggccaaguaccuaacgaacaacauauguggaaccuagaaaucaccaaccuaaacggcacccaauucgaccccacagacgacguucccgcaccccuaggcguacccgacuucgccggugaaguauucggcguccucucacaacgcaaccgcggagaaucaaaccccgccaacagagcacacgacgccgucguagcaaccuacuccgacaaauauacacccaaacuaggccucguacaaaucggcaccuggaacacaaacgacgucgaaaaccaacccaccaaauuuacaccaauuggacugaacgaagucgccaacggccacagauucgaacaauggacccugccccgcuacucaggcgcccugacacugaacaugaaccucgcccccgcaguagcaccccucuucccaggcgaacgacuucucuucuuccguagcuauguaccccucaaaggcggcuucggaaaccccgccaucgacugccucgucccccaagaauggguacaacacuucuaccaagaauccgcucccucacucggcgacguagcacucguacgcuacguaaaccccgacaccggccgcguacuauucgaagcaaaacuccacaaaggagguuuccucacagucucauccaccuccacaggacccguaguagucccagcaaacgguuacuuccgcuucgacagcugggugaaccaauucuacucccuagcccccauggggaccgggaacggacgccgccguuuccaauaa

SEQ ID NO: 35891 - RNA, 1623 nt, Artificial Sequence
  derived and/or modified sequence opt11 from VP1__Norovirus__AFN06734
augaugauggcaaguaaagacgccccaacaucacccgacggcgcaucaggcgccggccaacuuguucccgaagcaaauacagccgaacaaauaucaauggaccccgucgcaggcgccucaacugcuguugccacagccggccaaguaaacaugauagacccauggaucuucaacaacuucguccaagcuccccaaggcgaauuuaccauuucccccaacaacacuccaggcgacauccuauucgaccuccaauuaggaccacaucugaauccauuucucgcccaccucucgcaaauguauaacggauggguaggcaacaugcgaguccgaauccuccucgcaggcaacgccuucacugcgggaaaaauuaucaucuguugcguacccccaggcuucgaugcacguauacucacgauagcccaagccacccucuucccccaccucaucgccgacguccguacacucgaacccgucgaacuaccccucgaagacguccgcaacguccucuuccacaacuccucgcaaccgcaacccaccaugcgucuuguagcaaugcucuacacaccccuccgcacaggaggcggcuccggcggcaccgacgccuucgucguggcaggacgaguccuaacaugcccagccccggacuucuccuuccucuuccucgucccacccuccgucgaacagaaaaccagagucuucucuguacccaacgucccacugaaagaccucucuaacucacgaguaccaguccccauccaaggcauguucaugucccccgacgucaaccaauccguacaauuccaaaacggccgcugucaaaucgacggacaacuccaaggcaccacacccgucucccuaagccaacucugcaaaauacgcggcaaaacauccucgaacgcccgcguucucaaccucagcgaagucgacggaacuccauuuauuccccuagaaucccccgcccccgugggcuuccccgaccuaggcggcugcgacuggcacgucaacuuuaccuuucaagcccaaaaccaagacccaucccaaucugucaccuucgcuaccaacgacgccucauucguaccuuaccucggauccauaucuccucacaacgguggcgacuuccacucaggugacaucaucgguucacucggcuggaucucggcccccuccgacuccucccaacucaacgucuggacaaucccgaaauacggcuccucucuccccgauguaacacaccucgccccagccgucuucccuccaggcuucggugaaguaauccuuuacuuucacuccacauuucccggaucaggccaaccgggccaacuccaagucccauguuugcucccccaagaauuuaucacccacuucuguaacgaacaagcacccaucgccggcgaagccgcccuccuacauuacgucgaccccgacaccggacgcaaccuaggagaguucaaacucuacccagacggcuucaugaccugcgucccaaacuccgucuccuccggcccccaaacccuccccauaaacggugucuucgucuucgucuccugggucucccgauucuaccaacuaaaacccgugggcaccgccucggccgccagacgacuaggccuccgccgcauauaa

SEQ ID NO: 35892 - RNA, 1632 nt, Artificial Sequence
  derived and/or modified sequence opt11 from VP1__Norovirus__AFN06735
augaugauggccuccaaagacgcaucccccuccgccgacggcgcuaauggagccggccaacuuguccccgaagucaacaacgcagaaccccugccccuagaccccgucgccggagcuucaaccgcccuggcaacagcaggacaagucaacaugaucgaccccuggaucuucaacaauuucguacaagcaccccaaggagaauuuaccaucucccccaauaacaccccaggcgacauccucuucgacuuacaauuaggcccccaccucaacccauuccucgcccaccucucccaaauguacaacggaugggucggcaacaugcguguacgcguuauccucgccggaaacgccuucacugccggcaaaguaaucaucugcugcguacccccaggcuuccaaagccguacccucucaauagcccaagccacucucuucccccacaucauugccgacguccguacccuagaaccaauugaaauaccccuagaagacguccgcaacacccucuaucacaccaacgacaaccaacccaccaugcgacuccucugcaugcucuacacaccacuccgcacagguggaggaucaggcggcacugacgccuucguaguggccggccgaguacuaaccugcccauccuccgacuucaacuuccucuuccucguacccccaaccguagaacagaaaacacgacccuucucaguccccaacauuccccuacaacuccuauccaacucccgcguucccaaccucauccaauccaugguccuuucccccgaucaagcccaaaacguccaauuccaaaacgggcgaugcaccaccgacggacaacuacucggaaccacccccgucucugucucccaaauacuaaaauuccgagguaaaguuucugcaggcucccgugucaucaaccucaccgaacuagacggcuccccauuccuagccuucgaagcccccgcgcccaccggcuucccugaccuaggcaccucagacuggcacgucgaaaugucccuaaacucaaacucccaauccuccggcaacccaaucuuacuccgcgacauucaaccaaacucauccgacuucguaccucaccucggcuccguauccgucacaacagcaaucgacgucgccggcgacuauaccggcaccauccaauggacaucacaaccaucaaacgucacaccaguccccgacgucaacuucuggaccaucccccaauacgguagcaaucucgcugaagcaucccaacucgcccccgucguuuacccacccggauucggcgaagcuaucgucuacuucaugucccccauccccggccccaacacagcccacaaacccaaccuagucccgugccuccuuccccaagaguucguaacccacuucgucuccgaacaagcccccucaaugggagaggcugcucucguccacuacgucgaccccgacacaaaccgaaaccucggagaauuuaaacuauauccggaaggauucauuaccugcgucccuaacggcacaggcccacaacaauuaccccuaaacggcgucuucgucuucgccucauggguaucccgauucuaccaacucaaacccguaggcaccgccuccuccgcacgcggccgacucgguguacgccgauaa

SEQ ID NO: 35893 - RNA, 1635 nt, Artificial Sequence
  derived and/or modified sequence opt11 from VP1__Norovirus__AFN06736
augaugauggcauccaaagacgcaccuacuaacauggacggcaccuccggagccggacaacuugucccagaagccaacaccgccgaacccaucuccauggaccccgucgccggcgccgcaaccgccguagcaaccgcaggccaaaucaacaugaucgaccccuggauaaugucuaacuucguccaagccccccaaggcgaauucaccgucucccccaacaacaccccgggcgacguccuauucgaccuccaacuaggcccacaacucaaccccuuccuagcacaccucgcccaaauguacaacggcugggucggcaauaugcgagucaaaguccuacuagccggcaacgcauucacugcaggcaaaauaauaaucucaugcaucccacccggcuucaccucucaaaacauauccauagcucaaaugaccauguucccccacguaaucgccgacguccgcgugcucgaaccaauagaaauaccacucgaagacguccgaaacguucuauuccacaccaacgacaaccgcccaaccaugcgacucgucugcaugcucuacaccccacuccgugccaacggaucaagcucaggcaccgaccccuucgucaucgcaggacgcguccucaccugccccgacuccaacuucucauuccuauuccucgucccccccaacgucgaacaaaaaaccagaccauucuccguacccaacauccccuugaacacccuaagcaauagucgcguccccucccuaaucaaauccaugacaaucagccgcgaccaaaaucagaucauccaauuccaaaacgggcgcgucacgcucgacggccaacuccaaggcacaacccccaccucaguaucacaacucugcaaaauccgcggcaccacuuaccacgcaacugguggcaacggaauaaaccucaccgaacucaacggugaaccauaccacgccuucgaaucccccgcccccaucggcuuccccgaccucgguggcugugacuggcaccucacagccacccccacccaagcauucaacgacggcgccaaagucguccgccuguccguaacccaaggcgccgccuucgccccacaccucggcaccauucacuacaccaccaccgaccacgacuacgacccuaacaccucaaucauaugcacacuagacuggcucucccaaaccaccggacaaaauaacguugaccccuggcaaauccccaccuacggcucaacccuaacagaagccgcccaacucgcaccccccaucuuuccacccggcuucggcgaaacccuaguauucuuccuuuccgacuuucccaucucuaacggcaaaaacggacucucagucccaugcacccuuccccaagaauucguaacccacuucguaaacgaacaagcuccaauccgaggcgaagcagcccuacuccacuacgucgauccagacacccaccgaaaccuaggcgaauucaaacuauaccccgaaggcuucaugaccugcguaccaaacaccuccggaggaggaccccaaacacuucccauaaacggcguauucgucuucgucagcugggucuccagauucuaccaauuaaaacccguaggcacugccggcgcagcccgacgccuugggauacgacguuccuaa

SEQ ID NO: 35894 - RNA, 1635 nt, Artificial Sequence
  derived and/or modified sequence opt11 from VP1__Norovirus__AFN06738
augaugauggcauccaaagacgcaccuaccaacauggacggcacauccggagccggccaacucguaccagaagccaacacagcagaaccaaucucgauggaacccgucgcaggggcugcaacagcagccgcaacagccggacaagucaacaugaucgaucccuggauaaugaacaacuacguccaagccccacaaggcgaauuuaccauaucccccaacaacacccccggcgacauccuauucgaccuccagcuuggaccccaccuuaaccccuuccucucacaccuagcccaaauguacaacggaugggucggcaacaugaaaguaaaaguccuccucgcggguaacgccuucaccgcaggcaagaucaucaucuccugcaucccacccggcuucgcaagccaaaacauaagcaucgcacaagcuacaauguucccccacgucauagcggacgucagaguccuugaacccaucgaaguaccccucgaagacguccgcaacguucucuuccacaacaacgacaauacacccacaaugcgucuaguaugcaugcuauacaccccacuacgugcauccggaucguccuccggcaccgacccuuucguuauugcuggcagaguacuaaccugccccuccccagacuucuccuuccucuuccucgucccacccaacgucgaacagaaaacaaaacccuucuccguuccaaaccucccccuaaacguccucuccaacagccgcguccccagccuaaucaaauucaugaugguuucccaagaccacggacaaaugguccaauuccaaaacggccgaguuacccuugacggccaacuccaaggaacaacccccaccuccgcaucacaacuuugcaaaaugcguggcaccguauaccacgccagcggaggccaaggacuaaaccucaccgaaaucgacggcaccccuuaccacgcauucgaaucccccgccccuaucggcuucccagaccucggcgacucagacuggcacaucaaugccucccccgcaaccaccuucaacaccggagaaagcgucaaacgccucgacauggaacaaggcuccucauucgcaccccaucucggaaccguacacuacaccaacgccgacuacgacgccaacaccgaccucaucugcucucuagaauggcugucacccccaucuggcggaacccccaacaaagucaacccaugggccauccccagauacggcucaacccuaacagaagccgcccaacucgcucccccuaucuacccacccggauucggcgaagccauuguguucuucauguccgacuuucccauagcaaacggacaagacggccuaaaaguccccugcaccauaccacaagaguucgucacacacuucgucaacgaacaagcccccacacgcggcgaagccgcccuccuccacuacguagacccagacacacaccguaaucucggcgaguucaaacuauacccagaaggcuuuaugacaugcguucccaacuccucaggaagcggcccccaaacacuccccauaaacggcguauucacguucguauccugggucucccgcuucuaccaacucaagcccguuggaacaaccggcccaguacgcagauuaggcauacgacguagcuga

SEQ ID NO: 35895 - RNA, 1635 nt, Artificial Sequence
  derived and/or modified sequence opt11 from VP1__Norovirus__AFN06739
augaugauggccuccaaagacgccccaacuaacauggacggcaccagcggcgccggccaauugguaccugaagccaacaccgccgaacccaucuccauggaaccagucgccggcgcagccaccgccgccgccacagcaggacaaguuaauaugaucgaccccuggaucaugaacaacuacguccaagcaccccaaggcgaauucacaauaucacccaacaacacccccggcgacauccucuucgaccuccagcucggcccacaccuaaauccauuccuuucgcaccuagcacaaauguauaacggaugggucggcaacaugaaaguaaaaguccuacuagcuggcaacgccuucaccgccggcaaaauuauaauauccugcauaccacccggauucgccucccaaaacauauccaucgcacaagccaccauguucccgcacguaauagccgacguucgcguccucgaacccaucgagguaccucucgaagacguccgcaacguacucuuccacaacaacgacaacacccccacaaugcgacucgucugcaugcuauacaccccccuccgcgcuucaggguccuccagcggcaccgacccuuucgucauagcaggacgaguccucaccugucccucccccgacuucucauuccucuuccuaguccccccaaacguugaacaaaaaaccaaacccuucuccguccccaaccugccucucaacguacuuuccaacucacgcgucccaucacucaucaaguccaugauggucucccaagaccacggccaaaugguccaauuccagaacggacgaguaacucucgacggccaacuccaaggaaccaccccaacaucugccucacaacucugcaaaaugcgcggcaccguauaucacgcauccgggggccaaggccucaaccuaacagaaaucgacggcacaccauaccacgccuucgaaucccccgcacccaucggcuucccagacaucggagacucagacuggcacauuaacgcuucaccagccaccacauucgacucuggagaaucaaucaagcgccucgacauggaacaaggcuccucauucgccccacaccuaggcaccguacacuacacaaaugccgacuaucccgcaaacacagaccucauauguucccucgaauggcucuccccccccagcggaggcacacccaauaaaguaaaccccuggaccaucccccgcuacggauccacccuaacagaagccgcccaacuagcccccccaaucuacccccccggcuucggugaagcaaucgucuucuucaugucagacuuccccauagcaaacggccaagacggucucaaagucccaugcacaauaccacaggaauucgucacccauuucguaaacgaacaagcacccacccgcggcgaagccgcacuccuccauuacguugacccugacacccaccgcaaccucggagaauucaaacucuaccccgaaggcuucaugaccugcguccccaacagcuccggcuccggcccacaaacccucccaauuaauggugucuucaccuucgucucaugggucucccgcuuuuaccaacuaaaaccagucggcacuacaggcccagucagacgccucgguauacgacgcucuuaa

SEQ ID NO: 35896 - RNA, 1623 nt, Artificial Sequence
  derived and/or modified sequence opt11 from VP1__Norovirus__AFV08771
augaaaauggccucaaacgacgcuaacccuuccgacggcucagcugccaaccuagugcccgaagucaacaacgaagucauggcacuagaacccgucgucggcgccgccaucgcagcccccgucgccggacaacaaaacgucauugacccauggauccgcaauaacuucguccaagcccccggcggcgaauuuaccguaucaccacgaaacgcaccaggcgaaauacuaugguccgccccacuaggccccgaccuaaaccccuacuuaucacaccucgcccgcauguacaacggauacgcggguggcuucgaaguccaagucauccuugccggcaacgccuucacugccggcaaaauaauuuucgccgccguacccccaaacuucccuacagaaggccucucaccuucacaagucacuauguucccucauaucauagucgacgucagacaacucgaacccguccucaucccccuacccgacguccgcaacaacuucuaccacuauaaccaauccaacgacagcaccaucaaacuaaucgccaugcucuacacaccacucagagcaaacaacgccggugacgacguuuuuaccgucagcugccgcguccucaccaggccuucccccgacuucgacuucaucuuccucguacccccaacaguagaaucacgcacaaaacccuucuccguaccaauccucaccgucgaagaaaugacuaacucccgauucccaauuccccucgaaaaacucuucacaggcccauccagcaccuucguaguccaaccccaaaacggacgcuguacaaccgacggaguccuccucgggaccacccaacuaucucccguaaacaucugcacauuucgcggcgacguaacccacaucgccggcucccgcaacuacacaaugaaucucgcgucgcaaaauuggaacuccuacgaccccaccgaagaaauccccgccccucuaggcacccccgacuucguaggcaaaauacaaggcguacucacccaaaccacacgcacagauggcucaacccgcggacacaaagcaaccguauacaccggaagcgccgacuucucccccaaacucggccgcguccaauuugcaaccgacaccgacaacgauuucgaugccaaccaaaacacaaaauucacgcccgucggcguaauacaggacggcaacacagcacaccgcaacgaaccucaacaauggguccuacccuccuacagcggccgcaacacccacaacguccaccuagcccccgccgucgcccccacauuucccggagaacaacuccucuucuuccguuccaccaugcccggcugcucaggcuaccccaacauggaccuagacugccuccuaccucaagaauggguccaauacuucuaccaagaagccgcaccagcccaauccgaugucgcccuccuccguuucguaaaccccgacacgggacgcguacucuucgaauguaaacuccacaaaucgggauacguaaccguggcccacaccggacaacacgaucucgucauaccaccaaacggcuacuuccgcuucgacuccugggucaaccaauucuacacacucgcccccaugggaaacggaacaggccgccgacgcgcccucuaa

SEQ ID NO: 35897 - RNA, 1623 nt, Artificial Sequence
  derived and/or modified sequence opt11 from VP1__Norovirus__AFV08774
augaaaauggcaucauccgacgccaaccccagcgauggcucaaccgcaaaccucguccccgaaguaaacaacgaaguaauggcucucgaacccguagucggugccgccauagccgcucccgucgccggccaacaaaaugucaucgaccccuggauccgaaacaacuucguccaagcccccggcggugaguucacagucuccccacgcaacgcaccaggcgaaauauuaugguccgccccacucggccccgaccuaaaccccuaccucucccaccucgcccgaauguacaauggcuacgccggcggcuuugaaguccaaguuauccucgccggcaacgccuucacugccggcaaaaucaucuucgccgccguucccccuaacuuccccaccgaaggacuauccccaucccaggucaccauguucccucacauaauagucgacguccgccaacuugaacccguucucaucccacuacccgacguccgaaacaacuuuuaucacuauaaccaauccaacgacccuacaaucaaacucaucgcgaugcuauacacaccccuccgagcaaacaaugccggugacgacgucuucacaguaucaugucguguccuaacccgaccauccccugacuucgacuucaucuuccucguacccccaaccgucgaaucccgcaccaaaccauucuccguccccguacucacuguugaagaaaugacaaacucccgauuccccaucccccuagaaaagcucuuuaccggccccucuagcgcguucgucguacaaccccaaaacggacgcugcaccaccgacggaguccuacucgguaccacacaacucucccccgucaacaucugcaccuuccguggagacguaacgcacauaucuggcucacgcaacuauacaaugaaccucgcaucucaaaacuggaacuccuacgaccccacagaagaaauccccgcaccccucgguacgccagacuucguaggcaaaauccaaggcguacuuacccaaacaacccgcacagacggcagcacccgaggccacaaagcuaccgucuacaccggauccgccgacuuuagccccaagcucggccgaguccaauucgcaaccgacaccgacaacgacuucgucacaaaccaaaacaccaaauucacaccugucggcguaauccaagacggauccacuacuccccgcaacgaaccacaacaauggguccuucccuccuacuccggccguaauacccacaacguccaccucgcccccgccgucgccccuacauuccccggagaacaacuacucuucuuccgcuccaccaugcccgguugcuccggcuaccccaacauggaccucgacugccuacucccccaggaauggguccaauauuucuaccaagaagccgcccccgcccaauccgacguagcccuccuccgcuucgucaaccccgacacaggucgcguccucuucgaaugcaaacuucacaaaucaggcuacguaaccgucgcccacacaggccaacacgaucuuguaaucccacccaacggcuacuuccguuucgauucuuggguaaaccaauucuacacacucgcccccaugggcaacggcaccggacgccgccgcgcgcuguag

SEQ ID NO: 35898 - RNA, 1623 nt, Artificial Sequence
  derived and/or modified sequence opt11 from VP1__Norovirus__AFV08777
augaaaauggccucaucagacgcuaacccauccgauggcucuaccgcaaaccucguccccgaagucaacaaugaaguaauggcccuagaacccguugucggagcggccaucgccgcaccagucgccggacaacaaaacguaaucgacccuuggauccgaagcaacuucguucaagcccccggcggcgaauuuacagucagcccccgcaacgcccccggagaaauccucugguccgcaccccuuggccccgaccuaaaucccuaccuaucccaccucgcacgcauguacaacggcuaugccggcggcuucgaaguccaaguaauccuugcaggcaacgcauucacagccggcaaaaucaucuucgccgcugucccacccagcuucccaaucgaaggccuaucccccucccaaguaacgauguucccucacauuaucgucgacguacgccaacucgaaccaguacuaaucccucuacccgauguccgcaacaauuucuaccacuacaaccaaucaaacgacccaacaaucaaacucauagcaaugcuauauacaccccuucgcgccaacaacgccggcgacgacgucuucacaguauccugccgcguccucacccgcccuucccccgauuucgacuucaucuuccucgucccaccuacuguagaaagcagaacaaaacccuucucugucccaguccucacagucgaagaaaugaccaacucacgcuucccaauaccacuagaaaaacucuucaccgggccuucauccgcauucgucguccagccccaaaacggacgcuguaccaccgacggcguccuccucggcacaacccaacucucgcccgucaacauaugcaccuuccgaggcaauguaacccacaucuccggcagccgcaacuacaccaugaacuuagcuucccaaaacuggaacuccuacgaccccaccgaagaaauacccgccccacucggcacacccgacuucgucggaaaaauccaaggcguccucacccaaaccacuaaaaccaacggauccacccgcggccacaaggccacaguauacaccggaagcgccgacuucagccccaaacucggccgaguccaauucgccaccgacaccgacaacgacuucgaaacaaaccaaaacacaaaauuuacccccgucggaguaauccaagacggcuccaccacaccccgcaacgaaccccaacaauggguccuacccucauacucuggacgcaacacccacaacguacaccuugccccugcugucgccccaaccuucccaggcgaacaacuacuauucuuccgauccaccaugcccggcugcucgggcuaucccaacauggaccucgauugccuucucccacaagaauggguccaauacuucuaccaagaagccgcccccgcccaaucagacguagcacuacuacgcuucguaaaccccgauaccggcagaguccuauuugaaugcaaacuccacaaaucaggauacguaaccgucgcccacaccggccaacacgaccuagucauacccccaaacggauacuucagauuugacuccuggguaaaccaauucuacacacuagccccaaugggcaacggaacaggacgacgacgugcacucuaa

SEQ ID NO: 35899 - RNA, 1623 nt, Artificial Sequence
  derived and/or modified sequence opt11 from VP1__Norovirus__AFV08780
augaaaauggcaagcucagacgccaacccaucugauggauccacagcaaaccucguccccgaagucaauaacgaagucauggcccucgaacccgucgucggugccgccauagccgccccggucgccggccaacaaaacgucauagaucccuggauucgcaacaauuucguucaggcccccggaggagaguucaccgucucuccccgcaaugcacccggagaaauccucugguccgcuccccuaggccccgaccuaaaccccuaccuuucccaccuagccagaauguacaacggcuaugccgguggauucgaaguacaagucauccucgccggcaacgccuucaccgccggaaaaaucaucuucgcagcuguaccacccaacuuccccacagaaggccucucccccucacaagucaccauguucccccacauuaucguugacguacgacaacucgaaccagugcucaucccacuccccgacguccgcaacaauuucuaccacuacaaccaaucaaacgaccccaccauaaagcucaucgcaaugcuauacacaccccuccgcgccaacaacgcaggcgacgacgucuucaccgucuccugccgcguacucacccgcccaucacccgauuuugacuucaucuuucucgucccucccaccgucgaaucucgaacgaaacccuuuuccguaccaauccuaacaguagaagagaugaccaacucgcgcuuccccaucccccucgaaaaacucuucaccggacccuccuccgccuucguaguccaaccacaaaacggccgcugcaccacagacggcguacuccucggcacaacgcaacuaucucccgucaacaucugcaccuucagaggcgacgucacccacaucaccggcagccgcaacuauacaaugaaccucgccacccaaaacuggaacuccuacgacccaacagaagaaauuccagcaccccuagguacaccugauuucgucggcaaaauccaaggcguacuaacacaaaccacgcgagccgacggcucaacacgcggacacaaagccaccgucuacacuggcuccgccgacuucgcaccaaaacugggccgcguccaauucgcaaccgacacagaccacgacuucgacgccaaccaaaauaccaaauucacacccgucggcgucauccaagacggcgacaccgcccaccgaaacgaaccacaacaauggguucuccccuccuacuccggccgcaacucccacaacguccaccucgcaccaaccgucgcacccaccuuccccggcgaacagcuauuauucuuccguucgacaaugccaggcugcucaggcuaucccaacauggaccucgacugccuccucccacaagaauggguacaauacuucuaccaagaagcagcaccagcucaaucagacguagcccuccuacgauuugucaacccagacaccggucgcguacuuuucgaaugcaaacuccauaaauccggauacguaacagucgcucacaccggccaacacgaccuggucauaccacccaacgguuacuuccgcuucgauuccugggucaaccaauucuacacacucgcccccaugggcaacggcacaggccgacgccgcgcccuauaa

SEQ ID NO: 35900 - RNA, 1623 nt, Artificial Sequence
  derived and/or modified sequence opt11 from VP1__Norovirus__AFV08783
augaagauggcauccuccgacgcaaacccaucagacggcagcacugccaaccucguacccgagguaaacaacgaaguaauggcccucgagcccgucgucggagccgccaucgccgcacccgucgccggccaacaaaacguaaucgacccauggauccgcaacaacuucguacaagcaccaggcggcgaguucacugucuccccacgcaaugcccccggcgaaauccucuggucagccccacuuggccccgaccucaaccccuaccucucucaucucgcucgaauguacaacggcuacgccggcggcuucgaaguccaagucauccucgccggaaacgccuucaccgccggaaaaauaaucuucgccgcaguuccucccaacuuccccaccgaaggacucucucccagccaagucaccauguucccccacauaauugucgacguaagacaacuagaaccaguccucauaccccuccccgacguacgcaacaauuucuaccacuacaaccaauccaacgaccccaccaucaaacucaucgcgaugcuauacacuccccuccgcgccaacaacgccggagacgacgucuucacagucucaugccgaguccuaacacgacccucacccgacuucgacuucaucuuccucguacccccuaccgucgaaagccgaaccaagccauucagcguacccguccucaccgucgaagaaaugaccaacucacgauucccaauaccccuagaaaaacuauucacaggaccuuccagcgcauucguaguacagccacaaaacggccguugcaccaccgacgguguucuccucggaacaacccaacuaucccccgucaacauuugcaccuuccgcggcgacgucacccauaucuccggcucacgaaacuacacaaugaaccuagccucccaaaacuggaacucauacgacccaaccgaagaaauucccgcucccuuaggcacccccgacuuugucggcaaaauccaaggaaugcucacucaaacuaccagaacagacggcucaaccagggggcacaaagccacggucuacaccggcuccgccgacuucucacccaaacucggccgaguccaguucgcaacugacaccgauaaugacuuugucaccaaucaaaacacuaaauucacaccugucggcgugauccaagacggcucaaccacacccaggaacgaaccacaacaauggguacuccccuccuacuccggacgaaacacucacaacguccaccuagcuccagccgucgcccccaccuuccccggcgaacaacuccuguucuuccgauccacaaugcccgguugcuccggcuaucccaacauggaccucgauugccuacuaccccaagaauggguccaauauuucuaccaagaagcugcaccagcacagagcgaugucgcccuccuccgcuucguaaacccagacacaggccgcguucuuuucgaaugcaaacuacacaaaaccggcuacgucacugucgcccacacaggccaacacgaccuagucaucccacccaacggcuauuuccgcuucgacuccuggguaaaucaauucuacacccucgcacccaugggcaacggaaccggccgccgccgagcacucuga

SEQ ID NO: 35901 - RNA, 1623 nt, Artificial Sequence
  derived and/or modified sequence opt11 from VP1__Norovirus__AFV08786
augaaaauggcgucaaacgaugccaacccaucagacgguuccgcagcaaaccucgucccagaaguaaacaacgaagucauggcccuagaacccguuguaggcgcagcaaucgccgcacccgucgccggucaacaaaacgucaucgaccccuggauccgaaacaacuucguacaagccccaggcggcgaguucacagucuccccacgaaacgccccaggcgaaaucuuauggagcgcuccccuaggccccgaccuaaaucccuaccucucccacuuagcccgcauguacaacggcuaugccggaggauucgaaguccaaguaauucucgcgggcaacgccuucacagcaggcaaaauuaucuucgccgcaguucccccaaacuucccaaccgaaggacucucccccucccaagucaccauguucccacacaucaucgucgacguccgccaacuagaacccguccuaaucccccuaccagacguccgaaacaacuucuaccacuacaaccaauccaaugacuccacaauaaaacuuaucgcaaugcucuacacaccccugcgcgcuaacaaugccggcgaagacgucuucaccgucuccugccgcguccuaacucgccccucccccgacuucgacuucaucuuucucguacccccaaccgucgaaucccgcacaaaacccuucaccgucccaauccuaaccgucgaagaaaugacaaacagccgauuccccauaccccucgaaaaacuuuucaccggccccucauccgccuucgucguccaaccccaaaacggcagauguaccacggacggcguccuacucggaacaacacaacucucccccguuaacaucugcaccuuccgcggcgacguaacccacaucgcaggcucccgcaauuacaccaugaaccucgccucucuaaacuggaacaauuacgauccaacugaagaaaucccagccccacuaggcacccccgacuuuguaggcaaaauacaaggcguccucacccaaacaacaaaaggcgauggaucaacccgaggccacaaagccaccgucuacaccggcuccgccccuuucaccccaaaacucggaucaguccaauucucuacagacaccgaaaacgacuucgagacccaccaaaacaccaaauucacccccguaggugucauacaagauggaggcaccacccaccgcaacgaaccccaacaauggguccuccccuccuacuccggccgcaacguucccaacguacaccucgccccagccguugccccaaccuuccccggagagcaacuauuauucuuucgcucaacaaugcccggcugcucaggauaccccaacauggaccucgacugccuccucccacaagaauggguccaacacuucuaucaagaagcagcacccgcucaauccgacgucgcacuacuccgauucgucaauccagauacaggccgcguccucuucgaauguaaacuacacaaaucgggcuacgucacagucgcccauacaggccagcaugaccucgucaucccacccaacggcuacuuccgcuucgacuccugggucaaucaauucuacacccucgcacccaugggcaacggcacuggucgucgccgugcacucuga

SEQ ID NO: 35902 - RNA, 1623 nt, Artificial Sequence
  derived and/or modified sequence opt11 from VP1__Norovirus__AFV08789
augaaaauggcuagcaacgacgcuaaccccuccgacggauccgccgcaaaccuaguaccagaaguaaacaacgaaguaauggcacucgaaccaguagucggcgccgccauugccgccccugucgcuggccaacaaaacguuaucgaccccuggauuagaaauaauuucguccaagccccuggcggcgaauuuaccgucuccccacgcaacgcccccggcgaaauccuguggagcgcucccuuaggacccgaucucaaccccuaccucucccaccuggcacgcauguacaacggauaugcaggcggcuucgaaguccaagucauucucgcaggcaacgccuucacagccggcaaaaucaucuucgcagccguuccacccaacuuccccacggaaggucucucccccucucaaguaaccauguucccacacaucauagucgacguccgccaacuagaacccguucucaucccccuccccgacguacgcaacaacuucuaccacuacaaccaaucaaacgacuccacaauaaaacucaucgcaaugcuuuauaccccuuuaagagccaacaacgccggcgaagacgucuucacagucucaugccgcguucucacccgacccucaccagauuucgacuucaucuuccugguacccccgacagucgaaucucgcaccaaaccuuucaccgucccuauucuaacugucgaagaaaugaccaauucccgcuuccccaucccccuagaaaaacuauucaccgguccauccucagccuucgucguccagccccaaaauggccguugcaccacagacgggguccuacucggcacaacacaacucucaccaguaaacauaugcacauuucgcggcgacguaacacacaucgcuggaucccgaaacuacaccaugaaccuugccucccuuaacuggaauaacuacgacccaacugaagaaauccccgcuccccucggcacgcccgacuucgucggaaaaauccaaggcguccuaacccaaacaaccaaaggagacggcagcacacgcggccacaaagccacaguauauaccggauccgcccccuucacacccaaacuaggauccguccaauucggcacagacaccgaaaacgacuucgaaacacaccaaaacacgaaauuuacccccgucggcgucauccaagacggaggaaccacccaucgcaacgaaccacaacaauggguccuaccaucauacuccggacgcgacguaccaaacguccaccucgccccagccgucgccccaacauuccccggagaacaacuacucuucuuccgaucaaccaugcccggaugcuccggauacccuaacauggaccucgacugccuacucccccaggaauggguacaacacuucuaccaagaagccgcccccgcccagucagacgucgcccuacuccgcuucgucaacccagacaccggacgcguccuuuucgaaugcaaacuccacaaguccggcuacgucaccgucgcccacaccggacaacacgaccucguaaucccacccaacggcuacuuccguuucgacucaugggucaaccaauucuauacccucgcacccaugggaaacggcaccggccgcagacgagcccucuaa

SEQ ID NO: 35903 - RNA, 1623 nt, Artificial Sequence
  derived and/or modified sequence opt11 from VP1__Norovirus__AFV08792
augaaaauggcaucauccgacgcuaacccauccgacggauccgccgccaaccuaguaccagaaguaaacaacgaagucauggcucuagaacccgucgucggcgcagccaucgcugcacccgucgcaggccaacaaaacgucaucgaccccuggauacgaaacaacuucguccaagccccgggcggagaguucacagugucaccccgcaacgcacccggcgaaauccucugguccgccccucucggcccagaccuaaacccuuaccuaucccaccucgcccgaauguacaacggauacgccggagguuucgaaguccaaguaauccucgcuggaaacgcauucaccgccggcaaagucauauucgcagccgucccucccaacuuccccaccgaaggccuaucccccucccaaguaaccauguucccccauauagucguugacguacgccagcuagaacccguccucauuccacuccccgacguccgcaacaacuucuaccacuauaaccaguccaacgacuccaccaucaaacuaaucgcgaugcucuacacccccuugcgugcaaacaacgccggcgaugacguauucacaguaucaugccgcguccucaccagacccagccccgauuucgacuucauauuccuaguacccccaacggucgaaucacgaacuaaacccuucucuguccccguccuaaccgucgaagaaaugaccaacucccgauucccaauaccacuagaaaaacuauucaccgggcccuccagcgccuucgucgugcaaccccaaaacggccgcugcaccacagacggcguacuccucggcaccacucaguuaagccccgucaauaucugcaccuuccgcggugacgucacccacaucacuggaucccgcaacuacacuaugaaccuagccucacagaacuggaacaacuacgaccccaccgaugaaaucccagcaccacucgguacccccgauuucguuggcaaaauccaaggcaugcuaacccaaaccacccgcaccgacggauccacucgcggacacaaggccacagucuacaccggcuccgccgacuucgcccccaaacuaggccgcguccaauucgagaccgacaccgaccacgacuucgaagcaaaccaaaacacaaaauucacucccgucggcgucauacaagauggcuccacaacccaccgcaacgaaccacaacaauggguacuccccucauacuccggccgaaacacucacaacguccaucucgccccugccgucgcacccaccuuccccggagagcaacuacucuucuuucgauccacaaugcccggaugcuccggcuaccccaacauggaccuggauugccuauuaccacaagaauggguacaauacuucuaccaagaagccgccccagcccaaucagacguagcccuacuccgcuucgucaacccagauaccggacgcguccuuuucgaaugcaaacuccacaaaagcggauacgucaccguagcccacaccggacaacacgaccucguuauacccccaaacggcuacuuccgcuucgacagcugggucaaccaauucuacacccucgccccaaugggcaacggcacuggccgucgacgggucgucuaa

SEQ ID NO: 35904 - RNA, 1623 nt, Artificial Sequence
  derived and/or modified sequence opt11 from VP1__Norovirus__AFV08795
augaaaauggcauccagcgacgccaaccccuccgacggauccgccgccaaccucgugcccgaaguuaacaacgaagucauggcccucgaacccgucgucggugccgccaucgccgcccccgucgccggccaacagaacgucaucgaccccuggauacgcaacaacuuuguccaagcacccggcggagaguucacaguuagcccccgcaacgcccccggagaaauccucugguccgccccacuuggcccagaccuaaaccccuacuuaucccaccuagcccgcauguacaacggcuacgccggcggcuucgaaguacaagucauccucgccggaaacgcauucaccgccgguaaagucaucuucgccgccguaccucccaacuuccccacagaaggacucuccccuucacaaguuacaauguucccucacaucgucguagacguacgccaacucgaacccguccuaauaccccucccugacguccgcaacaacuucuaccacuacaaccagucgaaugaccccacaauaaaacuuaucgcaaugcucuacacaccccuacgcgccaacaaugccggagacgacgucuucaccgucuccugccgaguacucacacgcccuucacccgacuucgacuuuaucuuccuagucccucccacugucgaaucccgaaccaaaccuuucuccguacccguccucaccgucgaagaaaugacaaacucaagauuccccauaccccucgaaaaacucuucaccggacccagcuccgccuuuguuguccaaccccagaacgguagaugcaccaccgauggcguccuccuaggcacaacccaacuauccccggucaacaucugcaccuuccgcggagacguaacccacaucaccggaucaagaaacuacaccaugaaccuagcuagccaaaacuggaacgacuacgaccccacagaagaaauacccgcaccccuaggcaccccugacuucgucggcaaaauccaaggaguccucacccaaaccaccagaaccgauggaucgaccagaggccacaaagccaccguauacacuggcuccgccgacuuugcacccaaacuaggccgcguacaauuugaaacagacacagaucgagacuucgaagcaaaccaaaacaccaaauucacccccgucggaguaauccaagacggaggcacuacccaccguaacgaaccacaacaauggguucuacccagcuacuccggcaggaacacccacaacguccaccucgcccccgccgucgccccaacuuuccccggcgaacaacuucucuucuuccgaucuaccaugcccggcugcuccggcuacccaaacauggaucucgacugccuucuaccacaagaauggguccaauacuuuuaccaggaagccgcccccgcacaauccgacgucgccuuacuacgauucgucaaccccgacacaggacgaguccuauucgagugcaaacuccacaaauccggcuaugucaccguagcccacaccggccaacacgaccuagucaucccgcccaacggcuacuuuagauucgacucuuggguaaaucaauucuacacccuagcccccauggguaacggaaccggccggcgacgagccgucuaa

SEQ ID NO: 35905 - RNA, 1623 nt, Artificial Sequence
  derived and/or modified sequence opt11 from VP1__Norovirus__AFX95940
augaaaauggcaucaucugacgcaaaccccagcgacggcucugccgccaaccucguaccugaagucaacaacgaggucauggcucucgaaccugucguuggcgcggcaaucgccgcaccagucgcaggccaacaaaacgucaucgaccccuggauaagaaacaacuucguccaagcccccggcggagaguucaccguuucaccccgaaacgccccuggcgaaauccucugguccgcuccccuaggccccgaccuaaaccccuaccucucccacuuagcccguauguacaacggcuacgccggcggcuucgaaguccaaguaauccucgccggaaacgccuucacugccggaaaagucaucuuugccgccguaccacccaacuuccccaccgaaggccucucuccuucccaaguuacuauguucccacacaucgucgucgacguccgccaacucgaacccguccuaauuccucuccccgacguacgaaacaacuuuuaccacuacaaccaaucgaacgacccuaccauaaaacuaauagcaaugcucuacacaccccuccgcgccaauaacgccggagacgacguauucacagucuccugccgaguucucacccgacccucaccagacuucgacuucaucuuccuaguacccccaaccgucgaaucccguaccaaacccuucuccgucccaguccuaaccgucgaagaaaugaccaacagccgauucccuauuccccucgaaaaacuuuucaccggccccucauccgccuuugucguccaaccccaaaauggccgcugcacaaccgacggcguccuacucggaaccacacagcuaucacccgucaacauaugcaccuuccgcggcgacgucacacacauaaccggcucccgcaauuacaccaugaaccucgccucccaaaacugguccaacuacgaccccaccgaagaaaucccagccccucucggaacccccgacuucgucggcaaaauucaaggcgugcucacacaaaccacgcgcaccgacggauccacacgcggccacaaggccacagucuacacaggcuccgccgacuucgccccuaaacuaggccgaguccaguucgaaaccgacacagaccgcgacuucgaagccaaccaaaacaccaaauucacgccuguaggcgucauucaagacggaucaaccacccaccgcaacgaaccucaacaauggguacuuccgucuuacuccggaagaaauacacccaacguucaccucgcuccagccgucgcacccaccuuccccggagaacaacuccucuucuuccgauccaccaugcccggcugcucaggcuaccccaacauggaucucgacugccuacuaccacaggaauggguccaauacuuuuaccaagaagccgcacccgcccaaucugacgucgcacuucuccgcuucguaaaccccgacaccggcagaguacuauucgaaugcaaacuccacaaaucaggcuacgucaccgucgcccacaccggccaacacgaccucguuaucccuccuaacggcuacuuccgauucgacuccuggguaaaccaauucuacacacucgcccccaugggaaacggcacaggacgcagacgcgcccucuaa

SEQ ID NO: 35906 - RNA, 1620 nt, Artificial Sequence
  derived and/or modified sequence opt11 from VP1__Norovirus__AFZ84663
augaagauggccucaaacgacgccucccccuccgauggcuccacagcuaaccucguccccgaagucaacaacgaagucauggcccucgaaccagucgucggcgccgccaucgccgcaccugucgcaggccagcaaaaugucaucgaccccuggauaagaaauaacuucguucaagcacccggaggcgaauuuacagucagcccccgcaacgcaccuggcgaaauccucuggucagcaccccucggccccgaccuaaaccccuaucuaucccaucuagcacgcauguacaauggcuacgcaggcggcuucgaaguacaagucauacuugccggaaacgcauucacagcaggcaaaaucaucuuugccgcaguacccccaaauuuccccaccgaaggccucucacccucccaagucaccauguucccucacaucauagucgacgucagacaacucgaacccguccucauaccccuacccgacguccgcaacaacuucuaucacuacaaccaaucuaaugacucaaccauuaaacugaucgccaugcucuacaccccgcuccgagccaacaaugcaggcgacgacgucuucacugucuccugccgcguacucacaagaccaucacccgacuucgacuucauauuccuaguacccccuaccgucgaaucccguacuaaacccuucacaguacccauccucaccgucgaagaaauguccaauucacgcuuucccaucccacuugaaaaacucuacaccggccccucaagcgccuucgucguccaaccacaaaauggccgaugcaccacagacggaguucuccuuggcaccacccaacuuuccgccgucaacauuugcaccuuccgcggcgacgucacccacaucgccggaucgcacgacuauacaaugaaccuggcaagccaaaacuggaacaauuaugacccaaccgaagaaauaccagccccacucggcacaccugacuucgucggaaagauccaaggcaugcucacccaaacaaccagagaggacggcucaacacgagcucacaaagccacagucucaaccggauccguccacuucacccccaaacucggcuccguccaauacaccaccgacaccaacaacgacuuccaaaccggccaaaacaccaaauucacccccguuggcguaauccaagacggaaacaaccaccaaaacgaaccccaacaauggguacugccaaacuacucuggccgaacaggccauaacguccaccucgccccagccgucgcacccacauuccccggagaacaacuccucuucuuccgcuccaccaugccaggcugcagcggcuaccccaacaugaaccucgacugccuccucccgcaagaguggguccaacacuucuaccaagaagccgcacccgcccaaucagacgucgcacuauuacgcuucguaaacccagauaccggacgcguccucuucgaauguaaacuccauaaguccggauacgucacagucgcucacacaggcccccacgaccucgucaucccacccaacggauacuucagauucgacagcugggucaaccaauucuacacccuagcacccaugggcaacggcgccggacgccgccgcguccucuaa

SEQ ID NO: 35907 - RNA, 1623 nt, Artificial Sequence
  derived and/or modified sequence opt11 from VP1__Norovirus__AGG37871
augaaaauggccuccuccgacgccaaccccuccgauggcuccgccgccaaccucgucccagaagucaacaacgaagugauggcccuagaaccagucgucggagccgccauagcugcccccguagcaggccaacaaaacgucauagaccccuggauccgaaacaacuucguccaagcacccggcggggaguucaccgucagcccccgaaacgcaccaggcgaaauucucugguccgcaccccucggcccugaucucaaccccuaccuuucccaucuugcccgcauguacaacggauaugccggcggguucgaaguccaaguaauacuagccggcaaugccuucaccgccggaaagguaauauucgcagccgucccacccaacuuucccacagaaggccuaucacccucccaaguaacaauguucccccacaucgucguagacguacgucaacucgaacccguacucauaccccuccccgacgucagaaacaauuucuaccacuauaaccaaucaaacgacccaaccauuaaacuaauagccaugcucuacacaccccuacgagccaacaaugccggcgacgacgucuucaccguuuccugccgcguccucacacgccccuccccagacuuugacuucauauuccucguaccucccacagucgaaucacgaaccaaacccuucuccgucccaguucugaccgucgaagaaaugacuaacucaagauuccccaucccccuugaaaaacuuuucacgggcccauccagcgccuucgucguucagccacaaaauggccgcugcaccacugacggcgucuugcuaggcaccacccaacucucaccagucaacauaugcaccuuccgcggggacgucacccacauuacuggcagccguaacuacaccaugaaccucgccagccagaacuggaacaacuaugaucccaccgaagaaauccccgccccauuagggacaccagacuuugugggcaaaauccaaggcguccuaacccaaaccacccguaccgacggcagcacacgcggccacaaagccaccgucuacaccggauccgccgacuucgcacccaaacuaggacgaguucaauucgaaaccgacaccgaccacgacuucgaggccaaccaaaauaccaaauuuacccccguaggagucauccaagacggcggcaccacucaccgcaacgaaccccaacaauggguccucccaucauacucaggccgaaauacucauaacguacaccucgcacccgcugucgccccaaccuuccccggggaacaacuccuguucuuccgaucaaccaugcccgguugcuccggauaccccaacauggaucucgacugccuacucccacaggaauggguccaauacuucuaccaagaggcagcccccgcccaauccgagguagcccuccuacgcuucgucaauccagacaccggccgcguauuauucgaauguaaacuccacaaaucaggauacgucacaguagcucacacaggccaauaugaccucgucaucccacccaacggcuacuuccgcuucgacucaugggucaaccaauucuacacauuagcccccaugggcaacggcaccggcagacgccgagcagucuaa

SEQ ID NO: 35908 - RNA, 1623 nt, Artificial Sequence
  derived and/or modified sequence opt11 from VP1__Norovirus__AGI96383
augaaaauggccucuuccgacgccaaccccagcgacggcucuacagccaaccucguacccgaaguaaauaacgaagucauggcacucgaacccgucgucggcgccgccaucgccgccccaguagcuggccaacaaaacgucaucgaucccuggauccgcaacaacuucguccaagccccaggcggcgaguucacagucuccccuagaaacgcccccggggaaauccucugguccgcacccuuaggucccgaccucaaccccuaccucucccaccuagcccgaauguacaacggcuacgcuggcggauucgagguacaagucaucuuagcaggaaacgccuucacagcugguaaaaucaucuucgccgcaguaccucccaacuuccccaccgaaggccucucccccucacaagucaccauguucccccacauaaucgucgacguccgucaacuugaacccguccucaucccauuacccgacguccgcaacaacuuuuaccacuacaaccaaucuaacgacuccacaaucaaacuuaucgccaugcuuuacaccccacuaagggccaacaacgccggagacgauguauucacaguuuccugccgaguucuaacccgccccucacccgacuucgacuucaucuuccuagucccacccaccgucgaaucuagaacaaaaccauuuuccguccccauccucacugucgaagaaaugaccaacucccgauuccccaucccacuagaaaaacucuucaccggccccuccagcgcauucguaguacaaccucaaaacggacgcugcaccaccgacggaguccuccucggcaccacacaacuaucaccaguaaacaucugcaccuuccgcggagacgucacacacaucccaggcucccacaauuacacaaugaaccucgccucccaaaacuggaacucuuacgacccuacugaagaaauaccagcaccccucggcacccccgacuucgucgguaaaauacaaggcguucuuacccaaaccaccuccaccaacggcucgacccgaggucacaaagccaccguuuauacugggucagcagauuucuccccuaaacucggacgcguacaauucucuaccgacaccaacaacgacuucgaaaccaaccaaaacaccaaauuuacccccgucggagucauccaagacggcucaacaaccccacgcaaugaaccccagcaauggguccucccgagcuauucuggccgcaacauccacaacguccaccucgccccggcagucgcucccaccuucccaggcgaacaacuacuuuucuuccgcuccaccaugccaggaugcucaggcuacccaaauauggaccucgacugccuccuaccacaagaauggguccaauacuucuaccaagaagccgccccagcacaauccgacgucgcccugcuccgcuucgucaaccccgauaccggccgcguccuuuucgaaugcaaacuacacaaaagcggauaugucaccgucgcccacaccggccaacacgaccuagucauaccacccaacggcuacuuccgcuucgacagcuggguaaaccaguucuacacccucgccccuaugggcaacggaaccggccggagacgcgccuuauga

SEQ ID NO: 35909 - RNA, 1623 nt, Artificial Sequence
  derived and/or modified sequence opt11 from VP1__Norovirus__AGI99552
augaaaauggcuucaucugacgccaacccauccgacggauccgcugcaaaccucguacccaaagucaacaacgaagucauggcccucgaacccgucguaggggccgcaaucgcagcccccgucgcuggccaacaaaaugucaucgacccauggaucaaaaacaacuucguccaagcacccggcggcgaguucacagucucccccaaaaacgcccccggcgaaauccucuggucagcuccccuuggacccgacuuaaaccccuaucucucacaccucgccaaaauguacaacggauacgccgguggcuucgaaguacaaguaauccuagccggcaacgccuucacagccggcaaagucauauucgcagccgucccacccaacuuucccaccgaaggccuauccccaucacaaguaacaauguucccccacauagucgucgacgucagacaacucgaaccuguccucaucccacucccagacgucagaaacaacuucuaccacuauaaccaaucaaacgaccccaccaucaaacucaucgccaugcucuacacaccccuccgcgcaaacaacgccggugacgacgucuucaccguuagcugucgaguucuuacccgucccucaccagacuucgacuucaucuuccuaguuccacccacagucgaaucccgcaccaaaccauucuccgucccaguacucacaguagaagaaaugacaaacucacgcuucccgaucccccuagaaaaacucuucacaggccccuccuccgcauucguaguacaaccccaaaacggcagaugcaccacagacggcguccuccucggcaccacccaacucuccccaguaaacauaugcaccuucagaggggacgucacacacacuaucggcucccgcaacuacacaaugaaccuagccucccaaaacuggaacaacuacgaucccaccgaagaaaucccagcaccccucggaacccccgacuucgucggcaaaauacaaggaguccuaacccaaacaacacgcaccgacggcagcacaagaggacacaaggccacagucuacaccggcuccgcugacuuugccccaaaacucggccgcguccaauucgaaacagacaccgaccacgacuucgaagccaaucaaaacaccaaauuuacccccgucggcgucauccaagauggcuccaccacgcaucgcaacgaaccccaacaauggguacuucccuccuauuccggccgaaacacacacaacguccaccucgcaccagccgucgcaccaaccuuccccggcgaacaacuacuuuucuuucgcucaaccaugcccggcugcuccggcuaccccaacauggaccuagacugccuccuuccccaagaauggguccaauacuuuuaccaagaagccgcucccgcccaaucagacguugcacuacuccgcuucguaaaucccgauaccggccgcguccucuucgaaugcaaacuccacaaaucaggcuacguaaccgucgcccacaccggccaacacgaccucgucaucccucccaacggcuacuuccgcuuugacuccuggguaaaucaauucuacacacuagcccccaugggcaauggcacaggccgccgaagaccccucuaa

SEQ ID NO: 35910 - RNA, 1623 nt, Artificial Sequence
  derived and/or modified sequence opt11 from VP1__Norovirus__AGI99553
augaaaauggcauccuccgacgccaacccacccgacgguuccgccgccaacuuagucccaaaaguuaacaacgaagucauggcccuagaaccagucgucggcgccgccaucgccgccccagucgccggccagcaaaacgucaucgacccauggaucaaaaacaacuucguccaagcucccggaggagaguucacaguaucccccaaaaacgcccccggcgaaauacucuggucugccccacuaggcccagaccucaaccccuaccuaucacaccuagcacguauguauaacggauacgccgggggcuuugaaguccaagucauacuugccggcaacgccuucacagcaggcaaagugauauucgcagccguacccccgaacuuccccacagaaggccucagcccaucacaggucaccauguuuccccacauagucgucgacguccgccaacucgaaccuguccucaucccccuccccgauguccgaaacaacuucuaccacuacaaccaauccaacgacccaaccaucaaacucaucgccaugcuauacacaccccuccgugcuaacaacgccggcgacgacgucuucaccgucucaugccgcguacuuacccgccccuccccggacuucgacuucaucuuccucguaccaccaaccgucgaaagccguaccaaacccuucagcgucccaguacugaccgucgaagaaaugaccaacucgcgauuccccaucccccucgaaaaacucuucaccggcccuagcagcgcauucgucguucagccccaaaacggccgcugcaccaccgacggaguacuccucggaaccacucaacucucccccguaaacauaugcaccuucagaggcgacgucacacacauaaccggcucacgcaauuacaccaugaaccucgcuucccaaaacuggaauaacuacgaccccaccgaagaaauccccgcaccccucggaaccccagacuucgucggcaaaauccaaggcguccuuacccaaacaacccgcaccgacggcucaaccagaggccacaaagccaccgucuacaccggauccgccgacuucgcacccaaacuuggccgcguccaguucgaaacagacacagaccacgauuucgaagccaaccaaaacacaaaauucacccccguaggcgucauccaagacggcuccaccacccaccgaaacgaaccacaacaauggguucucccaagcuacucaggccgagacacccacaacguacaccuagccccagcuguagcccccacauucccaggcgaacaacuccucuucuuccguucgaccaugccagguugcuccggcuaccccaacauggaccuagauugccuacuaccacaagaguggguucaauacuucuaccaagaagcagccccugcccaaucugacguagcacuccuacgcuucguaaaccccgacacaggccguguacucuucgagugcaaacuccacaaaucuggauacgucaccguagcccacaccggacaacacgaccucguaauuccaccaaacggauacuuccguuucgacuccugggucaaccaauucuacacacucgcccccaugggcaacggaacaggaagaagacgcccccuuuaa

SEQ ID NO: 35911 - RNA, 1623 nt, Artificial Sequence
  derived and/or modified sequence opt11 from VP1__Norovirus__AGI99554
augaaaauggcuucgucagacgccaaccccuccgacggauccgccgcgaaccucguaccuaaaguaaacaacgaaguuauggcccucgaaccuguagucggagccgccaucgccgcaccggucgccggccaacaaaacgucaucgacccuuggaucaagaauaacuucguccaagcccccggaggcgaguucaccgucuccccuaaaaacgcccccggagaaauacucugguccgccccacucggccccgaccuuaaucccuaccucucccaccucgcccgaauguacaacgguuacgcuggcggcuucgaaguccaagucauccucgccggcaacgcuuuuacugccggaaaagucauauucgccgccguaccacccaauuuccccaccgagggccucucacccucccagguaaccauguucccccacaucgucguagacguaagacaacucgaaccaguccucauaccccucccagacguccgcaacaacuucuaccacuacaaccaaucaaacgaucccaccaucaaacucauagccaugcucuacaccccacuccgcgcuaacaacgccggagacgacguauucaccgucucaugccgaguucuuacccgcccaucccccgacuucgacuuuaucuuucuugucccacccaccguagaaucccgcaccaaacccuucuccguuccaguccucaccgucgaagagaugaccaacucacgguucccaauaccccucgaaaaacucuucacaggcccaagcuccgccuucguaguacaaccccaaaacggccgaugcaccaccgacggcguccuucuaggcaccacccaacucuccccugucaauaucugcaccuuccgaggugacguaacccacaucaccggaucccgcaacuacaccaugaaccucgccucccaaaacuggucaaacuacgacccaacugaagaaauaccagcuccccucggcacuccagacuuuguaggaaaaauccaaggcguacucacucaaacaaccagaaccgacggcuccaccaggggccacaaagcuacaguauacaccggcucagcagacuucgccccaaaacucggacgcguccaauucgaaaccgacaccgaccgagacuuugaagcaaaccaaaacacaaaauucacacccgucggggucauacaagacggcuccaccacccacagaaacgaaccucaacaauggguccucccuucauacucaggacgcaacacccccaacguccaccucgcaccagccguagcccccacauuccccggcgaacaacuccuauucuuccgauccacaaugccaggcugcuccggcuaccccaacauggaccucgacugucuccucccacaagaauggguccaauacuucuaccaagaagcagcacccgcacaaucugacgucgcccuccuccgauucgucaauccagacacuggccgcguacucuucgaaugcaaacuccacaaaagcggauacguaaccguagcccacaccggccaacacgaccuagucaucccacccaacggcuacuucagguucgacucuugggucaaccaauucuacacacucgcucccaugggcaacggcacgggucgccgccgcccccuuuga

SEQ ID NO: 35912 - RNA, 1623 nt, Artificial Sequence
  derived and/or modified sequence opt11 from VP1__Norovirus__AGI99555
augaaaauggccaguuccgaugcaaacccauccgacggcuccgccgccaaccuaguaccaaaagucaacaaugaagucauggcucuagaacccgucgucggcgccgcaaucgcggcacccgucgcaggccaacaaaacguaaucgaccccuggaucaaaaauaacuucguccaagccccaggcggcgaguucacagucagccccaaaaacgcuccuggcgaaauccuaugguccgcuccccucggaccagaucuaaaccccuaccuuucccaccuagcccgcauguacaacggauacgcgggcggcuucgaaguacaggucauccucgcagggaacgcauucacagcuggcaaaguaaucuucgcagccgucccaccuaacuuccccaccgaaggucuuucaccaucacaagucacaauguucccccacaucgucguugacguccgccaacucgaaccuguucuaauaccccucccugacguacgcaacaacuucuaccacuacaaccaauccaaugacccgaccauaaaacucaucgcaaugcuauacacaccccuacgagccaacaaugcaggcgacgaugucuuuaccgucagcugucgcguccuuaccagaccuuccccugacuucgacuucauauuccuggucccacccaccguugaaucucgcaccaaacccuucuccgucccaguauuaaccgucgaagaaaugaccaacucacgauuccccaucccccuagaaaaacuauucacuggucccuccuccgccuucgucguccaaccacaaaacggccguugcacaaccgacggcguccuccucggcacuacucaacuaucaccuguaaacauaugcaccuucagaggagacguaacacacauaaccggaucacgcaacuacaccaugaaccuagccucccaaaacuggaacaacuacgaccccaccgaagaaauaccggccccacucgggacccccgauuucgucggcaaaauacaaggaguacucacgcaaacaacccgaaccgacggauccacccguggucacaaagccaccguuuacaccggaagcgccgacuuugcccccaaacucggucgcguacaauucgaaaccgacaccgaccacgacuucgaagccaaccaaaacaccaaauucacccccgucggcguaauccaggacggcggcacaacacaccgcaacgaaccccaacaauggguacuaccgucauacuccggcagaaacacccacaacguacaccuagcccccgccguggccccaacauuccccggcgaacaacuucuauucuuccgcucaacaaugcccggaugcucaggauaccccaacauggaccuagacugccuacucccccaagaauggguucaauacuuuuaccaagaagccgcccccgcccaauccgacgucgcacuacuccgcuucgucaacccagacaccggacgcguccucuucgaaugcaaacuacacaaauccggcuacgucacagucgcucacaccggccaacaugaccucguaaucccacccaacggcuacuuucgcuucgacucaugggucaaccaauucuacacccuagcccccaugggcaacggaacaggccgacgccgcccccucuaa

SEQ ID NO: 35913 - RNA, 1623 nt, Artificial Sequence
  derived and/or modified sequence opt11 from VP1__Norovirus__AGK25882
augaaaauggcuuccaacgacgccagcccuagcgacggcuccgccgccaaucuggucccugaagucaacaaugaaguaauggcacuagaaccgguuguaggcgcagccaucgccgccccaguagccggccaacaaaacguuaucgauccauggauacgcaacaacuucguccaagcccccgguggagaguucaccguaucaccccgaaaugccccaggcgaaauucucugguccgcaccccucggacccgaccucaaccccuaucuaucccaccucgcccgcauguacaacggcuacgcaggcggcuucgaaguucaaguaauacuugcuggcaacgcauucaccgcuggcaaaaucauuuucgccgccgucccacccaacuuccccacagaaggccucucuccaucccaaguaaccauguucccccauauuaucgucgacgugcgacgccucgaaccaguccucauacccuuaccugacguccgcaacaacuucuaccacuauaaccaaagcaacgacuccaccaucaaauuaaucgccaugcucuacacaccccuacgcgcuaacaacgcaggcgaagacguauucaccgucuccugccgcguacuuacccgcccaucccccgacuucgacuucaucuuccuugucccacccacagucgaaucccgcacaaaacccuucaccguccccauccucacaguagaagaaaugaccuacucccgauuccccaucccuuuagaaaaacucuucaccggacccucaucggccuuugucguacaaccccagaacggucgaugcacaaccgauggcguccuucucggcaccacccaauuauccccagucaacaucugcacauuccgcggcgacgucacccacaucgcaggcucccgcaacuacaccaugaaccucgccagccucaacuggaacaacuacgaccccaccgaagaaauaccagcuccccucggcacacccgacuucguaggcaaaauccaaggcaugcuuacccaaacaacaaaaggcgacggcucuacgagaggacacaaagccaccguauacaccgggucagccccauuuaccccaaaacuaggauccguccaauucgaaaccgacaccgaaaacgauuucgaaacccaucaaaacauaaaauucacacccgucggcgucauacaagacggaggaaccacucaccgcaaugaaccacaacaauggguucuacccuccuacucuggccgcaacguccccaacguccaccucgccccggccgucgccccaaccuuucccggcgaacaacuacucuucuuccgcuccaccaugcccggcugcucaggauaccccaacauggaccucgacugucuccucccccaagaauggguccaacacuucuaccaagaagcugcacccgcacaaucagacguagcccuccuacgauucguuaaccccgacacaggcagaguccucuucgaaugcaaacuccacaaaucaggcuacgucaccguagcucacacuggccaacacgaucucaucaucccacccaacggcuacuuccgcuucgacuccugggucaaucaauuuuacacccucgccccuaugggaaacggaaccggcagacgacgcgcccucuga

SEQ ID NO: 35914 - RNA, 1623 nt, Artificial Sequence
  derived and/or modified sequence opt11 from VP1__Norovirus__AGK25884
augaaaauggccuccaacgacgcaucccccuccgacggaucugccgcaaaccuagucccugaagucaauaacgaagucauggcccucgaacccgucgucggagccgccauugcagcccccguagccggccaacaaaacgucaucgaccccuggauccgcaacaacuucguccaagcccccggaggcgaguucaccguauccccacgcaacgccccaggagaaauccucuggucugccccacuaggcccugaccuuaaucccuaccuaucacaccucgcacgcauguacaacggauacgccggaggcuucgaaguacaagugauacuagccggaaacgcauucaccgcaggcaaaaucaucuuugccgccguaccuccaaacuucccaacagaaggacucucccccagccaggucacaauguucccccacaucaucguagacguccgacaacuagaacccguccuaaucccauuacccgauguccgcaacaacuucuaucauuacaaccaguccaacgacuccaccaucaaauuaaucgccauguuauauacaccccuacgagccaacaacgcaggcgaagacgucuucaccgucuccugccgcguccugacccgccccagccccgacuucgacuucauuuuccucguaccucccaccguagaaucucguaccaaacccuucaccguccccauccuaaccgucgaagaaaugaccaacucccgcuuucccaucccucucgaaaaacucuucaccggacccucuucagccuucgucguccaaccccaaaacggccgcugcaccaccgacggaguacuacuaggcaccacccaacucagcccagucaacaucugcaccuuccgaggggacgucacacacaucgccggcucccgcaacuacaccaugaaccucgccucccuaaacuggaauaacuacgauccaaccgaagaaauucccgcaccacucgguacaccagacuuugucggaaaaauacaaggaaugcucacacaaaccgccaaaggcgacggcuccacacgcggacacaaagcaacuguauacacaggcucagccccauucacccccaaacuaggaagcguccaauucgaaacagacaccgaaaacgacuucgaaacccaccaaaacacaaaauucacacccgucggcgucauccaagacggcggaacaacccacagaaacgaaccccaacaauggguccuacccucauauuccggccggaacguacccaacguccaccuagccccagcaguagcacccacauucccuggcgaacaacuccuauucuuuagaucaaccaugccaggcugcucaggcugccccgacauggaccucgacugccuccuuccccaagaauggguccaacauuucuaccaggaggccgccccggcccaaucugacgucgcccuccuacguuucgucaauccggacacaggccgcguccuauucgaaugcaagcuccacaagucaggauacguaaccguagcccacacaggccaacaugaccucaucauacccccuaacggauacuuccgcuucgacagcugggucaaccaauucuacacacucgccccuaugggcaacggaaccggccgacgacgggcacucuaa

SEQ ID NO: 35915 - RNA, 1623 nt, Artificial Sequence
  derived and/or modified sequence opt11 from VP1__Norovirus__AGK25887
augaaaauggccucuucagacgccaacccauccgacggcucagccgccaaccucguaccagaaguaaacaacgaagucauggcacuagaacccguagucggagccgccaucgccgcacccguggccggccaacaaaacguaaucgaccccuggauccgcaauaacuucguacaagcacccggcggagaauuuaccgucucaccccgcaacgcccccggagaaauccuaugguccgccccauuaggacccgaucucaacccauaucucucccacuuagcccgaauguacaacggcuacgccggcggcuucgaaguacaagucauccuugccggcaaugccuucaccgcuggcaaagucaucuucgcagcaguaccacccaacuuccccacagaaggacuaucccccagccaagugaccauguucccccacaucgucguagacguccggcagcucgaaccuguccuaaucccccuaccagacguacgcaacaacuucuaccauuacaaccaguccaacgacccaaccaucaaacucaucgccaugcucuauacaccacuccgcgcaaacaacgccggcgacgacgucuuuaccgucuccugcagaguucucacccgccccagcccagacuuugacuucauauuccuagucccacccaccgucgaaucaagaaccaaacccuucuccgucccaguucuaaccgucgaagaaaugaccaacucccgcuuccccaucccacuagaaaaacuauucaccggaccaucuuccgccuuuguaguccaaccccaaaacggucgaugcacaacagacggcguacuccucggcacaacacaacucucccccgucaacaucugcaccuuccgcggagacaucacccacauuacgggcucccgcaacuacaccaugaaccuugcaucacaaaauuggaauaacuacgaccccacagaagaaauccccgccccacucggcacacccgacuucgucggcaaaauccaaggcguacucacccaaaccacccggaccgacggcuccaccagaggacacaaagccaccguccacaccgguucagcagacuucgcccccaaacuugggcgcguccaauucgaaaccgauaccgaccacgacuucgaagcaaaccaaaacaccaaauucaccccaguaggcguaauccaagacggcgguaccacccaccgcaacgaaccacaacaauggguccuccccuccuacagcggccguaacacgcacaacguccaucucgcacccgcgguagcaccuaccuuuccaggcgaacagcuccuguucuuccgaucgacuaugcccggcugcucaggcuaccccaacauggaccucgacugccuacuaccccaagaauggguccaauauuucuaccaagaagccgcccccgcacaaucugacgucgcccuccuacgauucgucaaccccgacacaggcagaguccucuucgaaugcaaacuccacaaaagcggauacgucaccgucgcacacacaggacaacacgaccuugucauucccccaaacggcuacuuccgcuucgauuccugggucaaccaauucuacacccuagcaccaaugggcaacgggacgggccgucgucgagccguuuaa

SEQ ID NO: 35916 - RNA, 1623 nt, Artificial Sequence
  derived and/or modified sequence opt11 from VP1__Norovirus__AGK25890
augaaaauggccucauccgacgcuaaccccucagacggauccgccgcgaaucugguccccgaagucaacaacgaagucaucgcacucgaaccaguugucggagccgcaaucgcugcccccguagccggccagcaaaacgucaucgaccccuggauacguaacaacuucguacaagcucccggcggcgaguucacagucuccccacgcaacgccccaggcgaaauacucuggucagcuccccucggccccgaccuaaacccauaccuaucacaccucgcacgcauguacaacggcuacgccggcggcuuugaaguccaaguaauacuagcgggcaacgccuucaccgcaggcaaagucaucuucgccgccguaccaccaaauuuccccacagaaggucucuccccuucccaagucacuauguucccacacauuguuguagacguacgccaacuagaaccuguccuaaucccccuccccgacguccgcaacaacuucuaucacuacaaccaaagcaacgacccaaccaucaaacuaauagcaaugcucuacacuccccuccgcgccaacaacgcaggagacgacgucuuuaccguauccugucgcguacuuacacgccccagcccagauuucgauuucauuuuccucguacccccuaccgucgaaucccgaacuaaaccguucuccguccccguucucaccgucgaagaaaugaccaacucacgauucccaaucccccuagaaaaacucuucacaggcccauccucagcauucgucguccagccucaaaacggccgcugcaccaccgacggcguacuacucggcaccacccaacucagcccaguaaacaucuguacuuuccgaggagacaucgcccacauaaccggaucacgcaacuacaccaugaaccucgcuagccaaaacuggaacaacuacgacccuacggaagaaauucccgccccucucggaacccccgacuucguuggcaaaauccaaggcguacucacccagaccacaagaaccgacggauccacccgcggacacaaagccaccguauacaccggcagcgccgacuucgccccaaaauuaggaagaguccaauucgaaaccgacacagaccacgacuucgaagccaaccaaaacacaaaauucacccccgucggcgucauccaagacggcggcacaacucaucgcaacgaaccgcaacaauggguccuccccuccuacuccggacgaaacacccauaacguucaccucgcacccgccguagcccccacauucccaggagaacaauuacucuucuuccgcuccaccaugcccggcugcuccggcuaccccaacauggaccuugacugccuccucccacaggaauggguccaauacuucuaccaagaagcagcccccgcacaaucagacgucgcacuccuccgcuucgucaacccagacaccggccgcguccucuucgaaugcaaccuccacaaauccggcuacguaacaguggcacacacuggacaacacgaccucguaauaccgcccaacgguuacuuccgcuucgauuccugggucaaccaauucuacacccucgcacccaugggaaacggcaccggccgccgacgcgccguauga

SEQ ID NO: 35917 - RNA, 1623 nt, Artificial Sequence
  derived and/or modified sequence opt11 from VP1__Norovirus__AGK25892
augaaaauggcaucaucagacgccaaccccagcgacggcuccacugccaaccucguccccgaaguaaacaacgaaguaauggcacuagaacccgucguuggcgccgccaucgccgccccagucgccggccaacaaaauguaaucgacccauggauccgaaacaacuucguccaagcacccggcggcgaguucaccguauccccucggaacgcuccgggagaaauacuauggucugcaccccuuggccccgaccuuaaccccuaccucucacaccuagccagaauguacaacgguuacgccggcggguucgaaguccaaguaauacuagcaggaaaugccuucaccgcaggcaaaaucaucuucgccgcagucccacccaacuuccccacugaaggccuaucccccucccaaguaaccauguucccacacaucauuguagacguccgccaacuagaaccgguacucauaccacuacccgacguccgaaacaauuucuaccacuauaaccaauccaacgauucgacaaucaaacuaaucgcuaugcuguacacaccccuccgcgccaacaacgccggcgacgacgucuucaccguuagcugccgaguccucacccgcccuuccccagacuuugacuucaucuuccuggucccacccaccguugaaucccguaccaaacccuucuccguaccaguacugaccgucgaagaaaugaccaacucacgauuccccaucccacucgaaaaacuauucaccggccccuccagcgccuucgucguccagccccaaaacggacgcugcaccaccgacggcguacuccuuggcacuacccaacuaucccccgucaacaucugcaccuuucgcggcgacguaacacacauacccggcucucgcaacuacacaaugaaccucgcaucccaaaacuggaacucauacgaccccaccgaagaaauccccgcgccccucggcacccccgauuucguagguaaaauacaaggcguccucacccaaaccacccgaaccaauggcuccacccgcggccacaaagccacggucuauacaggauccgccgacuucucccccaaacucggccgcguacaauucgcaaccgauacagauaacgacuucgaaaccaaucaaaacacaaaauucaccccaguaggcgucauccaggacggcagcaccacaccacgaaacgaaccccaacaauggguccuccccucauacuccggccgcaacauccacaacguccaccucgcccccgccgucgccccaaccuuuccaggugaacagcuccuauucuuccgaucaaccaugcccgggugcucaggcuacccaaacauggaccucgacugucuccugccucaagaauggguucaauacuucuaccaagaagccgcccccgcacaaucagacgucgcccuacuacgauucguuaacccagacaccggccgcguccuauucgaaugcaaacuucacaaaucaggcuacgucacaguagcccacaccggccaacacgaccucgucaucccacccaacggauacuuccgcuucgacuccugggucaaccaauucuacacccuugcgcccaugggcaacggaacaggccgccgacgcgcacuauga

SEQ ID NO: 35918 - RNA, 1623 nt, Artificial Sequence
  derived and/or modified sequence opt11 from VP1__Norovirus__AGK25898
augaaaauggcauccaacgacgccaaccccuccgacggcuccgccgcuaaccucguaccagaagucaauaacgaaguaauggcccuugaaccaguggucggcgccgccauagcagccccaguagccggccaacaaaacguaauagaccccuggauccgaaacaacuucguucaagcccccggcggagaguucaccgucucaccccgcaacgcccccggcgaaauacuaugguccgccccacuaggccccgaccuaaaccccuaccuuucccaccucgcccgcauguacaacggauaugcaggaggguucgaaguacaaguaauccucgccggcaacgccuucacagccggcaaaaucauauucgcagcagucccacccaacuuucccacagaaggacucucccccucucagguaaccauguucccccauaucaucgucgaugucagacaacuagaacccguccuuaucccucuucccgacguccgcaacaacuucuaucacuacaaccaauccaacgacuccaccauuaaacucauagccaugcuauacacaccccugcgcgccaacaacgccggagaagacguauucaccgugucuugccgcguccucacccgcccaagccccgacuucgacuucaucuuccuaguacccccuaccguagaaucucgcacaaaaccauucacaguccccauccucacagucgaagaaaugaccaauucaagauuccccaucccacucgaaaaacuauucaccggcccauccagcgccuucguaguucaaccacaaaacggccgcugcaccacagacggcguacuacuagacaccacccaacuaucacccgucaacauuugcaccuuucgcggcgacgucacccacaucgccggaucccgcaacuacaccaugaaccuagccucccucaauuggaacaacuacgauccuaccgaagaaaucccagcuccucuaggcaccccagacuuugucggaaaaauccaaggcauguuaacccaaaccaccaaaggcgacggaucaacccgcggccacaaagcaacagucuacaccgguuccgcacccuucacccccaaacucggcuccguccaauucgaaacugacacugaaaacgauuucgaaacccaccaaaacacgaaauuuacccccgucggcgucauccaagauggaggcacaacccaccgcaacgagccacaacaauggguccuacccagcuacuccggacgaaacguaccaaacgcccaccuugcccccgccgucgcccccaccuucccaggagaacaacuauuauucuuccguuccaccaugcccgggugcuccgguuaccccaacauggaccuagacugccuccucccccaagaguggguccaacacuuuuaccaagaagccgcacccgcucaaucagacguugcccuucuacgcuucgucaaccccgacaccggccgcguccucuucgaaugcaaacuccacaaaucaggauacguaaccgccgcccacaccggucaacacgaccucguuaucccucccaacggcuacuuccgauucgacuccuggguaaaccaauucuacacccucgcccccaugggcaacggaacaggccgccgacgcgcacuauaa

SEQ ID NO: 35919 - RNA, 1623 nt, Artificial Sequence
  derived and/or modified sequence opt11 from VP1__Norovirus__AGK25900
augaaaauggcauccaacgacgccaaccccuccgacggcucugccgccaaccucguccccgaaguuaacaacgaaguuauggcgcuagaacccguaguaggcgcugcuauagcagcccccguagccggccaacaaaacguuaucgaccccuggauccgcaacaacuuuguacaagccccaggcggcgaauuuaccgucuccccucgaaacgcccccggcgaaauccuaugguccgcccccuuaggacccgaccucaacccauaccugucccaccuugccagaauguauaacggcuacgccggaggcuucgaaguacaagucauccucgcaggcaacgcauucaccgcuggcaaaaucauuuucgccgccguacccccaaacuucccaacagaaggccuaucucccucccaagucaccauguucccccacaucauagucgacgucagacaacucgaaccaguccuaaucccacuacccgacguuagaaacaauuucuaccacuacaaccaauccaacgacuccaccaucaaacuaaucgcaaugcucuauaccccacuacgcgcaaauaacgcaggcgaagaugucuucacagucucaugccgaguccucaccagacccucgccagauuucgacuuuaucuuccuaguacccccaaccgucgaaucacgcaccaaacccuucaccgucccaauccuuaccgucgaagaaaugacuaacucccgguuccccauaccccucgaaaaacuauucacaggcccauccuccgccuucgucguucagccccaaaacggacgcugcaccaccgacggcguacuccuaggaacuacccaacuaucccccguaaacaucuguaccuuucgaggcgacgucacccacaucgccggcucccgaaauuacacaaugaacuccgcaucccuaaacuggaacaacuacgaccccaccgaagaaauaccugccccucuaggcaccccagacuucguuggcaaaauccaaggaaugcucacacaaacaaccaagggcgacgguuccacucgcggccacaaagcaaccguauacacaggauccgcgccauucaccccuaaacuuggcuccguacaguucgaaaccgacaccgaaaacgacuucgaaacccaccaaaauaccaaauucaccccagucggcguuauccaagacggaggcaccacccacagaaacgaaccccaacaaugggugcuacccuccuacucgggaagaaacguacccaacguccaccucgcaccagccgucgcucccaccuuccccggcgaacaacugcuuuucuuccggucaacaaugccgggcugcuccggcuaccccaacauggaccucgacugccuccucccccaagaguggguccaacacuucuaccaagaagccgccccagcccaauccgacgucgcccuccuccgcuucgucaacccagacaccggccgcguacucuucgaaugcaaacuacacaaguccggcuacgucaccgucgcacacacaggccaacacgaccucgucauuccacccaacggcuauuuccgauucgauucgugggucaaccaauucuacacacuagcacccaugggcaacggaaccggccggcgacgcgcgcucuaa

SEQ ID NO: 35920 - RNA, 1623 nt, Artificial Sequence
  derived and/or modified sequence opt11 from VP1__Norovirus__AGK25902
augaaaauggccucaaacgacgccaaccccagcgacggcagcgcagcaaaccucguacccgaaguuaacaacgaagucauggcacuagaacccgucguaggcgcagcaaucgccgccccaguagcaggucaacaaaacguaauagacccauggauccguaauaacuuuguccaagcccccggcggcgaguucaccgucucaccccgcaacgcccccggcgaaauccucugguccgcaccccucggacccgaccucaaccccuaccucucccaccucgcccgcauguacaacgguuaugccggcggcuuugaaguacaagucauccuagcugggaacgccuucaccgccggcaaaaucaucuucgccgcggucccacccaacuuccccaccgaaggacucucacccagccaaguaaccauguucccccacaucaucgucgacgucagacagcucgaaccaguccuaaucccccuacccgacguacgaaacaacuucuaccacuacaaccaaucuaacgacucaacaaucaaacuaaucgccaugcuguacacuccccugagagcaaacaaugcaggcgaagacguuuucaccgcaucuugccgcguucugacccgccccuccccagacuucgacuucaucuuccuaguaccacccacagucgaaucccgcacuaaacccuucacaguaccaauccucaccguagaagaaaugacuaacucuagauuccccaucccccuagaaaaacucuucaccggacccucguccgcauucgucguccaaccccaaaauggccgcugcaccacagacggcguacuacucggaaccacccaacucucacccgucaacaucugcacauuccgcggcgacguaacccacaucgccggcagccgaaacuacaccaugaaccucgccucccuaaacuggaacaacuacgauccaaccgaagaaauccccgccccucucggcacccccgacuucgucggcaaaauccaaggcaugcuaacucaaaccacaaaaggggacggaucaacacgcggccacaaagcuacagucuacacaggcuccgcccccuucacccccaaacuuggcuccguccaauucgaaaccgacaccgagaacgacuucgaaacccaucaaaacacaaaauucacucccgucggcgucauacaggacggcggcaccgcccaccgaaacgaaccccaacaauggguccuccccuccuacuccggccgaaacgugcccaacguccaccuagcccccgcagucgcaccaaccuuccccggcgaacaacuacucuucuuccgauccaccaugccuggcugcuccggauaccccaacauggaccucgacugccuccucccccaggaauggguacaacacuucuaccaagaagccgcccccgcccaauccgacgucgcccuccuacgcuucgucaaccccgacacuggacgaguacuauucgaaugcaaacuccacaaauccggcuacguaaccgucgcccacacuggccaacacgaccuagucaucccucccaacggcuacuuccgcuuugacuccugggucaaccaauucuacacauuagcacccaugggcaacggcaccggacgccgccgcgcuuuauaa

SEQ ID NO: 35921 - RNA, 1623 nt, Artificial Sequence
  derived and/or modified sequence opt11 from VP1__Norovirus__AGK25905
augaaaauggcaagcaacgacgccaaccccucagacggaucagccgcaaaccucgucccugaggucaauaacgaagucauggcccucgaaccugucguaggugccgcaaucgccgccccaguagcaggccaacaaaacgucauugacccauggaucagaaacaacuucgcucaagccccagggggcgaguucaccguaucgccacgcaacgccccaggcgaaauccuaugguccgcaccacucggccccgaccucaaccccuaccuaucccaccuugcccgaauguauaacggcuaugccggaggcuuugaaguacaagucauccuagcggaaaacgccuucacagccggcaaaaucaucuucgccgccguaccacccaacuuccccacagaaggccuaucccccucccgcguaacaauguucccccacauaaucgucgacguccgccaacuagaacccguccucauaccccucccagacguccgcaacaacuucuaccacuacaaccaguccaacgacuccaccaucaaacucaucgccaugcucuacacaccccuacgcgcaaacaacgcaggcgaagacgucuuuaccgugagcugccgaguccugacccgacccuccccagacuucgauuucaucuuccuagucccaccaacugucgaaucccgcacuaaacccuucacaguccccauccucaccguagaagaaacaaccaacuccagauuccccaucccacucgaaaaacuuuucacuggaccaucaucggccuucgucguucaaccacagaacggccgcugcacaacugacggagugcucuuaggcacaacacaacucuccccagucaacauauguacauuccguggcgacgucacccauauugcggguucccgcaacuacaccaugaaccuagccagccucaacuggaacaauuauguccccacagaagaaauaccagccccacucggcacacccgauuucguaggcaaaguacaaggcaugcucacccaaacaaccaaaggcgacgguucaacccgcggacacaaagccaccguuuacaccggcucagcgccuuuuacccccaaacuaggcucaguccaguucgaaaccgacaccgaaaacgacuuugaaacccaccaaaacacaaaauucacacccguaggcgucauccaagacggcggcaccacacaccgcaacgaaccccaacaauggguacucccauccuacuccggccgaaacguacccaacguccaccucgccccagccguagcccccacauucccuggcgaacaacuacucuucuuccgcucaaccaugcccggcugcuccggcuaccccaacauggaccuugacugccuccucccccaagaauggguccaacacuucuaccaagaagccgcccccgcacaauccgacguggcccuccuccgauucguaaaccccgacaccggcagaguccucuucgaaugcaaacuccacaaauccggcuacgucacaguagcccacaccggccaacacgaccucgucaucccacccaacggcuacuucagauucgacucuugggucaaccaauucuacacauuagcccccauggguaacggcaccggaagacgccgcgcccucuaa

SEQ ID NO: 35922 - RNA, 1623 nt, Artificial Sequence
  derived and/or modified sequence opt11 from VP1__Norovirus__AGK25908
augaaaauggccucaaacgacgccaauccauccgacggcuccgcagccaacuuaguccccgaaguuaauaacgaagucauggcacuggaacccgucgucggcgccgccaucgccgccccagucgcuggccaacaaaacgucaucgaccccuggauccguaacaacuuuguccaagcccccggcggcgaauuuaccguauccccacgcaacgcccccggcgaaauccuaugguccgccccucucggccccgaccuaaaccccuaccucucccaucuagcccgaauguacaacgguuacgccggaggcuuugaaguacaaguaauacucgccggcaacgcauucaccgccggcaaaaucaucuucgccaccgucccacccaacuuccccaccgaaggccucucacccucucaagucaccauguuuccccacaucauugucgacguccgacaacuagagcccguccuaauaccccuccccgauguccgaaauaacuucuaccacuacaaccaaagcaaugacuccacuaucaaacuaauagccaugcucuacacaccccuccgagccaacaacgccggcgaagacgucuucaccguauccugccgaguccuuacccgccccucaccagacuuugacuucaucuuccuaguacccccuaccgucgaaucacgcacgaaacccuucacagucccaauccuaacagucgaagaaaugaccaacucucgauucccaauaccccuagaaaaacuauucaccggacccuccucugccuuugucguccaaccccaaaacggccgaugcaccaccgacggcguccuccuggguaccacacaauuaucccccguaaacaucuguacauuccgcggcgacgugacccacaucgcaggcucacgcaacuacacaaugaaccucgccucauuaaacuggaacaacuacgaucccacagaagaaauacccgcaccccucggcacccccgauuuuguuggaaaaauccaaggcguccucacacaaaccaccaaaggcgacgguuccacccgaggccauaaagccacaguauacaccggcuccgcccccuucacaccaaaauuaggcucaguccaauucgagaccgacacagaaaacgacuucgaaacccaccaaaacacaaaauucacccccguuggaguaauacaagacggaggcacaacccaccgaaacgaaccccaacaauggguccucccgucauacucuggccgcaacgucccaaacguacaccuagcccccgccgucgccccaacuuuccccggagagcaacuacucuucuuccgauccacaaugcccggcugcuccggcuaccccaacauggaccucgacugccuacucccacaagaauggguccaacacuuuuaucaagaagccgcgccagcgcaauccgacgucgcacuacucagauucguaaaccccgacaccggccgaguccuauucgaaugcaaguuacacaaaucaggcuaugucaccgucgcucacaccggucaacacgaucuagucauacccccaaauggcuauuuccgcuucgacuccuggguuaaccaauuuuacacacucgcccccaugggcaacggcaccggccgccgccgcgcccuuuaa

SEQ ID NO: 35923 - RNA, 1623 nt, Artificial Sequence
  derived and/or modified sequence opt11 from VP1__Norovirus__AGK25910
augaaaauggccagcuccgacgccaaucccagcgacggcucagccgccaaucucguccccgaagucaacaacgaagucauggcacuagaacccgucguaggcgccgcaaucgccgcccccguagccggccaacaaaacgucauagacccguggauacguaacaauuucguccaagcacccggcggcgaauuuacuguauccccacgcaacgccccaggugagauccuaugguccgccccacucggaccagaccuaaacccauacuuaucccaccuagcgcgcauguacaacggguacgccggcggcuucgaaguccagguuauacuagcaggcaacgccuucaccgccggcaaaguaauauucgcggcuguccccucaaacuucccaaccgaaggccucucacccucccaagucaccauguucccccacaucauugucgacguccgccaacuagagccaguccucauaccacuccccgauguucgaaauaacuucuaccacuacaaccaaucaaacgacuccaccaucaaacucaucgcaaugcucuacacccuccuacgcgcgaacaacgccggcgacgacgucuucacagucuccugccgcguccucacuagacccuccccagacuuugacuucauauuucuaguucccccaaccgucgaaucgagaaccaaacccuucucgguuccaguccucaccgucgaagaaaugaccaacucacgauucccaaucccccuagaaaaacucuucaccggucccuccuccgcauuugucguccaaccacaaaacggccgcuguaccaccgacggaguccuacucggcaccacccaacuauccccagucaacaucugcaccuuccgcggugacgucacccacauaaccggcucccgcaacuacaccaugaaccuagcaucacaaaacuggaacaacuacgacccaacagaagaaauccccgcaccacucgguacacccgacuucguaggaaagauccaaggaauguuaacccaaaccaccagaaccgacggcuccacccgcggccacaaagccaccauguacacaggcucagccgacuuugccccaaaacucggccguguucaguucgagaccgacaccgaccaugacuucgaagcaaaccaaaacaccaaauucaccccugucggagucauccaggacgguggcaccacccaccgcaacgaaccccaacaauggguccucccauccuacuccggccgcaacacccacaauguacaccucgccccagccgucgcacccaccuucccuggcgaacaacuccucuucuuccgccccaccaugcccggcugcuccggcuaucccaauauggaccuagaccgucuccucccacaagaauggguccaauacuucuaccaagaagcagcccccgcacaaucagacgucgcacuccuacgcuucguaaacccagacaccggaagaguacuuuucgaaugcaaacuccacaaaucuggauacguaacagucgcccacaccggccaacacgaccucgucauaccacccaacggcuacuuccgcuucgauuccugggucaaccaauucuacacccucgcgcccaugggaaacggcacaggccgacgccgagucguuuaa

SEQ ID NO: 35924 - RNA, 1623 nt, Artificial Sequence
  derived and/or modified sequence opt11 from VP1__Norovirus__AGK25912
augaaaauggccuccaacgaugccaaccccagcgacggcucagccgccaaccugguccccgaagucgacaacgaagucauggcccucgaaccgguaguaggcgccgccaucgcagcccccgucgccggccaacagaacgucaucgaccccuggauccgaaacaacuucguccaagccccaggaggcgaguucaccguaucuccaagaaacgcacccggcgaaauccuuugguccgcaccccucgguccagaccucaaccccuaucuaucccaccucgcgcguauguacaacggauacgccggaggcuucgaaguccaagucauacucgccggcaacgccuucaccgccggcaagaucaucuucgccgccgugcccccaaacuuccccacagaaggucuaucaccaucccaggucacaauguucccucacaucauagucgacguccgccaacucgaaccaguacuuaucccccuccccgacguacgaaacaacuucuaccacuacaaucaauccaacgauuccaccaucaaacucauagccaugcuauacacuccacuccgagccaacaacgccggagaagacgucuucacugucuccugccgcguacuaacccgccccuccccagacuucgauuucaucuuccucgcaccgcccaccgucgaaucccgcacaaaacccuucaccgugcccauccuaaccguugaagaaaugaccaauucccgcuuccccaucccccuugaaaaacuauucaccggaccuuccucagccuucguaguccagccccaaaacgggcgcugcaccacugacggcguccuccucggaaccacacagcucucccccgucaacaucugcaccuuccgcggcgacgucacacauaucgcaggcucacgcaauuacaccaugaaccuagcaucacucaacuggaacaacuacgaccccacagaagagauccccgcaccccuaggcacacccgacuucguuggcaaaauacaaggcaugcuaacccaaaccaccaaaggcgacgguucaacccgaggccacaaagccaccguauacacuggauccgccccauucacucccaaauuaggaucaguccaguucgaaaccgacacagaaaacgauuucgaaacccaccaaaauaccaaauucacccccguaggaguaauccaagacgguggaaccacacauagaaacgaaccgcaacaauggguccuccccucauacucaggacgaaauguccccaacguacaccucgccccugccguggccccaacauucccaggcgaacaacuccucuucuuccgcucaacaaugccaggcugcuccggcuacccaaacauggaccucgacugccuccucccccaagaauggguccaacacuucuaccaagaagccgcccccgcccaauccgacguagcucuccuccgcuucguuaacccagacaccggaagaguccuauuugaaugcaaacuccacaaaagcggauaugucacagucgcccacaccggccaacacgaccucgucauacccccaaacgguuacuuccgauuugauuccugggucaaccaauucuacacccuugcaccuaugggcaacggaacaggaagacgccgcgcccucuaa

SEQ ID NO: 35925 - RNA, 1623 nt, Artificial Sequence
  derived and/or modified sequence opt11 from VP1__Norovirus__AGK25915
augaaaauggcaucaaacgaugcaaaccccagcgacggcagcgccgucaaccuaguucccgaagucaacaacgaagucauggcacuagaacccguugucggagcagcuaucgcagcccccgucgccggccaacaaaacguuaucgaccccuggauacgcaacaacuuuguacaagcaccaggcggagaguucacagucuccccacgaaaugcccccggcgaaauccucuggucagcaccccuagggcccgaccucaaccccuaccucucccaccuagcccgcauguacaacggcuaugccggcggcuucgaaguccaagucauccuugccggcaaugccuucaccgccggcaagauuaucuucgccgccgucccacccaacuuccccaccgaaggacucucacccucccaaguaacaauguuuccacacaucaucgucgacgcacgccaacuugaacccguacuaaucccacuaccagacguccgaaacaacuucuaccacuacaaccaguccaacgacuccaccauuaaacuuauugcaaugcucuacaccccacuacgcgcaaacaacgccggcgaagacguauucaccguuuccugccgcguccucacccgucccuccccagacuucgacuucauuuuccucguucccccaaccguagaaucacggacaaaaccauucacaguccccauccuaaccgucgaagaaaugacaaacucccgcuuccccaucccacuagaaaaacucuucaccggucccuccucagccuucgucguacaaccacaaaauggccgaugcaccaccgauggcguccuccucggcaccacccaacucucucccgucaacaucugcacauuucgcggggacgucgcacacaucgccgggucccgcaauuacaccaugaaccuagcaagccuaaacuggaacaacuacgacccaaccgaagaaauucccgcuccccuaggcacaccagacuucgugggcaaaauccaaggaaugcucacccaaacuaccaaaggagauggcuccacacgcggccacaaagccacuguauacaccggauccgcccccuucacaccuaaacuaggcuccguccaauucgaaaccgacacugaaaacgacuucgaaacccaccaaaacacaaaauucaccccuguuggagucauccaagacgguggaaccacccaucgcaacgaaccccaacaauggguccucccauccuacuccggccgcaacgugcccaacguccaccucgcccccgcaguagccccaaccuuccccggcgaacaacuucuccuuuuccgcuccacuaugcccggcugcucaggcuaccccaacauggaccuagacugccuccugccacaagaguggguccaacacuucuaccaagaagccgccccugcacaaucugacguagcccuacuccgcuucgucaaccccgacacaggucgcgucuuauucgaaugcaaacuccacaaaagcggcuacguaaccguugcccauaccggacaacacgaccucgucauuccucccucaggcuacuuccgcuucgacucauggguaaaccaauucuacacccuagcccccauggguaacggcacaggacgacgcagagcacuauaa

SEQ ID NO: 35926 - RNA, 1623 nt, Artificial Sequence
  derived and/or modified sequence opt11 from VP1__Norovirus__AGK25917
augaaaauggcauccaacgaugccaacccauccgacggcuccgccgccaaccuuguccccgaaguaaacaacgaggucauggcccucgaaccagucgucggcgccgcaaucgcugcacccguagcaggacaacaaaacgucaucgaccccuggauccgcaacaauuucguccaagcgcccggaggcgaguucaccgucagcccccgaaacgccccaggagaaauccucuggagcgcgccccucggcccugaucuaaaccccuaccucucccaccucgcccgcauguacaauggauacgccggcggauucgaaguacaagucauccucgccgguaacgccuucaccgccggcaaaaucaucuucgccgccgucccaccaaacuuccccacagaaggacuaagccccucccaagucacuauguucccacacauuaucgucgacguccgccaacucgaacccguacuaauaccccucccagacguacgcaacaacuucuaccacuacaaccaauccaacgacucaaccaucaaacuuaucgccaugcuguacaccccacucagagcaaacaacgccggagaagacgucuucaccgucucuugccgcguccucacacgccccuccccagacuucgacuuuaucuuccuuguaccgcccacaguagaaucccgcaccaaacccuucaccguacccaucuuaaccgucgaagaaaugaccaacucaggcuuccccaucccccuagaaaaacuuuucaccgggcccuccagcgccuucguaguacaaccccaaaacgggcgcugcacaaccgacggcguccuccucggcacuacacaacucucccccgucaacaucugcacauuccgcggagauguaacucacauagcuggcucacgaaacuacaccaugaaccucgccucucucaacuggaauaauuacgaucccaccgaagaaauccccgcaccccuaggcacgcccgacuuuguuggcaagguacaaggcguacuuacccagaccacaaaaggagacggcuccacccgcggccauaaagccaccguguacacaggcucagcacccuucacccccaaacuuggcuccguccaauucgaaacagacaccgaaaacgacuuugaaacacaccaaaacaccaaauucaccccuguuggcgucauacaagacggaggcaccgcccaccgcaaugaaccccaacaauggguccuccccuccuacuccggcagaaacguccccaacguccaccucgcccccgccgucgccccaacauucccaggcgaacaacuccucuucuuccgaucaaccaugccaggcugcuccgguuaccccaacauggaccucgacugccuccucccacaagaauggguucaacacuucuaucaagaagccgcccccgcccaauccgacgucgcccuccuccgcuucguaaacccagacacuggccguguccucuuugaaugcaaacuacacaaauccggcuacguaacagucgcccacacaggccaacgcgaccucguaauacccccaaauggcuacuuucgcuucgacucauggguaaaccaauucuacacacucgcccccauggguaacggaacaggcaggcgacgcgcacuauaa

SEQ ID NO: 35927 - RNA, 1623 nt, Artificial Sequence
  derived and/or modified sequence opt11 from VP1__Norovirus__AGK25919
augaaaauggccuccuccgacgcaaaucccucagacggcucagcggccaaccucgucccagagguaaauaacgaaguaauggcccuagaacccguugucggagcugcaaucgccgcccccgucgccggccaacaaaacgucauagacccauggauccgaaacaacuucguacaagcccccggcggcgaguucaccguaucuccacgaaacgcacccggcgaaauccucuggucagccccucucggcccugaccucaacccauaccuaucacaccucgcccguauguacaacggauaugccggcggcuucgaaguccaagucauccucgcaggcaacgccuucacugccggcaaagucaucuucgcugcagucccgcccaauuuccccaccgaaggccuaucacccucccaagucaccauguucccccacaucgucguagacguccggcaacucgagcccgugcucauaccccuacccgacguacgcaauaauuucuaccacuacaaucaaucgaacgaccccaccaucaaacuaaucgccaugcucuacacaccccuccgcgcaaacaacgcaggcgacgacguauuuaccgucuccugccgaguccucacccgccccucccccgacuucgacuucaucuuccucgucccacccacaguagaaucacgaaccaaacccuucucagucccaguccucacaguagaagaaaugacuaacucccgauucccaauuccccucgaaaaauuauucacgggccccucguccgccuucguaguccagccacaaaacggaaggugcacaaccgacggcguucuccuaggcacaacacaacucucgccugucaacauaugcaccuuuagaggcgacgucacccacauaaccggcucccgaaacuacacaaugaaccuagccagccaaaacuggaauaauuacgacccaaccgaagaaacacccgcaccacucggcaccccagacuucguaggcaaaauacaaggaguccucacccaaacaacccgcaccgacggaucaacacgaggccacaaagccaccgucuauaccgguucagccgacuucgcucccaagcucgggcgaguccaauucgaaaccgacaccgaccacgacuucgaagccaaccaaaacaccaaguucaccccaguaggcgucauacaagauggcggcaccacccaccguaacgagccccaacaauggguccugccguccuacagcggccgcaacacacacaacguacaccuagcccccgccgucgcccccacauuuccgggagaacaacuacuauucuuccgaucaacaaugcccggcugcucaggauaccccaacauggaccucgacugccugcucccccaagaauggguccaguacuucuaccaagaagcagcccccgcccauucugacguugcucuacuccgcuuugucaacccagacacaggccgaguacuauucgaaugcaaacuacacaaaagcggauacgucacagucgcucacacaggacaacacgaccuaguaaucccacccaacggauacuuccgguucgacuccuggguaaaccaauucuacacccuugcccccaugggcuccggaaccggccgacgacgagccguauaa

SEQ ID NO: 35928 - RNA, 1623 nt, Artificial Sequence
  derived and/or modified sequence opt11 from VP1__Norovirus__AGK25921
augaaaauggccucaagcgacgcaaacccauccgauggcagcgccgcaaaccucgucccagaagucaacaacgaagucauggcacuugaaccagucgccggggccgccaucgccgcacccgucgcaggccaacaaaacgucaucgacccuuggauccgcaacaacuucguccaagcccccggaggagaguucaccgucuccccucgaaacgcucccggcgaaauacuauggucagcaccucucggaccagaccuuaaccccuaccuaucacacuuagccagaauguacaacggcuacgccggaggauucgaaguccaagugauacucgccggcaacgccuucaccgccggaaaagucaucuucgccgccgucccacccaacuuccccaccgaaggccuaucccccucgcaaguaaccauguucccacacauagucgucgaugugcgucaacuagaaccaguucucauuccccuccccgacguccgaaacaacuucuaccacuacaaccaaucaaacgacccaaccaucaaacucaucgccaugcuuuacgcaccccuccgagcaaacaacgcuggcgacgauguuuucacagucucaugccgcguccucacccguccaucaccugauuucgacuucaucuuccucgucccacccaccguugaaucccguacuaaacccuucuccguccccguccucaccgucgaagaaaugaccaacuccagauucccaaucccacucgaaaaacucuucaccggccccucuucagcauucgucgugcaaccccaaaacggcagaugcacuaccgacgguguccuacucgguaccacccaacucuccccagucaacaucugcacauuccgaggugacgucacucauaucaccggaagcagaaauuacaccaugaaccucgccagccaaaacuggaacaacuacgaccccacagaagaaauucccgcaccucuaggaacacccgacuuugucggcaaaauccaaggcguccuaacccagaccacccgcaccgacgguagcacccgcggccacaaagcaaccgucuacacaggcuccgcagacuucgcccccaaacuaggccgaguccaauuugaaaccgacacagaccacgacuucgaagcgaaccaaaacacaaaauucaccccagucggagucauccaagacggcggcaccacccaucgaaacgaaccacaacaauggguacucccauccuacuccggccgcaacacccacaacguccaccucgcuccagcagucgcccccacauuccccggcgaacaguuacucuucuuccgaucuaccaugcccggcugcuccggcuaccccaacauggaccuagacugccuccucccccaagaauggguacaauacuucuaucaagaagccgcucccgcccaaucagacguagcacuccuacgcuucgucaacccugacaccggccguguccuauucgaaugcaaacuccacaaaucaggcuacguaaccguggcccacacaggccaacacgaccuggucaucccacccaacggcuacuuccgcuucgacuccuggguaaaccaauucuacacucuagcccccauggguaacggcaccgggcgccgccgcgccgucuaa

SEQ ID NO: 35929 - RNA, 1623 nt, Artificial Sequence
  derived and/or modified sequence opt11 from VP1__Norovirus__AGK25924
augaaaauggccuccuccgacgcgaaccccucagacggaucugccgccaaccucguccccgaagucaacaacgaaguaauggcccucgaacccguugucggagccgcaaucgccgcucccgucgccggacaacaaaaugucaucgaccccuggauccgcaacaacuucguccaagcccccggaggcgaauuuaccguuuccccacgcaacgcacccggcgaaauccuuugguccgcuccccucgggcccgaccucaaccccuaccucucucaccucgcacgcauguacaacggauacgccggcgguuucgaaguacaagucauccucgcuggcaacgccuucaccgcaggcaaggucaucuucgcagcagucccucccaacuuccccaccgaaggccucucucccucccaaguaacuauguucccccacauagucguagacguccgccaacuagaaccaguccucaucccccuccccgacguacgaaacaacuucuaccauuacaaccaaucaaacgaccccaccaucaaacuaauagccaugcucuacacaccccucagagccaacaacgccggcgacgacguauucaccgucuccugccguguccucacccgcccaagcccagacuucgacuucaucuuccucgucccucccaccgucgaaucccgcaccaaaccuuucucaguccccguccucacaguagaagaaaugaccaacucccgcuucccaauaccacucgaaaaacucuccacuggccccucauccgcguucgucguccaaccucaaaacggccgaugcaccaccgacggcguacuucucggcaccacacaacucucccccgucaauaucugcaccuuccguggcgacgucacccacaucacugguucgcgaaacuacaccaugaaccucgccucucaaaacuggaacaacuacgauccaaccgaagaaauacccgcuccacuaggcacccccgauuucgucggcaaaauccaaggaguccuaacccaaacaacccgcacagacggcagcacccgcggccacaaagccacaguguauacugguuccgcagacuucgcccccaaacuaggacgaguccaauucgaaaccgacacugaccacgacuucgaagccaaccaaaacacaaaauucacaccagucggcguaauccaggacggcggcacuacacaccgaaacgaaccacaacaauggguccuuccguccuacuccggacgaaauacucauaacguccaccucgcacccgcaguagcacccaccuuccccggagaacaacuccucuucuuccgauccacuaugcccggaugcucuggcuacccuaacauggaccuagacugccugcucccccaagaauggguacaauacuucuaccaagaagcugcacccgcccaaucagacguagcccuccuccgauucgucaaccccgacaccggacgcguccuauucgaaugcaaacuccacaaauccggauacgucacagucgcacauaccggacaacacgaucuugucauaccacccaacggcuacuuccgcuucgacucaugggucaaccaauucuacacacucgcacccaugggcaacgguaccggccgacgacgcgcagucuaa

SEQ ID NO: 35930 - RNA, 1623 nt, Artificial Sequence
  derived and/or modified sequence opt11 from VP1__Norovirus__AGK25927
augaaaauggccucuucagacgccaaccccagcgacggcucagccgccaaccucguucccgaaguaaauaacgaaguaauggcucucgaaccuguggucggagcagcuaucgccgcacccgucgcuggccagcaaaacgucaucgaccccuggauacgcaauaacuucguccaagcuccagguggagaguucaccgucuccccacgcaacgcccccggagaaauacucuggucagcaccccucggcccagaccuaaaccccuaccucucacaccucgcccgcauguacaacggauacgccggaggcuucgaaguccaagucauccuagccggcaacgccuucacagcaggcaaaguaauauucgccgccguaccacccaauuuccccacagaaggccucucacccucccaagucacaauguucccccacaucguaguugacguacgccaacucgaacccguacucaucccccuccccgacgucagaaacaauuucuaccauuacaaccaauccaacgacccaacuauaaaacuaaucgccaugcucuacgcaccccuccgggcuaacaacgcaggcgacgacguuuucaccgucucuugcagaguccucacccgacccucaccagacuucgacuucaucuuccucguaccacccacaguugaaucccgaaccaaacccuucuccguccccguccucaccguagaagaaaugaccaacucccgauuccccauuccacucgaaaaacuuuucacagggcccuccucagcauuuguaguccagccccaaaacggacgcugcaccacagacgguguccuccucggcacaacccaacuuucaccagucaacaucuguaccuuccgcggcgacguaacucacaucacaggcuccagaaacuacaccaugaaccucgccucgcaaaacuggaacaacuaugacccaacagaagaaauccccgcgccccuaggcaccccagacuucguaggaaagauccaaggaguccucacucaaaccacacgcaccgacggcagcacacgcggccacaaagccaccguauauaccggcuccgccgacuucgccccaaaacucggccgcguccaauucgaaacagacaccgaccacgacuucgaagccaaccaaaacaccaaauucaccccagucggcgucauccaagacggaggcaccacccaccgaaacgaaccccaacaguggguccuacccucauacuccggccgcaacacucauaacguucaccucgcccccgccgucgcccccaccuuccccggggagcaacuccucuuuuuccgcucgaccaugcccggcugcagcggcuacccgaacauggaccucgacugucuccucccacaggaguggguucaauacuucuaccaagaggccgcacccgcccaauccgacgucgcacuacuacgauucguaaaccccaacacaggccgaguccuauucgaaugcaaguugcacaaauccggcuacgucacagucgcacacaccggccaacacgaccucguaauaccacccaaugacuacuuccgauucgacuccugggucaaccaauucuauacccuugcccccaugggcaauggcaccggacgacgccgcgcggucuaa

SEQ ID NO: 35931 - RNA, 1623 nt, Artificial Sequence
  derived and/or modified sequence opt11 from VP1__Norovirus__AGK25930
augaaaauggccucauccgacgccaacccaucagacggcuccgccgccaaccucgucccggaaguaaacaacgaagucauggcccuugaaccagucgucggagccgccaucgccgcaccagucgccggccaacaaaauguaauagaccccuggauucgcaacaacuucguccaagcccccggaggcgaguucaccguaucuccccgcaacgcaccgggcgaaauucuauggucagcaccccuuggacccgaccuaaaccccuaccucucccaccucgcacgaauguacaacgguuacgccggcggcuucgaaguccaagucauucuagccggcaaugcauucaccgccgguaaagucaucuucgcagccguacccccaaacuucccaacagaaggauuauccccuucccaagucaccauguucccgcacaucgucguagacguccgccaacucgaaccaguccucaucccacuacccgacgucggaaacaacuucuaccauuacaaccaauccaaugacccaaccauuaaacuuauagcaauguuauacacaccccuccgcgccaacaacgccggcgacgacgucuucacagucucgugcaggguccucacccgccccucgccagacuucgacuucauauuucuagucccacccaccgucgaaagccgaaccaaacccuucuccguccccguccuaacuguugaagaaaugaccaacuccagauuucccaucccccucgaaaaacucuucacaggccccucaucagcauucgucguccaaccacaaaacggacgaugcaccaccgacggcguccuacucggcaccacacaacucucaccaguaaacaucugcacuuuccgcggcgacgucacucacaucacuggcucccgaaacuacaccaugaaccuugcuucccaaaacuggaacaacuacgauccaacugaagaaauccccgcgccccucggaaccccagacuucgucggaaaaauccaaggcgugcucacacaaaccacccgcaccgacggauccacccguggccacaaagccaccguguacaccggcucugccgacuucgcaccaaaacucggccgcguccaauucgaaacugacaccgaucacgacuucgaagccaaccaaaacaccaaauucacccccgucggcgucauccaagacggcggcaccacccaccgcaacgaaccccaacaauggguccuaccauccuacuccggacggaauacccacaacgugcaccuagcacccgcagucgcacccaccuucccaggcgaacaacuccuauucuuucgaucaaccaugccaggcugcucaggcuacccaaacauggaccucgacugccuccuaccacaagaauggguacaauacuuuuaucaagaagcagcaccagcccaaagcgacguugcccuucuccgcuucgucaaccccgacaccggccgcguacuuuucgaaugcaaauuacacaaaucaggcuacgugaccguugcccacaccggccaacacgaccucgucauaccacccaacggcuacuuccgauucgacucauggguuaaccaauucuacacccucgcccccaugggaaacggaaccggccgccgccgugccgucuaa

SEQ ID NO: 35932 - RNA, 1623 nt, Artificial Sequence
  derived and/or modified sequence opt11 from VP1__Norovirus__AGS08025
augaaaauggcaagcuccgacgccaaccccucagacggcuccacugcuaaccucgugcccgaaguaaacaacgaagucauggcccucgaacccguagucggcgcagccauagccgccccagucgcaggccaacaaaacgucauagacccauggauacgcaacaacuucguacaagcacccggcggcgaguucacaguaucuccccgcaacgcccccggcgaaauccuaugguccgccccacuuggaccagaccuuaaccccuaccucucccacuuagcccgcauguacaacggauacgccgguggcuucgaaguacaagucauacuagccggcaacgccuucacagccggaaaaaucaucuucgcggcaguacccccaaacuuccccaccgaaggccuauccccaucacaagucaccauguucccccacaucauugucgacguccgccaacucgaaccaguccucauaccacuccccgacgucagaaacaacuuuuaccacuacaaccagucaaacgaccccacaaucaaacucaucgccaugcucuacacaccccuccgcgccaacaacgcaggcgacgacgucuucacaguauccugccgaguccuaacccgacccuccccagacuucgacuucauuuuccuaguucccccaaccgucgaaucccgaacaaaaccguucuccguccccguucuaacagucgaagaaaugaccaacucccgcuucccaaucccauuagaaaagcuauucaccggaccaucaagcgccuucgucgugcaaccacagaacggacgaugcaccaccgacggaguccuacuuggcaccacacaacuguccccagugaauaucuguacauuccgcggcgaugugacucauauacccggcucccgcaacuacacuaugaaccuagcaucccaaaacuggaacuccuacgacccaacagaagaaauacccgcaccccuaggcacaccagacuucgucggaaagauccaaggcguccucacccagaccaccaaaacgaacggcucaacccgaggccacaaagccaccgucuacacaggauccgccgacuucagccccaaacucggccgaguacaauucgcgacugacaccgauaacgacuucgaaaccaaccaaaacaccaaauucacaccagucggcgucauccaagacgguuccacaacaccccgaaacgaaccccaacaauggguccugccauccuacuccggccgcaacauccacaacguccaccucgccccggccgucgcuccgaccuucccaggcgaacaacuccucuucuuccgauccaccaugcccggcugcucuggcuaccccaacauggaccucgacugcuuacuuccacaagaaugggugcaauacuucuaccaagaagccgcacccgcccaaucagacgucgcacuacuacguuucguaaaccccgacaccggccgaguccuauucgaaugcaaacuccacaaauccggauacgucaccgucgcccacacaggccaacacgaucucgucauacccccuaauggcuacuuccgauucgacagcugggucaaccaauucuacacacuugcaccaaugggcaacggcacaggacgacgccgcgcccuauag

SEQ ID NO: 35933 - RNA, 1623 nt, Artificial Sequence
  derived and/or modified sequence opt11 from VP1__Norovirus__AGS08026
augaaaauggccucauccgacgcuaaccccuccgacggcuccaccgccaaccucguccccgaagucaauaacgaaguaauggcccucgagcccgucguuggagcagccaucgccgcucccguugccggccaacaaaacgucaucgaccccuggauccguaacaacuucguccaagcaccaggcggcgaguucaccguaucuccacggaacgcccccggcgaaauccuuuggucagccccgcuaggcccugaccuaaaccccuaccuaucacaccucgcccgaauguacaacggcuacgcuggcggauucgaaguccaaguaauacucgcaggcaacgccuucaccgccggcaaaauuauauucgcagccguaccgcccaacuuccccacagaaggccucucccccucacaagucacaauguucccccacaucaucgucgauguacgccaacuagaacccgugcucauaccccuccccgacguacgcaacaacuucuaccacuacaaccaguccaacgaccccaccauaaagcucauagccauguuauauacaccccuccgcgcaaacaacgccggagaugauguauucacaguaucaugccgaguacuaacccgacccagccccgacuucgacuuuaucuuccucguaccucccacaguagaaucaagaaccaaacccuucuccguucccguucucaccguagaagaaaugacuaacucacgcuuccccaucccccuggaaaaacucuucaccggccccuccuccgccuucguaguccaaccccagaacggccgcugcaccaccgacggaguccuccuaggcaccacacaacucucaccggucaauaucugcacuuuccguggugacguaacccacauauccgguucacgcaacuacaccaugaaccuagccucccagaacuggaacuccuacgacccaaccgaagaaaucccugcuccccucgguacccccgacuucgucggcaaaauccaaggcguccucacucaaaccacccgcaccgacggauccacccgcggacacaaagccaccgucuacacaggauccgcagacuucagccccaaacucggccguguccaauucgccaccgacaccgacaacgacuuugucacuaaccaaaauaccaaauucacgccagucggcgucauacaggacggcuccaccacuccccgcaacgaaccacaacagugggucuuaccaucuuacagcggccgaaauacacacaacguccaccucgcacccgccguagcaccuacauuuccaggagaacaacuccuuuucuuccgguccaccaugcccgguugcucaggcuaucccaacauggaccucgacugccuacucccgcaagaauggguccaauacuucuaccaagaagccgcacccgcccaaucagacguagcccuccucagguucgucaacccagacaccggcagaguccuauucgaaugcaaacuucauaaaucugguuauguuaccgucgcacacaccggccaacacgaccucgucaucccacccaacggcuacuuccgcuucgauuccugggucaaccaauucuacacacucgcacccaugggcaauggaacaggcagacgccgugcccucuaa

SEQ ID NO: 35934 - RNA, 1623 nt, Artificial Sequence
  derived and/or modified sequence opt11 from VP1__Norovirus__AGS08027
augaaaauggcauccucagacgcuaaccccuccgacggcuccacagccaaccuaguaccagaggucaacaaugaaguaauggcccuggaacccgucgucggcgccgccaucgcugccccaguugccggccaacaaaacguaaucgaccccuggauacgaaauaacuucguccaagcccccggaggugaguucacuguuucaccccgcaacgcccccggugaaauccucugguccgcaccacuaggucccgaccucaacccuuaccucucucaccuugcccgcauguacaacggauacgcgggaggcuucgaaguucaagugauccucgcaggaaacgcuuucaccgcaggcaaaaucaucuucgccgccgucccgcccaacuuccccaccgaaggacucucccccucgcaagucaccauguucccccacaucauaguagauguacgccaacuugaaccaguucucaucccucucccagacguacgaaacaacuucuaccauuacaaccaauccaacgacuccaccauaaaacucaucgcaaugcucuacacaccccuccgcgccaacaacgccggcgacgacguauucaccguauccugccgcguccuaacccgcccauccccagacuuugauuucaucuuccuagucccacccaccgucgaaucccgaaccaaacccuucuccguccccauacucaccgucgaagaaaugacaaacucacgcuuccccaucccucuugaaaaacuuuucaccggcccauccagcgcuuuugucguccaaccacaaaacgggcgcugcaccaccgacggcguccuccuugguacgacgcaacuaucaccagucaacaucugcaccuuuagaggcgacgucacacacauacccggaagccacaacuacacaaugaaccuagccagccaaaacuggaacucuuacgaccccaccgaagaaauccccgcaccccucggaacccccgacuucgucggcaaaauccaaggcguccucacucaaacaaccucggccaacggauccacucgcggacacaaagccaccgucuacacaggcucugccgacuuuuccccaaaacucggccgcguccaauucgccaccgacaccaacaacgauuucgaaacuaaccaaaacaccaaauucacccccgucggagucauccaagacggaaacaccaccccucgcaacgaaccccaacaauggguacuacccucguauucuggccgcaacauccacaacguccaucuagccccugcugucgcacccacauuccccggagaacaacuccucuucuuccgauccacaaugcccggcugcagcggcuaucccaacauggaccucgacugccuacuaccccaagaauggguccaauacuuuuaccaagaagcugcacccgcccaauccgacguagcccuucuccgcuucgucaaccccgacaccggccgcguccucuuugaaugcaaacuacacaaauccggcuacguaaccgucgcccacaccggccaacacgaucucgucaucccacccaacggcuacuuuagauucgacuccugggucaaccaauucuacacccuugcucccaugggcaacggcaccggcagacgccgcgccuuauaa

SEQ ID NO: 35935 - RNA, 1623 nt, Artificial Sequence
  derived and/or modified sequence opt11 from VP1__Norovirus__AGS08028
augaaaauggcgagcucugacgccaaucccuccgacggauccgccgccaaccucguccccgaagugaacaacgaaguaauggcccuagaacccgucgucggagccgcuaucgccgcccccguagccggacaacaaaacguaauagacccuuggauccgaaacaacuucguccaggcacccggcggagaguucaccgucagcccacgaaacgcaccaggagaaauacuuuggucagcaccccucggcccagaccuuaaccccuaccucucccaccuagccagaauguacaacggauacgccggcggauucgaaguccaagucauccuagccggcaaugccuucaccgcuggaaaagucaucuucgcagccguuccacccaacuuccccaccgaaggauuaucucccucacaagucaccauguucccccacaucgucguagacguccgccagcucgaacccguccucaucccacuccccgacguucgcaacaacuucuaccauuacaaccagucaaacgaccccaccaucaaacucaucgccaugcucuacacaccccugcgcgccaacaacgccggcgacgacgucuucaccgucuccugccgcguucucacccgaccaagccccgacuucgacuucaucuuccucguaccacccaccgucgaaucacgaacuaaacccuuuuccguccccguucucacuguagaagaaaugaccaacucccgauuccccaucccccucgaaaaacuuuucacaggccccuccucugccuucguaguccaaccccaaaacggccgcugcacaacagacggcguacuucucggcacaacucaacuauccccagucaacaucugcaccuuccgcggugacgucacccacaucaccggcucccgcaacuacaccaugaaccucgccucccaaaacuggaacaacuaugacccaacagaagaaauccccgcaccccucggaaccccggacuuuguaggaaaaauacaaggaguccucacacaaaccacccgcacagacgggagcacacgaggacacaaagccaccgucuacaccggcuccgcagacuucgcaccaaagcucggccgcguccaauucgaaaccgacacugaccacgauuucgaagcaaaccaaaacaccaaauucacucccguaggagucauacaagacggcggcaccacccaccgcaacgaaccccaacaauggguccucccauccuacagcggcagaaacacccacaacguacaccucgcccccgccguugcaccaaccuucccaggcgaacagcuucuguucuuucgcuccacaaugcccggcugcuccggcuaccccaacauggaccuugauugccuacucccccaagaauggguccaauacuucuaccaagaaacagcacccgcucaaucugacguagcucuccuacgcuucgucaacccugacaccggucgcguccuuuucgaaugcaaacuacauaaaucuugcuacgucacugucgcccacacuggccaacacgaccucgucaucccacccaacggcuacuucagauucgacagcuggguuaaccaauucuacacccucgcccccaugggcaacggcaccggccgcagacgagccguauaa

SEQ ID NO: 35936 - RNA, 1623 nt, Artificial Sequence
  derived and/or modified sequence opt11 from VP1__Norovirus__AGS08029
augaaaauggcauccagcgacgccaaccccucagacggcucuaccgccaaccuaguaccagaagucaacaacgaagucauggccuuagaaccagucgucggcgccgcaaucgcggccccagucgccggccaacaaaacguaauagaccccuggauccgaaacaauuucguacaagcccccggcggagaguucaccguaucaccccgcaacgcccccggcgaaauccuuugguccgcaccccucggccccgaccuaaacccauaccucucccaccucgcccgcauguacaauggauacgcaggcggauucgaaguccaagucauccucgcaggcaacgccuucacagcaggcaagaucaucuuugccgccguaccgcccaacuuccccacugaaggccucucacccucccaagucaccauguucccccacauaaucguagacguccgccaacuagaacccgugcuaaucccccuacccgacguccgcaacaauuucuaccacuauaaccaauccaaugaccccacaaucaaacuaaucgccaugcuauacacaccccuccgcgccaacaacgccggcgacgaugucuucaccgucucuugccgcgugcuaacacgaccuucccccgacuucgacuucaucuuccuaguacccccaaccgucgaaucucgcaccaaacccuucagcguccccguccuuacagucgaagaaaugaccaacucccgcuuucccaucccccuagaaaaacuauucaccggucccucaucugccuucgucguccaaccacaaaacggucgcugcaccaccgacggcguccuccuaggcaccacccaacucucacccguaaacaucuguaccuuccgcggugauguaacccacauccccggcucacgcaacuacacaaugaaccucgccucccaaaacuggaacuccuacgacccaaccgaagaaauccccgccccacuaggaacccccgacuucgucggcaaaauccaaggaguacucacgcaaaccacccgcaccaacggcuccacucgcggacacaaagcaaccgucuacaccggcuccgccgacuucagccccaaacucggccgcguacaauucgccaccgauacagacaacgacuucgaaacuaaccaaaacacuaaauucaccccagucggcgucauccaagacggcuccaccaccccacgcaacgaaccacaacaauggguccuuccuucauacuccggacgaaacauacacaacguucaccuagcacccgccgucgcucccaccuuccccggagaacaacucuuauucuuucgcuccacaaugcccggcugcucggguuaccccaacauggaccuagacugccuucuaccacaagaauggguccaauacuucuaccaagaagccgcccccgcacaaucagacgucgccuuacuccgcuucguaaaucccgacacaggacgaguccuauucgaaugcaaacuccacaaauccggcuacguaacaguagcccacacaggccaacacgaccuagucaucccucccaauggauacuuccgcuucgacuccugggucaaccaauucuauacccucgcccccaugggcaacggcaccggccgucgccgugcccucuaa

SEQ ID NO: 35937 - RNA, 1623 nt, Artificial Sequence
  derived and/or modified sequence opt11 from VP1__Norovirus__AGS08030
augaaaauggcuagcuccgacgcuaaccccuccgauggaucaaccgcuaaccucgucccagaaguaaacaacgaaguuauggcccuagaaccagucgucggcgcagcaaucgccgcgccagucgccggccaacaaaacguaaucgaccccuggauccgcaacaacuucguccaagcacccggcggcgaauuuaccgucucaccccgaaacgccccaggcgaaauccucuggucagcaccauuaggcccggaccuuaaucccuaccuaucacaccuagcacgcauguacaacggcuacgccggcggauucgagguacagguaauacucgcuggcaacgccuucaccgcuggcaaaauaaucuucgcugccguuccgcccaacuuccccaccgaaggccucucaccaucacaagucacuauguucccccacauaaucgucgacguacgacaacucgaacccguccucauaccccuccccgacguccgaaacaacuucuaccacuacaaccagucaaacgaccccaccaucaaacucaucgccaugcuauacaccccacugcgcgccaacaaugccggcgacgacgucuucaccgucuccugccgagugcucacucgcccaagccccgauuucgacuucauuuuccuagucccacccacaguagagucacgcaccaaacccuucuccguaccagucuuaacagucgaggaaaugaccaauucucgcuucccaauaccccucgaaaaacuuuuuaccggccccuccuccgccuucgucguccaaccacaaaacggccgcugcacaaccgacgguguacuccuaggcacaacccaacucucccccguuaacaucugcaccuuccgaggcgacguaacccacaucccuggcucacguaacuacaccaugaaucucgccucccaaaacuggaacuccuacgacccaacagaagaaauccccgcaccccucggaacaccugacuuugucggaaaaauccaaggcguccucacacaaaccacccgcaccaauggcuccacaagaggacacaaagccaccgucuacaccggcucugccgacuucucccccaaacuuggccgaguccaauucgcaaccgacaccgacaacgacuucgaaaccaaccaaaacaccaaguucacgcccgucggcguaauccaagacggcuccaccacuccccgcaaugaaccccaacaauggguccucccauccuacuccggacgaaauauccacaacguccaccuggcccccgcuguagccccaaccuuccccggagaacaacuccucuucuuucgauccaccaugcccggcugcucaggauaucccaauauggaccucgacugccuccucccacaagaauggguacaauacuucuaccaagaagcggcacccgcccaaucagacgucgcccuucuccgcuucgucaaccccgacaccggacgaguacuauuugaaugcaaacuacacaaaucaggauacgucaccguugcucacacuggacagcacgaccucgucaucccacccaacgguuacuuccgcuucgacuccuggguuaaccaauucuacacccucgcccccaugggcaacggcacaggccgccgacgcgcccucuaa

SEQ ID NO: 35938 - RNA, 1623 nt, Artificial Sequence
  derived and/or modified sequence opt11 from VP1__Norovirus__AGS08031
augaaaauggcaucaagcgacgccaaccccagcgacggcuccaccgccaaccugguacccgaagucaacaacgaagucauggcccucgaacccguaguaggcgccgccaucgcagcccccgucgcaggccaacaaaacgucauugaccccuggauacgaaacaacuucguccaagcccccggcggagaauuuacggucagcccacgaaaugcccccggagaaauacuauggucagcuccauuagguccagaccuaaaucccuaccugucccacuuagcccgcauguacaacggcuacgccggcggauucgaaguucaagucauacuugcaggcaacgccuucacugccggaaaaauaaucuucgcugccguacccccgaacuuccccacagaaggccuaucccccucccaagucaccauguucccccacaucauugucgacguccgccaacuagaaccaguccucaucccucuccccgacguccgcaacaauuucuaccacuacaaccaaucaaacgacccaacaauaaaacucaucgccaugcucuacacaccacuuagagccaacaacgccggugacgacgucuucacagucuccugccgcguacucacgcgcccaucuccagacuucgacuucauauuccucgugccuccaaccguagaaucccgcaccaaacccuucuccguaccaguccucaccguagaagaaaugaccaacagccgauuccccaucccccucgaaaaacuauucaccggccccuccuccgcauucguaguccaaccccaaaauggccgcugcacaaccgacggcguccuccucggcaccacucaacucucccccgucaacaucugcacuuuccgcggagacgucacacacauccccggcucccgcaacuacaccaugaaucuagccucccagaacuggaacucuuacgaccccaccgaagaaaucccagcaccccuuggaaccccagacuucgucggcaaaauccaagguguccuaacccaaaccacacgcacaaacggcuccacacgaggccacaaagccaccgucuacacaggcuccgcagacuucucacccaaacucggccgcguacaauucgcuaccgacaccgacaacgacuuugaaacaaaccaaaacacaaaauuuacacccguaggagucauacaagacggcuccaccaccccucgcaacgaaccccagcaauggguccuacccuccuacuccggacguaacauccacaacguccauuuagcaccagccguugcccccaccuucccaggcgaacaacuccucuucuuccgauccacuaugcccggcugcucuggcuaccccaacauggaccucgacugccuacucccacaagaauggguacaauacuucuaccaagaagcagcccccgcacaaucugacguugcccuccuccgcuucguaaacccagacaccggacgcguccuauucgaaugcaaacuccacaaaucaggcuacgucaccguugcccacaccggccaacacgaccuagucauaccacccaacggauauuucagauucgacagcugggucaaccaguucuacacccucgcacccaugggaaacggcaccggcaggcgcagagcccuauaa

SEQ ID NO: 35939 - RNA, 1623 nt, Artificial Sequence
  derived and/or modified sequence opt11 from VP1__Norovirus__AGS08032
augaaaauggcaagcuccgacgccaauccaagcgacggcuccaccgccaaccucguccccgaagucaacaacgaagucauggcacuagaaccaguugucggcgccgccaucgccgcccccgucgcaggacaacaaaacgucaucgaccccuggaucagaaauaacuucguccaagcccccggcggcgaauuuaccguuucuccccgaaacgcccccggcgaaauccucugguccgcaccccucggcccagaccucaaccccuaccuaucacaccucgcacgcauguacaacggcuaugcaggaggcuucgaaguacaagucaucuuggcaggaaacgccuucaccgccgguaaaauuaucuucgcagccgucccacccaacuuccccacugaaggacuauccccaucccaagugacaauguucccccacauaaucguugacguacgacaacucgaacccguucuuaucccccuaccagacguacgcaacaacuucuaucacuacaaccaauccaacgauucuacuaucaaacucaucgcuaugcucuacaccccucuccgagcaaacaacgcuggcgaugacgucuucaccgucuccugcaggguccuaacucgacccucucccgacuucgacuucauauuccucguaccacccaccguagaaucacgaaccaaaccauucagcgucccaguccucaccguugaagaaaugacaaacucacguuucccuaucccccucgaaaaacucuucaccggcccaucaucugccuucguaguccaaccccaaaacggccgcugcacaacagacggaguacucuuaggaacuacccaacucagccccgucaacauuuguaccuucagaggcgaugucacccacaucccaggaucccgcaauuacacuaugaaccucgccagucaaaacuggaacuccuacgaccccaccgaagaaaucccugccccacuagguacccccgacuucguuggcaaaauccagggcguccucacccaaacaacccggacuaacggcuccacacguggacacaaagcuacugucuacacuggauccgccgacuucucacccaaacucggcagaguccaauucgcaacagacacagauaacgacuucgaaaccaaccaaaacaccaaauucaccccuguaggcguaauccaagacgguagcacaacaccccgcaacgaaccacaacaguggguccuccccuccuacuccggacgcaacauccacaauguccaccucgcccccgccguagcccccaccuucccuggagaacaacuccucuucuuccgcuccaccaugcccggaugcuccggcuaccccaacauggaccuagacugccuucucccccaagaauggguacaauacuucuaccaagaagcagcccccgcacaauccgacguagcacuccuucgcuucgugaaccccgacaccggccgcguucucuucgaauguaaacugcacaaauccggcuacgucaccgucgcacacaccggccaacacgaccucgucauucccccaaacggcuacuuccgauucgacuccugggucaaccaauucuacacccuagcucccauggguaacggcacaggccgccgucgagcccuguga

SEQ ID NO: 35940 - RNA, 1623 nt, Artificial Sequence
  derived and/or modified sequence opt11 from VP1__Norovirus__AGS08033
augaaaauggcuucuucggacgcaaaccccucggacggaucagucgccaacuuaguucccgaagucaacaacgaagucauggcccuagaacccgucguaggagccgcaaucgccgcacccgucgccggccagcaaaacgucauagaccccuggauucgaaacaacuucguacaagcacccggcggcgaguucaccgucagcccccgaaacgcccccggagaaauacucugguccgcaccccucggacccgaccugaaccccuaccuaucccaccuagcccgcauguacaauggauaugccggcggcuuugaaguccaagucauacucgccggcaacgccuucacggccggcaaaguuaucuucgccgccgucccacccaacuuucccaccgaaggccuaagccccucacaagucaccauguucccccacaucgucgucgacgucagacaacucgaacccguucuuauaccccuccccgacguacgaaacaacuucuaccacuacaaccaauccaacgacccaaccaucaaacucauugccaugcuguacacaccccucagagccaauaacgccggcgacgacgucuucaccgucuccugcagaguccucacgcgcccaagcccagacuucgacuuuaucuucuuagucccacccacaguagaaucacgcaccaaacccuucuccguccccguacucaccgucgaagaaaugacaaacucccgcuucccaauaccacucgaaaaacucuucaccggccccagcuccgccuucguaguccagccgcaaaacggccgcugcaccacagacggcguccugcucgguacaacacaacuaucucccgucaacauaugcaccuuccgcggagacgucacccacaucaccggaucccguaacuacacgaugaacuuagccagccaaaacuggaacaacuacgaccccaccgaagaaaucccagcccccuuaggcacccccgacuucguaggaaaaauccaaggcguccucacccaaaccacccgcaccgacgguuccacccgcggacacaaagccaccgucuacaccggcuccgccgacuuugcccccaagcucggccgaguccaauucgagaccgacacagaccacgacuucgaagccaaccagaacacaaaauucaccccugucgguguaauccaggacggaggaaccacacaucgcaacgaaccccagcaauggguccucccauccuacagcggccguaacacccacaacguccaccucgcccccgcaguagcucccacauucccgggcgaacaacuccucuucuuccgcucgaccaugccaggcugcucaggcuaucccaacauggaccucgauugccuacuuccccaagaauggguccaauacuucuaccaagaggcagcccccgcacaauccgacgucgcccuccuucgauucgucaaccccgacaccggucgcguccucuucgaaugcaaacuccacaaauccggcuacgucacugucgcccauacaggucaacacgaccucgucaucccucccaacggcuacuuccgauucgauuccuggguaaaccaauucuacacuuuagcacccaugggcaacggcaccggccgccgcagagcaguauag

SEQ ID NO: 35941 - RNA, 1623 nt, Artificial Sequence
  derived and/or modified sequence opt11 from VP1__Norovirus__AGS08035
augaaaauggccuccuccgacgcaaaccccuccgacggcuccaccgccucccuuguccccgaaguuaacaacgaagucauggcccucgaaccagucguaggugcagcgaucgccgcucccgucgccggccaacaaaaugucaucgaucccuggauacgcaacaacuucguccaagcccccggcggagaguucaccgucuccccacgcaacgcaccaggcgaaauacuauggucggcaccgcucgguccugaccucaaccccuaccuaucacaccucgccagaauguauaacuccuacgccggcggauucgaaguccaaguaauacucgcaggcaacgcauucaccgccgguaaaaucauauucgccgcagucccucccaacuucccaacagaaggccuuucucccucccaagucacuauguucccccacaucaucgucgacguccgccaacucgaacccguccuaaucccuuuaccagacguccgaaacaacuucuaucacuacaaccaaucaaacgaccccaccaucaaauuaauagcaaugcuauacacaccccuucgcgccaacaacgcaggcgacgacgucuuuacugucuccugccgcguccucacacgcccuuccccagacuucgauuucaucuuucuaguacccccgaccgucgaaucucgcacuaaaccauucuccgucccaguccuaaccgucgaagaaaugaccaauucacgcuuccccaucccacucgaaaaacuauucaccggccccucauccgccuucgucguacaaccccaaaacggccgaugcaccacagacggcguccuacucggcacaacccaacucucaccagucaacauuugcacauuucgcggcgacgucacucacauauccggcucccacaacuauaccaugaaccuagccucccaaaacuggaacuccuacgaccccaccgaagaaauccccgcccccuuaggaacacccgacuucguugggaaaauucaaggcguucucacccaaacaacccgaaucaacggcuccacucgagggcacaaagccaccgucuacaccggauccgcagacuucucccccaaacucggacgcgugcaauucgcaaccgauacagacaacgacuucgaaaccaaccaaaacacuaaauucacccccguaggcgucauccaagacggcuccacaacaccccgcaacgaaccccaacaauggguucuccccuccuacucaggccgcaacacccacaaugugcaucuugccccugccgucgccccuacauuccccggggagcaacuccucuucuuccguucgacuaugcccggaugcucaggcuacccaaacauggaccucgauugccuccucccccaagaauggguacaauacuucuaccaagaagccgcacccgcacaaucagacguagcccuccuacgcuucgucaacccagacacaggacgcguacucuucgagugcaaacuacacaaaucugguuaugucacagucgcccacaccggccagcacgaccucgucaucccacccaacggcuacuuccgcuucgacuccuggguaaaccaauucuacacacuagcccccaugggcaacggcaccggccgucgacgcgcccuauaa

SEQ ID NO: 35942 - RNA, 1623 nt, Artificial Sequence
  derived and/or modified sequence opt11 from VP1__Norovirus__AGS08036
augaaaauggccuccuccgacgccaaucccucagacggcuccacggccaaccuaguaccggaaguaaacaacgaagucauggcccuugaaccagugguaggagccgccaucgcagccccagucgccggccaacaaaacgucauagaccccuggauccgcaacaacuucguccaagcacccggaggcgaauuuaccgucagccccagaaacgcccccggcgaaauacucuggucugcaccacuuggcccagaccucaacccuuaccucagccaccuagccagaauguacaacggcuacgcaggcggcuucgaaguccaagucauccuagccggcaacgccuucaccgccggcaaaauuaucuuugccgccguaccacccaacuuccccaccgaaggccucucaccaucccaagucaccauguuuccacacauaaucgucgacguccgacaacucgaaccaguacuaaucccccucccagacguacgaaacaacuucuaccacuacaaccaauccaacgacccaaccaucaaacuuauagcaaugcucuacacaccccuacgcgccaacaacgccggcgaugacgucuucaccguuuccugccgaguccuuacacgcccauccccagacuucgacuucauauuccuuguucccccaaccgucgaaucccgaaccaaacccuucuccguacccguccucacugucgaagaaaugacaaacucucguuuuccuaucccccucgaaaaacuuuucaccggacccucgagcgcauucgucguccaaccccaaaacggcagaugcaccaccgauggcgucuuacucggaaccacccaacucucaccaguuaacaucugcaccuuccgaggcgacgucacacacaucucaggcucccgcaacuacacaaugaaccuugccagccaaaacuggaacuccuacgaccccaccgaagaaauccccgcaccccuaggcacccccgacuucgucggcaaaauccaaggaguccucacucaaaccacucgaacggacgguuccacccgcggccacaaagccaccgucuacaccgguuccgccgauuucucccccaaacuaggucgaguccaauucgccaccgacaccgacaacgacuucgucaccaaccaaaacacaaaguucaccccggucggagucauccaggacggcucaacaacaccucgaaacgaaccacaacaauggguccucccaucguacuccggccgcaauacccacaacguccaucucgcacccgccgucgccccuacauuccccggggaacaacuccuauucuuccgcagcaccaugccagguugcucaggcuauccaaacauggaccuagauugccugcuaccccaagaauggguacaauacuucuaccaagaagcagcccccgcacaauccgacgucgcccuccuccgcuucguaaaccccgacacaggacguguccucuucgaaugcaaacuccacaaaagugguuacgucaccgucgcccacaccgggcaacacgaccucguuauucccccuaacggcuacuuccguuucgacucaugggucaaucaauucuacacccuagccccaaugggaaacggaaccggaagacgcagagcccuauaa

SEQ ID NO: 35943 - RNA, 1623 nt, Artificial Sequence
  derived and/or modified sequence opt11 from VP1__Norovirus__AGS08037
augaaaauggccuccucugacgcaaaccccagcgacggcucaacagcuaaccuaguucccgaagucaacaaugaagucauggcccucgaacccgugguaggcgcagccauagcagcccccgucgcaggccaacaaaacgucauagaccccuggauccgcaacaacuucguacaagcacccggcggcgaguucacagucagcccaagaaacgccccaggcgaaauccucuggucagcuccacucggcccagaccucaaucccuaccuuucccaccucgcacgaauguacaacggcuacgccggaggcuuugaaguucaaguaauacuggcaggcaaugccuucaccgcaggcaaaaucaucuucgccgcaguaccaccaaacuuccccaccgaaggccucucccccucccaaguaacaauguucccacacaucauugucgacguccgacaacucgagcccgucuuaaucccccucccagacguccggaacaacuucuaccacuacaaccagucaaacgaccccacuaucaaacucauagccaugcucuacacaccccucagagcaaacaaugccggcgacgacgucuucacaguauccugccguguacucacccgccccagccccgacuucgacuucaucuuccucguacccccaaccgucgaaucacgaacaaaacccuucucagucccuguccucaccgucgaagaaaugaccaacucgcgauucccaauaccgcuagaaaaacucuucaccggcccauccuccgccuucgucguccaaccacaaaacggaagaugcaccacggauggaguacuccuuggaacuacccaacugagccccgucaacaucugcaccuuccgaggcgaugucacccacauccccgguuccaggaacuacaccaugaaccuagccucacaaaacuggaacuccuacgaucccacagaagaaaucccugcaccccucggcacucccgacuuuguaggcaaaauccaaggaguccuaacccaaaccacuagaaccaacggcuccacccgaggccacaaagccacuguauacacaggcuccgccgacuucucccccaaacucggccgaguacaauucgccaccgacaccgacaaugacuucgaaacaaaccaaaacacaaaauucacccccgucggcgucauccaagacggcuccacgacaccccggaacgaaccacaacaauggguccuccccucuuacucaggacgcaacauccacaacguccaccuagcccccgccgucgcccccaccuuccccggagaacaacuauuauucuuccgcucuaccaugcccggaugcuccggauaccccaacauggaucucgacugccuacucccacaagaauggguccaauacuuuuaccaagaagccgccccagcccaauccgacguagcccuccuccgcuucgucaacccagauaccggacgaguccucuucgaaugcaaacuacacaaauccgguuacgucacagucgcccacaccggacaacacgaccugguaaucccucccaacggcuacuuccgauucgacuccuggguaaaccaauucuacacacucgcccccaugggcaacggaaccggccgacgccgcgcccuguaa

SEQ ID NO: 35944 - RNA, 1623 nt, Artificial Sequence
  derived and/or modified sequence opt11 from VP1__Norovirus__AGS08038
augaagauggccuccucagacgccaaccccagcgacggcucugcagccaaccuagucccagaaguaaacaaugaagucauggcccuggagccagucgucggugccgccaucgccgcccccguagccggucagcagaacgucaucgacccauggauucgcaacaacuucguccaagcccccggcggcgaguucaccguuucaccccgcaacgcccccggcgaaauacucugguccgccccacucggucccgaccucaaccccuaccucucccaccuugcacgcauguauaacggcuacgccggcggcuucgaaguccaagucauccucgcaggcaacgccuucaccgccggaaaaguaaucuuugccgcugucccaccuaacuucccaaccgaaggcuuaucuccaucccaagucaccauguuuccacacaucgucgucgacguccgacaacuagaacccguauuaaucccccuacccgacguacgcaacaacuucuaccacuauaaucaaucaaacgacccaaccaucaagcucaucgccaugcucuacacaccccuucgagccaacaaugcaggcgacgacgucuucaccguuagcugccgcguccucacccgacccuccccagacuucgacuucaucuuccuuguacccccuaccgucgaaucccgcaccaaacccuucuccguccccguccucaccgucgaagaaaugacaaauucccguuuucccauaccacuagaaaaacuauucaccggacccuccuccgcauucgucguccaaccccaaaacggccgaugcaccaccgacggcguacuccucggaaccacccaacuaucccccguaaacauaugcaccuuucgaggugacguuacccacaucacaggcucucguaacuacaccaugaaccucgccagccaaaacuggaacaacuacgaccccacugaagaaauccccgccccucucggaacaccugacuucguaggcaaaauccaaggaguccuaacccaaacuacucgaacagacgguucuacacgcggccacaaagcaacugucuacacaggaucugccgacuucgccccaaaacuaggacgcguccaauucgaaacagacaccgaccacgacuucgacgccaaccaaaacaccaaauucacccccguaggugucauccaagacggcggaaccacccaccgcaaugaaccacaacaauggguacuccccucauacucuggacgaaacacccacaacguccaccucgccccagccgucgccccuacauucccuggagaacaacuccucuucuuucgcagcacaaugccaggcugcuccggcuacccaaacauggaccucgacugucuacucccacaagaauggguacaauacuucuaccaagaagcagcccccgcccaaucagacgucgcccugcuccgauucgucaaccccgacacuggccgaguccuuuucgaaugcaaacuucacaaaucuggcuacgucaccguagcacauaccggacaacacgaccucgucaucccgcccaacggcuacuuccgcuucgacuccugggucaaccaauucuauacacuugcuccaaugggcaacggcaccggccgccgacgcgcagucuaa

SEQ ID NO: 35945 - RNA, 1623 nt, Artificial Sequence
  derived and/or modified sequence opt11 from VP1__Norovirus__AGS08040
augaaaauggccuccucagacgcaaaccccuccgacggguccaccgcaaaccuugucccagaaguaaacaacgaagucauggcccuagaacccgucgucggcgcugccauagcugccccagucgccggacaacaaaacgucauagacccauggauccgaaacaacuucguccaagcaccaggaggagaguucacggucucaccccgaaacgcaccuggcgaaauccucugguccgcaccccugggccccgaccuuaaccccuaccucucccaccuagcccgcauguacaacggcuacgcaggcggauucgaaguacagguaauacucgccgguaaugcauucaccgccggaaaaaucauauucgccgccgucccacccaacuuucccaccgaaggucucagccccucucaagucacaauguucccccacaucaucgucgacgugaggcagcucgaacccguacucaucccauuacccgacgugcgaaacaacuucuaccacuacaaccaaagcaacgaccccaccauaaaacuaauagcgaugcucuacacuccacuacgagccaacaacgccggcgacgacgucuucaccgucucuugcagaguccucacucgccccucaccugacuucgauuucaucuuccucgucccaccaacagucgaaucccgaacaaagccauucucaguccccguucuuaccguggaagaaaugacgaacucacgcuuccccauuccccuggaaaaacucuucacaggccccuccagcgccuucgucguacagccccaaaacggaagaugcaccaccgacggcguauuacucggcaccacacaacuuucaccgguuaacauaugcaccuuccgcggagacgucacccacauacccggcucccgaaacuauaccaugaaccuugccucccaaaauuggaacuccuacgaccccaccgaagaaauaccagcaccccucggcaccccagacuucguaggcaaaauacaagguguccucacccaaaccacccgcacaaacggcucaacccgcggccacaaagccacagucuacaccggauccgccgacuucagccccaaacuaggccgcguccaauuugccaccgacaccgacaacgacuucgaaaccaaccaaaacacuaaauucacccccgucggggucauccaggacggauccaccaccccacgaaacgaaccacagcaauggguacuccccuccuacuccggacgcaacauccacaacguccaccucgcccccgccguugccccuaccuucccaggcgaacaacuucuauucuucagauccaccaugcccggcugcucaggauaccccaacauggaccucgacugccuccuuccccaagaauggguccaauacuucuaccaagaagccgccccagcccaauccgacguagccuuacuccgcuucguaaaccccgacaccggcagaguccucuucgaaugcaaacuccauaaaucaggcuacguaaccguagcccauaccggccaacacgacuuagucaucccacccaacggcuacuuccgcuucgacucuugggucaaccaauucuacacacuggccccuaugggcaacggaaccggccgccgccgcgcacucuaa

SEQ ID NO: 35946 - RNA, 1623 nt, Artificial Sequence
  derived and/or modified sequence opt11 from VP1__Norovirus__AGS08041
augaagauggcauccucagacgcaaaucccucagaugguucaacagccaaccucgucccagaagucaacaacgaagucauggcucucgaaccaguaguaggagccgccauagccgcacccguagccggacaacaaaaugucaucgaccccuggauacgcaacaacuucgugcaagcccccggcggcgaguucacuguuucuccccgcaacgcccccggcgaaauccucuggagcgcaccccucggccccgaccucaaccccuaccucucucacuuagcccguauguauaacggcuacgccggcgguuucgaaguccaaguaauccuagccggaaacgccuucacugcuggcaaaaucaucuucgccgccgucccacccaacuuucccacagaaggccuuucucccucccaaguaaccauguucccccacauuaucgucgacguucgucaacucgaacccgugcucaucccucuccccgacguccgcaacaauuucuaccacuacaaccaauccaacgacccuaccaucaaacuaaucgcaaugcucuacacaccccuucgcgcaaacaacgccggcgacgacguguucaccguaagcugccgcguccucacccgcccauccccugauuucgacuucaucuuucuuguacccccaaccguagaaucacgcaccaaacccuucucaguacccguacuuacagucgaagaaaugaccaacucucgcuuccccauaccucucgaaaaacucuucaccggaccguccucagccuucgucguacaaccccaaaacggacgcugcaccaccgacggcguacuccucggaaccacccaacucuccccuguaaacaucugcaccuuccgaggagacguaacacacaucuccggcucgcguaauuacaccaugaaccucgccucacaaaacuggaacucuuacgaccccaccgaagaaauccccgccccuuuaggcaccccugacuucguugguaaaauccaaggcguccuaacccaaacaacucgcacugacggcuccacccguggccacaaagcuaccgucuacaccggcagcgcagacuucagucccaaacuuggccgcguccaguucgccaccgacaccgauaacgacuucgucaccaaccaaaacaccaaauucaccccuguuggcgucauccaagacggcucaaccaccccucgaaacgaaccccaacaauggguccuccccucauauuccggccgcaauacccacaacguacaccucgcccccgccguggcacccacauucccaggcgaacaacuacuuuucuuccgcucaacuaugcccggcuguuccggcuauccuaacauggaccuagauugccuacucccacaagaauggguccaauacuucuaccaagaagcagcccccgcccaaucugacgucgcccuucuccgcuucgucaacccagacaccggccgcguucucuuugaaugcaaacuacacaaaagcggcuacgucaccgucgcccacaccggccaacaugaccucguuaucccacccaacggcuauuuccgcuucgacucaugggucaaccaauucuacacccucgcucccaugggaaacggcacaggacgccgucgagcccucuaa

SEQ ID NO: 35947 - RNA, 1623 nt, Artificial Sequence
  derived and/or modified sequence opt11 from VP1__Norovirus__AGS08042
augaaaauggcaucauccgacgccaacccauccgacggcuccacagccaacuuaguccccgaagucaacaacgaagucauggcccucgagccagucgucggugccgccaucgccgcuccagucgccggccaacaaaacgugauagaccccuggauaagaaacaacuucguacaagccccaggcggcgaauuuacuguaucaccgcgaaaugcccccggcgaaauccucugguccgccccacucggccccgaccucaacccauaucuaucccaccucgcccgaauguauaacggauaugccgguggcuuugagguccaagucauccuagcuggaaacgcauucaccgccggcaaaauaaucuucgccgccguacccccuaacuuucccaccgaaggccuuucacccucacaagucaccauguuuccccacaucaucgucgacguccgccaacuugaacccguccucaucccccuaccagacguccgcaacaacuucuaccacuacaaccaauccaacgacucaacuauaaaacuaaucgccaugcucuacacaccccuacgcgcuaacaaugcgggagacgacgucuucaccgucagcugccgaguacucacccgcccaucccccgacuucgacuucauauuucucgucccacccaccgucgaaucccguaccaaacccuucuccguccccguccucaccgucgaagaaaugaccaacucccgcuuucccaucccccucgaaaaacuauucaccggaccaucgucugcauucgucguccaaccucagaauggacgcugcaccacagauggcguccuccuaggcaccacacaacucucacccguaaacaucugcacauuccguggcgacguuacccauaucccuggcucccguaacuacacaaugaaccucgcaucacaaaauuggaacucauacgacccuacagaagaaauccccgccccacucgguacacccgacuucgucggcaaaauacaaggcguccucacccaaacgacccgaaccaacggauccacaagaggccacaaagccaccgucuauacuggcuccgccgacuucucacccaagcucggucgcguucaauucgcuacagacaccgacaacgacuucgaaacuaaucaaaauaccaaauuuaccccagucggaguuauccaagacggcucaaccaccccacgcaacgaaccccagcaauggguccuacccucauacucgggacgaaacauccacaacguccaccucgcaccagccgucgcuccaaccuucccaggcgaacagcuacuauucuuccgcuccaccaugcccgguugcucuggcuacccaaacauggaccucgacugccuccucccacaagaauggguacaauacuucuaccaagaagccgcccccgcccaauccgacgucgcacuacuacgcuucgucaacccagacaccggccgcguacucuucgaaugcaaacuccauaaaucaggcuacgucaccgucgcucacaccggacaacaugacuuagucaucccaccgaacggcuacuuccgauuugacuccugggucaaccaguucuacacccucgcucccaugggcaacggcacaggccggcgccgcgcccuauaa

SEQ ID NO: 35948 - RNA, 1623 nt, Artificial Sequence
  derived and/or modified sequence opt11 from VP1__Norovirus__AGS08043
augaagauggccucauccgacgcaaaccccucagacggcagcacagccaaucucguacccgaagucucuaacgaaguaauggcccucgaaccaguagucggcgccgccauagccgcccccguugccggccaacaaaaugucaucgaccccuggauacgcaacaacuucguccaagcacccggcggcgaguucaccguaucaccccguaacgcccccggcgaaauccucugguccgcaccacucggcccagaccucaacccauaccuuagccaccucgcccgcauguacaacggcuacgcgggcggcuucgaaguacaagucauacucgccggcaaugcauucaccgccggcaaaaucauauucgcugccguacccccaaacuuccccaccgaaggacuaucgcccucccaagucaccauguucccccacaucaucguggacguccgucaacucgaacccguacucaucccccuaccagacgucagaaacaacuucuaccacuacaaucagucaaacgacuccacaaucaaacucaucgccaugcuauacacaccccuacgcgccaacuccgccggagacgacgucuucaccguauccugccgaguccucacccgacccucaccagacuucgacuucauauucuuagucccgcccaccgucgaaagccgcaccaagcccuucagcgucccuauccucaccgucgaagaaaugaccaacucacgauucccgaucccccucgagaaacucuucaccggccccucuucagcguucguugugcaaccacaaaacggcagaugcaccaccgauggaguccuccucggcacaacacaauuaagccccgucaacauuuguacauucagaggugacgucacccacauucccggcucucacaacuacaccaugaaccucgccucucaaaauuggaacagcuaugaccccaccgaagaaauaccggccccacucggcaccccggacuucgucggcaaaauacaaggcguccucacccaaaccaccuccacgaauggcagcacacgagggcacaaagccaccgucuacacaggaagcgcugacuucucucccaaacucggccgcguacaauucgccacagauacaaacaacgacuucgaaaccaaccaaaacaccaaauucacuccagucggcgucauccaggacgguaguacgacaccccgaaacgaaccccaacaaugggugcuccccucauacucuggccgcaacauccacaacguccacuuagcccccgccguagcccccaccuuccccggugaacaacuccucuucuuccgguccaccaugcccggcugcuccggcuacccaaacauggaucuagacugccuacucccacaagaauggguccaauacuucuaucaagaagccgcaccagcucaauccgacguagcacuccugcgcuucgucaacccagacaccggcagaguccuauucgaaugcaaacuacacaaauccggcuacaucaccguagcacacaccggccagcacgaccuagucauaccaccaaacggcuacuuccgcuucgacucaugggucaaucaauucuacacccucgcccccaugggcaacgggaccggccgacgccgggccuuauga

SEQ ID NO: 35949 - RNA, 1623 nt, Artificial Sequence
  derived and/or modified sequence opt11 from VP1__Norovirus__AGS08044
augaaaauggcuucuuccgacgcaaaccccucagacggcucuaccgcaaaccuaguccccgaaguaaacaacgaagucauggcacucgaacccguagucggagcagcaaucgccgccccggucgcuggccaacaaaacguaaucgaucccuggauucgcaauaacuucguacaagcacccggcggcgaguucaccguuucgccccgcaacgcaccuggagaaauccucugguccgcuccccucggacccgaccucaaccccuacuuaagucaccucgccagaauguacaacggcuacgccgguggcuucgaaguacaagucaucuuagcaggaaacgccuucacagccggcaaaaucaucuucgcagccgucccucccaacuuccccacagaaggccuaucgcccucccaagucaccauguucccucacaucauagucgacguccgccaacucgaaccaguccuaaucccacuccccgacguucgaaacaacuucuaccauuacaaccaaucaaacgacagcaccaucaaacuuaucgcaaugcuauacacuccccuucgcgccaauaacgccggagaugacgucuucacuguauccugucgcguacucacccgacccucacccgacuucgacuucauauuccuaguuccacccaccgucgaaucccgaacaaaacccuucucaguacccauccuaacugucgaagaaaugaccaacucucgcuuccccaucccccucgaaaaacucuucaccggccccagcuccgcauucguaguucagccgcaaaacggccgaugcaccaccgacggcguccuucucggcaccacacaacucucccccgucaacauaugcaccuuccgcggcgacgucacacauauccccgguucccacaacuacaccaugaaccuggccucucaaaacuggaacagcuacgaucccaccgaagaaauccccgccccacucggcacccccgacuucgucggaaaaauccaggguguccuaacacaaaccaccucgaccaacggcucaacccgaggucacaaagcuaccguuuauacaggcucagcagacuuuucuccaaaacucggacgcguccaauucgccacagacacaaacaacgacuucgaaaccaaccaaaacaccaaauucacccccguuggcguaauccaagacggcucgaccaccccgcgcaacgaaccccaacaauggguccuacccucauacuccggacgcaacauccacaacguccaccuugcccccgccgucgccccaacuuuccccggggaacagcuccucuucuuccgauccaccaugcccggaugcucagguuacccuaacauggaccuagauugccuucucccccaagaauggguacaauacuuuuaccaagaagcugcacccgcccaauccgacgucgcccuacuacgcuucguaaacccagacaccggccgaguacuuuucgaaugcaaguuacacaaauccggcuacgucaccgucgcccacaccggacaacacgaccucgucauaccacccaacgguuacuuccgauuugauucaugggucaaccaauucuacacccuugcccccaugggcaacggaacaggacgccgccgcgcccucuaa

SEQ ID NO: 35950 - RNA, 1623 nt, Artificial Sequence
  derived and/or modified sequence opt11 from VP1__Norovirus__AGS08045
augaaaauggccucuucugacgcuaaccccucugauggcuccaccgcaaaccuaguuccagaggucaacaacgaagucauggcccuagaaccagucgucggcgccgcaaucgcagcaccagucgcgggccaacaaaaugucaucgaccccuggauccgcaacaacuucguucaagcaccuggcggcgaguucacagucuccccacggaacgccccaggcgaaauccucuggucagcccccuuaggccccgaucucaaucccuaccugagccaccuagcccgaauguacaacggauacgccggcggcuucgaaguacaagucauccuagccggcaacgcguucaccgccgguaaaaucaucuucgccgccgucccaccuaacuucccaaccgaaggacuaucucccucccaagucacuauguucccccacaucaucgucgauguccgccaacucgaaccgguccuaaucccccuacccgacguaagaaacaacuucuaccacuacaaccaaucaaacgaccccaccaucaaacuaauagcgaugcucuacacaccccuccgugcaaacaacgccggcgacgacguuuucaccgucuccugucgcguccucacccgccccuccccagacuuugacuucauauuccucguacccccgaccguugaaucccgaacaaaacccuucuccguacccguacucaccgucgaagaaaugaccaacucacgcuuccccgucccucucgaaaaacuuuucaccggcccaucaucagcauuugucguccaaccccaaaacggccgcugcaccaccgauggcguccuccuuggcacgacccaacuauccccugucaacaucugcacauuccgcggcgacgucacccacaucaccggcuccagaaacuacaccaugaaccuagcaucccagaacuggaacuccuacgaccccaccgaagaaaucccagcuccccucggcacccccgacuucgucggaaaaauccaaggagugcucacccaaaccacucguacaaacggaucaacacgaggccacaaagccaccgucuacaccggaucagcugacuucucacccaaacucggacgaguccaauuugcaacagauacagauaacgacuucgaaacaaaccaaaacaccaaauucacacccguaggcgucauccaagauggaucaaccacuccccgcaacgaaccucaacaauggguacucccaucauacucaggccgaaacauccacaacguccaccucgcccccgccgucgcacccaccuuccccggagaacaacuccuauucuuccgcuccaccaugcccggcuguuccggcuaccccaacauggaccucgacugccuacucccccaagaauggguacaguacuucuaucaagaagccgcccccgcccaaucugacgucgcacuacucagauucguaaaccccgacaccggccgcguauuauucgaaugcaaacuacacaaaagcggcuaugucaccguugcucacacaggucaacaugaccuugucaucccacccaauggcuacuuccguuucgacuccugggucaaccaauucuacacacuugcccccauggguaacggaaccggcagacggcgagcacucuaa

SEQ ID NO: 35951 - RNA, 1623 nt, Artificial Sequence
  derived and/or modified sequence opt11 from VP1__Norovirus__AGS08047
augaaaauggcauccucagaugcaaaccccagcgacggaaguaccgccaaccucguacccgaagucaacaacgaagucauggcccuugaaccagucgucggcgcggccaucgccgcuccaguagccggccaacaaaacgucauagaccccuggauccgcaacaacuuuguucaagcacccggaggcgaguucacaguaagcccccgaaacgcuccaggugaaauccuaugguccgccccacucggaccagaccucaacccauaccuaucccaccucgcacgcauguacaacagcuacgccggcgguuucgaaguccaagucauccucgcaggaaacgccuucaccgcaggaaagaucauauucgccgccgucccaccaaacuuccccacagaaggccucucacccucucaagucaccauguuuccccacaucaucguagacguucgccaacucgagcccguccucaucccacuaccagacgugcgaaacaacuucuaccacuacaaccaaucaaacgaccccacaauuaaacuuauagccaugcucuacacaccccuaagagcaaacaacgcaggcgacgacgucuucaccguuucaugccgaguccuuacccgcccuuccccagacuucgacuucauuuuccucgucccacccacagucgaaucucggacuaaacccuucucaguccccguacuaacaguagaagaaaugaccaacuccagauuccccaucccccucgaaaaacucuucacuggccccuccagcgcauucguaguacagccacaaaacggacgaugcaccaccgacggaguccuucucggaaccacacaacugucacccgucaacaucugcaccuuccgcggcgacguaacccauauauccggaucccguaacuacaccaugaaccucgcuucccaaaacuggaacucauacgaucccaccgaagaaauaccagccccacucggaacucccgacuucgucggcaaaauacaaggcguacuuacccagaccacccgaacugacggcuccacacgaggccacaaagcgaccgucuacacuggcucagccgauuucucccccaaacuaggacgcguccaauucgcuacagacacagacaacgacuucgucacaaaccaaaacaccaaauucacucccgucggagucauccaagacggcuccaccacaccccgcaacgaaccucaacaauggguccuccccucauacagcggccgaaacacccacaacguccacuuagcccccgccguagccccaaccuuuccgggcgaacaacuucucuuuuucagauccaccaugccuggaugcagcggcuaccccaacauggaccuagacugccuacuaccacaagaauggguccaauacuucuaccaagaagcugcacccgcccaguccgacgucgcccuccuacgauucgucaaccccgacaccggaaggguccucuucgaaugcaaacuacacaaauccggauacgucacugucgcgcacaccggacaacacgaucucguuaucccacccaauggcuacuuccgauucgauuccugggucaaccaauucuacacccucgccccaaugggaaacggaaccggccgucgacgagcccuuuga

SEQ ID NO: 35952 - RNA, 1623 nt, Artificial Sequence
  derived and/or modified sequence opt11 from VP1__Norovirus__AGS08048
augaaaauggcaucauccgacgcaaaccccuccgacggaucuaccgcuaaucuaguccccgaaguaaacaacgaaguuauggcccucgaacccguagucggcgccgcuaucgccgcccccguagccggccaacaaaacgucauagacccauggauucgcaacaacuuuguccaagccccaggaggcgaauuuaccgucucaccccgcaacgcccccggagaaauccucugguccgcaccccuaggaccagaccuaaaccccuaccuaucccaccucgcccgaauguacaacggauacgccggcggcuucgaaguccaagucauccuagcuggcaacgccuucacugccggcaaaaucaucuucgccgccguacccccaaauuuccccaccgaaggacuauccccaucccaagucaccauguucccccacaucaucgucgacguccgacaacucgaaccaguauuaauaccccuccccgacguacguaacaacuucuaccauuacaaccaaucuaaugacccaaccauaaaacuaauagcuaugcucuauaccccacucagagcuaacaacgccggcgacgacguauucaccgucucuugccgcguccugacacgaccuuccccagacuucgacuucauauuccuagucccacccaccgucgaaucucgcaccaaacccuuuuccguucccgugcuaaccgucgaagaaaugaccaacucacgcuucccuauaccccuugaaaaacucuucaccggcccauccuccgcauucgucguacaaccccaaaacggacgcugcacgacagacggcguccuccuaggcaccacccaacucucacccgucaacaucugcaccuuuagaggagacgucacacacaucuccggcucucgcaacuacacaaugaaucuagccagccaaaacuggaacuccuacgaucccacagaagaaauccccgcaccccucggcaccccugacuuugucgguaaaauccaaggcguucuaacacaaaccacccguaccgacggcucaacccgagggcacaaagccaccgucuacacuggcucagccgacuucucgccgaaacuaggccgcguacaauucgccaccgauacugacaacgacuucgucaccaaccaaaacaccaaauuuacccccgucggcguaauccaagacggcuccaccacuccccgcaacgaaccacaacaauggguccucccauccuacucaggccgaaacacacauaacguccaccucgcacccgccguagcccccacguuuccaggugaacaacuccucuucuuccgaucaacgaugcccggcugcuccggauaucccaacauggacuuagacugccuccucccccaagaauggguccaauacuucuaccaagaagcugcccccgcccaauccgacgucgcccuccuccgauucgucaacccugacaccggaagaguccuuuucgaaugcaaacuucacaagucgggcuacgucaccgucgcccacacaggccagcaugaccuagucaucccacccaacggcuacuuccgauucgacucgugggucaaccaauucuacacccucgcccccaugggaaacggcacuggccgccgccgagcccucuaa

SEQ ID NO: 35953 - RNA, 1623 nt, Artificial Sequence
  derived and/or modified sequence opt11 from VP1__Norovirus__AGS08050
augaaaauggcguccucagacgccaaccccuccgacggcucagcagcaaacuuaguucccgagguuaacaacgaaguaauggcccuugaacccgucgucggcgcagcaaucgccgcccccgucgccggccagcaaaacguaaucgaccccuggauccgcaauaacuucguccaagcacccggcggagaauuuaccgucucaccccgcaacgcccccggagagauccucugguccgcaccccuggggcccgaucuuaaccccuaccucucccaccucgcacgcauguauaacggcuaugcaggcggcuucgaaguccaagucauccucgccggcaacgcuuuuaccgcaggaaaaguaaucuucgccgccguacccccaaacuucccaaccgaaggccuauccccuucccaaguuaccauguuuccccacaucgucguagaugucagacaacucgaacccgucuuaaucccccuucccgacguacgaaauaauuucuaccacuacaaccaauccaacgauccaaccaucaaacuuaucgccaugcuguauacaccccucagagcuaacaacgccggagacgacgucuucaccguauccugucgcguccucacccgccccuccccugacuucgacuucauauuccucguacccccaaccgucgaaucccgcacaaaacccuucuccgucccaguacucacugucgaagaaaugacuaacucacgauuccccaucccccucgaaaaacucuucaccggccccuccucugccuucgucguacaaccucaaaacggccgaugcacaacggacggcgucuuacucggcaccacccaacucucccccgucaacaucugcaccuuucgcggcgauguuacccacauaaccggcucacgcaacuauaccaugaaccucgcaagccaaaacuggagcaacuaugacccaacagaagaaauacccgcaccacucggaacccccgacuucgucggcaagauccaaggcguccucacccaaacaacccgcacugacggaagcacccgcggacauaaagcaaccgucuacaccggcucagccgacuucgcccccaagcucggcaggguacaauucgaaacagacacugaccaugacuucgaagccaaccagaacaccaaauucacuccugucggcgucauccaggacggcucaaccacucaccgaaacgaaccucaacaauggguccucccauccuacuccggcagaaacacacccaacguccaccuugcacccgccgucgcaccuaccuuccccggagaacaacuccucuucuuccgcuccacaaugccagguugcuccggcuaccccaacauggaccucgacugccuacuaccccaagaauggguacaauacuucuaccaagaggcagcgccugcccaaucagacguagcccuccuccgauucguaaacccugacaccggacgaguacucuucgagugcaaacuccacaaaagcggguacgucacagucgcccacaccggacaacacgaccucguaauaccacccaacggcuauuuccgguuugauuccugggucaaccaguucuacacccucgcccccaugggaaacgguaccgggcgccgacgcgcccucuaa

SEQ ID NO: 35954 - RNA, 1623 nt, Artificial Sequence
  derived and/or modified sequence opt11 from VP1__Norovirus__AGS08051
augaaaauggccucauccgaugccaaccccucugacggauccaccgcuaaucugguccccgaagucaacaacgaagucauggcucuagaacccgugguaggagcagccaucgccgcccccgucgccggacaacaaaacgucauagaccccuggauccgcaacaacuuuguccaagcacccggaggagaauuuaccguuuccccacgcaacgcucccggcgaaauccucuggucggcaccccucggaccagaccucaacccauaccuaucacaucucgcccgaauguacaacggcuacgccggaggcuucgaaguucaagucauccucgccggaaacgccuucaccgcuggaaaaauuauuuucgccgcagucccacccaacuuccccacagaaggacucucacccucccaaguuacaauguucccccauaucaucguugacguacgacaauuagaacccguccuaaucccccuccccgacguccgcaacaacuucuaccacuacaaccaauccaacgaccccaccaucaaacuuaucgcuaugcuauacacaccccuccgagccaacaacgccggcgacgacguauucaccgucuccugccgcguccucacccgucccucacccgacuucgacuucaucuuccucgugccaccaaccguggaaucccgcaccaaacccuucucuguccccguccucacaguagaagaaaugaccaacucacgauucccaaucccccucgaaaaacuauuuaccggacccuccuccgcuuucgucguacaaccacaaaacggcagaugcacaacagacggcguccuucucggcaccacccaacuuucuccagucaacaucugcgccuuccgaggugacgucacccauaucagcggaucccgaaacuacaccaugaaccuagccucccaaaacuggaacucuuacgaccccaccgaagaaauccccgcaccccuaggcacccccgacuucgucgguaaaauccaaggaaugcuaacccagaccacccguaccgacggcagcacacgaggccacaaagcaaccguuuacaccgguuccgcagacuucagcccaaagcuaggacgcguccaauucgccacagacaccgauaacgacuucgucaccaaccaaaacaccaaauucacccccguaggaguaauacaagacggcucuaccacuccccgaaacgaaccccagcaguggguccuccccucauacucaggacgcaacacccacaacguacaccucgccccagcagucgccccaacauuucccggcgaacaacuccucuucuuccgcuccaccaugcccggaugcuccggauaccccaacauggaccuagacugccuccuuccccaagaauggguacaauacuucuaccaagaagcagcacccgcccaaucugacgucgcucuccuccgcuucgucaaccccgacaccggccguguacuauucgaaugcaaacuccauaaaucgggauacgucacaguagcacacaccggacaacacgaccucguaaucccuccaaacggauacuuccgcuucgacucaugggucaaucaauucuacacacuugcccccaugggcaacggcaccggucgacgacgcgcccucuag

SEQ ID NO: 35955 - RNA, 1623 nt, Artificial Sequence
  derived and/or modified sequence opt11 from VP1__Norovirus__AGS08052
augaaaauggcauccucagacgccaaccccuccgacggaucagcagccaacuugguaccagaaguaaacaaugaaguaauggcacuugaacccgucgucggagcagccauagccgcccccguagccggccaacaaaacgucauugaucccuggauccgcaacaacuucguacaagcccccggaggugaguucaccgucucaccccgcaacgcccccggugaaauccuuugguccgccccucuaggacccgaccucaauccauaucucucccaccucgcacgaauguacaacggcuacgccggcggauucgaaguccaagucauccuagccggcaacgcauucacagccggcaaagucauauucgcagcuguaccucccaacuuccccacugaaggcuuaagccccucacaaguuaccauguucccccacaucgucgucgacguccgccaacucgagccaguccucauccccuuaccagacguccgcaacaacuucuaccacuacaaucaaucaaacgacccgaccauaaaacucaucgccaugcucuacacuccccuccgcgccaacaacgccggagacgacgucuucacggucucaugccgcguccuaacaagaccaagcccugacuucgacuuuaucuuccuaguaccucccacaguugaaucccgaacaaaacccuuuuccguccccguccuaacagucgaagaaaugacaaacucccgcuuuccuaucccccucgagaaacucuucacuggcccauccucugccuucgucguacaaccccaaaacggccgaugcacaacagacggcguauuacucggcacgacccagcuaagccccgucaacauaugcaccuuccguggagaugucacucacauaaccggcucccguaacuacaccaugaaccuagccucacaaaauuggucaaacuacgaucccaccgaagaaaucccagcuccccuaggcacacccgacuucguuggcaaaauacaaggcguccucacucaaaccacccgcaccgacggcucaacacgcggccacaaagcaaccgucuauaccggcuccgccgacuucgcccccaaacuuggccgcguacaauucggcaccgacaccgaccacgacuucgaggccaaccaaaacaccaaauucacucccgucggcguaauacaagauggauccaccacccaccgcaacgaaccccaacaguggguccuccccucauacuccggccgaaacacuccaaacguccaccucgcacccgccgucgcccccaccuuccccggcgaacagcuucucuucuuucgauccaccaugcccggaugcuccggcuaucccaacauggaccucgacugccuccuaccacaagaauggguucaauacuucuaccaagaagccgcacccgcccaaucagacguagcacuccuacgauucguaaaccccgacacaggcagaguccucuucgaaugcaaacuucauaagucaggcuaugucacagucgcacacacuggccaacacgaccuagucauaccacccaacggcuacuuccguuucgacuccuggguaaaccaauucuacacccucgcacccaugggaaacggcaccggccgacgacgcgcacuauaa

SEQ ID NO: 35956 - RNA, 1623 nt, Artificial Sequence
  derived and/or modified sequence opt11 from VP1__Norovirus__AGS08054
augaaaauggccuccuccgacgccaaccccuccgaugguuccaccgccaaccuaguccccgaagucaacaacgaggucauggccuuagaaccagucguuggcgcagccaucgccgcccccgucgccggccaacaaaacgucauagaccccuggauccguaacaauuucguacaagcccccggcggcgaguucaccgucucaccccggaacgcacccggcgaaauacuuugguccgcaccccucggucccgaccuaaaccccuaccuaucccaccuagcccgcauguacaacggcuacgccggcggcuucgaaguccaaguaauccuugccgguaacgccuucaccgccggaaaaaucaucuuugccgcuguaccgccaaauuuccccaccgaaggccucuccccaucucaaguuacaauguucccucacauaaucgucgauguccgacaacuagaacccguccucaucccccuaccagauguccgcaacaacuuuuaccacuacaaucaauccaacgacccaaccaucaaacuaaucgcaaugcucuacacaccccuccgcgccaacaacgccggagacgacgucuucaccguguccugccguguacuuacccgcccaucacccgacuucgacuuuaucuuccucguaccacccacagucgaaucucgaaccaaacccuucuccguccccguacucaccguagaagaaaugaccaacucucgcuuccccaucccccucgaaaaacucuucaccggucccucuucagccuucgucguccaaccccaaaacggccgcuguaccaccgacggcguccuacucggcacaacgcaacucucacccgucaacaucugcaccuuccgcggcgacgucacccacaucuccggcucuagaaacuacacaaugaaccuagccucccagaacuggaacagcuaugacccaaccgaagaaaucccagccccgcuagguacacccgacuucgucggcaaaauacaaggaguacuaacacaaaccacccgcacagacgguuccacccgcggacacaaggccaccgucuacaccggcuccgccgacuucucacccaaacucggaagaguacaauucgccaccgacaccgacaacgacuucgucgcagaccaaaacaccaaauucacacccgucggcguaauccaagacggcagcaccacaccccgcaacgagccacaacaauggguccucccauccuacuccggucgaaacacccacaacguccaccucgcccccgccguugcaccuaccuucccaggagaacaauuacucuucuuccgcuccaccaugccaggcugcucaggguaccccaacauggaccuagacugccuccucccccaagaauggguccaguacuucuaucaagaagccgcccccgcccaaucugacguugcccuacuaagauucgucaaccccgacaccggccguguccucuucgaaugcaaacuccacaaauccggcuacgucaccgucgcucacacgggccaacacgaccuagucauaccacccaauggcuacuuccgauucgauucauggguaaaucaauucuacacucuagccccaaugggaaacggaaccggccgacgacgugcccucuaa

SEQ ID NO: 35957 - RNA, 1623 nt, Artificial Sequence
  derived and/or modified sequence opt11 from VP1__Norovirus__AGS08056
augaaaauggcaagcuccgacgccaacccuucagacgggucagcagcaaaccucguccccgaaguaaacaacgaggucauggcccucgaaccagucguaggagccgccauagccgcccccgucgcuggccaacaaaacgucauugacccauggauacgcaacaacuucguacaagcacccggcggcgaguucacuguaucuccccgcaacgcccccggagaaauccucugguccgcaccgcuaggccccgaccuaaaccccuaccucucccaccucgcccguauguacaacggcuacgcuggcggauucgaaguccaagucauccucgccggcaacgcguucaccgcaggcaagguuaucuucgccgccgucccaccaaacuucccgaccgaaggccuaucccccucccaaguaacaauguucccccacaucgucgucgacgucagacaacuagaacccguacuaauaccucuacccgacguccgcaacaacuucuaccacuacaaucaaucaaacgaccccaccaucaaacuaaucgccaugcucuacaccccgcuacgcgccaacaacgccggcgacgacguauucacggucuccugccgcguccuaacccgaccaucacccgacuucgauuucaucuuccucguuccuccaaccgucgaaucacgcacaaaaccauucuccguccccguccucaccguugaagaaaugacaaacuccagauuccccaucccacuagaaaaacuauucaccggucccagcucagccuucguaguccaaccacaaaacggccguugcaccacagacgggguacuccucgguacaacccaacuauccccuguaaacauaugcacuuuccgaggcgacgucacacacauaacagguucacgcaacuacaccaugaaccucgcaagucaaaacuggucaaacuacgacccaacagaagaaaucccagcaccccucgggacaccagacuucgucggaaaaauacaaggugucuuaacucaaaccacccgaacagacggaaguacccgcggacacaaagcaacagucuacaccggaucagccgacuucgcccccaaacuuggccgaguccaauucgaaaccgacaccgacagagacuucgaagccaaccaaaacaccaaguucaccccuguuggcgucauccaagacggaggaacgacccaucgcaacgagccccaacaauggguccucccauccuauuccggacgcaacacccccaacguccaccucgccccugccgucgcccccaccuuccccggcgaacaacuacucuucuuccggucaacaaugcccggcugcucaggcuacccaaacauggaccucgacugccuacucccccaagaauggguccaauacuucuaucaagaagccgcucccgcccaauccgacgucgcccuacuacgcuucgucaaccccgacaccggccgcguacucuucgaauguaaacuccacaaauccggcuacgucaccguagcccacaccggacaacacgaccuagucaucccucccaauggauacuuccgauucgacuccugggucaaucaauucuacacacuagcccccaugggcaacggaacuggccgccgacgagcucucuaa

SEQ ID NO: 35958 - RNA, 1623 nt, Artificial Sequence
  derived and/or modified sequence opt11 from VP1__Norovirus__AGS08057
augaaaauggcuucauccgacgcccaccccagcgacggcucuacagccaaccuaguccccgaaguaaacaacgaagucauggcccucgaacccgucgucggcgccgcaaucgccgcucccgucgcuggacaacaaaauguaaucgaccccuggauccgcaacaacuucguccaagcacccggcggcgaguucacugucuccccucgcaacgcacccggcgaaauacuuuggucugcaccccucggccccgaccucaaccccuaccucucccaccucgcccguauguacaacggcuacgccggcggcuucgaaguccaagucauccucgccggcaacgcauuuacagccggaaaaaucaucuucgcagccguacccccaaacuuccccaccgaaggucucucuccaucccaagucacaauguucccccacaucaucguagacgugcgacaacucgaacccguccuaaucccucuccccgacguccgcaacaacuucuaccacuacaaucaaucaaacgaccccaccaucaaacuuaucgccaugcuauacacccccuuacgagcaaacaacgccggcgacgacguauucacaguuagcugccgcguccucacacgccccucucccgacuuugacuucauauuccuagucccgcccaccguugaaagcagaaccaaacccuucuccguaccuguccuaaccgucgaagaaaugacuaacucucgcuuccccauaccccuugaaaaacuauucacaggccccucauccgccuucguaguccaaccacaaaacggccgaugcaccaccgacggaguccuacucggcacaacccaacuaagccccgucaacaucuguacauuccgcggagacgucacccauaucuccggaucacgcaacuacaccaugaaccuagcaagccaaaauuggaacuccuacgacccaacagaagaaauaccagccccacuaggcaccccugacuucgucggaaaaauccaaggaguccucacacaaacuacuagagccgacggguccacucgaggccacaaagccaccgucuacaccggauccgcagacuucucccccaaacuaggccgcguucaauuugccaccgauaccgacaacgacuucguugccaaccaaaacaccaaauuuacaccugucggcgucauacaagacggcuccaccacaccccgcaacgaaccacaacaauggguacucccaaguuacucaggucgcaacacacacaacguacaccucgcccccgcagucgccccaacauuucccggagaacaacuccucuucuucagauccaccaugcccggcuguuccggcuaccccaauauggaccucgacugccuccuaccacaagaauggguacaauauuucuaccaagaagccgccccugcccaauccgacguagcccuacuccgcuucgucaacccugacaccggccgcguacuauucgagugcaagcuccacaaaucuggauacguaacagucgcccacacuggucaacacgaccucguaauacccccgaacggauacuuccgcuucgacucaugggucaaccaauucuacacccuugccccaaugggcaacggcaccggccgccgccgagcccucuaa

SEQ ID NO: 35959 - RNA, 1623 nt, Artificial Sequence
  derived and/or modified sequence opt11 from VP1__Norovirus__AGS08058
augaaaauggccucaucagacgcuaaccccucagauggcuccgccgccaaccucgucccugaagucaauaacgaagucauggcccuagaaccagucgucggcgccgcaauagccgcccccguagccggacaacaaaaugucaucgacccuuggauccgcaacaacuucguccaagccccagggggcgaauuuacagucuccccaagaaacgcccccggagaaauccucuggucagccccacucggacccgaccucaauccauaccucucgcaccuagcccgaauguacaacggcuacgcaggcgguuucgaaguccaagugauccuagccggcaacgcauucaccgccggaaaaguuauauuugcagccgucccgcccaacuuccccacagaaggacucucccccucacaagucacaauguucccccacaucgucguagacguacgacagcucgaacccguccuaauuccccuccccgacguccgaaacaacuucuaccacuacaaccaauccaacgacccaaccaucaaacuaaucgccaugcucuacacaccccuccgcgccaacaacgccggcgacgacgucuucaccgucuccugucgcguacucacucgccccucccccgacuucgacuuuaucuuccuuguucccccaaccgucgaaucacguacaaaacccuucucaguccccguccucaccgucgaagaaaugacaaacucccgauucccaauaccacuugaaaaacuauucaccggaccuuccuccgccuucguaguccaaccccaaaacggacgaugcaccaccgacgggguacuccucggcaccacacagcuaagcccaguaaacaucugcacauuucgaggcgacgucacccacaucaccggcuccagaaacuacaccaugaaccucgccucacaaaacuggaauaacuacgacccaaccgaagagauccccgcccccuuaggcaccccagacuucgucggcaaaauccaaggcguccucacccaaaccacacgaaccgacggauccacacgcggccacaaagccaccgucuacaccgguuccgcagacuucgcccccaaacugggccgcguccaauucgaaacagacaccgaccacgauuucgaagcaaaucaaaacacaaaauucacccccgucggagucauccaagacggcggaaccacacaccguaacgaaccccaacaguggguccuacccuccuacuccggacgaaauacccauaacguacaccucgccccagcuguugcccccaccuuucccggagaacaacuccuuuucuuccgcuccaccaugccagguugcuccggcuaucccaacauggaccuagauugccuccucccccaggaauggguccaauauuucuaccaagaggccgccccugcccaaucagacgucgcccuacugcgcuucguaaacccagacacuggccgcguucucuucgaauguaaacuacacaaauccggcuacgucacagucgcacacaccggccagcacgaccuagucaucccaccuaacggcuacuuccgauucgacuccuggguaaaccaauucuacacacucgcccccauggggaacggaacaggccgccgacgcgccgucuaa

SEQ ID NO: 35960 - RNA, 1623 nt, Artificial Sequence
  derived and/or modified sequence opt11 from VP1__Norovirus__AGS08059
augaaaauggccagcuccgacgccaacccaucagacggcucagccgcaaacuuaguacccgaagucaacaacgaaguaauggcccuagaaccuguuguaggagccgcaaucgccgcccccgucgccggccaacaaaacguaaucgaccccuggauccgcaacaacuucguacaagcccccggaggcgaguucaccgucucaccacgcaacgccccaggugaaauccuuuggaacgcuccccucggccccgaccucaaccccuaccucagccaccucgcccgcauguacaauggcuacgccggcggcuucgaaguccaagucauccucgcuggcaaugccuucaccgcaggcaaaguaauauucgcugccguucccccaaacuucccaaccgaaggacucuccccaucccaagucaccauguucccacacaucgucgucgacguacgccaacucgaaccaguccucaucccccuccccgacguucgaaacaacuucuaccacuacaaccaaaguaacgaccccaccaucaaacuaauagccaugcucuacacaccccuacgagccaacaacgccggcgacgacgucuucacaguauccugccgcguucucaccagacccucacccgacuucgacuuuaucuuucuaguaccacccaccguagaaucccgcacuaaacccuuuucaguccccguccucaccgucgaagaaaugaccaacucccgcuucccaaucccacucgaaaaacucuucacgggcccaagcagcgccuucgucguccagccacaaaacgguagauguacuacugacggcguccuccucggcaccacccaacugucccccguaaacaucugcaccuuccguggugacgucacacacauaaccggcagcagaaacuacacaaugaaccucgcaucccaaaacuggaauaacuacgacccaaccgaagaaauccccgcaccccuaggcaccccagacuucguuggcaaaauccaaggcguacuuacucaaaccacccgaacggacggauccacucgcggacacaaagccaccguauacaccgguagcgccgacuucgcuccaaaacucggcagaguccaauucgaaaccgacaccgaccacgacuucgaagcaaaccaaaacacaaaauucacccccgucggagucauccaggacggcggcacuacccaccgcaacgaaccccaacaauggguccuacccucuuacucaggacgcaacacccauaacguccaccucgcacccgccgucgcccccaccuuuccaggcgaacaacuccucuucuuccguuccaccaugccuggcugcuccggcuaccccaacauggaccucgacugccuccuuccucaagaauggguacaauacuucuaccaagaagccgcccccgcccaauccgacguagcccuucuccgauucgucaacccagacacgggcagaguccucuucgaaugcaaacuacacaaauccggauacgcaaccguagcccacacaggacaacaugaccuaguuauacccccaaacggauacuuccgauucgacuccuggguaaaccaauucuacacccuagcccccaugggaaacggcaccggccgacgcagagccgucuag

SEQ ID NO: 35961 - RNA, 1623 nt, Artificial Sequence
  derived and/or modified sequence opt11 from VP1__Norovirus__AGS08060
augaaaauggccuccucagacgcaaaccccuccgauggcuccgccgccaaccucguccccgaaguuaacaacgaagucauggcccucgaaccagucgugggcgccgcaaucgccgcacccgucgcaggccagcaaaaugucaucgaccccuggaucagaaauaacuucguccaggcccccggcggcgaauuuacaguauccccacgcaacgcccccggcgaaauccugugguccgcaccccucggccccgaccuaaaccccuaccucagccaccucgcccgcauguauaacggcuacgccggaggauucgaaguacaagucauccucgccggcaaugcguucacugcaggaaaagucauauucgccgcagucccucccaacuuccccaccgaaggacuuuccccaucacaagucaccauguucccccacaucgucguugacguccgccaacuagaacccguccucaucccacuccccgacguccggaacaacuucuaccacuacaaccaauccaacgaccccacaaucaaacucauagccaugcucuacacaccacuccgcgcuaauaacgcaggagacgacgucuucaccgucucuugccgcguccucacccgaccaucacccgacuucgacuucauauuccucgucccucccaccguagaaucccgaaccaaacccuucuccguccccguacucacaguagaagaaaugacaaacucccgcuuccccaucccccucgaaaaacucuucacaggacccuccucagcauucgucguccaaccccaaaacggacgcuguaccacugacggaguccuccucggcaccacccaacucucccccgucaauaucugcaccuuccgaggcgacguaacccauaucaccggcucacgaaacuacaccaugaaccuugcuucccaaaacuggaacaacuacgaccccaccgaagaaauuccagcaccccucggcacaccagacuucgucgggaaaauccaaggcguccucacacaaaccacccgcaccgaugggucaacccgcggccacaaagccaccgucuacaccggcuccgccgacuuugcccccaaacucggccgcguccaguucgaaacagacaccgaccacgacuucgaagcuaaccaaaacacaaaauucacccccguaggagucauccaagacggcggcaccacgcaccgaaacgaaccacaacaauggguacuccccucauauuccggacgcaauacacccaacguacaccuagcaccagccgucgcccccaccuuucccggcgaacaauuacucuucuuccgaucuacuaugcccggaugcuccggauacccaaacauggacuuagacugccuccuuccccaagaauggguacaauacuucuaucaagaagccgcacccgcccaaucagacguagcccuccuacgcuuuguaaaccccgacacagguagaguacucuucgaauguaaacuccauaaauccggcuacgucacugucgcccacaccggccaacaugaccuaguaauacccccaaacggcuacuuccgauucgacuccuggguaaaccaauucuacacauuagccccuaugggcaacggcacuggacgccgccgugcccuauag

SEQ ID NO: 35962 - RNA, 1623 nt, Artificial Sequence
  derived and/or modified sequence opt11 from VP1__Norovirus__AGS08061
augaaaauggcuuccuccgacgccaaccccucugacggcucgacagcaaaccucguacccgaaguuaauaacgaaguaauggcccuagaacccguagucggagccgcaauugcugccccagucgcaggccagcaaaacgucaucgauccuuggauccgaaacaacuucguccaagcccccggcggagaguucaccgucuccccucgcaacgcaccaggagaaauacugugguccgcgccacucggccccgaccucaaccccuaccucucccaccucgccagaauguacaacggauacgcaggcggcuucgaaguccaagucauccuagcaggcaacgccuucaccgcuggcaaaauaaucuucgcagcagucccucccaacuuccccacugaaggccucucccccucucaagucaccauguucccccacaucaucgucgacgucagacagcucgaacccguccucauaccacuuccggacguccgcaacaacuuuuaucacuacaaccaaagcaacgacuccaccauaaaacucaucgcaaugcucuacacaccccuccgcgccaacaacgccggagacgaugucuucaccgucuccugccgggugcuaacccgaccauccccugacuucgauuucauauuccucguaccucccaccguagaaucgcgaaccaaaccauucucaguacccguacucaccgucgaagaaaugaccaacucucgcuuucccaucccccucgaaaaacucuucaccggacccucaucagccuucgucguucaaccccaaaacggcagaugcaccacugacggcguccuccucggaaccacucaacucagcccagucaacaucugcaccuuccgaggggacgucacccacaucccagguucccgaaacuacacaaugaaccuagccagccaaaacuggaacagcuacgaccccaccgaagaaaucccagcuccccucgguacacccgacuucgucggcaaaauccaaggcguccucacccagaccacacgcacaaacggcucaacccgcggccacaaagccaccguauacaccgguagcgcagacuucuccccuaaacucggccgcguccaauucgccaccgacaccgacaacgacuucgaaaccaaccaaaacaccaaauucacgccuguugguguaauccaagacggaucaaccacaccccgcaacgaaccccaacaguggguccuccccucauacagcggccgaaacauacacaacguccaucuagcccccgcgguagcacccaccuucccaggcgaacaacuccucuuuuuccgaucuaccaugcccggcugcucagguuacccaaacauggaccucgacugccuccucccacaagaauggguccaauacuucuaucaagaggccgcaccagcacaaucagacguugcccuccuccgauucgugaacccugacaccggcagaguucucuucgaaugcaaacuccauaaauccggcuacgucacagucgcacacacuggccaacacgaucucgucauaccacccaacggcuacuucagguucgacuccugggucaaccaauuuuacacccucgcccccaugggcaacggcaccggcagacgacgagccuuauaa

SEQ ID NO: 35963 - RNA, 1623 nt, Artificial Sequence
  derived and/or modified sequence opt11 from VP1__Norovirus__AGS08062
augaaaauggcaagcuccgacgccaacccaucggauggcucugcagcaaaccuaguaccugaaguaaacaacgaagucauggcccuagaacccgucguaggcgccgcaaucgcagcaccagucgcaggccaacaaaacgucaucgacccauggauccgcaacaacuucguccaagcgcccggcggcgaguucaccguaagcccacgcaacgcaccaggcgaaauccucugguccgcaccccuaggccccgaccucaaccccuaccuaucccaccucgcccgaauguauaacggcuacgccggaggcuucgaaguucaagucauccuagccggcaacgcauucaccgcaggcaaagucaucuucgccgccgucccacccaacuuccccacagaaggucucucacccucucaagucaccauguuuccccauaucguuguagacguacgccaacuagaacccguacucauaccccuacccgacguccguaacaacuucuaccacuacaaccaguccaacgaucccaccauaaaacucaucgcaaugcuauacacaccccuccgugcaaacaaugccggcgacgaugucuucaccgucuccugccgcguacucaccagaccuucaccagacuuugauuucaucuuccuagucccacccaccgucgaaucucgaaccaaacccuucuccguacccguacucaccgucgaagaaaugacuaacucccgcuuccccauaccccuagagaaacuuuucaccggccccuccucggcguucguaguacaaccucaaaacggccgcugcacuaccgacggaguccuacucggaaccacccaacucucccccguaaacaucugcaccuuccgcggagacguaacacacaucaccggcucccgaaacuacaccaugaacuuagcaucccaaaacugguccaacuacgacccgacagaagaaauccccgcaccccucggaacccccgacuucguuggcaaaauacaaggcguucuuacccaaaccacccgaaccgacggcuccacccguggccacaaagccacagucuacaccggcuccgccgacuucgccccaaaacuuggccgaguccaguucgaaacagacaccgacagagauuucgaagccaaccaaaacacaaaauucaccccugucggcgucauucaagacggcggaacaacccaccgcaacgaaccacaacaauggguccuacccagcuacuccggccgcaacacuccaaacguccaucuagcacccgccgucgcccccaccuucccaggagaacaacuacucuucuuccgaucaaccaugcccggcuguuccggcuauccuaacauggacuuagacugccuacucccccaagaauggguacaauacuucuaccaagaagccgcccccgcccaauccgacgucgcccuccuacgauucguaaaccccgacaccggacgcguccuuuucgaaugcaaacuacacaaauccggauacguaacaguagcccacacaggacaacacgaccuagucauucccccaaacggcuacuucagauucgacuccugggucaaccaauucuacacacucgcacccaugggcaacggcaccggucgucgccgagcccucuaa

SEQ ID NO: 35964 - RNA, 1623 nt, Artificial Sequence
  derived and/or modified sequence opt11 from VP1__Norovirus__AGS08063
augaaaauggcaucuucagacgcuaaucccuccgacggcuccacagcaaaccucguacccgaggucaacaacgaagucauggcacucgaacccguaguaggagccgcuauagcugccccuguagccggucaacaaaacgucaucgacccguggauccgcaacaacuucguccaagcccccgguggugaguucacagucuccccgcgcaacgcccccggagaaauccucugguccgcgccccuaggcccagaccuaaaccccuaccucucacaccuagcccgaauguacaacggcuacgccggaggauucgaaguucaaguaauccuagcaggcaacgcauucacagcuggcaaaauaaucuucgccgccguacccccaaacuuccccacugaaggccuaucacccucccaagucacaauguucccccacaucaucgucgacguccgccaauuagaaccaguccucaucccccuacccgacguccgcaacaacuucuaucacuacaaccaaucaaacgacucuaccauaaaacucaucgccaugcucuacacaccccuuagagccaacaacgcaggcgaugacgucuucaccgucucuugccgcguacucaccagacccucccccgacuuugacuucaucuuccucgucccuccaacagucgaaucacgcaccaaaccauucuccguccccauccucaccgucgaagaaaugaccaacucccgcuuucccaucccccuagaaaaacucuucaccggacccuccagcgccuucguaguacaaccucaaaacggccgcugcacaacagacggcguccucuuaggcaccacacaacucagcccagucaacaucugcacuuucagaggcgacgucacccauauccccggcucccacaacuauaccaugaaccucgcaucccagaacuggaacucauacgacccuaccgaggaaauacccgcaccccucggaacccccgacuucguaggaaaaauacaaggcguccucacccaaaccaccucaaccaacgguagcacaaggggccacaaagccaccgucuacaccggcucagcagacuucagccccaaacuuggcagaguccaauucgcuacagacaccaacaacgacuucgaaaccaaccaaaacaccaaauucacgccugucggcguaauccaagacgguuccacgacaccccgcaacgagccacaacaauggguccuacccucuuacucaggacgcaauauccacaacguacaccucgccccugcagucgcccccaccuuccccggagaacaacuccucuucuuccgcuccacuaugcccggcugcucaggcuauccaaauauggaccucgauugccuccuaccccaagaauggguccaauacuucuaccaagaagccgcaccagcucaaucagacgucgcacuacucagauucguaaacccagacacaggacgcguacuguucgaaugcaaacuacacaaaucaggauacguaaccguugcacacacaggacaacacgaccuuguaaucccucccaacggauacuuccgcuucgacucaugggucaaccaauuuuacacccuugcccccaugggcaacggcaccggccgccgccgagcacuguaa

SEQ ID NO: 35965 - RNA, 1623 nt, Artificial Sequence
  derived and/or modified sequence opt11 from VP1__Norovirus__AGS08064
augaaaauggcaucaucagacgccaaccccuccgacggaagcaccgcaaaccuaguccccgaaguaaacaacgaagucauggcacucgagcccgucgucggcgccgccaucgccgcccccguggcaggccagcaaaacgucaucgaccccuggauccgaaacaacuucguccaggcccccggcggagaguucaccguaagcccccgcaacgcacccggcgaaauacucugguccgcaccccucggccccgaccuaaaccccuaucucucacaccucgcccgcauguacaacggcuacgccggcggcuucgaaguccaagucauccucgccggcaacgccuucacagccggcaaaaucaucuucgcagcugucccacccaacuuucccaccgaaggcuuaucucccucacaaguaacuauguuuccacauaucaucgucgacguccgccaacucgaacccguccucaucccccuaccagacguccgcaacaacuucuaccacuauaaccaaagcaaugaccccaccaucaagcucaucgccaugcucuacacaccccuucgcgccaacaacgcuggcgacgacgucuucaccgucuccugccgcguccuaacccgccccuccccugacuucgacuucaucuuccucgucccacccaccgucgaauccagaaccaaacccuucuccguccccguucucaccguagaagaaaugaccaacuccagauuccccaucccccucgaaaaacucuucaccggacccucauccgccuucgucguccaaccccaaaacggccgcugcaccaccgacgguguccuucucggcacgacccaacuuucacccguaaacaucuguaccuuccgcggagacgucacccacaucuccggaucccgaaacuacacaaugaaccucgccucccaaaacuggaacuccuacgaucccaccgaagaaauacccgcaccccuaggaacucccgacuucgucggcaaaauccaaggcguccuaacacaaaccacaagaaccgacgguucaacucgaggccacaaagccaccgucuacacuggcucugcagauuucucacccaaacucggacguguccaauucgcaacagauaccgauaaugacuucgucaccaaccaaaauaccaaauucacucccguaggaguaauccaagacggcuccacaacaccacgcaaugaaccccagcaauggguccucccaagcuacuccggccgcaacacccacaacguccaccucgcacccgccgucgcccccacauuccccggcgaacagcuucuauucuuccgcucaaccaugcccggcugcuccggauaccccaacauggaccucgacugccuauuaccccaagaauggguacaauauuucuaucaagaagccgcacccgcacaauccgacgucgcacuccucagauucguuaacccagacaccggccgcguccuuuuugaaugcaaacuccacaaauccggcuacgucaccgucgcucacaccggacaacacgaccuaguuaucccucccaaugguuacuuccgauuugacucuugggucaaccaauucuacacccucgcccccaugggaaacggaaccggccgccgacgagcccucuga

SEQ ID NO: 35966 - RNA, 1623 nt, Artificial Sequence
  derived and/or modified sequence opt11 from VP1__Norovirus__AGS08065
augaaaauggccucauccgacgccaaucccuccgacgguuccaccgccaaccucguuccugaaguaaacaacgaagugauggcccucgaacccgucgucggagcugccauagcugcccccgucgccggccaacaaaaugucaucgacccuuggaucagaaacaacuucguccaggcccccggcggcgaguucaccguaucaccucgaaacgcacccggagaaauccuaugguccgccccucucgggcccgaccucaaccccuaccuuucccaccuagcccgcauguacaacggcuacgcaggcgguuucgaaguccaaguaauacucgccggaaacgcauuuaccgccggaaagaucauauucgccgccgucccucccaacuuccccaccgaaggccucucacccucacaaguaaccauguucccccacaucauagucgacguacgccaacucgaaccgguucuuaucccccucccagacguccgcaacaacuucuaccacuauaaucaguccaaugacccaacgaucaaacuaaucgcuaugcucuacacaccacuccgcgcuaacaacgccggcgacgacguauucacaguaagcugucgcguccucacccgccccucacccgacuucgacuucaucuuccuagucccacccaccguagaaucucgaacaaaacccuuuucagucccgguacuaaccguagaagaaaugacgaacucacgcuuucccauuccccucgaaaaacucuucaccggcccauccuccgcauucguaguccaaccacaaaacggacgcugcacaaccgacggcguccuccuagguaccacccaacucuccccugucaacauaugcacauuccgcggagacgucacucacaucccuggcucccgcaacuacaccaugaaccucgccucccaaaacuggaacagcuacgaccccacugaagaaauccccgcaccccucggcacacccgacuucgucggaaaaauccaaggcguucuuacucaaaccacccgcaccaacggcagcacacgcggccacaaagccaccguauacaccggcuccgccgacuucucacccaaacucggccgaguccaauucgccacggacacagacaacgauuucgaaaccaaccaaaacacaaaauucaccccagucggugucauacaagacggguccaccaccccgcgcaacgagccccaacaguggguccuccccagcuacucaggccgcaacauccauaacguccaccuugcccccgccgucgcucccaccuucccaggagaacaacuccuauucuuccguucuaccaugccuggaugcucaggauaccccaacauggaccucgacugucuccuaccccaagaauggguccaauacuucuaccaagaagccgcacccgcacaauccgacgucgcccuacuccgcuucgucaacccugacacaggccgaguccuuuucgaaugcaaauuacacaaaucaggcuacguaaccgucgcccacaccggccaacacgaccuuguaauacccccaaacggcuacuuucgcuucgacagcugggucaaccaauucuacaccuuagcacccaugggcaacggcaccggcagaagacgagcccucuga

SEQ ID NO: 35967 - RNA, 1623 nt, Artificial Sequence
  derived and/or modified sequence opt11 from VP1__Norovirus__AGS08066
augaaaauggccuccuccgacgccaaccccuccgacgguuccaccgccaaccucguccccgaaguaaacaaugaagucauggcccucgaaccaguggucggagccgcaaucgcugccccaguagccggucaacaaaacgucauagaccccuggauccgcaacaauuuuguccaagcucccggaggcgaauuuacaguaucaccccgcaacgcccccggugaaauccucuggucagcuccccuagguccagaccucaaccccuaccucucacaccuagcccgaauguacaacggauacgccggcggauucgagguccaggucauacuagccggcaacgccuucaccgccgguaaaaucauauucgccgccgucccacccaacuuccccaccgaaggucucuccccaucccaaguuaccauguucccccacaucaucgucgacguccgacaacuagaacccguccucaucccacucccagacguacgaaacaacuucuaccacuacaaccagucaaaugacuccaccauaaaacuuauagccaugcucuacacuccccuccgcgccaacaacgccggagacgaugucuucaccgucuccugccgcguccucacccgccccucccccgacuucgauuucaucuuccucgucccacccacaguagagucacguacuaagcccuucuccguacccauccuaaccgucgaagaaaugacgaacucccgauuucccauuccccuagaaaaacucuuuaccggacccucauccgccuucgucguccaaccccaaaacggccguugcacuacagacggcguccuccuuggaacuacucaacucucccccgucaacauuugcaccuuccgcggugacgucacacacauaccaggcucacauaacuacaccaugaaccuagcuucucagaacuggaacucuuacgacccaaccgaagaaauacccgccccgcucggcacccccgacuuugucggcaaaauccaaggcguccuaacccaaacaacauccacaaacggcucuacccgaggucacaaagccacagucuacaccggcuccgccgacuucucucccaaacucggucgcguccaauuugccaccgacaccaauaacgacuucgagaccaaucaaaacaccaaauucacccccgucggcgucauccaggacggguccaccacaccccgcaacgaaccccaacaauggguccuccccuccuacucaggacgaaacauccauaacguccaccuagcaccagcugucgcacccaccuuccccggagaacaacuccuauuuuuccgcucaaccaugccaggcugcuccgguuaccccaacauggaccuagacugccuccucccacaagaauggguccaauacuucuaucaagaggccgccccagcacaaucagaugucgcccuacucagauucgucaaucccgacaccgggcgcguacuauucgaguguaaacuccauaaaucagguuacguuaccguugcacacaccggccaacacgaccucgucaucccaccaaacggcuacuuucgauucgauucuugggucaaccaguucuacacccucgccccaaugggcaacgggaccggccgccgucgcgcccuauaa

SEQ ID NO: 35968 - RNA, 1623 nt, Artificial Sequence
  derived and/or modified sequence opt11 from VP1__Norovirus__AGS08067
augaagauggccuccucugacgccaaccccucagacggcuccacagccaaccuaguacccgaaguuaacaacgaaguaauggcccucgaacccguagucggagcagcaaucgcagccccugucgccggccaacaaaacguaaucgacccauggauacgcaauaacuucguucaagcaccuggcggagaguucacagucucaccacgcaacgcaccaggcgaaauacuuugguccgcuccacuaggccccgaccugaaccccuaccuaucccaccuagcccgcauguacaacggcuacgccggcggcuucgaaguccaagucauacuagccggcaacgcauucaccgcaggcaagauuaucuucgcagccguucccccuaacuuccccaccgaaggccucucccccucacaggucaccauguucccccacaucaucgucgacguccgacaacuugaacccguccuaauaccacuccccgacgucagaaauaacuucuaccacuacaaccaaucaaacgaccccaccauaaaacucaucgccaugcuauacacaccccuacgagccaacaacgccggcgacgacgucuucacaguauccugccgcguccuaacaagacccuccccagacuucgacuucaucuuucucguaccacccaccgucgaaagucgcaccaaacccuucuccguacccguccuuacagucgaagaaaugaccaacucccgguuucccaucccccucgaaaaacucuucaccggccccuccucagcauucguaguucaaccacaaaacggucgcugcacaaccgacggcguccuccucgguacaacccaacucucccccgucaauaucuguaccuuccgcggcgacguaacccacaucuccggcucccgaaacuacacaaugaaucucgccucgcaaaacuggaacucauacgaccccaccgaagaaauccccgcuccucuaggcacucccgacuucgugggcaagauccaaggcguacugacccaaaccacccgcaccgacggauccaccagaggacacaaagcaacuguauacacagguuccgccgacuuuagccccaaacuaggccguguccaauucgccaccgacacugacaacgacuucgucaccaaccaaaacaccaaauucacgcccgucggcgucauccaagacggcuccacuacaccccgaaaugaaccccaacaauggguccuaccauccuacucgggccgcaacacccauaacgugcaccucgcccccgcugucgccccuaccuuccccggcgaacaacuccuauucuuccgauccaccaugccaggaugcucaggcuaccccaacauggaccucgacugccuacuaccacaagaauggguccaauacuucuaccaagaagccgccccagcccaaucugacgucgcccuccuacgguucgugaacccugacacuggccgcguccuauucgaaugcaaacuacacaaauccggcuacgucacagucgcccacaccggacaacacgaccucgucaucccucccaacggauacuuccgcuucgacucauggguaaaccaauucuauacccucgcacccaugggaaacggcacuggacgucgacgcgcccucuaa

SEQ ID NO: 35969 - RNA, 1623 nt, Artificial Sequence
  derived and/or modified sequence opt11 from VP1__Norovirus__AGS08068
augaaaauggccucuucagacgccaaccccuccgacggcucaacggccaaccuugucccagaaguaaacaacgaaguaauggcacuagaacccguaguaggcgccgccauugccgcccccguugcaggccaacaaaacgucaucgaccccuggauccgcaauaacuucguccaagccccgggcggcgaguucaccguuucuccccgcaacgccccuggcgaaauccuaugguccgcaccccuaggacccgaccuaaacccuuaccucucccaccucgcccgcauguauaacggauacgccggcggcuucgaaguccaagucauccuggccggaaacgccuuuaccgccggaaaaaucaucuucgccgccgucccgccaaacuuucccaccgaaggucucuccccuucccagguuacaauguucccucacaucauagucgauguacgacaacuugaaccaguccuaauaccccuccccgacguccgcaacaacuucuaccacuauaaccaauccucagaccccaccauaaaacucaucgccaugcuauacacgccccuccgagccaacaacgccggcgacgacgucuuuaccguuucaugccgaguccucacccgccccucaccugacuucgauuucauauuccucguaccucccacaguugaaucucggaccaaacccuucucaguccccguccucacagucgaagaaaugaccaauucacgcuuccccauaccccucgaaaaacucuuuaccgggcccagcucagccuuugucguccaaccccagaacggccguugcaccacagacggaguccucuuaggaacaacccaacuaucucccgucaauauauguaccuuucgcggcgacgucacccacaucuccgguucccgcaacuacacaaugaaccuagccucacagaacuggaacuccuacgacccuacagaagaaauccccgcuccccuaggcacccccgacuuugucgggaaaauacaaggcguacucacccagacaacacgcacugacggcuccacacgcggccacaaagccacugucuacacgggcuccgccgacuucucaccaaaacucggccguguccaauucgccaccgauacagacaacgacuucguaaccaaucaaaacacaaaauucacccccgucggaguuauccaagacggcucaaccacuccccgcaacgaaccacaacaguggguccuccccucauacagcggccgcaacacccacaacguccaccucgcccccgccgucgcccccaccuuucccggcgaacaacucuuauucuuccgauccaccaugcccggcugcuccggauacccaaacauggaccucgacugccuccuaccccaagaauggguccaauacuucuaucaagaagcugcucccgcccagucagacguagccuugcuccguuucguuaaccccgacaccggacgcguccuauucgaaugcaaacuccacaaaagcggauaugucaccgucgcccacaccggacaacaugaucucguuaucccaccuaacggcuacuuccgauucgacucuugggucaaccaauucuacacccucgcccccaugggcaacggaacaggccgacgcagagcucuauaa

SEQ ID NO: 35970 - RNA, 1623 nt, Artificial Sequence
  derived and/or modified sequence opt11 from VP1__Norovirus__AGS08069
augaaaauggcauccucagacgcuaaccccagcgacggcuccaccgccaaccuagucccagaaguuaacaaugaagucauggcacucgaaccagucgucggcgcagcuaucgccgcccccgucgccggacaacaaaacguaauagaccccuggaucagaaacaacuucguccaagcacccggcggcgaguucaccguaagcccccgaaacgccccaggcgaaauccuaugguccgccccacucggacccgaccucaaccccuaccuaucccaccuagcacgcauguacaacggauacgcggguggauucgaaguccaagucauccuagcaggcaaugcauucaccgccggcaagauaaucuucgcagccgucccucccaacuuccccaccgaaggacucucccccagccaagucaccauguucccccacauaaucgucgacgugcgccaacucgaacccguccucauaccccuacccgacguccgaaacaacuucuaccauuauaaccaauccaacgacuccacaaucaaacucauagcaaugcuauacacuccccuccgugccaacaacgccggcgacgacgucuucaccgucuccugccgcguacuaacaagacccuccccugacuuugacuucaucuuccuugucccacccaccgucgaaucccgcaccaaacccuucagcguccccguccuuaccgucgaagaaaugaccaacucccgauuccccaucccccuugaaaaauuauucaccggcccauccucggcauuugucguccaaccccaaaacggccgcugcacaaccgacggaguacuccucggcaccacccaauuaucccccgucaauaucugcacauuccgcggagacgugacccacaucccaggcucacgaaacuacaccaugaaccuagccucccaaaacuggaacuccuacgaccccaccgaagaaauacccgcccccuuagguaccccagacuucgucggcaaaauccaaggcguacuaacccaaaccacccgcacaaauggauccacucgaggacacaaagcaaccgucuacaccggcucagccgacuucucacccaaacucggccgcguccaauucgccacagacacugauaacgacuuugaaaccaaccaaaacaccaaguucacccccgucggcgucauccaagaugguucuacaacaccccgcaacgaaccccaacaauggguccucccuagcuacuccggucgcaacacucacaacguccaucucgccccagcuguagcaccaaccuucccaggugaacaacuucucuucuuccgcuccacgaugcccggcugcuccggcuaccccaacauggaccucgacugccuucuuccacaagaauggguucaauacuuuuaccaagaagcagcccccgcccaaagcgacguggcccugcucagauucgucaacccagacaccggacggguccucuucgaaugcaaacuccacaaaucaggcuacguuaccguagcccacaccggccaacaugaccuugucauacccccaaacggcuacuucagauucgacagcugggucaaccaauucuacacccuagcccccaugggcaacggcaccggacgacgccgagcucucuga

SEQ ID NO: 35971 - RNA, 1623 nt, Artificial Sequence
  derived and/or modified sequence opt11 from VP1__Norovirus__AGS08070
augaaaauggccagcucagacgccaacccaucagacgguuccgccgccaaccucguacccgaagucaacaacgaagucauggcacucgaaccaguaguaggagccgcaaucgccgcccccgucgccggccaacagaacgucaucgacccuuggauccgaaacaacuucguacaagcccccggcggcgaguucacugucuccccuagaaacgcgcccggcgaaauccucuggucagccccacucggaccagaccucaaccccuaccuaucccaccuagcccgaauguacaacggauacgccggcggauucggaguccaagucauccuagcuggcaacgccuucacugccggcaaagucaucuucgcagccguaccacccaacuuccccaccgaaggccucagcccaucacaaguaacaauguucccucacauugucgucaacguccgccaacuagaaccaguacuaauuccccuccccgacguacgaaacaacuucuaccacuacaaucaauccaacgauccgaccaucaaacucaucgcaaugcucuacacaccacuccgcgcgaacaaugcaggagacgacgucuucaccgucucaugccguguccucacacgaccuucacccgacuucgacuucauauuccucguaccgcccaccguggaaagccgaaccaaacccuuuuccguccccguccucaccgucgaagaaaugaccaacucccgcuuccccaucccccucgaaaaacuauucaccgggcccuccucagccuucgucguacaaccacagaacggccgcugcacuacagacggcguacuccuaggcaccacgcaacuuucacccguaaacaucugcaccuuccgcggugauguaacccacaucaccggcucccgcaauuacaccaugaaucuagccucccaaaacuggaacaacuacgacccuaccgaagaaacccccgcaccccuaggcacucccgacuucguaggcaaaauccaaggaguccuaacacaaacaacccgcacagacggcuccacccgcggccacaaagccaccguauacaccggaucagccgacuucgcccccaaacuaggucgaguccaauucgaaacagauaccgaccacgacuucgaagcuaaccaaaacaccaaauucacaccaguuggcgucauacaagacggauccacaacccaccgaaacgaaccucaacaauggguccuacccucauacuccgguagaaacacccacaacguccaccuugccccggccguggcacccacauuccccggcgagcaacucuuauucuucagaucgacaaugcccggaugcucuggcuaccccaacauggaccuagacugccuacucccccaagaauggguacaauauuucuaccaagaagccgcgccugcacaaucagacgucgcacuccuccgguucguuaaccccgauacuggacguguccucuucgagugcaaacuccacaaaucaggcuacgucaccgucgcccucaccggccaacacgaccuggucaucccaccaaauggcuacuuccgauucgacucaugggucaaccaauucuacacccucgcacccaugggaaacggaacaggccgaagacgcgccgucuga

SEQ ID NO: 35972 - RNA, 1623 nt, Artificial Sequence
  derived and/or modified sequence opt11 from VP1__Norovirus__AGS08071
augaaaauggccucauccgacgcuaaccccuccgacggaucagccgccaaccucgucccugaaguaaacaacgaaguuauggcacucgaaccaguugucggugccgccaucgcugcucccgucgcaggccaacaaaacguaaucgacccauggauacgcaacaacuuuguccaagccccaggcggggaguucaccguaucaccccgcaacgccccgggagaaauccuguggucugcaccccuaggucccgaccucaaccccuaccuaucacaccuagcccgcauguacaacggauacgccggcggcuucgaaguccaagucauacucgccgguaacgcauucaccgccggaaaggucaucuuugcagcaguaccgcccaacuuccccaccgaaggccucucacccagccaagucacaauguuuccccacaucgucguugacguccgccaacuugaacccguccuaauaccucuucccgauguacgaaacaacuucuaccacuauaaccaauccaacgaccccaccaucaagcuaaucgcuaugcucuacacaccgcuccgugccaacaacgcaggagacgacgucuucaccgucuccugccgcguacuaacccgucccucccccgacuucgacuucaucuuccucgugcccccaacugucgaaucccgcacgaaacccuucucuguccccguucuaacagucgaagaaaugacaaacucacgauuuccaauaccacucgaaaaacucuucaccggucccucauccgccuucgucguccaaccccaaaacggacgcugcacaaccgacggcguccuucucggaacaacccaacuaucgccaguaaacaucugcaccuuccgcggggacgucacccacaucaccggaucccgcaacuacacaaugaaccucgccucccaaaacuggucaaauuaugacccaacagaagaaauacccgcuccccucggcacacccgacuucgucggaaagauacaaggcguucuaacccagacuacaagaaccgacggauccacccgcggccacaaagcaaccgucuacaccggcucagcugacuucgcccccaaacucggucgaguccaguucgaaaccgacacagaccgcgacuucgaagccaaccaaaacacaaaauucacccccguaggcgucauccaagacgggggcaccacccaccgcaacgaaccacaacaauggguacuccccuccuacagcggacggaacacccccaacguucaccuugccccagccgucgcacccaccuuccccggagaacaacuacuuuucuuccgcucaaccaugcccggcugcuccggauaucccaacauggaccucgacugucuccucccccaagaguggguacaauacuucuaccaagaagcagcacccgcccaauccgacguagcccuacuacgcuucgucaaccccgauaccggacgaguccuauucgaaugcaaacuacacaaauccggcuacgucacagucgcccacacuggccagcacgaccuagucauaccacccaacggcuacuuucgguucgacucauggguaaaccaauucuacacccucgcccccaugggcaauggcaccggccgucgacgcgcucucuaa

SEQ ID NO: 35973 - RNA, 1623 nt, Artificial Sequence
  derived and/or modified sequence opt11 from VP1__Norovirus__AGS08072
augaaaauggcauccucugacgcuaaccccagcgacggcuccaccgcuaaccucguacccgaaguaaacaacgaagucauggcccuagaacccgucgucggcgccgccauagccgcccccgucgccggccaacaaaauguuaucgacccauggauaagaaauaacuucguucaagccccuggcggcgaguucacugucucgccccgaaacgccccaggcgaaauccucugguccgcuccccucgguccagaccucaaccccuaccuaucccaccuagcacgcauguacaacggauaugccggcgguuucgaaguccaagucauccuggccggcaaugccuucaccgccggcaaaaucaucuucgccgccgucccacccaacuucccaaccgaaggacuaucacccucucaagugacaauguuuccacauaucaucgucgacguccgacaacuggaaccaguacuaauaccccuacccgauguacgcaacaacuucuaccacuacaaccaauccaacgauccaaccauaaaacucaucgccaugcuauacaccccgcuacgcgccaacaacgccggcgacgauguauucacagucuccugccgcguccucacucgccccuccccagacuucgacuucaucuuccucgugccucccaccgucgaaucccguacaaaacccuuuucugucccaguccucaccguagaagaaaugacaaacucccgguucccuauaccucucgaaaaacuuuucaccggccccucauccgccuucgucguccaaccccaaaacggacgcugcaccaccgacggcgucuuacucggaaccacccaacucuccccugucaacauaugcacuuuccgaggcgacgucacacacauccccggaucccgaaacuauacaaugaaccucgccucucaaaacuggaacuccuacgaccccaccgaagaaauccccgccccacucggcacuccagacuucgucggaaagauacaaggcguauuaacacaaaccacccgcacaaauggcucuacccguggccacaaggccaccguuuacaccggcuccgcggacuucagccccaaacuaggccgcguccaauucgccacagacaccgacaacgacuucgaaacaaaccaaaacaccaaauucacaccagucggaguaauccaagacgguuccacuacaccccgaaacgaaccccaacaauggguccuccccucauauuccggccgaaacauccacaacguccaccuagccccugccguagcccccaccuuccccggcgaacaacuccucuucuuccgcagcaccaugccagguugcuccgguuaccccaacauggaccuagacugccuccuaccccaagaauggguucaauauuucuaccaggaagcagcccccgcccaauccgacguagcccuacuccgauucgucaaccccgacacuggacgaguccucuucgaaugcaaacuccacaaauccggcuacguaacagucgcacacacuggacaacacgaccucgucaucccacccaacggauacuuccgcuucgacuccugggucaaccaauucuacacccucgcacccaugggcaacggaacuggucgacgcagggcucucuaa

SEQ ID NO: 35974 - RNA, 1623 nt, Artificial Sequence
  derived and/or modified sequence opt11 from VP1__Norovirus__AGS08073
augaaaauggcuagcuccgacgccaaccccucagacggaagcaccgccaaccuaguaccagaaguaaacaacgaggucauggcccucgaaccggucguaggcgccgcaaucgcagcaccagucgccggacaacaaaacguaaucgacccauggauccgcaacaacuuuguucaggccccuggaggugaguucaccguaagccccagaaaugccccaggggaaauccucugguccgccccacucggcccagaccuaaaccccuacuuaucccaccucgcccgaauguacaacggcuacgcaggaggcuucgaaguccaaguaauauuagccggaaaugccuucaccgcaggcaaaaucaucuucgccgccguaccacccaacuucccaacagaaggacuaucccccucccaaguuacaauguucccccacaucaucguagacguccgacaacucgaacccguccuaaucccacuccccgauguccgcaacaacuucuaccacuacaaccaaucaaacgacucaaccauaaaacucaucgcaaugcuauacacuccccuccgcgcuaacaaugccggcgacgacgucuucaccgucuccugccguguccuuacccgcccgucuccagacuucgacuucaucuuccucguacccccaaccguagaaucccgcacaaaaccuuucuccguccccguccucaccgucgaagaaaugacgaacucccgcuuccccauaccccucgagaagcuauucaccggcccauccucagcauucguuguccaaccccagaacggccgauguaccaccgacggcguccuucucggcacuacccaacucagccccgucaacaucugcaccuuccgcggcgacguaacccacaucucuggcucccgcaacuacaccaugaaccucgccucucaaaacuggaacuccuaugaccccaccgaagaaauccccgccccgcuaggcacaccagacuucguaggaaaaauacaaggcguacuuacacaaacaacccgcaccaauggcucaacucgaggacacaaagccaccgucuacaccggaucagcagacuucuccccgaaacuaggcagaguccaauucgccacagacaccgacaacgacuucgaaaccaaucaaaacaccaaauucacccccguaggcguaauucaagacggcucaacaacaccccgcaacgaaccccaacaauggguacucccauccuacucaggacgaaacauccacaacguacaccuugcacccgccgucgccccgaccuuccccggcgaacaacuacucuucuuccgcuccaccaugcccggcugcuccggauacccaaacauggaccucgacugccuucuuccccaagaauggguccaauauuucuaccaagaagcagcacccgcacaaucagacgucgcccuccuacgcuucguaaacccagacaccggccgcguccucuucgaaugcaaacuccacaaaucaggcuacguaaccgucgcucacaccggccaacacgaccucgucaucccacccaacggauacuuccgcuucgacagcugggugaaccaguuuuacacccucgcgccaaugggcaacggcaccggacgacgcagagcccuauaa

SEQ ID NO: 35975 - RNA, 1623 nt, Artificial Sequence
  derived and/or modified sequence opt11 from VP1__Norovirus__AGS08074
augaaaauggcaucaucugacgcaaaccccuccgacggcucgaccgcaaaccucguccccgaaguaaacaacgaaguaauggcccucgagcccgucguaggagccgccauagccgcccccguagcaggccaacaaaacgucauugaccccuggauccgaaacaacuucguacaagcaccagguggagaguucaccgucucaccccgcaacgccccaggugaaauacuaugguccgcuccccuaggacccgauuuaaaccccuaccucucccaccuagcccgaauguacaacggcuacgcuggcgguuucgaaguacaagucauacuagcuggcaaugccuucaccgcuggcaaaaucaucuucgccgcugucccacccaacuuccccaccgaaggccuaucuccuucccaagucaccauguucccgcacauaauagucgacguacgccaacuggaacccguccucaucccccuccccgacguccgcaauaacuucuaccacuacaaccaguccaacgacuccaccaucaaacuaauugccaugcuuuacacaccccuccgagccaacaacgccggcgacgacguauucaccgucucaugucgcguccuaacccgacccagccccgauuucgacuucaucuuccuagucccacccaccgucgaaucuagaaccaaaccauucucuguccccauccuaacaguagaagaaaugacgaacagccgcuuccccauaccccuagaaaaacucuucaccggacccuccuccgccuucgucguccagccccagaacggccgaugcacaacagacgguguacuccucggcaccacucaacuuucuccagucaacaucugcaccuuucgcggcgacgugacccacauuccaggcucccacaacuacacaaugaaucuagccucccaaaacuggaacucauacgaccccaccgaagaaauccccgcaccacuaggaacuccagacuuugucggaaaaauccagggcguacucacacaaaccacuagcaccaacggcuccacacgcggucacaaagccacaguauauaccggauccgccgacuucucucccaaacuaggccgcguccaauucgccaccgacaccaacaacgacuucgaaacaaaccaaaacaccaaauucacacccguaggcgucauacaagacggcuccacuacaccccgcaacgaaccccaacaauggguccuucccuccuacuccggccgcaacauccacaacguccaccuugcccccgccgucgccccaaccuuccccggcgaacagcuccuauucuuccgcuccaccaugcccggcugcucaggcuaccccaacauggaccucgauugccuccugccccaggaauggguacaauacuucuaccaagaagccgcaccagcacaauccgacgucgcccuccuccgcuucgucaacccggacaccggacgcguacuuuucgaaugcaaacuacacaaauccggcuacgucaccgucgcccacaccggccaacacgaccucgucaucccacccaacggauacuuccgcuucgacagcugggucaaccaauucuacacccucgcucccaugggcaacggcaccggccgccggcgcgcccuauaa

SEQ ID NO: 35976 - RNA, 1623 nt, Artificial Sequence
  derived and/or modified sequence opt11 from VP1__Norovirus__AGS08076
augaaaauggcuuccuccgacgccaaucccucagacggaucaacagcaaaccuuguaccugaaguuaacaacgaaguaauggcccuugaacccgucgucggagcagccaucgccgcgcccguugccggacaacaaaacguaaucgacccuuggauccgaaacaacuucguacaagcacccggcggagaguucaccguuuccccacgaaacgccccuggagaaauccuauggucagcuccccucggccccgacuuaaauccuuaccuuucccaccucgcccgcauguacaauggcuacgccggcggcuucgaaguccaagugauccucgccggaaacgccuuuaccgccggaaaaaucauuuucgccgccgucccacccaacuuccccaccgaaggccucucaccaucucaaguaacaauguucccccacaucaucgucgacguucgccaacucgaaccuguacuuauaccacucccagacguccgaaacaacuucuaccacuacaaccaauccaacgaccccaccauuaaacuaauagccaugcucuacaccccacuccgcgccaacaacgcuggcgacgacgucuuuacaguauccugccgcguacuaacccgccccuccccagacuucgacuucaucuuccucguaccacccaccgucgaaucacgcacaaaacccuucucaguccccguccucaccguagaagaaaugaccaacucucgcuuccccaucccacuagaaaaauuauuuaccggaccauccuccgccuucguuguccaaccacaaaacggccgaugcacaaccgacggcgucuuacuaggcacaacccaacucucccccguaaacaucugcaccuuccgaggcgacgucacccauaucuccggauccagaaacuacaccaugaaccuagccucccaaaauuggaacucauaugaccccaccgaagaaauaccugcaccccucggcacaccagacuuuguaggcaaaauucagggcgugcucacccaaacaacccgcaccgacggcuccacccgcggucacaaagccacagucuacaccggcuccgccgacuucucucccaaacucggucgcguccaauucgccacagacaccgacaaugacuucguaacgaaccaaaacacaaaauucacccccguaggcgucauccaagacggcuccaccacuccccgcaacgaaccacaacaauggguccuacccucauauuccggcagaaacacccacaacguucaccuugccccugccgucgccccaaccuucccaggugaacaacuccuauucuucagaagcaccaugcccgggugcuccggauacccaaauauggaucuggacugccuacucccccaagaauggguucaauacuucuaucaggaggcagcacccgcccaauccgacguagcgcuucuacgcuucgucaaccccgacaccggccgcguacucuucgaaugcaaacuacacaaauccggcuacgucaccguagcccacacaggacaacacgaccucgucaucccacccaacgguuacuuccgcuucgacuccuggguaaaccaauuuuacacucucgcccccaugggaaacggcaccggccgccgccgcgcccuuuaa

SEQ ID NO: 35977 - RNA, 1623 nt, Artificial Sequence
  derived and/or modified sequence opt11 from VP1__Norovirus__AGS08079
augaaaauggccuccuccgacgccaaccccuccgacggaucaaccgccaaccucguccccgaagucaacaacgagguuauggcccucgaaccaguggucggcgccgcgauugccgcccccgucgccggccaacaaaacgucaucgaccccuggauccgcaacaacuucguacaagcccccggcggugaguuuaccgucucuccccgcaacgccccaggcgaaauccuauggucagcaccccuaggccccgaccuaaaccccuaccuaucccaccuagcaagaauguacaauggcuacgcgggcggauucgaaguccaagucauucuagccggcaacgccuucacagcuggcaaaauuaucuucgccgccguuccaccuaacuucccaaccgaaggcuuaucccccucccaggucacaauguucccccacaucauuguagacguaagacaacucgaacccguacuaauuccccucccagauguccgcaacaacuucuaccauuacaaccaauccaacgacccuaccauuaaauuaaucgccaugcuuuacacuccccuccgcgcaaauaacgccggggacgacguuuucaccguauccugccgcguccuaacccgacccagccccgauuucgacuucauuuuccucguuccacccaccgucgaaucccgcaccaaacccuucucuguacccgucuuaaccgucgaagaaaugaccaacucacgauuccccauaccacuagaaaaacuauucaccggacccucaagcgcauucgucguccagccccaaaacggccgaugcaccaccgacggaguccuccucggaaccacccaacuauccccggucaauaucugcacuuuccgcggcgacguuacccacaucuccggcucucgcaacuacacaaugaaccucgccucccaaaacuggaacucuuacgaccccaccgaagagaucccugcaccccuagguacaccagacuucguuggcaaaauucaaggcguccuuacccaaaccacccgaacagacggcuccacacgaggacacaaggccacggucuacaccggcucagcagacuucucccccaaacuaggccgaguccaauucgccaccgacaccgacaaugacuucgucaccaaccaaaacaccaaauucacacccguaggagugauccaagacggcagcaccaccccacgaaacgaaccacaacaauggguccuccccagcuauuccggacgcaacacccacaacguccaucuagcccccgccgucgcacccaccuuccccggcgaacaacuccuguucuuccgcucgacaaugccaggcugcucagguuacccaaacauggaccucgacugccuccuaccacaagaauggguacaauacuucuaucaagaagccgcucccgcccagucagacgucgcccuccuccgcuucguaaaccccgacaccggucgcguacuauucgaaugcaaacuacacaagucuggcuacgucaccguagcccacaccggccaacacgaccuagucauaccacccaacggcuacuuccgauucgacuccuggguaaaccaauuuuacacacucgcccccaugggcaacggaaccggaagacguagagcccuguag

SEQ ID NO: 35978 - RNA, 1623 nt, Artificial Sequence
  derived and/or modified sequence opt11 from VP1__Norovirus__AGS08080
augaagauggcaucauccgaugcaaacccaucugacggcaguaccgccaaccuugucccagaaguaaacaacgaagucauggcccucgaacccgucgucggcgccgcaaucgccgcaccagucgccggccaacaaaacgucaucgaccccuggauccgaaacaacuucguccaagcccccggcggcgaguucacagucucaccccgcaacgcucccggagaaauccucugguccgcuccccucggccccgaccucaaccccuaccucucucaccucgcccgcauguacaacggcuacgcaggcggcuuugaaguacaaguuauacuagccggcaaugccuucaccgcuggcaagauaaucuucgcagcaguucccccuaacuuccccacagaaggccuaucccccucacaagucaccauguuuccccacauuauagucgacguacgacaacuagaacccguccuuaucccacuaccugacgucagaaacaacuucuaccacuacaaccaaagcaacgacuccaccaucaaacucauugcaaugcucuacacaccccuccgcgcuaacaacgccggagacgacgucuucaccgucucaugucgaguccucacccgaccaucccccgacuucgacuucaucuuccucguaccacccaccguugaaucccguaccaaacccuucuccguacccauccucaccguagaagaaaugacuaacucccgcuucccaaucccacuagaaaaacuauucaccggacccagcuccgcuuucgucguccaaccacagaauggccgaugcaccacagacgguguccuccucgguaccacacaacuaucacccgucaacauauguaccuuucgcggcgacguuacccacauaccaggcucccacaacuacaccaugaaccuugccucccaaaacuggaacuccuaugaucccacagaagagaucccagcaccccucggcacaccagacuucguaggaaaaauccaaggaguacuaacccaaaccacaucaacaaacggaagcaccagaggacacaaagccaccgucuauaccggaucugcagauuucucccccaaacuuggcaggguccaauucgcaacugacaccaacaacgacuucgaaaccaaccaaaacaccaaauucacacccguaggcgucauccaagacggcuccacaaccccacgaaaugaaccccaacaaugggugcuacccuccuacuccggccgcaacauccacaacgugcaccuggccccugccguagcccccaccuucccuggcgaacaacuccucuucuuccgauccaccaugcccggcugcucaggauacccaaacauggaccucgacugccuacuuccccaagaguggguacaauacuucuaucaagaagccgcccccgcccaaucagacgucgcccuacuccgcuucgucaaccccgacaccggccgcguucuuuucgaaugcaaacuacacaaaucuggcuacgucacagucgcccacacuggccaacacgaccucguaauaccacccaacggcuacuucagauucgacuccugggucaaccaauucuacacccuagcccccaugggcaauggcacuggacgccgacgcgcccucuaa

SEQ ID NO: 35979 - RNA, 1623 nt, Artificial Sequence
  derived and/or modified sequence opt11 from VP1__Norovirus__AGS08081
augaaaauggcauccucagacgccaaccccagcgacggcucaacugcaaacuuagucccagaagucaacaacgaagucauggcacucgaacccguaguaggcgccgccaucgccgcccccgucgcaggccaacaaaacgucaucgaccccuggaucagaaauaacuuuguacaagcacccggcggcgaguucaccgucuccccacgcaacgccccaggcgaaauccuaugguccgccccacuaggucccgaccucaacccuuaccuaucccaccucgccagaauguacaacgguuacgcuggcgguuucgaaguccagguaauucucgccggaaacgcauuuaccgccggcaaaaucaucuucgccgccgucccuccaaacuucccuaccgaaggccucucacccucacaaguaaccauguucccccacaucauagucgacguccgccaacucgaaccaguccuaauaccccucccugacguacgcaacaacuucuaccacuacaaccaauccaacgacucaacaauaaaacucaucgccaugcuauacacaccucuacgugcuaauaacgccggcgacgaugucuuuaccgucuccugccgcguccucacucgccccucucccgacuucgacuucaucuuucucgugccacccaccguugaauccagaacaaaacccuucucgguccccauccucaccgucgaagaaaugacuaacucccgauuccccaucccccucgaaaaacucuucaccggccccucaagcgccuucgucguucaaccccaaaacggccguugcacuaccgacggcguccuccucggaacaacgcaacucucccccgucaacaucugcaccuuccgcggagacgucacgcacauccccggaucccacaacuacacaaugaaucucgccucacaaaacuggaacucauacgaccccacggaagaaauccccgcaccccucgguacacccgacuucgucggcaagauccaaggaguccucacccaaacaaccucaaccaacggauccacccgaggccacaaagccacugucuacaccgguucagcagacuucucccccaaauugggccguguccaauucgucaccgauaccaacaaugauuucgaaaccaaccagaacacuaaauucacccccguaggaguuauccaagacggcucaacgacuccacgaaacgaaccacaacaauggguacucccuuccuacucaggacgcaacauccacaauguacaccucgcacccgccgucgcccccaccuucccaggcgaacaacuccucuucuuccgcuccaccaugcccggcugcagcggauaucccaacauggaccucgacugccuacuuccacaggaauggguccaauacuucuaccaagaagccgcccccgcacaaucagacgucgcacuccuacgcuucguaaaccccgacaccggccgcguucuguucgaaugcaaacuacacaaaucaggcuacguaaccgucgcacacacaggccaacacgaucuggucauaccacccaacggcuacuucagauucgauuccugggucaaccaauucuacacgcuagcccccaugggcaacggaaccggccgucgccgcgcacucuaa

SEQ ID NO: 35980 - RNA, 1623 nt, Artificial Sequence
  derived and/or modified sequence opt11 from VP1__Norovirus__AGS08082
augaaaauggccuccuccgacgcuaaccccuccgacggcucaaccgcaaaccuuguccccgaaguuaacaacgaaguuauggcacuagaaccaguugucggagccgcaaucgcagcccccgucgccggacagcaaaacgucaucgaccccuggauccgaaacaacuucguccaagccccuggcggcgaguucaccguuuccccacgcaacgccccuggcgaaauacucugguccgcaccccucggcccagaccuuaacccauaccucucccaccuggcccgcauguacaacggcuaugccgguggcuucgaaguacaagucauccucgccggaaacgcauucaccgcuggaaaaauaaucuucgcagcagugccacccaacuuucccaccgaaggacucucccccucucaggucaccauguucccccacauaauaguagacguacgccaacuagaacccguccucauaccacugcccgacguccgaaacaacuucuaccacuacaaccagagcaacgaccccaccauaaaacuuaucgcuaugcucuacacuccucuccgcgcaaacaacgccggcgacgacguuuucacagucucaugccgcguccucacacgcccauccccagacuuugacuucauauuccucgucccucccaccgucgaaucccgcaccaaacccuucuccguccccguucucaccgucgaagaaaugacaaacucccgcuuccccaucccccucgaaaaguuauucacaggccccucauccgccuucgucguucaaccacaaaacggccgcuguaccacagacggcguccuccuaggaacaacccaacuaucaccaguaaacauaugcaccuuccgaggcgacgucacccacaucucagguucucgaaacuacaccaugaacuuagccucccaaaacuggaacuccuacgaccccacugaagaaauccccgcaccccucgguaccccagacuucgucggcaaaauacaaggcguccugacccaaaccacccgaaccgacggcuccacccgcggccacaaggccaccgucuacaccggauccgccgacuucaccccgaaacuuggccgcguacaauucgccaccgacaccgacaacgacuucgucaccaaccaaaacacaaaauucaccccagucggcgucauccaggacggcuccacaacaccccgaaacgaaccacaacaauggguacuccccucauacagcggccgcaacacccacaacgugcacuuagcaccggcaguagccccgaccuucccaggcgaacaacuccucuucuuccgcucaaccaugcccggcuguuccggcuaucccaauauggaccuagacugccuacucccccaagaaugggugcaguacuucuaccaagaagccgcccccgcccaaucagacgucgcacuacuacgcuucguaaacccugacaccggucgcguccuguucgaaugcaaacuacacaagucagguuacguaacagucgcacacaccggacaacaugaccucgucaucccacccaacggcuacuuccgcuucgacucgugggucaaccaauucuacacccucgcacccaugggaaacggcaccggccgucgacgcgcccuauaa

SEQ ID NO: 35981 - RNA, 1623 nt, Artificial Sequence
  derived and/or modified sequence opt11 from VP1__Norovirus__AGS08083
augaaaauggccucgucugacgcaaaccccuccgacggcucaacagccaaccuaguccccgaaguaaacaacgaaguaauggcccucgaaccugucgucggugccgccaucgcagcuccuguagcaggccaacaaaauguaaucgaucccuggauccguaacaacuucguccaagcaccaggcggcgaauuuaccguaucaccccgcaacgcccccggcgaaauccuauggagcgcaccccuuggcccagaccucaacccauaccucagccaccucgcccguauguacaacggauacgccggcggcuucgaaguacaagucauccucgccggcaacgccuucaccgccgguaaaaucauauucgccgcaguaccucccaacuuccccaccgaaggucucuccccaucacaagucacaauguucccucacauaaucgucgacguccgccaacucgaaccuguccuaaucccucuccccgacguacgcaacaacuucuaccauuacaaccaaagcaacgaccccaccaucaaacuaaucgccauguuauacaccccacuccgcgccaacaacgccggugacgacgucuucaccgucuccugccgaguccucacccgccccucuccagacuucgacuucaucuuccuggucccacccacagucgaaucccgaacgaaacccuucucagucccaguccuaacagucgaagaaaugaccaacucacgcuucccaauaccacuagaaaaacucuucaccggcccauccuccgccuucgucguccagccccaaaacggucgaugcacuaccgacggcguccuacuaggaaccacccaacucucaccaguaaacauaugcaccuuucgcggcgacguaacucacaucuccggcucccgaaacuacacuaugaaccucgccucccaaaacuggaacuccuacgaccccaccgaagaaauaccagcaccccuaggcacccccgacuuuguaggcaagauccaaggcguccucacccagaccacccgcacagauggcucaacacgcggccacaaagccacaguauacaccgguuccgccgauuucucaccaaaacucggacgaguccaguucgccaccgacacagacaacgacuucgucaccaaccaaaacaccaaauucacccccgucggcguaauacaagacggcuccacuacaccacgcaacgaaccacaacaauggguccuuccuuccuacuccggccgcaauacucacaacguccaccucgcaccggccgucgccccaacuuuccccggcgaacaacuccuauucuuccgcucuaccaugcccggaugcucaggcuacccaaacauggaccucgacugccuccucccccaagaauggguccaauacuucuaccaagaagccgcccccgcccaauccgacguagcauuacuucgcuucguaaaccccgacacaggacgaguccucuucgaaugcaaacuacacaaaucaggcuacgucaccgucgcacacaccggacaacacgaccucguaauaccucccaacggauacuuccgcuucgauuccuggguaaaccaauucuacacacuugcccccaugggcaacggcacaggccgacgcagagcacuauaa

SEQ ID NO: 35982 - RNA, 1623 nt, Artificial Sequence
  derived and/or modified sequence opt11 from VP1__Norovirus__AGS08084
augaaaauggccucaagcgacgcaaaccccuccgacgguuccacagccaaccucguaccagaagucaacaacgaaguaauggcucuagaacccguagucggcgccgcuaucgccgccccuguagccggccaacaaaacguaauagaccccuggauccgcaacaacuucguacaagcacccggcggcgaguucaccgucuccccacgcaacgcaccaggcgaaauccucugguccgcuccccuaggccccgaucucaacccauaccucucacaccucgccagaauguacaacgguuacgccggcggcuucgaaguacaaguaauccuagcaggcaacgccuucaccgcaggcaaaauaaucuucgcagccgucccacccaacuuccccacagaaggacucuccccuucccaaguaaccauguucccacacaucaucgucgacguacgccagcucgaaccaguacucaucccccuccccgacguucgcaacaacuucuaccacuacaaccaaucauacgaccccacuauaaaacucaucgccaugcucuacaccccacuaagagccaacaacgcuggagaugacgucuucacaguaagcugccgaguccuaacccgaccaucacccgacuucgacuucaucuuccucgucccacccaccguugaauccagaaccaaacccuucuccgucccaguccuaacaguugaagaaaugacaaacucccgcuuccccaucccccucgaaaaacucuucaccggacccucauccgcuuucguaguccaaccacaaaacggacgcugcaccaccgacggaguccuucucgguaccacccaacuauccccagucaacaucugcaccuuucgaggcgacgucacacacauacccggaucccauaacuacaccaugaaccucgccucccaaaacuggaacucauacgaccccaccgaagaaaucccagcaccccucggcaccccagacuucgucgguaaaauccagggcguacuaacacaaaccacaaaaaccaacggcuccaccagaggucacaaagccaccgucuacacaggauccgccgacuucucccccaagcucggccgcguccaauucgccacggacaccaacaacgacuucgaaacaaaccaaaacaccaaauucaccccaguaggaguaauacaagacggcucuacaacaccccggaacgaaccccaacaauggguccuccccagcuacucgggacgcaacauccacaacguccaccucgcccccgccgucgcccccaccuuccccggcgaacaacuccucuucuuccgcuccacaaugcccggcugcuccggcuacccaaacauggaccuagacugccuacucccacaagaauggguucaauacuucuaccaagaagccgcucccgcacaaucagacguggcccuccuccguuucgucaaccccgacaccggccgagucuuauucgaaugcaaacuccacaaguccggcuacguaaccgucgccuacaccggacaacacgaucucgucauacccccaaacggcuacuuccgcuuugacucaugggucaaccaguucuacacccucgccccuaugggcaacggcaccggccgacgccgcgcucucuaa

SEQ ID NO: 35983 - RNA, 1623 nt, Artificial Sequence
  derived and/or modified sequence opt11 from VP1__Norovirus__AGS08085
augaaaauggccuccuccgaugccaaucccuccgacggcuccgccgccaaccucguaccggaagucaacaacgaagucauggcacuugaacccgucgucggagccgccaucgccgccccaguagccggccaacaaaacguaaucgacccauggauccgcaacaacuucguccaagcccccggaggugaauucaccguaucccccagaaacgcccccggcgaaauacucuggucagccccccucggccccgaccuaaaccccuaccuaucccaccuagcccgaauguacaacggcuacgcuggaggcuucgaaguccaagucauccuugcuggaaacgcauucaccgccggcaaagucaucuucgcagccgucccuccaaacuuccccacagaaggccuaucacccucgcaggucacaauguucccucacauagucguagacguccgccaacucgaaccagucuuaaucccucuaccagacguacggaacaacuucuaccacuacaaccaguccaacgaccccacaaucaaacuaaucgccaugcucuacaccccccugcgagccaacaaugccggagacgaugucuucacugucagcugccguguccucacccgccccucccccgacuucgacuucaucuuccucgucccgcccaccgucgaaucacgaaccaaacccuucuccguccccguccuaaccgucgaagaaaugaccaacagccgcuuccccauaccccuggaaaaacuauucaccggacccucaucagccuucgugguccaaccccaaaacggccgcugcaccaccgacggagucuuacucggcaccacccaacucucccccgucaacauaugcaccuuccgaggagacguaacccacaucaccggaucucgcaacuacaccaugaaccucgcaucacaaaacuggaacaacuacgacccgaccgaagaaaucccagcaccccucggaacacccgacuucguaggcaaaauccaagguguacuaacccaaacaacccguaccgauggaucaacccgaggccauaaagccaccguauacaccggcuccgccgacuucgcacccaaacucggacgaguccaauucgaaaccgacaccgaccacgauuucgaagcaaaccaaaacacaaaauucacccccguaggcgucauacaagacgggggaacaacccaccgcaaugaaccacaacaauggguccucccuuccuacuccggccgcaacacccacaacguacaccuugcucccgccguagccccaacauucccaggagaacaacuccuauucuucagaucaacaaugcccggaugcucuggcuaccccaacauggaccuugacugccugcucccccaagaauggguccaauacuucuaccaagaagccgccccagcacaaucagacgucgcccuacuccgauucgucaaucccgacacaggccgcguacuauucgaaugcaagcuccauaagagcggcuacgccacuguagcacacaccggccaacacgaccucgucaucccacccaacgguuacuuccgguucgacucuugggucaaccaauucuacacacucgcccccaugggcaacggcacaggccgacgucgcgcagucuaa

SEQ ID NO: 35984 - RNA, 1623 nt, Artificial Sequence
  derived and/or modified sequence opt11 from VP1__Norovirus__AGS08086
augaaaauggcuucuucagacgccaacccauccgacggcucaacggccaaccuuguccccgaagucaacaacgaagucauggcucucgaacccgucgucggcgcugccauugccgccccagucgccggacaacaaaacguaaucgaccccuggauccgcaacaacuucguacaggcccccggcggagaguucaccgucucuccccgaaacgcccccggagaaauauuaugguccgccccacucggucccgaccuuaaucccuaccucagccaccucgcucgcauguacaacggcuacgccgguggcuucgaaguccaagucauccuagcaggaaacgcuuucaccgcaggcaaaauuauauuugcagcaguaccucccaacuuccccacagaaggccuuucccccucucagguaaccauguucccccacaucauagucgacguccgccaacucgaacccguucucaucccccuucccgacguccgcaacaacuucuaccacuacaaccaauccaacgauuccaccaucaaacuaaucgcaaugcucuacacaccccuccgcgccaacaacgccggcgacgacguauucaccguauccugccgcguccucacccgucccuccccagauuucgacuuuauuuuccucguacccccaaccgucgaaucccgcaccaaaccauucuccguccccauccucaccguagaagagaugaccaacucacguuuuccaaucccccuagaaaaacuuuucacaggacccaguuccgcuuucgucguccaaccccaaaacggacgcugcaccaccgacggaguacuacugggcaccacccaacuuuccccugucaacaucugcacauuccgcggugacguuacccacaucccaggcucccacaacuacacaaugaaccucgcaucacaaaacuggaacucauaugaccccacugaagaaauacccgcaccucuaggaacaccagacuucguaggcaaaauccaaggcguccuaacacaaaccaccuccaccaacggcuccacccgaggccacaaagcaaccguauauaccggaagcgccgauuucucacccaaacuaggccgaguccaauucgccacagacaccaacaacgacuuugaaaccaaccagaacacaaaguuuacucccgucggcguaauccaagacggcuccacuacaccccgcaaugaaccccaacaauggguacuaccuuccuauucagguaggaacauccacaacguccaccucgcacccgccgucgcccccaccuuccccggcgaacaacuccucuucuuccgcucuacuaugccaggcugcucuggcuacccaaauauggaccuagacugccuucugccacaagaauggguccaauacuucuaccaagaagcagcaccagcccaauccgacguagcccuacuccgauucguaaaccccgacaccggccgaguucucuucgaaugcaaacuccacaaauccggcuacgucacagucgcccacacaggccaacacgaccuagucaucccaccuaacggcuauuuccgauucgacucaugggucaaccaauucuacacccucgcccccaugggcaacggcaccggaagacgccgcgcccuuuaa

SEQ ID NO: 35985 - RNA, 1623 nt, Artificial Sequence
  derived and/or modified sequence opt11 from VP1__Norovirus__AGS08087
augaaaauggcaucauccgacgcaaaccccucagacggcuccaccgcuaaccuaguucccgaagucaacaacgaggucauggcacuagagcccgucgucggagccgcuaucgccgcacccguagccggacagcaaaaugucaucgacccauggauccgaaacaacuuuguccaagccccgggcggcgaguucaccguaagcccccgaaacgcccccuccaccauacucugguccgccccacucggcccagaccuaaaccccuaccuaucccaccuagccagaauguacaacggcuaugccggcggauucgaaguccaaguaauacuagccggcaacgcauucaccgccggaaaaaucauauucgccgccguacccccaaacuuccccacggaaggccucucccccucccaaguaaccauguucccacacauaaucguggacguacgccaacuagaacccguccuaaucccccuccccgacguacgaaacaacuucuaccauuacaaucaaagcaacgacccuacaaucaaacuaaucgccaugcucuacacaccccuacgagccaacaaugcuggugacgacgucuucaccguauccugccgcguccucaccagacccuccccugacuucgacuucaucuuccuaguuccacccaccguagaaagccgcaccaaacccuuuucaguccccguccuaaccguagaagaaaugaccaacucccgcuucccaaucccacucgaaaaacuauucaccggccccuccuccgccuucguaguccaaccccaaaacggacgcugcaccaccgacggaguacuccucgguacuacccaauuaucccccguaaacaucugcaccuuucgcggcgacgucacccacauuagcggcuccagaaacuacacaaugaaccuagcaucacaaaacuggaacuccuaugacccuacugaagaaauccccgcaccccuaggcacccccgacuucgucggcaaaauccaaggcguccuuacccagaccacccguacagacggcucgacacguggucacaaagccacagucuacaccggaucagccgacuucucaccaaaacucggacgcguccaauuugcaaccgacacagacaacgacuucgucacaaaccaaaacacaaaauucacccccgucggcgucauacaagacgguuccacuacaccccgcaacgaaccccaacaauggguacuccccagcuacuccggucgcaauauccacaacguccaccuggcaccagccgucgccccaaccuucccaggcgaacagcuccuauucuuccgcucaaccaugccaggaugcucaggcuauccuaauauggaccuugacugccuccuaccacaagaauggguccaauacuucuaucaagaggcagcucccgcccaaagcgacguagcccuccuccgcuucgucaaccccgacaccggccgcguucuuuucgaaugcaaacuccacaaaucaggcuacguaacuguagcccauacaggacaacacgaccucgucaucccacccaacggcuacuucagauucgacuccuggguaaaccaauucuacacacuagcccccaugggcaacggcacaggccgucgcagagcccucuaa

SEQ ID NO: 35986 - RNA, 1623 nt, Artificial Sequence
  derived and/or modified sequence opt11 from VP1__Norovirus__AGS08088
augaaaauggccucauccgaugccaacccuuccgacggcucaaccgccaaccucguaccagaagucaacaaugaagucauggcccucgaaccaguuguaggagccgccauagccgcuccuguugccggacagcaaaacgucaucgaccccuggauacgcaacaacuucguccaagcccccgguggcgaguucaccgucucccccagaaacgccccaggcgaaauccucuggucagccccacuaggaccagaccucaaucccuaucuaucacaccuagcccgcauguacaacggcuaugcaggcggcuucgaaguccaaguuauccucgcaggcaacgcauucaccgccggcaaaauaaucuucgccgccgugcccccaaacuuccccaccgaaggucuaucaccaucccaagucacaauguucccccacauaaucgucgacguccgccaacucgaacccguccucauaccccuccccgauguucgaaacaauuucuaccacuacaaccaaucgaaugacuccaccaucaaacuuauagccaugcuauacaccccacuacgcgccaacaacgccggcgaugaugucuucaccgucuccugccgcguacucacccgccccagccccgacuucgacuucaucuuccuagucccacccacugucgaaucccgcaccaaacccuucagcguccccauccucaccguagaagaaaugaccaacucacgcuuucccaucccccucgaaaaacucuucaccggccccuccuccgccuuugucguacagccccaaaacggccgcugcaccaccgacgggguccuacucggcacaacccaacucucacccguaaacaucuguaccuucagaggagacgucacccacaucccaggcucucacaauuacacaaugaaccuagccucccaaaacuggaacucauacgaccccaccgaagaaauccccgcaccccuaggcacucccgacuuugucggaaaaauccaaggaguccugacccaaaccacaucaacuaacggcuccacccgcggccacaaagccacagucuacaccggcuccgccgacuucucaccgaaacuuggacguguacaauucgccacagacaccaacaacgauuucgaaaccaaucaaaacacaaaauucacaccugucggcgucauacaagacggcuccacuacuccccgaaaugaaccccaacaauggguccuucccucuuacuccggccguaacauccauaacguccaccuagccccugccgucgcccccaccuuccccggcgaacagcuucuauucuuccgauccacuaugcccggaugcucaggcuaccccaacauggaucuugacugucuacuaccccaggaauggguucaauacuuuuaccaagaagccgcuccagcccaaucugacgucgcucuccuccgauucgucaacccagacaccggccgaguccuauucgaaugcaaacuccacaaauccggcuacguaacgguugcccacaccggccaacacgaccugguaaucccgccaaacggcuacuuccgcuuugacucaugggucaaccaauucuacacacuagccccaaugggcaauggcaccggccgccgacgagcacucuaa

SEQ ID NO: 35987 - RNA, 1623 nt, Artificial Sequence
  derived and/or modified sequence opt11 from VP1__Norovirus__AGS08089
augaaaauggcauccuccgacgccaaccccuccgacggcucaaccgccaaccuaguacccgaagucaacaacgaaguaauggcucucgagcccguaguaggugcggcaaucgccgcacccguagcaggccaacaaaacgucaucgaccccuggauacgcaacaacuucguucaagcacccggcggcgaguucaccgucucccccagaaacgcaccaggagaaauccucuggagcgcaccccucggccccgaccucaacccauaccucagccaccucgccaggauguacaacggauacgccggaggauucgaaguccaagucauccuagccggcaacgcguuuaccgccggaaaaauaaucuucgccgccgucccucccaacuuccccaccgaaggccucucaccaucccaagucaccauguucccccacaucaucgucgacguacgccaacucgaaccaguacucauuccucucccagacguacgcaacaacuucuaccacuacaaccaauccaaugacuccacaauaaaacuaaucgcaaugcucuauacaccacuccgugcuaacaacgccggcgacgacguuuucacagucucuugucgaguccucacacgaccaucucccgauuucgacuucaucuuccucgucccucccacgguugaauccagaacaaagcccuucucaguccccguccuuacaguugaagaaaugacaaacucccgauuccccauaccccucgaaaaacucuucacaggccccuccuccgcauucguuguccaaccccaaaacggccgaugcaccaccgacgggguccucuuaggcaccacacaacucagcccgguaaacauaugcaccuuuagaggagacguaacacacaucccaggcucaaggaacuacaccaugaaccuggccucccaaaacuggaacuccuacgaccccacagaagaaauucccgcaccccucggcaccccagacuucguaggaaaaauccaagggguccucacacaaacaacacgcacaaacggaucuacccgcgggcacaaagcaaccguauacacaggcuccgccgacuucagccccaaacuaggacgcguccaauucgcaacagacaccgauaacgacuuugaaacuaaccaaaacaccaaauuuaccccaguaggcgucauacaggacgguucaaccacuccccgaaacgaaccucaacaauggguccucccaucauacucaggccgcaacauacacaacguacaccuggccccagccgucgccccaaccuucccaggagaacaacuccucuucuuccgauccacaaugccaggcugcagcggauaccccaacauggaccucgacugccuacuaccacaagaauggguccaauacuucuaccaagaagcagcccccgcccaaucagacguagcccuacuacgcuucgucaaccccgacacaggccgcguccucuucgaaugcaaacuccacaagagcggcuacgucacagucgcccacacaggccaacacgaccucgucauaccacccaacggauacuuccgcuuugacucauggguaaaccaauucuacacacucgcacccaugggaaacggcacgggccgccgacgagcccuauaa

SEQ ID NO: 35988 - RNA, 1623 nt, Artificial Sequence
  derived and/or modified sequence opt11 from VP1__Norovirus__AGS08090
augaaaauggccuccucagacgccaaccccuccgacgguuccaccgcaaaccucgucccugaagucaauaacgaagucauggcccucgaaccuguaguaggagcagccaucgccgcacccgucgcaggccaacaaaacgucaucgaccccuggauccguaauaacuucguacaagcuccaggcggagaguucacaguaucaccccggaacgcccccggagaaauccucugguccgccccacucggcccugaccuuaacccuuaccucucccaccucgcccgaauguacaacggauaugccggaggauucgaaguccaagucauucuagcaggcaacgcauucaccgccggcaaaaucauauucgccgccgucccacccaacuuccccaccgaaggacucucccccucccaagucacaauguucccccacauaaucgucgacguacgccagcuagaacccguacucaucccccuccccgacguacgaaacaacuucuaccauuacaaccaguccaacgacccgaccauuaaacuuaucgcgaugcuauacacaccccuccgcgccaacaacgcaggagacgacgucuucaccgucuccugccgcguccucacccgccccucucccgauuuugacuucaucuuccuaguacccccuaccgucgaaucacgaaccaaacccuuuuccguccccguccuaacagucgaagaaaugaccaauuccagauuccccaucccccuugaaaaacucuucaccggacccuccucggccuucguaguccaaccucaaaacggccgcugcacaaccgacggcguacuccucggcaccacccaacuaucccccgucaacaucuguacauuccgcggcgacgucacucacaucuccggcucacgaaacuacacuaugaaucucgccucucaaaacuggaacucauacgaccccaccgaagaaauaccagcaccccucggcaccccagauuucgucggcaaaauccaaggcguccucacccaaacaacucgcaccgacggcuccacgcgcggucauaaagcuaccgucuacaccggauccgccgacuuuuccccaaaacucggccgcguccaauuugccaccgacaccgacaaugacuucgucaccaaccaaaacaccaaauucaccccaguuggcgucauucaagacgggagcaccaccccacgaaacgaaccccaacaauggguacucccgucuuacuccggccgcaacacacacaacguccaccucgccccagccgucgcgccaacauuccccggugaacaacuccucuuuuuccgaagcaccaugcccggauguuccggcuaucccaacauggaccucgacugccuccuaccacaagaauggguccaauacuucuaccaagaagcagccccagcacaaucugacgucgcacuccuacgcuucguaaaccccgacaccggccguguccucuucgaaugcaaacuccacaaauccgguuacgucaccguggcucauaccggacaacacgaccucgucaucccacccaacggcuacuuccgcuucgacagcugggucaaccaauucuacacccucgcacccaugggcaacggcaccggccgccgccgcgcccucuaa

SEQ ID NO: 35989 - RNA, 1623 nt, Artificial Sequence
  derived and/or modified sequence opt11 from VP1__Norovirus__AGS08091
augaaaauggccucaucagacgcuaaccccaccgacggcucagcugccaaccuuguccccgaagucaacaacgaagugauggcccuagaacccgucgucggcgccgccaucgccgcccccguagccggacaacaaaacgucauagaccccuggauccgcaacaacuucguacaagcccccggaggagaguucacagucagcccaagaaaugcccccggugaaauccuauggagcgcaccccugggcccagaccuaaacccauaccucucucacuuagcccguauguacaacgguuacgccggcggcuucgaaguccaagucauccuugcaggaaacgcauucaccgccggcaaaaucaucuucgcagcagucccucccaacuucccgaccgaaggccucucaccaucccaagucacuauguucccccacaucaucgucgacguacgucaacucgagccaguacuaaucccccucccagacguccgcaacaauuucuaccacuacaaccaauccaacgacuccaccaucaaacucauagccaugcuuuacacuccuuuacgagccaacaacgccggggacgacguuuucacagucuccugccgcguucucacccgcccuucacccgauuucgacuucauauuccucguaccucccacggucgaaucacgcaccaaacccuucucugucccaguacucaccgucgaagagaugaccaauucccguuucccaaucccguuagaaaaacuauucaccggacccucauccgccuucgucguacaaccccaaaacggccgcugcaccaccgacggaguacuacucggaacuacccaacucagccccguuaacaucugcaccuuccgcggagacgucacccauauaaccggcucccgaaauuacacaaugaaccuagcaucccaaaacuggaacaacuacgacccgacagaagaaacacccgcaccccucggcaccccagacuucgucggaaaaauccagggcaugcucacacaaaccacccgcacagacggcuccacacggggccacaaagccacagucuacacagggagugccgacuucgccccaaaacucggccgcguacaauucgaaacugauaccgaccacgacuucgaagcaaaccaaaacaccaaauucacccccgucggcgucauccaagacggcuccacaacccaccgcaacgaaccacaacaauggguccuacccagcuacuccggacgcaauacacacaacguacaccucgcccccgccgucgcuccaaccuuccccggcgaacaacuccuuuucuuccgcucaaccaugcccggcugcucaggcuacccuaauauggaccuagacugccuacucccgcaagaauggguccaauacuucuaccaagaagccgcaccagcccaauccgacguagcccuccuccgauucgucaaucccgacaccggccgcguacuauucgaauguaagcuccacaaaucaggcuacguaacagucgcacacaccggacaacacgaccugguuaucccacccaacggcuacuuccgcuuugacagcuggguaaaccaauucuacacccucgcacccaugggcaacggaaccggccgccgacguguagucuaa

SEQ ID NO: 35990 - RNA, 1623 nt, Artificial Sequence
  derived and/or modified sequence opt11 from VP1__Norovirus__AGS08092
augaaaauggcaucaucggacgccaauccguccgacggcuccacggccaaccucguccccgaaguaaacaaugaagucauggcacuagaacccgucgucggagccgcuaucgccgcacccguagcuggccaacaaaacgucaucgaccccuggauccgcaacaacuucguccaagcccccggaggcgaguucacagucuccccacgcaacgcuccaggcgaaauccuaugguccgcgccccuaggccccgaccugaacccauaccuuucccaccucgcccgaauguacaacggauacgccggcggauucgaaguccaagucauccucgccggcaaugccuucacagccggcaaaaucaucuucgccgccguuccucccaacuuccccaccgaaggccuuucccccucccaagucaccauguucccacacaucaucguagacguccgccaacucgaacccguacucauaccccuccccgauguucgcaacaacuucuaccacuacaaccaaucuaacgacccgaccaucaaacuaaucgccaugcucuacaccccacuacgcgccaacaacgcgggcgacgauguuuucacagucagcugccgcguacucacccgcccgucccccgacuucgacuucaucuuccuuguucccccuaccgucgaaucucgaacaaaacccuucuccgucccaguccucacagucgaagaaaugacaaacucucgauuuccgauaccucucgaaaaacucuucaccggccccucuuccgccuucguaguccagccccaaaacggccgcugcacgaccgacggcguccuccucggaacaacccaacuaucucccgucaacaucugcaccuuucgcggagacgucacccacaucuccggaucccgcaacuacacaaugaacuuagcaagccaaaauuggaacuccuacgaccccaccgaagaaauccccgcuccccuuggcacgccugacuuugucggcaaaauacaaggaguccuaacccaaaccacacgaaccgacggaucaacccgaggacacaaggccacagucuauacgggcucugccgacuucucaccaaaacucggccgcguccaauucgccaccgacaccgacaacgacuucgucacaaaccaaaacacuaaauucacacccguaggcguuauccaagacggcucuaccaccccacgcaacgaaccccaacaauggguucucccaucuuacucaggaagaaacacccauaacguacaccuagcccccgccguagcccccacauuccccggugaacaacuccucuucuuccgcucuaccaugcccggcugcuccggauaccccaauauggaucuugacugccuccucccgcaagaauggguccaauacuucuaccaggaagcagcccccgcccaaucagacgucgcacuccuccgcuucgucaaccccgauaccggcagaguucucuucgaaugcaaacuacacaaauccgguuacgucaccguugcccacaccggacaacacgaccuaguaauacccccaaacggcuacuuccgauuugauuccugggucaaccaauucuacacccuagcacccaugggaaacggaaccggcagacgcagagcacucuaa

SEQ ID NO: 35991 - RNA, 1623 nt, Artificial Sequence
  derived and/or modified sequence opt11 from VP1__Norovirus__AGS08093
augaaaauggcaucauccgacgccaacccauccgacggaucaaccgccaaccucgucccagaagucaacaacgaagucauggcacucgaaccagucguaggcgcagccaucgcagcucccguagccgggcaacaaaacguaauagaccccuggauucgcaacaacuucguccaagcccccgggggagaauuuacagucucuccccgcaacgcacccggcgaaauccuuugguccgccccacucggccccgaccucaaccccuaccuaucccaccuagcacgcauguacaacggcuacgcaggcggcuucgaaguccaggucauccucgccggcaacgcuuucacugccggcaaaaucaucuuugccgccgucccacccaauuuucccaccgagggccuaucccccucccaaguaaccauguucccccacaucaucguagacguccgacaacucgaacccgucuuaaucccccuucccgacguccgcaacaacuucuaccacuacaaccagagcaaugacucuacaauaaaacucauagccaugcuuuacacaccccuccgcgccaacaacgcaggagacgacgucuucaccgucucaugccgaguccucacccgccccucacccgauuucgacuuuaucuuucucguaccacccacuguagaaucccgaaccaaacccuucuccguccccauacucaccgucgaggagaugacaaacucccgcuuccccaucccccucgaaaaacucuucaccggucccuccuccgccuucgucguccagccccaaaacggccgcugcaccaccgacggaguccuucuuggaaccacacaacuuucucccguuaauauaugcacuuuccgcggagacguaacccacauuccaggcucccacaauuacacaaugaaccucgccagccaaaacuggaacuccuacgaccccaccgaagaaauaccagcaccccucggcacacccgacuucgucggaaaaauccaagguguccucacccaaaccaccuccaccaacggcucuacacgcggccacaaagccacagucuacaccggauccgccgacuucucccccaaacuggggcgaguccaauucgcaacugacaccaacaacgauuucgagaccaaccaaaacacuaaauucacccccguaggcguaauacaagacgguucgacuacaccacgaaacgaaccccaacaauggguccuaccuuccuacuccgggcgcaacauacacaacguccaccucgcccccgcagucgcccccacauuccccggagaacaguuacuuuucuuccgaucaacaaugccaggcugcuccggcuacccgaacauggaccuagacugccuccuaccccaagaauggguucaauacuucuaccaagaagcagcccccgcccaaucagacguugcccuccuucgcuucguaaacccugacacaggcagaguccucuucgagugcaaacuacacaagucaggcuacguaacaguagcacacacuggccaacacgaccucgucaucccaccaaacggcuacuuccgguucgacuccugggucaaccaauucuacacacucgccccaaugggaaacgguacaggcaggcgacgggcccuauaa

SEQ ID NO: 35992 - RNA, 1623 nt, Artificial Sequence
  derived and/or modified sequence opt11 from VP1__Norovirus__AGS08094
augaaaauggcauccucagacgcgaaccccuccgacggaucaacagcuaaccuggucccugaaguaaacaacgaaguaauggcacuggaacccgucgucggugccgcaaucgccgcccccgucgccggccaacaaaacgucauagacccauggauccgaaacaacuuuguccaagcucccggcggugaauuuaccgucagcccccggaacgccccgggcgagauccuauggagcgcgccccuaggucccgaccuaaacccauaccucucacaccuagcccgcauguacaacggcuacgccggcggcuucgaaguacaagucauccuugccggcaaugcauuuaccgccggaaaaaucaucuucgccgcagugccaccuaacuuccccaccgaaggacucucacccucccaaguaaccauguucccccacauaauagucgacgucaggcaacuugaacccguacucauuccacuucccgacguccgaaacaacuucuaccacuacaaccaauccaacgacccaacaaucaaacuaauugccaugcucuacaccccucucagagccaacaacgccggcgacgacgucuucacugucuccugucgcguccuaacccgccccucuccggacuucgacuucaucuuccuaguacccccuacagucgaaucaagaaccaaaccuuucuccgucccuguacuaacuguagaagaaaugacuaauucacgauucccaaucccccuagaaaaacucuucaccggccccucauccgccuuugucguccaaccccaaaacggccgaugcaccacugacggcguccucuuaggaaccacacaacuaucacccgucaacaucugcaccuuucgcggcgacgucacccacauccccggcucuagaaauuacaccaugaaccuugcaucacaaaacuggaacuccuacgaccccacugaagaaauccccgcaccucuuggcacaccugacuuuguagggaagauccaaggaguccucacacaaaccacccgcacaaacggcucgacucgcggacauaaagccaccguuuacaccggaucagcggacuuuucacccaaacucggccgcguacaauucgcaaccgacacagacaacgacuucgaaaccaaccaaaacaccaaauucacccccguaggcgucauccaagacggcuccaccacaccccgcaacgaaccucaacaauggguccuccccagcuacucaggacgaaacauccacaacgugcaccucgccccugcagucgccccuaccuuccccggagaacaauuacuuuucuuccgcucaaccaugcccggaugcuccggcuaccccaacauggaccuagacugcuuacuaccccaagaauggguacaauacuucuaccaagaagcagcacccgcccaauccgacgucgcccuccuccgcuucgucaaucccgacaccggccgcguccucuucgaaugcaaacuacacaaauccggcuacgucacagucgcacacaccggccagcacgaccuugucaucccacccaacggcuacuuccgauucgacuccuggguaaaccaauucuacacccuagcucccaugggcaacggcaccggccgacgccgcgcacucuga

SEQ ID NO: 35993 - RNA, 1623 nt, Artificial Sequence
  derived and/or modified sequence opt11 from VP1__Norovirus__AGS08095
augaaaauggcuuccucagacgccaacccauccgacggaucaacagccaaccuaguacccgagguaaacaacgaagucauggcccucgagcccgucgucggcgccgccauugccgccccagucgccggccaacaaaacgucaucgacccauggauccgaaacaacuucguccaagccccagguggcgaguucacagucucaccccgcaacgcccccggagaaauccucuggucugcaccccucggcccugaccucaaucccuaccuaucccaccucgcccgaauguauaauggcuacgccggcggauucgaaguccaagucauccuagcaggcaacgccuucaccgcuggcaaaaucauauucgccgccgucccucccaacuuccccaccgaaggacucuccccaucccaaguaaccauguucccccacauaaucguugacguacgacaacuagaaccaguccuaaucccccuacccgacguccguaacaacuucuaccacuacaaccaauccaacgauccaacaaucaaacucaucgccaugcucuacacaccccuucgcgcaaacaacgccggagacgacgucuucaccguauccugucgaguccucacccguccgucccccgauuucgacuucaucuuccuaguacccccaaccgucgaaucccgcaccaaacccuucucggucccaguccucaccgucgaagaaaugaccaacucgcgcuuccccauuccacucgaaaaacuauuuaccggacccucauccgccuuuguaguacaaccacaaaauggaagaugcaccaccgauggaguacuccuggggaccacccaacugucccccgucaacauaugcaccuucagaggugacguaacccacaucccaggcucacgaaacuacaccaugaaccucgcaagucaaaauuggaacucauacgacccaaccgaagaaauccccgccccacucggcaccccggacuucgucggcaaaauccaaggaguacugacccaaaccacacguaccaacggcucaacucgcggucacaaagccaccgucuacaccggauccgcggacuucucacccaagcugggacguguccaauucgccacagacaccgauaacgauuucgaaacaaaccaaaacacaaaauucaccccaguagguguaauccaagacggcuccaccacaccccgcaacgaaccccaacaauggguccucccuuccuacucuggccgcaacauccacaacguacaccuggcccccgcagucgccccuaccuuccccggcgaacaacuacuuuucuuccgauccacaaugcccggcugcuccgguuaccccaacauggaccucgacugccuacucccacaagagugggugcaauacuucuaccaagaagccgcgcccgcccaaucagacgucgcccuccuccgcuucguaaaccccgacacaggacguguacucuucgaaugcaaacuccacaaauccggcuacgucacaguugcacacaccggccaacacgaucucgucaucccaccaaacgguuacuucagguucgacuccugggucaaccaauuuuauacccuagcucccaugggcaacggaaccggacgacgccgugcccucuga

SEQ ID NO: 35994 - RNA, 1623 nt, Artificial Sequence
  derived and/or modified sequence opt11 from VP1__Norovirus__AGS08096
augaaaauggccuccuccgacgcaaaccccuccgacggcucagccgccaaccucguccccgaagucaacaacgaaguaauggcccucgaaccaguagucggagcagccaucgcagcuccagucgccggccaacagaaugucaucgacccuuggauacguaacaacuucguccaagcccccggaggagaguucaccgucucaccccgcaacgcccccggcgaaauccuaugguccgcaccccuaggacccgaccucaaccccuaccuaucacaucucgcccguauguacaacggcuacgccggcgguuucgaaguccaaguuauccucgcuggcaacgcguucaccgccgguaaagucaucuucgccgcagucccgcccaacuuccccacagaaggccuuucccccucccaagucaccauguuuccccacaucgucguagacguccgacaacuagaacccguccuaauaccccucccagacguccgcaacaacuucuaccacuauaaccaauccaacgaccccaccaucaaacucaucgccauguuauacacaccccuccgagccaacaacgcaggcgacgacgucuucaccgucucaugccgcguccucacccgcccaucccccgauuucgacuucaucuuccuuguacccccaaccgucgaaucacgcacuaaacccuucuccguccccguccuaaccgucgaagaaaugacaaacagccgauuccccaucccccucgaaaaacucuucaccggccccuccuccgccuucguaguacaaccacaaaacggacgcugcaccacagauggcguccuacucggcacaacccaacucucacccguaaauauaugcacauuccgaggcgauguaacacauauuacaggcucccgcaauuacaccaugaaccuugccucacaaaacuggucaaacuacgacccaaccgaagaaauaccagcgccccucggcacccccgauuucgucggaaagauccaaggcguacugacccagacaacccgcaccgacggcucaacccgcggacacaaagccaccgucuacaccggaucagcagacuucgcacccaaacucggacgaguccaauucgaaacugacaccgaucgagacuuugaagccaaucaaaacaccaaauucaccccaguaggagucauccaagacggcggcaccacccaccgcaacgaaccucaacaauggguccuccccucauacuccggacgcaauaccccuaacguccaccucgcucccgccgucgcccccaccuucccaggcgaacaacuccucuucuuucgcagcaccaugccagguugcuccgguuaccccaacauggaccucgacugucugcuuccccaagaauggguccaauacuucuaccaagaagcagcacccgcccaauccgaugucgcacuccucagauucgucaaccccgauaccggucgcguccucuucgaaugcaaacuccacaaaucaggcuacgucaccgucgcccacaccggccaacacgaccuagucaucccucccaauggauacuuccgcuucgacucaugggucaaccaauucuacacccuagcccccaugggcaacggaacaggccgucgccgcgcccucuaa

SEQ ID NO: 35995 - RNA, 1623 nt, Artificial Sequence
  derived and/or modified sequence opt11 from VP1__Norovirus__AGS08097
augaaaauggccagcucggacgcuaaccccuccgacggcuccaccgcaaaccucguuccagaaguaaacaaugaagucauggcccucgaacccguagucggagcagccaucgcggccccaguggcaggccaacaaaacauaaucgacccauggauacgcaacaacuucguccaagcccccggcggcgaauuuaccgucagcccccgaaaugcaccuggcgaaauccucuggucugccccgcucggucccgaccucaaccccuaccuaucacaccucgcccgcauguauaacggcuacgccgggggcuucgaaguccaaguaauccucgccggcaacgccuucacagccggaaaaaucauauucgccgccgucccgccaaacuuccccaccgaaggccuaucaccuagccaagucacaauguuuccccacauaauagucgacguccgccaauuagaacccguccuaaucccacuccccgacguccgaaacaacuucuaucacuacaaccaauccaacgacuccaccaucaaacucaucgcaaugcucuauacaccccuacgagccaacaacgcaggcgacgaugucuuuaccguaagcugccgaguccuaacccgccccucaccagacuucgacuucauauuccucgucccacccacagucgaaucccgcaccaaacccuucuccguacccguccuaaccgucgaagaaaugacgaacucccgcuuccccaucccccucgaaaaacucuucacuggacccagcagcgccuucgucguccaaccccaaaacggacgcugcaccaccgacggcguucuccucggcaccacucaacucucucccgucaacauuugcacauuccgcggcgacgucacccacauaagcggcucucgaaacuacacaaugaaccuagcuagccaaaauuggaacuccuacgacccaacggaagaaaucccagcuccccucggaacccccgacuucgucggaaaaauacaaggaguccucacccagacuacgcgaaccgacggcagcacacgaggccacaaagccaccgucuacaccggcucagccgacuucucccccaaacucggucgcguccaauucgccacagacaccgauaacgacuucgucaccaaccaaaauaccaaguucacccccguuggcgucauccaagacggcagcacaacaccccgcaacgaaccacaacaauggguccuacccuccuacucaggccgaaacacacacaacguacaccuagcuccagccgucgcaccaaccuuccccggagaacaacuccuuuucuuccgcagcaccaugccagguugcuccggcuaucccaacauggaccucgacugcuuacucccccaagaauggguacaauacuucuaccaagaagcugcccccgcccaaucugacgucgcccuccuucgcuucguaaauccugacacuggccgcguacucuucgaaugcaaacuccacaaauccggauacgucacaguagcccacaccggccaacaugaccucguaauucccccaaacggcuacuucagauucgacuccuggguaaaccaauucuacacccuagcuccaaugggcaacggcaccggccgcagacgcgcccucuaa

SEQ ID NO: 35996 - RNA, 1623 nt, Artificial Sequence
  derived and/or modified sequence opt11 from VP1__Norovirus__AGS08098
augaaaauggccucuucagacgccaaccccucagacgguucuaccgccaaccucguacccgaagucaauaacgaagucauggcccuggaacccguagucggggcagccaucgcagccccaguugccggccaacaaaacgucauagacccauggauccgaaacaacuucguccaagcacccggcggugaauuuaccgucucaccccgcaacgcacccggugaaauacucugguccgcuccacuaggucccgaccucaaccccuaccuuucccaccucgcucgcauguacaacggauacgcaggaggcuucgaaguccaagucauucucgccggcaacgccuucacagccggcaaaaucaucuucgcagccguucccccaaauuuucccaccgaaggccuaucccccucucaagucaccauguucccacacauaaucgucgacguccgccaacucgaacccguccuaauaccccucccugauguacgcaacaauuucuaccacuacaaccagucaaacgacccaaccaucaagcuaaucgccaugcucuacaccccucuccgcgcaaacaacgccggcgacgacguauucacagucuccugccgcguacucacuagaccauccccugacuucgacuucaucuuccucguacccccaacagucgaaucgcgcaccaaacccuucuccguaccaguacuaacagucgaagaaaugaccaacucccgcuuuccaaucccacuggaaaaacucuucaccggcccaucuuccgccuucgucguccaaccacaaaacggacgcugcaccacagacggcguacuccucggaaccacacaacuuucaccugucaacauuugcaccuuucgaggagacguuacccacaucuccggcagccauaacuacacuaugaaucucgcaucccaaaauuggaacagcuacgauccaaccgaagaaauuccagcaccccucggcacaccugacuuugucggcaaaauccaaggcgucuuaacucaaaccacacguaccgacggauccacccgcggucauaaagcaaccgucuacaccggcuccgccgacuucuccccaaaacucggccggguccaauucgccaccgacaccgacaaugacuucgucaccaaucaaaacaccaaauucacacccgugggcgugauccaagauggaagcaccacuccccgcaacgaaccccaacaauggguccucccuuccuacuccggucgcaacacacacaacguacaccuagcccccgccgucgcaccaaccuuccccggcgaacaacuccucuucuuccguucaaccaugcccggcugcuccggcuaccccaacauggaccucgacugccuccuuccccaagaauggguacaauacuucuaccaagaagccgccccugcccaauccgacgucgcgcucuuacguuucguaaacccagacaccggccguguacucuucgaaugcaaacuacacaaaucgggauacgucaccgucgcacacacaggccaacacgaccucgugaucccucccaacgguuacuuucgcuucgauagcugggucaaccaauucuacacccuagcccccaugggcaacggcaccggacgccgccgugcacuauaa

SEQ ID NO: 35997 - RNA, 1623 nt, Artificial Sequence
  derived and/or modified sequence opt11 from VP1__Norovirus__AGS08099
augaagauggccuccucagacgccaaccccuccgacggcucaacagccaaccucguacccgaagucaacaacgaagucauggcccucgaacccguagucggcgccgcuaucgccgcccccgucgcaggccaacaaaacguaauagaccccuggauacgcaacaacuucguccaagccccaggcggcgaguucaccguaucaccccgcaaugcaccaggcgaaauacuuuggucugccccacucggacccgaccucaauccuuaccucucccaccucgcccgcauguauaacggauacgccggcggcuucgaaguacaagucaucuuagccggaaacgcauucaccgcaggaaaaaucauauucgccgccguacccccaaacuuccccaccgaaggccuaucccccucccaaguuacaauguucccacacaucauagucgacguccgccaacucgaacccguccuuaucccacuucccgacguucgcaauaacuucuaccacuacaaccaaucaaacgaccccacaaucaaacuaaucgcaaugcuauacaccccacucagagccaacaacgccggcgacgacgucuuuacagucucaugccgaguccucacacgcccaagccccgauuucgacuucaucuuucuugucccacccacugucgaaagccgaaccaaaccauucuccgucccaguacuaaccguagaagaaaugaccaauucacgcuuccccaucccccuagaaaagcuauucaccgguccaagcucagcauucgucguucaaccccaaaacggccgaugcaccacugacggaguccuacucggaaccacucaacucuccccugucaacaucugcacauuccgcggcgacgucacccacaucucagguucaagaaauuacaccaugaaccucgccucccaaaacuggaauagcuacgacccuaccgaagaaaucccagccccacucggcacccccgacuucguaggcaaaauacaaggcguacugacccaaaccacacgcacggacggaagcacccgcggccacaaggccaccguauacacaggcagcgcagacuucuccccaaaacucggacgcguacaauucgccaccgacaccgacaacgacuucgucacaaaccagaauaccaaauucaccccagucggcgucauccaagacggauccaccacuccccgaaacgaaccacagcaauggguccuucccuccuacuccggccgcaacacucacaauguccacuuagccccagccgucgcccccaccuuccccggcgaacaacuccucuucuucagaucaaccaugcccggaugcucaggauaucccaacauggaccuagacugccuccuuccccaagaauggguucaauacuucuaccaagaagccgcgcccgcccaaucagacgucgcccuucuccgauucguaaaccccgacacaggccgcguucucuucgaaugcaaguuacacaaauccggcuacgucacuguugcacacacaggccaacacgaccucguaaucccacccaacggcuacuuccgcuucgacucuugggucaaccaauucuacacacuagcccccaugggaaacgggacuggacgccgccgcgcccuauaa

SEQ ID NO: 35998 - RNA, 1623 nt, Artificial Sequence
  derived and/or modified sequence opt11 from VP1__Norovirus__AGS08100
augaaaauggcaucauccgacgccaaccccucggacggcuccacagccaacuuagucccagaaguaaacaaugaaguuauggcacuagaaccaguagucggcgccgcaauagccgcuccagucgccggacaacaaaacgucaucgaccccuggauccgcaacaacuucguacaagcacccggcggagaguucaccgucucaccccgaaacgccccgggugaaauccuuuggucagcaccucucggccccgaccuaaaccccuaccucucccaccuagcccgaauguacaauggauacgccggcggcuucgagguccaagucauccuagccggaaacgcauucaccgcaggaaagauaaucuucgccgccgucccaccaaacuuucccacagaaggacuaucgcccucacaaguaaccauguuuccccacaucauaguagacguccgacaacucgaaccaguacucaucccacuccccgacguuagaaacaacuucuaccacuauaaccaaucaaaugaccccacaaucaaacugaucgcaaugcucuacacaccccuccgcgccaacaacgcaggcgacgacguauucacagucucaugccgcguccuaacccgccccucccccgacuucgacuucaucuuccucgucccacccacagucgagucccgaaccaaacccuucuccguccccgugcuaaccguugaagaaaugaccaacucacgcuuccccaucccacuugaaaaacucuucacaggaccauccucagccuucguaguacagccccaaaacggccgaugcaccaccgauggcguccuccucggcaccacacagcuuuccccuguaaacaucugcacauuccgcggagacgucacacacauaagcgguucccgcaacuacaccaugaaccucgucucccaaaacuggaacuccuacgauccuaccgaagagauucccgcaccccucggaaccccagacuucguaggcaaaauacaaggcguacuuacccaaacaacccgaaccaacggcuccacccgcggccacaaagccacagucuacaccggauccgccgacuucucacccaaacucggacgaguccaauucgcaaccgacaccgacaacgacuucgagaccaaucaaaacaccaaauucacaccuguaggcguaauacaagauggcuccacaacuccccgaaacgaaccccaacaauggguccucccuuccuauagcggacgaaacauccacaacguccaccucgcccccgcuguagcuccaaccuucccaggcgaacaacuacucuucuuccgaucaaccaugcccgguugcuccggcuaccccaacauggaccuagacugccuccuaccacaagaauggguacaauacuucuaccaagaggccgccccagcccaauccgacgucgcccuccucagauucgucaaucccgauaccggcagaguacuauucgaaugcaaacuccacaaauccggcuacgucaccgucgcccacaccggccaacacgaucuggucauaccacccaacggauacuuccgauucgacuccugggucaaccaauucuacacccucgccccaaugggcaacggcaccggucgacgacgcgcccucuaa

SEQ ID NO: 35999 - RNA, 1623 nt, Artificial Sequence
  derived and/or modified sequence opt11 from VP1__Norovirus__AGS08101
augaaaauggcauccucagacgccaaccccuccgacggcuccgcagcuaaccucguccccgaaguaaacaacgaagucauggcacuugaacccguaguuggagccgcaauagccgcccccgucgcuggucaacaaaacgucauagaccccuggauacgaaacaacuucguccaagcacccggcggagaauuuacuguauccccacgcaacgcaccaggugaaauucucuggucggcaccccucggacccgaccuaaaccccuaccucucccaccuugcccgcauguacaacgguuacgccggcggauucgagguacaaguuauucuugccggcaacgccuucaccgccggaaaaaucaucuucgcagcaguacccccuaacuuccccaccgaaggccucucacccucccaggucaccauguucccacacaucaucgucgauguacgucaacucgaacccguacucaucccacucccagacguacguaacaauuucuaucacuacaaccagucaaacgacuccaccaucaaacucauagccaugcuauacacaccccuccgcgccaacaacgccggcgacgauguauuuacuguuagcugccgcguacuaacccguccgucuccagacuucgacuucaucuuccuagucccgcccacagucgagucccgcacaaaacccuucuccguccccguuuuaacagucgaagaaaugaccaacucccgcuuccccaucccccuagaaaaauuauucaccggaccaucuuccgccuucgucguacaaccccaaaacggacguugcaccacagacgguguccuccucggcaccacccaacuauccccaguaaacaucugcaccuuccgcggagacgucacccacauaucaggcucacgcaacuacacuaugaacuuagccucccaaaacuggaacucauacgacccuacggaagaaauucccgcaccacucgguacaccagacuucgucggaaaaauccaaggcguccucacccaaaccacccgcaccgacggauccacccgcggccacaaagccaccgucuacacaggcuccgcagacuucucacccaaauuaggacgcguacaguucgcaaccgacaccgacaacgacuucaucaccaaccagaacaccaaauucacccccgucggcgucauccaagacggcuccacuacaccccgcaacgaaccccaacaaugggucuuacccuccuacucaggacgcaacacccacaacguacaccucgccccagccgucgcccccaccuuccccggcgagcaacuucucuucuuccgcucuacuaugcccggaugcucgggcuaccccaacauggaccuggacugucuccucccccaagaguggguccaauacuucuaccaagaagcugcacccgcccaaagcgacgucgcccuccucagauucgucaaccccgauaccggccgcguacuauucgaaugcaaacuacauaaacccggcuaugucacugucgcucacacaggucaacacgaccuaguaauaccacccaacggauacuuccgguucgacuccugggucaaccaauucuacacacucgcccccaugggcaacggcaccggccgccgucgggcacucuaa

SEQ ID NO: 36000 - RNA, 1623 nt, Artificial Sequence
  derived and/or modified sequence opt11 from VP1__Norovirus__AGS08102
augaaaauggccuccuccgacgccaacccguccgacggaucagccgccaacuuaguccccgaagucaauaaugaaguuauggcccuagaacccguagucggcgccgccauagccgccccaguugcaggccaacaaaacgucaucgaccccuggauccgcaacaacuucguccaagcacccggcggcgaauuuacagucucuccccgcaacgccccaggcgagauccucuggucugccccacucggacccgaccuaaaucccuaccuaucccaccuagcacgaauguacaacggcuacgccggcggcuucgaaguccagguaauccuggccggcaacgcuuucaccgcaggcaaaguaaucuucgccgcagucccacccaacuuccccaccgaaggacuaucucccucccaaguuaccauguucccccacauagucgucgacgucagacaacuggaacccguccucaucccacuacccgacguccgcaacaacuucuaccacuacaaucaauccaacgacccaaccaucaaacugauagcaaugcuauacaccccucugcgcgccaacaacgccggagacgauguauucaccguaagcugccgcguacucacccgccccucccccgacuucgacuucaucuuucucguacccccgaccgucgaaucccgcaccaaacccuuuuccguccccguccucaccgucgaagaaaugacgaacucccgauucccaauaccccucgaaaaacuuuucacaggcccaucauccgccuuugucguccaaccccaaaacggccgcugcaccaccgacggaguccuccuuggcaccacacaacucagccccgucaacaucugcaccuuuagaggcgacgucacacacauaaccggaucccgaaacuacacuaugaaccucgccucacaaaacuggagcaacuacgacccaacagaagaaauccccgccccacucggcacccccgacuucgucggcaaaauacaggguguacucacccaaaccacccgcacugauggcucuacacgcggccacaaagccacagucuauaccggaucagccgacuucgcacccaaacucggccgaguacaauuugagaccgacacugaccgcgacuucgaagccaaccaaaauacaaaauucacacccgucggugucauccaagacggcuccacaacacaccgaaacgaaccacaacaauggguccucccuuccuacuccggacggaacacacccaacguccaccucgcccccgccgucgccccaacauuccccggcgaacaacuucuuuucuucagauccaccaugccuggaugcucaggcuaccccaacauggaucucgacugccuccuaccucaagaauggguccaauacuucuaucaagaagccgcacccgcacaguccgacguagcccuacuacgauucgucaaccccgacaccggacgaguccucuucgaaugcaaacuccacaaauccgguuacgucacagucgcccacaccggacaacacgaccuugucaucccacccaacggauacuuccgcuucgacucgugggucaaccaauucuacacacuagcaccaaugggcaacggaacgggaagacgccgcgcccuauaa

SEQ ID NO: 36001 - RNA, 1623 nt, Artificial Sequence
  derived and/or modified sequence opt11 from VP1__Norovirus__AGS08103
augaaaauggccucauccgacgcucaccccucagacggaucuacagcaaaccucguccccgaagucaacaacgaaguaauggcucucgaacccgucguaggcgcagcaaucgccgcacccgucgccggccaacaaaacgucaucgaucccuggauccgcaauaacuucguucaagccccuggcggcgaguucaccguaucuccccgcaacgcccccggcgaaauccucugguccgcaccacuaggccccgaccuaaaccccuaccuaucacacuuagcccgcauguacaacggcuacgcaggcggauucgaaguccaagucauccucgccggcaacgcauucacagccggaaaaauaauauucgcagcaguaccaccaaacuucccaacugagggccuauccccaucccaagucaccauguucccccacauuaucguagacguccgccaacuagagcccguccucaucccccuccccgacguccgaaacaacuucuaccacuacaaccaaucuaaugacccuacuaucaaacugaucgccaugcucuacaccccacuccgcgccaacaacgcaggagacgacguauucacugucucuugcagaguccucacccgccccucccccgacuucgacuucauauuccucgucccacccaccgucgaaucacgaaccaaacccuucucuguccccgucuuaaccguagaagaaaugaccaacucccgauuccccaucccccucgaaaaacuauucaccggccccuccuccgccuucgucguacaaccccaaaacggccgaugcaccaccgacggcguccugcuaggcacaacacaacuauccccagucaacauaugcacauuccgcggagacgucacccacauaucggggucacgcaacuacacaaugaaccucgccagccaaaacuggaacucauacgaccccacagaggaaauccccgcaccccucggcacaccugacuucgucggcaagauccaaggcguccucacgcaaaccacccgcacagacggcuccaccagaggccacaaagccacagucuacaccggcuccgccgacuuuucaccaaaacucggaaggguccaauuugcgaccgauaccgacaacgacuucguaacuaaccaaaacaccaaauucaccccuguaggcgucauccaagacggcuccaccaccccgcgcaacgagccccaacaauggguccucccaucauacucaggaagaaauacacacaacguccaccuagccccagccgucgcccccaccuucccuggggaacaauugcuauuuuuccgcuccaccaugccaggcugcuccggauacccaaacauggaccucgauugccuacuuccccaagaauggguccaauacuucuaccaagaagccgcccccgcgcaauccgacgucgcacuacuccgauucgucaaccccgacaccggccgcguccucuucgaaugcaaacuacacaaaagcggauaugucaccgucgcccacacuggccaacacgacuuagucaucccacccaacggcuacuuccgcuucgacuccugggucaaucaauucuacacacuagcacccaugggcaacggaaccggccgccgacgugcccuuuaa

SEQ ID NO: 36002 - RNA, 1623 nt, Artificial Sequence
  derived and/or modified sequence opt11 from VP1__Norovirus__AGS08104
augaaaauggcaagcucagacgccaaccccuccgacggcagcacagccaaccucguaccagaaguaaauaacgaaguaauggcccucgaacccgucgucggagcugcuaucgccgcccccgucgccggccaacagaacaucaucgaccccuggauccgaaacaacuucguccaagcacccgguggcgaauuuacagucucaccccgcaacgcacccggcgaaauccucuggucagccccucuaggcccagaccucaaccccuaccucucccaccuugcacgaauguacaacgguuacgccggcggcuuugagguacaaguaauccucgcaggcaacgccuucacagcgggcaaaaucaucuucgccgccguacccccaaacuuccccaccgaaggauuauccccgucccaagucaccauguucccccacaucaucgucgacgugcgacaacucgaacccguccucaucccucuccccgacguccgaaacaacuucuaccacuacaaucaguccaaugauucaaccaucaagcuaauagccaugcucuauaccccacuccgagcgaauaacgcuggcgacgauguauucaccgucucaugccgcguacuaacacgccccucccccgauuucgacuuuaucuuccuaguacccccaacagucgaaucucgaacaaagcccuucucaguacccguccuaacagucgaagaaaugaccaacucccgauuucccauaccgcucgagaaacucuucaccggccccucaagcgccuucgucguccaaccccagaacggccgcugcaccaccgacggcguccuccucggcacuacacagcuauccccuguaaacaucuguaccuuccgcggcgacgucacacacaucuccggcucccgcaacuacaccaugaaccucgcaagccagaacuggaacuccuacgaccccaccgaagaaaucccugcaccccucgguaccccagacuuuguaggcaaaauccaaggaguccucacacaaaccacccgcaccgauggauccacccgcggccacaaagccaccgucuacacaggaucagccgacuucuccccaaaacuaggacgaguccaguucgcaaccgauacagacaacgacuucguaaccaaccaaaauacaaaauucacacccguuggugucauccaagacgguucgaccaccccacguaacgaaccccaacaauggguacuccccuccuacucaggacgcaacacccacaacguccaucuggcccccgcagucgccccaaccuuccccggcgaacaacuccucuucuuccgcucaacaaugcccggcugcuccggauaucccaacauggaccuagacugccuacuaccccaagaauggguccaauacuucuaccaagaagccgcacccgcccaaagcgacguagcccuacuacgauucguaaacccagacacugggcgcguacuuuucgaaugcaaacuacacaaaucuggcuaugucacagucgcacacacaggccaacaugaccuagucauacccccaaauggauacuuccgguucgacuccugggucaaccaauucuacacacuagcacccaugggaaacgguacaggacggcgcagagcccucuaa

SEQ ID NO: 36003 - RNA, 1623 nt, Artificial Sequence
  derived and/or modified sequence opt11 from VP1__Norovirus__AGS08105
augaaaauggcuuccucagacgccaaccccucagacggcagcgcagccaaccuaguccccgaagucaacaacgaagucauggcccuagaacccgucguaggcgccgccaucgcagcgccugucgcaggccaacaaaacgucaucgaccccuggauuagaaacaacuucguccaagcccccggcggcgaguucaccgucucaccacgcaacgccccaggagaaauccuuuggucagcacccuuaggaccugaccucaacccauaccucagccaccuagcacgaauguacaacggauacgccggcggcuucgaaguucaaguaauccuugcaggcaacgcauucaccgccggaaaaguaauauucgccgccgucccacccaauuuccccacagaaggacucagccccagccaagucaccauguucccccacauagucguagauguccgacaacucgaacccguucucauuccccuacccgacguccguaacaacuucuaccacuacaaccaaucgaacgauccaacuauaaaacucauagccauguuauacacuccccuaagagccaacaacgcaggcgacgacgucuucaccguaaguugcagaguccuaacccgccccucccccgacuucgacuucaucuuccuaguaccacccaccguugaaucacgcacaaaacccuucucaguccccguccuaacaguagaagaaaugaccaacucucgcuucccuaucccccucgaaaaauuauucacaggccccuccucagccuucguaguccaaccccaaaacggacgcugcacaaccgacggcguccuacuagguacgacccaacucucacccguaaacaucuguaccuuccgcggcgacgucacacacaucacaggcucccgcaacuacaccaugaaccucgcaucucaaaacuggaauaauuacgaccccaccgaagaaauuccagcaccccuaggcacccccgacuucguaggcaaaauacaaggcguccucacccaaacgacacgaaccgacggauccacucgcggccacaaagccaccgucuacaccggcuccgccgacuucgccccaaaguuaggccgcgugcaguuugaaaccgacacagaccacgacuucgaagccaaccaaaauaccaaguucacccccguaggaguaauccaagacggaggcacaacacacagaaacgaaccccaacaauggguacuucccucguacuccggccgaaacacccccaacguccaccucgcccccgccguagccccaaccuuucccggcgaacaacuccuauucuuccgcuccaccaugcccggcuguagcggauaccccaacauggaccuagacugccuacuuccucaagaauggguacaauacuucuaccaagaagccgcccccgcacaaucagacguagcccuccugagauucgucaaccccgacacaggucgcguccucuucgaaugcaaacuccacaaauccgguuacgugaccgucgcacacaccggccaacaugaccuaguaauacccccaaacggauacuucagauucgacuccugggucaaccaauucuacacccuagcccccaugggcaacggcacaggaagacgccgcgcccucuaa

SEQ ID NO: 36004 - RNA, 1623 nt, Artificial Sequence
  derived and/or modified sequence opt11 from VP1__Norovirus__AGS08106
augaaaauggcaucuuccgacgccaacccuuccgacgguucuaccgccaacuuagucccagaaguaaacaaugaaguuauggcacucgaacccgucgucggagcugcaaucgcagcuccaguagccggccaacaaaacguuaucgacccauggauacgaaacaacuucguacaagcccccggcggcgaguucacuguauccccacgcaacgcacccggagaaauccuaugguccgcccccuuaggacccgaccuaaaucccuaucuaucacaccuggcccgaauguacaauggauacgccggcggcuucgaaguccaggucaucuuagcggguaacgccuucacagcaggcaaaaucaucuucgccgccguacccccaaacuuccccaccgaaggacucucccccucccaagucaccauguucccccacauaaucguagacguacggcagcucgaacccgucuuaauaccccuacccgacgucagaaacaacuucuaccacuacaaccaauccaacgacccaacgaucaaacucauagcaauguuauacacaccccuacgagcaaacaaugccggcgacgacguauucacagucuccugccgcguccuuacccgccccucaccagacuucgacuucaucuuccucguaccacccaccgucgaaagcagaaccaaacccuucagcguaccaguacucacaguagaagaaaugaccaacucccgauucccuaucccccuugaaaaacucuucacuggacccuccuccgccuucguaguccaaccacagaacggccgcugcaccaccgacggcguccuccuaggaacaacccaacucucccccgucaacauaugcacauuucgcggagacgucacccauaucuccggaucccgcaauuacaccaugaaucucgcaucccaaaacuggaacucauacgaccccacugaagaaauaccagcaccccucggcacccccgacuucguuggcaaaauccaaggcguccuaacccaaaccacccgcaccgacggcagcacgcguggacacaaagccaccgucuacacuggcucagccgacuucacacccaaauuaggccgcguccaauucgcaaccgacaccgacaacgacuucgucaccaaccagaacaccaaguucacacccguaggcguaauccaagacggcuccacaacaccccgcaacgaaccccaacaauggguacuccccucauauuccggacguaacacccacaacguccaccucgccccugccguagccccgaccuucccaggcgaacaacuacucuucuuccgauccaccaugccuggcugcuccggcuaccccaacauggaccucgacugccuccuuccccaagaguggguccaauacuuuuaccaagaagcagcacccgcccaaucugacgucgcccuccuccgcuucguaaacccagacaccggccgaguccucuucgaaugcaaacuccacaaaucaggcuacguuacagucgcacacaccggccaacacgaccucgucaucccuccaaacgguuauuuccgcuucgacuccuggguaaaccaauucuacacacuagcccccaugggcaacggcaccggccgucgccgcgcccuguga

SEQ ID NO: 36005 - RNA, 1623 nt, Artificial Sequence
  derived and/or modified sequence opt11 from VP1__Norovirus__AGS08107
augaaaauggcauccuccgacgcaaaccccucugacgguuccaccgcgaaccucguacccgaagucaauaacgaagucauggcacucgaacccgucgucggcgcugcaaucgccgcccccguagcaggucaacaaaacguaaucgaccccuggauccgaaacaauuucguccaagcaccaggcggugaguucaccguaucaccccgaaaugcacccggcgaaauccucugguccgcaccccucggacccgaccuaaacccauaccucucccacuuagcccgcauguacaacggcuacgccggcggcuucgaaguccaaguaauccuugcagguaacgcuuucaccgccggcaaaaucaucuucgccgccguacccccaaacuuccccacagaagggcucucccccucccaagucacaauguucccacacaucaucgucgacguacgccaacucgaacccguccucaucccacuacccgacguacgaaacaacuucuaccacuauaaccaaucaaacgacucaaccauaaaacugauagccaugcuuuacacuccccuccgcgccaacaacgccggcgacgacgucuucaccguaucaugcagaguccucacccgccccuccccagacuucgacuucauuuuccuaguuccacccacagucgaaucccguacaaaacccuucuccguacccauacuaacugucgaagaaaugacaaauucccgauuccccaucccacucgaaaagcuauucaccggacccucauccgcauucgucguccaaccccagaacggccgcugcaccacagacggcgucuuacucggcaccacccaacucagcccagucaacaucugcaccuuccgaggcgacgucacccacauaccuggcucucacaauuacacaaugaaccucgcgagccaaaacuggaacucauacgaccccaccgaagaaauaccagcgccccucggcacaccggacuucgucgggaaaauccaaggcgucuuaacccagaccaccuccacaaacggguccacccgcggccacaaagccacagucuauaccggcuccgccgacuucucacccaaacuaggcagaguccaauucgcaacugacaccaacaacgacuucgaaacaaaccaaaacaccaaauucacacccguaggcgucauccaagacggcucaacuacuccccgaaacgaaccacaacaauggguccuucccucauacuccggccgcaacauccacaacguccaucuggcuccugccgucgcaccuaccuuccccggcgaacaacuccuuuucuuccgcucuaccaugccuggcugcuccggcuacccaaacauggaccucgacugccuccuaccacaagaauggguacaauacuucuaccaagaagccgcacccgcccaaucugacgucgcccuccugcgauucgucaacccagacaccggacgcguccuuuucgaaugcaaacuccacaaauccggcuacgucaccgucgcacacaccgggcaacacgaccuagucaucccaccaaacggcuacuuccgcuucgacuccugggucaaucaguucuauacacucgcccccaugggcaacggaaccggucgccgucgugcacucuga

SEQ ID NO: 36006 - RNA, 1623 nt, Artificial Sequence
  derived and/or modified sequence opt11 from VP1__Norovirus__AGS08108
augaaaauggccuccucagacgcuaacccauccgacggcucuaccgccaaccuaguccccgagguaaacaaugaaguaauggcccuagaacccgucgucggagcagcaaucgccgcacccgucgcaggacaacaaaacguaaucgaccccuggauccgcaacaacuucguccaagcacccggcggcgaguucaccgucuccccacgcaaugcccccggagaaauccuauggucugcaccccucggcccugaccuaaacccauaccucucccaccucgcccgcauguauaacggcuacgcaggcggcuucgaaguccaagucauccucgccggaaaugccuucacagccggaaagauaaucuucgcagcaguacccccaaacuucccaaccgaaggacuuuccccaucccaagucaccauguucccccacauuauagucgauguccgccaacucgaacccguuuuaauaccacuccccgacguacgcaacaacuucuaccacuacaaccaauccaacgaccccacaaucaaacucauugcaaugcucuacacgccccuccgcgcaaacaacgccggcgacgacgucuucacaguuagcugccgaguacuaacccgccccucacccgacuucgacuucaucuuccucguaccucccacagucgaaagccgcacuaaacccuucuccgucccuguccucacaguugaagaaaugaccaacucccgcuucccuauaccccucgaaaaacuguucaccggaccauccuccgcauucgucguccaaccccaaaacggacgaugcaccaccgacgguguccuucuuggcacuacccaacuaucccccgucaacauaugcacauuccgaggagacgucacccacauauccgguucccgaaauuacaccaugaaccucgccucacaaaauuggucuuccuaugaccccaccgaagaaaucccagcaccccuaggcacccccgacuucgucggaaaaauccaaggcguccuaacccaaacaacccgcaccgacggcuccacgcgcggacacaaagccaccguauacaccggcuccgccgacuuuuccccuaaacucggacgcguccaauucgccacagacaccgacaaugacuucgucaccaaccaaaacacaaaauucaccccagucggugucauccaggauggcuccacaaccccucgcaacgaaccccaacaauggguacuacccucauacuccggccguaacacacacaacguccaccuagcccccgccgucgcccccacuuuccccggcgaacaacuccucuucuuccgcuccacaaugccaggaugcucaggauauccaaacauggaccuugacugccuacugccccaagaauggguccaauacuuuuaccaagaagccgcccccgcacaauccgauguagcacuccuacgauucgucaaccccgacaccggccgcguccuauucgaaugcaaacuacauaaguccggauacgucaccgucgcccacacuggacaacacgacuuagucaucccgcccaacggcuacuuccgauucgacucauggguuaaccaauucuacacccucgcucccaugggcaacggcaccggccgacgccgcgcacucuaa

SEQ ID NO: 36007 - RNA, 1623 nt, Artificial Sequence
  derived and/or modified sequence opt11 from VP1__Norovirus__AGS08109
augaaaauggccaguuccgacgccaacccauccgacggauccgccgcaaaccucguacccgaagucaacaacgaagucauggcacucgaaccagucgccggcgcagcaaucgccgcccccguugccggccaacaaaaugucaucgacccauggauccgcaacaacuucguccaagcccccggcggugaguucaccgucuccccacgcaaugcacccggcgaaauccuaugguccgcaccccuuggccccgaccucaacccauaccucucacaccuagcccgcauguacaacggguacgccggcggcuucgaaguacaagucauacuagccggaaacgcauuuacugccggcaaagucaucuucgccgcagucccucccaacuuccccacugaaggacucagccccucgcaagucaccauguucccccacaucgucgucgacguaagacaacuagaaccgguccuaaucccccuaccagacguccgaaacaacuucuaccauuauaaucaauccaacgacuccaccaucaaacucauagccaugcucuacaccccucuccgagccaacaacgccggcgacgacguuuucaccgucuccugccgcguucucaccagaccaucccccgacuucgacuucauauuccuaguacccccaaccguagaaagucgcaccaaacccuucucuguaccuguacucaccgucgaagaaaugaccaacucccgcuuccccaucccccucgaaaaacucuucacuggacccagcucagccuucgucguacaaccccaaaacggacgcugcaccacagacggaguccuccuagguaccacccaacucuccccaguaaacaucugcaccuuccgcggcgacguaacccauaucacuggaucacgcaacuacaccaugaaccuugccucccaaaacuggaacaacuacgaccccacugaagaaauuccagccccacuuggcacccccgacuucgucggcaagauccaaggcaugcuaacucagacaacccgcacugacggcucaacccguggacacaaagccaccguauacacaggauccgccgacuucgcgccuaaacuaggacguguacaauucgaaaccgacaccgaucacgacuucgaagcaaaucaaaacaccaaguucaccccagucggcguaauccaagauggcuccaccacacaccguaacgaaccacaacaauggguccuccccagcuacuccggccgcaauacacacaacguccaccucgcccccgcuguagcucccacauuccccggagaacaacuauuauucuuccguuccaccaugcccgguugcucuggauacccaaacauggaccucgacugccuccucccccaagaauggguccaauacuucuaccaagaagccgccccggcccaauccgacgucgcucugcuccgcuucgucaacccagacaccggccgcguucucuucgaaugcaaacuccacaaguccggauacgucacagucgcccacaccgggcaacacgaccucgucauaccacccaacggcuacuuccgcuucgacuccugggucaaccaauucuacacccucgcccccaugggcaacggaaccggacgucgccgcgucgucuaa

SEQ ID NO: 36008 - RNA, 1623 nt, Artificial Sequence
  derived and/or modified sequence opt11 from VP1__Norovirus__AGS08110
augaaaauggcuucuuccgacgcaaacccauccgacgggucaacagccaaccuaguccccgaagucaacaacgaagucauggcccuagaacccguagucggagccgcaaucgcugcaccaguagcaggccaacaaaacgucauugaccccuggauccguaacaacuucguccaagcccccggcggcgaauuuaccgucucuccccguaacgcccccggcgaaauccucugguccgcuccccuaggccccgaccucaaccccuaccucucccaccuggcccgaauguacaauggcuacgccgguggauucgaaguacaagucauccucgcuggcaacgcauucaccgcuggcaaaaucaucuucgccgccgucccacccaacuuccccaccgaaggacuaucccccucccaagucaccauguucccucauaucaucgucgacguacgacaacucgaacccguacucauuccccuaccugacguacgaaacaacuucuaccauuacaaccaguccaaugacucaacaaucaaacucauugccaugcuuuacacuccccuuagagccaauaaugcaggcgacgacguauucacagucucaugccgcguccuuacccgccccucaccagacuucgauuucauauuccucguuccacccaccgucgaaucccgcacaaaacccuucucaguacccguccuaaccgucgaagaaaugaccaacucucgcuuccccauaccacucgaaaaauuauucacaggacccucauccgccuucgucguacaaccccaaaauggccgcugcaccaccgacggcguccuccucgggaccacccaacucagccccgucaacaucugcaccuuccgaggcgacgucacccacauccccggcucccacaacuacacaaugaaccucgccucccaaaacuggaacuccuaugaccccacagaagaaauaccagcaccccuaggaacucccgacuucguagguaaaauccaaggaguccuaacacaaaccaccucaaccaacggcuccacccgaggccacaaagccacaguuuacacgggcucugccgacuucagcccgaaacucggacgcguccaauucgccacugacaccaauaacgacuucgaaaccaaccaaaacaccaaauucaccccagucggcgucauucaagacggcucuaccacaccccgcaacgaaccccaacaauggguccuccccuccuacuccggccguaacauccauaacguccaccucgcuccagccguugccccuaccuuccccggcgaacaauuacuguucuuccgcuccacaaugccuggaugcuccggauaucccaacauggaccucgacugccuccuuccacaagaauggguucaauacuucuaccaggaagccgccccagcacaauccgaugucgcccuccuacgauuugucaacccagacacaggccgcguccuuuucgaauguaaacuccauaaaucaggcuacgucaccgucgcccacaccggucaacacgaccucgucaucccacccaacggauacuuccgauuugacucuuggguaaaccaauucuacacccuagcaccuaugggcaacggcacaggacgacgucgcgcucucuga

SEQ ID NO: 36009 - RNA, 1623 nt, Artificial Sequence
  derived and/or modified sequence opt11 from VP1__Norovirus__AGS08111
augaaaauggcuagcuccgacgccaacccauccgacggauccacagccaaccucgucccagaagucaacaacgaaguaauggcccucgaacccgucgucggagccgcaaucgcagcucccgucgccggacaacaaaacgucauugaucccuggauacgcaacaacuucguccaagcccccggcggugaguucacugucucaccgcgcaaugccccaggagaaauccuuuggucugcaccccuggggcccgaccuaaaccccuaccucucccaccuagcccgcauguacaacgguuacgccggcggauucgaaguccaggucauccucgccggcaacgccuucacagccggcaaaaucauauucgccgccgucccacccaauuuccccacugaaggccucucacccucccaaguaaccauguucccccacauuauaguugacguccgccaacucgaacccguucucaucccccuccccgacguccgcaauaauuuuuaucacuauaaccaaagcaaugaccccaccaucaaacuaaucgccaugcucuacacaccccuacgugcaaacaacgccggcgacgacguauuuaccgucagcugccgcguccucacccgccccucccccgacuucgacuucaucuuccucgucccacccaccgucgaaucucguacgaaaccauucucugucccaguccucacaguugaagaaaugacaaacucacgcuucccaauaccccucgaaaaacucuucaccggacccuccagcgcuuucguaguccaaccccaaaacggccgguguacaaccgacggaguccuccucggaacaacccaacuauccccaguaaacauaugcaccuuccgcggcgacgucacccacauccccggcucacgaaacuauaccaugaaccuagcaucucaaaacuggaacuccuacgaccccaccgaagaaauacccgcaccucucggcacgccagacuucgucgggaaaauucaaggaguacugacccaaacaacccgcaccaacggcucuacacgaggccacaaagccaccgucuacacagguuccgccgacuucucacccaaacucggacgcguucaauucgcuacagacaccgacaacgacuucgaaacaaaccagaacaccaaauucacccccgucggcguaauucaagacggcuccacaaccccacgcaacgaaccccaacaauggguacucccauccuacagcggacgcaacauccacaacguacaccucgccccagccgucgcccccaccuucccuggugaacaacuccucuucuuccgaucaaccaugccaggcugcucaggauaccccaacauggaucucgacugucugcuuccucaagaauggguacaauacuucuaccaagaagccgccccagcccaaagcgacgucgcacuacuacgauucguaaaccccgacaccggaagaguccucuucgaaugcaaacugcacaaauccggcuauguaacaguagcucacaccggccaauacgacuuagucauaccgcccaacggcuacuucagauucgacuccugggucaaccaauucuauacccuagccccaauggguaaugggacgggccgccgccgcgcccucuaa

SEQ ID NO: 36010 - RNA, 1623 nt, Artificial Sequence
  derived and/or modified sequence opt11 from VP1__Norovirus__AGS08112
augaaaauggccucauccgaugcaaaucccuccgacggcuccaccgccaaccucguacccgaagucaacaacgaagucauggcccucgaacccguugucggagccgcaaucgcagcacccgucgccggccaacaaaacguuaucgaccccuggauccgaaacaacuucguccaagcccccggaggcgaguucaccgucucuccccguaacgcccccggcgaaauucuaugguccgcaccccuuggccccgaccuuaaccccuaccuuucacaccuugcccgcauguacaacggcuacgccggaggcuucgaaguccaggucauccucgccggcaacgccuucaccgccgguaaaauaauuuucgccgcaguacccccaaacuucccaaccgaaggucuaucaccaucccaagucaccauguucccccacauaaucgucgacguccgccaacucgaaccgguccucauaccccugcccgacguccgcaacaacuuuuaccacuacaaccaauccaacgacccaacaaucaaacucaucgccaugcuauacacaccccuccgagcaaacaacgcuggagacgacguauucaccguuuccugccguguacuuacccgcccaucacccgacuucgacuucaucuuccuuguaccacccacugucgaaagccgaacaaaacccuucuccguccccguccuaaccguugaagaaaugaccaauucccguuuccccauccccuuagaaaaacuuuucaccggccccucaucagccuucguuguccaaccccaaaacggccgaugcaccacagauggaguacuccucgggaccacccaacucagcccugucaacaucuguaccuuccgcggcgacgucacccacaucucuggcucacgaaacuacaccaugaaccucgccucgcaaaacuggaacuccuacgaccccaccgaagaaauccccgcaccccucggcacccccgacuucguaggaaaaauccagggcguccucacccaaaccacuagaaccgacggcucaacacgcggccauaaagccacaguauacaccggcuccgccgacuuuucccccaaacucggacgcguccaauucgcaaccgacaccgacaacgauuucgucaccaaccaaaacaccaaauucacacccgucggggucauccaagacggcuccacaacaccccgcaaugaaccccaacaauggguccuccccuccuacuccggccgcaacacccacaacguccaccuagccccagcagucgcacccaccuuccccggcgagcaacuccucuucuuccgauccaccaugcccggcugcucaggauaccccaacauggaccucgacugccuucuaccucaagaauggguacaauacuucuaccaagaagccgcccccgcacaauccgacgucgcccuccuccgcuucgugaaccccgacaccggacgaguccucuucgaaugcaaacuacacaaauccggcuacgucaccguugcucacaccggccaacaugaccucguaaucccacccaacggcuacuuccgauucgacagcuggguaaaccaauucuauacacucgcccccaugggcaacgguacaggccgucgucgcgcccucuaa

SEQ ID NO: 36011 - RNA, 1623 nt, Artificial Sequence
  derived and/or modified sequence opt11 from VP1__Norovirus__AGS08113
augaaaauggccuccagcgacgccaacccaucagacggcucgaccgcgaaccucguccccgaagucaauaacgaagucauggcccucgaacccguagucggcgcagccaucgcugccccagucgcaggccaacaaaacguaaucgaccccuggauacgcaacaacuucguccaagcccccggaggcgaguucaccgucagcccuagaaaugcacccggcgaaauacuuugguccgcuccccucggccccgaccucaaucccuacuuaucccaccuagcccgaauguacaacggcuaugccggaggcuucgaaguacagguaauccucgccggcaaugccuuuaccgccggcaaaauaaucuucgccgcaguucccccaaacuucccaaccgaaggccuaucucccucccaagucaccauguucccccauaucaucguagaugucagacaacuugaacccguccuaaucccacuucccgacguccgcaacaacuucuaccacuauaaucaauccaacgaucccaccaucaaauuaauugccaugcucuauaccccacuccgcgccaacaacgccggcgacgacgucuucaccgucucaugcagaguccuuacacgccccucccccgacuucgacuucaucuuccugguuccucccaccgucgaauccagaaccaaacccuucucaguacccgucuuaaccguugaagaaaugacuaacucacgcuuccccauaccacucgaaaaauuauucacaggcccaucuucagccuucguaguucaaccccaaaacggcagaugcaccaccgacggcguccuuuuaggcacaacccaacuuucccccgucaacauaugcaccuuccgcggcgacgucacccacauaucaggaagccgcaacuacaccaugaaccuagcuucccaaaacuggaacagcuacgaccccacagaagaaauccccgccccacucggcaccccagacuucgucggcaaaauccaaggagucuuaacccaaacaacacgcaccgacggaucaacacgcggucacaaggccaccgucuacacaggauccgccgacuucuccccaaaacuuggccgcguccaauucgccaccgauaccgacaacgacuucgucacaaaccagaauaccaaauucacccccgucggagucauccaagacgguuccacuacaccccguaacgaaccacaacaauggguccuccccaguuacuccggacguaacacccacaacguccaccucgcccccgcagucgccccaaccuuccccggcgaacaacuccuauucuuccgcucuaccaugccuggaugcucuggcuaccccaacauggaccucgacugccuucuuccccaagaauggguccaauacuucuaccaggaagccgcccccgcccaauccgacgucgcccuccuacguuucgucaaccccgacacaggccgcguacuuuucgaaugcaaacuucacaaaucggguuacgucacaguagcccacacaggacaacacgaucuaguaaucccacccaacggauacuuccgcuucgacucuuggguaaaccaauucuacacccuagcccccaugggcaacggcgcaggccgacgcagagcccucuga

SEQ ID NO: 36012 - RNA, 1623 nt, Artificial Sequence
  derived and/or modified sequence opt11 from VP1__Norovirus__AGS08114
augaaaauggccagcucagacgccaacccauccgacggaucaaccgcaaaccucguacccgaagucaacaacgagguaauggcccuagaacccgucguuggugcagcaaucgccgcacccgucgcaggacaacaaaauguaaucgaccccuggauacguaacaacuucguccaagcaccuggcggcgaauuuaccguaucucccagaaacgcccccggagaaauccucugguccgcaccccuuggaccagaccucaaccccuaccuaucucaccucgcccgcauguauaacggcuacgccggaggcuucgaaguccaagucauccuagccgguaacgccuucaccgccggcaagaucaucuucgccgccgucccacccaauuuccccacagaaggacuaucccccucccaagucacaauguucccacacaucaucgucgacguacgccagcucgaaccgguacucauaccccuccccgacguucgcaacaacuucuaccacuacaaccaauccaacgacuccaccaucaaacuaaucgccaugcucuacacuccacuccgcgccaacaaugcaggcgacgacguauucacaguaagcuguagaguucuuacccgcccuagccccgacuucgauuucaucuuucucgucccacccacagucgaaucacgaaccaaacccuuuuccguccccauccucacagucgaagaaaugaccaacucccguuuccccaucccccuugagaagcucuuuacaggccccagcuccgcauucguuguccaaccccaaaacggccguugcaccaccgacggcguccuccucggcaccacacaacuaagccccgucaacaucuguacauuccgcggugacguaacccacauacccggaucacacaacuacaccaugaaucucgcuucccaaaacuggaacucuuacgaccccaccgaagaaauccccgcaccccucggaacccccgauuucguaggaaaaauacaaggaguacuaacccaaaccaccucaaccaacggcuccacccgcggccacaaagccacaguauacaccggauccgccgacuucuccccaaaacucggccgcguacaauucgcaacagacacaaacaacgacuucgaaacaaaccaaaauacaaaguuuacuccagucggcgucauccaagacggauccaccaccccacgcaaugaaccccagcaauggguccuaccauccuauagcggccguaacauccacaacguccaccuggcucccgcagucgcccccacauucccaggagaacaacuccucuucuuccgcuccaccaugcccggaugcuccggcuauccuaacauggaccuugacugccuccucccccaagaauggguccaauacuucuaccaagaagccgcaccagcacaauccgacgucgcccuucuucgcuucguaaacccagacaccggccgcguacuauucgaaugcaaacuccacaaaagcgguuacguuacgguagcucacacuggccagcacgaccucguuauaccucccaacggcuauuuccgauucgacuccugggucaaccaauuuuacacucuagccccaauggguaacggcacaggccggcgccgcgcccuauag

SEQ ID NO: 36013 - RNA, 1623 nt, Artificial Sequence
  derived and/or modified sequence opt11 from VP1__Norovirus__AGS08115
augaaaauggccuccuccgacgccaaccccuccgacggcuccaccgccaaccuagucccugaagucaacaacgaaguaauggcccucgaacccguugucggcgccgccaucgcagcccccguagcaggccaacaaaacgucaucgacccauggauacgcaacaauuuuguccaagcccccggcggagaguucaccgucagcccacgcaacgcacccggcgaaauccucugguccgccccucucggacccgaccucaaccccuaccucucacaccucgcccgcauguacaacggcuacgccggaggcuucgaaguccaaguuauucuagcaggaaacgccuucaccgcaggcaaaaucaucuucgccgccguacccccuaacuucccaaccgaaggacuuucccccucacaagucaccauguucccgcacaucauagucgacguccgacaacucgaacccguccucauaccccuacccgacguccggaacaauuuuuaccauuacaaccaauccaacgaccccaccaucaaacugaucgcaaugcucuacacaccccucagagcuaacaacgcaggcgacgacguuuucaccguaucaugccgcguccucacccggccauccccagacuucgacuucauauuucucguacccccgaccgucgaaucucgcacaaaacccuucuccgucccgguccucaccguugaagaaaugaccaacucccguuucccaauaccacucgaaaaacucuucaccggcccaucaucagccuucguaguucaaccccaaaacggcagaugcaccaccgacggaguccuccuuggcaccacccagcucuccccugucaacauuugcaccuuccgcggagauguuacccauaucuccgguucgcgcaacuacaccaugaaccucgcgucacagaacuggaacuccuacgacccaacagaagaaauccccgccccacucgggaccccagacuucgucggcaaaauccaaggcguccucacacaaaccaccagaacagacggcuccacccgcggccacaaagccacagucuacaccggcuccgcugauuuuucacccaaacuuggacgcguccaauuugccaccgacaccgacaacgacuucgucaccaaccaaaacaccaaauucacccccgucggcguaauccaagacggcuccacaaccccacgcaacgaaccccaacaauggguucuaccuucauauucaggucgcaacacacacaacguacaccuagccccagccgucgccccgaccuuuccaggagaacagcuccuuuucuuccguuccaccaugcccggcugcuccggauaccccaacauggaccucgacugucuucuuccccaggaauggguccaauacuucuaccaagaggcagcccccgcccaaucugacguagcacuccuucgcuucguaaacccagacacaggccgcguccucuucgaauguaaacuccacaaaucaggcuacgucaccguagcccacaccggucaacacgaccucguaaucccuccaaacggcuacuuccgcuucgacuccugggucaaccaauucuacacccucgccccaaugggcaacgggaccggacgccgccgcgcccuauaa

SEQ ID NO: 36014 - RNA, 1623 nt, Artificial Sequence
  derived and/or modified sequence opt11 from VP1__Norovirus__AGS08116
augaaaauggccucauccgacgccaacccauccgacggcuccguagccaaccucguccccgaagucaacaacgaagucauggcacucgaaccaguagucggcgccgcaaucgccgcccccguagccggccaacagaacgucauagacccauggauccgcaacaacuucguccaagccccaggcggagaauuuacagucucaccccgaaacgcucccggugaaauccucuggagcgcuccacucggccccgaccuaaauccauaccucucccaccucgcucgcauguacaacggauacgccggaggauucgaaguacaagucauccucgcuggcaaugcauucaccgccggcaaagucaucuucgccgccgucccucccaacuucccuacugaaggauuaucccccucccaaguaacaauguucccacacaucguagucgacguccggcaacuagaacccguccuaaucccacuaccagacguacgcaacaacuucuaccacuacaaccaaucuaacgacccaaccauaaagcucauagccaugcucuacacaccccuccgcgccaacaacgccggcgacgacguauucacaguuagcugccgaguccucacacgcccaucccccgacuucgacuucauauuccuagucccacccacugucgaaucacgcacaaaaccauucucaguccccguacucaccgucgaagaaaugaccaacucccgcuucccaauaccccucgaaaaacuauucaccggacccuccagcgccuucgucguccaaccccagaacggcagaugcacaaccgacggaguccuccucggcacgacccaacucucuccuguaaacauaugcacguuccgcggugauguaacccacaucaccggcucccgcaacuacacuaugaaccucgcaagccaaaacuggaacaacuacgaccccacagaagaaaucccagcaccccuagguaccccagacuucgucggcaagauccaaggcguccucacccaaacaacccgcaccgacggcagcacacgcggccacaaagccacagucuacaccggcucagcugacuucgcaccgaaacucggccgaguccaauucgaaacagacaccgaccacgauuuugaagccaaccaaaacacaaaauucacccccguaggcguaauccaagacggcggcaccacccaccgcaacgaaccccaacaauggguccuacccucauacuccggacgcaacacccauaacguccauuuagcccccgcagucgcaccaaccuuccccggagaacaacuucuauucuuccgcuccacuaugcccggcugcuccggcuaccccaacauggacuuagacugccuccucccgcaagaauggguccaauacuucuaccaagaagccgcacccgcccaauccgacguugcccuacuccgauucgucaaccccgacaccggccguguccucuucgaaugcaaacuacauaaauccggcuacgugacugucgcccacaccggacaacacgaccuaguuauaccucccaacggcuacuuccgauucgacucaugggucaaccaauucuacacacucgcaccaaugggcaauggcacaggccgaaggcgagcagucuaa

SEQ ID NO: 36015 - RNA, 1623 nt, Artificial Sequence
  derived and/or modified sequence opt11 from VP1__Norovirus__AGS08117
augaaaauggcuuccucggacgcuaacccgagcgacggauccacagcaaaccucgucccugaagucaacaacgaaguuauggcccuagagcccgucgucggagccgccaucgccgccccaguugccggccaacaaaacgucauagacccuuggaucagaaacaacuucguacaagcccccggaggcgaguucaccguauccccacgcaacgcccccggagaaauccuuuggucugcaccccucggcccagaccucaaccccuaucuaucacaccucgcccgcauguacaacggauacgccgguggcuucgaaguccaagucauacucgcaggaaacgccuuuaccgccggaaaaaucaucuuugcagcaguaccuccaaacuuucccaccgaaggucuaucccccucccaagucaccauguucccccacaucauagucgacguccgccaacucgaaccagugcucaucccccuccccgauguccguaacaacuucuaccacuacaaucaaucaaaugaccccaccaucaaacucaucgccaugcuuuacacuccccuccgcgccaauaacgcaggagacgacgucuucacugugucaugccgaguccucacccgacccuccccagacuucgacuucauuuuucuuguaccucccaccguagaaucgcgcaccaaacccuucuccguccccguccugaccgucgaggaaaugaccaacucccgcuucccaaucccccucgaaaaacucuucaccggccccucuuccgcauucguuguccaaccccaaaacggccgcuguaccaccgacggcguccuccuuggcacaacccaacuaucaccaguaaacaucugcacauuccgcggcgaugucacccacaucuccgguucccgaaacuacacaaugaaccuagccucccagaacuggaacagcuacgaccccacugaagaaaucccugccccauuaggcaccccugauuucgucggcaaaauccaaggcaugcucacccagaccaccagaacagacggcuccaccagaggccacaaagccaccguauacaccggcuccgcagacuucucccccaaacuaggccgaguccaauucgccaccgacaccgacaacgacuucgucaccaaccaaaacacaaaauucacacccguaggaguuauccaggacggcucuacaacaccaagaaacgaaccccaacaauggguacuccccuccuacuccggccgcaacacccacaacguccaccuggccccagccguagcccccaccuuccccggcgaacaacuccuauucuuccgcucuacaaugccagguugcuccggcuacccuaacauggaccucgacugccuccucccccaagaauggguacaauacuucuaccaagaagccgcccccgcccaaucagacguagcccuacuucgcuucguuaaccccgacacaggccgcguccuauucgaaugcaaacuccacaaguccggcuacguaacagucgcccacaccggccaacacgaccucgucauacccccaaacggauacuuccgcuucgacuccugggucaaccaauucuacacacucgcccccauggguaacgggacaggaagacgccgcgcccuauaa

SEQ ID NO: 36016 - RNA, 1623 nt, Artificial Sequence
  derived and/or modified sequence opt11 from VP1__Norovirus__AGS08119
augaaaauggccuccuccgacgccaacccaucagacggaagcaccgccaaccucguaccugaagucaacaacgaagucauggcacuagaaccagucgucggcgccgccaucgccgcccccgucgcuggccaacaaaacgucaucgacccauggauccgcaacaacuucguccaagcccccggaggcgaguucacagucucaccccgcaacgcuccaggcgaaauccugugguccgccccacucggacccgaccugaaccccuaccuuucccaccuagcacgcauguacaacgguuacgcuggcggcuucgaaguucaagucauucucgccgggaacgcuuucacagccgguaaaaucaucuucgcagccguacccccaaacuucccuacggaaggccucuccccaucccaagucacaauguucccccacaucaucgucgacguccgccaacuagaaccggucuuaaucccccuaccagauguccgcaacaacuuuuaccacuacaaccaauccaacgacuccaccauaaaacucauugccaugcucuacacuccccuacgcgcuaacaacgcaggagacgacguauuuaccguauccugucgcgucuugacacgccccucccccgacuucgacuucauauuccucguaccacccaccgucgaaucccgcaccaaacccuucucaguccccauccucacagucgaagaaaugacaaacucacgcuucccuaucccccuagaaaaacucuucacaggccccagcucagcauucgucguccaaccccagaacggccgcugcaccaccgacggcguccuacucgguaccacucaacucucucccguaaacauaugcacauuccgcggcgacgucacacacaucccaggcucccacaacuacacaaugaaccucgcaucccaaaauuggaacuccuacgaccccacugaagaaauacccgcaccccucggaaccccagacuucgucgguaaaauacaaggaguccuuacccaaacaacaucuaccaacggcucaacccgaggacacaaagccaccguauacacaggcuccgcagauuucucccccaaacucggccgcguccaauucgcuaccgacaccaauaacgacuucgaaaccaaccagaacaccaaauucaccccagucggcguaauccaagacggauccaccaccccgcgcaacgaaccccaacaauggguucuacccuccuacuccggccgcaauauccacaacguccaccucgccccugcuguugcccccaccuuccccggcgaacaauuacucuucuuccgcuccacaaugcccggcugcuccggcuaucccaacauggacuuagacugccuccugccacaagaauggguccaauacuuuuaccaggaagccgcccccgcccaauccgacgucgccuuacuacgcuucgucaacccugacaccggacgcguacuauucgaaugcaaacuacacaagagcggcuacgucaccguagcccacacaggccaacacgaccuugucaucccucccaacggauacuuccguuucgacuccugggucaaccaauucuacacccuagcgcccaugggaaacggaaccggacgacgacgcgcacucuaa

SEQ ID NO: 36017 - RNA, 1623 nt, Artificial Sequence
  derived and/or modified sequence opt11 from VP1__Norovirus__AGS08120
augaaaauggccuccucugacgccaaccccucagacgggucuacugccaaccuaguacccgaagucaacaacgaagucauggcacuagaacccgucgucggagccgccauagccgccccuguugcaggacaacagaacaucauagacccguggauacgaaacaacuucguccaagcuccaggaggagaguucaccgucucgccccgaaaugcacccggcgaaauccucugguccgccccacucggucccgaccucaaccccuaucucucccacuuagccagaauguacaacggcuacgccggaggcuucgaaguucaagucauccucgcaggcaacgccuuuacugccggcaaaaucaucuuugcggcagucccgcccaacuuucccaccgaaggacucucucccucacaagucacaauguucccccacaucaucgucgacguacgacaacucgaacccguacucauaccauuaccugacguacgaaacaacuucuaccacuacaaccaaaguaacgauuccaccauaaaacucauagccaugcucuacaccccacucagagcaaacaaugccggcgacgacguauucacuguaucaugccgcguacucacccgacccagcccagacuucgacuuuaucuuccucgucccacccaccguagaaucccgcacaaaacccuucucuguccccguccuaaccgucgaagaaaugaccaacucacgcuuucccaucccccuugaaaaacucuucacaggaccaucauccgccuucgucguccaaccccaaaacggccgcuguaccacagacggcguccuccucggcacaacccaacuaucccccgucaacauaugcaccuuccgcggcgacgucacccacaucuccggcucccgcaacuacaccaugaaccucgccucccaaaacuggaacuccuaugaccccacagaagaaauucccgcaccacucggaacaccagacuucguaggaaagauccaaggcguacucacacaaaccacccgaaccgauggcuccacccgcggucacaaggccaccgucuauaccggcucagcugacuucucccccaagcuaggacggguccaauucgccaccgacacugacaacgacuucguuacaaaucaaaauaccaaguucacaccaguuggcgucauccaggacggcuccacaaccccacgcaaugaaccccagcaauggguacuccccuccuacagcggccgaaacacccauaacguccacuuagccccagccgucgcgccaaccuuccccggagaacaacuccuauuuuuccgcuccaccaugcccggaugcucaggcuaccccaacauggaccuagacugccuacuuccucaagaauggguccaauacuucuaccaagaagcagccccugcacaauccgacgucgcccuacuccguuucguuaacccggauacaggccgaguccucuucgaaugcaaacuccacaaaucagguuacguaaccgucgcccacaccggccaacacgaccucguaauaccacccaacggcuacuuccgauucgacuccugggucaaccaauucuacacccucgcccccauggguaacggcaccggccggcgccgagcacuauaa

SEQ ID NO: 36018 - RNA, 1623 nt, Artificial Sequence
  derived and/or modified sequence opt11 from VP1__Norovirus__AGS08121
augaagauggccucaagcgacgccaaccccuccgacgguucuaccgccaaccuaguccccgaagucaacaacgaagucauggcccucgaacccgucgucggugccgcaaucgccgcccccgucgccggccaacaaaacgucauugaccccuggauacgcaacaacuucguccaagcccccggcggagaguucaccguuucuccacgcaaugccccuggagaaauauuauggucugcuccccucggcccagaccucaaccccuaccucucacaccuagcccgaauguacaacggcuacgccggcggauucgaaguacaaguuauccucgccggaaacgcguucacagccggaaagaucaucuucgccgccgucccgcccaacuuccccaccgaaggccuaucccccagccaagucacaauguuuccccacauaaucgucgauguacgccaacucgaacccguacuuaucccacuccccgacguccgcaacaauuucuaccacuacaaccaauccaacgauuccacaaucaaacuuaucgccaugcucuacacaccccuacgcgccaauaacgccggugacgacgucuucaccguuucaugccgcguucucacacgucccucgccugacuucgacuucaucuuccucgucccacccaccgucgaaucccgaaccaagcccuucuccguccccauacucaccgucgaagaaaugacaaacuccagauuccccaucccccucgaaaaacuuuucaccggacccuccuccgccuucgucguacaaccacagaacggacgaugcaccaccgauggcguacuucuaggcaccacacaacuuucaccaguaaacauuuguaccuuccgcggcgacguuacacacauccccgguucccacaacuacaccaugaaccucgccucccaaaacuggaacucauacgaccccacugaagaaauacccgcaccccucggcacccccgacuucgucggcaaaauccaaggcguacucacccaaaccacuuccaccaauggaucuacccgaggccacaaagccaccgucuacaccggcuccgccgacuucucacccaaacucggccgcguacaauucgcuacugauacuaacaacgacuucgaaaccaaccaaaacaccaaauucacacccgucggagucauccaagauggcucuacuacccccagaaacgaaccccaacaauggguccuccccuccuacuccggccgcaacauacacaacguccaccucgcccccgcugucgcacccacauuccccggcgaacaacuccucuucuuccgaagcacgaugcccggcugcucaggcuaccccaacauggaccuagacugccuucucccccaagaauggguacaauacuucuaccaagaggcagcuccagcccagucugacgucgccuuacuacgcuucgucaaccccgacaccggacgcguccuauucgaguguaaacuccauaaguccggauacgucaccgucgcccacaccggccaacaugaccucgucaucccaccaaacggauacuuccgcuuugacuccuggguaaaccaauucuacacucuagcucccaugggaaacggaacaggccgccgccgcgcacucuaa

SEQ ID NO: 36019 - RNA, 1623 nt, Artificial Sequence
  derived and/or modified sequence opt11 from VP1__Norovirus__AGS08122
augaaaauggccucaucagacgccaaucccucagauggcuccaccgcaaaccucgucccagaaguaaacaacgaaguaauggcacuagaacccgucgucggagccgcaaucgcagcccccgucgccggucagcaaaacgucaucgaccccuggauccgaaacaacuucguacaagcccccggcggcgaguucaccgucucacccagaaacgcacccggagaaauccucuggucagccccacuaggacccgaccucaaccccuaccuuucacaccuagcccggauguacaacggcuacgccggaggcuucgaaguacaaguaauccucgccggcaaugcuuucacagccggcaaaaucauauucgccgccguacccccaaacuuccccaccgaaggacuaagccccucccaagucaccauguucccccacaucauagucgacguacgacaacuugaacccguacucaucccccuccccgacguccgaaacaauuucuaccacuacaaccaauccaacgaccccacaaucaaacucauugccaugcuuuauacaccccuccgugccaacaacgcaggcgacgacguauucaccguauccugccggguucuuaccagaccuucacccgacuucgacuucauauuccucgucccacccaccguagaauccagaacaaaacccuucucuguacccguccuaaccgucgaagaaaugaccaacagccgcuuccccaucccccuagaaaaacuauucacgggcccaucauccgccuucgucguccaaccccaaaacggccgcugcaccaccgacggcguccuacuuggcacaacccaauuaagccccguaaacaucugcacauuccgcggagacguuacacacauaucuggauccagaaacuacaccaugaaucuagccucccagaacuggaacagcuacgaccccacagaagaaauacccgcaccccuaggcacccccgauuucguuggcaaaauccaaggcguccuaacacaaaccacccgaacagauggcucuacgcgcgggcacaaagccacagucuacaccgguuccgccgacuucucacccaaacucggccgcguccaauuugcuaccgauaccgacaacgacuucgucaccaaccaaaacaccaaauucaccccagucggcgucauucaagacggcaacacuaccccacguaacgaaccucaacaaugggucuuacccuccuacuccggcagaaauacccacaacguccaccuagcccccgccgucgccccaaccuuucccggcgaacaacucuuguucuuccgcuccaccaugcccggaugcuccggcuaccccaacauggaccuagacugccuccucccccaagaauggguccaauacuucuaccaagaagccgcccccgcccaaucagacgucgcccuacuccgcuucgucaaccccgauaccggccgcguacuauucgaaugcaaacuccacaaacccggcuacgucacugucgcccacacaggccaacacgaccucguaaucccacccaacggcuacuuccgauucgacagcuggguaaaucaauucuacacccucgcccccaugggaaacggcaccggucggcgccgugcccuauga

SEQ ID NO: 36020 - RNA, 1623 nt, Artificial Sequence
  derived and/or modified sequence opt11 from VP1__Norovirus__AGS08124
augaaaauggcaagcucagacgccaauccaucagacggcucaacagccaaccuaguuccagaaguaaacaacgaagucauggcccuggaacccgucgucggcgccgccaucgccgcccccgucgcaggccaacaaaacguaaucgaucccuggauccgcaacaacuucguccaagcacccggcggcgaauuuacgguaucaccccgcaaugcccccggcgaaauacucugguccgcaccccucggcccugaccuaaaccccuaccucucacaccuugccagaauguacaacggcuaugccggaggcuucgaaguccaagucauacuugccggaaacgccuucaccgccggaaaaauaaucuucgcagccgucccaccaaacuuccccaccgaaggccucucacccucccaaguaaccauguucccccacaucaucguugacguccgccaacucgaaccaguucucauuccucuacccgacguacguaacaacuucuaccacuacaaccaauccaacgaccccaccaucaaacucaucgccaugcuauacaccccucuccgugcaaacaacgcaggagacgacgucuucaccguaucuugccgcguccuaacccgccccucacccgacuucgauuucaucuuucuagucccuccaaccguagaaucacgcaccaaacccuucagcguaccuguccucaccgucgaagaaaugacaaacucccgcuucccaaucccucucgaaaaacucuucaccggccccuccggcgccuucgucguccaaccccaaaacggccgcugcacuacagacggcguacuccuuggaaccacccaacuuucuccagucaacauaugcacauuccgaggcgacguaacccacaucucuggaucccgcaacuacacaaugaaccucgccucacaaaacuggaacuccuacgaccccaccgaagaaauccccgccccacuaggaacgccagauuucguaggcaaaauacaagguguccuaacucaaacaacacgaacggacggauccacuagaggacacaaagcuaccgucuacaccggcucagccgacuucucccccaaacuuggacgcguccaauucgccacagacaccgacuccgacuucgucaccaaccaaaacaccaaauucaccccagucggcgucauacaagacggauccacuacccccagaaacgaaccccaacaauggguacuccccuccuacucaggucgguccacacacaacguucaccuagcccccgcaguugcccccaccuuccccggcgaacaacuucuauucuucagauccacuaugcccggcugcucaggauauccaaacauggaccuagacugucuccuaccccaagaauggguacaauacuucuaccaagaagccgcccccgcacaaucagacgucgcccuacuccgcuucguaaaccccgauacuggccgaguccucuucgaauguaaacuccacaaauccggcuacgucaccgucgcccacaccggccaacacgaccucgucauacccccaaacggauacuuccgcuucgacucguggguuaaccaauucuacacccuagcaccgaugggcaauggcacgggcagacgacgcgcccuuuaa

SEQ ID NO: 36021 - RNA, 1623 nt, Artificial Sequence
  derived and/or modified sequence opt11 from VP1__Norovirus__AGS08125
augaaaauggccuccagcgacgccaacccaucagacggauccgccgccaaccucguccccgaagucaacaacgaagucauggcccuagaacccgucguaggagcugccaucgccgcccccguagccggccaacaaaacgucauagaccccuggauccgcaacaacuucguccaagcccccggcggcgaauuuacagucuccccacgcaacgccccaggagaaauccuuuggucugcaccccuaggacccgaccuaaaccccuaccucucccaccucgcccgaauguacaacggcuacgccggugguuucgaaguacaagucaucuuagccggcaacgccuucaccgccggcaaagucaucuucgccgcuguacccccaaacuuccccaccgaaggccucucaccuucacaagucacaauguucccccacauagucgucgauguacgccaacucgaacccguucuaaucccacuccccgacguccgcaacaacuucuaccacuacaaccaauccaacgaccccaccaucaaacucaucgccaugcuauacacacccuuacgagcaaacaacgcaggagacgacguauucaccgucucaugccgcguccuaacccgaccaucccccgacuucgacuucauauuccucguuccucccacugucgaaagccgcaccaaacccuucuccguacccguccuaaccgucgaagaaaugaccaacucacgcuuccccauuccccucgaaaaauuauucaccggacccucaucagcauucgucguccaaccccaaaacggacgaugcacaaccgacggcguccuccuaggcacaacacaacuaucccccguaaacaucugcaccuuccgaggcgacgucacccacaucacagggucaagaaauuacacaaugaaccucgccucccaaaacuggucaaacuacgacccaaccgaagaaauaccagccccacuuggaacccccgacuucgucggcaaaauacaaggaguccuaacccaaaccacccgcacugacggaucaacacgcggacacaaagccacagucuacacuggcuccgccgucuucgcacccaaacugggacguguacaauucgaaaccgauacagaucacgacuucgaagccaaccaaaauaccaaauucacacccgucggcguuauccaagacggcuccacaacccaccgcaacgaaccccaacaauggguccuacccuccuacucaggcagaaacacacccaacguccaccucgcccccgccgucgccccaaccuucccaggcgaacagcucuuauucuuccgcucaacaaugcccggaugcuccggcuaccccaacauggaccucgacugccuccucccccaagaauggguccaauacuucuaccaggaagccgcccccgcccaaucagacgucgcacuccuucgcuucgucaaccccgacaccggccgcgucuuauucgaaugcaagcuccacaaauccggauacgucacuguagcccacacaggccaacacgaccucgucauaccuccaaacggauacuuccgcuucgacucauggguaaaccaauuuuacacccucgcaccaaugggcaacggaacaggucgccgacgcgcucuguaa

SEQ ID NO: 36022 - RNA, 1623 nt, Artificial Sequence
  derived and/or modified sequence opt11 from VP1__Norovirus__AGS08126
augaaaauggcauccagcgacgccaacccauccgacggcucagcagcaaaccucguaccagaaguaaacaacgaagucauggcccuagaaccugucgucggcgccgcaaucgccgcaccaguagcaggucagcaaaacgucaucgauccauggauccgcaacaacuucguccaagcucccggcggcgaauuuacuguaucaccacgaaacgccccaggcgaaauccuauggucugcaccccucggaccagaucucaaccccuaccucucccaccuagcacgcauguacaauggguacgccggcggcuucgaaguccaagucauacuagcuggcaacgccuucaccgcaggcaaaguaaucuuugccgcaguaccacccaacuuccccaccgaaggacuuucgcccucgcaagucacuauguucccccacauagucguagacguccgccaacuagagcccguccucaucccccuaccagacguccgaaacaacuucuaucacuacaaccaaagcaacgaccccaccauaaaauuaaucgccaugcucuauacaccccuacgagccaacaacgccggcgacgauguauucacagucucgugccgaguacucacgcgacccagccccgacuuugacuucaucuuccucgucccacccaccgucgaaucccgaacaaaaccauucucugucccaguccuaaccguagaagaaaugaccaacucccgcuuccccaucccccuagaaaaacucuuuaccggacccuccagcgccuuuguuguccagccacaaaacggacgcugcaccacagacggaguacuccuaggcacaacccaacuaagccccgucaacaucugcacauucagaggcgacgucacccacauaacaggcucacgaaacuacacaaugaaccucgccucccaaaacuggaacaacuacgacccaacagaagaaaucccagcuccccuaggcacacccgacuucgucggcaaaauacaagguguccuaacccaaaccacacgaacggacggcagcacccgcggccacaaagccacaguauacaccggcuccgccgacuucgcucccaaacucggccgcguccaguucgaaacagacaccgaccacgacuucgaagccaaccaaaauacaaaauuuacacccgucggcguaauccaagacggcggaaccacccaucggaacgaaccacaacaauggguccuucccagcuacuccggacguaacacccauaacguccaccucgcaccagcagucgcucccacguuccccggugaacagcuccuuuucuucagauccacaaugccaggcugcagcggauaccccaacauggaccuagacugccucuuaccacaagaauggguccaauacuucuaccaagaagcagcuccagcgcaauccgacgucgcacuacuccgauucguaaaccccgacaccggucgaguccuuuucgaaugcaaacuccacaaauccggcuacguaacagucgcccacaccggccaacacgaccucgucauaccacccaacggcuauuuccgcuucgacuccugggucaaccaauucuacacacuagcccccauggggaacggcaccggacgacgccgagcuguauaa

SEQ ID NO: 36023 - RNA, 1623 nt, Artificial Sequence
  derived and/or modified sequence opt11 from VP1__Norovirus__AGS08127
augaaaauggccuccuccgacgccaaccccuccgacggauccaccgccaaccucguacccgaagucaacaacgaagucauggcgcucgaaccuguagucggcgccgccaucgcugcacccgucgcaggacaacaaaacgucauagaccccuggauucgcaacaacuucguccaagccccagguggagaguucacagucucaccccgcaacgcacccggcgaaauauuguggucagcaccccucggucccgaucucaacccauaccucucccaccucgcccgaauguacaacggcuacgccggagguuucgaaguccaaguaauacucgcuggcaacgccuucacagccggcaaaaucauauucgccgccguaccacccaacuuucccacugaaggucucucccccagccaaguaaccauguuuccccacauaaucgucgacguccgccaacucgaacccgucuuaaucccacuccccgacguccgaaacaacuucuaucacuacaaccaauccaacgaccccaccaucaaacuuaucgcaaugcuauacacaccccuucgagccaacaacgccggagacgacgucuucaccgucuccugccgcguccucacccgcccaagccccgacuuugacuucaucuuccucguaccaccaacuguagaaucgcgcacaaagcccuucuccguccccguacuaacagucgaagaaaugaccaacagccgcuuuccaaucccucuagaaaaacuguucacaggccccucauccgcauucgucguccagccccaaaauggacgcugcaccaccgacggcgucuuacucgggaccacgcaauuaucuccaguaaacaucugcaccuuccgcggcgacgucacccacauauccggaucccgcaacuacaccaugaacuuagccucucaaaacuggaacuccuacgaccccaccgaagaaauaccagccccacuagguacccccgacuucgucggcaagauccaaggcguccucacucaaacuacucgcacugacggcucuacacgcggccauaaagccacagucuacacuggcucagcagacuucuccccuaaacucggcagaguccaauuugccaccgacaccgacaacgacuuuguuacaaaccaaaacaccaaauucacccccgucggaguaauccaagauggcuccacgaccccaagaaacgaaccacaacaauggguucuccccucuuacucaggccgcaacacccacaacguccaccuagcccccgcggucgccccaacguuccccggagaacaacuccuauuuuuccgcucgaccaugccugguugcucaggcuacccaaacauggaccucgauugccuacuuccacaagaauggguacaauacuucuaccaagaagcagcacccgcacaauccgaugucgcccuacuccgcuucgucaacccagacaccggaagaguccuauucgaaugcaaacuccacaaguccggcuacguaacaguagcacacaccggacaacacgaccuaguaauaccaccuaacggcuacuuccgcuucgacuccugggucaaccaauucuacacacuagcaccaaugggcaauggcaccggccgcagacgcgcacuauaa

SEQ ID NO: 36024 - RNA, 1623 nt, Artificial Sequence
  derived and/or modified sequence opt11 from VP1__Norovirus__AGS08128
augaaaauggcuucaucagacgccaaccccucagacggcucaacugccaaccugguacccgaagucaacaacgaagucauggcucuagaaccagucgucggagcagcuaucgcagccccaguugccggccaacaaaaugucauagaccccuggauccgcaacaacuucguccaagcacccggcggcgaauuuacaguauccccacgcaacgcuccaggcgaaauacucugguccgcaccccucggccccgaccuuaaccccuaccucucccacuuagcccgcauguacaacggcuacgcgggaggcuucgaaguacaagucauccuagcuggcaacgcuuucaccgccggcaaaaucaucuucgccgccguacccccaaacuuccccaccgagggccucuccccaucacaagucaccauguucccccacaucaucguagacguccgccagcucgaaccuguccucaucccacuuccagacguccgcaacaacuucuaccacuacaaccaauccaacgaccccacuaucaaacucauagcaaugcuauacaccccacuacgcgccaacaacgccggcgacgacgucuucaccgucuccugccgcguccucacccgacccucucccgacuucgacuucaucuuccucguuccacccacagucgaaucacgaacaaaacccuucuccgucccaguacucacaguugaagaaaugacaaacucccgcuuccccaucccccuagaaaaacucuucaccggacccagcuccgccuucgucguccaaccccaaaauggccgcugcacaaccgacggcguccuacucggcaccacccaacucuccccugucaacaucugcacuuuccgcggcgaugucacucacauccccgguucacgcaacuacaccaugaaccuugcaucccaaaauuggaacucuuacgaccccacugaagaaauccccgcuccccucggcacaccagacuuuguaggaaaaauccaaggaguucuaacccaaaccacccgcaccgacggcuccacaagaggccacaaagccaccgucuacaccggauccgccgacuucucuccaaaacucggccgaguccaauucgcuaccgacaccgacaaugacuucguuacuaaccaaaauacaaaguuuacucccgucggaguaauccaagacggauccaccacaccccgaaacgaaccacaacaguggguacuacccuccuacucuggacgcaacacccauaacguccaccuagcccccgccguagccccaaccuuccccggcgaacaacuccucuucuuccgaucaaccaugcccggcugcuccggauaccccaacauggaccucgacugccuccucccccaagaauggguacaguacuucuaccaagaggccgcccccgcccaaucagacgucgcacuccuccgcuucguaaaccccgacaccggacgcguccuguucgaaugcaaacuccacaaguccggcuacgucacggucgcacacaccggacagcacgaccuaguaaucccacccaacggcuacuuucgauucgacagcugggucaaucaauucuacacccuagcacccauggguaacggaacaggccgccgccgcgcccuauaa

SEQ ID NO: 36025 - RNA, 1623 nt, Artificial Sequence
  derived and/or modified sequence opt11 from VP1__Norovirus__AGS08129
augaaaauggcaucguccgacgcaaaccccuccgacggauccaccgccaaccucguccccgaaguaaacaacgaagucauggcccuagaaccagucgucggcgccgcaaucgcagcccccguagccggccaacaaaacgucaucgaccccuggauacgcaacaacuuuguucaagcuccagguggagaguucacagucaguccccgaaaugcaccaggugaaauccucugguccgcaccacucggccccgaccucaaccccuaccucucccaccucgcccgaauguacaacggauacgccggcggguucgaaguccaagucauccucgccggcaaugcuuucaccgccggaaaaaucaucuucgcggccgucccacccaacuuccccaccgaaggccuauccccaucccaaguaacaauguucccacacaucaucgucgacguaagacaacucgaacccgucuuaauuccacugccugacguccgaaauaacuucuaccacuacaaccaauccaaugaccccaccauaaaacucaucgcaaugcuguacacaccucuacgcgccaacaacgccggagacgacguauucaccguaucaugccgaguacucacccgaccaucccccgacuucgacuucaucuuccucguaccaccgaccguugaaucucgaacaaaaccguucucagucccaguccucaccgucgaagaaaugacaaacucccgcuucccaauaccacucgaaaaacuauucacaggucccuccuccgcauucgucguccaaccacaaaacggcagaugcacaaccgacggcguccuacuaggaaccacccaauuaucacccgucaauaucugcaccuuucguggcgacguaacccacaucaguggaagccauaacuacacaaugaaccucgcaucucaaaacuggaacucauacgaccccaccgaagaaaucccagcuccccucggcaccccugacuucgucggcaaaauccaaggaaugcuuacccaaacuaccagaaccgacggcagcacccgcggccacaaagccacggucuacaccggaucgguagacuucucccccaaacuaggccgaguccaauucacuaccgacacagacaacgacuucgaaaccaaccaaaacacaaaauucacccccgucggcgucauccaggaugggagcacgacccaccgaaacgaaccacaacaauggguccucccauccuacuccggacgcaacacccacaacguccaccucgccccagccguagccccuaccuucccaggagaacaacuccuauucuuuagauccaccaugcccggcugcucaggcuacccuaacauggaccuagacugccuacuaccccaagaauggguccaauacuucuaucaagaagccgcccccgcccaauccgacgucgcacuccuaagauucguaaacccagacaccggccgcguccucuucgaaugcaaacuccacaaauccgguuacguaaccgucgcacacaccggucaacacgaucucgucauaccucccaacggcuacuuccgcuucgacuccugggucaaccaauucuacacacucgcacccaugggcaacggcacaggccgccggcgcgcucucuaa

SEQ ID NO: 36026 - RNA, 1623 nt, Artificial Sequence
  derived and/or modified sequence opt11 from VP1__Norovirus__AGS08130
augaaaauggccucauccgaugccaaccccuccgacggcagcaccgccaaccucguccccgaagucaacaacgaagucauggcacucgaacccgucguaggagcagcaaucgcagcacccgucgccggccaacaaaacgucaucgaccccuggauacgcaacaacuucguccaagcccccgguggcgaguucaccgucucaccacgaaacgcaccaggagaaauacucugguccgcuccccucggccccgaccucaacccauaccucucccaccucgcccgcauguacaacggauacgccgguggauucgaaguacaagucauccucgccggaaacgccuucaccgccggcaaaaucauauucgccgccguacccccaaacuucccaaccgaaggccuuucccccucccaagucaccauguucccccacaucaucgucgacguccgccaacuagaacccguccucaucccccuccccgacguccgcaacaacuucuaccacuacaaccaauccaacgacccuacaaucaaauuaauagccaugcuguacaccccacuacgcgccaacaacgcaggagacgacgucuuuaccgucuccugccgcguccuaacgcgcccaucucccgacuucgauuucauauuucucguacccccaacuguugaaucacgcacaaaaccauucuccgucccgguccuaacagucgaagaaaugaccaacucccgauuucccaucccacucgagaaacuuuucaccggccccuccuccgcuuucguuguacaaccccaaaacggucgcuguaccaccgacggcguccuacucgguaccacacaacucucccccguaaauaucugcaccuuccgcggcgacgucacacacaucucaggcucccgaaacuacaccaugaaucucgccucacaaaacuggaacucguacgaccccaccgaagaaaucccagccccacucggcacacccgauuucgucggcaaaauccaaggaguccuaacccaaaccacccgcgcagacggauccaccagaggccacaaggcaacagucuacaccggcuccgccgacuucucacccaaacuaggccgcguccaauuugccaccgacaccgauaacgacuucgucgccaaccaaaacacaaaauucacccccgucggcguuauccaagacggcagcaccacaccccgcaacgaaccccagcaauggguccucccgagcuacuccggacgcaacacccacaacgugcaccuugccccugcagucgcaccaaccuuccccggagaacaacuccucuucuuucgcagcaccaugcccgggugcucuggcuaccccaacauggaccuagacugccuacuaccccaagaauggguccaauauuucuaccaagaagccgcacccgcucaaucugacgucgcccuucuccgcuucguuaaccccgacaccggccgcguccuauucgaaugcaagcuacacaaauccggauacguaaccguugcccacaccggucaacacgaccuaguaaucccacccaacggcuauuuccgcuucgacuccugggucaaucaauucuacacucuagcucccaugggcaauggaaccggccgucgacgugcccucuga

SEQ ID NO: 36027 - RNA, 1623 nt, Artificial Sequence
  derived and/or modified sequence opt11 from VP1__Norovirus__AGS08131
augaaaauggcuuccuccgacgcaaaccccucagacggcucagccgccaaccuaguaccagaagucaacaacgaagucauggcucucgaaccagucgucggagcagccaucgcagccccaguagccggccaacaaaacguaaucgacccauggauacgaaacaacuucguacaagcccccggaggcgaguucaccgucuccccacgaaacgcaccaggugaaauccuaugguccgcaccccucggccccgaccucaacccauaccucucgcaccuugcccgcauguauaacggauacgccggaggauuugaaguacaaguuauccuagccggcaacgcauucacagccggaaaggucaucuucgcugccguacccccaaacuuccccacagaagggcucucccccagccaagucaccauguucccccacaucgucgucgacguccgccaacucgaacccguccucauaccacuacccgacguaaggaacaacuucuaccacuacaaucaguccaacgacccaaccauaaaacuaauagccaugcucuacacuccccuacgcgcaaacaacgccggcgacgaugucuucaccguaucaugucgcgugcucacacgccccucaccagacuucgacuucaucuuccucguuccacccacagucgaaucccgcacaaaacccuucucaguccccguacuaaccgucgaagaaaugaccaauucacgcuucccaaucccauuagaaaaacucuucaccggccccuccuccgccuucgucguccagccucagaacggacgauguacaacagacggaguccugcucggcacaacacaacuaagcccagucaauauauguaccuuccgcggcaacgucacccacauuaccgguucccgaaauuacacaaugaaucuagccucucaaaacuggaacaauuacgaccccaccgaagaaaucccagcuccccuagguacacccgacuuugucggcaaaauccaaggaguccuuacccaaacaacgcgaaccgacggcuccacccgcggccacaaagccaccgucuacaucggauccgccgacuucgccccuaaacuaggcagaguccaauucgaaaccgacaccgaccacgacuucgaagccaaccaaaacacaaaauucacacccguuggagucauccaagacggcggcaccacacaccgcaaugaaccucaacaauggguccugccaucauacuccggcagaaacacccacaacguccaccucgccccagccguagcccccaccuuccccggcgaacaacuauuauucuuucgcucuacaaugcccggaugcucuggauaccccaacauggaccuugacugccuacuaccacaagaauggguccaauacuucuaccaagaagccgcccccgcccaauccgacgucgcccuacugcgauucgucaacccagacaccggaagaguccuauucgagugcaaacuacauaaauccggauacguaacagucgcgcacaccggccaacacgaccuaguaaucccucccaacggauacuuccgcuucgauuccugggucaaccaauuuuacacacucgcucccaugggcaacgguaccggacgccgacgagccgucuaa

SEQ ID NO: 36028 - RNA, 1623 nt, Artificial Sequence
  derived and/or modified sequence opt11 from VP1__Norovirus__AGS08132
augaaaauggccuccuccgacgcaaaccccucagacggauccaccgccaacuuaguaccugaagucaauaacgaagucauggcccucgaacccgucguaggcgccgcgaucgcugcccccgucgcaggccaacaaaacguuaucgaccccuggauccgcaacaacuucguucaagcccccggcggagaauuuacagucagcccccgaaaugcuccaggcgaaauccuaugguccgcaccccucggccccgaccucaaccccuaccucucccaccucgcccgcauguacaacggauacgcaggcggcuucgaagugcaagucauccucgcaggaaacgcauucaccgccgguaaaauaauauucgcagccguacccccaaacuucccaaccgaaggccuuucccccucccaaguaaccauguucccccacauaauaguagacguccgccagcucgaacccguccucaucccccucccagacguacgcaacaacuucuaccauuacaaccaauccaacgaccccaccauaaaacuaaucgcaaugcucuauacaccccuccgagcgaacaaugccggugacgacgucuucaccguauccugccgaguucuuacccgcccgucccccgacuucgacuucaucuuccuaguaccacccaccguagaaucgcgcacaaaaccauucucaguccccguacuuaccgucgaagaaaugaccaacucccgcuuucccauaccccucgaaaaacuauucaccggccccucauccgcauucgucguccaaccccaaaacggccgcugcacaacggacggcguccuucucggcacaacucaacucucgccagucaauaucuguaccuuccgaggcgacgucacacauaucucaggcucccacaacuacaccaugaaccuugccucccagaacuggaacuccuacgaccccaccgaagaaauaccagcaccccucggaacccccgacuucgucggcaaaauccaagggguccucacccaaaccacccgcaccgacggcuccacucgcggacacaaagcuaccguuuacaccggcuccgccgacuucucaccaaaacucggucgcguccaauucgcgaccgacaccgacaacgauuucgaaaccaaccaaaacaccaaauucaccccagucggcgucauccaagacgggggcaccacccaccgcaacgaaccccaacaauggguccucccuuccuacagcggucgcaacauccacaacguacaccuagcucccgcagucgcccccaccuucccaggcgaacaacuucucuucuuccgaucgaccaugccagguugcuccggcuauccgaacauggaccuugacugccuccucccccaagaauggguucaauacuucuaccaagaagccgcacccgcccaaagcgacgucgcccuccuccguuucguuaaccccgacacaggccgcguacucuuugaaugcaaacuccacaaaucaggcuacgucaccgucgcacacacaggccaacacgaucucgucaucccgcccaacggcuacuucagauuugacuccugggucaaccaauucuacacccucgcacccaugggcaacggcaccggccgucgucgagcccuauaa

SEQ ID NO: 36029 - RNA, 1623 nt, Artificial Sequence
  derived and/or modified sequence opt11 from VP1__Norovirus__AGS08133
augaaaauggccucauccgacgccaacccauccgauggcucaaccgcaaaccuaguaccagaagucaacaaugaaguaauggcacuagaacccguaguuggcgcagccaucgccgcucccguugcaggccaacaaaacguaaucgacccauggauacgcaacaacuucguccaggcgccaggaggugaguucacaguaucuccccgcaacgccccaggcgaaauacucugguccgcaccccucggccccgaccucaaccccuaccuuucccaccucgcccgcauguacaacggcuaugccggcggcuucgaaguccaagucauccucgccggaaacgccuucaccgccggcaagaucaucuucgcagccgugcccccuuccuuccccaccgaaggccucuccccaucacaaguaacaauguucccacacaucaucgucgacguccgccaacucgaacccguacucaucccccucccagacguacgcaacaauuucuaccauuauaaccaauccaacgaucccaccaucaaacucaucgcaaugcuuuacaccccacuccgcgcaaacaacgccggcgaugacgucuucacagucuccugcagaguccucacccgcccaucccccgauuuugacuuuaucuuccucgucccaccuaccgucgaaagccgcacaaaaccauucuccgucccuguucuaaccguagaagaaaugacaaauucccgcuuccccauccccuuagaaaaauuguucacaggcccuucgucagccuucgucguccaaccccaaaauggcagaugcaccaccgacggaguccuacucggaaccacccaacugucucccguaaacauaugcaccuuccgcggugaugucacccacaucuccggcagccgcaacuacaccaugaaucucgccucacaaaacuggaacuccuacgaccccacggaagaaauuccggcaccccuaggcacccccgacuucgucgguaaaauccaaggagugcucacacaaaccacccgcaccgacggcucaacacgaggacacaaagccacaguauacaccgguucagccgacuucucccccaaacuuggacgaguacaauucgcaacugauacagacaacgacuucguuaccaaucagaacacuaaauucacccccguaggaguuauccaagacggcucaaccaccccucgcaacgaaccccaacaauggguccuccccucuuacuccggccgcaacacacacaacguucaccucgccccagccgucgccccaacuuuccccggagaacaacuccuauucuuccgaucaaccaugccaggaugcuccggcuaucccaacauggaccucgacugccuacucccacaagaauggguccaguacuucuaccaagaagccgcccccgcccaaucugacgucgcccuacuccgcuuugucaacccagacaccggccgaguccucuucgaaugcaaacuccacaaauccggcuacgucaccguagcacacaccggccaacacgaccucgucaucccacccaacggcuauuuccgguucgacucaugggucaaccaauucuacacccuagcccccaugggaaacggcaccggccgccgacgcgcccucuaa

SEQ ID NO: 36030 - RNA, 1623 nt, Artificial Sequence
  derived and/or modified sequence opt11 from VP1__Norovirus__AGS08134
augaaaauggcaucuucagacgcaaacccauccgacggauccaccgcaaaccuugugccugaagucaacaacgaagucauggcccucgagcccgucgucggugcagcaaucgccgccccagucgccggccaacaaaauguaaucgacccauggaucagaaacaacuucguccaagcuccugguggcgaguucaccgucagcccccgaaacgccccaggagaaauccucugguccgccccacuaggaccagaccucaacccauaccucucacaucuugcacgcauguacaacggcuacgccggaggauucgaaguacaaguaauccuagcaggcaaugccuuuaccgcaggcaaaauuauauucgccgcaguuccucccaacuuccccaccgaaggccuaucccccucccaaguuacaauguuuccccacaucauagucgacguccgccagcucgaacccguccucauuccccuccccgacguacguaacaacuucuaccacuacaaccaauccaacgacucaaccauaaaacuaauagccaugcucuacacaccccuacgagccaacaacgccggugacgacgucuucaccgucuccugccgcgucuuaacccgccccucucccgacuucgacuucaucuuccuagucccucccacaguagaaucccgcaccaaacccuucuccguaccaauacuaaccguagaagaaaugacaaacucacgauuccccaucccccucgaaaaacuuuucaccggccccuccuccgccuucguaguccaaccccaaaacggccgaugcaccaccgacggcguacuccuaggcaccacucaacuaucuccaguuaacguaugcacauuccgcggagacguaacccacaucccaggcucccacaacuacaccaugaaccuugccucacaaaacuggaacuccuacgacccaaccgaagaaaucccugccccucuagguacacccgacuuugucggcaaaauccaaggcguccuaacccagaccaccagcaccaacggcuccacaagaggccauaaagcuaccguauacaccggcucugccgacuuuagcccuaaacuaggacggguacaauucgccaccgacaccaacaaugacuucgaaaccaaccagaacaccaaauucacaccaguaggcgucauacaagacggaagcaccacaccccgcaacgaaccacaacaauggguacuccccucauacagcgggcgaaacauccacaacguacaccucgcccccgcagucgcaccaaccuuccccggugaacaacuccuauucuuccgcuccaccaugcccggcugcuccggcuacccuaacauggaccucgacugccuacuaccccaagaauggguacaauacuucuaccaagaggcagcccccgcccaguccgauguagcccuccuucgcuucgugaaccccgacaccggacgcguccucuucgaaugcaaacuccauaaauccggcuacguuaccguagcccacaccgggcaacacgaccuuguuaucccaccuaacggcuacuuccgcuuugacucaugggucaaccaauucuacaccuuagcccccaugggcaacggcaccggccgccguagagcucuauaa

SEQ ID NO: 36031 - RNA, 1623 nt, Artificial Sequence
  derived and/or modified sequence opt11 from VP1__Norovirus__AGS08135
augaagauggcuucauccgacgccaaccccuccgacggaucuacagcaaaccuaguccccgaaguaaacaacgaagucauggcucuagaaccagucguaggagccgccauagccgcacccguagccggccaacaaaacgucaucgaccccuggauacgcaacaacuucguccaagcccccggcggcgaguucaccgucucuccccgcaaugcccccggcgaaaucuuaugguccgcuccccucggcccagaccuaaacccuuaccucucacaccuggcccguauguacaacggcuacgccggcggauucgaaguccaagucgucuuagcuggcaacgccuuuaccgccggaaaaaucaucuucgccgccguacccccaaacuucccaacggaaggacucucccccucccaagucaccauguucccccacauaaucgucgacguccgccaacucgaacccguccucauaccccuccccgacgucagaaacaacuucuaccacuacaaccaauccaacgaccccaccaucaaacuuauagcaaugcucuauacaccccuucgcgcuaacaaugcaggcgacgacguauucaccguauccugccgcguccuaacccgccccuccccugacuuugacuucauauuccucgugcccccaaccguagaaagccgcaccaaacccuucuccgugccgguccuuaccguagaagaaaugaccaacucgcgcuucccgaucccacuagaaaaacuuuucacaggccccucauccgcuuucgugguacaaccccaaaacggccgcugcaccaccgacggcguccuccuaggcaccacacaacucucaccuguuaacaucugcaccuuucgcggagacgucacccacaucuccgguucacgaaacuacaccaugaaccuagccucccaaaauuggaacuccuacgaccccaccgaagaaauccccgccccucucggcacccccgacuuugucggcaaaauccaaggcguacuuacccaaacaacucgaacagacggcagcacccggggacacaaagccaccgucuacaccggauccgcagacuucucuccaaaacucggcagaguccaauucgcaaccgacaccgauaacgacuucgucaccaaccaaaacaccaaauuuacccccguaggcgucauccaagacggauccaccacuccccgaaacgaaccucaacaauggguacuucccucauacuccggucgcaacacccacaacguccaccuggcacccgccgucgcccccaccuucccuggcgaacagcuacuauucuuucgauccaccaugcccggaugcuccggcuaccccaacauggaccuagacugccuccucccccaagaauggguccaauacuucuaccaagaagccgcacccgcccaaucagauguagcccuacuaagguucgucaaccccgacacaggcagaguccucuucgaaugcaaacuucacaaauccggcuacgucaccgucgcccauaccggccagcacgaccuuguaauaccacccaacggguacuuccgcuucgacucaugggucaaucaauucuacacccuggcccccaugggcaacggcaccggccgacgccgcgcccuauaa

SEQ ID NO: 36032 - RNA, 1623 nt, Artificial Sequence
  derived and/or modified sequence opt11 from VP1__Norovirus__AGS08136
augaaaauggcauccuccgacgccaaccccagugacggcuccaccgcaaaccuuguacccgaagucaacaacgaagugauggcucucgaacccgucgucggugccgccaucgccgcucccgucgccggccagcaaaacguuauagaccccuggauccgcaauaacuucguccaagcccccggcggugaguucaccgucagccccagaaacgcccccggagaaauccucugguccgcaccccucggaccugaccuaaacccauaucuaucccaccuagccagaauguauaacggcuacgcaggcggcuucgaaguacaagucauacucgccggcaacgcauucaccgcaggcaaaaucaucuucgccgccguacccccaaacuuccccaccgaaggccucucacccucccaagucaccauguucccccacauaauaguagacguacgacagcucgaacccguccucaucccccucccagauguccguaacaacuucuaccacuacaaccaaucaaacgacuccaccauaaaacucauugccaugcucuacacaccacuuagagcgaacaacgccggagaugacgucuuuaccgucuccugcagaguacucacccgucccagccccgauuucgacuucaucuuccucgucccacccacaguugaaucccgaaccaaacccuuuucaguccccaucuugacagucgaagaaaugaccaauucccgauuccccauaccccuagaaaaacucuucacaggacccucauccgcauucguaguccaaccacaaaacggccgaugcaccaccgacggcgucuuacuaggcaccacucaacucucacccgucaacauuugcaccuuccgcggagacgucacccacauccccggcagccacaacuacaccaugaaccucgcuagccaaaacuggaacucauacgaccccaccgaagaaauucccgcaccccuuggcaccccagacuucgucggcaaaauacaaggcguacucacccaaaccacauccaccaauggauccacccgcggccacaaggccaccguauacacugguuccgccgauuucucuccaaaacuagggcgaguccaauucgccaccgacaccaacaacgacuuugaaaccaaccaaaacacaaaguucacacccguaggcgucauccaagacggcucuacaaccccucgcaacgaaccccaacaauggguguuaccauccuacagcggccgcaacauacacaacguucaccucgcccccgccguagcccccaccuuccccggagaacaacuccuguucuuccgcuccacaaugccaggcuguuccggcuacccuaacauggaccucgacugccuacucccccaagaauggguccaauacuucuaccaagaagccgccccugcacaauccgauguugcccuucuacguuucgucaacccagacacgggcagaguccuauucgaaugcaaacuccauaaauccggauaugucaccguagcucauaccggacaacacgaccuaguaaucccacccaacggcuacuuccgcuucgacucuugggucaaccaauucuacacucuagcccccaugggcaacggcacaggccgccgccgcgcccuuuaa

SEQ ID NO: 36033 - RNA, 1623 nt, Artificial Sequence
  derived and/or modified sequence opt11 from VP1__Norovirus__AGS08137
augaaaauggcaucaucagacgcaaaucccuccgacggauccuccgcaaaccucguccccgaagucaauaacgaaguaauggcucuagaacccgucguaggugcagcaaucgccgcgccagucgccggccaacaaaacguaaucgaccccuggauccgcaacaacuucguccaagcccccggcggagaguucaccgucuccccacgcaaugcacccggagaaauacucuggucugccccgcuagguccagaccucaaccccuaucuaucacaccuggcccgcauguacaacggauacgccggcggauucgaaguucaagucauccucgcaggcaacgcauucaccgccggcaaaaucaucuucgcugccguacccccuaacuuccccaccgaaggccuuucccccucgcaagucaccauguucccacacauaaucgucgauguacgccaauuagaacccguacucauuccccuaccugacguccgaaacaacuucuaucacuacaaucaauccaaugaccccaccauaaaacucaucgcaaugcuuuacaccccucuccgcgccaacaacgcaggcgacgacguuuucaccguauccugccgcguucucacucgccccucccccgacuucgacuucaucuuccucguacccccaaccgucgaaucacgcaccaaaccauucuccgucccaguccucaccgucgaagaaaugacgaacagccgauucccaauuccccuagaaaaacucuucaccggacccuccucugccuucgucguccaaccccaaaauggacgcugcaccacagacggcguccuccuagggaccacucaacugagcccugucaacaucugcaccuuccgcggcgacgucacacacaucuccggcagcagaaacuacaccaugaaccucgccucucaaaacuggaauagcuacgaccccaccgaagaaauaccagcuccccuuggaacucccgacuucgucggcaaaauccaaggcguccuaacccaaacaacacgaaccgacggcucuacccgcggccacaaagccacagucuacaccggcuccgccgacuuuucccccaaacucggccgaguccaauuugccaccgauacugacaacgacuucguaaccaaccaaaacacaaaauucacgcccgugggcguaauccaagaugggucaaccacuccccgcaacgaaccccaacaauggguacuacccuccuacucaggucgcaacacccauaacguacaccuagccccagccgucgcacccaccuucccgggcgaacaacuauuauucuuccguuccaccaugccaggcugcucaggcuaccccaacauggaccuagacugcuuacuuccccaagaauggguccaauacuucuaccaagaagccgccccugcccaaucugacgucgcccuacuacgcuucguaaaccccgacaccggccgaguacuauucgaaugcaagcuacacaaauccggauacguaacaguagcccacaccggccaacacgaccugguaaucccacccaacggcuacuuccgcuucgacucaugggucaaccaauucuacacacucgccccaaugggcaacggcaccggccgcaaacgcgcacucuaa

SEQ ID NO: 36034 - RNA, 1623 nt, Artificial Sequence
  derived and/or modified sequence opt11 from VP1__Norovirus__AGS08138
augaaaauggccucauccgaugcuaaucccucagacggcuccaccgccaaccucgucccagaagucaacaacgaagucauggcccucgagcccguagucggagcagcaauagccgcaccagucgcaggccaacaaaacgucaucgacccauggauccgaaacaacuucguccaagcacccggcggagaauuuaccguaucaccccgcaacgccccaggcgagauccucuggucagcaccccucggccccgaccucaaccccuaccucucacaccuagccagaauguacaacggcuacgcaggcggcuucgagguccaagucauccucgccggcaacgccuucaccgccggaaaaaucaucuucgcggccgucccacccaacuuccccacugaaggucucucccccucccaaguuacaauguuuccgcacaucaucgucgacguacgccaacucgaacccguacucauuccccuccccgacguccgcaacaacuucuaccacuacaaccaauccaacgacucaacaauaaaacucauagccaugcucuacaccccauuacgagcuaacaacgcaggcgacgacgucuucaccguauccugccgcguccugacccgcccuuccccugacuucgacuuuaucuuccucgucccaccaaccgucgaaucccgcaccaaaccauuuuccguccccguccuaaccgucgaagaaaugaccaacucucgcuuccccaucccccuagaaaaacuauucacaggcccuuccuccgcauucguaguccagccccaaaacggccgcugcaccaccgaugguguacuccucggaaccacccaacuuuccccagucaacaucugcaccuuccgaggcgacguaacccauaucccaggcucucgcaauuacaccaugaaccucgccucgcaaaacuggaacucuuaugaccccaccgaagagauccccgcaccgcucgguacucccgauuucgucggcaaaauacaaggcguccuaacccaaaccaccagaaccaauggauccacacgcggccauaaagccacaguauauacaggcucagccgacuuuucacccaagcucggccgcguccaauucgccacagacaccgacaacgacuucgaaacuaaccaaaacacuaaguucacacccguaggcguaauccaggauggaagcaccacaccccgcaacgaaccccaacaauggguacuacccucauauucuggacgaaacacucacaacguccaccuagcacccgccgucgcccccaccuuccccggcgaacaacuacucuucuuccgcuccaccaugcccgguugcuccggcuauccaaauauggaccucgauugccuccuuccccaagaguggguucaauauuucuaccaagaagcagcccccgcucaauccgacguagcccuacuccgcuucgucaaccccgacacaggccgcguccuuuucgaaugcaaacuacacaaauccggcuaugucacagucgcucacaccggacagcacgaccucgucauaccacccaacggcuacuuccgcuucgacuccugggucaaccaauucuacacccucgcacccaugggcaacggcaccggcaggcgccgagcccucuaa

SEQ ID NO: 36035 - RNA, 1623 nt, Artificial Sequence
  derived and/or modified sequence opt11 from VP1__Norovirus__AGS08139
augaagauggccucaucagacgccaacccauccgacggcuccgcagccaaccuuguucccgaaguaaacaacgaagucauggcccuugaacccguaguaggcgccgccauagccgcacccgucgccggccaacaaaacguuauagaucccuggauacguaacaacuucguccaagcccccggcggagaauuuaccgucagcccccgaaacgcccccggcgaaauccuuugguccgccccacugggccccgaccuaaaccccuaccucucccaccucgcacgcauguacaacggauacgccgguggauucgaaguucaagucauacuagcaggaaacgcuuucacagccggcaaagucaucuucgcagccguaccacccaacuuccccaccgaaggccucuccccaucccaagucacaauguucccacacaucgucgucgacguucgccaacucgaacccguccucaucccacuaccagacguccgcaacaacuucuaccacuacaaccaaucaaacgacucaaccaucaaacuaaucgccaugcuguacacuccacuaagagccaacaacgccggcgacgacgucuucacaguaucaugucgcguccucacccgccccucacccgacuucgauuucauauuccucguuccacccaccguagaaucucgcacaaaacccuucuccgucccaguccucaccgucgaagaaaugacuaacucacgauucccaaucccucucgaaaaacucuucaccggacccuccuccgccuucgucguacaaccacaaaacggacgcugcaccacagacgguguucuccucggaaccacacaacucagcccagucaacaucugcacauuccgaggagacguaacccacaucaccggcucccgaaacuacaccaugaaccucgccucccaaaacuggaacaacuacgacccaacagaagaaauccccgcaccccuaggcacacccgacuucgucggaaaaauacaaggcaugcucacccaaaccacccguaccgacgggucaacacgaggccacaaagccaccgucuacaccggcuccgcugacuucgcucccaaacuaggacgcguacaauucgaaacagacaccgaccacgacuucgaagcuaaccaaaacacuaaauucacucccgucggcgucauccaagacggauccaccacacaccgcaacgaaccucaacaauggguccuccccuccuacucuggacgcaacacccacaacguccaccucgccccagccguagcacccaccuuccccggcgaacaacuccuguucuuccgcuccaccaugccagguugcuccggcuacccaaacauggaccuagacugccugcugccacaagaauggguccaauacuucuaucaagaagccgccccagcccaaucagacgucgcacuccuccgcuucgucaaccccgacaccggaagaguccuauucgaaugcaaacuccacaaaucaggcuacgucaccguagcacacacaggccagcacgaccuugucauaccacccaauggauacuuccgauucgacuccuggguuaaccaauucuacaccuuagcuccaaugggcaacggcaccggccgccgucgagucgucuaa

SEQ ID NO: 36036 - RNA, 1623 nt, Artificial Sequence
  derived and/or modified sequence opt11 from VP1__Norovirus__AGS08140
augaaaauggcaucuucugacgccaaccccucugacgguuccgccgccaaccucguccccgaaguuaacaaugaagucauggcccucgaaccaguaguaggcgcagccauugccgcccccgucgccggacaacaaaaugucaucgauccguggauccguaacaacuucguccaagcccccggcggagaauuuacaguaucuccccgcaacgcaccuggagaaauccucugguccgcuccccucggccccgaccucaaccccuaccucucccacuuagcccgcauguauaacgguuacgccggcgguuucgaaguccaaguaauacuagccggcaacgccuucaccgccggcaaaaucauauucgccgccguacccccuaacuuccccaccgaaggucucucccccucccaagucaccauguucccccacaucauaguagacguucgccaacucgaacccguacugauuccccuucccgacguccguaacaacuucuaccauuacaaccaauccaacgacuccaccaucaaacuuaucgccaugcuuuauaccccgcuacgugcaaacaacgcaggagaugacgucuucaccguaucaugccgcguccucacccgcccauccccagacuucgacuucaucuuccucguacccccuaccgucgaaucccgcacuaaacccuucuccgucccaguacuaaccgucgaagaaaugaccaacucccgcuucccaauacccuuagaaaaacucuucacaggccccucuuccgccuucgucguccaaccacaaaauggccgcugcacuaccgacggcguccuacucggcacaacacaacuaucacccgucaauauaugcaccuuccgcggcgacgugacccacauaaccggcucacgcaacuacacaaugaaccucgcaucccaaaacuggaauaacuacgaccccaccgaagaaaucccagccccacuaggcacccccgacuucgucggcaaaauacagggcauguuaacacaaaccacccguacagacggaucaacacgaggccacaaggcaaccgucuacaccggauccgccgacuucgcccccaaacuuggucgaguccaguucgaaaccgacaccgaccacgacuucgaagccaaccaaaacaccaaauucacccccgucggcgucauccaagacggcggaaccacacacagaaacgaaccccaacaauggguccuacccucauacuccggccguaacacucacaacguucaccuagcccccgccgucgccccaaccuucccaggcgaacaacuccucuucuuccgcuccaccaugcccggaugcuccggcuaucccaacauggaccuagacugccuacucccccaagaauggguccaauacuuuuaccaagaagcagcucccgcacaaucugacgucgcucuccugcgcuucgucaaccccgacacuggacgcguccuuuucgaaugcaaacuccacaaauccggcuacgugaccgucgcacacacaggccaacacgaccucguaauuccgcccaacggcuacuuccgauucgacuccuggguaaaccaauucuacacccucgcccccaugggaaacggaacaggucgccgacgaguaguuuaa

SEQ ID NO: 36037 - RNA, 1623 nt, Artificial Sequence
  derived and/or modified sequence opt11 from VP1__Norovirus__AGS08141
augaaaauggcauccucugacgccaacccauccgacggaucggcagccaaccucgucccagaagucaacaacgaggucauggcccuagaacccgucgucggcgcagccaucgccgcucccgucgccggacaacagaacgucaucgaccccuggaucagaaacaacuucguacaagccccuggcggugaauuuacaguuagcccccgcaaugcucccggcgaaauccuaugguccgcaccccucggaccugaccuuaacccauaccucucccaccuagcccgcauguacaacggcuacgcaggcggcuucgaaguacaagucauccucgcagguaacgcauucaccgccggcaaaguaauauucgccgccgucccacccaacuucccaaccgaaggccucucaccaucccaaguaaccauguucccccacaucgucguagacguccgccaacuagaaccaguacucaucccccuacccgacguccgaaacaacuucuaccacuacaaccaauccaacgacccaaccaucaaacuuaucgccaugcuauacacaccccuacgcgccaacaacgcaggcgacgaugucuucaccguuucuugcagaguucucacccgaccaagcccagacuucgacuucaucuuccucgucccacccacaguagaaucgcgaacgaagcccuucuccguccccguccuuaccgucgaagaaaugaccaacucacguuuccccaucccacuagaaaaacucuucaccggccccucaucugccuucguaguucaaccacaaaacggacgcugcacgacugacggcguccuacuaggcacuacacaacucucaccaguaaacauaugcacauuccgcggcgacgucacacacaucaccggcucacgcaacuacaccaugaacuuagcaucccaaaacuggaacaacuaugaccccaccgaagaaauccccgccccacuaggcgcaccggacuucgucggcaaaauccaaggcaugcuaacccaaaccacccgaaccgauggcucuacacgcggccacaaagcuaccgucuacaccggcuccgcagacuucgcucccaaacucggucgcguccaauucgaaaccgacaccgaccacgacuucgaagccaaucaaaauaccaaauucacacccgucggcguaauccaagacggcuccaccacucaccguaacgaaccacaacaauggguucuacccagcuacucaggccgaaacacacacaacguacaucucgcccccgcaguugcccccaccuuccccggugaacaacuacucuucuuccgcucuacuaugccaggcugcuccggauaccccaacauggaccuagacugccuccucccucaagaauggguccaauacuuuuaccaagaagccgcccccgcccaaucggacgucgcccuacuccgcuucgucaauccugacaccggccgcguccuuuucgaaugcaaacuacacaaaucagguuacguaaccgucgcucacacaggacagcacgaccuugucauucccccaaacggcuacuuccgauucgauuccuggguaaaccaauucuacacacucgccccuaugggcaaugguacaggcagacgccgcguagucuaa

SEQ ID NO: 36038 - RNA, 1623 nt, Artificial Sequence
  derived and/or modified sequence opt11 from VP1__Norovirus__AGS08142
augaaaauggcauccucugacgcaaaccccucagacggcuccgcagccaaccucgucccugaagucaacaacgaagucauggcuuuagaaccaguaguaggagccgcaaucgccgcaccugucgcuggccaacaaaacgucaucgaccccuggauccgaaacaacuucguccaggcuccaggcggcgaauuuaccguauccccacgcaaugcccccggcgaaauacucugguccgcaccccucggucccgaccuaaaucccuaucucucucaccuagcccgaauguacaacgguuacgcaggcggcuucgaaguccaggucauucuagccggcaacgccuucacagccggaaaaguuauauucgccgcaguaccucccaacuuccccacagaagggcucagccccucacaagucaccauguucccccacaucgucgucgacguucgccaacuagaacccguacucauaccacucccagacguccgaaacaacuucuaccauuacaaccagagcaacgaccccacuaucaaacuaaucgccaugcuuuacaccccacuacgugccaacaacgccggagacgaugucuucaccguauccugcagaguccuaacacgacccuccccagacuucgacuucaucuuccucguacccccaaccgucgaaucacgcgcaaaacccuucucuguccccguccucaccgucgaagaaaugacaaacucgcguuuccccaucccacuagaaaaacucuucacuggcccgucauccgcauucgucguacaaccccaaaacggccgcugcaccacagacggcguccuccuaggcacaacccaacucucccccgucaauauaugcaccuuccgaggagacgucacacacaucacuggaagccgcaacuacaccaugaaccucgcaucccaaaacuggucaaauuacgaccccacugaggaaauacccgccccucuaggcacucccgacuucgucggcaaaauccaaggcguccucacccaaacuacccgaaccgacgguuccacccgcggacacaaagccaccgucuacacuggcuccgccgacuucgccccaaaacucggucguguccaauuugaaacugacacugaccacgacuucgaagccaaccaaaacaccaaauucacccccguaggcgucauucaagacggcuccacaacccauagaaacgaaccacaacaguggguacucccaucauauucaggccgcaacacccccaacguccaccucgccccagccguagcucccacguuccccggcgaacaacuccucuucuuccgauccaccaugcccggcugcagcgguuaccccaacauggaccuagauugucuccucccccaagaauggguccaauauuucuaucaagaagccgccccggcacaaucagacgucgcccuccuccgauucguaaaccccgauacuggacgcgugcuuuucgaaugcaaacuacauaaauccggauacgucacaguugcccacaccggacaacacgaccuagucauaccacccaacggcuacuuccguuucgacuccugggucaaccaauucuacaccuuagcaccaaugggaaacggcacaggucgccgcagagcccccuaa

SEQ ID NO: 36039 - RNA, 1623 nt, Artificial Sequence
  derived and/or modified sequence opt11 from VP1__Norovirus__AGS08143
augaaaauggccucaucagacgcuaaccccuccgacggcuccaccgcaaaucuaguucccgaagucaacaacgaagucauggcccucgaaccaguugucggagccgccaucgcagcacccgucgccggccagcaaaacgucaucgacccauggauccgaaacaacuucguccaagcaccaggcggcgaguucacaguaucaccccgcaacgcccccggagaaauucucugguccgcaccccucggccccgaccucaacccuuaccucagccaccucgcacgaauguacaacggauacgcaggcggauucgaaguccaagucauccuugccggcaacgccuucacagccggcaaaauaauuuucgccgcugucccaccaaacuuccccaccgaaggccucucacccucccaagucaccauguucccacacaucauaguagacguccgacaacucgaaccuguacuaauaccccuaccagacguccgaaacaacuucuaccacuacaaccaauccaacgacuccaccaucaaacuaaucgccaugcuauacacaccccuccgcgcuaacaacgcaggcgaugaugucuucaccguuaguugccgaguacucacccgucccuccccagacuucgacuuuaucuuccucguucccccaaccgucgaaucccgaacaaaaccauucucaguccccguccucacagucgaagaaaugaccaacucacguuuccccauaccccuagaaaaacuguucaccggccccuccucugccuucgucguccaaccccaaaacggucguugcaccacagauggaguacuccucggaaccacccaacuaucccccguuaauaucugcaccuuccgaggcgacgucacacacauccccgguagucgaaauuacacaaugaaccucgcaagccaaaacuggaacagcuacgaccccaccgaagaaauacccgcaccccuuggcacacccgacuucgucgguaaaauccaaggcguacucacccaaacuacgagaaccaacggcucaacccgcggccacaaggccaccgucuacaccggaagcgccgauuucucccccaaacuaggccgaguccaauucgccacugacaccgacaacgacuucgaaaccaaucaaaacaccaaauucacacccgucggcguuauacaagacggcuccaccacaccccgaaacgaaccacaacaauggguccuccccuccuacuccggucguaacauccauaacguccaccucgcccccgccgucgccccuaccuuccccggagaacaacuacuguucuuucgcucaaccaugcccgguuguuccggcuaccccaauauggaccucgacugccuccucccccaagaauggguccaauacuucuaccaagaagcugcccccgcccaaucugaugucgcccuucuccgguucguaaacccagacaccggccgcguccuauucgagugcaagcuccacaaauccggcuacguaaccgucgcccacaccggccaacacgaccucgucaucccacccaacggcuacuuccgcuucgauuccuggguaaaccaguucuacacacucgcccccaugggcaacggcacaggccgccgacgggcacuauaa

SEQ ID NO: 36040 - RNA, 1623 nt, Artificial Sequence
  derived and/or modified sequence opt11 from VP1__Norovirus__AGS08144
augaaaauggccucaucugacgccaaccccuccgacggcucaaccgccaaccucguacccgaaguaaacaacgaaguuauggcucuggaacccguaguaggagccgcaauagccgcccccgucgccggccagcaaaacguaauugaccccuggauccgaaacaacuucguccaagcccccggcggcgaguucaccgucucaccacgcaacgccccuggcgaaauccuuugguccgcaccccuaggccccgaucucaacccauaccucucccaucuagcccguauguacaacggcuacgccggcggauuugaaguacaaguuauccucgcaggcaacgccuucaccgcaggaaaaauaaucuucgcagcugugccaccaaacuuccccacagaaggccuuucaccaagccaagucaccauguucccgcacauuaucguagacguccgccaacucgaacccguccuaaucccccuucccgacguacgcaacaacuucuaccacuacaaccaaucaaacgaccccaccaucaaacuuaucgcaaugcucuacacaccccuucgcgcaaauaaugccggcgacgacguauuuaccgucuccugccgcguccucacccgucccucucccgacuucgacuucauuuuccuagucccacccaccgucgaaucucgcacaaaaccauucagcguccccguacuaacaguagaagaaaugacaaacucacgcuuccccaucccccuagaaaaauuauucaccggacccuccucagcauucgucguacaaccccaaaacggacgauguaccaccgacggcguccuacucgguacuacccaacuuuccccagucaacauaugcaccuucagaggagacgucacccacaucccaggcucccgcaacuacaccaugaaccucgccucccaaaacuggaacuccuaugauccaaccgaagaaaucccagcaccccucggcacccccgauuucgucggcaaaauacaaggcguuuuaacacaaaccacacgcacaaacggcuccacccgcggucacaaagccaccgucuacaccggcucagccgauuucucacccaaacuaggcaggguacaauucgcaacagacacggacaaugacuucgaaaccaaccaaaacacaaaauucacaccaguaggcgucauacaagacggaucuaccacaccccgaaacgaaccucaacaguggguccuacccucauacucaggacgcaacauccacaacguccaccucgcacccgccgucgcaccgaccuuuccaggcgaacaacuccuuuucuuccguuccaccaugcccggcugcaguggcuaccccaacauggaccuugacugccuccuaccccaagaauggguccaguacuucuaccaagaagcagccccugcacaaucagacgucgcacuccuacgcuucguaaaccccgacaccggacgcguccucuucgaaugcaaacuacacaaacccgguuacguaaccgucgcccacacaggccaacacgaccucgucaucccacccaacggcuacuuccgcuucgacuccuggguuaaccaauucuacacccucgcacccauggguaacggcacaggccgacgccgagcucucuaa

SEQ ID NO: 36041 - RNA, 1623 nt, Artificial Sequence
  derived and/or modified sequence opt11 from VP1__Norovirus__AGS08145
augaaaauggcauccuccgacgccaaccccuccgacggcucuaccgccaacuuaguccccgaagucaacaacgaagucauggcacucgaaccuguagucggcgccgcuaucgccgccccugucgccggccaacaaaacgucaucgacccauggauccgcaacaacuucguccaagcccccggcggugaguucacgguuucuccacgaaacgcccccggcgaaauccuaugguccgcaccgcucggccccgaccucaaccccuaccuaucccaccucgcucgcauguacaacggauaugccggcggcuucgaaguccaaguaauccuagccggcaacgccuuuaccgccggcaaaaucaucuucgccgcaguaccacccaacuucccaaccgaaggccucucacccucccaagucaccauguucccccauaucaucguagauguccgccaacucgaacccgucuuaauaccuuugcccgacguacgcaacaacuuuuaccauuacaaucaaucuaacgacuccacaaucaaacucauugcaaugcucuacacuccccuccgugcuaacaacgcaggagacgacgucuucaccgucuccugccgcguacucacccguccaucacccgacuuugacuuuaucuuccucgucccacccaccgucgaaucccgcacuaaaccauuuuccguccccauccucaccgucgaagaaaugaccaacucacguuuccccaucccccuagaaaaacuauucaccggcccaucaagcgccuucgucguccaaccccagaacggacgcugcacuaccgacggaguccuucucgguaccacacaacucucccccgucaauaucugcacuuucagaggcgacguaacacacauccccggcucacacaacuacaccaugaaccuagcaucccaaaacuggaacuccuacgacccaaccgaagaaaccccagcuccucucggcacccccgacuucgucgguaaaauacaaggcguccucacccagaccaccuccacaaacggcucuacccgcggacacaaggcaacuguauacaccggcucagcugacuucucccccaagcuaggcaggguccaauucgccaccgacaccaacaacgauuuugaaaccaaccaaaauaccaaauucacuccaguaggcgucauacaagacggcucaaccacaccccgaaacgaaccccaacaauggguacuacccuccuauucaggccgcaacauccacaauguucaccuagcgcccgccgucgcccccaccuucccaggcgaacaacuacucuucuuccgcuccaccaugcccggcugcuccggauaccccaacauggaccucgacugccuccucccccaggaauggguucaauacuucuaccaagaagccgcccccgcacaaucagacgucgcccuccuacgauucgucaaccccgacaccggccguguacuauucgaaugcaaauuacacaaauccggcuacguuaccgucgcgcacaccggccaacacgaccucgucauacccccuaacgguuacuuccgcuucgauuccuggguaaaccaauucuacacccucgccccaaugggaaacggcacaggcagacgccgagcccuuuaa

SEQ ID NO: 36042 - RNA, 1623 nt, Artificial Sequence
  derived and/or modified sequence opt11 from VP1__Norovirus__AGS08146
augaaaauggccuccucagacgcacaccccuccgacggcucgacagcuaaccuaguccccgaagucaacaacgaaguuauggcccuugaacccgucgucggcgccgccaucgcagcccccgucgccggccaacaaaacguuaucgaucccuggauccgaaacaacuuuguccaagcccccggcggugaauuuaccgucuccccacgcaacgcccccggcgaaauccucuggucagccccacucggucccgaccucaacccuuaucuaucacacuuagcccgcauguacaacggcuacgcuggcggauucgaaguccaaguaauccuagccggaaacgccuucaccgccggcaaaauuaucuucgcagcagucccacccaacuuccccaccgaaggacucucucccucccaagucaccauguuuccccacauaaucgucgacguccgccagcucgaacccguccucaucccccucccggacguccgaaacaacuucuaccacuacaaccaauccaaugacccaaccaucaaacucaucgccaugcuauauacuccccuacgcgcaaacaacgccggggacgacgucuucaccguaucaugucgcguccucacccgccccucgccagacuucgacuucaucuuucuagucccucccacugucgaaucccgcacaaaaccuuucucuguccccguccucacuguagaggagaugacaaacucccgcuuccccaucccccuagagaaacuauucaccggcccauccuccgccuucguaguccaaccccaaaacggcagaugcacuacagacggaguacuccucggaaccacgcaacucagcccagucaacaucugcaccuuucgcggcgacgucacccacaucuccggcuccagaaacuacacaaugaaccuagcaucacaaaacuggaacuccuacgacccaacagaagagaucccagcaccccuugguacccccgacuucgucggcaaaauucaaggcguacuaacacaaacaacaagaaccgacggcuccacccgaggacacaaggccaccguauacacaggcucagccgacuucucaccaaaacucggccguguccaauuugccaccgacacagacaacgacuucguaaccaaccaaaauacaaaauucacucccgucggcgucauccaagacggguccacaacacccagaaaugagccacaacaauggguccuacccuccuacucaggcagaaacacccacaacguccaccucgcccccgccgucgccccuaccuucccuggcgaacaacuccuauucuuucgcuccaccaugcccggcugcucaggauacccaaacauggaucuugacugccuccucccccaagaauggguacaauacuucuaccaagaagccgcccccgcccaaucggacguugcacuccuccgcuucgugaaccccgacacaggacgaguucucuucgaaugcaaacuacauaaaagcggcuaugucaccgucgcccacaccggccaacacgaccucgucaucccacccaacggcuacuuccgauucgacuccugggucaaccaauucuacacauuagcacccaugggcaacggcaccggacgccgccgcgcacucuaa

SEQ ID NO: 36043 - RNA, 1623 nt, Artificial Sequence
  derived and/or modified sequence opt11 from VP1__Norovirus__AGS08147
augaaaauggcaucauccgacgccaacccauccgacggcucaaccgccaaccucguccccgaaguaaacaacgaagucauggcccuagaacccgucgucggugccgcaaucgccgccccagucgccggccaacaaaacguaaucgaccccuggauccgcaacaacuucguccaagcaccaggcggagaauuuaccguuucaccccgaaacgcacccggagaaauacucugguccgccccucucggaccagaccucaacccauaccucucucaccuagcucgcauguacaacggcuacgccggugguuucgaaguccaaguuauacucgcaggcaacgcauucacagcuggcaaaauaaucuucgccgccguacccccaaacuuccccaccgaaggccucucccccucccaagucacuauguucccccacaucauugucgacguacgccaacucgaaccaguccuaaucccccuacccgacguccgaaacaacuucuaccacuacaaccaaucaaaugaccccaccauuaaacugauagccaugcucuauacaccccuacgagccaacaacgccggcgacgacgucuuuaccguaucaugucgcguccuaacccgccccucccccgacuucgacuucaucuuccuagucccacccaccguggaaucacgcaccaaacccuucuccguccccguacuaaccgucgaagaaaugaccaauucacgauuccccauuccccuagaaaaacucuucaccggcccauccucagcuuucgucguccaaccacaaaacggucgauguaccaccgauggcguccuccuaggcacaacacaacuuucacccgucaacauaugcaccuuccguggcgacguaacccacaucccaggcucccgcaacuacacaaugaaccucgccucccaaaacuggaacucauacgaccccaccgaagaaauccccgcaccccucggcacacccgacuuugucggcaaaauccaaggaguccucacccagacaacccgaacaaacggcuccacacgcggccacaaagccaccgucuacaccggcagcgccgacuucuccccaaaauuaggccgcguucaauucgccaccgauacagacaacgacuucgaaaccaaccaaaacaccaaauucacccccgucggcguuauacaagacggcagcacgacuccccgaaacgagccccaacaauggguacuacccuccuacuccggucguaacauucacaacguacaccucgcaccagccgucgcacccaccuucccaggagaacaacugcuuuucuuccgaaguacaaugccugggugcuccgguuacccaaacauggaccucgacugucuacuaccacaagaauggguccaauacuucuaccaagaagccgcccccgcccaauccgacguagcccuccuacgguucguaaacccagacaccggacgcguccuauucgaauguaaacuccacaaauccggcuacguaaccgucgcacacaccggccaacacgaccuuguaaucccacccaacggauacuuucgcuucgacuccugggucaaccaauucuacacccucgcacccaugggaaacggcaccggccgacgccgcgcacucuag

SEQ ID NO: 36044 - RNA, 1623 nt, Artificial Sequence
  derived and/or modified sequence opt11 from VP1__Norovirus__AGS08148
augaaaauggccuccuccgacgcaaacccaucagacggcuccacugccaaccucguucccgaagucaacaacgaagucauggccuuagagcccguugucggcgccgcaaucgcagcacccgucgccggucaacaaaacguaaucgacccauggauccgcaacaacuucguacaagcccccggcggcgaguucacagucucaccccgaaacgcccccggcgaaauccucugguccgccccacucggcccagaccucaaccccuaccucagccaccucgcccguauguauaacggcuacgccggcggcuucgaaguacaagucauccucgccggcaacgccuucacagccggcaaaaucauauucgcagccgucccacccaacuuccccaccgaaggucucucaccuagccaaguuaccauguucccccacaucaucgucgacguacgccaacucgaaccaguccucauaccccuaccagacguacgaaacaacuucuaccacuacaaccaaagcaacgacuccaccauaaaacucauagcaaugcuuuacacaccccuacgagcaaacaaugcuggagacgacgucuucaccguauccugccgcguccucacacgucccucccccgacuucgauuucaucuuccuuguaccacccaccgucgaaucucgaacaaaacccuucucuguacccauccuuacagucgaagaaaugaccaacucccgcuuccccauaccacucgaaaaacuauucaccggcccgucuuccgccuucguaguacaaccgcaaaacggacgcuguacaacagacggcguccuccuaggcacaacccaacuuucccccgucaacauaugcaccuuccgcggagacgucacccacauacccggcucucacaacuacaccaugaaccucgcuucucaaaacuggaacuccuaugacccaacagaagaaaucccagcuccccuagguacccccgacuucgucgguaaaauacagggcguccuaacacaaaccaccuccaccaacggcucaacacguggacacaaagccaccguauacaccggaucagccgacuucucccccaaacucggccguguccaauucgccacagacaccaacaacgacuucgaaaccaaucaaaacaccaaauucacccccguaggaguuauccaagacggcuccaccacaccccgcaacgaaccacaacaauggguacuccccuccuacucaggccguaacauccacaacguccaccuagcaccagccguggcccccaccuuuccaggagaacaacuccucuucuuccgcuccaccaugcccgguugcuccggcuaucccaacauggaccucgauugucuacucccacaagaauggguccaguacuucuaccaagaagcugcccccgcacaaucagacgucgcccuucuacgcuucgugaacccagacacuggccgaguccuguucgaaugcaaacuccacaaguccggcuacgugaccguagcucacaccggacagcacgaccucgucauaccacccaacggauacuuccgauucgacuccugggucaaccaauucuacacauuagcccccaugggaaacgguaccggacgccgccgagcccucuaa

SEQ ID NO: 36045 - RNA, 1623 nt, Artificial Sequence
  derived and/or modified sequence opt11 from VP1__Norovirus__AGS08149
augaaaauggcaucaucagacgccaacccaucugauggcuccacugcaaaucucguaccagaagucaacaacgaaguuauggcacucgaacccgucgucggcgcugccaucgcagcccccgucgcaggccaacaaaacguaaucgaccccuggaucagaaauaacuucguacaagcacccggcggcgaguucaccgucucaccccgcaacgcccccggcgaaauccucuggaacgcaccccucggccccgaccucaaucccuaucugagccaccucgcccgcauguacaauggcuacgcaggcggcuucgaaguacaaguaauccuggccggaaacgcauucaccgccggcaaaaucauauucgccgcggucccacccaacuuccccacagaaggacucucucccucucaagucacaauguucccccacaucaucguagacguccgccaacuagaacccguccucaucccccuacccgacguacguaacaacuucuaccacuacaaccaauccaacgaccccaccaucaaacucaucgccaugcuauacacaccccuccgagccaacaacgccggagacgacgucuucacugucuccugcagaguccuuacccgacccucccccgacuucgacuucauauuucucguacccccaaccgucgaaucacguaccaaaccguucucagucccaguccuuaccgucgaagaaaugacuaacucccgauucccaaucccccucgaaaaacucuucacaggccccagcucagcauucgucguccaaccccaaaaugguaagugcacaacugauggaguccuccuuggcacaacccaacucucacccguaaacaucugcacauuccgaggcgacgucacccacauccccggcucgcgcaacuacacuaugaaucuagccucucaaaacuggaacuccuacgaccccacugaagaaauacccgcaccccucggcacuccagacuucgucggcaaaauccaaggcguucucacccaaaccacccgaaccaacggauccacacgcggucacaaagccacagucuauaccggcagcgccgauuucucaccaaaacucggacguguccaauucgcaacagacacagacaacgacuucgaaaccaaccaaaacacuaaauucacaccagucggagucauacaagacggcucaaccacaccccgcaaugaaccccaacaauggguccuacccuccuacucaggacgcaacauccacaauguccaccucgcccccgccgucgcaccuacauuccccggagaacagcuucucuucuuccgauccaccaugccaggcugcuccggcuaccccaacauggaccuagacugccuacucccacaagaauggguccaauacuucuaccaagaagccgccccggcccaauccgacguagcacuacuccgcuuuguaaacccagacaccggccgcgucuuauucgaaugcaaacuacacaaauccggauacgucaccguagcucacacuggccaacacgacuuaguuauucccccaaacggguacuuccgcuuugacucuugggucaaccaauuuuacacacucgcacccaugggcaacggcaccggccgacgccgagcccucuaa

SEQ ID NO: 36046 - RNA, 1623 nt, Artificial Sequence
  derived and/or modified sequence opt11 from VP1__Norovirus__AGS08150
augaaaauggccuccucugacgcaaacccaucagacgguuccacagccaaucucguccccgaaguaaacaaugaagucauggcacucgaacccguuguuggugccgccaucgccgcacccgucgcaggccaacaaaauaucaucgaccccuggauacgcaacaacuuuguacaagcccccggaggagaguucacaguuagcccuagaaacgccccgggagaaauccucugguccgcuccccuuggucccgaccucaaccccuaccuaucgcaccuugcucgcauguacaacggcuacgccggcgguuucgaaguccaagucauacuagcaggcaacgccuucacugcagguaaaaucauauuugcagcaguuccaccaaacuucccuacagaaggucuaucccccucccaaguaacaauguucccccacaucauaguagacguccgccaacucgaaccaguacuaaucccccucccggacguccgcaacaacuucuaccacuauaaccagucuaaugacagcacaauaaaacucaucgccaugcucuacacccccuugcgagcuaacaacgccggagacgacgucuucacagucuccugccgcguccuaacacgcccuucucccgacuucgacuucaucuuccucgucccucccaccgucgaaagccguacaaaacccuucuccguucccguucucaccguagaagaaaugacaaacucccgcuuccccauccccuuagaaaaacucuucaccggccccuccuccgccuucgucguacaaccccaaaacggccgauguacaaccgacggaguacuccuuggcaccacccaacuuucccccgucaacaucuguacauucagaggcgacguaacccacaucuccggcucccgcaacuacacaaugaaccucgcaucccaaaacuggaacucauacgaccccaccgaagaaaucccagcaccccuaggcacccccgauuucgucgguaaaauucaaggcguccuaacacagaccacccgcacagacggaaguacccgcggacacaaagccaccgucuacaccggcagcgccgacuucuccccuaaacugggacgcguccaauucgccaccgacaccgacaacgacuucgucaccaaccaaaacaccaaauucacccccgucggagucauccaagacgguucaaccacuccccguaacgaaccacaacagugggucuuacccuccuacucuggccgcaacacccacaacguucaccucgccccugccguagcccccaccuucccuggcgaacaacuacuauucuuccgcuccaccaugcccggcuguucaggauaccccaacauggaucucgacugccuccucccccaagaauggguacaauacuuuuaccaagaagccgccccagcacaauccgacguagcccuucuacgcuucguaaaccccgacaccggacgaguccucuucgaauguaaacuacacaaauccggcuacgucaccguagcccacaccggccaacacgaccuagucaucccacccaacggcuacuuccguuucgacuccugggucaaccaauucuacacucucgcccccaugggaaacgguaccggucgccgccgagcccucuaa

SEQ ID NO: 36047 - RNA, 1623 nt, Artificial Sequence
  derived and/or modified sequence opt11 from VP1__Norovirus__AGS08152
augaaaauggccagcuccgacgccaaccccuccgacggcucagcagcaaaccucguccccgaagucaacaacgaagucauggcccucgaaccagucgucggcgccgccauagccgcccccgucgcaggccaacagaacgucaucgacccauggauccgcaacaacuucguccaagcccccggcggcgaguucaccguuuccccacgaaacgccccaggcgaaauccucuggucugcaccucucggccccgaccucaaccccuaucuaucccaucuugcccgaauguacaacggcuacgccggcggcuuugaaguccaaguaauccuagccggaaacgcauucaccgccggcaaaauuaucuucgccgcaguacccccaaacuuccccacagaaggccucucccccucccaagucaccauguucccacacaucaucgucgacguccgccaacucgaacccguccuaaucccccuaccugacguccgcaacaacuucuaucauuacaaccaauccaacgaccccacaaucaaacucauagcaaugcucuacacaccccuacgcgcaaacaacgcaggcgacgacgucuucaccgucuccugccgcguccucacccgccccuccccagacuucgacuucauauuucucgucccaccuacugucgaaucccgcacaaaacccuucucugucccaguccucacagucgaagaaaugaccaacucccgcuuccccguaccauuggaaaaacucuucaccggaccguccuccgccuucgucguccaaccccagaaugggcguuguaccacagacgguguccuccucggcacuacccaacucucucccguaaacaucugcaccuuccgaggcgauguaacacacauuaccggcucacauaacuacaccaugaaccucgccucacaaaacuggaacucauacgauccuaccgaagaaauucccgcaccccucggcaccccagacuuugucggcaaaauacaaggcguccucacccagacaacgcgcgccaacggcuccacccgcggacacaaagccacagucuacaccggcuccgccgacuucgcaccaaaacuaggccgcguacaauucgccacagacaccaacaacgacuuugacgccaaccaaaacacaaaauucacccccguuggcguuauccaagacggugacacagcacaccgcaaugaaccccaacaauggguacuaccauccuacuccggucgcaauucacauaacguucaccuagccccagccgucgccccaaccuucccaggcgaacaacuucuauucuuccgcucaacaaugcccggauguuccggauaccccaacauggaucuggacugccuccucccccaagaauggguccaauacuucuaucaggaggccgcucccgcacaguccgacgucgcccuccuacgauucgucaaccccgacaccggccgcguacucuucgaauguaaacuccacaaaucuggcuacguaaccgucgcccacacaggacaacaugaccucgucaucccucccaacggcuacuuccgauucgacucauggguaaaucaauucuacacccucgcacccaugggaaacggaacaggacgucgccgugcccuauag

SEQ ID NO: 36048 - RNA, 1623 nt, Artificial Sequence
  derived and/or modified sequence opt11 from VP1__Norovirus__AGS08153
augaaaauggcaaguucagacgccaaccccagcgacggcuccgccgcaaaccuuguacccgaagucaacaacgaagucauggcucuugaacccguaguaggugcagccaucgccgcacccgucgccggucaacaaaacguaaucgaccccuggauacgcaacaacuucguccaagcaccaggcggagaguucaccgucucaccccgcaacgcacccggcgaaauccuaugguccgcaccucucggccccgaccucaaccccuaccucucccaccuagcgcgcauguacaacggcuacgccggcggcuucgaaguacaggucauccucgccggcaacgccuuuaccgccggcaaaauaauauucgccgcaguacccccuaacuuccccaccgaaggacucucucccucccaagucaccauguucccacacauaauagucgacguacgccaacuagaaccaguucucauaccccuacccgacguccgcaacaacuucuaccacuacaaccaaucgaaugacccaaccaucaaacucauugcaaugcucuacaccccacuaagagcaaacaacgcuggagacgacgucuucaccguuucaugccgugucuuaacucgcccauccccggacuucgacuuuaucuuccucgucccucccacaguagaaucacgaacaaaacccuucuccguucccguccucaccgucgaagaaaugaccaauucacgcuuccccguaccccuugaaaaacuauucacgggccccucauccgcuuucgucguucaaccccaaaacggaagaugcaccaccgauggcguccuccuuggcaccacacaacucucccccgucaacauaugcaccuuccgcggcgacguaacccauaucaccggcagccacaacuacaccaugaaccuagccucccaaaacuggaacuccuacgacccaacagaagaaauccccgcaccccucggcacacccgauuucguaggcaaaauacaaggcguccugacacaaacaacucgcgccgacgggucaacucgaggccacaaagccaccgucuauaccggcuccgccgacuucgcccccaaacucggacgaguccaauucgccaccgacaccaacaacgacuucgacgcuaaccaaaacaccaaauucaccccagucggcgucauccaagacggcgacaccgcucaccgaaacgaaccucaacaauggguccuccccuccuacucagguagaaacucacacaacguucaccuagcuccugcugucgccccaacauuccccggcgaacaacuacuuuucuuucgcucuaccaugccaggcugcucaggcuaucccaacauggaccucgacugccuccucccccaagaauggguucaauacuucuaccaggaagccgcacccgcacaaagugaugucgcccuacuccgauucguaaaccccgacacgggcagaguccucuucgagugcaagcuacacaaaucaggcuacguaacagucgcucacaccggccaacacgaccuaguaauaccucccaauggcuacuuccgguuugacaguugggucaaccaauucuacacucucgcacccaugggcaacggaacaggccgccgccgcgccuuguga

SEQ ID NO: 36049 - RNA, 1623 nt, Artificial Sequence
  derived and/or modified sequence opt11 from VP1__Norovirus__AGS08154
augaaaauggccucaucagaugccaacccaagcgacggcuccgccgccaaccucguccccgaaguaaacaacgaagucauggcccuagaaccagucgucggggcggcaauagccgcaccagucgccggacaacaaaacgucauagacccauggauccgcaacaacuucguccaagcccccggcggagaguucacaguuuccccacgaaacgccccaggugaaauccucugguccgcaccccucggccccgaucuaaacccuuaccucucucaccucgcccgaauguauaacggauacgccggaggcuucgaagucgaagucauccucgccggcaacgcauucaccgccggcaagaucaucuucgccgcuguaccucccaacuuccccacagaaggccucucccccucacaagucacaauguucccacacauuaucguagacguacgccagcucgaacccguccuaaucccacuuccagacgugcgcaacaacuucuaccacuacaaccaaucaaaugacuccacaaucaaacuaaucgccaugcucuacaccccacuucgcgccaacaacgccggcgacgacgucuucaccguuucaugcagaguacucacccgacccucaccggacuucgacuucauauuccuaguaccacccaccguagaaucuagaaccaaacccuucucugucccgguccuaacaguagaagaaaugacaaacucacgcuuccccaucccacucgaaaaacucuucaccggacccuccuccgccuucgucguccaaccucaaaacggaagaugcacuaccgacggcguacuccugggcaccacccaacucuccccagucaacaucugcaccuucagaggggacgugacacacaucaccggguccagaaacuacaccaugaaccuagccagccaaaacuggaacaacuacgacccgaccgaagaaaucccagccccacucggcaccccugacuucgucgguaaaauacaaggaacccuaacccaaaccacccgcaccgacggcuccacacgaggccacaaagccacagucuacaccggcuccgcagacuucgcucccaaauuaggccgcguccaguucgaaaccgacacugaucacgacuucgaagccaaccaaaacaccaaauuuacucccgucggcgugauccaagauggcagcaccacccaccgaaacgaaccccaacaauggguccuacccucauauuccggacgaaacacccacaacguacaccucgcgccagccgucgcaccaacauuccccggcgaacaacuacucuucuuccguucuaccaugcccggcugcuccggcuaccccaacauggaccucgacugccuucucccccaagaauggguacaguacuucuaccaagaagccgcuccagcccaauccgacgucgcccuccuccgguucgucaaccccgacaccggccgcguccucuucgaaugcaaacuacacaaauccggauacguaacagucgcccacaccggacaacacgaccuggucaucccucccaacggguacuuccguuucgacucuugggucaaccaauucuacacccuagcacccaugggcaacggcacuggacgacgacgcgucgucuaa

SEQ ID NO: 36050 - RNA, 1623 nt, Artificial Sequence
  derived and/or modified sequence opt11 from VP1__Norovirus__AGS08157
augaaaauggcauccucagacgccaaccccuccgacggcuccgcagcaaaccuuguacccgaagucaacaacgaagugauggcucucgaacccguaguaggcgcugccaucgccgccccaguagccggccaacaaaacgucauagauccauggauucgcaacaacuucguccaggccccaggcggcgaguucaccguaucaccacgcaacgccccaggagaaauccuaugguccgcaccacucggaccagaccuaaaccccuaccucucacaucuagcccgcauguacaacgguuacgccggcggauuugaaguccaagucauucuagccgguaacgccuucaccgcaggcaaaguuaucuucgccgccguacccccuaacuucccaaccgaaggccucuccccaagccaagucacgauguucccccacaucgucgucgacgucagacaacucgaacccguccuaauaccacucccagacguccgaaacaacuuuuaccacuacaaucagucuaacgaccccaccaucaaacucauagccaugcuuuacaccccacucagagcaaacaacgccggcgacgacgucuucaccgucucaugucgaguccucacccgcccaucaccagauuucgacuucauauuccuagucccacccacagucgaaucaagaacaaaacccuucuccguccccguccucaccguagaggaaaugaccaacucacgcuuccccaucccccucgaaaaacuuuucaccggccccucauccgccuucgucguacaaccccaaaacggccgauguaccaccgauggcguacuccucggcaccacucaacuaucccccguaaacauuuguaccuuucgcggcgacgucacccacauaacaggcucccgcaacuacaccaugaaccucgcaagccaaaacuggagcaacuacgaccccaccgaggaaaucccugcuccccucggcacccccgacuucgucggaaaaauccaaggaguccucacccaaaccacacguaccgacggauccacucgcggucacaaagccaccguauacaccggcuccgccgacuucgcccccaaacuaggccgcguccaauucgaaacagacaccgaccgcgacuucgaagccaaccaaaacacaaaguucaccccaguaggagucauacaagacggcggcaccacccacagaaacgaaccacaacaauggguccuacccucuuacucagggagaaacaccccaaacguacaccucgcccccgcggucgccccaacguuccccggcgaacaacuccucuucuuccgcucaacuaugccuggcuguuccggcuaccccaacauggaccuugacugccuucuuccccaagaauggguccaauauuucuaccaagaagccgcaccagcccaauccgacgucgcccuccuccgauucguaaacccagacaccggccgaguccuauucgaaugcaaacuccacaaaagcggcuauguaacagucgcccacaccggucaacacgaccuagucauaccaccaaacggcuacuuccguuucgacucauggguaaaccaauuuuacacccucgcccccaugggaaauggaacuggucgccgccgagcacuauga

SEQ ID NO: 36051 - RNA, 1623 nt, Artificial Sequence
  derived and/or modified sequence opt11 from VP1__Norovirus__AGS08158
augaaaauggcauccuccgacgcuaacccauccgauggcucagccgcaaaccuaguacccgaaguaaacaacgaagucauggcacuugaacccgucgucggcgcagccauagccgcacccguagcaggacaacaaaacguaaucgacccauggauccgcaacaacuucguccaagccccaggcggcgaguucacagucuccccacgcaacgcccccggugaaauacucugguccgccccacuaggccccgaccucaauccuuaucugucgcaucuggcccgaauguacaacggcuaugccggcggcuucgaaguccaagucauccuagcuggcaacgcauucaccgcuggcaaagucaucuucgccgccgucccacccaacuuccccaccgaaggacucucccccucccaagucacgauguucccccacauugucguagauguccgccaacucgaacccguucucaucccccuucccgacguccgaaacaacuuuuaccacuacaaccaaucuaacgaccccaccauaaaacuaaucgccaugcucuacacaccccuaagggccaacaacgccggcgacgacgucuucaccguuucaugccgcguccucacccguccauccccagacuucgacuucaucuuccuaguacccccuacaguagaaucacgcacuaaacccuucuccguccccguccucaccguagaagaaaugaccaacucccgauuccccaucccccuagagaaacuauucaccggccccuccuccgccuucguuguccaaccacaaaacggccgaugcacuacagauggcguacuccuaggcaccacccaacuuucccccgucaauaucugcaccuuccgcggcgacgugacccacaucaccggaucaagaaacuauaccaugaaccuugcaucacaaaacuggaacaacuacgacccaaccgaagaaauaccugcaccccucggaacccccgacuucgucggaaagauacaaggcguccuaacccagaccacacgcacagauggcuccacacgaggccacaaagccaccguauacaccggcuccgccgacuucgccccaaaacuuggacgcguucaguucgaaaccgacacagaccacgauuucgaggcuaaccaaaacacuaaguucaccccagucggcgucauccaagacgggggcaccacacaucguaacgaaccccaacaauggguccuccccucauacuccggccgcaacacccacaacguccaccucgcccccgcagucgcacccaccuuucccggcgaacaacuuuuauucuuccgcucaaccaugcccggaugcuccggauacccgaacauggaccucgacugccuacucccccaagaauggguccaauacuucuaccaggaagcagcccccgcccaaagcgacgucgcccuccugcgauucguaaaccccgacacaggccgcguccucuucgagugcaaacuacacaaguccggcuacguuacagucgcacacaccggccaacacgaccucgucauuccuccaaacggcuacuuccgcuucgacuccuggguaaaccaauucuacacccucgcacccauggguaacggcacaggucgccgacgcguuaucuag

SEQ ID NO: 36052 - RNA, 1623 nt, Artificial Sequence
  derived and/or modified sequence opt11 from VP1__Norovirus__AGS08160
augaaaauggccuccuccgacgccaaccccuccgacggcuccgccgcuaacuuagucccagaaguuaacaacgaaguuauggcccucgaacccgucgucggagccgcaauagccgcacccgucgcuggccaacaaaacguuauagaucccuggauccgaaacaacuucguucaagccccaggcggagaguucaccgucuccccgcgcaacgccccaggcgaaauccuaugguccgccccacucggccccgacuuaaaccccuaccuuucccaucucgcgcgaauguacaacggcuacgccgggggcuuugaaguacaagucauacuagcaggcaacgcauucaccgcuggaaaagucaucuucgcagcaguacccccuaacuuccccaccgaaggccucuccccaucccaagucaccauguucccccacaucgucgucgacguccgacaauuagaacccguacucauuccccucccugacguccgcaacaacuucuaccacuacaaccaauccaacgaccccaccaucaaacucaucgccaugcucuacacaccccuacgcgccaacaacgccggcgaugacgucuucaccgucucaugcagaguccuaacccgccccucccccgacuucgacuuuaucuuucucgucccacccaccguagaaucccgaacaaaaccauucuccguccccguccucacagucgaagaaaugaccaacucacgcuuccccaucccccuagaaaaacucuucacaggaccauccuccgccuucguaguacaaccccaaaacggccgaugcacuacagacggcguccuccuaggcaccacucaacucucccccgucaacaucugcaccuuccgcggugacgucacccacaucacagguucccgcaacuauaccaugaaccucgccucacaaaacuggaacaacuacgacccaaccgaagaaauccccgcaccccucggcaccccagauuucgugggcaaaauacaaggcguccucacacaaacaacccgcaccgacggcucaacccgcggacacaaagccacagucuacaccggcucugccgacuucgcaccaaaacuuggccguguccaauucgaaaccgacaccgaccacgacuucgaagccaaucagaacaccaaauucaccccaguaggugucauacaagacggcggcaccacccaucgcaacgaaccccaacaauggguccuaccauccuacucuggccgcaauaccccaaacguacauuuagcgcccgccgucgccccaaccuuccccggcgaacaacuucucuucuucagauccaccaugccuggaugcuccggcuaucccaacauggaccucgacugccuacuaccucaggaauggguucaauacuucuaccaagaagccgcccccgcccaaucggacguagcccucuuacgauucguaaauccugacaccggccgcguacucuucgaaugcaagcuacacaaaagcggcuacguaaccgucgcacacacuggccaacacgaccuagucauacccccaaacggcuacuuccgcuucgacucuugggucaaucaauucuacacccuagcacccaugggcaacggcacaggcagacgacgagcacuauaa

SEQ ID NO: 36053 - RNA, 1623 nt, Artificial Sequence
  derived and/or modified sequence opt11 from VP1__Norovirus__AGS08161
augaaaauggccuccuccgacgccaaccccucagacggcuccgcagccaaccucguccccgaaguaaacaacgaaguaauggcacucgaacccguugucggcgccgccauagccgcccccgucgccggccaacaaaacguaaucgaccccuggauucgcaacaacuucguccaagcuccuggaggcgaguucacaguaucaccccgcaacgcacccggagaaauccuuugguccgcaccccucggcccggaucuaaaucccuaccuuucgcaccuagcucgcauguacaacggcuacgccggaggcuucgaaguacaaguaauucucgccggaaacgccuucaccgccggcaaaauaaucuucgccgccguucccccuaacuuccccacugaaggccuuucacccucccaagucaccauguucccccacauaaucgucgacguacgacaacuagaaccaguccucaucccccucccagauguccgaaacaacuuuuaccacuacaaccaauccaaugacuccacaauaaaacucauugcaaugcucuacacaccucuccgcgccaacaacgcuggcgacgauguauucacagucuccugccgcguccuaacucgccccucccccgacuucgacuucaucuuccucgucccacccacuguugaaucccgaacaaaacccuucucuguaccaguccuaaccgucgaagaaaugacgaacucccgcuuccccauaccccucgaaaaacucuucacaggaccaucuuccgcauucgucguccaaccccaaaacggcagaugcacaaccgacggaguccuacucggcaccacucaacugucgcccgucaacaucugcacuuuccgaggcgacgucacgcacaucacaggcucccgcaacuacacaaugaaccuagccucccaaaauuggaacaacuaugaccccaccgaggaaauacccgcaccccucggaacccccgacuucgucgguaaaauccaaggcaugcucacccaaaccacucggaccgacggauccacccgcggccacaaagcaacaguauacaccggcagcgcagacuucgcacccaagcucggccgcguucaauucgagaccgacacagaccacgacuucgaagcaaaccaaaacacuaaauucacccccguuggagucauccaagacggcuccacaacacaccgcaacgaaccacaacaauggguuuuaccaucauacucaggccgaaacacccacaacguccaccucgcccccgcaguagccccuaccuuccccggcgaacaacuccucuucuuccgcuccacaaugcccggcugcagcggauacccaaacauggaccucgacugucuccucccucaagaauggguccaauacuucuaccaagaagcagccccugcucaaucggacguagcucuacuacgcuucguaaaccccgacacaggacguguccucuucgaaugcaaacuacacaaaucuggcuacguaaccgucgcccauaccggccaacaugaccucgucauaccacccaacggcuacuucagauucgacuccuggguaaaccaguucuacacucucgcacccaugggaaacggcaccggccgccgccgcgcagucuaa

SEQ ID NO: 36054 - RNA, 1623 nt, Artificial Sequence
  derived and/or modified sequence opt11 from VP1__Norovirus__AGS08162
augaaaauggcauccucugacgcaaaccccagcgacgguuccgcagccaaccucguccccgaaguaaacaacgaaguuauggcccucgaacccgucgucggcgccgccaucgccgcccccguagccggccagcaaaacgucauugaccccuggauacgaaacaacuucguccaagccccaggcggagaguucaccgucucuccccgcaacgcccccggcgaaauccugugguccgcaccccucgggccagaccuaaaccccuaccuaucccaccuagcucguauguacaacggcuacgccggcggauucgaaguccaagucauccuagccggaaaugccuucacagccggcaaaauaauuuucgcagcaguacccccaaacuuccccacagaagggcuaucacccucacaagucacaauguucccacauaucaucgucgacgucagacaacucgaacccguccuaaucccccuaccagacguccgaaacaauuuuuaccacuacaaccagucaaacgacucaaccauuaaacuaaucgcaaugcucuacacaccccuacgggccaacaacgccggagacgaugucuucaccgucucuugccgaguacuaacccgcccaucccccgacuuugacuucaucuuccucguaccacccaccgucgaaucccgcaccaagcccuuuuccgugcccguccucacaguagaagaaaugaccaacagccguuuccccaucccacuugaaaagcuauuuacaggccccucaagcgcauucgucguccaaccccaaaacggccgauguaccaccgacggaguccuacucggcaccacccaacuuucccccguaaacaucuguacauuccgcggggacguaacucacauaacaggcuccagaaacuacacaaugaaccuugcaucacagaacuggaacaacuaugacccaacagaagaaauucccgccccacucgggaccccagacuucgucggaaaaauucaagguaugcucacccaaaccacccgcacagacggcuccacccgcggacacaaagccaccguauacaccggcucagcagacuucgccccaaaacuaggccgcguacaauucgaaacagacacagaccacgacuucgaagccaaccaaaacacaaaauucacaccugucggagucauccaagacggcuccaccacccaccgcaacgaaccucaacaaugggugcuacccuccuacagcggacgcaacacccacaacguccaccucgcacccgccgucgcaccaaccuuccccggcgaacagcuccuauucuuccgcuccacaaugccaggcugcucaggcuaucccaacauggaccucgacugccuacucccccaagaauggguacaauacuuuuaccaagaagccgcccccgcccaaucagacgucgcccuucuccgauucguaaacccugacacaggccgcguccucuucgaaugcaaacuacacaaauccggcuacgucaccguggcccacaccggccagcacgaucuuguuaucccacccaacggcuauuuccgcuucgacagcugggucaaccaauucuacacccucgcccccaugggcaacggcacaggacgccgccgagucguuuaa

SEQ ID NO: 36055 - RNA, 1623 nt, Artificial Sequence
  derived and/or modified sequence opt11 from VP1__Norovirus__AGS08163
augaaaauggccuccagcgacgccaaccccucagauggcucugcugccaaccucgucccagaagucaacaacgaagucauggcccuggaacccguaguaggcgccgcaaucgccgcucccgucgccggacaacaaaacgucauugacccuuggauucgcaacaacuucguccaagccccaggcggggaguucaccguauccccucgaaacgcucccggcgaaauccucugguccgccccucuaggcccagaccucaaccccuaccucucacaccucgcccgaauguacaacggauacgccggcggcuuugaaguccaaguaauccucgcuggaaacgccuucaccgccggcaaaaucauauucgccgcaguuccucccaauuuccccacagaaggccuaucccccucccaagucaccauguucccccacauaaucgucgacguacgccaacucgaacccguacucaucccccuccccgacguucgcaacaacuucuaccacuacaaccaauccaacgacuccacgaucaaacucaucgcaauguuauacacaccacuucgcgcaaacaacgcaggagacgacguauucaccgucucuugucguguccuuacacgcccauccccagacuucgacuucaucuuucuggucccacccaccguagaauccagaaccaaacccuucucaguacccguccuuacagucgaagaaaugacuaacagucgcuuccccaucccccuagaaaaacucuucaccggccccucauccgcauucgucguccagccccaaaacggccgaugcaccacagacggcguccuacuaggcaccacccaacucuccccggucaacauauguaccuuccgcggagacgugacacacauaacaggcucccgcaacuacaccaugaaccucgccucccaaaacuggaacaauuaugacccuacagaagaaauccccgcaccccucggcacuccagacuucgucggcaaaauccaaggcaugcucacacaaacaacgcguacugacgguucaacucgcggccacaaagccaccguuuacaccggcucagccgauuucgcccccaaacuaggccgaguccaauucgaaaccgacaccgaccacgacuucgaagcaaaccaaaacaccaaauucacccccgucggcgucauccaggacggcagcaccacacaccguaacgaaccccaacaauggguccuccccucuuauagcggccguaacacccauaacguacaccuagcuccagccguagcgccaaccuucccaggugaacaacuacucuucuucagaucaaccaugccgggaugcucaggauacccaaacauggaccuugacugccuacucccucaagaauggguccaauacuucuaccaagaagccgcccccgcccaaucagacguagcccuacuccgcuucgucaaucccgacacaggacgaguccuauucgaaugcaagcuacauaaauccggauacgucaccgucgcacacacaggccaacacgaccuagucauucccccaaacggcuacuuccgcuucgacuccuggguaaaccaauucuacacacucgcccccaugggcaauggcaccggacgccgccgcgucguauaa

SEQ ID NO: 36056 - RNA, 1623 nt, Artificial Sequence
  derived and/or modified sequence opt11 from VP1__Norovirus__AGS08164
augaaaauggcguccuccgacgccaauccauccgacggcuccgccgccaaccuagucccagaagugaacaacgaagucauggcauuagaaccagucguaggagccgccaucgccgcaccagucgccggccaacaaaacgucauagacccauggauccgcaacaacuucguccaagcaccaggcggcgaguucaccgucucaccccgcaacgccccuggcgaaauccucugguccgcaccccuuggacccgaccucaaucccuaccucucccaccucgcacgcauguacaacgguuacgccggcggcuuugaaguccaagucauacucgcaggaaacgcauucacugcuggaaaagucaucuucgccgcagucccacccaacuuccccaccgaaggccuaucccccucccaaguuacaauguucccucacaucgucguagacguccgacaacucgaacccguacucauaccccuacccgacguccgcaacaacuucuaccacuacaaccaaucaaacgaccccaccaucaaacuaauagccaugcuauauacaccccuacgagccaacaacgccggagacgacgucuuuaccgucuccugcagagucuuaacucgccccuccccagacuuugacuucaucuuucuagucccgcccacugucgaaucacguaccaaacccuucuccgugccaguccucaccguugaagaaaugaccaacucacgcuuccccaucccacucgaaaaacucuucacaggaccgucuucagccuucgucguccaaccucaaaacggucgaugcaccacggauggcguccuccucgguaccacccaacucuccccugucaacaucugcaccuucagaggugauguaacccacauaacagggucacgcaacuacaccaugaaucucgcaucacaaaacuggaacaacuacgacccaaccgaagaaauucccgcaccacuaggcacacccgacuucguaggcaaaauccaaggagucuuaacccagaccacccgcacagacggauccacccgcggccauaaggcuaccgucuacacaggcuccgcagacuucgcaccaaaacucggacgcguccaauucgaaacagacaccgaccacgacuucgaagccaaccaaaacacaaaauucacacccgucggaguaauccaagacggaggcacuacccaucgcaacgaaccccaacaauggguccucccauccuacuccggccgaaacacacacaauguucaccuagcccccgccguagcccccaccuuccccggcgaacagcuccuuuucuuccgcuccacuaugccaggcugcucaggcuaccccaacauggaccucgacugccuccuaccccaagaauggguccaauacuucuaccaagaagcagcuccagcccaauccgacguagcacuacuacgauucguaaauccagacaccggccgaguccucuucgaaugcaaacuacacaaauccggcuacgucacgguagcccacaccggucaacacgaccucguaaucccucccaacggcuacuuccguuucgacuccugggucaaccaauuuuacacucucgcccccaugggcaacggcaccggccgacgacgcgcagucuaa

SEQ ID NO: 36057 - RNA, 1623 nt, Artificial Sequence
  derived and/or modified sequence opt11 from VP1__Norovirus__AGS08165
augaaaauggcauccucagacgcaaaccccagcgacgguuccgccgcaaaccucguccccgaagucaacaacgaagucauggcacuagaacccgucgucggcgccgccauagccgcucccgucgccggacaacaaaacguaaucgaccccuggauccgcaacaacuuuguccaagccccaggcggagaguucacagucagcccccgcaacgcccccggcgaaauccucugguccgcuccccucggccccgaccucaacccauaccucucccaccuagcccgaauguacaacggcuacgcaggcggauuugaagucgaaguuauccucgcaggaaacgccuucaccgcuggaaaaauuaucuucgcagccgucccgcccaacuuccccaccgaaggccuaucccccucccaagucacaauguucccccauaucauagucgacguacgccaacuagaaccuguccucauaccccucccagacguacguaacaacuuuuaccacuacaaccaaucaaacgacucaaccaucaaacucaucgccaugcucuacacgccccuucgcgccaacaacgccggcgacgacgucuucaccgucucaugccgaguacuaacccgacccucaccagacuucgacuucaucuuccuaguacccccgaccgucgagucccgaaccaagccuuucucagucccaguccuuacagucgaagaaaugaccaacucucgauucccaauaccccuugaaaaacucuucaccggccccucuucugccuucgucguccaaccccaaaauggccgaugcaccaccgacggcguucuacuaggcaccacccaacucuccccagucaacaucugcaccuuucgaggcgacgucacccacaucaccggaucacgcaacuacacaaugaaccuagccucccaaaacuggaacaacuacgacccaacagaggaaauccccgccccgcuagguacccccgacuucgucggaaaaauccaaggcaugcuaacccaaacgacccgaaccgauggcucaacacgcggccacaaagcuaccgucuacacaggguccgcagacuucgccccaaaacuaggccguguccaauucgaaaccgacacagaccacgacuucgaagcaaaccaaaacacuaaauucacccccgucggaguaauccaggacggcuccaccacacaccgcaacgaaccccaacaguggguccuuccgucauacucaggccgcaauacacacaacguacaccuagcuccagcaguagccccaacuuucccaggcgaacaacucuuauucuuccguucaaccaugcccggcugcucaggcuaccccaacauggaccucgacugccuccuuccucaagaauggguucaauacuucuaccaagaagccgcacccgcucagucggacguagcccuccuccgcuucguaaacccagacacaggccgcguccucuucgaaugcaaacuacacaaauccggcuacguaacugucgcccacacaggccaacaugaccuaguaaucccaccaaacggcuacuuccgcuucgacucauggguaaaccaauucuacacacucgcacccaugggaaacggcaccggccgccgccgcguuguguga

SEQ ID NO: 36058 - RNA, 1623 nt, Artificial Sequence
  derived and/or modified sequence opt11 from VP1__Norovirus__AGS08166
augaaaauggcaagcucagacgccaaccccucugacggcucagccgcaaaccucguccccgaaguaaacaacgaagucauggcucucgaacccgucgucggcgccgccaucgccgccccuguagcgggccagcaaaacguuaucgaccccuggauacgcaacaacuucguccaggcccccggaggcgaguucacaguaucaccccgcaacgcaccuggcgaaauacucuggucugcaccccucggucccgaccucaaccccuaccucucccaccucgcccgaauguauaacggcuacgccggcggcuucgaaguccagguaauccucgccggcaacgccuucaccgcaggcaaaaucaucuucgcagccgucccaccaaacuuccccaccgaaggucuauccccuucucaaguaacaauguucccacauaucaucguagacguccgacaacuagaaccaguccuuaucccccuccccgacguacgcaacaacuucuaccacuacaaccaauccaacgacucaaccaucaaacucaucgccaugcucuacacaccccuccgcgccaacaacgccggagacgacguuuucaccgucuccugucgcguccuuacacgacccagcccagacuucgacuucaucuuucucguacccccaaccgucgaaucacgaaccaaaccauucuccguccccguacucaccguugaagaaaugaccaacucacgauucccuauacccuuagaaaaacucuucacgggccccucauccgccuucgucguccaaccccaaaauggucgaugcacuacagacggcguccugcucggaaccacccaacugagcccgguuaacauaugcaccuuccgcggagauguaacucacaucacuggaagcagaaacuacacaaugaaccucgccagccaaaauuggaacaacuacgacccaacagaagaaauccccgcaccccucggaacccccgacuucgucggcaagauucaaggcaugcucacccaaacaacccgaaccgacggcuccacccgcggccacaaagccacugucuacaccggcagcgccgacuucgcacccaaacucggccgaguccaauucgaaaccgauaccgaccacgauuucgaagcaaaucaaaacaccaaauucaccccagucggcgucauccaagacggcucaaccacccaccgcaacgaaccccaacaaugggugcuccccuccuauuccggcagaaacacccacaacguacaccuagcacccgccguagcccccaccuucccuggcgaacaacuccuuuucuucagauccaccaugcccgguugcucaggcuacccaaacauggaccucgauugcuuacucccacaagaauggguccaauacuucuaccaagaagcagcacccgcucaaucagacgucgcacucuuacgcuuugucaauccagacacuggccguguccucuucgagugcaaacugcacaaauccggauacguaaccgucgcccacaccggccaacacgaucuaguaauaccacccaacggauacuuucgcuucgacucauggguaaaucaauucuacacccucgcccccaugggcaacgguacuggacgccgacgcgucgucuaa

SEQ ID NO: 36059 - RNA, 1623 nt, Artificial Sequence
  derived and/or modified sequence opt11 from VP1__Norovirus__AGS08167
augaaaauggcauccuccgacgccaaccccagcgacggauccgccgcaaaccuaguccccgaagucaacaacgaagucauggcacuagaaccaguaguaggugccgcaaucgccgccccugucgccggccaacaaaacguaaucgaccccuggauccgaaacaacuuuguucaagcccccggcggagaguucacagucucucccagaaaugcccccggcgaaauacucuggucugccccacucggacccgaccuuaacccauaccuaucgcaccuagccagaauguacaacggauacgccggcggauucgaaguccaaguaauccuagccggaaacgccuucacagccggcaaaaucaucuuugccgccgucccacccaacuuccccaccgaaggccuaucccccucacaagucaccauguucccacacauaaucguagacguccgacaacuagaacccguacuaauccccuuaccagaugucagaaacaauuuuuaucacuacaaccaaucaaacgacuccaccaucaaacuuauugccaugcuauacaccccacuccgagccaacaacgccggggacgauguauucacagucucaugccgcguccuaacacgccccucgccggacuucgacuucaucuuccuagucccaccaaccgucgaaagcagaaccaaaccauucucuguucccguacucacuguugaagaaaugacaaacucccgauucccaaucccacuagaaaaacucuucacaggacccuccaacgccuucguaguccaaccacaaaacggacgauguaccaccgacggcguccuccucggcacaacccaacucuccccggucaacaucugcacauuccguggcgacgucacccacauaacaggcucacgcaacuacacuaugaaucuugcaucucaaaacuggaacaacuacgaccccaccgaggaaauaccggcgccccuaggaaccccagacuucgucggaaaaauccagggcaugcuaacccagacaacgcgcacagacggauccacccgcggccacaaagccaccguauacacaggcuccgccgacuucgcaccaaaacugggccgaguccaauucgaaacagacaccgaccacgacuucgaggcuaaccaaaacaccaaauucaccccaguaggcgucauacaagacggcuccaccacccaccgcaacgaaccccagcaauggguccuucccucauacuccggccgcaacacccacaacguccaccucgcccccgccgucgccccaaccuuccccggcgaacaacuacuauucuuccgcuccaccaugcccggcugcuccggcuacccaaauauggaucucgauugccuccucccccaagaauggguccaauacuucuaccaagaagccgcccccgcccaaucugacguagcacuucuccgauucguaaaccccgacaccggucggguacuauucgaaugcaaacuacacaaaucaggcuacgugaccguagcacacaccggccagcacgaccucgucauacccccaaauggcuacuuccgcuucgacucauggguaaaccaauucuacacacuggcacccaugggcaacggcaccggucgcagaagagucgucuaa

SEQ ID NO: 36060 - RNA, 1623 nt, Artificial Sequence
  derived and/or modified sequence opt11 from VP1__Norovirus__AGS08168
augaaaauggcauccucagacgccaacccaagcgacgguucagccgccaaccucgucccagaaguaaauaacgaaguaauggcccucgagcccgucgucggcgcagccaucgccgccccagucgcaggacaacagaacguaauagaccccuggauccguaacaauuuuguacaagcaccuggcggcgaguucaccgucucgccccgcaacgccccaggagaaauccuaugguccgcaccccuuggccccgaccuaaaccccuaucuaucccaucucgcacgcauguacaacggauacgccggcggcuucgaaguagaaguuauucucgccggcaacgccuucacagcuggcaaaauuaucuucgccgccguacccccaaacuuccccacagaaggccucuccccgucccaagucaccauguucccacacaucaucgucgacguccgacaacucgaaccaguccucauaccccucccagacguccgcaacaauuucuaccacuacaaccaaucuaacgacucaaccaucaaacucaucgcaaugcuauacacaccacuucgagcaaacaacgcaggcgacgacgucuucaccguaagcugccgcguacuuacacgcccuucccccgacuucgacuucaucuuccucgucccacccaccguggaaucccgcacaaaacccuucuccguccccguccuuacagucgaagaaaugaccaacucucguuucccaaucccccucgaaaaacuuuucacaggcccaucaucugccuucgucguccaaccccaaaacggacgaugcacaaccgacggcguccuccuaggcacaacccaacucucacccgucaacaucugcaccuuucgcggcgacgucacacacauaaccggcucccgcaacuauaccaugaaccucgcaucccaaaauuggaacaacuacgacccaacagaggaaauccccgcaccccuagguacccccgacuucguaggcaaaauacaaggcaugcuaacccagacuacacguaccgacggaagcaccagaggccacaaggccacuguauacaccggaucugcagacuucgccccaaaacuaggaagaguccaauucgaaaccgacaccgaccacgacuucgaagccaaucagaacaccaaauucaccccaguaggcguaauccaggacggauccacaacccaccgcaacgaaccgcaacaauggguccuacccagcuacucuggacgcaacacccacaacguucaccuagcccccgccguagccccaaccuucccaggcgaacagcuccucuucuuccgcucgacaaugcccggcugcucgggcuauccaaacauggaccucgacugccugcucccccaagaguggguccaauacuucuaccaagaagccgcccccgcccaaucagacguagcccuacuccgauucgucaaccccgacaccggcagaguccucuucgaauguaaacuacacaaauccggcuacgucaccgucgcacacaccggccaacacgacuuagucaucccacccaauggcuauuuccgcuucgauucaugggucaaccaauucuacacccucgcuccaaugggcaacggcacuggccgccgacgaguuguuuaa

SEQ ID NO: 36061 - RNA, 1623 nt, Artificial Sequence
  derived and/or modified sequence opt11 from VP1__Norovirus__AGS08169
augaaaauggcauccuccgacgccaacccguccgacggcucugcagccaaucucguucccgaagucaacaaugaagucauggcccucgaacccgucguuggagccgccaucgcagcacccgucgccggccaacaaaacguaaucgaccccuggaucagaaacaacuucguccaagccccgggaggcgaguucaccgucuccccacgcaacgcccccggugaaauacuaugguccgccccacuaggaccagaccucaaccccuaccugucgcaccucgcacgaauguacaacggcuacgccgguggcuucgaaguacaagucauccucgcaggcaacgcauucacugccggaaaaauaauuuucgccgccguacccccaaacuuccccacagaaggucucucgccaucccaggucaccauguucccacacaucauuguagacguacgacaacucgaacccguccuaauaccccucccagacauccgcaacaacuucuaccacuacaaccaaucaaacgauagcacaauaaaacucauagcaauguuauacacaccccuccgggccaauaacgccggcgaugacgucuucaccguaagcugccgcguccuuacccgacccucaccagacuucgacuuuaucuuccucguacccccgacagucgaaucccgaacaaaacccuucuccguccccguccucaccguagaagaaaugaccaacucacgcuuucccauccccuuagaaaaacucuuuaccggccccuccagcgccuucgucguacaaccccaaaacggacgaugcaccaccgauggcguucuccuugguaccacccaauuaucaccagucaacauuugcaccuuccgcggggacgucacacacaucacagguucacgcaacuacacaaugaaucucgccucccagaacuggaacaacuacgaccccaccgaagaaaucccagcaccccuaggaacccccgacuucgucggcaaaauccaaggcguccucacacaaacaacccgcacagacggcuccacacguggucacaaagccaccguauacaccgggagcgccgacuucgcccccaaacucggccgcguccaguucgaaaccgacaccgaccacgacuuugaagccaaccaaaacacaaaauucaccccggucggcguuauccaagauggcuccaccacccaccgcaacgaaccccagcaauggguccuucccucauacucaggucgcaauacccacaacguacaccuugccccugccguagcccccaccuuccccggcgaacaacuacucuucuuccgauccaccaugcccggcuguagcggcuaccccaacauggaccucgacugccuccucccccaggaauggguccaauacuucuaccaagaggccgcaccagcacaaucagauguugcccuucuccgcuucgucaaccccgacaccggucgcguccuauucgaauguaagcuacacaaauccggauacgucaccguugcucacacaggccaacacgaccuagucauacccccaaacggcuacuucagauuugauucaugggucaaccaauuuuacacccucgcccccaugggcaauggaacuggccgaagacgcguagucuaa

SEQ ID NO: 36062 - RNA, 1623 nt, Artificial Sequence
  derived and/or modified sequence opt11 from VP1__Norovirus__AGS08170
augaaaauggccuccuccgacgcaaaccccucugacggcucagccgccaaccucgucccugaagugaacaacgaagucauggcacuagaacccgucguaggcgccgccauugccgcccccgucgccggacaacagaacguaauagaccccuggauacgcaacaacuucguccaagcaccaggcggugaauuuacagucucaccgagaaacgcaccuggcgaaauacucugguccgcaccccuaggccccgaucucaaccccuaccucucacaucucgcccgaauguacaacggcuacgccggcggauucgaaguacaagucauccuagccggaaacgccuucaccgccggaaaaaucauauuugccgccgucccaccaaacuuucccaccgaaggccuuucccccucccaagucaccauguucccucacaucauagucgacguacgucaacucgaacccguucucaucccacuaccagacguccgcaacaacuucuaccacuacaaccaaucaaacgacucaaccaucaaacuaauagccaugcuauacacaccccuccgcgcaaacaacgccggcgacgacgucuucaccguuucgugccguguccucacccgcccuucaccagacuucgacuucaucuuccucguaccucccaccgucgagucucgcaccaaacccuucucuguccccguccucaccgucgaagaaaugaccaacucacgcuucccaauaccccucgagaaacuuuucacuggaccaucauccgcauucgucguccaaccacaaaacggacgcugcaccaccgauggaguccuccuaggcacaacacaacucucacccgucaacauuugcacuuuccgcggcgacgucacccacaucaccgguucccgcaacuacacaaugaaccuggcaucccaaaauuggaacaacuacgacccaaccgaagaaauacccgcaccccucggcacaccagacuucguaggcaaaauccaaggcaugcucacccaaaccacacgcaccgacggcuccacccgcggacacaaagccaccguauacacaggcagcgccgacuucgcccccaaacucggccgcguccaauucgaaaccgacacagaccacgacuucgaagccaaccaaaacaccaaauuuaccccagucggcgucauacaagacggcucaacuacacaccgaaacgaaccacaacaauggguccuccccucauacucgggacgcaauacccacaacguacaccucgcacccgccguggcccccacauuccccggcgaacaacuacucuucuucagguccaccaugccaggcugcuccggcuacccaaacauggaccucgacugccuccucccccaagaauggguccaauauuucuaccaagaagccgcccccgcacaaucugacguugcccuccuccgcuucgucaaccccgacaccggccgcguacucuucgaaugcaaacuacacaaauccggguacgucacagucgcccacaccggccaacacgaccucgucauaccacccaacgguuacuuccgauucgacucuuggguaaaccaauucuacacccucgcccccaugggcaacgggacaggccgucgccgcgucgucuaa

SEQ ID NO: 36063 - RNA, 1623 nt, Artificial Sequence
  derived and/or modified sequence opt11 from VP1__Norovirus__AGS08171
augaaaauggccucauccgacgcuaaccccagcgacggcucagccgccaaccucgucccagaagucaacaacgaagucauggcccuagaccccgucguaggagccgcaaucgcagcccccgucgcaggccaacaaaacgucaucgauccuuggauccgcaacaacuuuguccaagccccuggcggagaguucaccguuagcccucgcaacgcccccggagaaauccucugguccgcaccccuuggccccgaccucaaccccuaccucagccaucucgcccgaauguacaacgguuacgcaggcggauucgaaguacaagucauacuagcuggcaacgccuucaccgccggaaaaaucaucuucgccgcagucccacccaacuucccaaccgaaggccuaucgccaucucaagucaccauguucccccacaucaucgucgacguacgccaacucgaaccaguucuaaucccccuuccugacguacgcaacaacuucuaccacuacaaccaaucaaaugacucaaccaucaaacucauugcgaugcuuuacacuccacuccgcgccaacaacgccggcgacgacgucuucaccgucuccugccgaguccucacccgcccauccccagacuucgacuuuaucuuccuagucccucccaccguagaaucacguaccaagcccuucuccguccccguucucacugucgaagaaaugaccaacucccgauuucccauaccccucgaaaaacucuucacaggacccucuuccgccuucguaguacagccacaaaacggacgcugcacaacugacggaguccuccuaggaaccacacaacuaucccccgucaacauaugcaccuuccgcggagacguuacacacaucaccggcucucgcaacuacaccaugaaccucgccucccaaaauuggaauaacuacgaccccacagaagagauaccugccccacucggcacccccgauuucgucggcaaaauccaaggcaugcuaacccaaaccacgcguaccgauggaucaacacguggccacaaagcaacugucuacaccggcuccgcagacuucgcccccaaacucggccguguccaauucgaaaccgacaccgaccacgacuucgaagccaaccaaaacacaaaauucacaccugucggcguaauccaggacggcuccacuacccaccgcaacgaaccgcaacaauggguccuccccuccuacuccggccgcaacacccacaacguccaccucgcccccgccgucgcccccacauuccccggagaacaacuacuauucuuccgaucaaccaugcccggcuguuccggcuaccccaacauggaccuagacugccuccuaccacaagaauggguacaauacuuuuaccaagaggccgcccccgcccaauccgacgucgcccuccuccgcuucguaaaucccgacaccggcagaguccucuucgaaugcaaacugcauaaaucaggcuacgucacugucgcccacaccggccaacacgaccuaguaauacccccaaacggcuacuuccgcuucgauuccugggucaaccaauucuacacccucgcccccaugggcaacggaacuggacgccgccgcguuguauaa

SEQ ID NO: 36064 - RNA, 1623 nt, Artificial Sequence
  derived and/or modified sequence opt11 from VP1__Norovirus__AGS08172
augaaaauggccagcucagacgcaaaucccuccgacggcagugccgccaacuuaguccccgaagucaacaacgaaguaauggcguuagaacccgucguaggagccgccaucgccgccccagucgccggccaacaaaacgucaucgacccuuggauacgaaacaacuucguccaagccccaggcggugaguucaccgugucaccccgaaacgcccccggagaaauucuguggagcgcaccccuaggccccgaccucaacccauaccuuucccaccuagcccgaauguacaacggauacgccggaggcuucgagguccaaguaauccucgccggcaacgccuucaccgccggcaaaguaauauucgcagccgucccucccaacuucccaaccgagggccucuccccaucccaagucaccauguucccacacaucgucguagacguccgacaacucgaacccguccucaucccccuccccgauguuagaaacaacuucuaccacuacaaccaauccaacgaccccacaaucaaacucauagccaugcucuauacuccacuccgugcuaacaacgcaggagacgacguauucacugucuccugccgcguacucacucgcccaucacccgacuucgacuucauauuccuugucccacccaccguugaaucacguaccaaacccuucuccgucccuguacuuacaguugaagaaaugaccaacucucgcuuccccaucccacucgagaaacuauucaccggcccuucaagcgcauucgucguccaaccccagaacggccgcugcaccaccgacggcguauuacucggcaccacacagcuauccccagucaacaucugcaccuuccgaggcgacguaacccacauaacgggaucccgaaauuacacgaugaaccuagccucacaaaacuggaacaacuacgaucccacugaagaaauccccgccccacucggcaccccagacuucguuggcaaaauccaaggcguccuaacucaaacaacccgcaccgacggcuccacacgcggccacaaagccaccgucuacacuggaucagcugacuucgcaccuaaacuuggcagaguccaauucgaaaccgacaccgaccacgacuucgaagcaaaccaaaacacgaaauuuacacccguaggcguaauccaagacggcggcaccacucaccgaaaugaaccccaacaguggguacuccccuccuacuccggcagaaacacacacaacguccaccucgccccugccgucgcccccaccuuccccggcgaacaacuucuguucuuccgaucaaccaugcccggcugcuccggcuaccccaacauggaucucgacugccuccucccccaagaauggguacaauacuucuaccaagaagcagcccccgcccaaucagacgucgcucuacuucgcuucgucaaccccgacaccggccgcguccucuucgaaugcaaacuacacaaauccggauacguaaccguagcccacacaggccaacacgaccucgucaucccacccaacggauacuucagauucgacagcugggucaaccaauuuuacacccuagcccccaugggcaacgguaccggccgccgccgcgccgucuaa

SEQ ID NO: 36065 - RNA, 1623 nt, Artificial Sequence
  derived and/or modified sequence opt11 from VP1__Norovirus__AGS08173
augaaaauggcaucauccgacgccaacccuuccgacggcuccgccgccaaccucguccccgaggucaacaacgaagucauggcacuagagccagucgucggcgccgcaaucgcggccccaguagccggccaacaaaaugucauagaccccuggauuagaaacaauuucguccaagccccaggcggagaguucacugucucuccacgcaacgccccaggagaaauccucuggucugcaccccucggucccgaucucaaccccuaccuaucucaccuagcccguauguacaacggcuacgccggcggauuugaagucgaagucauccucgccggcaacgcauucacagcaggaaaaauaauuuucgccgccguuccacccaacuuccccacagaaggucucucacccucccaagucaccauguucccccacaucaucguagacguccggcagcuagaaccaguccuaauaccccuaccagacguaagaaacaacuucuaccacuacaaucaauccaacgacucaaccaucaaacuaauagcaaugcucuacacaccccuacgagccaauaacgccggugacgacgucuuuacagucucaugccgcguacucacccgacccucacccgacuucgacuucauuuuucuagucccucccaccgucgaaucccgcaccaaacccuucuccguccccguccucacagucgaagaaaugaccaacucacgauucccuauaccccucgaaaaacucuucaccggcccaagcucagcauucguaguccaaccccagaacggacggugcaccaccgacggaguacuacucggcaccacacaacuauccccaguaaacaucugcaccuucagaggcgacguaacccacaucaccggaucacgaaauuacacaaugaaccucgcaucccaaaacuggaacaacuacgaccccaccgaagaaaucccagccccacucgguaccccugacuucguugguaaaauacaaggaaugcuaacccaaaccacucgcacggauggaucaacucgcggccacaaagccaccgucuacacgggcuccgccgacuucgcccccaaacuuggccgcguccaauucgaaacagacaccgaucacgacuucgaagcaaaccagaacacaaaauucacacccgucggcgucauucaagacggcuccaccacacaccgcaacgaaccccaacaauggguccuccccagcuacuccggccgcaacacacacaacguccaccucgcaccagcagucgcccccaccuuccccggugaacaacuucuauucuuucgcucaaccaugcccggcugcucaggcuacccaaacauggaccucgacugucuacuuccccaagaauggguccaauacuuuuaccaggaagccgcccccgcccaaucagacgucgccuuacuccgcuucgucaaccccgacacaggccgaguccucuucgaaugcaaacuccacaaaagcggcuacgucacaguagcacacaccggacaacacgaccuaguaauaccacccaacggcuacuuccgauucgacuccuggguaaaccaguucuauacacucgcccccaugggcaacggcacgggccgccgccgcguaguauaa

SEQ ID NO: 36066 - RNA, 1623 nt, Artificial Sequence
  derived and/or modified sequence opt11 from VP1__Norovirus__AGS08174
augaaaauggccuccuccgacgccaaccccuccgacggcuccgcagcaaaccuagucccagaagucaacaacgaaguaauggcacuagaaccagucgucggugcagccauagcugccccuguagccggccaacaaaacguaauugaccccuggaucagaaacaacuucguccaggccccuggcggcgaguucacagucuccccucgaaacgcccccggcgaaauccuauggucagcuccccugggccccgaccuaaacccuuaccucucccaccucgcccgaauguacaacggcuacgccggcggcuucgaaguacaagucauccucgcaggcaacgccuucaccgccgggaaaaucaucuucgccgccgucccacccaacuuucccaccgaaggacuauccccaagccaaguaaccauguucccacacaucaucgucgacgugcgccaacuagaaccgguccuuaucccccuacccgauguccgcaauaauuucuaccacuacaaccagucaaacgacuccacuauaaaacucaucgcuaugcuauacacaccccuccgcgccaacaacgcuggugacgaugucuuuaccgucucaugccgcguccuaacccgaccaucccccgauuucgacuucaucuuccucgucccacccacagucgaaucccgcaccaaacccuucuccguccccguccuuacugucgaagaaaugaccaacucccgcuucccaaucccacucgaaaaacuauucaccggacccucguccgccuucguaguccaaccccaaaacggcagaugcaccaccgacggcguccuccucgguaccacacaacucucaccagucaacauuugcacuuuccgaggugacgucacacacauaaccggcucacgaaacuacaccaugaaucuagcaucccaaaauuggaacaacuacgaccccaccgaagaaauacccgcaccccucggcacaccugacuucgucgguaagauccaaggaaugcuaacccaaaccacacgcacagacggcuccacucgcggacauaaagcaaccguuuacaccggcuccgccgacuucgcacccaaacucggccgcguccaauucgaaaccgacaccgaccacgacuucgaagccaaccaaaacacuaaauucacgcccgucggagucauccaagacggcucaacaacccaccgcaacgaaccccaacaguggguccuccccucuuacagcggcagaaacacacacaacguccaccuugcccccgccguagcucccacauuccccggagaacagcuacuguucuuccgcucaaccaugccaggcugcuccggauaccccaacauggaccucgacugccuccucccccaagaauggguccaauacuuuuaccaggaagccgcaccagcccaaucagacguagcccuccucagauucguaaacccagacaccggccgcguucuguucgaauguaaauuacacaaaucaggcuacgucaccgucgcccacacuggccaacaugacuuagucaucccuccaaacggcuacuuccgcuucgacagcuggguuaaccaauucuacacacuagcaccaaugggaaacggcaccggacgcagaagagucgucuga

SEQ ID NO: 36067 - RNA, 1623 nt, Artificial Sequence
  derived and/or modified sequence opt11 from VP1__Norovirus__AGS08175
augaaaauggcauccuccgacgccaaccccucagacgguuccgcagccaaucucgucccggaaguaaacaaugaggucauggcccucgaacccgucgucggugcugccauagccgcucccgucgcaggucaacaaaacguaaucgacccauggauccgcaacaacuucguucaagcgcccggaggcgaguucaccgugucaccucgcaacgccccaggagaaauccucuggucagcaccccuaggcccugaucuaaaccccuaccucagccaccucgcccgaauguacaacggcuacgccggcggcuucgaaguccaagucauccucgccggcaacgccuuuaccgcuggcaaagucaucuuugccgccguuccacccaacuuccccaccgaaggccucucccccucccaaguaaccauguucccccacauagucguagacguccgacaacuugaacccguccucauaccccuccccgacguacgaaacaauuucuaccacuacaaccaauccaacgaccccaccauuaaacucauagccaugcuuuauacaccccuucgagcaaacaacgccggagacgauguauucaccgucuccugccgaguucuaacccgccccucccccgacuucgacuucaucuuccucgucccucccaccgucgaaucacgaaccaaacccuucuccgucccaguccuaaccguugaagaaaugaccaacucgcguuuccccauccccuuggaaaaacucuucaccggaccuuccuccgcauucgucguccaaccucaaaauggacgcuguaccaccgacggaguacuccucggaaccacccaacuuuccccugucaacaucuguacauuccgaggagacgucacccacaucaccggcucccgcaacuacaccaugaaccucgcaucucaaaauugguccaacuacgaccccaccgaagaaauccccgccccacucggcaccccagacuucguuggcaaaauccaaggaguccuaacucaaaccacccgaacagacggaucaacccgaggccacaaagcaacaguuuacaccggcuccgcagauuucgccccaaaacuuggccgaguccaauucgaaaccgacaccgaccacgacuucgaagccaaccaaaacaccaaauucaccccagucggaguaauccaagacggcucuacgacccaccgcaacgaaccccaacaauggguccucccauccuacuccggccgcaacaccccaaacguccaccucgccccagcaguugcacccacguuccccggcgaacagcuccuauucuuccgaucaacaaugcccggcugcucaggcuacccaaacauggaccucgacugccuauuaccccaagaauggguacaauacuucuaccaagaagccgcacccgcccaaucagacgucgcccuacuccgcuuugucaaccccgacacaggacgcguacucuuugaauguaaacuccacaaauccggcuacguuaccguagcccauacaggccaacacgaccucguaauaccacccaacggauacuuccgauuugacagcuggguuaaucaauucuacacccucgcccccaugggcaauggcaccggccgccgccgcgcccucuaa

SEQ ID NO: 36068 - RNA, 1623 nt, Artificial Sequence
  derived and/or modified sequence opt11 from VP1__Norovirus__AGS08176
augaaaauggccuccucagacgcuaaccccucugacggcuccgccgccaaccuaguccccgaagucaacaacgaggucauggcccucgaaccagucguaggcgcagccaucgccgcccccguugcaggccaacaaaacgucaucgaucccuggauacgcaacaacuucguacaagccccaggcggcgaguucaccgucucuccccgcaacgcacccggcgaaauauuaugguccgcaccccuaggacccgaccucaacccauaccucucccaccucgcccgcauguauaacggcuacgccggaggauucgaaguucagguaauccucgccggcaacgccuucaccgccggcaaaaucauauucgcagcagucccacccaauuuccccaccgagggccuaucccccucccaaguuacuauguucccucacauaauagucgacguccgccaacuagaaccgguucucaucccccucccagacguacgcaauaacuucuaccauuacaaccaaucaaacgacagcaccaucaaacugauugccaugcuuuacaccccacuacgagccaacaacgccggcgacgacgucuuuaccgucuccugccgcguacucacccgacccucacccgacuuugacuucauauuucuaguacccccaacagucgaauccagaacaaagccauucucagucccaguccuaaccguugaagaaaugaccaacucccgauuccccaucccccucgaaaaacucuucacaggccccuccucagccuucguaguacagccccaaaacggccgaugcaccaccgacggcguccuucucgguaccacccaacucucacccguaaacaucugcacauuccguggagacgucacccauaucacgggcucaagaaacuacaccaugaaccucgccucacaaaacuggaacaacuacgaccccaccgaagaaaucccagccccucucggcacccccgauuucgucggcaaaauccaaggcaugcuaacccaaacuacccgcacagacggaucaacccgaggccacaaagcgaccguauacacagguagcgccgacuucgcacccaaacucggcagaguacaauucgaaacagacacugaccacgacuucgaagccaaucagaacacgaaauucacccccgucggcgucauccaagacggauccaccacccaccgcaacgaaccccaacaauggguacuucccucauacagcggccgcaacacccauaacguccaccuagcacccgccgucgcccccacauuccccggcgaacaacuccuuuucuuccgauccaccaugccaggcugcuccggcuauccuaacauggaccuagacugucuccucccccaagaauggguccaauacuucuaccaagaagccgccccugcccaauccgacguugcccuacuacgcuucguaaacccagacacaggccguguccuguucgaaugcaaacuacacaaauccggcuacguaacagucgcacacaccggacaacacgaccucguuaucccucccaacggauacuuccgcuucgacuccugggugaaccaauucuacacacucgccccgaugggcaacggaacaggacgccgccguguagucuaa

SEQ ID NO: 36069 - RNA, 1623 nt, Artificial Sequence
  derived and/or modified sequence opt11 from VP1__Norovirus__AGS08177
augaaaauggccuccucugacgcaaaccccucagacggaucugcagccaacuuaguaccagaagucaacaacgaagucauggcacucgaacccgucgucggagccgccaucgccgcuccagucgccggacaacaaaacguaaucgaccccuggauccgcaacaacuuuguacaagcacccggcggcgaguucaccgucucaccccggaacgccccaggcgaaauccuaugguccgcaccccuaggccccgaccucaacccauaccuaucccacuuagccagaauguacaacgguuacgcuggcggcuucgaaguagaaguaauacucgcaggaaacgccuucaccgccggcaaaauuaucuucgcugccguaccacccaacuuucccaccgaaggccuaucccccucccaaguaaccauguucccccacaucaucgucgacguccgccaacucgaaccaguacucaucccacuacccgacguucgaaacaacuucuaccacuacaaccaauccaacgacuccaccaucaaacuaauagcaaugcuauacaccccacugcgcgccaacaacgccggagacgacguuuucaccgucucuugccgaguccucacccgccccucuccagacuucgacuucaucuuccucgucccucccacagucgaaucccgcaccaaacccuucucaguccccgucuuaaccguagaagaaaugaccaacucccgauuccccaucccccucgagaaacuauucaccggacccuccagcgccuucgucguacaaccacaaaacggaagaugcaccaccgauggcguccuccucggcaccacacaacuaucccccgucaacauaugcaccuucagaggcgacguaacccacaucaccggaucccgaaacuacacaaugaaccucgcuagccaaaacuggaacaauuacgauccuaccgaggaaaucccugcuccccucggcacccccgacuucguaggaaaaauccaaggcauguuaacucaaacaacacgaacagacggcuccacaagaggacacaaagccaccgucuacacuggcuccgccgacuuugccccaaaacucggacgaguccaguucgaaacagacaccgaccacgacuucgaggccaaccaaaauacuaaauucacgcccguaggcgucauccaagacggauccacaacacacagaaacgaaccgcaacaauggguccuccccuccuacuccggacgaaacacccacaacguccaucuagcaccagccgucgcccccacauucccuggcgaacaacuccucuucuuccgcucaaccaugcccggcugcucaggcuaccccaacauggaccuagacugccuccuaccccaagaauggguacaauacuucuaucaagaagccgcacccgcccaaucugaugucgcucuacuccgauucgucaaccccgacaccggacgcguauuauucgaaugcaaacuccacaaaucaggcuacgucaccguagcccacacaggccaacacgaucucgucaucccuccaaacggauacuuccgcuuugacuccuggguaaaccaauucuacacccuagcacccaugggaaacggaacaggccgccgccgcguaguauaa

SEQ ID NO: 36070 - RNA, 1623 nt, Artificial Sequence
  derived and/or modified sequence opt11 from VP1__Norovirus__AGS08178
augaaaauggcuucuuccgacgccaaccccuccgacggcagcgcagcuaaccucguccccgaagugaacaacgaaguaauggcucucgaacccgucguaggcgccgcaauagccgcuccagucgcaggacaacaaaacguaaucgacccauggauucgcaacaacuucguccaagcacccggcggagaauucacaguuuccccacgcaaugcccccggcgaaauacugugguccgccccacucggacccgaccucaaccccuaccucucccaccucgcccgcauguacaacggauacgccggcgguuucgaaguacaaguaauccucgccggcaacgccuucaccgccggaaaaaucaucuucgccgccgucccccccaacuuccccacagaaggacucucccccucucaagucacaauguucccacacaucaucgucgacguucgacaacuggaacccguccuaaucccccuacccgacguccgcaacaauuucuaccacuacaaccaauccaacgacuccaccaucaaacucaucgccaugcucuacacaccuuuacgcgcaaacaacgcuggagacgacgucuucaccgucuccugucgcguacuuacacgccccucccccgacuucgauuucaucuuccuugucccccccacagucgaaagccggacuaaacccuucucuguccccguacucaccguagaagaaaugacuaacucccgcuucccaauccccuuagaaaaacuauucaccggaccauccuccgcauucgugguccaaccccaaaacggccgcugcacgaccgacggaguccuccucggaacaacccaacucucccccguaaacaucugcaccuucagaggcgacgucacacacauuaccggaucccgcaauuacacaaugaaucucgcuucccagaacuggaacaacuacgacccaaccgaagaaauccccgccccacucgguaccccagacuucgucggaaaaauccaaggcaugcucacccaaaccacccgcaccgacggcuccacccggggccacaaagccacaguauacaccggcuccgccgacuucgcccccaaauuaggacgcguacaauucgaaacagacaccgaucaugacuucgaagcaaaccaaaacaccaaguucacuccggucggcgucauccaagacggcagcaccacccaccgcaacgaaccccagcaauggguccuaccuucuuauucaggcagaaacacacacaacguccaccucgcccccgccgucgcccccaccuucccuggcgaacagcuccuauucuuccgauccaccaugccagguugcuccggcuaccccaacauggaucucgacugccuccuaccacaagaauggguccaauacuucuaccaagaagcagcacccgcccaaucagacgucgcccuccuccgcuucguaaaccccgauacuggccgcguccucuucgaaugcaaacuccacaaaucaggauaugucaccguugcacacacaggacagcacgaccucguaauaccccccaacggauacuuccguuucgacuccugggucaaccaauucuacacccucgccccuaugggcaacggcacaggccgccgacgagucgucuaa

SEQ ID NO: 36071 - RNA, 1623 nt, Artificial Sequence
  derived and/or modified sequence opt11 from VP1__Norovirus__AGS08179
augaaaauggcaucuucagacgcaaaccccuccgacggcuccgccgcaaaccuagucccggaagugaacaaugaagucauggcccuugaacccgucgucggagccgcuauagccgcccccgucgccggucaacaaaacguaaucgacccuuggauccgcaacaacuucguccaagcacccggaggcgaauuuaccgucagccccagaaacgccccaggagaaauucuaugguccgcuccccucggccccgaucuuaaccccuaucucucacaccucgcccggauguacaacggcuaugccggagguuucgaaguucaagucauucuagcaggaaacgccuucaccgccggcaaaaucauauucgccgccguaccacccaacuuccccacugaaggccucucacccucacagguaaccauguucccccacauaauugucgacguacgccaacuagaacccguacucaucccccuccccgacguacguaacaacuucuaccacuauaaucaauccaacgacucaaccauuaagcugaucgcuaugcucuacacaccacuacgcgccaacaacgcaggggacgacgucuucaccguauccugccgaguccucacacgacccucuccggacuucgacuucaucuuccucguaccucccaccguugaaucccgaaccaaaccauucuccguccccguacucaccgucgaagaaaugacaaacucccgcuuuccaauaccccuggaaaaacucuuuacaggucccucauccgcauucgucguacagccacagaacggucgcugcacaaccgacggaguccuccuuggaaccacccaacuauccccagucaacaucugcaccuuucgcggagacguaacucacaucacuggaucccgcaacuacaccaugaaucucgccagucaaaacuggaauaacuacgaucccacugaagaaauaccagcaccccucggcacccccgauuuugucggaaaaauccaaggcaugcucacacaaaccacucgcaccgacggcucaacccgagggcacaaagcaacuguuuacaccggcucagcugacuucgcaccaaaacucggacgcguccaauucgaaaccgacaccgaucacgacuucgaagccaaccaaaacaccaaauuuacccccgucggcguaauccaagacggcuccaccacccaucgcaacgaaccucaacaauggguacucccauccuacucagggcgcaacacccacaacguccaccuagcacccgcagucgccccaacuuucccaggcgaacaacuccucuucuuccgcuccaccaugcccggcugcucuggcuacccaaacauggaccuugacugccuccuaccccaagaauggguccaauauuucuaucaagaagccgcccccgcccaauccgacgucgcuuuacuccgcuucgucaaccccgacaccggacguguccuuuucgaaugcaaacuacacaaauccggcuacgucaccgucgcccacacaggccaacacgaccucgucaucccucccaacggauacuuccgcuucgauuccugggucaaccaauucuacacacucgcccccaugggcaacggcacuggccgccgacgagucgucuaa

SEQ ID NO: 36072 - RNA, 1623 nt, Artificial Sequence
  derived and/or modified sequence opt11 from VP1__Norovirus__AGS08180
augaaaauggccuccucagacgccaacccaucugacggauccgccgcaaaccucguacccgaagucaacaacgaagucauggcccucgaaccaguagucggcgccgccaucgcugcccccgucgccggccaacagaauguaauagacccauggauccgcaacaauuucguacaagcgcccgggggcgaguucaccgucagcccccgcaacgccccuggcgaaauacuauggagcgcuccccucggacccgaccucaacccauaccuaucccaucuagccagaauguacaacggcuacgcaggcggcuucgaaguacagguaauccucgcaggaaacgccuucaccgcaggcaaaaucaucuucgccgccgucccucccaacuuccccaccgaaggccucucacccucacaaguuacuauguucccccacaucauagucgacguacgccagcucgaaccaguccugauaccacuucccgacguccgcaacaacuucuaucacuacaaccaaucaaacgacuccacgauuaaacucaucgcaauguuguacaccccacuacgcgccaacaacgccggcgacgacgucuucacuguuuccugccgcguacucacccgccccagccccgacuucgacuucauauuccuggugccacccacagucgaaucccgcaccaaacccuucucaguacccguacuuacaguagaagaaaugacaaauucacgauuccccaucccccuugaaaaacucuucacaggcccaucauccgccuucgucguccaaccccaaaacggccgcugcacaacagacggcguucuacuaggcaccacccaacucucaccuguaaauaucugcacauuccgcggcgaugucacacauaucaccggcucacgaaacuacaccaugaaccuagcaucccaaaacuggaacaauuacgaccccaccgaagagauccccgcaccccucgguacuccagacuucguaggcaaaauccagggaaugcucacccagacaacccguaccgacggcucaacccgaggccacaaagccacugucuacacaggaucagccgauuucgcacccaaacucggacgaguccaauucgaaacugacaccgaucacgacuucgaagccaaccagaacacaaaauucacaccaguaggcgucauccaggacggcucaacaacccaccgcaacgaaccccaacaauggguacuuccauccuauucuggccgcaacacacacaacguccaccucgcaccagccgucgccccaaccuuccccggcgaacaacuacucuuuuuccgaucaaccaugcccggcugcucuggcuaucccaacauggaccucgacugccuacucccccaagaauggguccaauacuucuaccaagaagccgcacccgcccaaucagacgucgcacuccuccgcuuuguaaacccugacacaggacgcguccucuucgaaugcaaacuccacaaaucagguuacgucaccguagcacauaccggccagcaugaccuagucauacccccaaauggcuacuuccgcuucgacuccugggucaaccaauucuacacccuagcgccaaugggcaacggaaccggacgcagacgaguagucuga

SEQ ID NO: 36073 - RNA, 1623 nt, Artificial Sequence
  derived and/or modified sequence opt11 from VP1__Norovirus__AGS08181
augaaaauggccucaucagacgccaaccccucagacggcucugccgccaaccucguuccagaagucaacaacgaagucauggcccuagagccuguagucggcgccgccaucgccgcaccagucgcaggccaacaaaaugucaucgaccccuggauacgaaacaacuucguccaagccccagguggcgaguucacugucagcccucgcaacgccccaggcgaaauauuaugguccgcaccccucggcccggaccuaaaccccuaccucucgcaccuagcacgcauguauaacggcuacgccggaggcuucgaagucgaagucauccucgccggaaacgccuuuaccgcuggaaagauuauauucgcagcugucccacccaacuuccccacagaaggccuaucacccucacaagucaccauguucccccacaucaucgucgacguaagacaacucgaacccguccucauaccccuccccgauguacggaacaacuucuaccacuacaaccaaucaaacgacucaaccaucaaacucaucgcaaugcuauacacaccccuccgugccaacaacgccggagacgaugucuucaccgucucuugccgcguacucacccgcccuucccccgacuucgacuucauauuccucguaccacccaccgucgaaucccgcacaaaacccuuuucaguacccguacucaccgucgaagaaaugaccaacucucguuuccccaucccccuugaaaaacuauucaccgggcccagcucugcuuucgucguccaaccccaaaacggccgcugcaccacagacggugucuuacuaggcaccacccaacucucaccugucaacaucugcaccuuccguggcgacguaacacacauaaccggaucgcgcaacuacaccaugaaccucgcaucccagaacuggaacaacuacgaccccaccgaagaaauccccgcaccccuagguacacccgacuucguuggcaaaauacaagguaugcuaacucaaaccacccgcacugacggaucuacacgcggacacaaagccaccgucuauaccggcuccgccgacuucgcuccuaaacucggacgcguccaauucgaaacagacaccgaccacgauuucgaagcaaaccaaaacaccaaauucaccccagucggcgucauucaagacggcucaaccacccacagaaacgaaccccagcaauggguccuccccucauacagcggacguaacacccacaacguccaccuagccccugccguagccccaaccuucccuggcgaacaacucuuauucuuccguuccacaaugcccggaugcaguggcuaccccaacauggaccuagacugccuccucccccaagaauggguccaguacuucuaccaagaagcagcacccgcucaauccgacgucgcacuccugcgcuuugucaauccagacaccggucgaguccuauucgaaugcaaacuacacaaaucuggcuacgucacagucgcacacaccggacaacacgaccucguaauacccccaaacgguuacuuccgauucgacucauggguaaaccaauucuacacccucgcccccaugggcaacggcacuggccgacgccgaguuguauaa

SEQ ID NO: 36074 - RNA, 1623 nt, Artificial Sequence
  derived and/or modified sequence opt11 from VP1__Norovirus__AGS08182
augaaaauggcaucauccgacgccaauccaagcgacggcuccgccgccaaccucgucccagaaguuaacaaugaagucauggcccuagaacccguagucggcgccgcuaucgccgccccagucgccggucagcaaaacgucaucgaccccuggauccgcaauaacuucguccaagcucccggaggcgaguucaccgucuccccacgcaaugcaccaggagaaauccucuggucagcuccacucggacccgaccuuaaccccuaccucucccaccucgcccgaauguacaacggcuacgccggcggcuucgaagucgaagucauacucgcaggcaacgccuucaccgcaggcaaaaucauauucgccgccguacccccaaacuucccaaccgaaggccuuucacccucccaagucacaauguucccccacauaaucgucgacguccgccaacucgaaccaguccucauaccacuaccagacguuagaaacaacuuuuaccacuacaaccaauccaacgacuccaccaucaaacucauagccaugcuguacacaccccuacgcgccaacaacgccggcgacgacguauucacugucagcugccgcguccucacccgcccaagccccgacuucgauuucaucuuccucguuccacccaccgucgaaucccgaacuaaaccauucucugucccaguacuuacugucgaagaaaugaccaacucccgauucccaauaccccucgaaaaacucuucaccggaccguccuccgcguucguaguacaaccccaaaacggcagaugcacaaccgacggagucuuacucggcaccacgcaacucuccccaguaaacaucuguaccuucagaggcgacgucacccacaucaccggcucacguaacuacacgaugaaccuagccucacaaaauuggaacaacuaugaccccacagaagaaauccccgccccgcuagggacacccgacuucgucgggaaaauacaaggcaugcuaacccaaaccacacgcacugacggaucaaccagaggacacaaggccaccgucuacaccggauccgccgacuucgccccgaaacucggacgaguacaauucgaaaccgacaccgaucacgacuucgaggccaaccaaaacacaaaauucaccccagucggcgucauacaagacggauccacaacccauagaaacgaaccccaacaauggguccuccccuccuauuccggccguaauacacacaacguccaccucgccccagcaguagcacccaccuuccccggcgaacaacuacuuuucuuccgaucuaccaugcccggaugcucaggcuacccaaacauggaccucgacugccuacuaccccaagaauggguccaauacuucuaccaagaagccgcccccgcccaaucugacgucgcccuacuacgcuucgucaauccugacacaggccgcguccuauucgagugcaaacuacacaaaagcggcuacgucaccgucgcacacaccggacaacacgaccucgucauacccccaaacggcuacuuccgcuuugacuccugggucaaccaauucuacacacuagcacccauggggaacggcacaggccgccgccgcgucgucuag

SEQ ID NO: 36075 - RNA, 1647 nt, Artificial Sequence
  derived and/or modified sequence opt11 from VP1__Norovirus__AGT39181
augaaaauggccuccaacgacgccaccccauccaacgacggugccgccggccucguccccgaaaucaacaacgaagcaauggccuuagaccccgucgccggagcugccaucgcagcaccccuaaccggucaacaaaacaucaucgaccccuggauaaugaacaauuucguucaagcaccaggcggcgaguucacagucucaccccguaacucccccggcgaaguccuauuaaaucucgaacucggccccgaaaucaaccccuaccucgcucaccucgcccgcauguacaauggcuacgccggcggcuucgaaguacaagucguccucgccggcaacgccuucaccgcaggcaagauaaucuucgccgcaauucccccaaacuucccuaucgacaaccucuccgccgcacaaaucacaaugugcccccacgucaucguagacguccgacaacuagaacccgucaaccuucccaugcccgacgucagaaacaacuucuuccacuacaaccaaggauccgacucccgccuacgauuagucgccaugcuauacacaccucuucgagccaacaacucaggcgacgacguuuucaccgucuccugcagaguccucacgcgccccucccccgacuucuccuucaacuuccucguucccccaaccgucgaaucaaaaaccaaacccuucacacuccccauacucaccaucuccgaaauguccaacucacgcuucccagucccuaucgacucucuccacacaucccccaccgaaaacaucgucguccaaugccaaaacggccgcgucacccuagacggcgaacuuaugggcacuacccaacuccuacccucccaaauaugcgccuuccgaggaguccucacacgaagcaccuccagagccuccgaccaagccgacaccgccacaccccgccucuucaacuacuauuggcacauacaauuagacaaccuaaacggcacccccuacgacccagccgaagauauccccggcccccuuggaacccccgacuuccgcggcaaagucuucggagucgccagucaacgcaauccagacuccacaacccgcgcccacgaagccaaagucgacaccaccgcuggacgcuucacacccaaacucggaagccuagaaaucuccacagaaaguggagacuucgaccaaaaccaaccaacccgcuucacuccaguaggcauugguguugacagagaagccgacuuccaacaauggucccuccccgauuacuccggccaauucacccacaacaugaaccucgcccccgcagucgccccaaacuucccaggagaacaacuacucuucuuccguucccaacuaccaucauccggaggucgcuccaacggaauccucgacugccucguuccccaagaauggguucaacacuucuaccaagaaucagcccccgcacagacccagguagcccuaguccgauacguaaauccagacacaggccgcguuuuauucgaggcuaaacuucauaaacugggcuucaugaccaucgccaaaaauggcgacucacccauaaccgucccaccaaacggcuacuuucgauucgaauccugggucaacccuuucuacacccucgcaccuaugggcacuggaaacggccgccgccgcauccaauaa

SEQ ID NO: 36076 - RNA, 1608 nt, Artificial Sequence
  derived and/or modified sequence opt11 from VP1__Norovirus__AGT39191
augaaaauggccucgaacgacgcagcccccuccaacgacggcgcagccggccuuguacccgaggugaccaaugaaaccauggcccuugaaccuguagccagagccucaaucgccgcuccucuaacaggccaaaacaacgugaucgaccccuggaucacacucaacuucggacaagcccccaccggccaccuuacccucagcccacccuacucucccggagaaguucuccuaaaccuugaacuucgacccgaacucaacccauaccucgccaaucucucccgcauguacaacggcuaugccgguggggucgaaguccaaguccuccuagccggaaacgccuucaccgccggcaaacucgucuucgcagcagucccaccccacuucccccucgaaaacaucuccccgggccagauaaccauguuuccccacgucaucaucgacguccgcacccucgaaccuguccuacucccccuucccgacguucgaaauaacuucuuucacuacaaccaacaaaacgaaccccgcaugagacucguagccaugcuauacacaccacuccgcuccaacggcucuggcgacgaugucuuuacagucuccugccgaguucucacccgccccuccccagauuucgacuuuaacuacuuaguaccacccaccgucgaguccaaaacuaaacccuucacacucccaauacuaaccaucggcgaacuaaccaacucacgcuuccccguaccaaucgaugaacucuacaccuccccaaacgaaucgcucguuguccaaccccaaaacggacgcugcgcucucgacggagaacuacaaggcacaacccaacuccuccccaccgcuauuugcuccuuucgaggacgcaucaaccaaaaaguaucgggcgaaaaucacgucuggaacaugcaaaucaccaacauaaacggaacucccuucgacccaaccgaagacguccccgcaccccuaggcaccccagacuucuccggcaaacuauucgguguccuaucccaacgagaucacgacaacgccugccgcucccacgacgccgucaucgccaccaacuccgcaaaauucacccccaaacucggcgccauccaaauagggacaugggaacaggacgacguccacaucaaccaacccaccaaauucacccccgucggccuauucgaaucagaaggcuucaaccaauggacgcuccccaacuacucaggcgcccucacccuaaacaugggccucgcaccacccgucgcccccaccuuccccggcgaacaaauccucuucuuccgcucccacaucccccucaaaggcggcgucgccgacccagucaucgacugccuucucccccaggaauggauccaacaccucuaucaagaauccgcccccucccaaaccgacgucgcacucauacgcuucacuaaccccgacacuggccgcguccuuuuugaagccaaacuccaccgcagcggauacaucacagucgccaacacgggcagccgucccauagucguccccgcaaacggcuacuuccgcuuugauuccuggguaaaccaauucuacucccuagccccuaugggaaccggcaacggccgccgucgcguccaauag

SEQ ID NO: 36077 - RNA, 1608 nt, Artificial Sequence
  derived and/or modified sequence opt11 from VP1__Norovirus__AGT39194
augaaaauggccucaaacgacgccgcaccaagcaacgacggcgccgccggccucguacccgaaguuaacaacgaaacaauggcccuagaacccgucgcaggagccucaauagccgccccgcucacaggccaaaacaacguaaucgauccauggauacgacucaacuucguacaagccccaaacggagaguucaccguuucccccagaaacuccccuggugaaguccuccucaaccucgaacucggccccgaacucaacccauaccucgcucaccucucccgaauguacaacggauaugccggcggaguagaaguccaaguccuccucgccggcaacgcuuucacagccgguaaacucgucuucgccgccguaccaccccacuucccccuagagaacaucucccccggccaaaucacaauguucccccacguaauaauagacgugcgcacucucgaaccaguccuacucccccuacccgacguccgcaacaacuuuuuccacuacaaccaacagaacgaaccacgcaugcgccucgucgcaaugcucuacaccccacugcgcuccaacggcuccggcgacgacguuuuuaccgucuccugccgcguccuuacacgcccaucuccagacuucgacuucaacuaccucgucccucccaccgucgaauccaaaaccaagcccuucaccuuaccaauucuaacaauaggcgaacuaacaaacagccgcuucccaguccccaucgacgaacuguauacauccccaaacgaaucccucgucguccaaccacaaaacggaagaugcgccuuagauggagaacuucaaggcacaacucaacuacuccccaccgccaucugcuccuuccguggccgaaucaaccaaaaagucaguggcgaaaaccacgucuggaacaugcaaaucaccaacaucaacggcacccccuuugacccaacagaagacguccccgcaccgcucggcacccccgacuucucaggaaaacucuucggcgucuuaucccaaagagaccacgacaacgccugccgcucccacgacgcagucauagccaccaauuccgccaaguuuacgccaaaacucggagcaauccaaaucggaacaugggagcaagacgacguccacauuaaucaaccaaccaaauucacccccgucggucucuucgaauccgaaggcuucaaccaauggacacuacccaacuacucaggcgcccucacccucaacaugggccucgcacccccugucgccccuacuuuccccggcgaacaaauucuguucuuccgcucccacaucccacucaaaggcggcgucgccgaucccguaaucgacugccuccugccccaagaauggauccaacaccuauaccaagaauccgcccccucccagaccgacgucgcacuuauccgauucacuaaccccgacaccggccgaguccuauuugaagcuaaacuacaccggucuggauacauaaccgucgccaacacaggauccaggcccauagucguacccgccaacggcuacuuccgauucgacuccugggucaaccaauucuauucccuagcccccaugggaaccggcaacggacgccgccgcguacaguaa

SEQ ID NO: 36078 - RNA, 1608 nt, Artificial Sequence
  derived and/or modified sequence opt11 from VP1__Norovirus__AGT39197
augaaaauggccucaaaugaugccgccccaucaaacgacggagcagccggacugguccccgaagucaacaaugaaaccauggcacucgaacccgucgccggagccucuauagccgcaccccuaacaggacaaaacaacgucaucgaccccuggauaaggcucaacuucguacaagcccccaacggagaguucaccguaucuccacggaacucacccggcgaaguucuccucaaccuagaacuaggcccugagcucaacccuuaccuagcccaccucucccgcauguacaacggcuacgcaggcggcguagaaguccaaguacuccucgcaggcaacgcuuucaccgcaggcaagcuagucuucgccgcagucccuccccacuucccccucgaaaacaucucacccggacaaaucaccauguucccacacguaaucaucgacguccgcacccuagaaccgguacuacucccacuccccgacguccgaaacaacuucuuccacuacaaccaacaaaacgaaccccgcaugagacucguagcaaugcucuacaccccacuccgcucuaacgguuccggagacgaugucuucaccgucuccugucgcguacucacacgccccuccccagacuucgacuuuaacuaccucguucccccaaccguugaaucaaaaaccaaacccuuuacacuccccauccucacuaucggcgaacucacaaacucacgauuccccguccccaucgacgaacuauacaccucuccaaacgaaagccucgugguccaaccucagaacggccgcugcgcccuagacggagaacugcaaggcaccacccaauuacuccccaccgccauaugcucauuccgaggccgcauaaaccaaaaaguuuccggagaaaaccaugucuggaacaugcaagucaccaacauaaacggaaccccauucgaccccaccgaagacguacccgcaccccucggcacucccgacuucucuggaaaacuuuucggaguccucucccagcgcgaccacgacaacgcuugccgcucccacgacgccgucauugccaccaacuccgcaaaauucacacccaaacucggcgccauccaaaucggaacaugggaagaaaaugacguccacaucaaccagcccacaaaauucacaccagucgggcuauucgaaucagaaggcuucaaccaauggacccuacccaacuacucaggcgcgcucaccuugaacaugggccucgccccacccgucgcacccaccuucccuggcgaacaaauacuuuucuuccgcucacacaucccucucaaaggaggcgucgcugaccccguaauagacugccuccuuccccaagaauggauccaacaucucuaccaagaaucagcucccucccaaaccgacgucgcccucauacgauuuaccaaccccgacacaggucgcguccuauucgaagccaaacuacaccgcuccggcuauaucaccguagcuaacacaggcucacgacccaucguaguccccgccaacggauacuuccgcuucgacuccuggguaaaccaauucuacucucucgcacccaugggcacuggcaacggccgacgccgcguccaauaa

SEQ ID NO: 36079 - RNA, 1608 nt, Artificial Sequence
  derived and/or modified sequence opt11 from VP1__Norovirus__AGT39200
augaaaauggccuccaacgacgccgcccccuccaacgacggcgccgcuggccucguccccgaaguuaacaacgaaacaauggcccucgaaccagucgcgggcgccuccaucgccgccccucuuacaggacaaaacaaugucaucgaucccuggauccgccuuaacuucguucaagcacccaacggggaguucacagucucaccccgcaacucuccaggagaaguccuccucaaccuugaacucggcccagaacucaaccccuaccuagcucaccuuucccgcauguacaauggcuaugcaggcggagucgaaguccagguccucuuagcuggaaaugcuuuuacagcuggaaaacucgucuucgccgcaguucccccacacuucccucuagaaaacaucuccccaggacaaaucaccauguucccccaugucauaauagacguucgcacccucgaacccguacuccucccucuccccgacguccgaaacaacuucuuccacuauaaccaacaaaacgaaccacgcaugcgccuagucgccaugcucuauacccccuugcgauccaauggauccggugacgacguauucaccguuuccugccgcguccucaccagacccucccccgacuuugacuucaacuaccucguaccacccacugucgaauccaaaacaaaacccuucacccuaccaauacucaccauaggcgaacucacaaacucgcgcuuccccgugccaaucgacgaacucuauaccucccccaaugaaucacuuguuguccaaccgcagaacggccgaugcgcacuagacggcgaacuacaaggcaccacccagcuccuccccaccgccauaugcuccuuccgcggccgcaucaaccaaaaagucuccggcgaaaaccacguuuggaacaugcaaaucaccaacaucaacggaaccccuuucggacccaccgaagacguacccgcuccccucggcacccccgacuucuccggcaaacucuucggaguccucucacaacgcgaccacgacaaugccugccgcucccaugacgccgucaucgccaccaacucugccaaauucacccccaaacuaggagccauccaaauaggaaccugggaacaagacgacguccacaucaaccaacccaccaaauucaccccagucggucucuuugaauccgaaggauucaaccaauggacucuacccaacuauuccggagcccuaacucuaaacaugggucucgccccacccgucgcgccaaccuuccccggugaacaaauccucuucuaccgaagccacaucccccucaaaggaggcgucgccgaccccgucaucgacugcuuacugccccaagaauggauacaacaccuauaccaggaaucagcaccuucacaaaccgacgucgcccucauacgcuucacaaaccccgacaccggucgcguacucuucgaggccaaacuccacagguccggcuacauaaccguugccaacaccgguucccgccccauagucgucccugccaacggcuacuuccgcuucgacucauggguuaaccaguucuacucacuagcccccaugggaaccggcaacggccgccguagaguacaauaa

SEQ ID NO: 36080 - RNA, 1608 nt, Artificial Sequence
  derived and/or modified sequence opt11 from VP1__Norovirus__AGT39203
augaaaauggcguccaacgacgcugcucccucaaacgauggugccgccggccucgucccagaaguuaauaacgaaaccauggcacuugaacccguugcaggagcuucaauugccgcuccccucaccggccaaaacaacgugaucgacccauggauucgccucaacuucguccaagcccccaacggcgaguucacagucaguccccgaaacucccccggagaaguacugcucaaccuagaacucggcccagaacuaaaccccuaccuagcccaccucucccgcauguacaacgguuaugccggcggcguagaaguccaaguccuacuagccggcaacgcauucacagccggcaaacucgucuuugcagcagucccaccacacuucccacuagaaaacaucucccccggccagaucaccauguuuccacacgucaucaucgacguacguacacuagaacccguccuacuaccucuacccgacgucagaaacaacuucuuccacuacaaccagcaaaacgaacccagaaugcggcugguagcaaugcuauacacaccccugcgaucaaacggcagcggcgacgacgucuucacugucucuugccgcgucuuaacccgcccaucucccgacuucgacuucaacuaccucgugcccccuacugucgaauccaaaaccaaacccuucacccuccccauccugacgaucggugaacucaccaacucccgcuuccccguccccaucgacgaacuuuacacaucccccaacgaaucccuagucguccaaccccaaaacggccgcugcgcacucgacggagaacuccaaggaacaacccagcugcuacccacggcaaucugcuccuuccgcgggcgcauaaaccaaaaaguuucaggcgaaaaccacguguggaacaugcaagucaccaauaucaacggcacaccuuucgaccccaccgaagacguucccgcaccacucggcacccccgacuucuccggcaaacucuucggcguccucucacaacgagaccacgauaacgccugccgaucccacgacgccgucaucgccaccaacuccgcgaaauuuacccccaaauuaggcgccauccaaauaggcaccugggaacaagacgauguucacauaaaccaaccaaccaaauucacuccaguaggacucuucgaauccgaaggcuucaaccaauggacccuacccaacuacagcggcgcucucacucucaacaugggacucgcuccacccgucgcccccacauuccccggcgaacaaauacucuucuuccgcucccacaucccccucaaaggcggggucgccgaucccguaaucgacugccuacucccccaagaauggauccaacaccucuaccaagaaucagcaccaagccaaacagacguagcacuaauaagauucaccaaccccgacacuggacgaguccucuucgaagccaaacuccaccgaucaggcuacauaaccguggcgaacacagguucacgccccaucguaguacccgccaacggauacuuccgcuucgacuccugggucaaccaauucuacucccuagcccccaugggcaccggcaacggacgccgacgaguucaauaa

SEQ ID NO: 36081 - RNA, 1629 nt, Artificial Sequence
  derived and/or modified sequence opt11 from VP1__Norovirus__AGT39206
augaaaauggccucuaacgacgccgcccccuccacagauggcgccgcaggccucguaccagaaucaaacaacgaaguaauggcccuagaaccggucgccggugccgcacuagcagcaccaguaaccggacaaaccaacaucaucgaucccuggauacgcgcaaacuucguccaagccccuaacggcgaauuuaccgucucuccacgcaacucgcccggagaaguucuccucaaccucgaacucggacccgaacuaaaccccuaccuagcccaccucgcccgaauguacaacggauacgccgguggaauggaaguucaagugaugcucgccggcaacgccuucaccgcaggcaaacucgucuucgcagccgucccuccccacuuccccgucgaaaaccucucuccucaacaaaucaccauguucccccacgucauaauagacgucagaacacucgaaccaguccuccuaccguuacccgacguccgaaacaacuucuuccacuauaaccaaaaagacgaccccaaaaugcgaauaguugccaugcuauacacaccccuacgcuccaacggcagcggcgacgauguauucaccgucucaugccgcguccuaacccgccccucccccgacuucgacuucacauaccucgucccgcccacagucgaauccaaaaccaaacccuucacccuacccauccuaacacucggcgaacuaagcaacucccgauuuccugucuccaucgaccaaauguauaccucccccaaugaagucaucagcguccaaugccaaaauggaagaugcacccuagauggcgaacuccagggaaccacucaacuccaagucuccggcaucugcgcauucaaaggcgaagucaccgcccaccuccacgacaacgaccaccucuacaacguaaccaucaccaaccuaaacggcucccccuucgaccccuccgaagacaucccugcaccccucggcgucccugacuuccagggacgggucuucggcgucauuucccaacgcgacaaacacaacacaccaggacacaacgaacccgccaacagagcccaugacgccgucgucccaaccuauacugcccaauacaccccaaaacuaggccaaauccaaaucggcacuuggcaaaccgacgaccucacagugaaccaacccgucaaauucacucccgucggacucaacgacaccgaccacuucaaccaauggguaguaccccgcuacgccggcgcacucaaccucaauacuaaccucgccccaucuguagcacccguauuccccggagaacgacuacuauucuuccgcagcuacaucccccucaaaggcggcuacggcacacccgcaaucgacugccuccuuccacaagaauggguccaacacuucuaccaagaagccgccccuuccaugucggaaguagcgcucguccgcuacaucaacccagacaccggacgagcccuauucgaagccaaacuccaucgagcaggcuucaugacggucucauccaacaccucggccccaguagucguccccgcaaauggguacuuccgcuucgacuccugggucaaccaauucuacucacuagcacccaugggaaccggcaacggacgucgucgcauacaauaa

SEQ ID NO: 36082 - RNA, 1623 nt, Artificial Sequence
  derived and/or modified sequence opt11 from VP1__Norovirus__AHF45991
augaaaauggccuccuccgacgcaaaccccuccgacggcuccaccgcaaaccuugucccagaagucaacaacgaagucauggcccuggaaccagucguaggagccgccaucgcagccccagucgccggacaacaaaacguaaucgacccauggauccgcaacaacuucguccaggcccccggcggcgaauuuaccguuagcccccgaaaugccccuggcgaaauccucugguccgcaccucugggccccgaccucaacccauaccucucacaccucgcacgcauguacaacuccuacgcuggcggcuucgagguacaaguuauacucgccggcaaugccuucaccgccggcaaaauaaucuucgcagccguacccccaaacuuccccaccgaaggccucuccccaucccaagugaccauguucccccacaucauagucgauguacgacaacuagaaccuguccucaucccacuccccgacguccguaacaacuucuaccacuacaaccagucaaacgacccuacaaucaaacucauugccaugcuuuacacaccccuccgcgccaacaaugccggagacgaugucuucaccguauccugccgcguccucacccgccccucacccgacuucgacuucaucuuccucguacccccuaccgucgaaagccgcaccaaaccauucucaguccccauccuaacagucgaagaaaugacuaacucccgcuuccccaucccccucgaaaaacucuucaccggaccauccuccgcauucgucguccagccccaaaacggucgcugcaccaccgacggaguucuccucggcaccacccaauuaucacccgucaacaucugcacauuccgcggcgacgucacacacaucgccuccacacaagaguacaccaugaaccucgccagccaaaacuggaacaacuacgaccccacagaagaaauccccgcaccccuaggcacgccagacuucgucggcaaaauacaaggcgugcucacccaaacgacccgccgcgacggaagcacucgcggccacaaagccacagucuccacaggcucaguccacuucacaccaaaacucggcagaauccaauucucaaccgacaccuccaacgacuuugagaccggccaaaacacccgauucaccccagucggcgucguccaagacggguccacaacccaccaaaacgaaccccaacaauggguccuacccaacuacagcggacgcgacucucacaacguccaucuugcccccgccguagcccccagcuuccccggcgaacaacuacucuucuucagauccacaaugcccggauguuccggcuacccuaacaugaaucucgacugucuacucccacaagaauggguccaacacuucuaccaagaagccgcuccagcccaauccgacgucgcacuacuccgcuucgucaacccugacacaggccgcgucuuauucgaaugcaaacuccauaaauccgguuacgucacagucgcucacaccggccagcacgaccuagucaucccuccuaacggcuacuuccgauucgacuccuggguaaaccaauucuacacccucgcccccaugggcaacggaaccggccgccgccgcgcccuuuaa

SEQ ID NO: 36083 - RNA, 1623 nt, Artificial Sequence
  derived and/or modified sequence opt11 from VP1__Norovirus__AHF45993
augaaaauggccuccucugaugccaacccuucagauggaucuaccgcaaaccucguccccgaggucaacaacgaagucauggcacuagaaccagucguaggcgccgccaucgccgcccccgucgcgggccaacaaaauguaaucgaccccuggauucgcaacaacuucguccaagcaccuggcggagaguucaccgucucaccccgcaacgcccccggagaaauccugugguccgcaccccuaggccccgaccuaaauccauaccucucccaccucgcacgcauguacaacggcuacgccggcggcuucgaaguccaagucauccuagcuggaaacgccuucaccgcaggcaaaaucaucuucgcggcagucccacccaacuuccccacagaaggccuauccccaucucaagucaccauguucccccacaucaucgucgacguccgacaacucgaaccaguccucauaccccugcccgacgucagaaacaacuucuaccacuacaaccaaagcaacgacuccaccaucaaacucaucgccaugcucuacacaccccucagagcaaacaacgcuggcgacgacgucuucacagucuccugccggguacucacucgccccucccccgauuucgacuucauauuccucgucccacccacaguagaaucccgaaccaaacccuuuucaguccccguacucaccgucgaagagaugaccaauuccagauuccccauaccucucgaaaaacuuuucacuggccccucauccgccuucgucguccaaccccaaaacggccgaugcaccaccgacggcguccuccucggaaccacccaacucucaccagucaauaucugcaccuuucgaggcgacgucacacauauccccggaucccgcaacuacacaaugaaccuagccucccaaaacuggaacagcuaugacccaacagaagaaauccccgcaccccuuggcacacccgacuucgucggaaaaauccaaggcguccucacccaaaccacccgaaccaacggcucaaccagaggccacaaggccacuguauacaccggcucugccgacuucucccccaaacucggucggguccaauucgccacagauacagacaacgacuucgaaacaaaccagaacacaaaauucacccccguuggcguaauacaagacggcagcaccacaccccguaacgaaccacaacaauggguccuccccuccuacuccggcaggaacauccauaacguacaccuugccccugcagucgcccccaccuucccaggcgaacagcuccuguucuucagaucaaccaugcccggaugcuccggcuaucccaacauggaccuagacugcuuacucccccaagaauggguccaauacuucuaucaagaagcagcccccgcccaaucagacguugcacuacucagauucgucaacccagacaccggacgcguccucuuugaaugcaaacuucacaaaucuggcuacgucacugucgcccacaccggccaacacgaccucgucaucccaccaaacggcuacuuccgcuucgacuccugggucaaccaauucuacacccuagccccuaugggaaacggaaccggccgccggcgagcccuauaa

SEQ ID NO: 36084 - RNA, 1623 nt, Artificial Sequence
  derived and/or modified sequence opt11 from VP1__Norovirus__AHF45997
augaagauggccuccuccgacgccaaccccagcgacggaucagccgccaaccugguccccgagguuaacaacgaaguaauggcccucgaacccguaguaggagcagccauagcugcccccguagccggccaacaaaacgugauugacccuuggauccgaaacaacuuuguccaagccccaggcggcgaguucacgguuagcccccgaaacgcuccaggcgaaauccuaugguccgccccucuaggccccgaccuuaaucccuaccucucacaccuagcgcgaauguacaacggcuacgccggaggcuucgaaguccaaguaauacucgcaggaaacgcauucaccgccggcaaagucaucuucgccgccgucccucccaacuuucccaccgaaggccucagccccucccaaguaacaauguucccacacaucgucgucgacguucgccaacucgaaccuguccuaauaccacuccccgacguccgcaacaacuucuaccacuacaaccaaagcaacgaccccacaaucaaacuaaucgcuaugcucuacacuccccuccgcgccaacaacgccggcgacgacgucuucaccguauccugccgaguccucacccgacccagcccagacuuugacuucaucuuccucguacccccaaccguagaaucccgcaccaaacccuucagcguccccguccucaccgucgaagaaaugacaaacucccgauucccuauuccccucgaaaaacucuucaccggccccucauccgcauucgucguccaaccccaaaacggacgcugcacuaccgacggcguccugcuagguaccacgcaacucucccccguaaacaucuguacuuuucgcggcgacgucacccauauaacgggcuccagaaacuacacaaugaaccucgcaucccagaacuggaacaacuacgaccccaccgaagaaauccccgcaccacucggcacccccgacuucgucgguaaaauucaagguguccucacccaaaccacacgcaccgacggaagcacacgcggccacaaagccaccgucuacaccggcucagccgauuucgcucccaaacuaggccgcguacaauucgaaacugacacagaccacgauuucgaagccaaccaaaacaccaaauucacccccguuggcguaauccaagacggcggcaccacacaucgcaacgaaccccaacaauggguccuccccuccuacucaggccgcaacacccacaacguccaccucgcacccgccgucgcacccaccuuccccggcgaacaacuccucuucuuccguucaaccaugcccggcugcucaggauaccccaacauggaccucgacugccugcucccccaagaauggguacaauauuucuaucaagaagcugcacccgcccaguccgacguagcccuacuucgauucgucaaccccgacaccggccgcguccucuucgaaugcaaacuccacaaaagcgguuacgucacaguagcccacaccggucaacacgaccuagucaucccacccaacgguuacuuccgauucgacucaugggucaaccaauuuuauacacuagcccccaugggcaacggcaccggccgaagacgggccguuuaa

SEQ ID NO: 36085 - RNA, 1623 nt, Artificial Sequence
  derived and/or modified sequence opt11 from VP1__Norovirus__AHF45999
augaaaauggcuuccucugacgccaaccccuccgacggcuccgccgccaaccucguccccgaaguuaacaacgaagucauggcccucgaacccguugucggcgccgccauagcagcccccguagccggccagcaaaauguuauagaccccuggauacgaaacaacuucguacaagccccaggaggugaguucaccgucucaccccgcaacgcccccggcgaaauccuaugguccgcaccacucggaccugaccucaaccccuaccuaucacaccucgcccgcauguacaacggauacgcaggcggcuucgaaguccaagucauccuagccggcaacgccuucaccgccggcaaagucaucuucgcugcagucccacccaacuuccccaccgaaggacucuccccaucacaagucaccauguucccgcacaucguagucgacguccgccaacuagaacccguccucauaccccuccccgauguccgcaacaacuuuuaccacuacaaccagucaaacgacccaaccaucaaacugauagccaugcucuacacaccucuucgcgcaaauaacgcaggagacgacgucuucaccgucagcugccgcguacuaacacgcccaagcccagacuucgacuuuaucuuccucguaccacccaccgucgaaucucgaacuaagcccuuuucaguacccguacucacuguugaagaaaugaccaacucgcgauuccccauaccacuagaaaaacucuucaccggcccaucauccgcauucgucguccaaccacaaaacggcagaugcacaaccgacggaguacugcucggaaccacacaacucucccccgucaauaucuguaccuuccgaggggacgucacccacaucacugguucacggaacuacaccaugaaccucgcaucucaaaacuggaacaacuacgaccccaccgaagaaaucccagccccacucggcacaccugacuucgucggaaaaauccagggaguccucacacaaacaaccagaacugacggcuccacacgcggccacaaggcaaccguauacaccggcuccgcagauuucgcccccaaacucggccgcguccaauucgaaacagacacagaccacgacuucgaagccaaccaaaacaccaaauucaccccaguuggagucauccaagacggcggcaccacccaccgaaacgaaccccaacaauggguccucccaucauacuccggccgcaacacacacaacguccacuuagcaccagccgucgcccccacauuccccggugaacaacuacucuucuuucgcucaaccaugccaggaugcucgggcuaccccaacauggaucuagacugucuccucccacaagaauggguccaauacuucuaccaagaagccgcccccgcacaguccgacgucgcacuacuacgcuucgucaacccggacacuggccgaguacuauucgaaugcaaacuccacaaauccggcuacgucaccguagcucacaccggacaacacgauuuagucaucccaccaaacggcuacuucagauucgacagcugggucaaccaauucuacacacuagcccccaugggcaacggaaccggccggcgacgagccgucuaa

SEQ ID NO: 36086 - RNA, 1623 nt, Artificial Sequence
  derived and/or modified sequence opt11 from VP1__Norovirus__AHF46001
augaaaauggcuuccuccgaugcuaaccccucagacggcuccgccgccaacuuaguccccgaaguuaacaacgaaguuauggcccuugaaccaguuguuggagcagcuauagcagccccugucgccggacaacaaaaugucaucgaucccuggauccgaaacaacuucguccaagcccccggcggcgaauuuaccguauccccgcgaaacgcccccggcgaaauccucuggucagccccacucggccccgaucucaaccccuaucuaucccacuuagcacgcauguacaacggcuacgccggaggcuucgaaguccaaguaauccucgccggaaacgccuucacugccgggaaaguaauauucgcagccgucccuccaaacuucccaaccgaaggucucagcccaucccaagucaccauguucccacacaucgucguggauguacgacaacucgaaccggucuugauaccccugccagacguacgcaacaacuucuaccacuacaaccaauccaacgacccaacuaucaaacuaaucgccaugcuuuacacaccccuacgcgccaauaacgccggggacgacguuuucaccgucuccugcagaguccuaacccgccccucacccgacuucgacuucaucuuccucgucccucccacagucgaaucccgaaccaaacccuucucgguccccguccucaccguugaagaaaugaccaacucccgcuuccccaucccacucgaaaaacuauucaccggcccuucauccgccuucgucguccagccacaaaacggacgcugcaccaccgacggaguccuacucgggaccacccaacucucccccgucaacaucuguaccuucagaggcgacgucacccacaucaccggcuccagaaacuacaccaugaaccucgcaucacaaaauuggaacaacuacgacccaacugaagaaauccccgcaccccugggcacccccgacuucguaggaaaaauacaaggcguccuaacacaaaccaccagaacagacggcucuacacgcggacacaaagccaccgucuacacaggcucagccgacuucgcaccaaaacucggccgcguacaguucgaaacagacacugaccacgacuucgaagccaaccaaaacaccaaauucacccccgucggcguaauccaagacggugguaccacccaccgaaacgaaccccaacaauggguccuccccucauacuccggccgcaacacccacaacguucaccuugccccagccguagcccccaccuucccaggagaacaacuacucuucuuccgauccacaaugccaggcugcagcggcuaccccaacauggaccuagacugccuacucccccaagaauggguccaauacuucuaccaggaagccgcccccgcccaaucagacguagcacuccuacgcuucgucaauccugacaccggccgagucuuauucgaaugcaaacuccacaaguccggauacguaacagucgcacacaccgggcaacacgaccucgucaucccucccaacggauacuuccgauuugacucaugggucaaccaauucuacacccuagcucccaugggcaacggcaccggacggcgccgagcaguuuaa

SEQ ID NO: 36087 - RNA, 1617 nt, Artificial Sequence
  derived and/or modified sequence opt11 from VP1__Norovirus__AHH44876
augaaaauggccucaaaugacgccaacccaagcgacggcuccgccgcaaaccuugucccagaagucaacaacgagguaauggcacucgaaccaguagucggcgccgcaaucgcagcacccgucgccggucagcaaaacguaauagaccccuggaucagaaacaacuucguacaagcccccggaggcgaguucaccaucuccccacgcaacgcacccggcgaaauccuuuggucagcgccccucggccccgaccuaaaccccuacuuaucccaccucgcccgaauguacaacggcuacgcaggcggauucgaaguccagguaguccucgcuggcaacgccuucacagcaggcaaaaucaucuucgcagccgucccacccaacuucccaaccgaaggccucucccccagccaaguaaccauguucccccacaucauuguagacguccgccaacucgaaccaguccuaaucccccuaccagacguccgcaacaacuucuaccacuacaaccagagcaacgacucaacaaucaaacucaucgccaugcucuacacaccccuccgagccaacaacgcaggagacgacgucuuuaccguauccugccguguucuaacacgcccaucaccagacuucgacuucauauuucucguacccccaacugucgaaucccgcacaaaaccauucaccguacccguucucacaguggaggagaugacaaacagccgcuuccccaucccccuagaaaaacuuuucacuggaccaagcuccgccuucgucguccaaccccaaaacggccgaugcaccaccgacggcguccuccugggaaccacacaacucucagcagucaacaucugcaccuucagaggcgacgucacccacgucucugauaaaaccuucgcaaugaaccucgccuccccaaacuggaacaacuacgaccccaccgaagacauccccgcaccccuaggcacacccgacuucguaggccgaauccauggcaugcucacccaaacaacccgccgugacggagccacccgaggucacaaagccaccgucuccacaggaggagccgacuucacuccuaaacuaggcucuguccgauauaucaccgacacaaccgacgaccucgaaguccgcgaaaacacaaaauuuacacccaucggcguccuccacucauccggugaacaccgggccgaacccgaccaauggcgccuccccgaauacucaggacgcaacguucacaacguccaccucgccccugccgucgcaccuaccuuccccggcgaacagcuacucuucuuccgauccgcccuuccugguugcggaggauauccuaacacugacuuggacugccuacuaccccaagaauggguccaacacuucuaucaagaagccgcacccgcccaaagcgacguagcccuucuccgcuucgucaauccagacacaggaagaguccuuuucgaaugcaaacuccacaaaucaggauaugucacagucgcccacacaggcccccacgaccucguaauaccacccaacggcuauuuccguuucgauucauggguaaaccaauucuacacccuugccccaaugggaaacggcaccggacgccgacgggcccuguaa

SEQ ID NO: 36088 - RNA, 1617 nt, Artificial Sequence
  derived and/or modified sequence opt11 from VP1__Norovirus__AHH44877
augaaaauggccucaaacgacgccaaccccuccgacggaucagccgcaaaucuaguaccugaagucaacaacgagguuauggcacucgaacccgucguaggcgccgccaucgccgcccccguagccggccaacaaaacguaauagauccauggauacgcaacaacuucguccaagccccgggaggagaguucaccaucucuccccgcaacgccccgggagaaauacuaugguccgccccgcucggccccgaccuaaaccccuaccucucccaccuugcccgaauguacaacggcuacgccggaggcuucgaaguccaagucguccuagcaggaaacgccuucaccgccggcaaaaucaucuucgccgcuguacccccaaacuuccccaccgaaggccuaucccccucccaaguuaccauguucccccacauaauaguggacguccgccaacucgaacccguacuaaucccccuaccagacguccgaaacaacuucuaccacuacaaccagucaaaagacucuacaaucaaacuuauugccaugcuauacaccccacuucgcgcaaacaacgccggcgacgacgucuucaccgucucaugcagaguccuaaccagacccucacccgacuucgacuucaucuuccuagucccacccaccgucgaaucgcgcaccaaacccuucuccguacccguauuaaccgucgaagaaaugaccaacucccgcuuccccauuccccucgaaaaacuauucacaggacccuccucugcauuugucguccagccccaaaacgguagaugcaccaccgacggcguccuccucgguaccacccaacucuccgccgucaacauaugcaccuuccgaggcgacguaacccacgucgccggagacaccuucgcaaugaauuuagccucacuuaacuggaauaacuacgaccccacugaagaaacccccgcaccccucggcacacccgacuuuguaggacgcauccacggaaugcuaacccagaccacccgcuccgacggcgccacccgagcccacaaagccaccgucuccaccgggggcgccgauuucacacccaaacucggcuccguccgauacucaacagacaccuccggcgaccuagaaguacgagaaaacacaaaguucacccccaucggcguucuacacuccagcggcgaacgccgcgccgaacccgaacaauggcggcuccccgaauacuccggacgaaacguccacaauguacaccuagccccugcagucgcccccacguuuccaggagaacaacuccuauucuuucgauccaccaugcccggcugcggcggcuaccccaacauggaccuagauugcuuacucccacaagaauggguacaacacuucuaccaagaagcagccccagcccaaagcgacguugcccuacucagauucgucaacccugauaccggccggguccuauucgaaugcaaacuccacaaaagcggcuacgucaccguagcacacacaggcccacaugaccuuguaaucccgcccaacggcuacuuccgauucgacagcugggucaaccaauucuacacccucgccccaaugggcaacggcacaggccgccgccgcgcccuauaa

SEQ ID NO: 36089 - RNA, 1617 nt, Artificial Sequence
  derived and/or modified sequence opt11 from VP1__Norovirus__AHH44878
augaaaauggcaagcucagacgccaaccccuccgacggcuccgccgccaaccucguccccgaaguaaacaacgaagucauggcacucgaaccagucgucggagccgccauagccgccccagucgcaggccaacaaaacguaauugaccccuggauucguaacaacuucguccaagcacccggcggagaguucaccauaucaccccgcaacgccccaggagaaauccucuggucagcgccccucggcccugacuuaaacccauaucuaucacaccucgcccguauguacaauggcuacgccggcggauucgaaguacaaguaguucucgcaggcaacgccuucacagccggcaaaaucaucuuugccgccguacccccaaacuuccccacagaaggacuaucacccucucaagucacaauguucccccacaucaucguagacguccgccaacucgaacccguccucaucccccuccccgauguccgcaauaacuucuaucacuacaaucaauccaaagacucuaccaucaaacucaucgccaugcucuacaccccacuacgcgcuaacaacgccggcgacgacguauucacagucucgugccgcguccucacucgccccagucccgacuucgacuucaucuuccuagucccgcccaccgucgaaucccgcacgaaacccuucucaguccccguccuuaccgucgaagaaaugaccaauucccgcuuccccauaccccucgaaaaacucuucacgggucccucauccgcauucgucguccaaccccaaaauggaagaugcaccacugacggcguccuccuagggacaacccaacucuccgccguaaauaucugcaccuuccgcggagacgucacccacgucgcaggcgacacauucgccaugaaccucgcuucacuaaacuggaacaacuacgaccccaccgaagaaacccccgcuccccucggcacaccagacuucgucggccguauccacggcaugcuuacccaaaccacucguuccgacggcgccacacgagcccacaaagcaaccgucuccaccggcggagcagacuucacccccaaacuaggcuccguccguuacucaaccgacacuucaagcgaccucgaaguacgcgaaaacacaaaauucaccccaaucggcguccuccacuccuccgguggccaccgagcggagcccgaccaauggcgacuccccgaauacuccggacguaacguccacaacgugcaccuggcucccgcugucgccccaaccuuucccggcgaacaacuccuauucuuccgcuccacaaugcccggcugcggagguuaccccaacauggaccuugacugccuucuaccccaagaauggguacaacauuucuaccaagaagccgcccccgcccaauccgacgucgcccuccuccgcuucgucaacccagacaccggccgaguacucuucgaaugcaaacuucacaaauccggguacgugaccgucgcccacaccggcccacacgaccucguaaucccacccaacggcuacuuccgcuucgacuccuggguaaaccaauucuacacacucgcccccauggggaauggcaccggucgcagacgagcccucuaa

SEQ ID NO: 36090 - RNA, 1617 nt, Artificial Sequence
  derived and/or modified sequence opt11 from VP1__Norovirus__AHH44879
augaaaauggccagcaacgacgcaaaccccagcgacggcucagccgccaaccucguacccgaagucaauaacgaagucauggcacucgaaccaguagucggcgccgccauugccgccccuguagcaggccaacaaaacguaaucgaccccuggauacgcaacaacuucguccaagcuccuggcggagaauuuaccaucuccccaagaaacgcccccggcgaaauccuaugguccgccccucucggacccgaccucaaccccuaucucagccaccuagcaagaauguacaacggauaugccggcggauucgaaguccaagugguucucgccggcaacgccuucaccgccggcaagaucaucuucgccgccguaccaccaaacuuccccacagaaggucucuccccaucacaaguuacaauguucccccacaucaucguagacguacgccaacuagaacccguccucauaccccucccagacguccgaaacaacuucuaccacuacaaccaaucuaaagauagcacgaucaaacucaucgccaugcucuacacccccuuacgcgccaacaacgccggcgacgacguauucaccgucucuugccguguccucacccgacccucccccgacuuugacuuuauauuccucguacccccaaccgucgaaucccgcaccaagcccuucuccguacccguccucacagucgaagaaaugacaaacucccgcuuccccaucccccucgagaaacuauucaccggcccuucauccgccuucgucguacaaccacaaaacggccgcugcacaacggacggaguccucuuaggcacuacccagcucucagccgucaacaucugcaccuucagaggugacgucacacacgucgccggcgacacauucgccaugaaccuagccucacucaacuggaacaacuacgaccccaccgaagaaacacccgccccacucggaacaccagacuucgucggacgaauccauggcauguuaacccaaaccacccgcuccgacggagcaacccgcgcacacaaagcaaccguaucaaccggcggcgccgacuucacccccaaacucggaucuguccgcuacuccacugacaccuccucagaccuugaaguacgcgaaaacacuaaauucacccccauaggcguccuacacucauccggaggccaccgagccgagccagaccaauggcgccuccccgaauacuccggccgcaauguccacaacguccaccuagcuccagcagucgcccccacauuccccggcgaacaacuacucuucuuccgcucaaccaugccagguugcggcggauacccaaacauggaccuugacugccuucucccccaagaguggguacaacacuucuaucaagaagcugcucccgcccaauccgacgucgcacuccuacgauucgucaaucccgacaccggacgaguacucuucgaaugcaaacuccacaagucaggcuacgucacagucgcccauacaggcccccaugaucucguaauucccccaaauggcuacuuucgcuucgacucaugggucaaucaauuuuacacccuugcaccaauggggaacggaacaggucgccgccgagcccuauaa

SEQ ID NO: 36091 - RNA, 1617 nt, Artificial Sequence
  derived and/or modified sequence opt11 from VP1__Norovirus__AHH44880
augaaaauggcauccaaugacgccaaccccuccgacggcucugccgccaaccucguaccugaaguaaacaaugaagucauggcccucgaacccgucguaggagccgccaucgccgcgccagucgcagggcaacaaaacgucauagacccuuggauccgcaacaacuucguccaagcccccggcggcgaauuuacaaucagcccacgcaaugcucccggagaaauacucuggucugccccacuaggccccgaccugaaccccuaccucucacaccucgcccgcauguacaacggauaugcaggcggcuucgaaguccaagucguccucgcaggcaacgccuucacagccggaaaaauaauuuucgccgccguaccacccaauuuccccaccgaagggcucucccccucacaaguaaccauguucccccacauuaucgucgacguaagacaacuagaacccguccuaauaccccuacccgacguccgcaacaacuucuaccacuacaaccaaagcaaagacuccaccauuaaacucaucgccauguuauacaccccacuacgcgccaacaacgccggagacgacgucuucacagucuccugccgcguacucacccgaccuuccccagacuucgacuucaucuuccucgucccgcccacagucgaaucccguaccaaacccuucuccguccccguacucaccgucgaagaaaugaccaacagccgcuuccccaucccacucgaaaaacuauuuaccggacccuccucagccuucguaguccaaccacaaaacggccgaugcaccaccgauggcguacuccuaggaaccacccagcucuccgccgucaacaucugcacauuccguggagacgucacccacguagccggagacacauucgcaaugaaccucgccucucuuaacuggaacaacuacgacccaaccgaagaaaccccagcaccacucggcaccccugacuucguaggccgcauccacggcaugcucacccaaaccacaagaucugacggcgccacucgcgcccacaaagccaccguauccaccggcggugccgacuucacacccaaacucggcucaguacgcuauucaaccgacacauccuccgaccucgaaguccgcgaaaauacaaaauucacacccaucggaguccuccacuccuccggcggccaccgcgccgaaccagaccaauggcgacuucccgaauacuccggccgaaacguccacaacgugcaccuagccccagcagucgcccccaccuucccuggagaacaacuacuuuucuuccgcuccaccaugcccggaugcgggggauaccccaacauggaccucgacugccuucuaccacaagaauggguccaacacuucuaccaagaaaccgcacccgcacaauccgacgucgcacuccuacgcuucguaaacccagacaccggccgaguccuguucgaaugcaaacuacauaaaucaggcuacgucaccgucgcccacaccggaccucacgaccuugucauucccccaaacgguuacuuccgcuucgacagcuggguaaaccaauucuacacccuagcucccaugggcaacggcacaggcagacgccgcgcucucuaa

SEQ ID NO: 36092 - RNA, 1617 nt, Artificial Sequence
  derived and/or modified sequence opt11 from VP1__Norovirus__AHH44881
augaaaauggccuccaacgacgccaaccccagcgacggcucagccgcaaaucuugucccagaaguaaacaaugaaguaauggcccucgaaccagucguuggcgcagccauagcagccccugucgccggccaacaaaacguuauagaccccuggauccgaaacaacuuuguacaagcccccggcggcgaguucaccaucuccccucgaaacgccccuggugaaauccucugguccgcaccccuuggacccgaccucaacccauaucuaucccaccuagcccgaauguacaacggcuacgccggcggcuucgagguccaagucguccuagccgggaacgccuucacagcaggaaaagucaucuucgccgccguacccccaaacuucccaaccgaaggccuaucccccucccaagucacgauguucccucacaucauagucgauguccgccaacucgaaccaguacucaucccccuaccggacguacgcaacaacuucuaccacuacaaccaauccaaugacucgaccaucaaacuaaucgcaaugcucuauaccccucuucgagccaacaacgccggagacgacguuuucacagucuccugccgcguacucacccgccccucucccgacuucgacuucaucuuccucguaccaccaaccgucgaaucacgcaccaaacccuucuccguacccguccuaaccgucgaagaaaugaccaacucccgauuucccaucccccucgaaaaacuauucacaggccccucuuccgcauucgucguccaaccacaaaacggacgcugcaccacagacggaguccuccucggcaccacacaacuaucagccgucaacauaugcaccuuccgcggcgacgugacacauguugcuggugacaccuucgccaugaaccuagcaucucuaaacuggaauaacuacgaucccaccgaagaaaccccagcgccacuuggaacacccgacuucgucggacgaauccacggcaugcucacccaaaccacccgcuccgacggagccaccagagcgcacaaagcaaccguauccacaggaggcgcagacuucacacccaaacucggauccguccgcuauuccacagacacuuccuccgaccucgaaguacgcgaaaacacaaaauucacacccaucggcguccuucacuccuccggaggccaccgagcagaacccgaccaauggcgucuaccagaauacagcggccgcaacguccacaacguacaccucgccccggccgucgcccccaccuucccaggugaacaacuccucuucuuccgcuccacaaugcccggaugcggaggcuaccccaacauggaccucgacugccuacuaccacaagaauggguacaacacuucuaccaagaagcagcaccagcacaaucagacgucgcccuccuacgcuucguuaacccagacaccggccgcguacuauucgaaugcaaacuucacaaauccggauacgucaccgucgcccacaccgggccacacgaccuaguaauuccacccaacggcuacuuccgcuucgacuccugggucaaucaauucuauacccuagcccccaugggaaacggcacaggacgccgacgcgcccuauaa

SEQ ID NO: 36093 - RNA, 1617 nt, Artificial Sequence
  derived and/or modified sequence opt11 from VP1__Norovirus__AHH44884
augaaaauggccuccaaugacgcaaaccccucagacggaucagccgcaaaucucguucccgaagucaacaacgaagucauggcccucgaacccgucguuggugccgccauagccgcccccguagccggccaacaaaacgucauagacccauggauacgcaacaacuuuguucaagccccaggaggcgaguucaccauaucaccccgcaacgccccaggcgaaauacucuggucagcuccccucggcccagaucuuaaccccuaccuaucccaccuggccagaauguauaacggcuacgccggcggcuucgaaguacaagucguccuagccggaaacgccuucacagccggcaaaauaauauucgcagccgucccacccaacuuccccacugaaggacuauccccaucccaggucacaauguucccccacauaauagucgacguacgacaacuagaacccguccucaucccccucccagacgucagaaauaacuucuaucacuacaaccaauccaacgacuccaucaucaaacuaauagccauguuauauacaccacuacgggccaacaacgccggcgacgacgucuucaccgucuccugccgaguucucacccgccccuccccagacuucgacuucauuuuccuaguacccccaaccgucgaaucccgaacaaagcccuucacaguccccguccucaccguggacgaaaugaccaacucccgauuccccaucccccucgaaaaacucuucaccggccccucauccgccuucgucguccaaccccaaaacggccgcugcaccaccgacgguguccuccucggaacaacgcagcucucugcaguaaacaucuguaccuuccgaggcgacgucacccacguauccgacaaaaccuucgcuaugaaccucgccucccccaacuggaacaacuacgaccccacagaagagauccccgcaccccucggcaccccugacuucguaggacgcauucauggcaugcuaacccaaacuacaagacgcgacggcgcaaccagaggccacaaagccaccgucucgaccggcggcgccgacuucacccccaaacucggauccguacgcuauaucaccgacaccaccgaugaccucgaaguccgcgaaaacaccaaauucacccccaucggcguacuccacucauccggcgagcaccgugcagaaccagaccaauggcgucuccccgaauauucagggcgaaacguucacaacguacaccucgcccccgcaguugcacccacguucccgggagaacaacuacucuucuuccgaucagcacuacccggaugcggaggauacccaaacaccgaccucgacugccuacuaccacaagaauggguccaacauuucuaccaggaagccgcccccgcccaauccgacgucgcacuccuccgauucgucaaccccgacaccggccgcguccucuucgaaugcaaacuccacaaauccggauaugucaccguugcccacaccggaccccacgaccucgucaucccaccaaacggcuacuuccgcuucgacucuuggguaaaccaauucuacacccucgcacccaugggcaacggcaccggccgacgccgcgcccuauaa

SEQ ID NO: 36094 - RNA, 1620 nt, Artificial Sequence
  derived and/or modified sequence opt11 from VP1__Norovirus__AHH44886
augaaaauggccuccaacgacgccucaccaucugacggcuccgcagccaaucucguccccgaaguaaacaaugaagucauggcacuugaacccgucgucggcgcggccaucgccgcacccgucgcaggccaacaaaacgucaucgacccguggauccgcaacaauuucguccaagcccccggaggagaguucaccgucucaccccgaaacgcaccaggagaaauccucugguccgcaccccucggcccugaccucaaccccuaccuuucccaucucgcccguauguacaacggcuacgcaggcggauucgaaguccaagucauccucgcaggcaacgcauucaccgccggcaaaaucaucuucgccgcuguacccccaaauuucccgaccgaaggccucucccccucccaagucacaauguucccucacaucguagucgacguacgacaacuagaacccguacucauaccccuacccgacguccgaaacaacuucuaccacuacaaucaauccaaagaccccaccauaaaacucaucgccaugcuauauacaccccuaagagccaacaacgccggagaagacguauuuaccguauccugccgcguccucacccgacccucuccagauuucgacuucaucuuccucgucccucccaccgucgaaucccgaucaaaacccuucaccguccccauccuuaccgucgaggaaaugaccaauagcagguuccccauaccccucgaaaaacucuucaccggacccuccggcgcauucgucguacaaccucaaaacggucgcugcaccaccgauggcguccuacucggcacaacccaacucucaccaguaaacaucugcaccuuccgcggagaccucacccacuucaccggaacuuccgaauaugccaugaaccuugccucccaaaauuggaacaacuacgacccaaccgaagaaauccccgcaccacucggagcccccgacuucguuggcaaaauccgaggaaugcucacucaaaccacccgacgcgacggcucaacccgcggacaccgcgccaccuuauccacaggcucagcacauuucacccccaaacucggauccauccgauucuccacugauacaaacaacgacuuugaagccggucaaaacaccaaauucacacccgucggcgucuuccaagaaggugacaaucaccaaaacgaaccgcaacaauggguguuacccaacuacuccggcgccacugcccacaacguacaucuagcccccgccgucgcccccgccuuccccggcgagcaacuccucuucuuccgaucaaccaugccaggaugcggaggcuaucccaacaugaaccucgauugccuccuuccccaagaauggguccaacacuucuaucaggaagccgcacccgcacaaagcgacguagcccuccuccgauucguaaaucccgacacaagccgcguccuauucgaaugcaagcuccacaaauccggauacguaaccgucgcacacaccggacaacacgaccucgucauacccccaaacggauacuuccgauucgacucuuggguuaaccaauucuacacacucgcccccaugggaaacggaacuggccgucgccgagcccuguga

SEQ ID NO: 36095 - RNA, 1620 nt, Artificial Sequence
  derived and/or modified sequence opt11 from VP1__Norovirus__AHH44888
augaaaauggccuccaacgacgccucaccaucugacggcuccgcagccaaccucgucccagaagucaacaacgaagugauggcucucgaacccgucgucggcgcagccaucgcagcacccgucgccggacaacaaaacgucauagaccccuggauccgcaacaacuucguccaagcccccggaggagaguucacaguaucuccccgcaacgcuccaggcgaaauccucugguccgccccacucgggcccgaccucaacccauaccucucccaccuugcccgaauguacaacggcuacgcaggcgguuucgaaguccaaguaauccucgccggcaaugccuuuaccgccggcaaaaucaucuucgccgcaguaccacccaauuuccccacugaaggccucucccccucccaaguuacaauguucccccauauaguugucgacguucgucaacuugaacccgugcuaaucccucuacccgacguucgaaacaacuucuaccacuauaaccaauccaaagaccccacaauaaaacucaucgccaugcucuacaccccacuacgcgccaacaacgccggcgaagacgucuuuacugucuccugucggguccuuacccgccccucaccagacuucgacuucaucuuccuaguaccacccaccgucgaaucccgcucuaaacccuucacaguccccauccuuaccguugaagaaaugacaaacucccgauucccaaucccccucgaaaagcuauucacaggccccucaggggcauucgucguucaaccccaaaacggccgcugcaccaccgacggaguacuacucggcacaacucaacucucccccgucaacauaugcacuuuccgcggagaccucacacacuucacuggcaccucugaauacgcaaugaaccucgccagccaaaacuggaacaacuaugauccaacugaagaaauccccgcuccccucggcgcaccugacuucguaggaaaaauccgcggcaugcucacccaaaccacccgccgugacggauccacccgaggccaccgcgccacccucuccaccggaucagcccacuucacccccaaacuaggaaacauacgcuuuucaacugacaccaacaacgacuucgaagcuggccaaaacaccaaauucaccccagucggcgucuuccaagaaggcgacaaucaccaaaacgaaccccaacaauggguucuccccaacuacuccggugcaaccgcccacaacguccaccuagcccccgccgucgcgcccgccuuccccggcgaacaacuccucuucuuccgcuccaccaugcccggcuguggcggcuacccuaacaugaaccucgacugccucuuaccacaagaauggguacaacacuucuaccaagaagccgcaccagcccaauccgacguagcccuacuccgcuucgucaacccagacaccucacgcguacucuucgaauguaaacuccacaaaucaggcuacgugaccgucgcccacaccggccaacacgaccuagucaucccacccaacggcuacuuccgauucgacuccugggucaaccaauucuacaccuuagccccuaugggaaacggcacaggcagaagacgcgcccuauag

SEQ ID NO: 36096 - RNA, 1620 nt, Artificial Sequence
  derived and/or modified sequence opt11 from VP1__Norovirus__AHH44889
augaagauggcauccaacgacgcaucccccucagacggcucugcagccaaccuagucccagaagucucaaacgaagucauggcccuagaaccuguugucggcgccgcgaucgccgcccccgucgccggacaacaaaacguuaucgaccccuggauacgcaacaacuucguccaagcacccggaggcgaauuuaccgucucaccacguaacgcacccggagaaauacucuggucagcaccacugggacccgaccucaaccccuaccucucccaccucgcccgcauguacaacgguuacgcaggcggcuucgaaguccaagucauccuagcuggcaaugccuucaccgccggaaaaaucaucuucgccgccguacccccaaacuucccaaccgaaggccuaucaccaucccaagucacaauguucccccauauagucgucgacguccgccaacucgaacccguccuuaucccccuucccgacguccgcaacaacuucuaccacuacaaccaaagcaaagaccccacuauuaagcucaucgcaaugcuuuacacaccccuccgcgcaaacaacgcgggcgaggacgucuucaccgucucaugccgcguacucacccgccccuccccagacuucgacuucauauuccuagucccacccaccgucgaaucacguagcaaacccuucacaguaccaauucucacagucgaagaaaugaccaacucccgcuucccuauaccccuagaaaaacucuuuaccggaccaucuggcgccuucgucguccaaccacaaaacggccgauguacaacagauggcguacuuuuaggcacuacccaacucagccccguaaauauuuguaccuuccgcggcgaccucacccacuucaccggaacaagcgaauacgccaugaaccucgcaucccaaaacuggaacaacuacgaucccaccgaagaaauccccgccccucucggcgccccagacuucguaggcaaaauccgcggaaugcuaacccaaaccacccgccgagacggcagcacccgaggccacagagccacacuaucaaccggcuccgcccacuucacaccaaaacuaggauccauacgcuuuuccacagacacgaacaacgacuucgaggccggccaaaacacaaaauucacccccgucggaaucuuucaagaaggcgacaaccaccaaaacgagccacaacaauggguacucccuaacuacagcggagcaacagcccacaacguccaccuggcccccgccgucgccccagccuuccccggagaacaacuccuguucuuccgcagcacaaugcccggaugcggaggcuaccccaacaugaaccuggacugccugcuaccccaggaauggguccagcauuucuaucaggaagcagcccccgcccaauccgacgucgcccuccuccgcuucguaaaccccgacaccucccgcguacuauucgaaugcaaacuccacaaaucaggauacgucacaguagcacacaccggacaacacgaccuaguuauuccacccaacggauacuuccgauucgacuccuggguaaaccaauucuacacacuggcucccaugggcaacggaaccggccgccgccgcgcacuauaa

SEQ ID NO: 36097 - RNA, 1620 nt, Artificial Sequence
  derived and/or modified sequence opt11 from VP1__Norovirus__AHH44890
augaaaauggccuccaacgaugccucccccuccgacggcucagccgccaaccuaguccccgaaguaaacaacgaggucauggcacuagaaccagucguaggcgccgccaucgccgcccccgucgcaggccaacaaaacguaaucgaccccuggauccggaauaacuucguucaagcaccuggcggagaguucaccgucucaccccgcaacgcccccggcgaaauccucugguccgcgccgcucggccccgaccucaacccuuaucuuucccaccucgcccgcauguauaacgguuacgcuggaggcuucgaaguacaagucauacucgccggaaacgccuucaccgccggcaaaaucaucuucgcagccgucccacccaacuuccccaccgaaggacuaucccccucccaagucaccauguucccccacaucguuguagacguccgccaacuggaaccuguccuaaucccccugccagacgucagaaacaacuucuaccacuacaaccaauccaaggaccccaccaucaaacucaucgcaaugcucuacaccccacugcgcgcaaacaacgcgggggaagacguauucaccguuuccugccgcguacucacccgacccuccccugacuucgacuuuaucuuucucgucccaccaaccgucgaaucccgcuccaaacccuucacagucccaauacucaccguagaagaaaugaccaacucccgcuuccccauaccccucgaaaaacucuucaccggccccucaggcgccuucgucguacaaccccaaaacggccgcugcaccacagacggcguacuguuaggaaccacccaacucucacccgucaacauuuguaccuuccgcggcgaccucacacacuucaccgguacuucagaauacgcuaugaaccucgccucccagaacuggaacaacuacgacccaacugaagaaauccccgccccucucggcgcccccgacuuugucggaaaaaucagaggcaugcuaacccaaaccacccgccgagacggcagcacccgcggacacagagccacgcucuccacaggcagcgcacacuucacccccaagcucggcaacauucgcuucagcaccgacaccaacaacgauuucgaagcuggccaaaacacaaaauuuacccccguaggcguauuccaagaaggcgauaaccaccagaacgaaccccaacaaugggugcuccccaacuacucaggcgcaaccgcacacaacguccaccucgcacccgccgucgcccccgccuucccuggagaacaacuacuauucuucagauccaccaugcccggcugcggcggcuaccccaacaugaaucucgacuguuuacucccccaagaauggguacaacauuuuuaccaagaagccgccccagcucaaagugaugucgcgcuccuacgcuucguaaacccagauacaucccgcguccuuuucgaaugcaaacuacacaaaaguggauauguaaccgucgcccacaccggucagcacgaccucguaauacccccaaacggcuacuuccgcuucgacucauggguuaaccaauucuacacccucgcaccuaugggaaacggcacaggacgucgccgcgcccucuaa

SEQ ID NO: 36098 - RNA, 1620 nt, Artificial Sequence
  derived and/or modified sequence opt11 from VP1__Norovirus__AHH44891
augaagauggccagcaacgacgccucccccuccgacggaucagcagccaaccuaguaccugaaguuaacaacgaaguaauggcccucgaacccgucgucggcgcagcgaucgccgcaccaguagccggccaacagaacguaaucgaccccuggauccgcaacaacuucguccaggccccaggcggcgaguucaccgucucaccccgcaaugcaccuggagaaauccucugguccgcgccccucggccccgaccucaaccccuaccucagccacuuagcccgaauguacaacggcuacgccggcggauucgaaguccaagucauccuagccggcaacgccuucacagcaggcaaaaucauauucgcagccguacccccuaacuucccaacagaaggacucucccccucccaagucacaauguucccucacaucguugucgacguccgacaacucgaaccaguccucaucccgcuucccgacguacggaacaacuucuaccacuacaaccaaaguaaagaccccaccauuaaacuaauagcaaugcucuacacgccccuccgagcuaacaacgcaggcgaagacgucuuuaccguauccugucgcguucucacccgcccaucaccagacuucgacuuuauuuuccucguaccgcccaccgucgaaucacgcuccaaaccguucaccguccccauacucaccguugaagaaaugaccaacucccgauuccccaucccccucgaaaaacucuucacaggucccucaggcgccuucgucguacaaccccaaaacggacgaugcaccaccgacggcguacuccuaggcacuacccagcucucccccgucaacaucugcaccuucagaggagaccucacccacuucacuggcacaagcgaauaugccaugaaccucgccucccaaaacuggaacaacuacgaccccaccgaagaaauacccgccccacucggagcacccgacuucgucggcaaaauacgcggcaugcucacgcaaaccacucgccgugacggcuccacgcgaggucaccgcgcaacccucuccaccggcuccgcccauuucacaccaaaacuaggcaacauccgauucuccacagacacuaacaacgacuuugaagccggccaaaacaccaaauuuacacccguaggcgucuuccaagaaggcgacaaccaccaaaacgaaccccaacaauggguccuccccaacuacuccggcgcaaccgcccauaacguccaccuagcccccgcgguagcccccgcauucccaggcgaacaacuacuauucuuccgcuccaccaugcccggaugcgguggcuacccaaacaugaaccucgacugucuccuuccacaagaauggguccaacacuucuaccaagaagccgcacccgcccaauccgacguagcccuccuccgcuucgucaacccugacaccucccgcguccucuucgaaugcaaacuccacaagagcggcuacguaaccguagcgcacaccggucaacacgaccucgucauacccccuaacggcuacuuucgcuucgacucaugggugaaccaauucuacacccucgcacccaugggcaacggcacaggucgacgccgagcccuauaa

SEQ ID NO: 36099 - RNA, 1620 nt, Artificial Sequence
  derived and/or modified sequence opt11 from VP1__Norovirus__AHH44893
augaaaauggccuccaacgacgccagcccuuccgacggcucagcagcaaaccuaguccccgaagucaacaacgaaguaauggcccuagaacccgucgucggagccgcaaucgcagcacccguagcuggucaacaaaacguaaucgauccauggauccgaaacaacuucguacaagcccccggaggcgaguucaccguaucaccccgcaacgcaccaggagaaauacuaugguccgcaccccucggccccgaucucaaccccuaccucucccaccucgcccgaauguacaacgguuacgccgguggcuucgaaguccaaguaauccuagccggaaacgcguucaccgccgguaaaaucaucuuugccgcugucccacccaacuuccccacagaaggccucucacccucccaagucacuauguucccccauauagucgucgacguccgccagcuagaaccagucuuaaucccacucccagacguacgcaacaacuucuaucacuacaaucaaucaaaagacccuaccaucaaacuaaucgcuaugcucuacaccccacuacgcgccaauaacgccggcgaagacguauucaccgucuccugccgcguacucacccgcccaucacccgacuucgacuucaucuuccuugucccucccaccgucgaaucccgcuccaagcccuuuacaguucccauccucaccgucgaagaaaugacaaacucccgcuuucccaucccucuagaaaaacucuucaccggacccuccggugcauucgucguccaaccccaaaacggccgcugcacaaccgacggcguucuccucggaaccacccaacucucacccgucaacaucugcaccuuccgcggcgaccuuacccacuucacaggcaccuccgaauacgcaaugaaccucgcaagccaaaauuggaauaacuacgaccccaccgaagaaauucccgcaccccuaggagcccccgacuucguaggcaaaauccgcgguaugcucacccaaaccacccgccgcgacggauccacccgcggccaccgagccacccucucaacaggcuccgcccacuucaccccgaaacucggcaacaucagauucuccacagacaccaacaaugacuucgaagccggacaaaacacaaaauucacaccaguuggugucuuccaagaaggagacaaccaccaaaacgaaccacaacaauggguacuccccaacuacuccggugccacugcccacaauguccaccucgcccccgccguugcacccgcauuccccggcgaacaacuacuauucuuccgauccaccaugcccggaugcggaggauacccaaauaugaaccuagacugccuacucccccaagaauggguccaacacuucuaccaagaagcagcacccgcccaaucugaugucgcccuucuacguuuugucaacccugacacaucccgcguccuauucgaaugcaaacuacacaaauccggcuacgugaccguagcccacacaggccaacacgaccucgucauaccacccaacggcuacuuucgcuucgacuccugggucaaccaauucuacacccuagccccaaugggcaauggaaccggacgucgccgcgcccucuag

SEQ ID NO: 36100 - RNA, 1620 nt, Artificial Sequence
  derived and/or modified sequence opt11 from VP1__Norovirus__AHH44894
augaaaauggccucaaaugacgccucacccucagacggcucugcagccaaccuaguacccgaagucuccaacgaagucauggcgcucgaaccagucgucggagcagcaauagccgcccccguagcaggucaacagaacguaauagauccauggauacgaaacaacuucguccaagccccuggcggggaguucacaguaagcccaagaaacgcccccggcgaaauacuuugguccgcaccucuaggccccgaucucaacccauaccuaucacaccuagccagaauguacaacggauacgccggcggauucgaaguccaagucauccucgccggcaacgcauuuaccgccggcaaaaucauauucgccgccguaccacccaacuuccccaccgaaggacucucacccucacaaguuaccauguucccccacauagucgucgacguacgccaacucgaacccguccuaaucccucugccagacguccgcaacaacuucuaccacuacaaccaaagcaaagacccaaccauaaagcucauagccaugcuuuacacuccccuacgcgccaacaaugccggcgaagacgucuucacaguauccugccgaguacucacaagaccgucccccgacuucgacuucaucuuccuaguaccaccaaccguggagucccguucaaaacccuucaccguccccauccugaccguagaagaaaugacaaacucccgcuuccccauaccccucgaaaaacuauuuaccggacccuccggcgccuucgucguccaaccccaaaacggccgcugcaccaccgauggaguccuccucggcaccacgcaacuaagccccgucaacaucugcacuuuccgcggagacuuaacucacuucaccggcaccucagaauaugccaugaaccuagccucccagaacuggaacaacuacgacccaacagaagagaucccagcaccacucggagcccccgacuucgucggcaaaauacgaggcaugcugacccaaaccacccggcgcgacggcagcacgcgcggccaccgagcuacccuuucuacaggcucggcccacuucacccccaaacucggcagcauccgauucuccacugacacuaacaacgacuucgaggcuucacaaaacaccaaauucacaccagucggcgucuuucaagaaggcgauaaucaccagaacgaaccacaacaauggguccuccccaacuacuccggcgcaacagcacacaacguccaccucgcccccgcaguagcaccagcuuuccccggcgaacaacuccuuuucuuucguuccaccaugccaggcugcggcggcuaccccaacaugaaccucgacugucuccucccccaagaauggguccaacacuucuaccaggaagcggcccccgcccaaagcgacgucgcccuacuaagauucguaaaucccgacaccucccgaguacucuucgaaugcaaacuccacaaauccggcuacgucacagucgcccacacuggacaacacgaccucguaauaccacccaacggcuacuuccgcuucgacuccuggguaaaccaauucuacacccuugcgcccaugggaaacggcaccggacgacggcgcgcccuauaa

SEQ ID NO: 36101 - RNA, 1620 nt, Artificial Sequence
  derived and/or modified sequence opt11 from VP1__Norovirus__AHH44895
augaaaauggccuccaacgacgccuccccaucugauggaucagccgcuaaccuagucccugaggucaacaacgaggucauggcacucgaacccgucgucggcgcagcaaucgccgcaccugucgcaggucaacagaacguaaucgaccccuggauccgcaacaacuucguacaagcccccggcggcgaguucacagucuccccacgcaacgcccccggugaaauacucuggucagcaccacuuggccccgaccucaacccauaccucucucaccuagcccgaauguacaacggcuaugcuggcggcuucgaaguacaagucauccuagcaggcaacgccuucacugccggaaaaaucaucuucgcagccgucccuccuaacuucccaaccgaaggccucuccccuucccaaguaaccauguucccgcacaucgucgucgacguacgucaacucgaacccguccucaucccccuacccgacguccgcaacaacuuuuaccacuacaaccaaaguaaagacccaacaauaaaacuaauagccaugcucuacaccccacuccgcgccaacaacgccggcgaagaugucuucaccgucuccugucgcguccucacccgccccagcccagacuuugacuucaucuuccucguaccucccaccguagaaucccgcuccaaaccauucacuguaccaauccuuacagucgaagaaaugacaaacucccgcuuccccauuccacuagaaaaacucuucaccggccccuccggagccuucgucguucaaccacagaacggucgaugcacaacagacggcguucuucuaggaaccacccaacuuagccccgucaacaucugcaccuuccgaggcgaccuaacacauuucaccggcaccuccgaauacgcaaugaaccucgccucccaaaacugggacaacuacgacccaacagaagaaauaccagcaccccucggagcccccgacuucgucggcaaaauucgcggcaugcucacccaaaccacacgccgagauggguccacccgcggacaucgagccacccuuuccaccggaagcgcccacuuuacccccaagcucggaaacauccgguucucaaccgacaccaacaacgacuucgaagccggacaaaacaccaaguucacucccgucggaguauuccaagagggagacaaccaccaaaacgaaccccaacaauggguccuucccaacuacuccggcgccaccgcccauaacguccaccucgcuccagcaguagcucccgcuuucccaggcgaacaacuccuauucuuccgcucaaccaugcccggcugcggcggcuacccaaacaugaaccucgacugccuccucccacaagaauggguccaacacuucuaccaagaagccgcacccgcccaauccgacguugcccuccuccgcuuuguuaaccccgacaccagcagaguccuauucgaaugcaaacuacacaaauccgguuaugucaccguagcccacaccggccaacacgaccucguaauacccccaaacggcuacuuccgauucgauuccuggguaaaccaauucuacacccucgcacccaugggaaacggcaccggccgcagacgagcccucuaa

SEQ ID NO: 36102 - RNA, 1620 nt, Artificial Sequence
  derived and/or modified sequence opt11 from VP1__Norovirus__AHH44896
augaaaauggcuucaaacgaugcaucacccuccgacggauccgcagccaaccucguccccgaagucaacaacgaagucauggcccucgaaccagucguuggcgcagccaucgccgcccccguugccggacaacaaaacgugaucgaccccuggauccgcaauaacuuuguacaagcacccggcggcgaguucaccguaucgcccagaaacgcccccggcgaaauacucugguccgcaccccucggcccagaccuaaaccccuaccucucacaccucgcccguauguacaacggcuaugcaggcggcuucgaaguccaaguaauucuagccggcaacgcauucaccgccgggaaaaucaucuucgccgccguacccccaaacuucccaaccgaaggacucuccccuucccaagucacuauguuuccccacaucgucgucgacguccgccaacucgaaccuguccuaaucccccuuccagacguccgaaacaacuucuaccauuauaaccaauccaaagacccaacaauaaaacucaucgcaaugcuauacacaccccuaagagcuaacaacgcaggagaagacguauucaccguuagcugccgcguucucacccgacccagccccgacuucgacuucaucuuccucgucccacccacagucgaaucacgcucaaaacccuucacuguacccaucuuaaccgucgaagaaaugaccaacucucgauucccaaucccacuugaaaaacucuucaccggccccuccggcgcauucgucguccaaccccaaaacggccgcugcaccaccgacggaguccuacuuggcacuacccaacuaucccccgucaacauaugcacuuuccgcggugaccucacacacuucacgggcaccucagaauacgccaugaaccuagccagccaaaacuggaacaacuacgaccccaccgaagaaaucccagcaccccuaggagcccccgauuuugucgguaaaauccgaggcauguuaacacaaaccacccgccgagacgguagcacccgcggccaccgcgccacucuaucaacaggauccgcacacuucacccccaagcuaggaaauaucagauucucaaccgacacaaacaacgacuucgaagcaggccaaaacaccaaguucaccccugucggagucuuccaagaaggugacaaccaccaaaacgaaccacaacaauggguacuacccaacuacuccggcgcaaccgcccacaacguccaccuugcccccgccguagccccagcauuccccggcgaacaacuacucuucuuccgcuccaccaugcccggaugcgguggauaucccaacaugaaccucgacugccuacuuccccaagaauggguccaacacuucuaccaagaagcagcucccgcucaauccgacgucgcccuccuacgcuuuguaaacccugacacaucccgcguacuauucgaaugcaaacuccacaaauccggcuacgucaccgucgcacauacaggccaacacgaccucgucaucccacccaacggauacuuccgauucgacuccugggucaaccaguucuacaccuuggcucccauggguaacggaaccggacgacgccgcgcccucuaa

SEQ ID NO: 36103 - RNA, 1620 nt, Artificial Sequence
  derived and/or modified sequence opt11 from VP1__Norovirus__AHH44897
augaaaauggcuuccaacgacgccucccccucagacggcucagccgccaaucuaguccccgaagucaacaacgagguaauggcccucgaacccguagucggcgccgccauugccgcccccgucgccggacaacaaaacgucaucgacccuuggauccgcaacaacuucguucaagccccugguggagaguucaccgucucaccuagaaacgcaccaggugaaauccucuggucggcaccccuaggacccgaucucaaccccuaccucucucaccucgcccguauguacaauggauacgcaggcggauucgaaguccaagucauacuggcaggcaacgcuuucacagcuggaaaaaucaucuuugcagcugucccucccaacuuccccacugaaggccucagccccucucaagucaccauguucccccacaucgucgucgacguacgccaacucgaacccguacucaucccacuucccgacguccgcaacaacuucuaccacuacaaccaauccaaagaccccacaaucaaacucauagcaaugcucuauacaccccuacgcgcaaacaacgccggcgaagacgucuucacaguauccugccgcguucucacccgccccucuccagacuucgacuucaucuuccucgucccacccacugucgaaucacguucuaaacccuucacaguccccauccuaaccguagaggaaaugaccaacucccgcuuccccaucccauuagaaaaacuauucacuggccccuccggcgccuucgucguccaaccccaaaacggcagaugcaccacagacggcguacuacucgguaccacccagcucucaccagucaacauaugcaccuuucgcggagaccuaacccacuucaccggcaccuccgaauacgcaaugaaccuagccucccaaaacuggaacaacuacgaccccaccgaagaaauacccgcaccacucggagccccagacuucgucggaaagauacgaggaaugcucacccaaaccacccgacgagacggcuccacccgcgggcaccgcgccacacucuccaccgguucagcccacuucacaccaaaacuaggaaauauccgauucucaaccgacaccaacaacgacuucgaagccggccaaaacacaaaauucaccccagucggugucuuccaagaaggcgacaaccaccaaaacgaaccccaacaauggguccucccaaacuacuccggcgccacagcccacaacguacacuuagcaccagcagucgcccccgccuucccuggagagcaacuacuauucuuccguucaaccaugcccggcuguggaggauaccccaacaugaaccuagacugccuacucccccaagaauggguacaacacuucuaccaagaagccgcacccgcacaauccgacgucgcccuacuccguuucguuaaccccgacaccucccggguacuuuucgaaugcaaacuccacaaaucaggcuacguuaccgucgcgcacaccggccaacacgaucucguaauuccacccaacggcuacuuccgcuucgacucuuggguaaaccaauucuacacacucgcacccauggggaacggaaccggccgacgcagagcccuuuaa

SEQ ID NO: 36104 - RNA, 1620 nt, Artificial Sequence
  derived and/or modified sequence opt11 from VP1__Norovirus__AHH44899
augaaaauggccuccaacgacgccagccccagcgacggcuccgccgcaaaccucguccccgaagucaacaacgaaguaauggcacuagaacccguugucggagccgcuaucgccgcccccgucgccggacaacaaaacguaaucgaccccuggauccgcaacaacuucguccaggcucccggcggcgaguucaccgucucaccccgcaacgcccccggcgaaauacuuugguccgcaccccuaggccccgaccuaaaccccuaccucucacaccucgcacgcauguauaacggcuacgcaggcggcuucgaaguccaagugauccuugcgggcaacgccuucacugcaggcaaaauuauuuucgcggcaguacccccaaacuuccccacugaaggccucuccccaucccaagucaccauguucccccacauugucgucgacgugagacaacuggaaccaguccuaaucccucuccccgacguccgcaacaacuucuaccacuacaaccaaucaaaagaccccaccaucaaacuaaucgccaugcucuacacaccccuacgagcaaacaacgccggcgaagacgucuuuaccgucuccugccgcguacucacccgcccgucccccgacuucgauuucauauuccuagucccaccaaccgucgaaucacgauccaaacccuucaccguaccaauucucacaguagaagaaaugacaaacucccgcuuccccaucccacucgaaaaacuauucaccggucccucaggagcauuugucguccaaccccaaaacgguagaugcacaaccgacggcgugcugcucggaaccacccaacucucccccguaaacaucugcacauuccgaggcgaccucacccacuucaccgggaccuccgaauacgccaugaaucucgccucucaaaacuggaacaacuacgaccccacagaagaaauccccgcaccacucggcgcacccgacuucguaggcaaaauccgaggaaugcucacacaaacaaccagacgcgacggcuccaccagaggucaccgagccacccucagcaccggcuccgcccauuucacccccaaacucggaaauauacguuucucuaccgacaccaacaacgacuucgaagccggccaaaacaccaaauucacuccugucggcgucuuccaagaaggagacaaccaccaaaacgaaccccaacaauggguccuccccaacuacagcggagccacagcacacaacguccaucucgcacccgcaguagcacccgcuuucccaggagaacaacuacuauucuuccgcuccaccaugcccggcugcggaggcuacccaaacaugaaccucgacugccuacuuccccaagaauggguacaacacuuuuaucaagaagccgccccagcacaaagcgacguagcccuccuacgauucguaaaccccgacacaucucgcguccuauucgaaugcaaacuucacaaauccggcuacgucaccguagcccacacaggccaacacgaccucgucauaccuccaaacggcuacuuccgcuucgacuccugggucaaccaauucuacacucucgcacccaugggcaacggcaccggccgacgacgcgcacucuaa

SEQ ID NO: 36105 - RNA, 1620 nt, Artificial Sequence
  derived and/or modified sequence opt11 from VP1__Norovirus__AHH44900
augaaaauggccagcaacgacgcaucccccucagacggcucagcagccaaccucguacccgaagucaacaacgaaguaauggcacucgaacccgucgucggagccaccauagccgcccccguagcuggacagcaaaacguaauagacccuuggauccgaaacaacuucguccaagcccccggcggagaguucacaguauccccucgcaacgcccccggagaaauccuuuggucagcaccccucggccccgaccucaaccccuaccuaucacaccuagccagaauguacaacggauacgccggaggcuucgaaguccaaguuauacuagccggcaacgccuucaccgcaggaaagauaaucuucgcagccgucccucccaacuuccccaccgaaggccuuucacccucccaagucacuauguucccacacaucgucgucgacguccgccaacucgaacccguccucaucccacuccccgacguucgcaacaauuucuaccacuacaaccaauccaaagacccaaccaucaaacuuaucgcaaugcuauacacuccacuucgcgccaacaacgccggcgaagacguuuucacagucucuugucgagugcuuacccgccccuccccagacuucgacuucaucuuccuagucucccccaccgucgaaucccgcucaaaacccuucacaguccccaucuuaacaguugaagaaaugacuaacucccgcuuccccauuccucucgaaaaacucuucacaggccccuccggcgccuucguaguacaaccucaaaacggacgcugcacuaccgacggcguacuucucggcaccacccagcucucccccgucaacaucugcacauuccgcggcgaccucacccacuucaccggaaccucagaauacgcaaugaaccuugcgucucaaaacuggaacaacuacgaccccacagaagaaauucccgccccacuuggcgcaccggacuucgucggcaagauacgcggcaugcucacccaaaccacacgacgcgacggaucuacccguggccaccgagcaacccucucaacaggcucagcccacuucaccccaaaacuaggaaacauccgguucucaaccgacacaaacaacgacuucgaagcaggucaaaacacaaaguucacccccgucggcgucuuccaagaaggugacaaucaccaaaacgaaccccaacaaugggucuuaccaaacuacucaggcgcaacugcacacaacguacaccucgccccagccgucgcacccgccuucccuggcgaacaacuacucuucuuccgguccacaaugccuggcugugguggauacccuaacaugaaccuagacugucuacuaccacaagaauggguccaacacuucuaccaagaagccgccccugcccaguccgacgucgcacuccuacgauucguuaaccccgacaccucccgcguccucuuugaauguaaauuacacaaaucaggauaugucacaguagcccacaccggccaacacgaccucguaaucccacccaauggcuacuuucgauucgacucuugggucaaccaauucuacacccucgcucccauggguaacggcaccggacgccgacgcgcacucuaa

SEQ ID NO: 36106 - RNA, 1620 nt, Artificial Sequence
  derived and/or modified sequence opt11 from VP1__Norovirus__AHH44902
augaagauggccucaaacgacgccucacccuccgacggaucugccgccaaccucguccccgaagucaacaacgaagucauggcccucgaacccgucgucggagccgcuauagcugccccagucgccggccaacaaaacguaauagaccccuggauccgcaauaacuucguacaagcaccugggggcgaauuuaccgucuccccaagaaacgcuccaggcgaaauacuauggucagcaccacucggcccagaccuuaacccauaccucucacaccucgcccgcauguacaacggcuacgccggcggcuucgaaguccaaguaaucuuagccgguaacgcauucacugccggcaaaauuaucuuugccgcagucccucccaacuuccccaccgagggccuaucccccucccaagucaccauguucccccacaucgucgucgauguacgccaacuugaacccguccuaaucccacuaccugacguccgcaacaacuucuaccacuacaaccaaucuaaagaccccaccaucaaacuaauugcaaugcuauacacaccccuccgcgccaacaacgcaggcgaagacgucuucaccgucuccugcagaguacucacccgaccaucccccgacuucgacuucaucuuccuuguaccucccaccgucgaaucccgcuccaaaccauucacaguacccauccucaccgucgaagaaaugaccaacagccgcuucccaaucccccuugaaaaacucuucaccggacccuccggcgcauucgucguucaaccccaaaacggacgcugcaccaccgacggcguccuacucggaacaacccaacuauccccugucaacauauguacauuccgcggugauuuaacacacuucacaggcaccucagaauaugccaugaaccucgcaucccaaaacuggaacaacuacgaccccaccgaagaaauaccugcaccccucggagcccccgacuucgucggaaaaauccgcggcaugcuaacacaaaccacacgacgagacgguuccacucguggccaccgcgccacccucuccaccggcucagcacacuucacaccaaaacucgguaacauacgcuucuccacggacacaaacaaugacuuugaagcaggacaaaacaccaaauucacaccaguaggcgucuuccaagaaggcgauaaccaccaaaacgaaccccaacaaugggugcuccccaacuacuccggugcaacagcccacaacguccaccuagcacccgccgucgcaccagcauuuccaggagaacagcuguuauucuuccgcuccacaaugcccggcugcggaggcuaccccaacaugaaccucgauugccuucugccacaagaauggguccaacacuucuaccaagaagcagccccugcacaauccgacgucgcccuccuacgcuucgucaaccccgauacaucacgaguccuguucgaaugcaaacuacauaaaagcggcuacgucacagucgcccacaccggccaacacgaccucguuaucccaccaaacggcuacuuccgcuucgacagcugggucaaccaauuuuacacacuugcccccaugggaaacggcacgggccgcagacgcgcccucuga

SEQ ID NO: 36107 - RNA, 1620 nt, Artificial Sequence
  derived and/or modified sequence opt11 from VP1__Norovirus__AHH44904
augaagauggccucaaacgacgccucacccucagacggcuccgccgccaaccucguacccgaaguaaacaacgaagucauggcacucgaaccagucguaggcgccgccaucgccgcccccgucgcaggccaacaaaacgucauagaucccuggauccgcaacaacuucguccaagcccccgguggcgaguucaccgucucaccccgcaacgccccaggcgaaauccucuggucagcaccccuaggccccgaccuaaaucccuaccucucccaccuagcccgcauguacaacggcuacgcaggcggauucgaaguccaagucauacucgccggaaacgccuucaccgcaggaaaaauaaucuucgcagccgucccucccaacuuccccacagaaggccucucccccucccaagucaccauguucccucauaucguagucgacguacgacaacucgaaccaguccuaaucccacuacccgauguccguaauaacuucuaccacuauaaccagucaaaagaccccaccaucaaacuaaucgcaaugcuauacaccccacuccgugccaacaacgccggcgaagacgucuucacagucuccugccgcguccuaacccgccccucucccgacuuugacuuuaucuuccuuguaucacccaccgucgaaucccgcuccaaacccuucacuguacccauccucaccguagaagaaaugaccaacucucgauuccccaucccccuugaaaaacuauucacaggccccuccggcgcauucguuguccaaccccaaaacgggcgcugcaccacggauggaguccuucuaggcaccacacaacuuuccccagucaauaucugcaccuuccgcggugaccucacacacuucacaggaaccuccgaauacgcaaugaaccucgccucacaaaacuggaacaacuacgauccuaccgaagaaauccccgcaccccuaggagcccccgacuuugucggcaaaauccgcggaaugcucacccaaacaacacgacgcgacgguuccacacgaggacaccgggccacccucagcacaggcuccgcccacuucacccccaaacugggcaacauaagauuuucuaccgacaccaacaacgacuucgaagcaggccaaaacacgaaauucacucccgucgguguauuccaagaaggcgacaaccaccaaaacgaaccacaacaauggguccuccccaacuacucuggcgcuaccgcacacaacguccaccuagcccccgcagucgcccccgccuucccaggcgaacaacuccucuucuuccgcuccacaaugccuggaugcggcggcuauccaaacaugaaccucgacugccugcucccccaagaauggguacaacacuuuuaccaagaagcagccccagcacagucagacgucgcucuacuccgcuucgucaaccccgacacaucccgcguucucuucgaaugcaaacuacacaaaucagguuacgucacugucgcacacaccggccaacacgaccucguuaucccucccaacggauacuuccgcuuugacuccuggguaaaccaguucuacacccucgcgcccauggggaauggcaccggacgccgucgcgcucucuaa

SEQ ID NO: 36108 - RNA, 1620 nt, Artificial Sequence
  derived and/or modified sequence opt11 from VP1__Norovirus__AHH44905
augaaaauggccuccaacgaugcaucccccucugacggcuccgccgcuaaccucguacccgaaguaaauaacgaagucauggcccucgaacccguagucggugccgcaauagcugcccccgucgcaggccaacaaaacguuaucgaccccuggauacgaaacaacuucguccaggcccccggaggcgaguucaccgucucaccuagaaacgcccccggcgaaauccuauggucagcaccccucggccccgaccucaaucccuaccuaucacaccuagcccgcauguacaacgguuacgccggaggcuucgaaguccaaguuauccucgccggcaacgcauucaccgccggaaaaauaaucuucgccgcaguaccacccaacuuccccaccgaaggucugucccccucacaaguaaccauguucccccacaucgucgucgacguccgacaacuagaacccguacucauaccacucccagacguccguaacaacuucuaucacuacaaccaaucaaaagacccuaccaucaaacuuaucgccaugcucuacaccccacuccgagccaacaacgcaggcgaagacgucuucaccguuucgugccgaguccuaacccgccccagcccagacuucgacuucaucuuccuagucccacccacaguagaaucgcgauccaaacccuucaccguccccauccuuacagucgaagaaaugaccaauucacgauuccccaucccccuagaaaaacucuucaccggcccaucaggcgcauuugucguacaaccacaaaacggccgcugcacaaccgacggcgucuuacuaggcacaacccaacucuccccaguaaauauauguacauuccgcggcgaccuaacccacuuuacaggaaccuccgaguacgccaugaaccuagccucacaaaauuggaauaacuacgacccuaccgaagaaauuccagcaccccuaggcgcccccgacuucgucggcaaaauacgcggcaugcucacccaaaccacccgccgcgacggauccacccgaggccaccgcgccacccucuccacaggcuccgcccauuucacaccuaaacuagguaacauccgcuucuccacagacacaaacaacgacuucgaggccggccaaaacaccaaguucacccccgucggcgucuuccaagaaggagacaaccaccaaaacgaaccgcaacaauggguacucccaaauuauucaggcgccaccgcccauaacguacaccuagcgcccgcugucgccccagccuuccccggcgaacagcuacucuucuuccguuccacaaugccaggaugcggcggcuaccccaauaugaaccuagacugccuccuaccacaagaauggguccaacacuucuaccaagaagcagccccugcccaaucagauguugcacuccuccgcuucguaaaccccgacacuucucgaguccucuucgaaugcaaguuacauaaguccggauacgucacaguagcccauaccggccagcacgaccucguaaucccacccaacggcuacuuuagauucgacuccugggucaaccaauucuacacccucgcccccaugggaaacggaaccggccgacgccgcgcccucuaa

SEQ ID NO: 36109 - RNA, 1620 nt, Artificial Sequence
  derived and/or modified sequence opt11 from VP1__Norovirus__AHH44906
augaaaauggcauccaacgacgcauccccauccgacggcucagccgcaaaccucgugcccgaagucaacaacgaaguaauggcccucgaacccguuguaggagccgccaucgccgccccagucgccggccaacagaaugucaucgaccccuggauacgaaacaacuucguacaagcccccgguggcgaauuuacaguuucaccacgcaacgccccaggcgaaauacuauggagcgcaccccuagguccagaccucaaccccuaccuaucccaccuugcccgaauguacaacgguuacgcaggaggauucgaaguccaagucauacucgcggguaacgcauucaccgcaggcaaaaucaucuucgcggccgucccucccaacuuccccacagaaggccucucccccucccaaguaaccauguucccccauaucguagucgacguccgucaacuugaacccguccuaauaccacuucccgacguccgcaacaauuucuaccacuacaaccaauccaaagauccaaccaucaagcucaucgcaaugcucuacacaccccuccgcgcaaacaaugccggugaagacgucuucaccgucuccugccgcguccuuacccgacccucccccgacuucgauuucaucuuccuagucccaccuaccgucgaaucacggucaaaacccuucaccgucccgauccucacaguagaagaaaugaccuacucccgauuuccaaucccucuagaaaaacuauucaccggcccaucguccgcauucgucguacagccccaaaacggucgcugcacaaccgacggaguucuucugggcaccacccaacuuucacccgucaacauuugcaccuuccgaggagaccuuacccauuucgccggcacauccgaauacgccaugaaccucgccucccagaacuggacaaacuacgaccccaccgaggaaaucccagcaccccuuggcgcacccgacuucgucgguaaaauccgaggcguacucacccaaaccacgcguggggacggcuccacacgcggccaccgagccacacucucaaccggcuccgcacacuucacccccaaacucggcucaguacgcuucucgaccgacacuaacaacgacuucgaagcaggccaaaacacaaaauucacccccguaggcgucuuccaagacggcgacaaccaccaaaacgaaccacaacaauggguccuacccaacuacuccggcgccacugcacacaacguccaccuugcacccgcaguagcacccgccuucccaggcgaacaacuacucuuuuuccgcucaaccaugcccggaugcucaggauaccccaauaugaaccucgacugccuccuaccacaagaguggguccaacacuucuaucaagaagcagcacccgcucaaagcgacguagcccuccuuagauucgugaacccagacacaucccgcguccucuucgaaugcaaacuacacaaauccggcuaugucaccgucgcccacacaggacagcacgaccucguaauacccccuaacggauauuucagauucgacuccugggucaaccaauucuacacccuagccccuaugggcaacgguacaggacgccgccgcgcucucuaa

SEQ ID NO: 36110 - RNA, 1620 nt, Artificial Sequence
  derived and/or modified sequence opt11 from VP1__Norovirus__AHH44907
augaaaauggcaucaaacgacgccuccccuagcgacggcagcgccgcaaacuuagucccagaagucaacaacgaaguuauggcccuagaaccaguugucggcgccgccaucgccgcccccgucgccggccaacaaaacgucaucgaccccuggauccgcaacaaauuuguacaagcucccgguggcgaguucaccguguccccacgcaacgcccccggagaaaucuuauggucugcaccccuaggacccgaccucaaccccuaccucucacaccucgcccguauguacaacggcuacgccggaggcuucgaaguccaaguaauccucgccggcaacgccuucacugccggcaaaaucaucuucgccgcagucccacccaacuuccccacagaaggccucucucccucccaagucacaauguucccccacaucgucgucgacguccgacaauuagaacccguccucaucccccucccagacguacgaaacaacuucuaccacuacaaccaauccaaagaccccacaauuaaacucaucgccaugcucuauaccccuuuacgcgcuaacaacgccggcgaagaugucuucacugucucaugccgaguccucacccgacccuccccagacuucgacuuuaucuuucucguaccacccacggucgaaagcagaucgaaacccuucacaguaccuauccuuaccgucgaagaaaugaccaacucccgcuucccaaucccccucgaaaaacuguucacaggcccauccggagcuuucgucguccaaccucaaaacggccgcugcacaacugacggcguucuccuaggcacaacacagcucagcccaguaaacaucugcaccuuccggggugaucucacccacuucgcaggaacccacgaauacgccaugaaccuagccucgcaaaacuggaacaacuacgaccccaccgaagaaauccccgcaccccucggcgccccagacuucgucggcaaaauccgcggcguccucacucaaacuacaagacgugacggcuccacccgcggacaccgagccacucuaucuaccgguucugcacacuuuacccccaaacuuggcucaauccgcuucucuaccgacaccaacaacgacuucgaagccggccaaaacaccaaauucacucccgucggcguauuucaagacggagacaaucaccaaaacgaaccccaacaauggguucucccaaacuacucuggcgccaccgcccauaacguacaccuagcucccgccgucgcccccgccuuccccggagaacagcuccucuucuuccgaagcaccaugccaggcuguuccggcuaccccaacaugaaccuugacugccuacucccccaagaauggguacaacacuucuaccaagaagccgccccagcacaaucagacgucgcccuccuccgguucgucaaccccgacacaagccgaguccuauuugaaugcaaacuucacaaaucaggcuacgucaccgucgcccauaccggccagcacgaccucgucauacccccaaacggcuacuuccgauucgacuccugggucaaccaauucuacacacucgcccccauggguaauggcacuggacgaagaugcgcccuauaa

SEQ ID NO: 36111 - RNA, 1620 nt, Artificial Sequence
  derived and/or modified sequence opt11 from VP1__Norovirus__AHH44908
augaaaauggccagcaacgacgccucccccucugauggcucagcugcaaaccucgucccagaagucaacaacgaagucauggcacuugaaccaguaguaggggcagcaauugccgcacccguagccggccaacagaacgucaucgacccauggauccgaaacaacuucguccaagcccccggcggagaguucaccgucucaccccgaaacgcacccggagaaauccucugguccgcuccccucgguccugaccucaacccauaccucucgcacuuagcccgcauguacaacggcuacgccgggggcuucgaaguucaagucauccucgccggcaacgcauucacagccggcaaaaucauauucgccgccgucccacccaacuuccccacagaaggccuaucccccucacaagucaccauguucccccacaucguagucgacguacgacaacucgaaccggugcuaaucccccuccccgacguacggaacaacuucuaccauuacaaucaaucaaaagaccccacaauaaaacucauagccaugcuguacacaccccuacgagcaaauaacgcaggagaagacgucuucacaguauccugcagaguccucacccgccccucacccgauuucgacuucaucuuccuugucccacccaccgucgaaucccgcucaaaacccuucaccguacccauccuaacuguagaagaaaugacaaauucccgauuccccaucccccucgaaaaacucuucaccggacccuccuccgcauucguaguccaaccccaaaacggccgaugcaccaccgacggaguacuccucggcaccacccaacuauccccagucaacauaugcaccuuccgcggagaccucacccacuuugcgggaacuuccgaauacgccaugaaccuagccucccaaaacuggacaaacuacgaccccaccgaagaaauccccgcaccacugggcgcuccagacuucgucggcaaaauacgcggaguccuaacccaaaccacccgcggcgacggcucaaccagaggccaccgagccacacugucaaccggcucagcccacuucacccccaaacucggcuccguccgcuuuucaacagacacaaacaacgacuucgaagccggccaaaauaccaaauucaccccagucggcguauuccaagacggcgacaaccaccaaaacgaaccccaacaauggguacuacccaacuacucuggcgcaaccgcccacaacguacaccuggccccggccguagccccagccuucccaggagaacaacuccucuucuuucgcuccaccaugcccggcugcucaggcuacccaaacaugaaccuugacugccuccuaccccaggaauggguacaacacuucuaccaagaagccgcacccgcccaaucagacguagcacuccuacgcuucgucaacccagacaccucucgcguccucuucgaaugcaaacuccauaaauccggcuacgucaccgucgcccacaccggucaacacgaccuaguaaucccgcccaacggcuacuuucgguucgacuccugggucaaccaauuuuacacccuagccccaaugggcaacggaacaggacggagacgcgcccuauaa

SEQ ID NO: 36112 - RNA, 1620 nt, Artificial Sequence
  derived and/or modified sequence opt11 from VP1__Norovirus__AHH44909
augaaaauggccagcaacgaugcaucccccuccgacggcucugccgcaaaccuagucccagaagucaacaacgaagucauggcacuagaacccguagucggcgcagccaucgccgccccagucgcaggccaacaaaacgucaucgaccccuggauccgcaacaacuucguccaagcaccgggaggcgaguucaccgucucgccacgcaacgcccccggcgaaauucuauggucagcaccccucggccccgaccuaaaccccuaccucucacaccuugcccgcauguacaacggauacgccggaggcuucgaaguccaaguaauccucgccggcaacgccuucaccgccggcaaaaucaucuucgcugccguacccccaaauuucccaaccgaaggccuaucucccucccaggucaccauguuuccccacaucgucgucgacguccgccaacucgaaccaguccucaucccccuccccgacguccgcaacaacuuuuaccacuacaaucaauccaaagaccccaccaucaaauuaaucgcuaugcucuacacaccucuacgagcaaacaaugccugggaagacgucuucacagucuccugccgcguccuuacacgccccucccccgacuucgacuucaucuuccuaguucccccaaccgucgaaucccgcuccaaacccuuuacaguccccauacucacagucgaagaaaugacuaacucacgcuucccgaucccccucgaaaaacucuucaccggcccauccggagccuucgucguccaaccccaaaacggucgcugcacaacagacggcguccuacuaggaacaacccagcuaucacccguuaacaucugcacauuccgcggagaccuaacacacuucgccggcacacacgaauacgcaaugaaccucgccucccaaaacuggaacaacuacgaccccacugaagaaaucccagcaccccucggcgcaccagacuucgucggcaaaauccgcgggguccucacacaaaccacccgccgagacggcuccacucgcggacaccgcgccacccucucuacuggcucagcccauuucacucccaaacucggcucuauccguuucucaaccgauaccaacaacgacuucgaagcaggccaaaacaccaaauucaccccaguuggagucuuccaagacggcgacaaccaccaaaacgaaccccaacaauggguccuuccaaacuauagcggagcaacagcccacaacguucaucucgcacccgcaguagcccccgcauuucccggagaacagcuccucuucuuccgcuccacaaugcccgguugcucaggcuacccuaacaugaaccuagacugccuccucccccaagaaugggugcaacacuucuaccaagaagccgcacccgcccaauccgacgucgcacuacuccguuucgucaacccggacacaucccgaguacucuucgaaugcaaguuacacaaguccgguuacgucacugucgcccacacaggccaacacgaccucguuauucccccuaacggauacuuccgguucgacucuuggguuaaucaauucuacacucuggcaccaaugggcaauggcacuggccgccgacgcgcccucuga

SEQ ID NO: 36113 - RNA, 1620 nt, Artificial Sequence
  derived and/or modified sequence opt11 from VP1__Norovirus__AHH44911
augaaaauggccuccaacgacgccagcccaucagauggcucagcagccaaccucgucccugaagucaacaacgaagucauggcccuugaacccgucguaggugccgccauagccgcaccaguugccggccaacagaauguaaucgacccuuggauccgcaacaacuucguacaagcccccggcggcgaauuuaccgucagcccccgcaacgcacccggugaaauacucugguccgcaccccucggaccagaccugaacccauaccucucacaccucgcccgcauguauaacggauacgcaggcggcuucgaaguccaagucauccucgcaggaaaugccuucacugccggaaaaauaauauucgccgccguuccacccaacuuccccacagaaggacugucccccagccaagucaccauguucccccacaucgucgucgacguaagacaacuagaacccguccucaucccccuacccgacguacgcaacaacuucuaccacuacaaccaauccaaagaucccacaaucaaacucaucgcaaugcucuacaccccacucagagccaacaaugcgggagaagacgucuucaccgucuccugccguguccuaacccgcccauccccugacuucgacuucauauuccuagucccacccacugucgaaucacgauccaaacccuucaccgucccgauacuaaccguagaagaaaugaccaacucucgcuucccaaucccacucgaaaaacucuucacaggacccuccggcgccuucguaguacaaccacaaaacggcagauguacaacagacggcguccuccucggaacaacacaacuuucccccgucaacauaugcaccuuccgcggugaccucacccacuucgccggaacacacgaauacgccaugaaccucgccucacaaaacuggaauaacuacgacccaaccgaagaaauuccugcaccccuaggagccccagacuucguaggcaaaauucgcggcguccucacacaaacuacccgccgcgacggauccacccgaggacaucgcgccacucucucaacaggauccgcucacuucacccccaaacucggauccauacgauuuuccacagacaccaacaacgacuuugaagccggacaaaacaccaaauucacccccgucggcgucuuucaagacggcgacaaccaccaaaacgaaccccaacaauggguccuuccaaauuacuccggagcaaccgcccacaacguccaccuagccccagccguagcacccgccuuucccggcgaacaacuucuguucuuccguuccacaaugcccgguugcucaggcuacccaaacaugaaccuugacugucuacucccccaagaauggguccaacauuucuaccaagaagccgcacccgcacaauccgacguugcccuacuacgcuucgucaaccccgacaccucccgcguucuauucgaaugcaaacuccacaaguccggcuacguaacagucgcucacacaggacaacacgaccucguuaucccacccaacggcuacuuccgcuucgacuccugggucaaucaauucuacacccuagcacccaugggcaacggcacaggccgccgacgagcccuauaa

SEQ ID NO: 36114 - RNA, 1620 nt, Artificial Sequence
  derived and/or modified sequence opt11 from VP1__Norovirus__AHH44912
augaaaauggccuccaacgacgccucacccucagacgguucagccgccaaccucgucccagaaguaaacaacgaagucauggcccucgaaccaguagucggagcagccauagcagcucccgucgccggccagcagaacgucauagaccccuggauccguaacaacuucguccaggcacccggaggcgaguucaccgucagcccccgcaacgccccaggagaaauccuaugguccgcaccccuaggccccgaccucaaucccuaccuaucacaccucgcccguauguacaacggcuacgccggaggauucgaaguccaaguuauccuagccggcaacgcauucaccgcaggcaagaucaucuucgccgcgguaccacccaacuucccaaccgaaggccuauccccuucccaagucaccauguucccacacaucgucguagacguccgccaacucgaaccuguacucaucccacuccccgacguaagaaacaacuucuaccacuacaaccaaucuaaagacccuacuauuaaacucauagccaugcuauacaccccacucagagccaauaacgcaggagaagacgucuucaccgucuccugccguguccuaacccgcccaucacccgacuucgacuucaucuuccucgucccacccacagucgaaucccgcucaaaacccuucacaguacccauccuuacagucgaagaaaugaccaacucccguuuccccaucccccucgaaaaacucuucaccggccccucuggcgcauucgucguccaaccccaaaacggacgcugcacaaccgacggaguccuccucggcacaacacaacucucccccguaaacauuugcaccuuccgcggagaccucacccacuucgcaggcacccacgaauacgccaugaaccucgccucccaaaacugguccaacuacgacccuaccgaagaaauccccgcaccccuaggggcccccgacuucguggguaaaaucagaggaguacucacucagaccacccgcggcgacggcucaacccguggccaccgcgccacccuuuccacaggcuccgcacacuucacccccaaacuaggaucaauacgcuucucaaccgacacaaacaacgacuuugaagccggccaaaacacaaaauucaccccagucggaguauuucaagacggcgacaaccaucaaaacgaaccccagcaguggguucuccccaacuacagcggcgcuaccgcccacaacguacaccucgcacccgccgucgcacccgcauuccccggagaacaacuacucuuuuuccguuccacaaugcccgguugcucuggauaccccgauaugaaccuagauugccuccucccccaagaauggguccaacacuuuuaccaagaagccgcccccgcccaauccgacgucgcacuccuccgauucguaaaucccgacaccucacgaguacuuuucgagugcaaacuccacaaaucaggcuaugucaccgucgcacacacaggucaacacgacuuaguaauacccccgaacggcuacuuucgcuucgauuccugggucaaccaauucuacacccuagccccaaugggcaacggcacuggccgccgucgagcacuauga

SEQ ID NO: 36115 - RNA, 1620 nt, Artificial Sequence
  derived and/or modified sequence opt11 from VP1__Norovirus__AHH44913
augaaaauggccucuaacgacgccucccccuccgacggaagcgccgccaaccucguacccgaagucaacaacgaaguuauggcacuagaacccgucgugggcgcggccaucgcagcccccgucgcaggccaacaaaacgucaucgaucccuggauccgcaacaauuucguccaggcacccggcggcgaguucaccguaucucccagaaacgccccaggcgaaauccucuggagcgcaccccuaggacccgaucuaaaccccuaccucucucaccuagcccgaauguacaacggcuacgcaggcggcuucgaaguacaggucauccucgccgguaacgcauucaccgcaggcaaaauuauuuucgcugccgucccacccaacuuccccaccgaaggccucucccccucccaagucacuauguuuccucacauaguagucgacguacgccaacucgaacccguucucauaccacuacccgacguccgaaacaacuucuaccacuacaaccaaucuaaagaccccaccauaaaacuuaucgccaugcucuacacaccccuacgugcaaacaacgccggagaagaugucuucaccguauccugcagaguacuaaccagaccaucaccagauuucgacuucaucuuucuaguucccccuaccgucgaauccagaucaaaacccuucacaguaccgauccuaaccgucgaagaaaugaccaacucacgcuucccaaucccacucgaaaaacucuucacaggccccuccuccgcauucgucguacaaccccaaaacggccgcugcaccaccgacggaguccuccuaggaaccacccaacucuccccugucaacauaugcacauuccgaggagacuuaacccacuucgccggaaccucagaauacgccaugaaccucgccucucaaaauuggacuaacuacgaccccaccgaagaaaucccagcaccccuaggcgccccugacuucguaggaaagaucagaggcguacucacccaaaccacccgacgcgacggcucuacucgcggccaccgcgccacacucuccacuggcucagcacacuucacccccaaacucggaucaauaagauuuuccacagacaccaacaaugacuuugaagccggccaaaacaccaaauucacccccgucggagucuuccaagacggcgacaaccaccaaaacgaaccacaacaauggguacuucccaacuacuccggagccaccgcacacaacguucaccucgcucccgccguagcaccagccuuccccggcgaacaacuccucuucuuccgauccaccaugccagggugcagcgguuaccccaacaugaaccuagacugccuucucacccaagaguggguccaacacuucuaccaagaagcagccccugcucaauccgauguagcccuccuacgcuucguaaaccccgacacaucacgcguccucuucgaauguaaacuacacaaauccggauacguaacagucgcacacaccggacaacacgaccucgucauuccacccaacgguuacuuccgcuucgacagcugggucaaccaauucuacaccuuagcacccaugggcaacgggaccggacgccgacgugcccucuaa

SEQ ID NO: 36116 - RNA, 1620 nt, Artificial Sequence
  derived and/or modified sequence opt11 from VP1__Norovirus__AHH44914
augaaaauggccuccaacgacgcaucccccuccgacggcuccgccgccaaccuagucccagaaguaaacaacgaaguaauggcccuagaaccaguugucggcgccgcaauagcagcacccgucgccggccaacaaaacguaaucgaucccuggauacgaaacaacuucguccaagccccuggcggugaguucaccguuucuccccgaaacgccccaggcgaaauacucuggucagcaccccuagggcccgaccuaaacccuuaccuuucccaccucgcccgaauguacaacggcuacgccggcggauucgaaguccaagucauccucgccggcaacgcauucaccgcuggcaagauuaucuucgccgccgucccucccaacuuccccaccgaaggacuaucccccucccaagucaccauguucccccacauaguaguagacguacgacagcucgaacccguacuaaucccacuacccgacguucgaaacaacuucuaccacuacaaccaauccaaagaccccaccaucaaacucaucgccaugcucuacaccccacuccgcgccaacaacgccggagaagacguuuucaccgucucuugcagaguccuaacacgcccauccccagauuucgacuucaucuuccucguaccacccaccguggaaucccgcuccaaacccuucaccgugcccauccuaacaguagaagaaaugacaaacucacgcuuccccaucccacuggaaaaacuauucaccggccccuccuccgccuucguaguacaaccccaaaacggacgcugcaccaccgacggcguccugcucggcaccacccaacucagccccguaaacauauguacauuccguggagaccucacccauuucgccggcacucacgaauacgccaugaaccuagccucgcaaaacuggaccaacuaugaccccaccgaagaaauacccgcuccccuuggcgccccugauuucgucggaaaaauucgcggcguacucacccaaaccacuagaggcgacggauccacccgaggccaccgugccacccucucaaccggaucagcccacuucacccccaaacuaggcucaguccgcuucuccacagacaccaauaacgacuuugaagcuggccaaaacaccaaauucacccccgucggcgucuuccaagauggcgacaaccaccaaaacgaaccccaacaauggguacuccccaacuauuccggcgccaccgcacacaacguccaccuagcccccgccguagcaccagccuuuccaggcgaacaacuccucuucuuccgauccacaaugccgggaugcucaggcuaccccaacaugaaucucgacugccuucucccacaagaauggguccaacauuucuaccaagaagcagcccccgcacaaucagacgucgcacuccuucgcuucguaaaccccgauaccuccagaguccucuucgaaugcaaacuacacaaaucaggcuacgucacagucgcccauaccggacaacacgaccuagucaucccgcccaacgguuacuuuagauuugauucaugggucaaccaauucuacacacucgcaccaaugggcaacggcacaggccgccgacgagcccucuaa

SEQ ID NO: 36117 - RNA, 1620 nt, Artificial Sequence
  derived and/or modified sequence opt11 from VP1__Norovirus__AHH44915
augaaaauggcuucaaaugacgccucacccucugacggcuccgcagccaaucucguaccugaaguaaacaacgaaguaauggcgcucgaaccagucgucggagccgcaauagccgcccccgucgccggccaacaaaacgucaucgaccccuggauccgaaacaauuucguccaagcccccggcggagaguucaccguuucaccucguaacgcaccaggagaaauacucuggucagcaccccucggcccagaccuaaacccauaccuaucccaccucgcccgcauguacaacggcuacgccggcggcuucgaaguacaaguaauucucgccggcaacgccuucacagcugguaaaaucaucuucgccgccgucccacccaacuuccccaccgaaggacugucccccucccaagucaccauguucccccauaucguugucgacguccgacagcucgaacccguccucauuccccuacccgacguccguaacaacuucuaccacuacaaccaauccaaagacccuaccauaaagcucauagcaaugcuguacacuccccuccgcgcaaacaacgcuggagaagacgucuucaccguaucgugccgaguccuaacccgacccuccccagacuucgauuuuauauuccucgucccacccacagucgaaucacgcuccaaacccuucaccguccccauauuaacaguagaagaaaugacaaacucacgauucccaaucccacucgaaaaacucuuuacgggcccaagcuccgccuucgucguccaaccccaaaacggccgaugcacaacagacggcguccuacucggcaccacccaacucagccccgugaacauaugcaccuucagaggcgaccuuacacacuucgccgguaccucagaauacgcaaugaaccuagccucucaaaacuggaccaacuacgaccccaccgaagaaaucccugcaccccuaggagcccccgacuuuguaggcaaaauacgaggcguccucacacaaacaacccgucgagacggauccacccgcggccaccgcgcuacacuauccaccggcagcgcccacuucacacccaaacucggcagcauccgcuucuccaccgacacaaacaacgauuucgaagccggacaaaacaccaaauucacacccgucggcgucuuccaagauggcgacaaccaucaaaacgaaccccaacaauggguccuucccaauuacucaggcgccaccgcucauaacguccaccuagcccccgcagucgccccagccuucccuggcgaacagcuccuauucuuccguucaacuaugcccgguuguuccggcuaccccaacaugaaccucgacugucuacucccccaagaauggguccaacacuucuaccaagaagccgcccccgcacaauccgacgucgcccuccuccgcuuuguaaauccagacaccucccgcguacucuucgaauguaaacuccacaaauccggcuacgucaccgucgcccacaccggccaacacgaccugguaauacccccgaacggauacuuccgcuucgacagcuggguaaaccaauucuacacccuagccccaaugggcaacggaacaggaagacgccgcgcccucuaa

SEQ ID NO: 36118 - RNA, 1623 nt, Artificial Sequence
  derived and/or modified sequence opt11 from VP1__Norovirus__AID60853
augaaaauggcaucuuccgacgccaaccccucagacggcuccgcagccaaccuaguucccgaagucaacaacgaagucauggcacuugaacccgucguaggagccgcaauagcagcaccagucgcaggacaacagaacgucaucgacccauggauccgcaacaacuucguacaagccccaggcggagaauuuacagucagcccacgaaaugcccccggagaaauacuaugguccgcgccccucggccccgaccuuaaccccuaccucucacaccuagcccguauguacaacggcuacgcugguggauucgaaguccaagucauacuagccggcaacgcguucaccgccggcaaagucaucuucgccgccguaccucccaacuuccccacagaaggccuuucuccaucccaaguaacuauguucccacauaucgucgucgacgucagacaacucgaaccuguccuaauaccccuccccgacgucagaaacaacuucuaucacuacaaccaauccaacgaccccacuaucaaacucauagcaaugcucuacacuccccugagagccaacaacgccggagacgacgucuucaccgucuccugccgcguccuuacccgacccuccccugacuucgacuucaucuuccucgucccacccaccgucgaaucccgaaccaaaccuuucagcgucccaguacuaaccgucgaagaaaugaccaacucccgcuuccccaucccccucgaaaaacucuucaccgguccauccucagccuucguuguccaaccccaaaacggccgaugcaccacagacggaguccuccuaggcacaacgcaacuaucccccgucaauauauguacuuuccgaggcgacgucacccacaucaccggcucccgcaauuacacuaugaaccuugccucacaaaacuggagcaacuacgaccccaccgaagaaauacccgcaccccuagggaccccugacuucgucggcaagauccaaggaguccucacacagaccacccgcacagacggcucaacaagaggccacaaagccacaguguacaccggcuccgcagauuucgcuccaaaacucggacgaguucaauucgaaacagacaccgaccgcgacuucgaagcaaaccaaaauaccaaauucacccccguuggagucauacaagacggcuccaccacccaccguaaugaaccacaacaauggguacuccccucauacucaggccgcaacacccccaauguccaccuagccccugccgucgcccccaccuuccccggcgaacaacuccuuuucuuucgauccacuaugcccggcugcucgggcuacccaaacauggaccucgacugccuacuaccccaagaauggguccaauacuucuaccaagaagcagcuccugcccaauccgacguagcucuauuacgcuucguaaacccagacacaggccgaguccucuucgaaugcaaacuacacaaaucuggcuacgucaccgucgcccacacaggucaacacgaccuuguaauaccacccaacggcuacuuccgcuucgacuccuggguaaaccaauucuacacucucgcccccaugggcaacggcaccggcagacgccgagcacuauaa

SEQ ID NO: 36119 - RNA, 1623 nt, Artificial Sequence
  derived and/or modified sequence opt11 from VP1__Norovirus__AID60855
augaaaauggccuccuccgacgccaaccccagcgacggcuccgcagcuaaccucguucccgaagucaacaacgaaguuauggcccuagaacccguagucggcgcagcaaucgccgcacccgucgccggccaacaaaacguaaucgacccauggauccgaaacaacuucguccaagccccaggcggagaguucaccgucucuccccgcaacgcuccaggggaaauccucugguccgcgccccucggccccgaccuuaaccccuaucuaucacaucuggcccgaauguauaacggcuaugccggcgguuucgaaguacaagucauccuagccgguaacgccuucacagcaggcaaggucauauucgccgcaguaccacccaacuucccuaccgaaggccuaucaccaucucagguuaccauguucccucacauagucgucgacguccgccaacucgaacccguccuuauaccacucccggacguacgcaacaacuucuaccauuauaaccaaucuaacgacccaacuaucaaacuaauagcuaugcuguacacaccgcuacgagccaacaacgccggugacgacguauucacggucucaugccgcguccucacccgcccuucccccgacuuugacuucauauuccucgucccacccacagucgaaucccgaacuaaacccuucuccgucccgguccucacagucgaagaaaugacuaacucccgauuccccaucccacuugaaaaacuauucacaggacccagcuccgccuucgucguccagccccaaaacggccgcugcaccaccgacggcguacuacuuggcacgacacaacuaucccccguaaacaucugcacauuccgcggagacgucacccacauaaccgguuccagaaauuacaccaugaaccucgccagccagaacugguccaacuacgaccccacagaagaaauacccgcaccccuaggcaccccagacuucgucggcaaaauccaaggcguccucacacaaacaacccgcacggacggcuccacccgcggacacaaagccaccgucuacacaggcagcgccgacuucgcacccaaacucggccgcguccaauucgaaacggacaccgaccacgacuucgaagccaaccaaaacacaaaauucacuccaguuggcguuauacaagacggcucaaccacucaccgaaacgaaccccaacaauggguccuccccuccuacuccggccgaaauacacccaauguacaccuugccccagcagucgcccccacauuccccggcgaacaacuccucuucuuccgcucaacuaugcccggcugcuccggcuaucccaacauggaucuagacugccuccuaccccaagaauggguucaauacuucuaucaagaagccgcccccgcucaaucagaugucgcccuccuccgcuucgucaacccugauacaggccgaguccucuuugaaugcaagcuacacaaauccggcuacgucaccgucgcccacaccggccaacacgacuuagucauacccccaaacggcuacuuccgauucgacuccugggucaaucaguucuacacccuugcacccaugggcaacggcaccggcagacgccgcgcacuguga

SEQ ID NO: 36120 - RNA, 1623 nt, Artificial Sequence
  derived and/or modified sequence opt11 from VP1__Norovirus__AID60857
augaaaauggccuccuccgaugccaaccccuccgauggcucagccgccaaccucguccccgaagucaacaacgaagucauggcucucgaaccaguagucggcgccgccaucgccgcgcccgucgccggacaacaaaacguaauagacccauggauccgcaacaacuucguccaagcaccaggaggagaguucacugucucaccccgcaacgcucccggcgaaauccucugguccgcaccccuaggccccgaccucaacccuuaucucucccaccucgcccgaauguacaacggcuacgccggcgguuuugaaguccaaguaauccucgcaggaaacgccuucacagccggaaaaguaaucuucgcagcaguaccacccaacuuccccaccgaaggccuaagccccagccaagucacuauguucccccacaucgucgucgauguccgccaacuagaacccguccucaucccccuccccgacguccgcaacaauuucuaccacuacaaccaaucaaacgaccccaccaucaaacuaaucgccaugcucuauacaccacuucgagccaacaacgccggagacgacgucuucaccgucucaugccgcguccuaacccgacccuccccagacuucgacuucaucuuccucgucccucccacuguagaaagucgcacuaaacccuucucugucccaguucucacggucgaagaaaugaccaacucacgcuuccccauuccacucgaaaaacucuucacaggacccucauccgccuucguaguucaaccacaaaacggcagauguacuaccgaugggguccuccuaggcaccacccaacuaucucccgucaacauuugcacauucagaggcgacgucacucacaucaccggaucccgaaacuacacuaugaaccuagccagccaaaacuggucaaacuacgaccccaccgaggagauccccgccccacucggaacccccgacuucguaggaaaaauccaaggaguacuaacucaaaccacccgcaccgacggcucgacccggggccacaaagcaacugucuacacaggcuccgccgacuucgcucccaaacuaggccgcguccaguucgaaaccgacaccgaccacgacuucgaagcaaaucagaacaccaaauucacccccgucggcgucauccaagacggcucaaccacccaccgaaacgaaccccaacaauggguucucccaucauacuccggucggaacacccccaacguccaccuagcucccgcagucgcccccaccuuuccaggcgaacaacuccucuucuuccgcuccacaaugcccggaugcucuggauacccaaacauggaccuugauugccuacuaccucaagaaugggugcaauacuucuaucaagaagccgcacccgcccaauccgacgucgccuuacucagauucguuaaccccgacaccggacgcguccucuucgagugcaaacugcacaaaucaggauacgucaccgucgcccauacaggucaacacgaccucgucaucccucccaauggcuacuuccgcuucgacuccugggucaaccaauuuuacacccucgcccccaugggcaacggaaccggacgacgacgcgcccucuaa

SEQ ID NO: 36121 - RNA, 1623 nt, Artificial Sequence
  derived and/or modified sequence opt11 from VP1__Norovirus__AID60859
augaaaauggccucuuccgacgcuaaccccucagauggaucagcagcaaaccucguccccgaaguaaacaacgaaguuauggcucuagaacccguaguaggcgccgccaucgcagccccugucgccggccaacaaaacguaaucgaccccuggauacgcaacaacuucguccaagcccccggcggcgaguucaccgucucgccccgcaacgcccccggcgaaauccucugguccgcgcccuuaggccccgaccuaaauccauaccucucccaucucgcccgcauguacaauggcuacgccggcggcuucgaaguccaagucauacucgccggaaacgccuucaccgccgguaaagucaucuucgccgccgucccaccgaacuuccccaccgaaggccuaucccccucccaagucaccauguucccccacauaguagucgacguacgccagcucgaaccaguacugauccccuuacccgacguccgaaacaacuucuaccacuacaaccaaucuaacgaucccacuaucaaacucaucgccaugcucuacacaccccuccgcgcaaauaaugccggcgacgacguauuuaccgucagcugccgcguccucacccgcccauccccagacuucgacuucauauuccucgucccacccaccguagaaucccgcaccaaacccuucuccguacccguccuaacugucgaagaaaugaccaacucccgauucccuaucccccucgaaaaacuauuuaccggucccagcucugccuucgucguucaaccucagaacggccgcugcaccaccgacgggguccuccuuggaaccacacaacucucccccguaaacaucugcacuuucaggggagacguuacacacaucaccgguucaaggaacuacaccaugaaccucgccucccaaaacugguccaacuacgaccccaccgaagaaauccccgcaccacucggaacccccgauuucgucggcaaaauacaagggguccucacucaaacaacccgcaccgacggcuccacccgcggacacaaagccaccguauacaccggcuccgcagacuucgcacccaaacucggccgcguacaauucgaaaccgacacggaccacgacuucgaagccaaccaaaacacuaaauucacaccagucggcguuauccaagacgguuccacgacccaucgcaaugaaccccaacaauggguauuaccuucauacuccggccgcaauaccccaaacguccaccuagcgccagcuguagcacccacauuccccggcgagcaacuccuauucuuccgcucaaccaugccuggaugcucgggcuacccaaacauggaccuugacugccuccucccucaagaauggguccaauacuucuaccaagaagccgcaccagcccaauccgacguagcccuccucagauuugucaacccagacaccggaagaguccuguuugaaugcaaacuccacaaauccggauacgucaccgucgcccacacuggccaacacgauuuaguaaucccacccaacggcuacuuccgauucgacuccuggguaaaccaauucuacacacuugccccuaugggcaacggcacaggccgccgccgugccuuauaa

SEQ ID NO: 36122 - RNA, 1623 nt, Artificial Sequence
  derived and/or modified sequence opt11 from VP1__Norovirus__AID60861
augaaaauggcaucuuccgaugccaaucccuccgacggcucugccgccucccucgucccagaagucaacaacgaagucauggcacucgaacccgucgucggcgccgcaaucgccgcccccguagccggacaacaaaacgucaucgaccccuggauccgcaacaacuucguucaagcaccagggggcgaguucaccgucucaccccgaaacgccccaggcgaaauccucugguccgccccucuuggaccugaccucaaccccuaccuaucccaccuagcccgcauguacaacggcuacgccggaggguucgaaguccaagucauccucgccggcaacgcauucaccgccggcaaagucaucuucgccgcagucccacccaacuuucccacagaaggccucucccccucacaagucacaauguucccccauaucgucguagacguccgccaacuagaaccgguccucaucccacucccagacguccgaaacaacuucuaccauuacaaccaaucuaacgaccccaccaucaaacuaaucgccaugcucuacacaccccuccgcgcaaacaacgcuggagacgacgucuucaccguaagcugccgcguccucacacgacccucccccgacuucgacuucaucuuccucguuccacccaccguugaaucacgcacuaaaccauucucagucccaguccucacaguugaagaaaugaccaacucccgcuuccccaucccacucgaaaaacuuuucacuggccccuccagcgccuucguaguccaaccacaaaacggccgcugcacaaccgacggcguucuacucggaaccacgcagcuaucacccgucaacauauguaccuuccgcggcgacgucacacacaucaccggcucccgcaacuauaccaugaaccucgcaucccaaaacugguccaauuacgacccaacagaagaaauccccgcaccccucggcaccccagacuucguaggaaaaauccaaggcguccuaacccaaaccaccagaaccgaugguucuacucgcggacacaaagccacagucuacaucgguuccgccgacuucgccccuaaacucggccgaguccaauucgaaacagacaccgaccacgacuucgaagccaaccaaaauacaaaauucacacccgucggcgucauacaagacgguucuaccacccaccgcaacgaaccacaacaauggguccucccauccuacucaggccguaacacacccaacguccaccuagcccccgccgucgccccuaccuuccccggagaacaacuucuguucuuccgcuccaccaugcccggaugcuccggcuacccaaacauggaccuagacugccuacuaccccaagaauggguccaauacuucuaccaagaggcagcacccgcccaaucggacguagccuuacuacgauucguaaaccccgacacaggccgaguccuauucgaaugcaaacuacacaaauccggcuacgucaccgucgcacacaccggacaacacgaccucgucauacccccaaacggcuacuucagauucgacucguggguaaaccaauucuacacccucgcccccaugggcaauggcaccggcaggcgccgggcccuuuaa

SEQ ID NO: 36123 - RNA, 1623 nt, Artificial Sequence
  derived and/or modified sequence opt11 from VP1__Norovirus__AID60863
augaaaauggccagcucagacgccaacccuucagacggauccgcagcuucccuaguccccgaagucaacaacgaagucauggcccucgaacccguaguaggcgccgcuaucgccgccccuguugcaggucaacaaaacguaaucgaccccuggauccgcaauaacuucguacaagcccccggcggcgaguucacaguauccccacgcaacgcccccggagaaauccuuugguccgcaccccuuggcccagaccucaaccccuaccucagccaccuagcccgcauguacaacggcuacgccggaggcuucgaaguccaagucauccucgccgggaacgccuucaccgccggaaaagucaucuucgccgccgucccacccaacuuccccaccgaaggccucucccccucccaaguaaccauguucccccacaucguaguagacguacgccaacucgaacccguccuaauuccccuacccgacguccgcaacaacuucuaucacuauaaccaauccaaugaccccaccaucaaacuaaucgccaugcucuacacaccccuccgggccaacaacgccggcgacgaugucuucaccgucuccugucgcguacucacacgcccauccccagacuucgacuucaucuuucuagucccgcccaccgucgaaucccgaaccaaacccuucuccguacccguacucaccgucgaagaaaugacaaauagccgcuuucccauaccccuagaaaaacucuucacgggccccuccagcgcguucgucguccaaccccaaaacggccgcugcacuaccgacggcguccuccucggaaccacacaacugagcccaguaaauauauguaccuuccgaggcgacgucacccacaucaccggcucccgaaacuacaccaugaaccuagcaucucagaacugguccaacuacgaccccaccgaagaaauacccgcuccccuuggcacacccgauuucguaggcaaaauccaaggcguccucacccaaaccacucgcacugacggaagcacgagaggacacaaggccacugucuacacaggcucggccgacuuugcccccaaacucggccgcguacaauucgaaacagacacagaccacgacuucgaggcaaaccaaaauaccaaauucacaccaguaggcgucauccaagacggcuccacaacccaucgcaacgaaccacaacaauggguccuacccuccuacucaggccgcaacaccccaaacguccaccuggccccagccgucgcacccacauucccaggugaacaacuacuuuucuucagauccaccaugcccggaugcuccggcuaccccaacauggaccucgacugccuccucccccaagaauggguccaauacuucuaccaagaagcagcccccgcccaaucagacgucgcccuccuacgguucgucaaccccgacaccggccgcguccucuucgaaugcaaacuccacaaauccggcuaugucacagucgcccacaccggccaacacgaccucguaaucccaccaaauggcuacuuccgcuucgacucuugggucaaccaauucuacacccucgcccccauggguaacggaaccggccgcagacgcgcccucuag

SEQ ID NO: 36124 - RNA, 1623 nt, Artificial Sequence
  derived and/or modified sequence opt11 from VP1__Norovirus__AID60865
augaaaauggccuccuccgacgcaaaccccuccgacggcuccgccgccagccuaguccccgaaguaaacaacgaaguaauggcccuagaaccagucguaggagcagcuauugcugcccccgucgccggccaacaaaauguaaucgaccccuggauucguaacaacuucguccaagccccaggcggcgaguucacugucucaccccgaaacgcccccggcgaaaucuuauggucugcgccccuaggccccgaccucaaccccuaccucucacaccucgcucgaauguauaacggcuacgcaggaggauuugaaguccaagucauccuagccggaaacgcauuuaccgccggaaaaguaaucuucgccgccguaccacccaacuuccccaccgaaggccucucucccucucaaguaacaauguucccccacgucgucaucgacgucagacaacucgaacccguacuaaucccccuccccgacguccguaacaacuucuaccauuacaaucaauccaacgaccccaccaucaaacucaucgccaugcuauacacaccccuccgcgcaaauaacgccggcgacgacgucuuuaccguaucaugccgcguacucacccgccccucgccugacuucgacuucaucuuccucgucccucccaccguugaaucgcgcaccaaaccauucucaguacccguccucacagucgaagaaaugaccaacucacgcuuccccauaccccucgaaaaacucuucaccggacccucaucugcauuugucguacaaccucaaaacggacgcugcaccacugacggaguccuucuaggcaccacccaacucucccccguaaacaucugcaccuuccgaggcgacgucacccacaucaccggcucccgaaacuacaccaugaaccucgcaucccaaaacuggucaaauuacgauccaacugaagaaauucccgcaccccuagguacaccugacuuugucggcaaaauucaaggcguccucacacaaaccacgcgaacagauggcuccacucgaggccacaaagccaccgucuauaccggguccgccgacuucgccccaaaacucgguagaguucaauucgaaaccgacacagaccacgacuucgaaacaaaccaaaacaccaaauucacacccgucggagucauacaagacggcggcacuacccaccgaaaugagccccaacaguggguucuccccuccuauucuggccgaaauacccccaacguccaucucgcaccagccguugcccccaccuuccccggcgaacaacuacucuucuuccgauccacaaugccaggaugcucuggcuaccccaacauggaccuagacugccuacucccccaagaauggguccaauacuucuaccaggaggcagcccccgcacaaucagacgucgcccugcuccgauucgucaaccccgacaccggccgaguacucuucgaaugcaaacuccacaaauccggauacgucacugucgcccacaccggccaacacgaccucguaauaccacccaacggcuacuuccgcuucgacuccugggucaaccaauucuacacccucgcccccaugggcaacggcacgggccgacgccgagcccucuaa

SEQ ID NO: 36125 - RNA, 1623 nt, Artificial Sequence
  derived and/or modified sequence opt11 from VP1__Norovirus__AID60869
augaaaauggccuccucagacgccaaccccuccgauggauccgcagccucccucguccccgaagucaacaacgaagugauggcccuagaacccguaguaggcgcagccaucgccgcccccgucgccggacaacaaaacguaaucgaccccuggauccgcaacaacuucguacaagcacccggcggagaauuuacaguuucgccccgcaacgccccaggagaaauccuaugguccgccccucucggaccagaccucaacccauaccugucucaccucgcccgaauguacaacggcuacgccggaggcuucgaaguccaaguaauccucgcgggcaacgcauucacagccggcaaagucauauucgccgccgucccacccaacuuccccaccgaaggccuaucccccucccaagucaccauguucccccacauagucguggacguacgccagcucgaacccguacuaaucccccuacccgacguccguaacaacuucuaccacuacaaccaauccaacgaccccacgaucaaacuuaucgccauguuauacacuccccuucgugccaacaacgccggagacgacgucuucaccgucuccugccgagugcucacacgcccaucccccgauuucgacuucaucuuccucguuccacccacagucgaaucccgcacaaaacccuucucaguccccguccuaaccgucgaagaaaugacaaacucccgcuucccaaucccccucgaaaaacucuucaccgguccaucaucugccuucgucguacaaccacaaaauggacgcugcacgaccgacggcguccuccuuggcaccacucaacucucccccgucaacaucugcaccuuccgcggcgacguaacucacauaacgggcucccacaauuacaccaugaaccuagccucccaaaauugguccaacuacgaucccaccgaagaaauccccgccccacuaggcacccccgacuucgucggcaaaauacaagggguacucacccaaaccacacgcaccaacggcucaacccgagggcauaaagccacuguauacgccggcuccgcaaacuucgcacccaaacucggucggguccaauuugaaaccgacacugaucacgaccuugaagccaaccaaaacaccaaguucacccccguaggcgucauccaagacggaaacacaacucaucgcaacgaaccccaacaguggguacuccccuccuacucaggccgcuccacucccaacguccaccucgcccccgcaguagcccccacauucccuggagaacaacuucucuucuucagauccacgaugcccggcugcuccggcuaccccaacauggaccuugacugccuccuaccucaagaaugggugcaauacuucuaucaagaagccgccccagcccaguccgacguagcacuacuccgcuucgucaacccagacacuggucgcguacucuucgaaugcaaacuacacaaaucaggauauguaacagucgcccacaccggccaacaugaccucguaauacccccaaacggcuacuuccguuucgacuccuggguaaaccaauucuacacccucgcccccaugggaaacggaaccggccgccgacgagcccucuaa

SEQ ID NO: 36126 - RNA, 1623 nt, Artificial Sequence
  derived and/or modified sequence opt11 from VP1__Norovirus__AID60871
augaaaauggcuuccuccgacgcaaaccccuccgacggcucugccgcaaaccuaguacccgaaguaaacaacgaaguaauggcacuagaacccguagucggcgcagcaauagcugccccagucgccggucaacaaaacgucaucgaccccuggauccgcaacaacuucguccaagcacccggcggcgaguucaccguaagcccccgcaacgcucccggagaaauacuaugguccgcaccccucggacccgaccuaaaccccuaccugucccaccucgcccgcauguacaacggcuacgccggaggcuucgaaguccaagucauacucgccggcaaugccuucaccgccggaaaaguaaucuuugccgcaguaccucccaauuuccccaccgaaggccucucccccucacaagucaccauguucccccacauaguugucgacguacgccaacucgaacccguccuaauuccccugccagauguacgcaacaacuucuaccacuacaaccaauccaaugacccaacaauuaaacucaucgccaugcuuuacacuccccucagagccaauaacgccggcgacgacguuuucaccgucagcugccgaguacuuacccgcccuagccccgacuucgacuucauauuccucgucccucccaccgucgaaucccgcaccaaacccuucuccguccccguccuaaccgucgaagaaaugacaaacucccgcuuccccacuccccucgaaaaacuguucacaggacccucgagcgcauucgucguccaaccccaaaacggacgcugcacaacagacggcgugcuccucggaaccacucagcucucgccaguuaacaucugcaccuuccgcggcgacgucacccacaucaccggaucacgaaacuacaccaugaaccuugccucacaaaacuggucuaacuacgacccaacagaggaaauccccgccccuuuaggaacccccgacuucgucggcaaaauacaaggcguccuaacucaaacaacacguaccgacggcagcacacgcggacacaaagccacuguauacacuggcagugccgacuucgccccuaaacucggucgaguccaauucgaaaccgacacagaccacgauuucgaagccaaccaaaacaccaaauuuacccccgucggcgucauacaagacggcucuaccacacaccgcaacgaaccccaacaauggguuuuacccucauacuccggccgaaacacccccaauguccaccuagcccccgcugucgcccccaccuuccccggcgaacagcuccuauuuuuccguuccaccaugcccgggugcuccggcuaucccaacauggaccuugacugccuccucccccaggaguggguacaauacuucuaccaggaggccgcccccgcccaaucagacgucgcccuucuccgcuucguaaacccagacaccggcagaguccuauucgaaugcaaacuccacaaauccggcuacgucacagucgcccacaccggccaacacgaccuugucaucccacccaacggcuacuuccgcuucgacucuugggucaaccaauucuacacucucgcccccaugggcaauggcacuggccgacgacgcgcccucuaa

SEQ ID NO: 36127 - RNA, 1623 nt, Artificial Sequence
  derived and/or modified sequence opt11 from VP1__Norovirus__AID60875
augaaaauggccucgucagacgcuaaucccuccgacggaucagccgccaaccuaguccccgaagucaacaacgaaguaauggcacucgaacccguagucggugccgcaaucgccgccccagucgcuggccagcaaaacgucauagauccauggauacgcaacaacuucguccaagcaccaggaggugaguucacugucucaccgcgcaacgcuccgggagaaauccuaugguccgccccucucggccccgaccucaaccccuaccucucccaccucgcccgcauguacaacggcuacgccggcggcuucgaaguucaagucauccucgccggcaaugccuucaccgcgggcaaagucaucuucgcagcagucccacccaacuuccccacugaaggccucucacccucucaaguuacaauguucccccacaucguagucgacguccgccaacucgaaccugugcucauaccccuccccgacguccgcaauaacuucuaccacuacaaccaaagcaacgauuccaccaucaagcucaucgcaaugcucuacacuccccuucgagccaauaacgcaggcgacgacgucuucaccgucuccugccgcguccucacccgcccaucgccugacuucgacuucauauuucucgucccaccuaccgucgaaucccgcaccaaacccuucucagucccaguccuuaccgucgaagaaaugaccaacucucgauuccccacaccccucgaaaaacucuucaccggaccaucauccgccuucguuguccagccccaaaacggccgaugcaccaccgacggcguccuccuaggcaccacccagcucucacccgucaacaucugcacauuccgcggcgacgucacucacaucaccggaucccgaaacuacaccaugaaccucgccucccaaaacuggucuaacuacgacccaacagaagaaauccccgcgccccucggcaccccugacuucgucggcaagauccagggaguccucacccaaacaacacgcaccgacggcuccacacgcggccacaaagccaccguuuacaccggcuccgccgacuucgcccccaaacuaggccgaguucaauuugaaacagacaccgaccacgacuucgaaacuaaccaaaacaccaaauuuaccccagucggcgucauucaggacggcuccaccacacaucgaaacgaaccccaacaauggguccuuccauccuacuccggccggaacaccccaaacguccaccucgcccccgccgucgccccaaccuuccccggcgaacaacuccuauucuuccgauccaccaugcccgguugcagcggcuacccuaacauggaccucgacugucuccuuccacaagaauggguacaauauuucuaccaagaagccgcccccgcccaaucagacgucgcccuacuacgcuuugucaacccagacaccggccgugucuuauucgaaugcaaacuccacaaaucgggcuacgucacagucgcacacaccggccaacaugaccucguaauaccacccaacggcuacuuccgauucgaauccugggucaaccaauucuacacucuagcccccaugggcaacggcaccggccgacgucgagcccuauaa

SEQ ID NO: 36128 - RNA, 1623 nt, Artificial Sequence
  derived and/or modified sequence opt11 from VP1__Norovirus__AID60877
augaaaauggcaucaucugacgcaaacccauccgacggcucagcagccaaccucguccccgaagucaacaacgaagucauggcacucgaacccguaguaggcgccgccauagcagcucccgucgccggucaacagaacgucaucgaccccuggauacgcaacaacuucguccaagcccccggcggcgaauuuaccgucuccccucgaaacgcccccggcgaaauccucugguccgcuccccuaggccccgaucuaaaccccuaccucucccaccucgcccgcauguacaacggcuacgccggcggauucgaaguccaagucauacuggccggaaaugcauucacagccggaaaggucauauucgcagcagucccaccuaacuucccaaccgaaggacucuccccaucacaagucaccauguucccacacaucguugucgacguccgucaacucgaacccguccuaauaccucuucccgacguccgcaauaacuucuaccacuacaaccaauccaacgacucaacaaucaaacucaucgccaugcucuacacaccccuacgagccaacaacgccggcgacgacgucuucaccgucuccugccgaguacucaccagacccucacccgacuucgacuucaucuuccucgucccacccaccguugaaucccgcaccaaacccuucuccguaccaguccucaccgucgaagaaaugacaaacucaagauuccccacuccccuagaaaaacuauucaccggccccuccuccgcuuucgucguccaaccacaaaacggccguuguaccaccgacggcguccuccuaggcaccacucaacuaucucccgucaacauaugcacuuuccguggcgacgucacccacauaaccggaucccgcaacuacaccaugaaccuagccucccagaacugguccaacuaugaccccaccgaagaaaucccagcuccccucggcacacccgacuucgucggcaaaauccaaggaguacugacacaaacaacccggacagacgguucaacacgaggacacaaagccacagucuacacaggcuccgccgacuucgcucccaaacucggacgaguacaauucgaaacagacaccgaccacgacuucgaaaccaaccaaaacacaaaauucacucccgucggagucauacaggacggcucaacaacacaccguaacgaaccccaacaauggguccucccaucauacuccggcaggaacacccccaacguacaccuagcccccgcgguugcaccaacuuucccuggagaacagcuccuuuucuuccgaucaaccaugcccggaugcuccggauaccccaacauggaccucgacugccuccucccacaagaauggguucaauacuucuaucaagaagccgcccccgcccaaucagacgucgcccugcuccgauucguaaaccccgacaccggccgcguccucuucgaaugcaaacuucacaaaucagguuacgucaccguagcccacacaggacaacacgaccucguaauuccaccaaacggcuauuuucgcuucgacuccugggucaaccaauucuacacgcucgcccccaugggcaauggaaccggccgucgacgcgcccuuuga

SEQ ID NO: 36129 - RNA, 1623 nt, Artificial Sequence
  derived and/or modified sequence opt11 from VP1__Norovirus__AID60879
augaaaauggcuucaagcgacgccaaccccagcgacgguucagccgccaaccucgucccagaagucaacaacgaagucauggcucucgaaccugucgucggggcggccauagccgcccccguagcuggacaacaaaacgucauagacccauggauccgcaacaacuucguccaagcuccaggaggagaguucaccgucucccccagaaacgcccccggagaaauacucuggagugcaccccuaggccccgaucucaauccauaccucucccaccucgcccgcauguacaacggcuacgccggcggauucgaaguccaagucauccuugcaggcaacgcauucacugccggcaaagucauuuucgccgccgugccacccaacuuccccacagagggccucucccccucacaaguaacgauguucccccacaucguugucgauguccgccaacucgaacccguucucaucccacuccccgauguccguaacaauuucuaccacuacaaccaauccaaugacuccaccaucaagcucaucgccaugcuuuacacaccccuccgugccaacaacgcaggagacgacgucuucaccgucuccugccgcguucuuacacgccccucccccgacuucgacuucauauuccucguacccccaaccguugaaagccgcacaaaacccuuuuccguacccguacuaaccgucgaagaaaugaccaacucccgcuucccgacaccacuagaaaaacuauucacaggacccucauccgcauuuguaguccaaccucaaaacgggcgcugcacaacagacggaguccuccucggcaccacccaacugucccccgucaacaucuguacauuccgaggagacgucacccacaucaccggcucacgaaacuacaccaugaaccucgccucccaaaacugguccaauuacgacccaaccgaagaaauacccgcuccccuuggaacacccgacuucgucggcaaaauccaaggaguccucacacaaaccacacgaaccgacggcucaacccguggccauaaagcaacagucuacaccggcucagcagacuucgccccuaaacucggacgcguccaauucgaaaccgacacagaccacgacuucgaaaccaaccaaaacaccaaauucaccccuguaggcguuauacaagauggauccacaacccaccgcaacgaaccccaacaauggguccucccaagcuacuccggccgcaacacccccaacguacaucuugcaccagccgucgcccccacauucccaggcgaacaacuccucuucuuccgcucaaccaugcccggaugcucaggguacccaaacauggaccuagacugccuacucccccaagaauggguccaauauuucuaccaagaagccgcccccgcccaauccgacgucgcccuccuucgcuuuguuaaccccgacacaggccgcguccuauucgaaugcaaacuccacaaauccggauacguaacaguagcacacacuggucaacacgaccuaguaaucccuccgaacggcuacuuccgauucgacagcuggguaaaccaguucuacacccucgcuccuaugggcaacggaaccggacgccgccgcgcccuauga

SEQ ID NO: 36130 - RNA, 1623 nt, Artificial Sequence
  derived and/or modified sequence opt11 from VP1__Norovirus__AID60881
augaaaauggccagcuccgacgccaaccccuccgacggcucagccgcaaaccucguucccgaaguuaacaacgaagucauggcucucgaaccugucguaggagccgccaucgcagcacccgucgccggccaacaaaacguaaucgaccccuggauccgaaacaacuucguccaagcccccggcggcgaguucaccgucucaccccguaacgcacccggcgaaauccucugguccgccccacuggggccagaucucaacccauaucucucacaccuugccagaauguacaacggcuacgcaggaggcuucgaaguccaaguaauacucgccgguaacgccuucaccgcaggaaaaguuaucuucgccgcuguacccccaaacuuccccacagaaggacuaucccccucccaaguaaccauguucccccacauagucgucgauguccgccaacucgaacccguccuaauaccacucccagacguacgcaacaacuucuaccacuacaaccaauccaaugacagcaccaucaaacuaauagccaugcucuacacaccacuccgcgcgaacaacgcuggcgacgacgucuucaccgucuccugccgcguacucacacgcccuucccccgacuucgacuucaucuuccucgucccuccgacugucgagucucgcaccaagccauuuuccgugccaguccuaaccgucgaggaaaugaccaacucacgcuuccccacaccccucgaaaaacucuucacuggcccaucaucagcauucguaguacaaccacaaaacggccguugcaccaccgacggaguccugcucggcacaacacaacucucccccguaaacauaugcacauuccgcggcgacgucacccacauaaccggcucccgaaacuacaccaugaaccuugcaucccaaaacuggagcaacuaugacccaacagaagagauacccgcaccccucggaacacccgauuucgucggcaaaauacaaggcgugcuuacacaaaccacccgcaccgacggcuccacccgcggccacaaagccaccgucuacaccggcuccgccgacuucgcccccaagcucggacgcguacaauucgaaaccgacaccgaccacgacuucgaaaccaaccaaaacaccaaauucaccccagucggcgucauacaagacggcuccaccacacaccgaaacgagccccaacaauggguacuccccuccuacuccggccgaaauacacccaacguacaucucgcucccgccgucgcccccacauuccccggcgaacaauuacuauucuuccgauccaccaucccaggcugcuccggauaucccaacauggaccuagacugccuccuaccacaagaauggguccaauacuucuaucaagaagcagcccccgcccaaagcgacgucgcccuccuaagguucgucaaccccgacaccggacgcguccuauucgaaugcaaacuacacaaaucaggauacgucaccguugcucacaccggucaacaugacuuaguaauaccgcccaauggcuacuuccgcuucgacuccuggguaaaccaauucuauacccuagcacccaugggaaacgguacaggacgacgccgugcccuuuaa

SEQ ID NO: 36131 - RNA, 1623 nt, Artificial Sequence
  derived and/or modified sequence opt11 from VP1__Norovirus__AID60883
augaaaauggcauccucugaugccaacccuuccgacggaucggccgcuaaucuaguccccgaaguaaacaacgaaguaauggcccucgaacccgucguuggugccgcgaucgcagcacccguugcaggacaacaaaacgucauagacccuuggaucagaaacaacuucguccaagccccaggcggcgaguucaccauaagcccccgcaacgccccuggugaaauacucugguccgccccacucggacccgaucucaacccauaucuaucacaccucgcccggauguacaacggcuaugcaggcggauuugaaguacaaguaauccucgccggcaacgccuucaccgccggaaaggucauauuugccgcaguacccccuaauuucccaacugaaggccuaucaccaucccaagucaccauguucccccauauagucgucgauguccgucaacuagaacccguacucaucccccuacccgacguccgcaacaauuucuaccacuacaaucaauccaacgacuccaccauaaaacuaaucgccaugcuauacacuccacuccgcgccaacaacgcgggagacgacgucuucacagucucaugcagagucuuaacacgccccagcccagacuucgaccucaucuuccucguuccacccacuguugaaucccgaaccaaaccauucucaguccccguccuaaccgucgaagaaaugacaaacucccgcuuccccacuccccuagagaaacuuuucaccggccccuccagcgcauucgucguccagccccaaaacggccgaugcacaaccgacggaguccuacuaggcaccacccaacuaucacccgucaacauaugcacauuccgcggcgacgugacacacauaacuggaucccgaaacuacaccaugaaccucgccucccaaaacuggucuaauuacgaccccaccgaagaaauccccgcaccccuuggcacucccgacuucgucggcaaaauccaagggguacucacccaaacaacccgcaccgauggcuccacccggggacacaaagccaccgucuauaccggcuccgccgacuuugccccaaaacucggacgcguucaauucgaaacagacacugaccacgauuucgaaaccaaccagaacaccaaauuuacucccgucggaguaauccaagacggcuccaccacccaccgcaacgaaccacaacaguggguccuaccauccuacuccggaagaaacacccccaacguacaccucgcgccugccguugccccaaccuucccgggcgaacaacuccucuucuuccgauccaccauucccggaugcucaggcuaccccaacauggaccucgacugccuccuaccccaagaaugggugcaauacuucuaccaagaagccgcacccgcucaauccgacgucgcccuacugcgcuucgucaacccagacacaggccgcguccucuucgagugcaaacuccacaaaucaggcuacgucaccgucgcccacacaggccaacacgaccucgucauacccccaaacggcuacuuccgcuuugacucaugggucaaccaauucuauacccuagcacccaugggcaacggcaccggacgccgccgcgcccucuaa

SEQ ID NO: 36132 - RNA, 1623 nt, Artificial Sequence
  derived and/or modified sequence opt11 from VP1__Norovirus__AID60885
augaaaauggccuccucugacgcuaaccccuccgacggauccgccgccaaccucguccccgaagucaacaacgaagucauggcacuagaacccgucguaggcgccgcuaucgccgccccaguagccggccaacaaaacgucaucgacccuuggaucagaaacaacuucguccaagccccuggaggcgaguucacaguauccccaagaaacgcacccggcgaaauccucugguccgcgccccugggacccgaucuaaacccauaccucucccaccuugcccgaauguacaacggcuacgcgggcgguuuugaaguccaagucauccuagccggcaacgccuucacagccgguaaagucaucuucgccgccgugccuccuaacuucccaacagaaggccucucacccucacagguuaccauguucccccacaucgucguagauguacgacagcuagaacccguucucaucccccuacccgacguccgcaacaacuucuaccacuacaaccaaucaaacgacuccaccauaaaacucauagccaugcuauacacaccccuccgcgccaacaacgccggcgacgacgucuuuaccguaucaugccgaguacucacucgccccucacccgacuucgacuucaucuuccuugugcccccuacagucgaaucacgcaccaaacccuucucaguccccguacuaaccgucgaagaaaugaccaacucacgcuuccccacaccccuugaaaaacucuucaccggcccuuccuccgcauuuguaguacagccccagaacggccgcugcaccacggacggaguccuccucggcacuacacaacuauccccugucaacaucugcaccuuccgcggagacgucacucacauaacaggcucuagaaacuacacgaugaaccuagccucccaaaacuggucaaacuaugaccccacugaagagauccccgcuccccucggaacaccugacuucgucggcaaaauacaaggaguccuuacgcaaaccacccguaccgauggcuccacccgcggccacaaagccaccgucuacacaggguccgccgacuuugccccaaaacuaggccgcguucaauucgaaacagacaccgaccacgacuucgaaacaaaccaaaacacaaaguucaccccaguaggagucauccaagacggcuccaccacccaccgcaacgaaccccaacaauggguccuaccaagcuauuccggccgaaacacccccaacguccaccuugccccagccgucgcccccaccuuccccggugaacaacuccucuucuuccgcucaacaaugcccggcugcucuggcuaccccaacauggaccucgacugccuccuuccccaggaauggguucaauacuucuaccaagaagccgcccccgcccaaucagauguagcccuucuccguuucgucaaccccgacacaggccgcguacuauucgaaugcaaacuccacaaaagcggcuacguaaccgucgcacacacaggccaacacgaccucgucaucccucccaacggauacuuccgauucgacagcugggucaaccaauucuacacccucgcccccaugggcaauggcaccggcagacgucgagcccuuuaa

SEQ ID NO: 36133 - RNA, 1623 nt, Artificial Sequence
  derived and/or modified sequence opt11 from VP1__Norovirus__AID60887
augaaaauggcauccuccgacgccaaccccucugacggcuccgccgccaaccucgucccagaaguaaacaacgaagucauggcacucgaaccuguagucggggcagcaaucgccgcaccagucgcaggccaacaaaacgucaucgaccccuggauacgaaacaacuucguacaagcccccggcggagaguucacaguaucccccagaaacgcacccggcgaaauucuaugguccgcuccccucggcccugaccucaacccauaccuaucccaccucgcccgaauguauaacggguacgccggcggauucgaaguacaagucauacuugccggcaacgccuuuaccgccggcaaagucaucuucgccgccgucccuccaaacuuccccaccgaaggacucucucccucccaagucaccauguucccccacaucguagucgacguccgccaacucgaaccaguccucaucccucuucccgacguccgcaacaacuuuuaccacuacaaccaaucaaacgaccccacaaucaaacucaucgccaugcucuacacaccccuacgcgccaacaacgccggcgacgacgucuucaccguaucaugccggguacuaacccgccccucucccgacuucgacuucaucuuccucguaccacccaccgucgaaagccggaccaagcccuucuccgucccaguccuaaccgucgaagaaaugaccaacucacguuucccuacgccccucgaaaaacuauucacaggccccuccuccgccuucguaguccaaccacaaaacggccgcugcaccaccgaugguguacuccuagguaccacccaacucucccccgucaacaucugcaccuuccgcggcgacgucacgcacaucaccgggucacgaaacuacaccaugaaccucgccucacaaaacuggagcaauuaugaucccacagaagaaauccccgcaccccucggcacacccgauuucgucggcaaaauacaaggcguccuaacacaaaccacacgcaccgacggcucuacacgcggccacaaagccacagucuacacuggaucagccgauuucgcccccaaacugggccguguccaauuugaaaccgacaccgaccacgacuucgaaacuaaccaaaacaccaaauucacacccguaggagucauccaagaugguuccaccacccaccgcaacgaaccccaacaauggguucucccauccuacuccggccgcaacacccccaacguccaccucgcuccugccguagcuccuacauuccccggagaacaacuacucuucuuccgcagcaccaugcccggaugcucgggcuaccccaauauggaccuagacugucuacucccccaagaauggguacaauacuucuaccaagaagcugcacccgcccaauccgacgucgcccuacuccgcuucgucaaccccgacacuggucgcguccucuucgaaugcaaacuccacaaguccggauacgucaccgucgcccacacaggccaacacgaccucgucauaccucccaauggauacuuucgcuucgacuccuggguuaaucaauuuuauacccuagcccccaugggaaacggaaccggccgccgacgcgcacuuuaa

SEQ ID NO: 36134 - RNA, 1623 nt, Artificial Sequence
  derived and/or modified sequence opt11 from VP1__Norovirus__AID60889
augaagauggccucauccgacgccaaccccugcgacggcucugccgccaaccucguccccgaaguaaauaacgaaguaauggcacucgaacccguagucggcgccgcuaucgcagcacccgucggcggccaacaaaacgucaucgaccccuggauacgaaauaacuucguacaagcccccggcggcgaguucacaguuucaccccgcaacgcccccggagaaauccucugguccgcaccccuuggccccgaccucaaccccuaccucucccacuuagcccguauguacaauggauacgccggcggcuucgaaguccaaguaauacuagccggcaacgccuucaccgcgggaaaagucaucuucgcagccgugcccccuaacuuccccaccgaaggccuaucacccucacaaguuaccauguucccccacaucgucguugacguccgacagcuagaaccuguccucaucccccuacccgauguccgcaacaacuucuaccacuacaaccaaagcaacgacucuacaauaaaacucaucgccaugcucuacacaccccuaagagccaacaacgccggagacgacgucuucaccguuuccugccgaguacucacacgcccaucacccgacuuugacuucaucuuucucgucccacccacagucgaaucacgcacaaaacccuucucugucccaguccucaccgucgaagaaaugaccaacucacgauucccaacuccccucgaaaaacuauucaccggacccuccuccgcauucgucguccaaccucaaaacggacgaugcaccaccgacggaguacuccuaggcacaacacaacucucacccguaaauaucugcacauuccgcggcgacgucacucacauaacaggaucgcgaaacuacacgaugaaccuugccucgcaaaacugguccaacuacgaccccaccgaagaaauaccagccccacucggcacccccgauuucgucggaaaaauacaaggcguacuaacucaaacaacccgcaccgacgguagcacccgcggccacaaggcaaccgucuauauaggauccgccgacuuugcccccaaacucggccgcguccaguuugaaaccgacaccgaccacgauuucgaaaccaaccaaaacaccaaauuuacccccguaggcguaauccaagacggcucaaccacccacagaaacgaaccccaacaguggguacuccccuccuauuccggacgcaacacccccaacguacaccuagcuccugccgucgcucccaccuuccccggcgaacaacuacucuucuuucgcuccacucucccagguugcagcggguacccaaacauggaccucgacugccuccucccucaagaauggguucaguacuuuuaccaagaagcagccccugcccaaucugacgucgcacuccuacgauucguaaaccccgacacaggacgaguccucuucgagugcaaacuucacaaauccggauacgucacagucgcccacaccggccaacacgaccucgucaucccucccaacggcuacuuccgcuucgacucaugggucaaccaauucuacacccucgcccccaugggcaacggaaccggccgcagacgagcacuauaa

SEQ ID NO: 36135 - RNA, 1623 nt, Artificial Sequence
  derived and/or modified sequence opt11 from VP1__Norovirus__AID60893
augaaaauggccuccuccgacgccaaccccagcgacggauccgccgccaaccuaguacccgaagucaacaaugaagucauggcacuugaacccgucgucggagccgccaucgccgcacccgucgcaggccaacaaaacguaaucgacccauggauacgcaacaauuucguccaagcacccggcggagaguucaccguuucaccacgaaacgcuccaggcgaaaucuuaugguccgcaccccuuggacccgaccucaacccauaccuuucccaccuugcccgaauguacaacggcuacgccgggggauucgaaguccaaguaauccucgccggcaacgcauucaccgcaggcaaagucaucuucgcagcaguucccccaaacuucccaacugaaggccugucacccucccaggucaccauguucccccacaucgucguagacguccgccaacuagaacccgugcucauaccccuucccgacguccgcaacaacuucuaccacuacaaccaauccaacgacucuaccaucaaacuaaucgccaugcuauacacuccccuccgugccaacaacgcaggagacgacgucuucaccgucuccugccgaguauuaacccgcccuucccccgacuucgacuucauuuuccucgugcccccgaccgucgaaucgcgcacaaaacccuuuucgguacccgucuuaaccguagaagaaaugacaaacucccgauuccccacaccccucgaaaaacuuuuuaccggcccauccuccgcauucgucguacaaccccaaaacgggaggugcacaaccgacggcguccuccuaggcaccacacaacucucacccgucaauauuugcaccuuccgcggcgacgucacucacaucaccgguucccgcaacuacaccaugaaccucgccucacaaaacuggagcaacuacgacccaacagaagaaauccccgcuccucuuggcacccccgacuucgucggcaaaauccaaggaguccuaacacaaacgacucgcaccgacggcuccacacgaggacacaaagcaaccgucuauaucggaucagcagacuucgcccccaaauuaggcagaguacaauucgaaaccgacaccgaccacgacuucgaaacaaaccaaaacaccaaauucacaccuguaggagugauccaagacggcucuaccacccacagaaacgaaccccaacaauggguccuaccauccuacuccggccgcaacacccccaacguccaccucgcaccagccguagcacccacauuccccggagaacaacuccuauucuuccgcucuacccuucccggcugcucugguuaccccaacauggaccucgacugccuccuaccccaagaauggguccaauacuucuaccaagaagcagcccccgcccaauccgacguagcucuacuccgcuucgucaaccccgacaccggccguguccuauucgagugcaaacuccacaaaucaggcuacgucacaguugcucacaccggccaacacgaccucguaauacccccaaacggcuacuuccgcuuugacagcugggucaaccaauucuacacucucgcccccaugggcaacggcacaggccgacgacgcgcccucuaa

SEQ ID NO: 36136 - RNA, 1623 nt, Artificial Sequence
  derived and/or modified sequence opt11 from VP1__Norovirus__AID68577
augaaaauggccucuuccgacgccaaucccuccgacggauccgccgccaaccucguacccgaaguaaacaacgaaguaauggcccucgaaccugucgucggcgccgccaucgcagccccagucgccggccagcaaaacgucauugaccccuggauacgaaacaacuucguacaagccccaggaggagaguucaccguuucuccaagaaacgcaccaggcgaaauacucugguccgccccgcucggacccgaccucaaccccuaccuaucccaccuugcaagaauguacaacggcuacgccggaggcuucgaaguacaaguuauccuagccggaaacgccuuuaccgcugguaaagucaucuucgccgccgucccucccaacuucccgaccgaaggacucucaccaucccaagucacaauguucccccacaucgucgucgacguccgccaacuagaaccuguacuaaucccacuccccgacguccgcaacaacuuuuaccacuacaaccaaucaaaugacccaacaaucaaacucauugccaugcucuacaccccacuacgcgccaacaacgcaggagacgacgucuucacagucuccugucgaguacuaacccgccccucucccgacuucgauuucaucuuccugguaccacccaccgucgaaucucgaaccaaacccuucuccguacccguacucaccguagaagaaaugaccaacucccgcuuccccaucccacuugaaaaacucuucacaggccccucaagcgccuucguuguacaaccacaaaauggaagaugcaccaccgacggcguccuacucggcaccacacaacucuccccagucaacauuugcaccuuccgcggcgacguaacgcacauaaccggcuccagaaacuauacaaugaaucuggccucccaaaacuggucaaacuacgacccaaccgaagaaauccccgcaccccucggcaccccagacuucguaggcaagauacaaggcaugcucacacaaaccacccgaaccgacggcucuacccgcggacacaaagccaccgucuacacaggaucagcagacuucgcccccaaacucggacgcguccaauucgaaaccgacacagaccgcgacuucgaagccaaccaaaacacuaaauuuacccccgucggcgucauccaagacggcucuaccacgcaccgcaacgaaccccaacaauggguucuccccuccuacuccggacgcaacaccccaaauguccaccuagcccccgccgucgcacccacauucccgggcgagcaacuccucuucuuccguuccacaaugcccggaugcuccggguaccccaacauggaucuugacugccuacuuccacaggaauggguccaauacuucuaccaagaagccgcaccagcccaaucggacguagcccuacuacgcuucgucaaccccgacaccggucgcguccucuucgaaugcaaacuccacaaaagcggcuacgucaccgucgcacacacaggccaacacgaccuagucauaccuccaaacggcuacuuccgcuucgacucauggguaaaccaauuuuacacacuugccccaaugggaaacggcaccggccgacgccgcgcccuauag

SEQ ID NO: 36137 - RNA, 1623 nt, Artificial Sequence
  derived and/or modified sequence opt11 from VP1__Norovirus__AID68578
augaaaauggccuccuccgaugccaaucccucagacggauccgccgccaaccuugugccagaagucaacaacgaagucauggcccuagaaccagucgucggagccgccaucgcggcgcccgucgccggccaacaaaacgucauugacccuuggauccgcaacaauuucguacaagccccuggcggugaguuuacaguaucaccacgcaacgcaccaggcgaaauccucugguccgcuccccucggaccagaucuaaacccauaccuaucccaccucgcccgcauguacaacgguuacgccggaggcuucgaaguccaaguaauccucgccggcaacgccuucaccgccgguaaagucauuuucgccgcaguucccccaaacuucccuacagaaggccucucucccucacaagucaccauguucccccacauugucguagacguccgccaacucgaacccguccucauaccccuccccgacguccgcaacaauuucuaccacuauaaccaaucuaacgaccccaccaucaaacucaucgcaaugcuauacaccccacuccgcgccaacaacgcaggcgacgacguuuuuacagucuccugccgcguccuaacccgccccagcccagacuuugacuucaucuuccucgucccacccacugucgaaucccgcaccaaaccauucuccguaccaguucucaccgucgaagaaaugaccaauucacgcuuccccaucccccuagaaaaacuauuuacgggucccuccuccgcauucgucguccaaccacaaaacggacgcugcaccaccgacggcguccuucucggcaccacucaacucuccccagucaacaucugcacauuccgcggcgaugucacacacauaacaggcucccacaacuacaccaugaaccuagcuucccaaaacuggaacaacuacgauccaaccgaggagauccccgcgccacucggcacccccgacuucguugguaaaauccaaggcguacugacacaaaccacacgaaccgacggcucgacacgaggacacaaagccacagucuacacagguuccgccgacuucucacccaaacuuggccgaauacaauucgaaacagacacaaaccacgacuucgaagccaaccaaaacacaaaauucaccccaguuggagucauccaagacggaggcaccacacaccgcaacgagccccaacaauggguccuacccuccuauuccggccguaacacuccaaacguacaucucgcccccgccgucgcacccacuuucccaggcgagcaacuccucuucuuccgcuccaccaugccaggcugcuccggcuaccccaacauggaccuagacugccuacuaccacaagaauggguccaauacuucuaccaggaagccgcgcccgcgcaauccgacgucgcccuucuccgcuucgucaacccagacaccggccggguccuauucgaaugcaaacuacacaaauccggcuacgucaccgucgcccacaccggccaacacgaucucguaaucccgccuaacggauacuuccgauucgacuccugggucaaccaauucuacacccucgcccccaugggcaauggcaccggccgccgcagagcccuauaa

SEQ ID NO: 36138 - RNA, 1623 nt, Artificial Sequence
  derived and/or modified sequence opt11 from VP1__Norovirus__AID68579
augaagauggccucaucugaugccaacccaagcgacggcuccgccgcaaaucucguccccgaagucaauaacgaaguacucgcccucgaacccguaguuggcgcagccaucgccgccccagucgcaggccaacaaaacguuaucgacccauggauacgcaacaacuucguccaagcaccaggcggcgaauuuaccguuuccccacgaaacgcacccggcgaaauacucugguccgcaccccuaggacccgacuuaaaccccuaucucucccaccuugcccgcauguauaacggcuacgccggaggauucgaaguccaagucauccuagccggcaacgccuucaccgccggcaaaguuauauucgcagccgucccacccaacuuccccacagaaggccuaagccccucucaagucaccauguucccacacauugucguagacguacgacaacuagaaccuguacucauaccccuucccgacguacgcaacaacuucuaccacuauaaccaaaguaacgaucccacaaucaaacuaauagccaugcuauacacuccccuacgcgcaaacaacgcaggcgacgacgucuucacggucuccugccgaguccuaacacgccccucccccgacuucgacuucauauuccucgucccaccgaccguugaaucccgaaccaaaccauucuccguaccaguccuaaccgucgaagaaaugaccaacagccguuuccccauaccacuagaaaaacucuucaccggacccagcucagccuuuguaguccaaccccaaaacggccgaugcacaacugacggcguccuucuaggcaccacccaacucucuccagucaacaucuguacauucagaggcgacgucacacacaucaccggaucccacaacuacacaaugaaucuagcuucccaaaacuggaacaacuacgaccccaccgaagaaauacccgcgccccucggaacccccgacuuuguaggcaaaauccaaggcguccucacacagacgacccgcaccgacggcucaacccgcggucacaaagccacugucuacaccggcuccgccgacuucuccccuaaacuaggccguauucaauucgaaaccgacaccaaccacgacuucgaagccaaucaaaacacaaaauucacccccgucgguguaauccaagacggcggcacaacccacagaaacgaaccccaacaauggguacucccaagcuacucuggccgaaacacccccaacguacaccucgccccagccgucgcccccaccuuccccggcgaacaacuccuauucuuccgcucaaccaugcccggcugcucaggauaucccaacauggaccuagacugccucuuaccucaagaauggguacaauacuucuaccaagaagccgcccccgcccaaucagacguagcccuccuccgcuuugucaaccccgacaccggccggguacuauuugaaugcaaacuucacaagucuggcuacgucaccguagcacacaccggccaacacgaccucguaauaccucccaacggcuacuuccgauucgacucauggguaaaccaauucuacacccucgcccccaugggaaacggcaccggccgccgccgcgcccucuaa

SEQ ID NO: 36139 - RNA, 1623 nt, Artificial Sequence
  derived and/or modified sequence opt11 from VP1__Norovirus__AID68581
augaaaauggccucauccgacgccaacccuagcgacggcuccgccgcgaaccuaguccccgaaguaaacaacgaagucauggcccuugaacccguagucggcgcagccaucgccgcuccagucgcaggucaacaaaacgucaucgaccccuggauccgaaacaacuucguccaagcucccggcggagaguucacaguauccccacgaaacgcccccggagaaauccucugguccgccccacucggacccgaccuaaacccauaccuaucacaccucgcccgaauguacaacggauacgccgguggcuucgaaguccaggucauccucgcgggaaaugcauucaccgccggcaaaguaauauucgcagccguacccccuaacuuccccaccgaaggucuaucaccaagccaagucaccauguucccacacaucgucguugacguccgacaacuagaacccgucuuaauaccccuccccgacguacgaaacaauuucuaccacuacaaccaaucaaacgaccccaccaucaaacucauugccaugcuauacacaccacuccgcgcaaauaacgcuggagacgacgucuucacagucucaugccgaguccucacacgcccaucccccgacuucgacuucaucuuccucguucccccuaccgucgaaucccgaacaaaacccuucucaguuccaguacucacagucgaagaaaugacaaacucccgcuuccccaucccccucgagaaacuuuucaccggccccucaucggccuucguaguccaaccacagaacggaagauguaccaccgacggaguacuccucggaacaacacaacucuccccgguuaacaucugcaccuuccgcggcgacgucacacacaucaccggcucacgcaacuacacgaugaaucucgcaucucaaaacuggaacaacuacgaccccaccgaagaaauccccgcaccccuaggaacccccgacuucgucggcaaaauccaaggcguccucacccaaaccacccgaaccgacggcagcacaagaggacacaaagccacagucuacaccggcuccgcagacuucgccccaaaacuaggacgcguccaguucgaaacagauacagaccacgacuuugaagccaaccaaaacaccaaauucacacccgucggcgucauccaagacggcggaaccacccaccgcaaugaaccucaacaauggguccuaccuagcuacuccggacgcaacacccccaacguucaccucgcccccgccguggcaccaaccuuccccggcgaacaacuccuauucuuccgauccaccaugcccgguugcuccggcuacccuaacauggaccucgacugccucuuaccccaagaauggguccaauacuucuaccaagaggccgcacccgcccaaucagacgucgcccuacuccgcuucgucaacccggacacaggacguguccucuucgaaugcaagcuccacaagucgggcuacgugaccgucgcccacaccggccaacacgaucucguaaucccucccaacgguuacuuccgcuucgacuccugggucaaccaauucuacacccucgcgcccaugggcaacggcaccggccgacgccgcgcccucuag

SEQ ID NO: 36140 - RNA, 1623 nt, Artificial Sequence
  derived and/or modified sequence opt11 from VP1__Norovirus__AID69174
augcgcauggcauccgacgacgccaaaucagcacccucagaccucgaaggcgccggucucguccccgccaccgcagcaccgcuaccaguagcccccgucgccggcgcgcaagccgccgaacccuucgccggccaaaucaacgucauagacccauggauauacaccaacuucguccaagcacccaccggggaguucacaguaucuccccgcaacacccccggagaaguccucgugaaccucgaaaucggccccaacuuaaacccuuaccuacagcaccuagcccaaauguacaauggcuacgccggaggcgucgaaguucaaguaauacucgccggaaacgccuucaccgccggaaaacuacucugcgcccuagucccacccggauuccccacauccuccauaacccccgcacaacucaccaugcucccacacaccauaauagacguccgcacaaccgaccccgucgucguccccaugccagaugugcgccgaacccuauggcacgaaguccgcuccacaaccgaaccccucaugagacucgucaucaugcucuacacccccaugcgcgccaacuccggcucagacgaagccuucgucguauccggccgcguacucucaagacccgcccccgauuucaacuucuuuuaccuaguucccccacgcguagaagacaccguagaacccuuuucccuccccgacuuacgugucgacgaaaugucaucaucccgcuggcaaaacccagucguaaugcuccaagcugaccccaaccagaauaucgcagcacacuggcaaaacggcagaugcaccaucaacggagaacuccucggcaccacaccccgaaaccaaagcuggcuacucagaaugcgcggaagcguacuagccgcaccaggaggccaaaaagcagucaccgucaacgucgaccucaccgagcccgacggccaagcauuuuccguacucucaggcaaccccggaccagaaggaguaccagacuuccaagccaucuacaauguacgcauguccaccgcaucaaccaccgccggacacaccguagccaccaacggauacaucgaacaaucaggauacacaccagcacuagguacccucguaauccaaggcgucgaccuaucucaaguccccgcacuuggaucagaagucaccaugcaagucgucuccauugaccucaaccauaacauggaccccaccagacuccccgacuacaacggcgccggcuucgacgguuccgucgcccucgcuccuccccucgucccaccccuccccggggaaguucuccuccgauucaccacacucccgauuaccaccucacgagguucuuccgucuccgccacucucgacugcgcccuacccgccgaauggaucacaugguuccuaguccacaacuucguaccccaaggcgacgccgcccuacuccgcuaccgcaaccgaggcaccggacaaauccucuuugaaugcaaacucuacaaagaagguuuccucgcaguggccggcguauccacucgcacagucuuccccacaagcggcguauucgaguucguauccuggguccccgucuuuuaccaacuaacacccgucggcuccagcggagccagaaaacgccaaagauag

SEQ ID NO: 36141 - RNA, 1623 nt, Artificial Sequence
  derived and/or modified sequence opt11 from VP1__Norovirus__AIG59994
augaaaauggccuccuccgaugccaaccccagcgacggcuccgccgccaaccuaguccccgaagucaacaaugaaguaauggcccuagaacccguaguaggcgccgccaucgcugccccaguugcuggacagcaaaacgucaucgacccuuggauccgaaacaauuucguccaagcaccaggcggggaguucaccgucucaccccgaaacgcccccggcgagauccucugguccgccccacuaggccccgaccuaaaccccuaccucucccaccucgcacgaauguacaacggcuacgcaggaggcuucgaaguccaagucauccucgcuggcaacgccuucaccgccggcaaagucaucuucgccgcagucccacccaacuuucccacugaaggccucucaccaucacaaguaaccauguucccccacaucgucgucgacguacgacaacucgagccuguucucaucccccucccagacgucagaaacaacuucuaucacuacaaucaaucaaacgaccccaccauuaaacuaauugccaugcucuacacaccccuccgcgccaacaacgccggugacgacgucuucaccgucuccugucgcguccuaacccgccccucccccgacuucgacuuuaucuuccuugucccacccaccgucgaaucccgcaccaaacccuucucuguccccguacuaaccgucgaagaaaugacaaacucccgauuccccauaccccucgaaaaacucuucaccggaccaucuucagccuucgucguucaaccccaaaacggucguugcaccacugacggaguccuccucggaacaacgcaacucucacccgucaacauaugcacauuccgcggagacgucacccacauuacuggcucacgaaacuacaccaugaaccucgccucccaaaacuggaacaacuaugacccuaccgaagaaauccccgcaccccucggcacccccgacuucgucggcaaaauucaaggcguccucacccaaaccacccgaaccgacggcuccacccgcggccacaaagccacaguuuacaucggauccgccgacuucgccccgaaacucggcagaguccaauucgaaaccgacaccgaccaugacuuugaagccaaccaaaauaccaaauucacccccgucggcgucauacaagacggcggcacaacccaucgaaacgaaccacaacaauggguccuccccucauacucaggccgaaacacccacaacguacacuuagcacccgccguugccccaaccuuccccggagagcaacuccuauucuuccgaucaaccaugcccggaugcagcgguuaccccaacauggaucucgacugccuucuaccacaagaauggguacaauauuucuaccaagaagccgcccccgcucaaucagacguagcccuacuccgcuucgucaacccugacaccgggcgaguacuauucgaaugcaaacuucacaaaucaggcuacguuaccgucgcccacaccggccaacacgaccuaguuaucccaccuaauggcuacuuccgauucgacuccugggucaaccaguucuauacacucgcccccaugggcaacggcaccggcagacgacgagccguauaa

SEQ ID NO: 36142 - RNA, 1623 nt, Artificial Sequence
  derived and/or modified sequence opt11 from VP1__Norovirus__AIG59996
augaaaauggcauccucggacgccaaccccuccgacggcucagccgccaaccucguacccgaagucaacaacgaagucauggcccuugaaccagucgucggagcagccaucgccgcccccgucgccggccaacaaaacguuauagaccccuggaucagaaacaauuucguccaagcccccggcggugaguucacaguaucuccacgcaacgcacccggagaaauccuuuggucagcaccccucggucccgaccuaaaccccuaccuaucccaccuugcccgaauguacaacggcuacgcaggaggcuucgaaguccaaguaauucucgccgguaacgccuucacagccggcaaaguaauauucgccgccgucccaccaaacuuccccacggaaggucucucccccucacaaguaacgauguucccgcacaucguagucgacguccgacaacuagaacccguccuuaucccccuccccgacgucagaaacaauuucuaccauuacaaccaaucaaacgacccaaccauaaaacucaucgcaauguuauauacaccccuccgcgcaaauaacgccggcgacgacguauucaccgucuccugccgaguccucacccgccccucuccggacuucgacuucaucuuccucgucccacccacagucgaaucccgcaccaaaccauucucagucccuauccucaccguggaagaaaugacaaacucucgcuuccccaucccccuagaaaagcuauuuaccggacccucaagcgcuuucgucguccaaccucaaaacggccgcugcaccaccgacggaguccuccucggcaccacacaacucagccccguaaauaucugcaccuuccguggcgacgucacucacaucaccgggucccgcaacuacaccaugaaccucgcaagccaaaacuggaacaacuacgaccccaccgaagaaaucccagcuccccucggcacccccgacuuugucggcaaaauacaaggaguccuuacccaaaccaccaggacagacggcucaacacgcggccacaaagccacaguauacaccgguucagccgacuucgcccccaaacucggcagaguacaauucgaaacagacaccgaucacgacuucgaagccaaccaaaacaccaaauucaccccagucggagucauccaagacggcggaacuacucaccgaaacgaaccccaacaauggguccuccccucauacuccggccgcaacacccacaacguccaccucgcccccgcagucgccccaaccuucccaggcgaacaacuccuauucuuccgauccaccaugcccggaugcucaggcuaccccaacauggaucuagacugccuccuaccccaagaaugggugcaauacuucuaccaagaagccgcaccagcccaaucagacguugcccuccuacguuucgucaacccagacacaggccggguccucuucgaaugcaaacuccauaaauccggauacguaaccgucgcccacaccggccaacacgaccucgucaucccacccaauggcuacuuccgauucgauuccuggguaaaccaauucuacacucuugcccccauggguaacggaacuggccgccgacgagccguauaa

SEQ ID NO: 36143 - RNA, 1623 nt, Artificial Sequence
  derived and/or modified sequence opt11 from VP1__Norovirus__AIG59998
augaaaauggcaagcucagacgccaauccauccgacggcuccgcagccaaccucgucccagagguaaacaacgaaguaauggcccuugaacccgucguuggcgccgccauagccgcaccagucgcaggccaacaaaacguaaucgaccccuggauccgaaauaacuucguccaagccccaggcggagaauuuaccguuagcccucgaaacgcaccaggcgaaaucuuauggucagcaccucucggacccgaccuaaaucccuaccuaucccaccucgcccgaauguacaacggcuacgccggcggauucgaaguccaagucauccucgccggcaacgccuucaccgcaggcaaagucauauucgcggccgucccaccaaacuucccaacagaaggccucucaccaucccaaguaaccauguucccacacauaguagucgacguacgucaacuagaacccguccucauaccacucccagacguacgaaacaacuucuaccauuacaaccaaaguaacgacccaaccaucaaacucauugccaugcucuacacaccucugagagccaacaacgcaggagacgacgucuucaccgucuccugccgcguccuuacccgccccuccccagacuucgacuucaucuuucucguaccacccaccgucgaauccagaaccaaacccuucagcguccccguccucaccgucgaagaaaugaccaacuccagauuccccaucccccuggaaaaacucuucaccggacccucaucagccuucgucguccaaccucaaaauggccgcugcaccacugacggaguucuucuuggcaccacccaauuaucuccaguaaacauauguaccuucagaggugacgucacccacauaaccggcucucgaaacuacaccaugaaccucgccucccaaaacugguccaacuaugaccccacagaagaaauccccgcaccccucggcacacccgacuucguagguaaaauacaaggcguacuuacccaaacaacacgcaccgacggauccacacgcggccacaaagccaccgucuacaccggaagcgccgacuucgcccccaaacucggccgcguucaauuugaaaccgacaccgaccgcgacuucgaagcaaaccaaaacaccaaguucacacccguuggagucauccaagacggcuccaccacacaccgcaacgaaccccaacaauggguccuccccucauacagcggccgaaacacacccaacguccaccucgcucccgccgucgcccccaccuuuccaggggaacaacuucucuucuuucgcuccaccaugcccggcugcuccggcuaucccaacauggaucucgacugccuccucccccaagaauggguccaguacuucuaccaagaagcagcacccgcccaauccgacgucgcccuacuccgcuucguaaacccggacaccggccgcguacucuucgaaugcaaacuccacaaauccggcuacguuaccgucgcccacacuggccaacacgaccuagucauaccacccaacggcuacuuucgcuucgacucauggguuaaccaauucuacacccucgcucccauggguaacggcaccggacgccgccgagcacucuaa

SEQ ID NO: 36144 - RNA, 1623 nt, Artificial Sequence
  derived and/or modified sequence opt11 from VP1__Norovirus__AIG60000
augaaaauggccucuucagacgccaaccccucagacggcuccgccgccaaccuggucccagaaguaaacaacgagguaauggcccucgaacccguagucggcgccgccauagccgccccugucgccggacaacaaaacguaaucgaccccuggauccgaaauaacuucguucaagcacccggcggagaguucacagucucuccccgaaacgccccaggugaaauccucugguccgcuccccucggccccgaucuaaaccccuaccucucccaccucgcacgaauguauaacggccacgcaggcggcuucgaaguacaagucauccuagcaggcaacgccuucacagcaggcaaaguuauauucgcugccgucccaccaaacuuucccacagaaggacucucccccucccaaguaacaauguucccccacauagucguagacguccgacaacucgaaccuguucuuaucccauuacccgacgugcgcaacaacuucuaccacuacaaccaaucgaacgaccccacaaucaagcuaauagccaugcuuuacacaccccuuagagccaacaacgccggcgacgacgucuucaccgucagcugccgcguccuaacccgccccucccccgacuuugacuucauauuccucguacccccaaccgucgaaagccgcaccaaacccuucucugucccaguccucaccgucgaagaaaugaccaacucccgcuucccaauccccuuagaaaaacucuucaccggaccaagcucagcauucgucgugcaaccccaaaacgguagauguacuacagacggaguccuccucggcaccacccaacuuucccccgucaacauauguacauuccgcggcgacgucacccacaucaccggaucccgcaacuacacaaugaacuuagccucacaaaacuggaacaacuacgaccccacagaagaaaucccagcuccccucggaacaccagacuucgucggaaaaauccagggcgucuuaacacaaacuacccguacagacggcuccacacgaggccacaaagccaccguguauacgggcuccgccgacuucgccccaaaacuuggccgaguccaauucgaaacagacaccgaccacgacuucgaagccaaccaaaacaccaaauucacacccgucggcgucauccaagacggugguacaacccaucgcaacgagccccaacaauggguacuaccaucuuacucgggacgcaacacacauaacguacaucuugcaccagccguagccccaaccuucccaggcgaacaacuccucuucuuucguucgacgaugcccggaugcucaggcuaccccaacauggaccuagacugccuacucccccaagaauggguucaauacuucuaccaagaagcagcccccgcccaaagcgacgucgcucuacuacgauucgucaacccagacacaggccgcguccuauucgaaugcaaacuccacaaaucaggauacgucaccgucgcacacaccggacaacacgaccuugucauaccucccaacggcuacuuccgcuucgacucauggguaaaccaauucuacacccuagcgcccaugggcaacggaacaggucgccgucgagccguauaa

SEQ ID NO: 36145 - RNA, 1623 nt, Artificial Sequence
  derived and/or modified sequence opt11 from VP1__Norovirus__AIG60002
augaaaauggccuccagcgacgccaacccauccgacggcucagcagcaaaucuaguaccagaaguaaacaacgaagucauggcacuagaacccgucgucggcgcagccaucgcagcaccuguagcaggccaacaaaaugucaucgacccauggauccgcaacaacuucguccaagcccccggaggcgaauuuaccgucagcccccgcaacgccccaggcgaaauccugugguccgcaccacuaggccccgaucucaaccccuaccuuucacaccuagcccgcauguacaacggauacgccggaggauucgaaguccaagucauacuagccggcaacgcauucaccgccggcaaagucaucuucgcagcaguaccucccaacuuccccaccgaaggccuaucccccucacaagucaccauguucccccacaucgucgucgacguccgccaacuagaacccguacucauaccccuccccgacguccgaaacaacuucuaccacuacaaccaauccaacgacccaaccauuaaacucauagcuaugcuauacacuccccuccgcgccaacaacgcaggcgacgacguuuuuaccguaagcugucgcguacucacccgccccuccccagauuucgauuuuauauuccucgucccuccaaccguugaaucccgcaccaaaccguucucaguccccguacuaacuguagaagaaaugaccaacagccgauucccaaucccacuagaaaaacuauucaccggccccuccuccgcauucgucguacaaccccaaaacggccguuguaccaccgacggcguccuccucggcaccacccaacuaucccccgucaacaucuguaccuuccgcggcgccgucacccacaucaccggaucucgcaacuacaccaugaaccucgccagccaaaacuggagcaacuaugacccaacagaagaaauccccgccccacucggaacaccagauuucgucggcaaaauacagggcguccucacacagaccacccgaaccgacggaucaacccgcggccauaaggccacagucuacacaggcagcgcagacuucgcacccaaacucggacgaguacaauucgaaaccgacaccgaccgcgacuucgaagccaaccaaaacaccaaauucaccccagucggugucauccaagacggcucaaccacccacagaaacgaaccacaacaauggguacuaccaucauacuccggccgaaacaccccaaacguccaccuugcccccgccguggcaccgacauucccaggcgaacagcucuuauucuuuagauccaucaugcccggcuguucaggcuaucccaacauggaccucgacugccuccugccccaagaauggguacaauacuucuaccaagaagccgcacccgcccaauccgacgucgcccuccuccgcuucguuaaccccgacacaggucgaguccuauuugaaugcaaacuucacaagucuggcuacgucaccgucgcacacaccggccaacaugaccucgucauacccccgaacggcuacuuccgauucgacuccuggguaaaccaauucuacacucucgcuccgaugggaaacggcaccgggagacgccgagcccucuaa

SEQ ID NO: 36146 - RNA, 1623 nt, Artificial Sequence
  derived and/or modified sequence opt11 from VP1__Norovirus__AIG60004
augaaaauggccucuuccgaugcuaaccccucagacgguagcgccgcaaaccucguaccagaaguaaacaacgaagucauggcccuagaaccagucgucggcgcugcaaucgccgccccaguagccggacaacaaaacguaaucgauccuuggauccgcaacaauuucguccaagcacccggaggagaauuuaccgucucaccccgaaacgccccuggcgaaauacucugguccgcaccccucggcccagaucucaacccauaccuuucccaccucgcccgaauguauaacggcuacgccgguggcuuugaaguccaagucauccucgccggaaacgcuuucacggccgguaaggucaucuucgccgccguucccccaaacuuccccaccgaaggacuaucccccucccaagucaccauguucccccacaucgucgucgacguccggcaacucgagcccguccuaauaccccuccccgacguccgcaacaacuucuaucacuacaaccaauccaacgacccaaccaucaaacuaaucgcuaugcucuacaccccacuccgagccaacaacgccggcgacgacgucuucaccguaagcugccggguccuaacccgacccuccccagauuucgauuucaucuuccucguaccacccacaguagaaucccgcaccaagccauucuccgucccaguucuaaccgucgaagaaaugacaaacucccgcuuccccaucccacuagaaaaacucuucacaggacccuccuccgccuucguuguucaaccccaaaacggccgcugcaccaccgacggaguauuacucggaaccacacaacucucaccuguaaacauaugcaccuuccgcggagacgucacccacauaacaggaagccgcaacuacaccaugaaucucgccucccaaaauugguccaacuacgacccaacagaagaaauccccgccccacuagguaccccagacuucgucggaaagauccaaggcguccuuacacaaacaacccgcaccgacggauccacacgcggccacaaagccacagucuauaccggcagcgccgauuucgcccccaaacuuggccgcguccaauucgaaacagacacagaccgcgacuucgaagccaaccaaaacacaaaauucacccccgucggcguaauccaagacggcuccaccacccaccgaaacgaaccacaacaauggguccuccccuccuacucaggccgaaacacacccaauguacaccuagcccccgcagucgcacccaccuuccccggagaacaacuccucuucuucagaagcaccaugcccggaugcagcgguuacccuaauauggaccuggauugccuccuaccccaggaauggguacaguauuucuaucaagaagcagcccccgcccagucggauguagcccucuuacgcuucgucaacccagacaccggacgcguccucuucgaaugcaaacuccacaaauccggcuacgucacagucgcacacacuggccaacacgaccucguaaucccacccaacggcuacuuccgauuugacucauggguaaaccaauucuacaccuuagcacccauggguaacgguaccggcaggcgccgcgcacucuaa

SEQ ID NO: 36147 - RNA, 1623 nt, Artificial Sequence
  derived and/or modified sequence opt11 from VP1__Norovirus__AIG60006
augaaaauggccucaucugacgccaacccauccgacggcucugccgcaaaccuagucccagaagucaacaacgaagugauggcccuggaacccguuguaggcgccgccaucgcagcccccgucgcaggacaacaaaacgucaucgaccccuggauccgaaacaauuucguccaagcccccggcggagaguucacugucagcccacgaaacgcccccggcgaaauccuaugguccgcuccccucggcccagaccuaaaccccuaccuaucacaccucgcccggauguacaacggcuacgccggcggcuucgaaguacaagucauacuagccggcaacgcauucaccgccggcaaagucaucuucgcagccguucccccaaacuuccccaccgaaggccucuccccaucccaagucaccauguucccccacaucgucgucgacguccgacaacuagaaccaguccuaaucccccugccagacguucgcaacaacuuuuaucacuacaaccaauccaaugauccaaccauaaaacuaaucgccaugcucuacacacccuuacgcgccaacaacgccggagaugacgucuuuaccguauccugucguguccucacccgacccucaccagacuucgacuucauauucuuagugcccccuaccgucgaaucacgcaccaaacccuucuccguccccguacuaaccguagaagaaaugaccaacagccgcuuccccaucccccuugaaaaacucuucaccggacccagcuccgcauuugucguacaaccccaaaaugggcgcugcacaaccgacggcguccuccucggcaccacccaacucucccccguuaacaucugcaccuuucgcggcgacgucacccacaucaccggcucacgaaacuacaccaugaaccucgccagccaaaacugguccaacuacgauccuaccgaagaaauacccgcgccccuaggcaccccagacuucguagguaaaauccaaggcguccugacccaaaccacccgaacagacggauccacacguggccacaaagccaccguauacacaggcucagccgacuucgccccaaaacucggacgcguccaauucgagaccgacacugacagagacuucgaagccaaccaaaacacaaaguucacccccguuggcgucauccaagacggcagcacuacccaccgaaacgaaccccaacaauggguacucccaucguacucaggacgcaacaccccaaacguacaucuugcccccgccgucgccccaaccuuccccggcgaacaacuccucuucuuccgaucaaccaugcccggaugcuccggcuaccccaacauggaucucgacugccuccuaccacaagaguggguucaauacuucuaccaggaagccgcccccgcucaaucagacgucgcccuacuccgcuucgucaaccccgauaccggacgaguccuguucgaaugcaaacuccacaaaucaggcuacguuaccgucgcacacaccggacaacacgaccuagucauaccaccgaacggauauuuccguuucgacucaugggucaaccaauucuauacccuagcacccaugggaaacggcaccggccgccgccgcgcccuauga

SEQ ID NO: 36148 - RNA, 1623 nt, Artificial Sequence
  derived and/or modified sequence opt11 from VP1__Norovirus__AIG60008
augaaaauggccucauccgacgcaaaccccucagacggaucagcggccaaccucguccccgaagucaacaaugaagucauggcccucgaacccgucgucggagccgccaucgcagcccccguugccggacaacaaaacgucaucgaccccuggauccgaaacaacuucguccaagcccccggaggagaguucaccgucucaccccgcaacgcccccggcgaaauccucugguccgcaccccucggccccgaccucaacccuuaccucucacaccucgccagaauguacaacggcuacgccggcggcuucgaaguccaggucauacucgccggcaacgcauucacagcaggcaaagucaucuuugccgccguaccacccaacuuccccaccgaaggacucagccccucccaaguaaccauguucccucacaucguagucgacguacgccaacucgaaccaguccucauaccccucccugauguccgcaacaauuuuuaccacuacaaccaauccaacgaccccaccauaaaacucauagccaugcucuacacaccccuacgcgccaacaaugccggcgacgacgucuuuaccguauccugccgaguacucacacgccccuccccagacuucgacuucaucuuccuaguuccaccaaccgucgaaucccgcaccaaacccuucucuguacccguacucaccguagaagaaaugacaaacuccagauuccccaucccccucgaaaaacucuucaccggacccagcuccgcauucguaguacaaccucaaaacggacgcugcaccaccgauggcguucuccuaggcacaacccaacucagcccugucaauauaugcaccuuccgcggcgacgucacccauaucaccggaucgcgcaacuacaccaugaaccucgcaucacaaaacugguccaacuacgaccccaccgaagaaaucccggccccacucggcaccccagacuucguaggcaaaauccaaggcguccucacacaaaccacacguacugacggcucuacccgcggacacaaagccaccguuuacaccggcucugcagacuucgccccaaaacucggucgcguccaauucgaaacagacacagaccacgacuucgaagccaaccaaaacacaaaauucacaccaguaggugucauacaagacggcggcaccacccaucgcaaugaaccacaacaauggguacuccccuccuacagcggcaggaacacuccuaacguccaccucgcaccagcagucgcccccacuuuccccggcgaacagcuccucuucuuccgcuccaccaugcccggaugcucaggauacccaaacauggaccuagacugucuucuaccacaagaauggguccaauauuucuaccaagaagcagcucccgcacaaucagacguagccuuacuccgguucguaaacccagacacaggaagaguccucuucgaaugcaaacuccacaaaucuggcuacgucaccgucgcucacaccggucaacacgaccucgucaucccacccaacggauacuucagauucgacuccuggguaaaccaauucuacacacuugcccccaugggcaacggcaccggccgccgcagagcccucuga

SEQ ID NO: 36149 - RNA, 1623 nt, Artificial Sequence
  derived and/or modified sequence opt11 from VP1__Norovirus__AIG60010
augaaaauggcauccuccgacgccaaccccucagacggcuccgccgccaaccuaguaccugaagucaacaacgaagucauggcccuugaaccaguagucggcgccgccaucgccgcacccguagcaggacagcaaaacgucaucgaccccuggauccgaaacaacuucguacaagcucccggaggcgaguucaccguaagcccucgcaacgcgccaggcgaaauccucuggagcgcaccccuaggccccgaccuuaaccccuaccucagccaccuagcccgcauguacaacggauaugcaggcggcuucgaaguccaagucauccucgcagguaacgcauucaccgcaggcaaggucaucuucgccgccguaccacccaacuuccccaccgaaggccucucccccucccaagucaccauguuuccucacauagucgucgacguccgccagcucgaacccguccucaucccucuacccgacguccgcaacaacuucuaccauuacaaccaauccaacgaccccaccaucaaacuaaucgcuaugcuuuacacaccccuccgcgccaacaacgccggagacgacguuuucacagucuccugccgaguacucaccagaccaucccccgauuuugacuuuauauuccuaguuccucccacagucgaaucccguacaaaacccuucucugugcccguccuuaccgucgaagaaaugacaaacucccgauuccccaucccccucgaaaaacuauucaccggacccuccucagcauucgucguccaaccacaaaacggccgcugcaccaccgacggaguccuccucgguacaacccagcuaucucccgucaauauaugcaccuuccgaggcgaugucacccauaucacaggaucccgcaacuacaccaugaaucucgccucccaaaacuggaacaacuacgaccccacugaagaaauccccgcuccccucggcacaccugacuucguaggaaaaauccaaggcgucuuaacccaaacaacccgaaccgacggaucaacccgcggccacaaagccacaguauacaccggauccgccgacuucgcacccaaacucggccgaguacaauucgaaaccgacacagaccaugacuucgaagccaaccaaaacaccaaauucaccccagucggugucauccaagacggcggcacaacacaccgcaacgaaccccaacaauggguccuacccuccuacucaggacgcaacacacacaacguccaccuagccccagcaguagcccccacauucccaggugaacaacuacuauucuuccgcagcacaaugcccggaugcucaggcuacccaaacauggaccuagauugccuacuaccccaagaaugggugcaguacuucuaccaagaggccgcucccgcacaauccgacguagcccuccuccgcuucgucaaucccgacaccggucgaguccucuucgaauguaagcuccacaaauccggcuacguaacagucgcccacaccggccaacacgaccucgugauacccccgaacgguuacuuccgauuugacuccuggguaaaucaauucuacacccuugcccccaugggcaaugggaccggccgccgccgcgcagucuaa

SEQ ID NO: 36150 - RNA, 1623 nt, Artificial Sequence
  derived and/or modified sequence opt11 from VP1__Norovirus__AIG60012
augaaaauggccuccuccgacgccaaucccuccgacggguccgccgccaaccucguaccagaaguaaacaacgaagucauggcccucgaacccguagucggcgccgcuauagccgccccagucgccggccaacaaaaugucaucgacccauggauacgcaacaacuucguacaggcacccggcggcgaguucacaguaagcccccgcaacgcccccggagaaauccuaugguccgccccucuaggcccagaccucaaccccuacuuaucccaccucgcucguauguacaacgguuacgccggcggcuucgaaguacaaguaauccuagccggcaacgccuucacagccggcaaagucauauucgccgccguacccccuaacuucccgacagaaggccuauccccuucccaagucaccauguucccgcacaucgucgucgacguccgccaacucgaacccguucucaucccacucccagauguccgcaacaacuucuaccacuacaaccaguccaacgaucccacaaucaaacuaaucgcaaugcuauacaccccacuacgcgcaaacaacgccggcgacgacguuuuuacaguaucgugccgaguucugaccagacccuccccagacuucgacuucaucuuccuaguacccccaacugucgaaucccgcaccaaaccuuucuccguccccguccuaacagucgaagaaaugacaaacucacgauucccaauaccccucgaaaaacuauucaccggaccauccucagccuuugugguccaaccccaaaacggccgaugcacaacagacggcguccuacucggcaccacccaacuaucacccgucaauaucugcaccuuccgaggcgaugucacccacauaaccggcuccagaaacuacaccaugaaccuugcaucccagaacuggucaaacuacgaccccaccgaagaaauacccgcaccccucggcacaccagacuuugucggaaaaauccaaggaguucuuacccaaacaacccggacagacgguucgacccgcggccauaaagccacagucuacacaggauccgccgacuucgccccaaaacuuggucguguccaauucgaaacagacaccgaccgagacuucgaagcaaaccagaacaccaaauucacccccgucggcgucauccaagacggcuccacaacccacagaaaugaaccacaacaauggguccuacccuccuacucaggccggaacacccccaacguacaucucgcaccagccgucgcccccacauucccuggagaacaacuccucuucuuccgauccaccaugccaggcugcucgggcuacccaaacauggaccucgacugccuccuaccacaagaauggguccaauacuucuaucaagaagcagccccagcacaauccgauguggcacuccugcgcuucgucaacccagacaccggccgcguacucuucgagugcaaacuucacaaauccggcuacgucacaguggcacacaccggccaacacgaccuugucauuccacccaacggcuacuuccgcuucgacucauggguaaaccaauucuacacucuagcccccaugggaaacggcacgggccgccgacgagcccucuaa

SEQ ID NO: 36151 - RNA, 1623 nt, Artificial Sequence
  derived and/or modified sequence opt11 from VP1__Norovirus__AIG60014
augaaaauggccagcucugacgccaaccccuccgacggcuccgccgccaaccucgucccagaaguaaacaacgaaguaauggcgcuagaacccguaguaggcgccgcaaucgccgcccccgucgcgggccagcaaaacgucaucgacccauggauuagaaauaacuuuguccaagcaccaggcggcgaguucaccgucagcccccguaacgcccccggcgaaauccucugguccgcaccgcuaggccccgaucucaaccccuaccucucccaccuagcucguauguacaacggcuacgccggaggauucgaaguccaagucaucuuagccggcaacgccuucaccgccggaaaagucaucuucgccgccgucccacccaacuuccccacagaaggccucucgcccucacaagucacuauguucccccacauaguugucgacguacgacaacucgaacccguucucaucccccuccccgacguccgcaacaauuucuaccacuacaaccaaucaaacgaccccaccaucaaacuuauagcaauguuauacaccccauuacgcgccaacaacgccggcgacgacgucuuuacagucuccugucgcguacucacuagacccucacccgacuucgacuucauauuccucguuccacccacaguagaaucccgaacaaaaccuuucucagucccaguacuaacaguagaagaaaugaccaacucccgcuucccaaucccccuugaaaaacucuucacagguccaucgucagccuucguaguccaaccccaaaacggacgcugcaccacggacggaguccuccucggcacaacccaacucagccccgucaacaucugcaccuuucgcggcgacgucacccacaucaccgguucacguaacuacacuaugaaccuagcaucccagaacuggaauaacuacgaccccacagaagagauaccagcaccccuaggaacacccgacuucgucggcaaaauacaaggcguucucacacaaaccacccgaacugacggcuccacccgcggccacaaagccaccgucuacaccggcuccgccgacuuugcccccaaacuaggacgcguccaauucgaaacagacacugaccacgacuucgaagccaaccaaaacaccaaauucacccccgucgguguuauccaagacggcucuaccacccaccgaaacgaaccccaacaauggguacuaccaagcuacuccggccguaacacccacaacguccaccuagcacccgcagucgccccaaccuuccccggcgaacaacuccuguucuuccgcuccaccaugcccggaugcucuggcuacccaaacauggaccuugacugucuacuaccgcaagaauggguacaauacuucuaccaagaagccgcccccgcacaauccgacguggcccuccuacgauucguaaaccccgacacaggccgaguccuuuucgaaugcaaacuccacaaaucaggcuacgucaccgucgcacacaccggccagcacgaccugguaaucccucccaacggcuacuuccgcuucgacuccugggucaaccaguuuuacacucuagcucccaugggcaacggaacaggacgcagacgcgccgucuaa

SEQ ID NO: 36152 - RNA, 1623 nt, Artificial Sequence
  derived and/or modified sequence opt11 from VP1__Norovirus__AIG60016
augaaaauggccuccucggacgcgaacccauccgauggcuccgccgccaaccucguaccagaagucaacaacgaaguaauggcccuagaacccguagucggcgcagccaucgcagcacccgucgcaggucaacaaaacgucauagacccauggauacgaaacaacuucguacaagcccccgguggagaguucacagucucaccucgcaaugcccccggagaaauccucuggucagcuccacucggacccgaccucaaccccuaccucucccaccuagcccgcauguacaacggguacgccggcggcuucgaaguacaaguuauacucgcuggaaacgcauucacagccgguaaagucaucuucgccgccguucccccaaacuuccccaccgaaggauuaucccccucccaggucaccauguucccacacaucguaguggacguccgccaacuugaacccguacuaauaccacuaccagacguccguaacaacuucuaccacuauaaccaaucaaacgaccccaccauaaaauuaauagccaugcucuacaccccacuccgcgccaacaacgccggcgacgaugucuucaccguauccugccgcguacucacccgacccucacccgacuucgacuucauauuccucguacccccaaccgucgaaucccgcaccaaacccuucuccguccccguacucacuguugaagaaaugaccaacucacgauuucccaucccucuugaaaaacucuucaccggcccauccucugccuucgugguccagccccaaaacggacgcugcaccaccgacggcguccuauuaggaaccacccaacucucccccgucaacaucugcaccuuccgcggcgacgucacccacaucaccggaucaagaaacuacaccaugaaccuagcuagccagaacugguccaacuacgauccgaccgaagaaaucccagcaccccugggaacuccagacuucgucggaaaaauccaaggaguacucacccaaaccacucgcaccgacggcucaacgcgcggacauaaagccaccguauacacaggcucagccgacuucgccccuaaacucggccggguccaguucgaaaccgacaccgaccacgacuucgaagccaaccagaacaccaaauucaccccagucggcgucauacaagacggcucaaccacccacagaaacgaaccccaacaauggguccuccccucauauuccggccgaaauaccccaaacguccaccucgccccagcugucgcacccaccuuccccggcgaacaacuacucuucuuucgcucaaccaugccaggcugcaguggcuaccccaacauggaccucgacugccuacuuccacaagaauggguacaauacuucuaccaagaagcugccccagcacaauccgacgucgcccuucuucgcuucgucaaccccgacaccggacgaguccucuucgaaugcaaacuucacaagucaggauacguaacagucgcccacacagggcaacacgaccuugucauaccacccaacggcuacuuccgauuugacuccuggguaaaccaauuuuacacccuagcucccaugggaaacggcacaggacgacgccgcgcucucuaa

SEQ ID NO: 36153 - RNA, 1623 nt, Artificial Sequence
  derived and/or modified sequence opt11 from VP1__Norovirus__AIG60018
augaaaauggcauccuccgacgcaaaccccucagacggcuccgccgcuaaccuagucccagaaguaaacaacgaaguaauggcccucgaacccguagucggcgcggccaucgccgcccccgucgccggacaacaaaacgucaucgaccccuggauccgcaacaacuuuguucaagcaccaggcggagaauuuacugucucaccucgaaaugcuccaggagaaauccucugguccgcuccccucgguccagaccuuaauccguaccucucccacuuagcccguauguacaacggcuacgcaggcggcuucgaaguccaagucauccucgccggcaacgccuuuaccgccggcaaaguuaucuucgccgcagucccacccaauuuccccaccgaagguuuaucccccucucaaguaaccauguucccccacaucgucguugacguccgccaacucgaaccaguacuuauuccccucccagacgucagaaacaacuuuuaccacuacaaccaaucaaaugacccaaccaucaaacuaaucgccaugcucuacacuccccucagagccaacaacgcaggcgaugacgucuuuaccgucucuugcagaguccucacccgccccuccccagacuucgacuucaucuuccucgucccaccaaccguagaaucccgcaccaaacccuucuccgucccuguacuuacagucgaagaaaugacaaacucccgcuuucccaucccccuagaaaaacucuucacuggaccauccucagcauucgucguacaaccacaaaacggcagaugcaccaccgacggaguccuccuaggaaccacccaacuuucccccguaaacaucugcacauuccgcggagacgucacacacaucaccggaucacgcaacuacacaaugaaccucgccucccaaaacugguccaacuacgauccaacagaagagauccccgcaccccuaggaaccccagacuucguaggaaaaauccaaggcguccuaacccaaaccacucgaacugacggauccacgcgcggacacaaggccaccgucuacaccggcuccgccgacuucgcacccaaacucggccgaguccaauucgaaaccgacacagaccgcgacuucgaagcuaaccaaaacaccaaauucacaccagucggcgucauccaagacgguucaacgacacaccgcaacgaaccacaacaauggguccuuccuuccuacucaggccguaacacacccaacguccaccucgcccccgcagucgcacccacguuccccggcgaacaacuccucuucuuccggucaaccaugcccggcugcuccggcuaucccaacauggaccuagacugccuccucccacaggaauggguccaauacuuuuaccaagaggcagcccccgcccaauccgacguagcccuccuucguuucgucaaccccgacaccggccgaguccucuucgaaugcaaacuccacaaaucuggauacgucacagucgcccacacuggacagcacgaccucguaauacccccuaacggcuacuucagguucgacuccugggucaaccaauucuacacacucgcgcccaugggcaacggcaccggccgccgccgcgcccucuaa

SEQ ID NO: 36154 - RNA, 1623 nt, Artificial Sequence
  derived and/or modified sequence opt11 from VP1__Norovirus__AIG60020
augaaaauggccucauccgacgccaaccccuccgacggauccgcagccaaccucguccccgaaguuaacaaugaagucauggcccuugaacccgucgucggugccgccaucgccgcccccguagcaggucaacaaaacgucaucgaccccuggaucagaaacaacuucguccaagcccccggaggcgaauuuaccgucucuccccgcaacgcccccggcgaaauccucugguccgcaccacuaggcccagaccucaaccccuaccucucucaccuagcccgcauguacaacggcuacgcuggaggcuucgaaguacaagucauacucgccggcaacgcauucaccgcaggaaaagucaucuucgccgccgucccucccaacuucccaacugaaggccuaucccccucucaagucacuauguucccacacaucgucgucgacguccgacaacucgaacccgugcucaucccacuacccgacguacgcaacaacuucuaucacuacaaccaaucaaacgacccaaccauuaaacucaucgccaugcucuauacuccacuacgcgcaaacaacgccggcgacgacguuuucaccgucuccugccgaguccucacccgccccucccccgacuucgacuuuauauuccuagugcccccuaccgucgaauccagaaccaaaccauucuccgucccaguacucaccgucgaagaaaugaccaacucucgcuucccaauuccucuagaaaaacuauucaccggucccuccucagccuucguuguccaaccacagaacggccgaugcacuacagacggcguccuccucggcacuacacaacuuucuccagucaauaucugcaccuuucgcggcgacguaacacacaucaccggauccagaaacuacacaaugaaccucgccucccaaaacugguccaacuaugaccccacagaagaaaucccagcaccccucggcacacccgacuucguaggcaaaauacaaggaguccucacccaaaccacccgcaccgacggcuccacccgcggccacaaagccaccgucuauaccggauccgccgacuucgccccaaaacucggaaucguccaauucgaaacagacacagaccacgacuucgaagcaaaccaaaacaccaaauucaccccgguaggcgucauacaagacgguucaaccacccaccgaaacgaaccacaacaauggguacuacccuccuacuccggccgaaacacccccaacguccaccuugcucccgccguugcucccaccuuccccggcgaacaacuccuauucuuccgcuccaccaugcccggcugcuccggcuaucccaacauggaccuagacugccuccugccacaagaauggguccaauacuucuaccaagaagcagccccagcccaguccgacguagcccuacuccgcuucguaaauccagacaccggccgcguacucuucgaaugcaaacuccacaaauccggcuacgucacagucgcccauacaggccaacacgaccuaguaaucccucccaacggauacuuccguuucgacucaugggucaaccaauucuacacauuagcgcccaugggcaacggaacuggccgccgccgugcccucuaa

SEQ ID NO: 36155 - RNA, 1623 nt, Artificial Sequence
  derived and/or modified sequence opt11 from VP1__Norovirus__AIG60022
augaaaauggccuccucagaugcaaaccccuccgacggauccgcugcaaaccucguacccgaaguaaacaaugaaguaauggcacucgaacccguugucggcgcagccaucgcugcaccugucgccggccaacaaaacgucaucgaccccuggauccgcaauaacuuuguccaagcacccggcggcgaguucacuguaucaccccguaacgcccccggcgaaauccuaugguccgcaccccucggucccgaccuaaacccauaucucucccaccucgcacgcauguacaacgguuacgccgguggcuucgaaguccaagucauccucgcuggcaacgccuucaccgccggcaaagucauauucgcugcaguaccucccaacuuccccaccgaaggacucucccccucccaagucaccauguucccucacauaguagucgacguacgccaauuagaaccuguccucaucccccuacccgacguccgaaacaacuucuaccacuacaaucaauccaacgaccccaccauaaaacuuaucgcgaugcucuacacaccccuccgcgccaacaacgccggagacgacgucuucaccgucuccugccgaguccuuacccgccccucaccagacuucgacuucauauuccucgucccacccaccguugaaucacgcaccaaacccuucuccguccccguccucaccgucgaagaaaugaccaacucccgcuuccccauuccacucgaaaaacucuucaccggacccucaucagccuucgucguccaaccccaaaacggacgcugcaccaccgacggcguccuccuaggcaccacccaacucucccccgucaacaucugcaccuuccgcggcgacguaacccacaucacgggcucccgaaacuacacuaugaaucuugccucucaaaacugguccaacuacgaccccacagaggaaauaccagccccacuuggaacacccgacuucgucggcaaaauccaaggcguccucacccaaaccacucgcaccgacggauccacccguggacauaaagccaccgucuacacaggcuccgccgacuucgccccaaaacucggccgcguccaauucgaaaccgacaccgaccgcgacuucgaagccaaccagaacaccaaauucacacccguaggcgucauccaagacggauccaccacccaccgcaacgaaccccaacaauggguccuacccuccuacuccggacgcaacaccccaaauguccaccuagcacccgcggucgccccaaccuuccccggagaacaacuccuauucuuucgaagcaccaugcccgguugcuccggcuaucccaauauggaccucgacugccuacuuccacaagaauggguccaauacuucuaccaagaagcugcccccgcccaauccgacgucgcuuuacuacgcuucguaaacccagauacuggacgcguccucuucgaauguaaacuucacaaguccggcuacgucacaguagcccacacaggacaacacgaccuaguuauacccccaaacggcuacuuucgcuucgacucuuggguaaaccaauucuacacccucgcucccaugggaaacggcaccggacgucgacgagcacucuaa

SEQ ID NO: 36156 - RNA, 1623 nt, Artificial Sequence
  derived and/or modified sequence opt11 from VP1__Norovirus__AIG60024
augaaaauggccuccuccgaugccaaccccucagacggcucugccgccaaccucgucccagaagucaacaacgaagucauggcccucgaaccugucguaggagccgccaucgccgcccccgucgcaggacaacaaaacgucaucgacccuuggauccgcaacaacuucguccaagcaccuggcggcgaauuuaccgucuccccaagaaacgcccccggcgaaauccuauggucagcuccccucggcccagaccuuaaccccuaccucucgcaccuagcccgcauguacaacggcuacgcaggcggauucgaaguacaagucauacucgccggaaacgccuucacugccggcaaaguaaucuucgcagccgucccacccaacuuccccaccgaaggacuuucaccuucacaaguaacaauguucccccacauagucgucgacguccgccaacucgaaccaguccucauaccccugcccgacguacgcaacaacuucuaccacuacaaccaauccaacgaccccaccauaaaacucaucgccaugcucuacaccccacuccgcgcaaacaacgcaggcgacgaugucuucaccgucucaugccgcguucuuacgcgccccuccccagacuucgacuucaucuuccuagucccacccaccgucgaaucccgaacaaaacccuucuccgucccaguccucaccguagaagaaaugaccaacucacgcuuccccaucccccucgaaaaacuauucaccggccccucuucugccuucgucguccagccccaaaaugguagauguacaaccgacggaguccuccucggcacuacgcaacuauccccggucaauaucugcaccuuucgaggcgacgucacacacaucaccggcucccggaacuacaccaugaaccuagccucccaaaacuggaacaauuacgacccuaccgaagaaauuccggcaccccucggaacacccgacuucgucggcaaaauccaaggcguccuaacccaaaccacacgcaccgacggcuccacccguggacacaaagccacaguauauacaggcagcgcagacuucgcucccaaacuuggcaggguccaauucgaaacagauaccgaccacgacuucgaagccaaccaaaacaccaaguucaccccagucggcgucauacaagacggaggaaccacccaccgcaacgaaccccaacaauggguacuucccucauacucaggccgaaacacacacaacguacaccuagcacccgccgucgccccaaccuuccccggagaacaacuccucuucuuccgauccacaaugcccggcugcuccggauaccccaacauggacuuagacugccuacuaccucaagaauggguacaauauuucuaccaggaagccgcccccgcucaguccgacgucgcucuccuccgcuucgucaacccagacacagggagaguacucuucgaauguaaacuacauaaaucaggauacguaaccgucgcccauaccggccaacacgaucucgucaucccacccaacggcuacuuccgauucgacagcuggguaaaccaauucuacacccuagcgcccaugggcaacggcacuggccgacgccgugccgucuaa

SEQ ID NO: 36157 - RNA, 1629 nt, Artificial Sequence
  derived and/or modified sequence opt11 from VP1__Norovirus__AII73717
augaaaauggccuccaacgaugccgcacccucaaacgacggcgcugccucccucguccccgaaggcaucaacgaaaccaugccccuagaacccgucgcaggcgccucuaucgccgccccagucgccggacaaaccaacauaauagaccccuggauaagaaccaacuucguccaagccccuaauggcgaauucacagucuccccccgcaacuccccuggcgaaauccuucuaaaccuagaacuaggcccugaucuaaacccauaccucgcccaccucucacgaauguacaacggcuacgccgguggcgucgaaguccaaguccuucuagccggaaacgccuucaccgccggcaaaauccuuuucgcagcaaucccccccaacuuccccgucgacaugaucucaccagcccaaaucaccaugcuaccccaccuaaucgucgacguacgcacacucgaaccaaucaugaucccccucccggauguccgcaacgucuucuaccauuucaacaaucaaccccagccacgcaugagacucgucgcaaugcucuacacaccccuucgauccaacggcucgggcgacgacgucuucacagucagcugccguguauuaacacgccccacccccgacuucgaauucauauaccuaguaccacccuccgucgaauccaaaaccaagccauucacucuccccauacucacuauauccgaacucaccaacucccgauucccuauucccaucgaacaacuauacaccgcaccuaacgaaaccaacguaguacaaugccaaaacggccgcugcacccucgacggugaacuccaaggcaccacccaacuucucucauccgcugucuguucauaccgcgggcgcacuguagcaaacaacggggacaacugggaccaaaaccuccuucaacucaccuaccccaauggcgcuucuuacgaccccacagacgaaguacccgcaccacucggcacccaagacuuuucaggcaugcucuacggcguccucacccaagauaacguaaacgucuccacuggcgaagcuaaaaacgcaaaaggaaucuacauauccacaaccagcggaaaauucacccccaaaauagguuccaucggccuucacagcaucaccgaacacguccaccccaaccaacaaucacgcuucacccccgucggcgucgccgucaacgaaaauaccccuuuccaacaguggguccuaccccacuacgccgguucccuagcccucaauaccaacuuagcacccgccguagcacccaccuucccgggugaacaacuccucuucuuccgcucccgaguacccugcguccaagggcuccagggccaagacgcguucauagacugccuacucccccaagaaugggucaaccacuucuaccaagaagcagccccuucccaagccgaugucgcccuuauuagauacgucaauccagacaccggccguacccucuucgaagcaaaauuacaccgcuccggauucauaaccguaucacacaccggcgccuacccccuagucguaccgccaaacggccacuucagauucgacuccuggguuaaucaauucuacucccuugccccaaugggcaccggcaacggccgccgcagaauccaauaa

SEQ ID NO: 36158 - RNA, 1623 nt, Artificial Sequence
  derived and/or modified sequence opt11 from VP1__Norovirus__AII73720
augaaaauggccuccaacgacgccaccccauccaacgacggcgccgccggccuaguccccgaaucaaacaacgaagcaauggcccucgaacccgucguaggcgcaucucuagcagccccagucacaggccaaacaaacaucaucgacccguggauccgcacaaacuucguccaggcccccaacggcgaauuuaccguuagccccagaaacucccccggugaaauccuagucaaccuagaacucggcccagaacucaaccccuaccucgcccaccuagcaagaauguacaacggauacgcaggcggcauggagguccaaguaaugcuagcaggcaacgcauucacagccggcaaaaucaucuucgcagcuguaccacccuacuuccccgucgagaaccuaucccccucacaaaucaccauguucccccacgucauagucgauguucggacccuagaacccguccuacuccccaugcccgacguccgcuccacucucuuccacuucaaucaaaaagacgagcccaaaaugcgccuaguagccaugcuauacacaccccuccgaucaaacggaucuggcgacgacguguucaccguaucaugccgcauccuuacccgccccaguccagaguucgacuucaccuaccuaguacccccaaccgucgaauccaaaaccaagcccuuuacucuacccguacuaacucucggagaacucagcaacucccgcuucccacuauccaucgacgaaaugguuaccucccccaacgaaucaaucgucguccaaccacaaaacggacgcgucacccuggacggagaacuccucggaaccacucaauugcaagcaugcaacauaugcucgauccgcggcaaaguuaccggccaaguacccaacgagcaacacauguggaaccuagagaucaccaaccucaacggcacccaauucgacccaaccgacgacguccccgcaccccuaggaguccccgacuucgccggagaagucuuuggcguccucagccaacgcaaccgaggagaauccaaccccgcuaaccgcgcccacgacgccguaguagcaaccuacuccgacaaauacacccccaagcugggcuuaguccagaucggcacauggaacaccaacgacgucgagaaccaacccacaaaauucacacccaucggccuaaaugaagucgccaacggccaccguuucgaacaauggacacucccacgcuacucaggcgcccucacucuaaacaugaaccucgcccccgccguagcgccccucuuccccggcgaacgccuccucuucuuccguagcuacguaccacuaaaaggcggcuucggcaaccccgccaucgauugccucgucccacaagaauggguacaacacuucuaucaagaauccgcccccucccucggcgacgucgcacucguacgcuacgucaaccccgacaccggccgcgucuuauuugaagccaagcuccacaaaggcggcuuccucacaguuuccucaacauccaccggacccgucguaguacccgcaaauggauacuuccgcuuugacuccugggucaaccaauucuacucccucgcccccaugggcaccggcaacggaagacgacgauuccaauaa

SEQ ID NO: 36159 - RNA, 1611 nt, Artificial Sequence
  derived and/or modified sequence opt11 from VP1__Norovirus__AII73723
augaaaauggcaucaaaugacgccaccccaucugacgacggcgcagccggccucguacccgaaaucaacuccgaagucauggcccucgaaccagucgcaggcgccuccaucgcagcuccagucgucggacaacaaaacaucaucgacccauggauccgaaacaacuucguccaagcacccgccggcgaguucaccgucagcccucgcaauuccccaggugaacuccuccucgaccucgaacucggccccgaacugaacccuuaccucgcacacuuagcccguauguacaacggccacgcaggaggcauggaaguccaaaucguccucgccggcaacgcauucaccgcuggaaaaauccucuucgccgcaaucccacccuccuuccccuacgagaaccugucccccgcccaacuaaccaugugcccccacguaauuguugauguccgucaacucgaaccaguucucuuacccaugccagacauacgcaaugucuucuaccacuacaaccaaaacaauucccccaagcuacgacucguugccaugcuauacacaccccuacgcgccaauaacagcggugacgacguauucaccgucuccugccguguucucacccgucccuccccagacuuccaauucaccuuucuuguacccccaacagucgaauccaaaaccaaaaacuucacccucccuguccuccgcgucucagaaaugaccaacucccgcuuccccgucguccuugaccaaauguauaccucacgcaacgaaaacaucaucguccaaccccaaaacggccgcugcacuacugauggcgaacuccucggcaccacaauccuccaauccguauccauaugcaacuucaaaggcaccaugcaagcaaaacucaacgaagaaccccgcuaucagcuacaacuaacaaacuuagauggcucucccaucgaccccacagaugacaugccagcaccccucggcacacccgacuuucaagccguccucuacggaguagccucacaacgcagcucccgagauaacgcgacccgcgcccacgacgcacaaauagacaccgcaggagacaccuucgcccccaaaauuggccaaguacgcuucaaauccuccucaaacgauuuugaccuccacgauccuaccaaauucacucccaucggagucaacgucgacgaucaacaccccuuccgccaauggagccuccccaacuauggcggacaccuagcccucaacaaccaccuugccccugccgucaccccacucuuccccggagaacaaauacuauucuuccguucauauauucccuccgccggcggccacaccgacggugccauggacugccuacuaccccaagaaugggucgaacacuucuaccaagaagccgcacccucccaauccgacaucgcccuuguccgcuucauaaaccccgacacaggccgcguacucuucgaagccaagcuccacaaacaaggcuuccucacuaucgcugcauccggcgaucaccccauagucaugcccaccaaugguuacuucagauucgaagccugggucaacccauucuacaccuuagcccccgucggaaccggcuccggaagacgcagaauccaauaa

SEQ ID NO: 36160 - RNA, 1623 nt, Artificial Sequence
  derived and/or modified sequence opt11 from VP1__Norovirus__AII73726
augaaaauggcgagcuccgacgccaaccccucagacggaucagccgccaacuuaguccccgaagucaacaacgaaguaauggcccuagaacccgucgucggcgccgcaaucgccgcaccaguagccggccaacaaaacguaauugaccccuggaucagaaacaacuucguacaagcccccggcggggaguucaccguuucaccccgcaacgcacccggcgaaauacucugguccgcaccccucggccccgacuuaaaccccuaccuaucccaccuagcccgcauguacaacggauacgccggcggauucgaaguacaaguaauacucgccggcaacgccuucaccgccggcaaagucaucuucgcugccgucccacccaacuuccccacugaaggccucucacccucacaagucacaauguucccccacaucguaguagacguacgccaacuagaacccguccucauaccccuacccgacguaagaaacaacuucuaccacuauaaccaaucaaacgaucccaccaucaaacugaucgccaugcuuuacacuccccuccgagccaacaacgcaggagacgacgucuucacaguuuccugccgcguacuuacccgcccaucaccagacuucgacuucaucuuccuggucccgcccaccgucgaauccagaaccaaacccuucuccguccccguccuaacugucgaagaaaugaccaacagccgauuccccaucccccucgaaaaacucuucaccggacccucauccgccuucgucguacaaccacaaaauggcagaugcaccaccgacggcguacuacucggcacaacacaacucucccccgucaacaucuguacauuccgaggcgacgucacccacauaaccggcucccgcaacuacacaaugaaucucgcaucacaaaacuggagcaacuacgaccccaccgaagaaaucccagcaccccucggaacacccgacuucgucggaaagauccaaggcguacucacacaaacuacccgcacagacggcuccacacgcggccacaaagccaccgucuauaccggaucagcugauuucgcaccuaaacucgggcgcguccaauucgaaaccgacaccgaccgagauuucgaagccaaccaaaacacaaaauucacccccguaggcgucauucaagacggcuccacaacacaccgcaaugaaccucaacaauggguccuacccucauauuccggccgaaacacccccaacguccacuuagcacccgccgucgcccccacuuuccccggcgaacaacuucucuucuuccgauccaccaugcccggcuguucaggcuaccccaacauggaccucgacugccuccucccucaagaguggguccaauacuucuaucaagaagccgccccagcccagucagacgucgcccugcuucgcuucguaaacccagacaccggccguguacucuucgaaugcaaacuccacaaauccgguuacguaacggucgcccacacaggccaacacgaccucguuaucccacccaacggcuacuuccgcuucgacagcugggucaaccaauucuauacccuagcgccaaugggcaauggcacaggccgccgccgcgcacucuaa

SEQ ID NO: 36161 - RNA, 1623 nt, Artificial Sequence
  derived and/or modified sequence opt11 from VP1__Norovirus__AII73729
augaaaauggccagcucagacgccaacccuuccgacggcagcgccgcaaaccucguccccgaagucaacaacgaggucauggcucucgaaccaguaguaggagccgcaaucgccgccccagucgcaggucaacaaaacgucauagaccccuggauccgaaacaacuuuguacaagcacccggcggcgaguucaccgucucuccacgaaacgcacccggcgaaauccucugguccgcaccccuuggaccggaccuaaacccauaccucucccaccucgcccgcauguacaauggcuacgccggaggauucgaaguccaagugauccuagccggcaacgccuuuaccgccggcaaggucaucuucgccgccguaccucccaacuuccccacugaaggccucucccccucccaagucaccauguucccccacaucgucguugacguccgccaauuagaacccguucucaucccccucccagacguccgaaacaacuucuaccacuacaaccaauccaacgaccccacaaucaaacucauagccaugcuuuacacaccgcuucgcgcuaacaacgccggcgacgacgucuucaccguaucaugccgaguccucacacgucccucccccgacuuugacuucaucuuucucguaccacccaccguugaauccagaaccaaacccuuuuccguccccguacucaccgucgaagaaaugaccaacucucgcuuccccaucccccucgaaaaacucuucaccggccccucauccgccuucguaguccaaccccaaaacggccgaugcaccaccgacgguguccuccuaggaaccacacaacuaucacccguaaacaucugcacuuuucgcggcgacguaacccacauuacaggaucccgcaacuacacaaugaaccucgccucacaaaacuggucaaacuacgaccccaccgaagaaauaccagcaccccuaggcaccccagacuucgucggaaagauccaaggaguacuaacucaaaccacccgaacagacggcuccacccgcggccacaaagccaccgucuacaccggaucagcugacuuugccccaaaacucggucgcguacaauucgaaacagacaccgaccgagacuucgaagccaaccaaaacaccaaauucacccccguaggcgucauccaagacggcuccaccacacaccgaaacgaaccccaacaguggguccuacccucauacuccggccgaaacacacccaacguccaucuugcccccgcagucgcacccaccuucccaggcgaacaacuccuauucuuccgcuccaccaugcccgguugcagcggauacccaaacauggaccuugacugccuccugccccaagaauggguacaauauuucuaccaggaagccgcccccgcacaauccgacgucgcccuccuccgguuugucaaccccgacaccggccgcguccuuuucgaaugcaaacuacacaaauccggcuacgucaccgucgcccauacaggccaacacgaccuggucauacccccaaacggcuacuuccgcuucgacucgugggucaaccaauucuacacccuagccccaaugggcaacggcacuggacgccgcagagcucucuaa

SEQ ID NO: 36162 - RNA, 1623 nt, Artificial Sequence
  derived and/or modified sequence opt11 from VP1__Norovirus__AII73732
augaaaauggccucuuccgacgccaaccccagugacggcucagcagcaaacuuaguucccgaaguaaacaacgagguaauggcccucgaaccagucgucggugcagccauagcagcccccgucgcuggccaacaaaacgucauagacccauggauccgcaacaacuuuguccaagcucccggaggugaauuuaccguuucgccccgaaaugcuccaggcgaaauccuaugguccgccccucucggccccgacuuaaaccccuaccucucacaccuagcccgcauguacaacggcuaugccggcggguucgaaguccaagucauccuagccggaaaugccuucacagccggcaaagucaucuucgcagccgucccacccaacuucccaacagagggccucucccccucccaaguaaccauguucccacacaucgucguagacguccgacaacuugaacccguccucauuccacuccccgacguccgcaacaauuucuaccacuacaaccaauccaacgacccgaccaucaaacucauagcaaugcuauacacaccccuccgcgccaacaacgcaggagacgacgucuucaccguaucaugccgcguacucacccgucccagucccgacuucgacuucauuuuucucgucccucccacaguugaaucacgcacaaaacccuucagcguccccguacuuacagucgaagaaaugaccaacucccgcuucccaauaccccucgaaaaacucuucaccggaccaucauccgccuucgucguccaaccucaaaacggacgcugcacaaccgacggcguacugcucgguaccacccaacuaucccccgucaacaucugcaccuuccgcggagacguuacacacaucaccggcucccgcaacuacaccaugaaccucgcaucacaaaacuggucuaacuacgauccuaccgaagaaaucccagcaccccuaggcacccccgacuucgucggcaaaauccaaggcguucucacccaaaccacccgaaccgauggaucuacacgcggccacaaagccaccgucuacaccggauccgcagacuuugccccaaaacucggacgcguccaauucgaaacagacacagaccgcgacuucgaagccaaucaaaacaccaaauucaccccggucggugucauccaagacggauccacaacucaccgaaacgaaccccaacaauggguacuacccucauacagcggacgcaacacacccaacguacaccucgccccugccguagcccccacauuuccaggcgagcaacuccuguucuuucguuccacaaugccaggcugcuccggcuacccuaacauggacuuagacugucuccucccccaggaauggguacaauacuucuaccaagaagccgcccccgcccaaucagacgucgcccuacuacgcuucguuaaccccgacaccggccgaguucucuucgaaugcaaacuacacaaauccggcuaugucaccgucgcacacacaggccaacacgaccucgucaucccaccuaacggauauuuccgauucgacucaugggucaaccaguucuacacccucgcucccaugggcaacggcacaggccgccgcagagcccucuaa

SEQ ID NO: 36163 - RNA, 1608 nt, Artificial Sequence
  derived and/or modified sequence opt11 from VP1__Norovirus__AII73735
augaaaauggccuccucagacgccgcccccuccaacgacggcgccgcaggccuaguccccgaagcaaacaacgaaacaauggcgcuagaacccguagcaggagccuccaucgccgccccacucaccggacaaaacaauaucaucgaccccuggauccgccuuaacuucguccaagccccaaacggcgaguucacagucucuccccgaaacucccccggcgaaguccuacucaaccucgaacuaggccccgaacucaauccuuaccuagcccaucuaagccgaauguacaacggcuacgccggcggcguagaaguacaaguccuacucgcuggaaacgcuuucaccgccggcaagcuaguuuucgcagcagucccuccacacuucccucuagaaaacauaucccccggccaaaucaccauguuuccccacgucaucauagacguacgcacacucgaaccuguccuccuaccacucccugacguacgaaacaacuucuuccauuacaaccaacaaaacgaaccacgcaugcgccucguggccaugcucuauacaccucuccgcuccaacggcagcggcgacgacguuuucacugucuccugccgaguccuuacccgccccucacccgacuucgacuucaacuaccucguaccacccacuguagaauccaaaacaaaacccuucacacuccccauccuaaccauaggcgaacucaccaauucccgauuccccgucccuauugacgaacucuacaccuccccuaaugaaucccucgucguccaaccccaaaacggaagaugugcccuugacggcgaacuccaaggcaccacacaacuccucccuaccgcgauaugcuccuucagaggccgaaucaaccaaaaagucucaggcgaaaaucacgucuggaacaugcagguuacaaacauaaacgguaccccauuugaccccaccgaagaugucccagccccucuagggacucccgacuucucuggaaaacuuuucggcguauuauccccacgugaccacgacaacgcaugccgcucccacgacgccguaauagcaaccaacuccgccaaauucacacccaaacucggcgcaauacaaaucggcacuugggaagaaaacgacguccacaucaaccaacccaccaaauucaccccagucggccucuucgaagaugaaggcuucaaccaauggacacuacccaacuacucaggcgcccucacacuuaacaugggccucgcgccucccgucgcccccaccuuccccggcgaacaaauccucuucuuccguucccacaucccacucaaaggcggcgucgccgacccaguaauagacugccuccuuccccaagaauggauccaacaccuuuaccaagaauccgcccccucccaauccgacgucgcccuaauccguuucacuaaccccgacacaggacgcguccuuuucgaagcaaaacuccaccgaucuggcuacaucaccguugccaacacuggcucccgccccauagucguccccgccaacggcuacuucagauucgacucauggguaaaccaauucuacucacucgcccccaugggcacaggcaacgggcgccgacgaguucaauga

SEQ ID NO: 36164 - RNA, 1623 nt, Artificial Sequence
  derived and/or modified sequence opt11 from VP1__Norovirus__AII73738
augaaaauggccagcucagacgcaaaccccagcgauggcucugccgcaaaccucgucccagaaguaaacaacgaagucauggcacuugaaccagucguaggcgccgcaauagccgcccccgucgccggccaacaaaacgucaucgacccauggauccgcaauaacuucguccaagcccccggcggcgaguucaccgucagcccacgaaacgccccgggagaaauccuuugguccgcaccccuuggccccgaccucaacccauaccucucacaccuagcccgcauguacaacggcuacgccggcggguucgaaguacaggucauacucgccggcaacgccuucaccgccggcaagguaauauucgccgccgucccacccaacuuccccacagaaggacucucccccucacaagucacaauguucccacacauagucgucgacguccgccaacuagaacccguucucaucccccuucccgacgucagaaauaacuucuaccacuacaaccaaucaaacgaccccaccauaaaacucaucgccaugcucuauacaccccuacgcgcaaacaacgccggcgacgacguauucaccgucagcugccgaguccucacucgacccucucccgacuuugauuucaucuuccuaguacccccuacaguagagucacgaaccaaacccuucucagucccaguacuaaccgucgaagaaaugacaaacucccgauucccaaucccacucgaaaaacucuucaccggacccuccuccgccuucgucgugcaaccccagaacggacgcugcaccaccgacggaguccuccuuggcaccacacaacucucccccgucaacaucugcacauuccgaggcgacgucacacacaucaccggaucacgaaacuacaccaugaaccuagcaucccaaaacuggaacaacuacgacccaacugaagaaauccccgcaccccucggcacacccgacuucgugggcaaaauccaaggcguacucacgcagacaacccgcacagacggcuccacccgaggccacaaggcgaccgucuacacaggcucugcagacuucgcaccaaaacucggcagaguccaauucgaaacugacacagaucacgauuucgaagccaaccaaaacacaaaauucacccccgucggcgucauccaagacggcggaaccacccacagaaaugaaccgcaacaguggguucucccgucauacucaggccgcaacacccacaacguccaucuugcccccgccgucgcuccaacauucccaggagaacaacuauuauucuuccgcucaaccaugcccggcugcuccggcuaccccaacauggaccucgacugccuccucccccaggaauggguccaauacuucuaccaagaagcagcccccgcacaaucagacgucgcccuccuccgauucgucaacccagacacuggccgcguauuauucgaaugcaaacuccacaaauccggauacguaaccguagcacacaccggccaacacgaccucguuaucccucccaacggcuacuuccgcuucgacucauggguaaaccaauucuacacucuggcccccaugggcaacggcaccggacgacgccgcgccguauaa

SEQ ID NO: 36165 - RNA, 1620 nt, Artificial Sequence
  derived and/or modified sequence opt11 from VP1__Norovirus__AII73741
augaaaauggcuuccaacgacgcugcacccuccaacgacggcgcuacuggccuaguacccgaaaucaauaccgaaacccucccccucgaacccgucgcuggagcagccaucgcagcccccguaaccggacaaaacaauaucaucgaccccuggauucgaaacaacuucguccaagccccaaacggcgaguucacagucucgccccgcaacagccccggcgaaauacucaugaaccucgaacuaggccccgaccucaacccauaccucgcacaccucucucgcauguacaacggcuacgccggcgguguggagguucaaguacuacucgccggaaacgccuucaccgccggaaaaauccucuucgccgccguaccaccaaacuuccccguagacaugcuaucccccgcccaaauaaccaugcucccacaccucaucgucgauguucgcacacucgaaccuaucaugauaccccuacccgacguucgcaacgucuuuuaccacuucaacaaucaaccagccccacgaaugcggcuagucgcaaugcucuacacaccccuacgauccaauggcucuggcgacgacguauucaccgucucaugccgaguucucacccgacccacccccgacuucgaauuuacauaccuagucccacccucagucgaaucaaaaaccaaacccuucacccuacccauccucacaaucggagaacuaaccaacucccgcuuccccgcuccuauagaccaacuuuauacauccccaaacgcagacaucgucguccaaccgcaaaacggucgcugcaccuuagacggcgaacuccaaggaacaacccaacuccucaccaccgccaucugcucauaccgcggcaugaccuccaaccccaccucagacuacugggacgaccaccuccuacaucucguccacccaaacggagcuaccuacgacccaacagaagacguccccgcacccuucggaacccaagacuucagaggaauacucuacggcaugcucacccaaaacccccgcacaucuggcgacgaagccgccaacucccacggcauuuacauauccuccaccucagaaaaauucacccccaaacucggcacaaucggccuccaccaaguccaaggcgacauagcaucaaaccaacaaucaaaauucacucccgucggcaucgccgucaauggaaacacacccuuccgccaaugggaacucccaaauuacuccggagcacucacccuaaacaccaaccucgcuccugcagucgggccuaacuuccccggcgaacaaauccuguucuuccguucaaacgucccuucuguccaaggcggacaacccaucgaaauagacugccuaaucccccaagaaugggucucacauuucuaccaagaauccgcacccucccaguccgacguagcccuaguccgauacguaaaccccgacaccggccgcacaauuuucgaagccaaacuccaccgacaagguuucaucaccaucgccgccaccggauccaauccaguuguggucccacccaauggcuacuuccgauucgacuccuggguaaaccaguucuacgcacuagcccccaugggcaccggcaacggccgucgucgcguacaauaa

SEQ ID NO: 36166 - RNA, 1623 nt, Artificial Sequence
  derived and/or modified sequence opt11 from VP1__Norovirus__AII73744
augaaaauggcaucuuccgacgcaaacccuagcgauggauccacagcuaaccuaguccccgaagucaacaacgaagucauggcccucgaacccgucguuggugccgcaauugccgcacccgucgccggacaacaaaauguaauagaccccuggauacgcaacaacuucguacaagccccuggaggagaguucaccguaagcccacgaaacgcccccggcgaaauccucugguccgcaccccuaggccccgaccucaaccccuaccucucccaccuggcccgcauguacaacgguuacgccggaggcuucgaaguacaaguaaucuuagccggcaacgccuucacugccggcaaaauaaucuucgccgcagucccgcccaacuuccccacagaaggacuaucucccucccaagucaccauguucccgcacauuaucgucgacguccgccaacucgaaccgguccuuaucccacuaccagacguccgcaacaacuuuuaccacuacaaccaauccaacgacuccaccaucaaacucauagcaaugcuauacacuccacuccgcgccaauaacgccggugacgacguuuucacugucuccugccgcguccucacacgccccuccccagacuucgacuucauauuccucgucccaccaaccguggaaucgagaaccaaacccuucucaguaccaguccucacaguagaagaaaugacaaacucacgauuucccaucccccuggaaaaacucuucacaggacccuccagcgccuucgucguccaaccccagaacggucgcuguacaaccgacggcguacuccucggcaccacccaacucucacccgucaacaucugcaccuuuagaggugacguaacccacauccccggcucccgcaacuacacaaugaaccuagccucccaaaacuggaacagcuacgacccaaccgaagaaaucccagccccacuaggaacacccgacuucguaggcaaaauacaaggcguccuuacccaaaccacucgcaccaacggcuccacccgcggccacaaagccaccguauacaccggaucagccgacuucagcccaaaacucggccgcguacaauuugccacagauaccgacaacgacuucgaaacaaaccaaaacacaaaauucacacccguaggcgucauccaagauggauccaccacaccccguaacgaaccacaacaauggguucuccccuccuacucaggccgcaacauccacaacguccaccucgccccagcaguagcacccacuuuccccggugaacaacuacuauucuuccgcucaaccaugccgggcuguucaggcuacccaaacauggaccucgacugccuacuaccacaagaauggguacaauacuucuaccaggaagcagccccugcccaaucagacgucgcccugcuccgcuucguaaacccagacaccggacgcguccuauucgaaugcaaacuccacaaauccggcuaugucaccguugcgcauacaggccaacacgaccuugucaucccucccaauggcuacuuccgcuucgacucauggguuaaccaauucuauacgcucgcacccaugggcaacggaacuggccgacgucgugcacuauaa

SEQ ID NO: 36167 - RNA, 1623 nt, Artificial Sequence
  derived and/or modified sequence opt11 from VP1__Norovirus__AII73747
augaaaauggccagcaacgacgcugcccccucaaacgacggcgccaccggccuaguccccgaaaucaacaacgaaacacuuccccuugaacccguagccggagcagccaucgcggcccccgucaccggacaaaauaacaucauagacccauggauccgcaccaacuuuguccaagcccccaauggagaauuuaccguaucuccccgcaacucucccggcgaaauccuucucaaccuagaacucggcccagaccucaacccauaccucgcccaccucucacgcauguacaacggauacgccggcggggucgaaguucaaguacuacucgccggcaacgcuuucaccgccggcaaaauacuauucgccgcaguacccccaaacuuccccgucgaauuucuaucaccagcccaaauaaccaugcucccccaccucauagucgacgugcgaacccucgaaccaaucaugaucccccuucccgacguucgaaauacauucuuccacuacaacaaccaacccgccaaucgcaugcgccuuguagccaugcucuacaccccacuucgauccaacggauccggagacgacguauucaccgucuccugccgcguccuuacacgacccacccccgacuucgaauuuaccuaccuagucccucccuccguagaauccaaaaccaaacccuucucacucccaaucuuaaccaucucugaacucacaaauucccgcuuccccgcccccauagacucucucuucacagcucaaaacaacaaccucaacguccaaugccaaaacggaagauguacacucgacggcgaacuacaaggcaccacccaacuccuacccagcggaauaugcgcauuccgcggucgccucacagcagacguagacggcucucacgacgaccgcuggcacaugcaauuaaccaaccuaaacggcacaccauucgaccccacugaagacguccccgcaccccucggcaccccagauuucacaggccuccuauucggcguagcuucgcaacgaaacgucggcuccaacccaaacacuacacgcgcccacgaagccgucauaucuaccacaucaucccaauucguccccaaacucggauccgucaacuucggcuccacauccaccgacuuccaacuacaacaaccaacaaaauucacgccaguaggaaucaaaauagaaucaggacacgaguucgaccaaugggcacucccucgauacuccggccaccuaacacuaaacaugaaccuagccccgcccaucgcucccaacuucccaggagaacagcuccuguucuuccgcucaaacguccccugcgccggaggaguaagcgauggugucaucgacugccuccucccccaagaauggauacagcacuucuaccaagaauccgcccccucccaauccgacguagcacuaaucagauacgucaaucccgacaccggacgcacacucuucgaagcgaaacuccaccgcaccgguuacaucaccgucgcacacucaggcgauuacccacucguaguccccuccaacggcuacuuccgguucgacucaugggucaaccaauucuacucccucgcuccaaugggcaccggcaacggccgccgacgcguccaauaa

SEQ ID NO: 36168 - RNA, 1623 nt, Artificial Sequence
  derived and/or modified sequence opt11 from VP1__Norovirus__AII73750
augaaaauggccuccucugacgccaaccccuccgacggcucaacagccaaccucguccccgaagucaauaacgaaguaauggcauuagaacccgucgugggcgcagccaucgccgcaccugucgccggccaacaaaacgucaucgacccauggauccgaaauaacuucguucaagcccccggcggcgaguucaccguuucuccccgaaacgccccaggagaaauccucuggucggcaccccucggacccgaccucaauccuuaccuaucccaccucgcccgcauguacaacggccacgccggcggauucgaaguucaaguaauccuggccggcaaugcauuuaccgcuggaaaaauaauauucgcagccguaccacccaacuuccccaccgaaggccucucacccucacaagucaccauguucccacacauaauagucgacguccgacaacuggaacccguccucaucccccucccagacguacgaaacaacuucuaccacuacaaccaauccaaugacuccaccauuaaacucaucgcaaugcucuacaccccauuacgcgccaacaaugcaggcgaagacgucuucaccgucucuugucgcguccuaacccgaccaucacccgacuucgacuucauauuccucguucccccaaccgucgaaucaagaaccaaacccuucaccguccccauccucaccguggaagaaaugaccaacucucgcuuccccaucccacucgaaaaacucuucaccggacccagcuccgcguucgucguccaaccccaaaacggaagaugcacuaccgacggcguucuccucggaacaacccaacucucacccgucaacaucugcaccuuccguggcgacguaacacacaucgccgggucccgaaacuacacaaugaaccucgccucucugaacuggaacaacuacgacccaaccgaagaaauccccgcaccccucgguacucccgacuucgucggaaaaauccaaggcguccuaacccagaccaccaaaggagauggauccacccgaggacacaaagccaccguauacaccggaagcgcccccuuuacaccaaagcucgguuccguacaauucuccaccgacaccgaaaacgacuucgaaacacaccaaaacaccaaauucacccccguaggcgucauccaggacggcggcacuacccaccgcaacgaaccccaacaauggguccugcccuccuacucaggcagaaauguccacaauguccaccucgcucccgcagucgcaccaaccuucccaggcgagcaacuccucuucuuccgcuccaccaugcccggauguuccggauaccccaacauggaccuagacugccuacucccccaagaauggguccaacacuucuaccaagaagccgcccccgcucaauccgacguagcucuccuucgcuucgucaacccagacacaggccgcguccucuucgaaugcaaauuacacaaauccggcuacgugaccguagcccacacaggacaacacgaccucguaauacccccaaacggcuacuuccgcuucgacuccugggucaaccaauucuacacacuagcccccaugggaaacggaaccggacgccgacgcgcacuauaa

SEQ ID NO: 36169 - RNA, 1623 nt, Artificial Sequence
  derived and/or modified sequence opt11 from VP1__Norovirus__AII73753
augaaaauggccucaaacgacgcaaccccauccaacgacggcgcagccggccuaguccccgaauccaacaacgaagcgauggcacucgaaccugucguaggcgcuucccucgccgcacccgucacaggacaaaccaauauaaucgaccccuggauccgcacuaauuucguccaagccccgaacggagaguucaccgucucaccccgaaacuccccaggugaaauccucgucaaccucgagcuaggcccagaacucaaccccuaccucgcccaccucgccagaauguacaacggauacgcuggcggcauggaaguucaagucaugcuugcaggcaacgcauucacugcaggcaaaaucaucuucgcagcuguacccccauauuucccggucgaaaaccucuccccaucacaaauaacaauguucccccacgucaucauagacguacguacccuagaacccguccuccuccccaugcccgacgucagauccacccuauuccacuucaaccaaaaagacgaaccaaaaaugcgacucgucgcuaugcuuuauacaccccucagaagcaacggauccggugacgacguuuucacaguaucaugccgcauccucacacgccccucccccgaguucgauuucaccuaccuggugcccccaaccgucgaaaguaaaaccaaacccuuuacccucccuguacucacccuaggugaacucucaaacagccgcuucccacucuccauagacgaaaugguaaccucccccaacgaaucaaucgucguccaaccacaaaacggccgugucacccucgacggugaauuacucggcaccacccaacuacaagccugcaauaucugcuccauccgcggcaaagucaccggacaaguccccaacgaacaacauauguggaaccuccaaauaacuaaccucaacgguacccaauuugaccccacagacgacguucccgccccauuaggcguccccgacuucgccggagaagucuucggcguccuaucccaacgcaaccgcggcgaaaguaaccccgcaaaccgcgcccacgacgccgucgucgccaccuacagcgacaaauacacaccaaaacucggccuaguccaaauaggcaccuggaacaccaacgauguagaaaaccaacccaccaaauucacacccauaggacucaacgaagucgcaaacggccacagauuugaacaauggacacucccccgcuacucaggcgcacucacacucaacaugaaccucgcacccgcaguagcuccccucuuccccggcgaacgccuccucuucuuccgcuccuacgucccccuuaaaggcggauucggcaacccugcaaucgacugccuaguaccccaagaauggguccaacacuucuaccaagaauccgcccccagccucggcgacguagcccucguacgauacgucaacccggacacaggacgcguucuuuucgaagccaaacuucacaaaggcggcuuucucacagucuccagcacauccacugggccuguaguaguccccgccaacggcuacuuccgcuucgacucuugggucaaccaauucuacucgcucgcccccaugggcaccggcaacggccgacgccgcuuccaauaa

SEQ ID NO: 36170 - RNA, 1623 nt, Artificial Sequence
  derived and/or modified sequence opt11 from VP1__Norovirus__AII73756
augaaaauggcgaguucugacgccaaccccucagacggcuccaccgcaaaucuagucccugaaguaaacaacgaaguaauggcacuagaacccguugucggcgccgccauagcagccccaguagccggacaacaaaacgucaucgacccauggauacgcaacaacuucguccaagcacccgguggcgaguucaccgucucccccagaaacgcaccuggcgaaauccucugguccgcaccccucggccccgaccucaacccauaccuuucccaccuagcccgaauguacaacggguacgccggcggcuuugaaguccaagucauccucgcaggcaaugccuucacagccggcaaaaucaucuucgccgccguaccacccaacuuccccaccgaaggccucucccccucccaagugaccauguucccacacaucaucguagacguccgacaauuggaacccguccucauaccccugccugacguacgcaacaauuucuaccacuacaaccaauccaacgauagcaccaucaaacucaucgcaaugcucuacacgccccuccgcgcaaacaacgccggcgacgaugucuucaccgucucaugccgcguucuaacccgaccgucaccagacuucgacuucaucuuucucguacccccaaccgucgagucacgcaccaaacccuucucaguccccguccuuaccgucgaagaaaugacaaacucccgcuuccccaucccacucgagaaacuauucaccggccccuccagcgccuucguaguucaaccccaaaacggacgaugcaccaccgacgguguacuccucggcaccacacaacuauccccggucaacaucugcacauuccgcggagacguuacccacauccccggcucacgaaacuacaccaugaaccuagccucccaaaacuggaacuccuaugacccaaccgaagagauccccgccccacucgggaccccagacuucguuggcaaaauccaaggaguccucacacaaacaacccgcacaaacggcucaacccgcggccacaaagccacagucuacacaggcuccgcagacuucucacccaaacuaggccguguccaauucgccacagacaccgacaacgacuuugaaaccaaccaaaacaccaaauucacaccaguuggcgucauccaagacggauccaccacacccagaaacgaaccccaacaauggguacuacccucauacuccggccgcaacauccacaacguccaccuagcccccgcagucgcucccaccuuccccggcgaacaacuccuguucuuccgauccaccaugcccggcugcuccggcuaccccaauauggaccucgacugccuccucccccaggaauggguccaauacuucuaccaagaagcugcaccagcacaauccgacgucgcacuucuccgauucgucaaccccgacaccggccgcguccucuucgaaugcaaacuacauaaauccggcuacguaaccguagcccacaccggccaacacgaccuugucauaccucccaacggauacuuccguuuugacuccugggucaaucaauucuacacccuagcacccaugggcaauggcacgggccgccgacgagccuuauaa

SEQ ID NO: 36171 - RNA, 1668 nt, Artificial Sequence
  derived and/or modified sequence opt11 from VP1__Norovirus__AII73759
augcgcauggccuccucagacgcaccaguauccggaaccgacggugcagcuggacuuguucccgaaucccaacaagaaguacucccccucgaacccgucgccggcguacaacucgccgccccugucgccggacaauccaacauaauugaccccuggauccgaaugaacuucguccaggcacccgccggcgaauuuaccguuucuccccggaacgccccaggcgaaguacucaucgaccucgaacucggaccagaacucaauccauaccuaaaccaccuagcacguauguacaacggguacgucggcggcauggaaguugaaguuguccucgccggcaacgccuucacugccggcaagauacuauucgccgcagucccacccuccuucccaacccacggcaucucagccgcccaagccacaaugcuaccacacgucaucgucgacguccgccagcuagaacccguacgccugccccuccccgacguccgcaacgucauguuccacuucugccaagaaaacaaagaaccccgcaugcgcaucgucgcaauccucuacacaccccuacgugcaaacggagccggggacgacgucuucaccgucucuugccguguacucacccgcccauccccagacuucgacuucauauuccucguuccacccuccgucgaauccaaauuaaaacaauucacacuccccaaccuacaacccaacgaaaugaccaacucccgcuuccccacagguaucacacaacucuacaccucaccaaacaccaaccucgucguccaauuccaaaacggccgcugucuccucgacggcacccuacuaggcacaacgccagucagagccgcagacauuugcuccuuccgaggcgucacauccacugaagucgacgccaccgauucaccccgaguggccggcucccaccguauaaugguacaauuacgcgaaccagacggcgaagaauuuucccccaccggcccaaaccccgcgcccguagguacacccgacuuccaggccgccaucuucggcacacucucccagcguaacacuggaggcgccggccaaaacuccaaccgagcccacuucgccuauuucuacacacgcaaccccacauucgcccccggcauuggcaccgucgucuucucauucgacaccacugauuuccaaaaccgacaacccaccaaauuuagccccuccggaguauucgaugacgacuccucagaacccuucaaccaauucucccuaccauacuacaacgguucauuaggcgcgguagacgcaggaaaacuagccccucccgucgcccccaacuacccaggugaacaaauccucuacuuccgcggauccguaccauucaaaggcggcuacggcgaaggcgaaaucgacagccuccucccccaagaauggaucacccacuucuacgccgaacaagcacccacccaaggagacgcggcccuucuccgauauuacaaccccgacacaggccgcguccuguucgaaugcaaacuccaccgagaaggauuuauaaccauuaacuacaccggcuccaacgcccucgccguccccguaaacggcgucuuccgcuucgaaggcugggucaauaaauucuacacucuaacccccaugggaaauggcaacggacgccguggacgcagacgcgaacucuaa

SEQ ID NO: 36172 - RNA, 1668 nt, Artificial Sequence
  derived and/or modified sequence opt11 from VP1__Norovirus__AII73762
augaaaauggcaucaaaagaugccucccccuccaccgacgguacagcgaaccugguacccgaaucccaacaagaagucuuagcucuccaaccugucgcaggagcccaaauugccgcgccugucgccggccaauucaacgucauagaccccuggaucuaccaaaauuucguacaagcccccgaaggcgaguucaccgucucaccccgcaauuccaccggcgaaaucuuaaugaaccuagaacuaggcccccaacuaaaccccuaccucgcacaccucgccagaauguacaacgccuacgccggcgguuucgaaguccaagucuuacucgccgguaacgcauucacagccggcaaaaucauagucugcgccguuccgcccaacuucccccuccaaaauaucuccgcugcccaggcaacccaacuaccacacgucgucgucgacguucgccaacucgaaccugucguccuaccccuucccgacguucgagcaggcuucuaucacuacaaccaaguagaagaaucucgcaugcgccuaguagcgauccuauacaccccacuuagaaccaacucugccggcgacgacgccuucaccgucuccugcagaauccucacgcgacccgcucccgacuucuccuucuucuuccuaaucccacccaccaucgaaucaaaaacuacccccuucacgcucccccgacuccccauauccgaaaugaccaacucucgauucccccucguaauaaaaggcauggucgucgacccaaaccuuccccuccaagcaaacuuccaaaacggccgcauaacccucgacggcgaacuacaaggcacuacccuaccuaccagcaccuccauuggccgcaucucagguacccacauguccucuacacccucccgaauaauccaacacgaagacagcggcgauuccacccaaccacgugucuucaacccagucuggauggaccuaacugaaaacaacuggaccgaguuccaacccuucaacgaccaaccggcaccccuuggcugccccgacuucaaagccaaaauacucggaacccuaaucagacaacccaacaacgguuccuacuacuucgacgccuaccuugacacccgucaacacggcaccuuugcccccuacacaggacacgccgccguccacucugaccaacaagccggccaccucgcucaaggcuacaagauacaauucuccccuaccgggaucgaaucagaccaaaacaccgaccucaaccaacucccagacuacggcggagccaugacagucuccaaaggccuggccccugccgccgcccccgacuucccgggagaaaugauccuauacuucgucucagacaugcccguccguaacccaaacggcgaacgccgugacaccgaaauccucugccucuuaccacaagaaauggucacacacuucuacgaacaacaagcccccagccaaggagacguagcacucguacgguacaucaacgccgaaaccggccgcguaauguucgaaggcaaacuccaccgaaacggcuucuucacuguauccgcaaccgcacgaacucuuauaguacccgacggcuacuucagauucgauuccugggucaacagauucuacaccuuauccccaaugggcaccgguaauggccgccgccgcgcucgaaugcuagaauaa

SEQ ID NO: 36173 - RNA, 1638 nt, Artificial Sequence
  derived and/or modified sequence opt11 from VP1__Norovirus__AII73765
augaugauggcaucgaaagacgccccaaccaacauggacggcaccuccggcgccggccaacucguacccgaagcaaacaccgccgaacccauaucaauggaacccguagccggcgcugcaaccgccgccgcaacagccggccaaguaaacaugauagacccauggaucaugaacaauuacguccaggccccacaaggcgaauuuacuaucagccccaacaacacaccaggcgacauccucuucgaccuucaacucggcccccaccucaaccccuuccuaucacaccucgcccagauguacaacggaugggucggcaacaugaaagucaaaguccuccucgccggcaacgccuucaccgcuggcaaaaucauaaucuccuguaucccgcccggcuucgucgcacaaaacgugagcauagcucaggccacaauguucccccacgucaucgccgacguccgcguccucgaacccauagaagucccccucgaagacguccgcaacguucucuuccacaauaacgacaacacacccaccaugcgacucgucugcaugcucuacaccccacuccgcgccuccgggucaucaucuggaaccgacccauucgucaucgccggccguguccuuaccugccccuccccagacuucagcuuccucuuccucgucccucccaacgucgaacagaaaacaaagcccuucuccguccccaaccucccccucaacacccuuuccaacucacgcgugcccucccuaauaaaauccaugaugguaagccgagaccacggccaaaugguccaauuccaaaacggccguguaacccucgacggccaacuccaaggcacaacaccaacaucagcaagccaauuaugcaaaauccgcggcuccgucuuccacgccaacggcggaaacggcuacaaccucacagaacuagacggcucaccauaccacgccuucgaaucacccgcccccauaggcuucccugaccucggcgaaugcgacuggcacauggaagcgucuccaaccacgcaauucaacaccggggacgucaucaaacaaaucaacgucaaacaagaaucagcuuucgccccacaccucgguaccauccaagccgacggccuaucugacgucucaguaaacacaaacaugaucgcaaaacuaggcuggguaucccccgucuccgacggccacaaaggcgacgucgacccauggguaaucccacguuacgguuccacccucacagaagccgcccaacuagccccacccaucuacccucccggcuucggagaagcaauagucuucuucaugagugacuuccccaucgcccacggcaccaacgggcucagcguccccugcaccaucccccaggaauuugucacccacuucguaaacgaacaagcccccacgagaggcgaagccgcccuccuucacuaucuugaccccgacacacaccgcaaucuaggagaguucaaacucuaccccgacggcuucaugacauguguacccaacuccagcggaacggguccccaaacccuucccaucaacggcgucuucgucuucgucuccuggguauccagauucuaccaacucaaacccguaggcacagcuggccccgcacgccgacucggaauccgacgaucauaa

SEQ ID NO: 36174 - RNA, 1623 nt, Artificial Sequence
  derived and/or modified sequence opt11 from VP1__Norovirus__AII73768
augaaaauggccuccuccgacgccaaccccuccgacgguucugccgcaaaccuaguccccgaagucaacaacgaagucauggcccuagaaccagucgucggcgcagcaauugcagccccaguagccggccagcaaaacguaauugaccccuggauccgcaacaacuucguccaagcucccggcggcgaguucacaguaagcccccgcaacgccccaggcgaaauacucugguccgcaccccuaggccccgaccucaauccauaccuuucacaccucgcccgcauguacaacggcuacgccggagguuuugaaguucaaguaauccucgccgguaacgccuucaccgccggcaaggucauuuucgccgccgucccacccaacuuccccaccgaaggacuaucacccucccaagucaccauguucccccacauaguugucgacguccgacaacucgaaccaguccucaucccccuaccagauguccgcaacaauuucuaccacuacaaccaauccaacgaccccacuauuaaacucaucgcuaugcuauacacaccccuccgcgcaaacaacgccggggacgacguuuucaccgucucaugccguguccucacacgcccaucacccgacuucgacuucaucuuccucgucccgccuaccgucgaaucucgcacaaaaccuuucuccguucccguacuaaccguugaagaaaugacaaacucgagauucccaaucccacuugaaaaauuauucaccggccccuccucagccuucguaguccaaccacaaaacggccgcugcaccaccgacggaguucuucucggcacuacacaacucucaccuguuaacauauguacauuccgcggagacgucacccacauaacuggaucgcgaaacuacaccaugaaccuggccucgcagaacugguccaacuacgaccccacagaagaaauccccgcaccccucgguacacccgauuuugucggcaaaauacaaggcguccucacacagacuacucgcacagacggauccacccgaggucacaaagcaaccguuuacacaggcuccgccgacuucgcaccaaaacucggccgcguccaauucgaaacugacacugaucgcgacuucgaggccaaccaaaacaccaaauucacccccgucggaguuauccaagacggaucaaccacccaucgaaacgaaccccaacaaugggugcuccccuccuacuccggccgaaacaccccuaacguccacuuagccccagccgucgcaccaacauucccaggcgaacaacuccucuucuuccgaucaaccaugcccgguugcagcggcuaccccaauauggaccucgacugccuccuuccucaagaguggguccaauauuucuaccaagaagccgcaccagcccaauccgacgucgcccuacuacgcuucgucaacccagacaccggccgcguacuuuucgaaugcaaacuccacaaaucuggcuacguaaccgucgcccacaccggccagcacgaccuagucaucccuccaaacggauacuuccgauucgacuccuggguaaaccaauuuuacacccucgccccaauggguaacggcaccggacgccgacgcgcccuauga

SEQ ID NO: 36175 - RNA, 1608 nt, Artificial Sequence
  derived and/or modified sequence opt11 from VP1__Norovirus__AII73771
augaaaauggccuccuccgacgcagcucccuccaacgacggagccgccggccuaguccccgaagccaacaaugaaaccauggcccuagaaccaguagccggagcauccaucgcagcuccucucaccggccaaaacaacauaaucgaucccuggauucgacucaauuucguccaagcucccaacggcgaguucaccgucucuccccgaaacuccccaggagaaguccuccucaaccucgaacuaggaccagaacuuaaccccuaccuagcucaucucagcagaauguacaacggauacgccggcggagucgaagugcaaguccuccuagccggaaacgcauucacagccggaauauuagucuucgcugccguacccccacacuucccccuagaaaacaucucuccuggccaaaucacaauguucccacacgucaucaucgacguccgaacccucgaaccaguccuccuaccacucccagacguacgcaacaacuucuuccauuacaaccaacaaaacgaaccacgcaugagauuagucgccaugcucuacacuccccuucgcucaaacggaagcggggacgacguuuucaccguauccugccgcguacuuacaagacccucacccgauuucgacuuuaacuaucucgucccaccaaccguagaaucaaaaacaaaacccuucacccucccaauacuaaccaucggcgaacucaccaacucccgcuuccccguccccaucgacgaacucuacaccucccccaacgaaucacuuguaguccaaccacaaaacggccguugcgcccuagacggcgaacuccaagggaccacucaacuccucccaacagccaucugcucauuccgcggccgcaucaaccaaaaaguuucuggcgaaaaccacguauggaacaugcaagucacaaacaucaacggcacuccauucgaucccacagaagacguaccagccccacugggaacucccgacuucuccggcaaacuauucggcguccucucacaacgcgaccaugacaacgccugccgcucccacgacgccgucauagccaccaacagcgccaaauucacacccaaacucggcgccauccaaaucggcaccugggaacaagacgacguccacaucaaucaacccacaaaauucaccccaguuggcuuauucgaaaacgaaggauucaaccaauggacacuaccaaacuacuccggagcccucacccuaaacaugggacuagccccacccgucgcucccaccuuccccggagaacaaauccucuucuuucgcucccacaucccccucaaaggcggcguugcagacccaguaaucgacugccuccuaccccaagaauggauccaacaccucuaucaagaauccgcccccucacaauccgacgucgcccucauccguuucacaaacccugacacuggccgcguccucuucgaagccaaacuccaccgauccggcuacauuaccgucgccaauaccggcucccgccccauaguaguaccagcaaacggcuacuuccgcuuugacucaugggucaaccaauucuacucacucgcgcccaugggcacagguaacggcagacgacgcguccaauaa

SEQ ID NO: 36176 - RNA, 1623 nt, Artificial Sequence
  derived and/or modified sequence opt11 from VP1__Norovirus__AII73774
augaaaauggccuccaacgacgccgcacccucaaacgacggagccgcuggccucguccccgaaaucaacaacgaaguaaugccacuagaacccgucgcaggcgccucccuagcaacgcccgucgucggccaacaaaacaucaucgauccauggauccgaaacaacuucgugcaagccccagccggcgaguucaccgucucaccccgaaacucccccggcgaaauccuccucgaccuggaacucggcccagaacucaacccauaccuagcccaccucgcccguauguacaacggccacgccggcggcauggaaguccaaaucguccucgcaggcaacgcauucaccgccggcaaaaucaucuucgccgcaauacccccaggcuuccccuacgaaaacuuaucaccaucccaaaucaccaugugcccccacgucaucaucgacguccgccaacucgaacccguucuccuacccaugcccgauauccgaaacaacuucuuccacuacaaccaaggcaacgacccuaaacucagacucaucgcaaugcucuacacaccacuacgugccaauaacagcggcgacgacguauucacugucaguugccgaguccucacaaaaccaucccccgacuucgaguucaccuuccucgucccaccaacuguggaauccaaaacaaaacaauucacccuaccaauccucaaaauuucggaaaugacaaacagcagauuccccguccccguagaaaugauguacaccgcucgaaacgaaaaccaagucguucaaccacagaacggccgaguaacccucgacggagaacuacucggcaccacaccccuccucgccgucaauaucugcaaauucaaaggcgaaguaauagccaaaaacggcgacguccgaagcuaccggauggacauggaaaucaccaacaccgauggcacaccaauagaccccacagaagacacccccggccccauuggcucccccgacuuccagggcauucuguucggagucgcaucucagcgcaacaaaaaugaacagaaccccgcaacccgcgcccaugaagccaacaucaauaccggaggagaccaauacgccccaaaacuggcccaagucaaauucuucuccgaaucccaagacuucgaaguacaccaacccacuguauucacccccgucggcguagccggcgacaccucccaccccuuccgccaguggguccuaccccgcuacggcggccaccuaaccaacaauacucaccucgcccccgcaguugccccacuauuccccggcgagcaaaucuuauucuuccguagucaaauccccuccucuggcggacacgaacuggguuauauggacugccucgucccccaagaauggguccagcacuucuaccaagaagccgcaaccgcccaaucagaagucgcucuuauaagauucauaaacccagacacagggcgcguccucuuugaggccaaacuccacaaacaaggcuucaucaccguagcucacacaggcgauaaccccauagucaugcccccaaauggcuacuuccgcuucgaagccugggucaaccaauuuuacucccucgcaccggucggcaccggaaacggccgccgccgcauacaauaa

SEQ ID NO: 36177 - RNA, 1623 nt, Artificial Sequence
  derived and/or modified sequence opt11 from VP1__Norovirus__AII73777
augaaaauggccagcucugacgccaaccccucagacggcuccgccgcaaaccuuguccccgaggucaacaacgaaguaauggccuuagaacccgucgucggcgccgcaaucgccgcccccgucgcaggacaacaaaacgucaucgaccccuggauccgaaacaacuucguucaagcacccggcggagaguucaccgucagcccccgcaaugccccaggcgaaauauuauggucugcaccccuuggcccagaccucaacccguaccuaucccaccuagcccgaauguacaacggauacgccggcggauucgaaguccaaguaauccuagcaggaaacgcauucaccgccggcaaagucaucuucgcagcagucccacccaacuucccaacagaaggccuaucacccucccaagucaccauguucccacacauugucgucgaugucagacagcucgaacccguacucaucccacucccggacguucgaaauaacuucuaccacuacaaccaaagcaaugaccccaccaucaaacugaucgcaaugcuauacacaccccuccgagcaaacaacgccggcgacgacgucuucaccgucucuugucgcguucucaccagaccaucucccgacuucgacuucaucuuccucgucccacccaccgucgaaucaagaaccaaaccauucuccguccccguccucaccgucgaagaaaugacuaacucacgauuucccaucccucuagaaaagcuauucaccggccccuccuccgcauucgucguccaaccacaaaauggucgcugcacaacagacgguguccuccucggaaccacccaacucucaccaguaaacaucugcaccuuccgcggagacguaacacacaucaccggcucccgaaacuacacaaugaaccuugccagccaaaacuggaacaacuacgaucccaccgaagaaauccccgcaccccuaggcacgccagacuucguaggaaaaauccaaggcguccucacccaaacaacacgcaccgacggcucaacacgaggccacaaagccaccgucuauaccggauccgccgacuucgccccaaaacuuggccgaguccaauucgaaaccgacacagaccaugacuucgaggccaaccaaaacaccaaauucacccccguaggcguaauacaagacggcggaacaacacaccgcaacgaaccccaacaauggguacuccccuccuacucaggacgcaacacacauaacguccaccucgcccccgccguggcacccaccuuccccggugaacaacuccucuucuuccgcuccaccaugccaggaugcucgggcuaccccaacauggaccuagacugccuacuaccacaagaauggguacaauacuucuaucaagaagccgccccagcccaaucagacguagcacuccuccgcuucguaaaccccgacacaggccgcguacuauucgaaugcaaacuacacaaaucaggcuacguuaccguagcccacaccggccaauacgaucucguaauaccacccaacggcuacuuccgguucgacucaugggucaaucaguucuacacucuagcccccaugggcaacggaacaggacgcagacgcgccgucuag

SEQ ID NO: 36178 - RNA, 1611 nt, Artificial Sequence
  derived and/or modified sequence opt11 from VP1__Norovirus__AII73780
augaaaauggccaguaacgacgcaacccccucagacgauggcgccgccggccucguacccgaaaucaacucagaagucauggcccucgaacccgucgccggcgcauccauagccgcacccgucgucggacaacaaaauaucauugacccauggauacgcaauaacuuuguccaagcccccgcaggcgaguucacaguaucaccacgcaacagcccgggcgaacuccuccucgaccucgaacucggccccgaacucaacccauaccucgcccaccuagcacgcauguauaacggccaugccggcggcauggaaguacaaauuguuuuagcaggcaaugccuuuaccgccggcaaaauccucuucgcagccaucccacccuccuuccccuaugaaaaccuaucccccgcacaacucacgaugugcccccacguuauagucgacguccgccaacucgaacccguccuacuccccaugccagacauccgaaacguauucuaccacuauaaccaaaacaacagcccaaaacuucgccucguagccaugcucuacacaccccuccgugccaacaacuccggcgaugacguuuucaccgucucaugccgcguccucacccgcccaucccccgacuuccaauucaccuucuuaguaccucccaccguagaauccaaaaccaaaaacuucacccuccccguacuccgcgucuccgaaaugaccaacucccgcuuccccguaguccucgaccaaauguacaccucccgaaaugaaaacaccaucguccaaccccaaaacgggcgcugcaccacagacggagaacuccucggaaccacaauacuccaaucuguauccaucugcaacuucaaagguacaaugcaagcaaaacucaacgaagaaccccgauaccaacuacaauugacaaaucucgacggaucccccaucgaccccacagacgacaugccagcaccccucggaacccccgacuuccaagccguccuuuacggcgucgccucacaacgcuccuccagagacaaugccacacgcgcacacgacgcccaaauagacaccgccggcgacaccuucgcccccaaaaucggucaaguacgcuuuaaauccagcuccaacgacuucgaccuccaugacccuacaaaguucacccccaucggcgucaacguagacgaucaacaccccuuccgccaauggucacuccccaacuacggcggucaccucgcccucaacaaccaccucgcccccgccgucacaccccucuuccccggagaacaaauccucuucuuccgaucauacauaccuuccgccggaggucauaccgauggcgcaauggacugccuccucccccaagaauggguagaacacuucuaccaagaagcagcacccucacaaucagacauagcacucgucagauucaucaaccccgacaccggcagaguccucuucgaagcaaaacuccauaaacaaggcuuccucacaaucgcagccuccggcgaccaucccaucguuaugccaacaaacggcuacuuccgauucgaagcauggguaaaccccuucuacacccucgcaccagucggcacuggcucaggccgccgcagaauccaguaa

SEQ ID NO: 36179 - RNA, 1632 nt, Artificial Sequence
  derived and/or modified sequence opt11 from VP1__Norovirus__AII73783
augaugauggccagcaaagacgcaccgacaaacauggacggcaccuccggugccgggcaacucgugccagaagcaaacaccgccgaaccccuacccauaaaaccagucgccggagcggcaaccgcagucgcaacagccggccaagucaacaugaucgaccccuggaucaugaauaacuucguacaagcgccacaaggcgaguucacaauuucucccaacaauacacccggagacauccucuuugaccuccagcucggaccccaccuaaaccccuuccuagcccaccucucacgcauguacaacggcuggguaggcaauaugcagguccgaaucaugcuagccggcaacgccuucuccgccgguaaaauaaucgucugcugcaucccaccaggcuucuccucccaauccauaagcauagcccaagccaccauguucccccacgucauagcagacguccguguccuagaaccaaucgacguuccccuugacgacguccgaaacguacucuuccacaauaacgacaacccccaaacaaugcgccuccucugcaugcucuacacaccccuucguuccggcggcaccucaucaggaaccgaccccuucgucaucgcaggccguguccucaccugucccacccccgacuucucauuccuuuuccuugucccucccgacaucgaacaacgcaccaagcccuuuuccguacccaacaucccaaugaaccucauguccaacucacgagucuccaugcuaaucgacggcaugauggucuccaacgaccaaaaccaaguuccccaauuucaaaacggacgcguaacacuagacggacaacuacaaggcacaaccacagucuccgccgcaugcgucgcacgcaugcgcggccgaauauuuaacaacaacggcaacuacggaguaaaccucaccgaacucgacggaaaccccuaccacgcauucgacucccccgcgccccucggcuuccccgauuucggaaauugcgaccuccacaugaccuucguuaaaauaaaccccaacgaacucuccucaggcgaccccuccggaaaagucguaauccacucauacgacgcaacauucgcaccccaccucggcaccgucaaacuagagaacgacgacgaacucgcccguuucguaggcaaagaagucguacuagaacucacaugggucuccaaccgcgaaggugccacccuaaaccuaugggccguaccaaacuacggcucgucacuaacccaagcaucccaacucgcacccccaauuuacccucccggcuucggagaagccaucguauacuucacaucaacauuccccaccgucucaaacccaaaaguccccugcacacucccccaagaauuuguuucccacuucguuaacgaacaagccccgaccagaggcgacgccgcccuccuccacuacgucgaccccgacacccaccgcaaccuaggggaguucaaaauguaccccgaaggcuacaugaccugcgucccaaacgcaggcggaggcccacaaacccucccuaucaacggcgucuucguauucaucuccuggguaagccgcuacuaccagcucaaacccgucggcaccgcuggcgcugcccgccgacuaggucuucgccgcagcuaa

SEQ ID NO: 36180 - RNA, 1608 nt, Artificial Sequence
  derived and/or modified sequence opt11 from VP1__Norovirus__AII73786
augaaaauggccuccuccgacgccgccccuuccaacgacggagcggccggccucguccccgaagccaacaacgagaccauggcccucgaacccgucgccggugcguccaucgcugcaccccugaccggccaaaauaauaucaucgaccccuggaucagacucaacuucguccaagcccccaacggagaguucacagucucuccccguaauuccccaggcgaaguacuacucaaccuugaacucggccccgaacucaacccauaccucgcucaccuaucccgcauguacaauggcuacgccggcggaguagaaguccaaguucuccucgccggcaacgcauucaccgccggaaagcuaguuuucgccgccgucccaccacacuucccccuggaaaacaucucacccggacaaaucaccauguucccccacgucaucaucgacguccgaacuuuagaacccguccuacuaccacuucccgacguccgaaacaacuuuuuccacuacaaccaacaaaacgaaccccgcaugcgccuugucgccaugcucuacacacccuuacgcuccaacggauccggcgacgacgucuucaccguuuccugccgaguccucacccgccccucacccgacuuugauuucaacuaucucgugccacccacugucgaaucuaaaaccaaacccuucacacuccccauacucaccaucggcgaacugaccaacagccguuucccuguccccauugacgaacuauacacuuccccaaacgaaagccucgucguacaaccacaaaacggccgcugcgcccucgacggagaacuccaaggcaccacccaacuacuacccacagccaucugcucuuuccgcggacgaaucaaucaaaaagucucuggcgaaaaucauguauggaacaugcaagucacaaacaucaacggcaccccuuuugaccccacagaagacgucccagcgccacuaggcacccccgacuucucaggcaaacucuucggcguccucucccaaagagaccacgacaacgccugccguucccaugacgccguaaucgccaccaacucagccaaauucacccccaaacucggcgccauccaaaucggcacaugggaagaaaacgacguccauauaaaccaacccaccaaguucacacccgucggccuguucgaagacgaaggcuuuaaccaauggacccuccccaacuacagcggcgcccucacccucaauaugggccucgcacccccagucgccccaaccuucccaggagaacaaauacuuuucuuccgcucacauauuccauuaaaaggcggcgucgccgaucccguaauugacugccuauuaccacaagaauggauacaacaccucuaccaagaaagcgcaccaucccaauccgacgucgcauuaauacguuucacaaacccagacacgggccgcguccucuucgaagccaagcuccaccgcuccggauacauaaccguugcaaacacuggcucucgccccaucgucguccccgccaacggcuacuuccgcuucgacuccugggucaaccaauuuuacucccuugcacccaugggcaccggcaacggccgacgacgcguucaauaa

SEQ ID NO: 36181 - RNA, 1623 nt, Artificial Sequence
  derived and/or modified sequence opt11 from VP1__Norovirus__AIS40019
augaaaauggcaagcucagacgccaacccaagugacggcucagcagccaaccucguaccagaagucaacaacgaaguaauggcacucgaacccgucgucggagccgcaaucgcagccccagucgccggccaacaaaacgucaucgaccccuggauccgcaacaauuucgucccugccccaggcggcgaguucaccgucuccccuaggaacgcaccaggagaaauccuauggucagcaccccucggucccgaccucaacccuuaucuaucucaucuagcacggauguacaaugguuacgcuggcggcuucgaaguacaagucauccucgccgguaacgccuucaccgccggcaaagucaucuucgcagcugucccuccuaacuuccccaccgaagggcuuucucccucccaaguaaccauguucccccacaucgucguggacguucgacagcucgaacccguccucaucccucuccccgacguccgcaacaacuucuaucacuacaaccagucuaacgaccccaccaucaaacucaucgccaugcucuacaccccacuacgcgccaacaacgcaggcgacgacgucuucacugucuccugucgaguccucacacgccccucccccgacuucgacuucaucuuccuaguaccacccaccguagaaucccgcaccaaaccauucuccguccccguccucaccgucgaagaaaugaccaacucacgcuuccccaucccccuagaaaaacucuucacaggaccaucuucagccuucgucguacagccacaaaauggucgaugcaccaccgacggaguccuccucggugccacacaacuuucaccagucaauaucugcaccuuccgcggcgacguuacacacauuacaggcucccgaaacuacacaaugaaccucgcaucccaaaacugguccaacuaugaucccacugaagaaauucccgcaccccuaggcaccccagacuucgucggcaagauccaaggaguguuaacacaaaccacacgcacagacggcuccacccggggccacaaggccaccgucuacaccggcuccgcagacuucgcccccaagcuaggcagaguacaguucgaaacagacaccgacagagacuuugaagccaaccaaaacaccaaguucaccccaguaggugucauacaagacggcucaaccacacaccgaaacgaaccccaacaauggguacuacccucauacuccggacguaacacccccaacguccaccucgcccccgcaguagccccaacauucccuggcgaacaacuucuauucuuccgcuccacuaugccuggcugcuccggcuaccccaacauggaccucgacugucuacucccacaagaauggguucaauacuucuaccaagaggcagcccccgcacaaucagacgucgcacuccuacgguucgucaaccccgacacaggacgaguccuuuucgagugcaaacuccacaaaagcggcuacguaaccgucgcccacacaggccaacacgaccucgucauaccaccgaacggcuacuuccgcuucgacuccugggucaaccaauucuacacacucgccccaaugggaaacggaacuggacggcgcagagcacucuaa

SEQ ID NO: 36182 - RNA, 1623 nt, Artificial Sequence
  derived and/or modified sequence opt11 from VP1__Norovirus__AIV43147
augaaaauggccagcuccgacgcaaaccccuccgacggcuccgccgccaaccucguccccgaagucaacaacgaaguaauggcccucgaacccgugguaggagccgcaaucgcagcacccguagcaggacaacaaaacgucauagacccauggaucagaaacaauuucguacaagcacccggcggcgaguucaccgucaguccccgaaacgcacccggagaaauuuuaugguccgcaccccuaggcccugaucucaacccauaccucagccaccuagcccgcauguacaacggcuacgccggcggcuucgaaguccaagucauacuagccggaaacgccuucacggcaggcaaaguaaucuucgccgccguaccucccaacuuccccaccgaaggacuaucccccagucaaguaacuauguucccccauauaguagucgacguccgccaacuggaacccguccuaaucccccuaccagacguccgaaacaacuucuaucacuacaaccaauccaacgacccgaccauaaaacuaaucgccaugcuauacacaccccuccgcgcgaacaacgccggugacgacgucuucaccgucuccugccgcguacuaacccgccccagcccagauuucgacuucauauuuuuaguaccacccacagucgaaucacgaacaaaacccuucucaguccccguacucaccguagaagaaaugaccaacucccgcuuucccaucccccuagaaaaacucuucacaggcccauccuccgcauucgucguucaaccccaaaacggacgcugcaccacagacggcguccuacuaggcaccacccaacuuucacccguaaacauuugcacauuccgcggcgacgucacccacaucacaggaucccgcaacuacaccaugaaccuagcaucacaaaacugguccaauuacgacccaaccgaagaaauuccagcaccacuuggaacacccgacuucgucggcaaaauccaaggcguccuaacccaaaccacccgcaccgacgggucuacacgaggacacaaagccaccgucuacaccgguagcgccgacuucgcccccaaacugggaagaguacaauucgagaccgacaccgaucacgacuucgaggcaaaccaaaacaccaaauucacacccgucggagucauccaagacggcagcacuacccaccgcaaugaaccccaacaauggguacuacccuccuacuccggccgcaacacccccaacguacaccucgcaccagccguagcccccacauucccuggcgaacaguuacucuucuuccgcagcaccaugcccggcugcuccggcuaccccaacauggacuuagacugucuacuuccacaagaauggguccaauacuucuaccaagaagccgcccccgcacaaucagacguugcccuacucagauucguaaaccccgacacuggccgcguccucuucgaaugcaaacuacacaagucaggcuacgucacggucgcccacacagggcaacacgaccuaguaaucccacccaauggauacuuccgcuucgacuccugggucaaccaauucuauacccucgcacccaugggcaacggcaccggccgccgacgcgcccucuag

SEQ ID NO: 36183 - RNA, 1623 nt, Artificial Sequence
  derived and/or modified sequence opt11 from VP1__Norovirus__AIV43148
augaaaauggccucaucugacgcuaaccccagcgacggcucugccgccaaccuagucccugaagucaacaacgaagucauggcacucgaaccagucgucggcgccgcaauagcagcccccgucgccggccaacaaaacgucauugacccauggauccgcaacaacuucguacaagcccccggcggcgaguucacagucucaccccgaaacgccccaggcgaaauacucuggagcgcaccccuaggccccgaccuaaacccguaccuaucccaccuagcccgaauguacaacggcuacgcaggaggauucgaaguacaagucauccuugcuggcaacgccuucacagcuggcaaggucauauucgccgcagucccucccaacuuucccaccgaaggccucucccccucccaagucacaauguuuccgcacauagucguagacguccgacaacuugaacccguacucauaccccuaccugacguacgaaacaacuuuuaccacuacaaccaaucuaacgacccuacaauaaaacucauagcuaugcucuacaccccacuucgcgccaacaacgccggcgaugacguauucaccguaaguugcagaguccucacccgccccucgcccgacuucgacuucauauuccucgucccacccacagucgaaucacgaaccaaacccuucucuguacccguacuaacagucgaagaaaugaccaacucccgcuuccccauaccccuagaaaaacuauucacuggcccauccucagccuucguaguacagccccaaaacggcagaugcaccaccgacgggguacuccuagggaccacccaacucuccccagucaacauaugcaccuuccgaggcgacguaacccacauaacaggaucacgaaauuacacaaugaaccucgcuucccaaaacugguccaacuacgaucccacagaagaaauccccgcaccccuaggaacaccugacuucgucggaaaaauccaaggcgugcugacccaaaccacccgaacagacggauccacacgaggacauaaagccacagucuacaccggaagcgcugacuucgcacccaaacucggccgcguacaauucgaaaccgacacagaccgcgacuucgaagccaaucaaaacacaaaauucaccccagucggaguaauacaagacggcggcacaacccaccggaacgaaccacaacaauggguacuccccuccuacucaggccgaaacacacccaacguucaccucgcccccgcugucgcaccaacauuccccggugaacaacuucucuucuucagauccaccaugccaggcugcagcggcuacccaaacauggaccuugacugccuccucccccaagaauggguacaauauuuuuaccaagaagccgcgccagcccaaucagacguagcccuacuacgcuucguaaacccggacaccggacgaguccucuucgaaugcaagcuacauaaauccggcuacgucaccgucgcacacacaggccaacacgaccuugucauaccacccaacggcuacuuccgcuucgacuccugggucaaccaauucuacacccucgcccccaugggcaacggcacgggccggcgccgcgccuuauaa

SEQ ID NO: 36184 - RNA, 1623 nt, Artificial Sequence
  derived and/or modified sequence opt11 from VP1__Norovirus__AIV43149
augaagauggcauccuccgacgccaaucccuccgacggcagcgccgccaaucuaguccccgaaguaaacaacgaagucauggcacucgaacccguaguuggcgccgccaucgcagccccagucgccggccaacaaaacgucaucgaccccuggauccgcaacaacuucguacaagccccagguggcgaguucaccgucucuccccgcaacgcacccggcgaaauccucuggucggcaccccucggucccgaccucaacccauaccucucacaccucgcccggauguacaacggguacgcaggcgguuucgaaguccaaguaauacuagccgguaacgcauucaccgcuggaaaagucaucuuugcagcagucccacccaacuuccccaccgaaggccucucccccucccaaguaaccauguuuccccauauagucguagacguucgccaacucgaacccguccucaucccucuccccgacguccgcaauaacuucuaccacuacaaccaaucgaacgaccccacaaucaagcucaucgccaugcucuacaccccucucagagcaaacaacgcaggcgacgacguuuucaccgucuccugccguguccugacacgacccuccccagauuucgacuuuauauuccucguaccacccacugucgaaagccgcaccaaacccuucuccguccccguccuaacagucgaagaaaugaccaacucucgguuucccaucccccuagaaaaacucuucaccggacccuccuccgccuucgucguccaaccccaaaacggccgcugcaccacugacggcguacuccucgggacaacacaacucucaccaguuaacaucugcacauuccggggcgacguaacccacaucaccggcucucgcaacuacaccaugaaccuugcaucucaaaacuggucuaacuacgaccccaccgaagaaaucccugcaccccucggcacucccgacuucguugguaaaauacagggcguccucacacaaacuacccguaccgauggcuccacucgcggccacaaagccacagucuacacaggcuccgccgacuucgcuccuaaacucggccgcguccaauucgaaacagacacagaccgcgacuucgaagccaaccaaaacacuaaauucacccccgucggcguaauccaagacggcggcacaacacaccgcaaugaaccccaacaauggguccuaccauccuacucuggccgcaauacccccaacguucaccuagcacccgcagucgcccccaccuucccaggcgaacagcuccucuucuuccgaucuaccaugcccggcugcucaggauaccccaacauggaccuugacugccuccucccacaagaauggguucaauacuucuaccaagaagccgccccagcccaauccgacgucgcccuccuacgcuucgucaaccccgacaccggccgcgucuuauuugaaugcaaacuccacaaauccggcuacguaaccguugcccacaccggccaacacgaccucgucauacccccaaacggcuauuuucguuuugacucauggguaaaccaguucuacacccucgcccccaugggcaacggcacaggccgccgccgcgccuuauaa

SEQ ID NO: 36185 - RNA, 1623 nt, Artificial Sequence
  derived and/or modified sequence opt11 from VP1__Norovirus__AIV43150
augaaaauggccuccucugacgcaaaccccuccgacggcucagcugccaaccucgucccagaagucaacaacgaagucauggcccuagagccagucgucggagccgcuaucgccgccccagucgcaggccaacaaaacgucaucgacccauggauccgaaauaacuucguacaagcacccggaggagaguucaccguuucgccaagaaacgccccaggcgaaauccucugguccgcgccgcucggacccgaucuaaaucccuaccucucucaccuugcacgcauguacaacggcuacgcuggcggcuucgaaguccaagucauacuagcaggaaacgcauucacagccggcaaagucaucuuugccgccgucccucccaacuuccccacagaaggucucucccccucgcagguuacaauguucccucacaucgucgucgacguaagacaacucgaaccuguccucauaccacuucccgauguacgcaacaacuucuaccacuacaaccaauccaacgacucuacaaucaaacucaucgccaugcucuacaccccacuuagagccaacaacgcaggagacgacgucuucaccguuucaugccgaguacucacccgucccuccccagacuucgacuucaucuuccuagucccacccacagucgaaucccgcacaaaaccauucucuguccccguacuaaccguugaagaaaugacaaacagccgauuccccauaccccucgaaaaacucuucacagggcccuccuccgccuucgucguccaaccccagaacggacgaugcaccaccgacgguguauuacucggcacaacccaacucuccccaguuaacauuuguaccuuccgaggcgacguuacacacaucaccggcucacgaaacuacacaaugaaccuagccagccagaauugguccaacuacgaccccacagaagaaauaccagcaccccuaggcacccccgacuucgucggaaaaauacaaggcguccucacccagacuacccgcacugacggcuccacacgcggccauaaagccaccgucuacacaggaucagccgauuuugcccccaaacucggccgcguccaauucgaaaccgacaccgaccacgacuucgaagccaaccaaaacaccaaauuuacacccgucggcguaauacaggacggcggcaccacacaccgcaacgaaccccaacaauggguccuccccuccuacuccggccgcaacaccccaaacguacaccuagcacccgccgucgcacccacauuccccggugaacaacuccucuucuuccgcuccaccaugcccggaugcuccggcuaucccaacauggaccucgacugccuacucccccaagaauggguacaauacuuuuaccaagaagccgccccagcccaauccgaugucgcccuccuaagauucgucaacccggacaccggccgcguccucuucgaaugcaaacuccacaaaucaggcuacgucaccgucgcccacaccggacaacacgaccucgucauacccccaaacggcuauuucagauucgacuccuggguaaaccaauucuacacccucgccccuauggggaacggcaccggccgacgccgcgcccucuaa

SEQ ID NO: 36186 - RNA, 1623 nt, Artificial Sequence
  derived and/or modified sequence opt11 from VP1__Norovirus__AIV43151
augaaaauggccuccuccgacgccaaccccucagacggcucagccgcuaaccucguccccgaagucaacaacgagguaauggcacucgaaccagucgucggcgccgccaucgccgcaccaguagcaggccaacaaaacguuaucgaucccuggauccgaaacaacuucguccaggccccgggaggcgaguucaccgucucaccccgcaacgcacccggugaaauccucugguccgcaccccuaggacccgaucucaaccccuaccuuucacaucucgcccgcauguacaacggcuacgccggcggcuucgaaguacaagucauccuagccgguaacgcauucacagccgguaaaaucauauucgcagcaguaccgcccaacuucccaaccgaaggacucucaccuucccaagucaccauguucccccacauagucguagacguccgucaacuugaacccguauuaaucccccuuccagacguacguaacaacuucuaccacuacaaccaaucaaacgaccccacaaucaaacuaaucgccaugcuauacacaccccuccgagccaacaacgcuggagaugacguauucaccguaagcugccgcguccuuacccgccccucacccgacuuugacuuuaucuuccucguuccgcccaccgucgaaucacgaaccaaacccuucucaguccccguacuaaccgucgaagaaaugacaaacuccagauuccccaucccccucgaaaaacucuucacaggccccagcuccgcauucgucguccaaccacagaacggacgcugcaccacagacggcguccuccucggcaccacucaacuaucccccguaaacauaugcaccuuccgaggcgacgucacccacaucacuggcucacgcaacuacacgaugaacuuagcuucccaaaacugguccaacuacgacccaacagaagagauccccgcaccacuaggaacccccgacuucgucggcaaaauccaaggaguacucacccaaacaacccgcacugacggaucaacucgcggccacaaagccaccguauacacaggaucagcagacuuugcccccaaguuaggacgcguccaauucgaaaccgacaccgaccacgauuucgaagccaaucaaaacaccaaauucacacccgucggagucauccaagacggcgggaccacacaccgaaacgaaccacaacaguggguccuccccuccuacuccggccgcaauacaccgaauguacaccucgcccccgccgucgcccccacauuccccggcgaacaacuccucuucuuccgcaguaccaugccgggcugcagcggcuaccccaacauggaccuugacugucuacuaccacaagaguggguccaauacuucuaccaagaagccgccccagcccaauccgacgucgcccuccuccgauucgucaaccccgacaccggccgugugcuauucgaaugcaaacugcacaaaucaggcuacguaaccguagcacacaccggacaacacgaccuagucauuccucccaacggauacuuccgauucgacuccuggguaaaccaauucuauacucucgcccccaugggcaacggaaccggcagacgacgcgcccucuaa

SEQ ID NO: 36187 - RNA, 1623 nt, Artificial Sequence
  derived and/or modified sequence opt11 from VP1__Norovirus__AIV43152
augaaaauggccuccucagacgccaacccauccgacggcucagccgcaaacuuagucccagaagucaacaacgaaguaauggcccucgaacccguaguaggagccgcaaucgccgcgcccguugccggacaacaaaacgucaucgaccccuggauccgcaacaacuuuguccaagcccccggaggcgaguucaccgucucaccccguaacgcccccggagaaauccuaugguccgcccccuuaggccccgaccucaaccccuaccuaucccaucucgcccgcauguacaacggauacgccggcggcuucgaaguccaaguuauacucgccggcaacgccuucaccgccggcaaaguaaucuucgccgccguaccacccaacuuccccaccgaaggucuguccccaucucaaguaaccauguucccacacaucguagucgauguacgacaacucgaaccuguccuaaucccccuccccgauguucgcaacaacuucuaccacuacaaccagucaaacgacccaaccaucaaacucaucgccaugcucuacacaccccuacgcgccaacaacgccggcgacgacgucuucacgguuucaugccgcguacucacccgccccuccccugacuuugacuucauauuucucgucccaccaacagucgaaucccgcacuaaacccuucuccguccccguccucaccguagaagagaugaccaacucacgauuccccaucccccucgaaaaacuuuuuaccggcccauccucggcauucgucguacaaccacaaaacggccgcugcacuaccgauggcguccuccucggcacaacccaacuuuccccagucaacaucugcacuuuccgaggcgacgucacacacaucaccggcucacgcaacuacaccaugaaccuagcaagucaaaacugguccaacuacgacccaaccgaagaaauacccgcaccccucggcaccccagacuucgucggaaaaauccaaggaguccuaacacagaccacaagaaccgacggcucaacacguggccacaaagcuaccgucuacaccggcuccgcagacuucgccccaaaacucggccggguccaauucgaaacagacaccgaccacgacuucgaagccaaccaaaacaccaaauucacccccguaggcgucauccaagacggguccaccacacacagaaacgaaccccaacaauggguccuuccauccuacuccggccgaaacacccccaacguucaccuagcucccgccgucgcccccaccuuccccggcgaacaacuccucuucuuucgcagcaccaugcccggcugcuccggcuaccccaacauggaccucgacugccuauuaccucaagaauggguccaauacuucuaccaggaagccgcccccgcacaauccgacgucgccuuacuacguuucgucaaccccgacacaggacgcguccuuuucgaaugcaaacuccacaaauccggcuacguaaccguagcacacacaggucaacacgaccuugucauacccccaaacggcuacuuccgcuucgacaguugggucaaccaauucuacacucuagccccaaugggcaacggcaccggccgacguagagcccucuaa

SEQ ID NO: 36188 - RNA, 1623 nt, Artificial Sequence
  derived and/or modified sequence opt11 from VP1__Norovirus__AIV43153
augaaaauggccuccuccgacgcuaacccaagugacggauccgcagccaaccucgucccugaaguaaauaacgaagucauggcacucgaaccgguagucggcgccgcaaucgcagcacccguagccggacaacaaaacguaauagaccccuggauccgaaacaacuucguccaagcccccggcggcgaguucaccgucucaccccgcaacgccccaggcgaaauccugugguccgcgccacucggcccagaccuaaaccccuaccuaucccaccuggcacgcauguacaauggcuacgccggcggauucgaaguccagguaauccucgcaggaaacgccuucacugccggaaaagucaucuuugccgcagugccaccaaacuuccccacugaaggccucucaccgucacaaguaaccauguucccccacaucgucgucgacguacgccaacucgaacccguccuaauuccccucccggacguucgaaacaauuucuaucacuacaaccaauccaacgaccccacaaucaaacuuauagccaugcuuuacacaccccuacgcgccaacaacgccggagacgacguauucaccguguccugccgcguccucacaagacccucacccgacuucgacuuuauauuccucgucccacccacugucgaauccagaaccaaacccuucucaguacccguacucaccgucgaagaaaugacaaauucacgguuccccaucccccuugaaaaacucuucaccggaccgucauccgccuucguaguccaaccccaaaacggacgaugcacaacugacggaguacuucucggaaccacacaacucucaccugucaauaucugcacguuccgcggcgacgucacccauauaaccggcagucgcaauuacacuaugaaccucgccucucaaaacugguccaacuacgaccccaccgaagaaauaccugcaccccuaggcacaccagacuucgucggcaaaauccaaggcguccuaacccaaacaacacgcaccgacgguagcacccgcggccacaaagcaacagucuauacaggaucggccgacuucgcuccuaaacucggacgcguacaauucgaaaccgacacagaccacgacuucgaagcaaaccaaaacaccaaguucaccccagucggcguaauacaggacggcuccacuacccaccgcaacgaaccccaacaauggguccuccccagcuacagcggccgaaacacccccaauguucaccucgcacccgccguagcccccacauuccccggugaacaacuacucuucuuccgcuccaccaugccaggcugcucuggcuacccaaacauggaccuugauugucuccucccccaagaauggguccaauacuucuaccaagaagccgcuccagcacaaucugacgucgcacuacuacgauucgucaaccccgacaccggccgcguccucuuugagugcaagcuccacaaauccggcuacgucacagucgcccacaccggccaacaugaccuaguaaucccacccaacggauacuuccgcuucgacuccugggucaaccaauucuacacacuggcacccaugggcaacggcaccggucgcagacgagcccuauaa

SEQ ID NO: 36189 - RNA, 1623 nt, Artificial Sequence
  derived and/or modified sequence opt11 from VP1__Norovirus__AIV43154
augaaaauggccucauccgacgcaaaccccuccgacggaucagccgccaaucucguacccgaagucaacaacgaaguaauggcacucgaacccgucgucggagccgccauagccgcacccguagccggacaacaaaacgucaucgacccguggauccgcaauaacuucguccaagccccuggcggcgaguucacagucagcccccgcaacgccccuggcgaaauccucugguccgcaccccugggacccgaccucaaccccuaccucucccaccuagcccgcauguacaacggauacgccggcggcuuugaaguccaagucauacucgccggaaacgcuuucaccgccggcaaagucaucuucgccgccgucccaccuaacuuccccacagaaggacuauccccaucacaaguaacaauguucccccacauuguaguagacguccgacagcucgaacccguacucauaccccuacccgacguccgcaacaacuucuaccacuacaaccaaagcaacgaccccaccaucaaacuaaucgcaauguuauacaccccucuacgcgcaaacaacgcaggagacgaugucuucacugucucuugccgaguccuuaccagacccucaccagacuucgacuucaucuuccuaguacccccaacugucgaaucccgcaccaagccauucuccguccccguccucacuguagaagaaaugaccaauucacgauuccccauuccccucgaaaaacuuuucaccggacccuccucugccuucguaguucaaccccaaaauggccgcugcaccaccgacggaguccuccucggcaccacccaacucucccccgugaacaucugcacuuuccgaggcgacgucacccacauaacaggcucacgcaacuacaccaugaaucuagccucccaaaacugguccaacuaugaccccacagaagaaaucccagcaccccucggcacccccgacuucgucggcaaaauccaagguguacucacacaaacuacccgcacagacggauccacuagaggacauaaagccaccgucuacacaggaucggccgauuuugcccccaaacucggacgcguccaauucgaaacagacacagaucacgacuucgaagccaaccagaacaccaaauucacacccguaggcgucauacaagacggaucuacaacccaccgcaacgaaccccaacaauggguacuucccuccuacucuggccgcaacacccccaacguccacuuagcacccgccguagcccccacauuccccggcgaacaacuccucuucuuccgaucaacaaugccaggcugcuccggcuaccccaacauggaccucgauugccuccucccccaagaauggguucaauacuucuaccaagaagcagcaccagcccaaucugacgucgcacuacuacgcuucguuaauccagacacaggacgcguacucuucgagugcaaacuacacaaauccggcuacgucaccguagcacacaccggccaacacgaccucgucaucccacccaacggcuauuuccgcuucgacuccugggucaaccaauucuacacccucgcacccaugggcaacggcaccggccgacgcagagcccucuaa

SEQ ID NO: 36190 - RNA, 1623 nt, Artificial Sequence
  derived and/or modified sequence opt11 from VP1__Norovirus__AIV43155
augaaaauggccuccucagaugcuaacccaucagacggaucagcugccaaccucguacccgaagucaacaaugaaguaauggcucucgaaccagucguaggagccgcaaucgccgcucccgucgccggccaacaaaacguaauugacccauggauuagaaacaacuucguccaagcccccggcggagaguucaccgucucaccaagaaacgcccccggggaaauccuuuggucagcaccccucggccccgaucucaaccccuaccucucgcaccucgcccgcauguacaacggcuacgcuggcggauucgaaguacaagucauacucgccggcaacgccuuuaccgcaggcaaagucauuuucgccgccgucccgcccaacuuccccacagaaggccucucacccucccaaguaaccauguucccccacaucgucguagacguccgacaacuagaacccguccucaucccacucccagacguccgcaacaacuuuuaccacuacaaccaauccaacgaccccacaauaaaacucauagccaugcucuacacaccccuccgcgcaaacaacgccggcgacgacguuuucaccgucucaugucgcguccuaacccgaccgucacccgacuucgacuucauauuccucguuccacccaccgucgaaagccgaacaaaaccguucucaguccccguccuaacaguagaagaaaugacaaacucacgauuccccaucccccuagaaaaacuauuuaccggccccucauccgccuucguaguacaaccacaaaacggacgcuguacaacagacggcguacuacucggcaccacacaacugucacccgucaacaucugcacguuucgaggcgauguaacccacaucaccggcucccgcaacuacaccaugaaccucgcaucacaaaacugguccaacuacgaccccaccgaagaaauaccagccccgcuaggcaccccagacuucgucggcaaaauccaaggaguucucacccaaaccaccagaacagacggcuccacacgcggccacaaagccaccgucuacaccggcucagcugacuucgcccccaaacucggccgcguucaauucgaaaccgacaccgaccgcgacuucgaagccaaccaaaacacaaaauucacccccgucggcguuauacaagacggaucaaccacccaccgcaacgaaccccaacaauggguccuccccucuuauuccggacgcaacacccccaacguacaccuagcccccgccgucgcccccacauucccaggcgaacaacucuuauucuuccgcuccaccaugcccggaugcuccggcuacccuaauauggaccucgacugccuacuaccccaagaauggguccaauacuucuaccaagaagccgcacccgcccagucagacgucgcacuccuccguuucgucaaccccgacaccggccguguacucuucgagugcaaacuacacaaaucuggauaugucacuguagcccacacuggccaacacgaccucguaaucccacccaacggcuacuuccgcuucgacuccugggucaaccaauucuacacccuagcucccaugggcaacggcaccgguagacgccgcgcccuauga

SEQ ID NO: 36191 - RNA, 1623 nt, Artificial Sequence
  derived and/or modified sequence opt11 from VP1__Norovirus__AIV43156
augaagauggcauccuccgacgccaaccccuccgacggcagcgccgcaaaucucguccccgaagucaauaaugaagucauggcucuagaacccguggucggcgcagcaaucgccgcaccagucgcaggccaacaaaacgucaucgaccccuggauccgcaacaacuucguacaagcccccggcggagaguucaccgucucuccccgcaacgcccccggagaaauucuaugguccgccccucuaggacccgaccuaaauccauaccucucacaccuagcccgcauguacaacggauacgcaggaggauucgaaguacaaguaauccucgccggcaacgccuucaccgcaggcaaggucaucuucgccgccgucccacccaacuuccccaccgaaggccuaucacccucacaaguaaccauguucccccacauaguagucgacguccgccaacucgaacccguccucauaccccucccagacguccgcaacaacuucuaccacuacaaccaaucaaacgaccccacaaucaaacuuaucgcaaugcucuacaccccacuccgcgccaacaacgcaggcgacgacgucuucaccguaucaugccgaguccuugcccggcccucaccggacuucgauuucauauuccucguuccacccaccgucgaaucacguacaaaacccuucucaguccccguccugaccgucgaagaaaugacuaacucccgcuuccccaucccucucgaaaaacuauucaccggccccuccucagccuucguuguacaaccccaaaacggccgaugcaccacagacgggguccuucucggcacuacucaacucucccccguaaacaucugcacuuuccgaggagacguaacccacaucacgggcagccgcaacuacacaaugaaccuagcaagccaaaacugguccaauuaugaccccaccgaagaaauccccgccccucucggcacccccgacuucgucggaaaaauccagggaguccucacccaaaccaccaaaaccgacggauccacccgcggacacaaagcaaccguauacacaggauccgcagacuucgccccaaaacuaggacgcguacaauuugaaaccgacacugaccaugacuucgaagcaaaccaaaacaccaaauucacccccguaggaguaauacaagacgguuccaccacccaucgcaaugagccccaacaguggguccuacccucauacucgggccgcaacacaccuaacguccaccuagcccccgccguugcccccacauuccccggcgaacaacuccucuucuuccgcagcacgaugcccggcuguucaggcuaccccaacauggaccucgacugcuugcucccccaggaauggguucaauacuucuaccaagaagccgccccagcccaaagcgacgucgcccuccuccgcuucgucaaccccgauaccggccgaguacuuuucgaaugcaaacuccacaaauccggauauguuacugucgcacacacaggccaacacgaccuagucauacccccaaacggcuacuuccgcuucgacucaugggucaaccaauucuacacacuugcacccaugggcaacgguaccggccgacgacgcgcccuauaa

SEQ ID NO: 36192 - RNA, 1623 nt, Artificial Sequence
  derived and/or modified sequence opt11 from VP1__Norovirus__AIV43159
augaaaauggccuccucugacgccaauccguccgacggcuccgccgccaaccuugucccagaaguaaacaacgaaguaauggcccucgaacccgucgucggcgcagcaauagccgccccugucgccggacaacaaaacgucauagaccccuggauccgcaauaacuucguccaagcaccaggaggagaguucaccguuucuccaagaaacgcccccggagaaauccucugguccgcaccccuaggaccagaucucaaccccuaccucucucaucucgcccgaauguacaacggcuacgccggcggauucgaaguccaagucauacuagccgggaacgccuucacagccggcaaaguaaucuucgcugccgucccacccaacuuccccacagaaggccuuucccccucccaagucacaauguucccccauauugucgucgacguccgccaauuagaacccguccucaucccccuacccgacguacgcaacaacuucuaccacuacaaccaauccaacgaucccaccaucaaacucaucgcaaugcucuacacaccccuucgagccaacaacgccggcgacgaugucuucaccgucucaugccgaguccuagcccgccccuccccugacuuugacuucaucuuccuggucccacccaccguagaaucucgcaccaaacccuucuccguacccguccucaccgucgaagaaaugaccaacucacgcuuccccauaccacucgaaaaacuauucaccggccccuccagcgccuucguaguccaaccccaaaacggucguugcacaaccgacgguguccuccuaggcacaacacaauuauccccugucaacaucugcacauuccgaggcgacgucacgcacaucaccggcuccagaaacuauaccaugaaccuagccagccaaaauuggucuaauuacgaccccacagaagaaaucccugcuccacucggcacccccgacuucgucggcaaaauccaaggcguacucacccaaaccacccgcaccgacggauccacccgaggacacaaagccaccguauacacgggauccgccgacuucgcaccaaaacucggacgcguccaauucgaaaccgacaccgaccacgauuucgaagcaaaucaaaacacgaaauuuacccccguuggcguaauccaggacggcuccaccacccaccgaaacgaaccccaacaauggguacuacccucauauuccggccgcaacaccccaaacguccaccucgccccugccguagcccccaccuucccaggcgaacaacuccucuuuuucagaucuacaaugcccggcugcucaggauacccaaacauggaccucgacugccuucucccccaagaauggguccaauauuucuaccaagaagccgccccugcccagagcgacgucgcccuccuccgauucgucaacccagacaccggacgaguacucuucgaaugcaaacuccacaagucuggcuauguaaccguagcccacaccggccaacacgaccuagucaucccgcccaauggauacuuccgauucgacucuugggucaaccaauucuacacucuagcucccaugggaaacggcacaggccgccgccgcgcacucuaa

SEQ ID NO: 36193 - RNA, 1623 nt, Artificial Sequence
  derived and/or modified sequence opt11 from VP1__Norovirus__AIV43160
augaaaauggcuuccucagacgccaacccuucagacggcuccgcagccaaucucguccccgaaguaaacaacgaaguaauggcacucgaacccguugucggggccgcaaucgccgcccccguugcuggccaacaaaacguaauagaccccuggauacguaacaacuucguacaagcccccggcggagaguucaccgucucaccccgcaacgcccccggcgaaauccuuugguccgcaccccucggccccgaucuuaaccccuaccuaucucaccuggcccgcauguacaacggcuaugccggaggcuucgaagugcaagucauccucgccggcaacgcauucacagccggcaaagucaucuucgccgccgucccacccaacuuccccaccgaaggccuuucccccucccaagucacaauguucccacacaucguagucgauguacgccaacuagaaccaguacucauaccccuccccgacguccgaaauaacuuuuaccacuacaaccaaucaaaugaccccaccauaaaacucaucgccaugcucuacaccccacugcgcgccaacaacgccggcgacgacgucuucaccgucuccugccgcguccuaacccgcccuucucccgacuucgacuucaucuuccugguaccacccaccgucgaaucacgaaccaaacccuucucagucccaguccucaccgucgaagaaaugacaaauucaagauuccccauaccccucgaaaaacucuucacuggccccucuucugcuuuuguaguccaaccccaaaacggccguuguaccaccgacggcguacuucucgguaccacccaacucucccccgucaacauaugcaccuuccguggcgacguaauucacaucaccggaucccgcaacuacaccaugaaccuagccucacaaaauugguccaacuacgaucccaccgaagaaauacccgccccucucggaaccccagacuucgucggaaagauacaaggcguacucacccagacuacccgcaccgacggauccacccgaggacacaaagccacugucuacacuggaucagcugacuucgcccccaagcucggccgcguccaauucgagacagacaccgaccacgacuucgaagcaaaccaaaacaccaaauucaccccaguuggggucauccaagacggauccacaacccaccgcaacgaaccacaacaauggguccuccccucuuacuccggccggaacacaccaaacguccacuuagcccccgccguggcaccgacauuucccggcgaacaacuauuauuuuuccgcucuacuaugccaggcugcuccggcuauccuaacauggaccucgacugccuccucccccaagaauggguccaauacuucuaccaagaagccgccccagcacaauccgacgucgcacuacuccgcuucgucaaccccgacaccggccgcguccuauucgaaugcaaacuacacaaaucuggauacguuacuguagcacacaccggccaacacgaccucgucaucccuccaaacggcuacuuccgcuucgacucauggguaaaccaauucuacacccucgcccccaugggcaacggcaccggucgacgccgagcccucuaa

SEQ ID NO: 36194 - RNA, 1623 nt, Artificial Sequence
  derived and/or modified sequence opt11 from VP1__Norovirus__AIV43161
augaaaauggccuccuccgacgcaaaccccucugacggcuccgcagccaacuuagucccagaaguaaauaaugaggucauggcacuagaacccgucgucggagccgccauagcagcucccgucgccgggcaacagaacguaauugauccuuggauucgcaacaacuuuguccaagcccccgguggcgaguucacugucagcccccgcaacgcccccggcgaaauccucuggucagcaccacugggacccgaccuaaaccccuaccucucccaccuagcccgcauguacaacggcuacgccggcggauuugaaguccaagucaucuuagccggcaacgcauucacugccggcaaaguaauuuucgccgccguacccccaaacuuccccaccgaaggacuauccccaucccaagucaccauguucccccacauagucgucgacgucagacaacuagaacccguccucaucccccucccagacguccgcaauaacuucuaccacuacaaccaauccaacgaccccaccaucaaacuaauagcaaugcuuuacacaccucuccgcgccaacaacgccggcgacgacgucuucacagucagcugccgaguccucacccgacccuccccagauuucgacuuuaucuuccucgucccucccaccguugagucccgcaccaaacccuucuccguacccguccuaaccgucgaagaaaugacgaacucccgcuuccccaucccccucgaaaaacucuucacgggcccaucuucugcauucgucguucaaccccaaaacggccgcugcaccaccgacggcguccuccucgguacaacccaacucucccccgucaauaucugcacauuccgaggcgacguaauccacauaaccggcagccguaacuacaccaugaaccuugcaucccaaaacuggagcaacuacgacccaacagaagaaauucccgcaccccucggcaccccugacuucgucgguaagauccaaggaguacucacacaaaccacucgaacagacggaucaacccgcggacacaaagcaacaguuuauaccggcucugccgacuucgccccuaagcugggccgcguacaauucgaaaccgacacagaccacgacuucgaagccaaccaaaacacaaaauucaccccaguaggcgucauccaagauggauccacuacucaucguaaugaaccccaacaauggguccuacccuccuacuccggaagaaacacccccaacguccaccuagcaccagccguagcccccacauuccccggagaacaacuccucuucuuccggucuaccaugcccggcugcuccggcuaccccaacauggaccucgacugccuucucccucaagaauggguccaauacuucuaucaagaggccgcccccgcccaaucagacgucgcccuucugcgcuucgucaaccccgacacuggccgaguacucuucgaaugcaaacuccacaaauccggcuaugucaccguagcccacaccggacaacacgaccuugucauacccccaaacggcuacuuccgcuucgauuccugggucaaccaauuuuacacacuagcacccaugggcaauggcaccggccgucgccgcgcccucuga

SEQ ID NO: 36195 - RNA, 1623 nt, Artificial Sequence
  derived and/or modified sequence opt11 from VP1__Norovirus__AIV43162
augaaaauggcaucauccgacgcuaaccccuccgacggcuccgcagccaaccucguccccgaagucaauaacgaaguaauggcacucgaaccaguagucggcgcagcuauagccgcacccgucgccggacaacaaaacgucaucgaccccuggauccgcaacaacuucgugcaagcuccaggcggcgaauuuacagucucaccccggaacgcccccggagaaauccucugguccgcaccacuaggaccagaccucaaccccuaccuaucccaccucgcacguauguacaacggcuaugccggugguuucgaaguucaagucauccucgcaggaaacgccuucaccgccggaaaaguaaucuucgccgccgucccacccaacuuccccaccgaaggccuuucccccucccaagucaccauguucccgcacaucgucgucgacguacgacaacucgaacccguacucauaccacuucccgacguccgaaacaacuuuuaccacuauaaccaauccaacgacccuaccaucaaacuuaucgcaaugcuauacacaccccuucgcgcaaacaaugcaggggacgacguguucaccguaucaugccguguccucacccgacccucaccggacuucgacuucaucuuccucguacccccaacagucgaaucccgcaccaaacccuucuccguccccguccuaacagucgaagaaaugaccaauucgcgauucccaauacccuuagaaaaacuauucaccggccccucauccgcauucgucguccaaccucaaaacgguagauguaccaccgacgguguccuccuaggcacgacccaacuaucacccgucaacauaugcaccuuccgcggcgacguaacccacaucacuggaucccgaaacuacacaaugaaucuugccucccaaaacuggucaaacuacgaccccacagaagaaaucccagcaccccucggcacaccugacuucgucggcaaaauacaaggcguauuaacccaaaccaccagaaccgacggauccacccgaggacacaaagccaccguauacaccggauccgccgacuucgcccccaagcucggccgaguccaauucgaaaccgacacagaccacgacuuugaagccaaccagaacacuaaauucacaccagucggaguaauacaagauggcuccacuacccaccgcaacgaaccccaacaauggguccuacccucguacucaggccgcaauacccccaacguccaccuugcucccgccgucgcccccacuuuccccggagaacaacuccucuucuuccgauccaccaugccaggcugcuccgguuaucccaacauggaccuagacugccuccugccccaagaauggguccaauacuucuaccaagaagccgcccccgcccaauccgacgucgcccugcuccgcuucguaaaccccgacacgggccgcguccucuucgaaugcaaacuccacaaauccggguacgucaccgucgcccacacaggccaacacgaucucguuauaccucccaauggauacuuccgcuucgacucaugggucaaccaauucuacacccucgcacccaugggaaacggcacuggcagaagacgagcacucuaa

SEQ ID NO: 36196 - RNA, 1623 nt, Artificial Sequence
  derived and/or modified sequence opt11 from VP1__Norovirus__AIV43163
augaaaauggcgucauccgacgcaaaccccuccgauggcuccgccgccaaucucguacccgaagucaacaaugaaguuauggcacuagaaccuguaguuggcgccgccaucgccgcacccgucgccggacaacaaaacgucaucgacccauggauacgaaacaacuucguacaagcccccgguggagaauuuacugucucaccacgcaacgccccuggagaaauacuuugguccgcaccccuaggacccgaccuuaacccauaccuaucccaccuagcacgcauguacaacggcuaugccgggggcuucgaaguccaaguaauacucgccggcaacgccuucacugccggcaaagucaucuucgcagccgucccuccuaacuuccccacagaaggacuaucccccucgcaagucaccauguucccccauaucguagucgacgucagacaacuggaacccguucucaucccccuccccgacguccgcaacaacuucuaccacuauaaccaauccaacgacccuaccaucaaacucauagccaugcucuacaccccacuucgagccaacaacgccggcgacgacgucuucacugucuccugccgcguccuuacccggcccagcccugacuucgacuucaucuuccucguuccuccaacugucgaaucccgaacuaaacccuucucgguccccguccuaacaguagaagaaaugaccaacucccgauucccaaucccacucgaaaaacucuuuaccggccccuccucagccuucgucguccaaccucaaaacggccgaugcaccacagacggaguucuacucgguacuacccaacucucucccgucaauaucugcaccuuccgcggcgacguaacacacauuaccggaucacgcaacuacaccaugaaccucgcaagccaaaacuggucaaauuacgaccccaccgaagaaauacccgcaccccucggcacccccgacuucgucgguaaaauccaaggcguacuaacccaaacaaccagaaccgacggcuccacccgcggucacaaagccaccgucuacaccggauccgccgacuucgcacccaaacuuggccgaguucaauucgaaaccgauaccgaccacgacuucgaagccaaccaaaacaccaaguucacccccguugggguaauccaagacggcuccacuacccaccgcaaugaaccccaacaauggguucuccccagcuacuccggaagaaacaccccaaauguccaccucgccccugccgucgccccaaccuuccccggagaacaacuccucuucuuuagaucaacgaugccaggaugcuccgguuauccaaacauggaccucgacugccuccuaccccaggaauggguacaauauuuuuaccaagaagcugcccccgcacaaucugacgucgcccuccuccgcuucguaaaccccgacaccggccguguccucuucgaaugcaaacuacacaaauccggauacgucaccgucgcccacacaggacaacacgaccucgucauucccccaaacggauacuuccgauucgauuccugggucaaccaauucuacacccuagcccccaugggcaacggcaccggccgcagaagggcacucuaa

SEQ ID NO: 36197 - RNA, 1623 nt, Artificial Sequence
  derived and/or modified sequence opt11 from VP1__Norovirus__AIV43164
augaagauggccuccagcgacgccaaccccucugacggcuccgccgccaaccucguacccgaaguaaauaacgagguaauggcccuugaaccaguagucggagccgccaucgcagcaccagucgcaggccaacagaauguaaucgaccccuggauacgcaacaacuucguacaagcccccggcggggaguucaccgucucaccccgcaacgcccccggcgaaauacucugguccgcuccccucggccccgaucuaaaucccuaccucucacaccuagcccgcauguauaacggauacgcaggcggcuuugaaguccaagucauccucgccggcaacgcauuuaccgccggcaaggucauauucgccgcuguaccacccaauuuucccaccgaaggccucucacccucacaaguuaccauguuuccacauaucgucgucgacguacgccaacucgaaccaguccuaaucccucuacccgacguacgaaacaacuucuaccacuauaaccaauccaacgacccaaccauaaaacugauagccaugcuauacacuccccuccgcgcuaacaacgccggugaugacguauucaccgucagcugccgcguccugacccgacccuccccagacuucgacuucaucuuccucgucccacccaccgucgaaucccguaccaaacccuucuccguccccguacuaaccguagaagaaaugaccaacucucgauuccccauaccccuagaaaaacuauucacaggaccaucauccgcuuucguuguccagccccaaaacggaaggugcaccaccgauggaguuuuacucggcaccacacaauuaucccccgucaacauaugcaccuuccgcggcgauguaauccauaucaccggcuccagaaacuacacaaugaaccucgcaucccaaaacugguccaacuacgacccaaccgaagaaauccccgccccacuugguaccccagacuuugucggcaaaauacaaggcgucuugacccaaaccaccagaacagacggcagcacaagaggccacaaagcaaccgucuacaccggcucagccgacuucgcacccaaauuaggccgaguacaauucgaaacagacaccgaccacgacuucgaagccaaccaaaauacaaaauucacucccguaggcguaauccaagacggauccacaacacaucgcaacgaaccucaacaauggguccuuccaagcuacuccggacgcaacacccccaacguacaccucgcuccagcuguugcccccacuuuuccuggcgaacaacuccucuucuuccgaucaacuaugcccggcugcuccggcuacccaaacauggaccuagacugccucuuaccccaagaguggguacaauacuucuaccaggaagccgcccccgcccaaucagacguagcacuccuacgcuucguaaacccagacacuggccguguccuguuugaaugcaaacuccacaaauccggcuacgucaccguagcacacaccggucaacacgaccucgucaucccgcccaacggauacuuccgcuucgacagcugggucaaccaauucuauacccucgcccccaugggcaacggcaccggccgccgacgcgcccucuaa

SEQ ID NO: 36198 - RNA, 1623 nt, Artificial Sequence
  derived and/or modified sequence opt11 from VP1__Norovirus__AIV43165
augaaaauggcaagcuccgacgccaaccccuccgacggcuccgcagccaaccuaguccccgaaguaaacaacgaagucauggcacucgaacccgucgucggagcagccaucgccgccccagucgccggccaacagaacgucauagaccccuggauucgcucuaacuucguccaggcaccagguggagaguucacuguaucaccccgcaacgccccaggcgaaauccucugguccgcaccccuaggacccgaucucaaccccuaccucucccaccucgcccgcauguacaacggcuacgcaggcggcuucgaaguacaaguaauacucgccggaaacgccuucacagccggaaaagucauauucgccgcaguacccccgaacuuccccaccgaaggccuaagcccaucacaagucacaauguuuccccacauaguagucgacguacgccaacucgaaccaguacuuauaccacuccccgacguccgaaauaacuucuaccacuacaaccaguccaacgaccccacaaucaaacuaauagccaugcucuacacaccccuccgugcaaacaacgccggagacgacgucuucacaguuuccugccgcguacuaacccgacccucaccagacuucgacuucauuuuccuagucccacccacggucgaaucccgcaccaaacccuucucagugcccguccuuaccgucgaagagaugaccaacucccgcuuccccaucccacuugaaaaacucuucacaggccccuccucagccuucgucguacaaccacaaaacggccgcugcacaaccgacggcguccuacuuggcacuacacaacucucacccgucaacaucuguacauuccgcggcgacguuacccacaucaccggcucgcgcaacuacacaaugaaccucgcuucacaaaacuggucaaacuacgacccuaccgaagaaaucccugcaccccucggaacccccgacuucguaggcaaaauccaaggcguacuuacacaaaccacacgcacagacggcagcacccgaggccacaaagccaccgucuacacaggcuccgcagacuucgcccccaaacuaggccgcguccaauucgaaaccgacaccgaccacgacuucgaagcuaaccaaaacaccaaauucaccccuguaggcgucauucaagacggcggcaccacacaccgcaacgaaccccagcaaugggugcucccgucauacuccggccgaaacaccccaaauguccaccuagcaccggccgucgccccaaccuuccccggugaacaacuacucuucuuccgcagcacaaugcccggaugcuccggauacccuaacauggaucuggacugccuacucccacaagaauggguccaauacuucuaccaagaggccgcccccgcccaauccgacguagcccuacuccguuucgucaacccagacacaggccgcguacucuucgaaugcaaacuccacaaauccggcuacgucaccgucgcccacacuggucaacacgaucuagucaucccucccaacggauacuucagauucgacucaugggucaaccaauucuacacacucgccccaaugggcaauggcacaggccgacgucgcgcgcuauaa

SEQ ID NO: 36199 - RNA, 1623 nt, Artificial Sequence
  derived and/or modified sequence opt11 from VP1__Norovirus__AIV43166
augaaaauggccagcucagaugccaaccccuccgauggcuccgccgccaaccuaguucccgaagucaacaacgaagucauggcacucgaacccgucguaggcgccgccaucgcagcccccgucgccggccaacaaaacgucaucgacccuuggauccgcaacaacuucguacaagcccccgggggugaguucacuguuuccccucgcaacgcaccaggugaaauccucugguccgcaccccucgguccugaccuuaaccccuaccuaucccaccucgcccgcauguacaacggcuacgccggaggcuucgaaguacaaguaauccuagccggaaacgccuucaccgccggaaaaguuaucuucgcagcggucccucccaauuuccccacagaaggccucucacccucacaaguaaccauguuuccccacaucgucguagacguacgacaacucgaacccguucucaucccccuacccgacguacgaaacaacuucuaccacuacaaccaaaguaaugacccaaccaucaaacucaucgccaugcuauauacuccccuacgcgccaacaacgccggagacgacgucuuuaccgucucaugccgaguacugacccgccccucccccgauuucgacuucaucuuccucgugcccccaaccgucgaaucccguacaaaacccuucagcgucccaauacucacagucgaagagaugaccaacucccguuuccccaucccacuagagaaacucuucaccggucccucaucagccuucgucguacaaccacagaacggccgcugcaccaccgacggcguccuccugggcacaacccaacucucccccguaaauaucugcacauuccgaggcgaugucacccacauaaccggcucucgcaacuacaccaugaaccuagccucacaaaauugguccaacuacgaccccacagaagaaauuccagcaccccucggcacccccgacuucguaggcaaaauccaaggcguacucacucaaaccacccgcaccgacggcuccacacgcgggcacaaggccaccgucuacacaggcuccgccgacuucgcccccaagcuaggccgcguccaguucgaaacagacaccgaccacgacuucgaagccaaccaaaacaccaaauucacuccggucggagucauucaagacggcucaaccacccaccgcaacgagccccaacaauggguccuucccucuuacuccggacgaaacacuccuaacguacaccucgcacccgccguugcacccaccuuccccggcgaacaacuccucuucuuccgcucaaccaugccaggcuguuccggcuaucccaacauggaccuagacugccuccuaccccaagaauggguccaauacuucuaccaagaagccgcccccgcccaaucagacgucgcccuccucagauucgucaacccugacacaggccgaguccucuucgaguguaaacuccauaaauccggcuacgucaccgucgcccauaccggccaacacgaccucgucauacccccaaacggauacuuccgcuucgacucauggguuaaccaauucuauacccuagcaccaaugggcaacggaaccggccgccgccgcgcccuauaa

SEQ ID NO: 36200 - RNA, 1623 nt, Artificial Sequence
  derived and/or modified sequence opt11 from VP1__Norovirus__AIV43167
augaaaauggccucuuccgacgccaaccccucagacggcucugccgccaaccucguccccgaagucaacaacgaaguaauggcccucgaacccguagucggagcugcuaucgccgcccccgucgccggccaacaaaacgucauagacccauggauccgaaacaacuucguccaagccccaggaggcgaauuuacagucucuccgcgcaacgcacccggcgagauccuauggucagcaccccucggcccagaccucaaccccuaucucucccaccucgcccgaauguacaacggauacgcuggcggauucgaaguccaggucauacucgccggaaacgccuucacagccgguaaagucauauucgccgccgucccgcccaacuuccccacagaaggccucucccccucccaagucacaauguucccacacaucgucguagacguacgccagcucgaaccaguccuuaucccccugccagaugucagaaacaacuucuaccacuacaaccaaagcaaugaccccaccauaaaacucaucgccaugcucuacacaccacuccgcgcaaacaacgccggcgacgacgucuucaccguauccugccgaguccucacuagaccauccccagacuucgacuucaucuuccucgugcccccaacagucgaaucucgcaccaaacccuucuccguccccguacucacaguagaagaaaugaccaacucaagauuccccauccccuuagaaaaacuuuucaccggccccuccagcgccuucguuguccaaccucaaaacggccgaugcaccaccgacggaguccuacuaggcaccacccagcucucccccgucaacaucugcaccuucagaggagacgucacccacaucaccggaucccgcaacuacaccaugaaccuagccucacagaacugguccaacuacgaccccacugaagaaauccccgcaccccuaggaacaccagacuucgucggcaaaauacaagguguccugacccaaaccaccagaaccgacggcagcacccgaggucacaaagccacagucuacaccggcuccgcugauuucgcacccaaacucggccgcguccaauucgaaacagacaccgaccacgacuucgaaaccaaccaaaacaccaaauucacccccguuggugucauccaggacggcucaacaacacaccgaaacgaaccccaacaauggguccucccuuccuacuccggccguaacaccccaaacguacaccucgcacccgccgucgcccccaccuuucccggggaacaacuacuguuuuucagaucaaccaugcccggaugcucaggcuaccccaacauggaccuugauugccuucuaccccaagaguggguacaauacuucuaccaagaagccgcccccgcacaaucagacgucgcucuccuucgauucgucaaucccgacaccggucgcguccucuucgaaugcaaacuccacaaaucaggauauguaacagucgcccacaccggacaacacgaccuugucaucccacccaacggauacuuccgcuucgacuccugggucaaccaauucuacacccuugcccccauggguaauggcaccggccgccgccgugcccucuaa

SEQ ID NO: 36201 - RNA, 1623 nt, Artificial Sequence
  derived and/or modified sequence opt11 from VP1__Norovirus__AIV43171
augaaaauggccuccucagacgcuaaucccagcgauggcucagccgcuaaccucgucccggagguaaacaacgaagucauggcccuagaacccgucgucggagcagccaucgccgcacccgucgccggacagcaaaacguuaucgaccccuggauccgaaacaacuuuguccaagccccaggaggcgaguucaccgucucaccccgaaacgcacccggcgaaauccuauggucagccccacuaggccccgaccucaaccccuaccuaucucacuuagcaagaauguacaacggauacgccggcggcuucgaaguacaaguaauauuagcaggcaacgccuucacagcaggcaaagucauauucgccgccguacccccaaauuuccccaccgaagggcucagccccucccaagucaccauguucccccacaucgucgucgacguaagacaacucgaaccuguccucaucccacuccccgacgucagaaacaacuucuaucacuacaaccaaucaaacgaccccaccauuaaacuaaucgccaugcuauacacaccacuacgugcuaacaacgcaggcgacgacgucuucaccguauccugucgcguccucacccgccccucccccgacuuugacuucaucuuccucgucccgcccaccgucgaaucucguaccaaacccuucuccguccccguacucacagucgaagaaaugaccaauagccgcuuccccaucccccuugaaaaacuauucaccgggccaucauccgccuuugucguccaaccccaaaacggacgcugcaccacugacggcguccuccucggcaccacccaacuaucccccgucaacaucuguacauuccgcggcgacgucacacacaucacaggcucacacaacuacacaaugaaccuagcuucccaaaauuggaacaacuaugaccccaccgaagaaauccccgcgccccucggcaccccagacuucgucggcaaaauccaaggcguacucacccaaaccacacgcacagacggaagcacccgaggucacaaagccacagucuauaccggcucagccgacuucgccccuaaacucggccgcguacaauucgaaacagacaccaaccacgacuucgaagccaaccaaaacacuaaauucacccccguuggugucauucaagacggcggaacaacucaccgcaacgaaccccaacaauggguacuccccucauacucaggccgcaacacucccaauguucaucucgccccagccgucgccccaaccuuccccggagaacaacuccucuucuuccgaucaacaaugcccggcugcuccggauaccccaacauggaccuagacugccuucugccccaagaauggguccaauacuuuuaccaagaagccgcgccagcacaaucagacguugcacuacuccgcuucgucaaccccgacaccggacgcguccucuucgaaugcaagcuccacaaauccggauacguaacagucgcccacaccggccaacacgaccuagucaucccacccaacggcuacuuccgcuucgacucaugggucaaccaauucuacacccucgcccccaugggcaacggaaccggccgucgccgcgcccucuaa

SEQ ID NO: 36202 - RNA, 1623 nt, Artificial Sequence
  derived and/or modified sequence opt11 from VP1__Norovirus__AIV43172
augaaaauggccuccucagacgcaaacccauccgacgguuccgcagcaaaccuaguccccgaaguaaauaacgaggucauggcgcuugaacccgucgucggcgccgccauagccgcacccguagccggccaacaaaacgucaucgaccccuggauacgaaauaacuucguucaggcccccggaggcgaguucaccguaucaccccgcaacgccccuggagaaaucuuauggucagcuccccucggccccgaccucaauccauaccucucccaccucgcccgcauguacaacggcuacgccggcggcuucgaaguccaaguaauccucgcaggcaacgcauuuacagcaggaaaaguaauauucgccgccguaccacccaacuuccccaccgaaggccuaucccccucccaaguaaccauguucccccauaucgucgucgacguacgccaacuagaaccaguccugauaccccuacccgauguccgcaacaacuucuaccacuauaaccaauccaacgacccuaccauaaaacuuauugcaaugcucuacacuccccuccgugccaacaacgcaggagacgacgucuucaccgucucuugucgcguccucacccgacccagccccgacuuugacuucauauuucuaguacccccgaccgucgaaagccgcaccaaacccuucuccgucccuguccuaaccgucgaagaaaugaccaauucacgauuccccauaccgcucgaaaaacuauucacuggcccuucauccgccuucguuguucaaccccaaaacggccgaugcaccaccgacggcguacuacuagguacaacucaacucuccccaguaaacaucugcaccuuucgcggagacgucacccacaucacaggaucccgcaacuacacaaugaaccucgcaucccaaaacuggucaaacuacgacccaaccgaagaaauccccgccccacucggcacccccgacuucguaggaaaaauacaaggcauguuaacccaaaccacacgaacagacggcucgacccgaggccacaaagccaccguauacacaggauccgcagacuucgcaccaaaacucggccguguccaguucgaaacagacaccgaccacgacuuugaagcuaaccaaaacaccaaauucaccccggucggagucauccaagacggaucaaccacccaccgcaacgaaccucaacaauggguccuacccuccuacuccggccgcaacacccccaacguacaccuugcucccgccgucgccccuaccuuccccggagaacaacuacucuucuuccgcuccacaaugcccggcugcuccggcuacccaaacauggaccucgacugccuacuuccccaagaguggguccaauacuucuaucaagaagccgcaccagcacaauccgacgucgcacuacucagauucgucaacccugacaccggucgcguacucuucgaaugcaagcuccacaaaagcggcuacgucaccgucgcacacaccggucaacacgaccuugucauaccacccaacgguuacuuccgcuucgacuccugggucaaccaauucuacacacuagcaccaaugggaaacggcaccggacgacgcagagcccuauaa

SEQ ID NO: 36203 - RNA, 1623 nt, Artificial Sequence
  derived and/or modified sequence opt11 from VP1__Norovirus__AIV43173
augaaaauggccucuucugacgcaaacccaagcgacggcucagcagccaaccucguacccgaagucaacaacgaagucauggcccucgaacccguagucggcgccgccauugccgcacccguagccggucaacaaaaugucaucgaccccuggauccgcaacaacuucguucaagcccccgggggagaguucaccgugucccccagaaacgcaccaggcgaaauccuaugguccgcaccccucggucccgaccuaaacccauaccucucccaccuagcccgcauguacaacggcuaugcuggcggauucgaaguccaaguaauacuagcaggcaacgccuucacagcaggaaaaguaauauucgcagccguucccccaaacuuccccacagaaggccuaucacccucgcaagucaccauguuuccacacaucgucgucgacguucgccaacuagaacccgugcucaucccccuccccgacguacgcaacaacuucuaccacuacaaccaaucaaacgacccuacaaucaaacuaauagcgaugcuauacacuccccuccgcgccaacaacgccggagacgacgucuucaccgucagcugccgcguccuaacccgucccucaccagacuucgacuucaucuuccuaguaccucccaccgucgaaucacguaccaaacccuucucaguacccguccuaacaguugaagaaaugaccaacucccgauuccccauaccccuagaaaaacucuucaccggccccucuuccgccuucguaguccaaccacaaaacggccgcugcacaaccgacggcguccuacuuggcaccacccaacucucacccgucaacauuugcaccuuccgcggagacguaacccacaucaccggaucccacaacuacacgaugaaucuagcaucacaaaauuggaacaacuacgacccaacugaagaaauccccgcaccccuuggaaccccagacuuuguaggaaaaauccaaggcguccucacucaaaccacgcgcacagacggauccacacgcggccacaaagccaccgucuacaccggcuccgccgacuucgcccccaaacucggaagaauacaauuugaaacugacaccaaccacgacuucgaagccaaucaaaacaccaaauucaccccagucggugucauacaagacggcggcaccacucaccguaacgaaccccaacaguggguccuacccuccuauuccggacgcaacacccccaacguccaccuagcacccgccgucgcccccacguucccuggugaacaacuccuauucuuccgcucgacaaugcccggcugcucaggcuacccaaacauggaccucgauugccuccuaccccaagaauggguucaauacuucuaucaagaagcagccccggcccaaucagacguagcccuccuccgcuucgucaaucccgacacaggccgcguacucuucgaaugcaaacuccacaaaucaggcuacgucacagucgcccacaccggacaacacgaccucgucauaccucccaacggcuacuuccguuucgacucaugggucaaccaauucuacacccucgcacccaugggcaacggaacaggcagacgacgcgcccuauga

SEQ ID NO: 36204 - RNA, 1623 nt, Artificial Sequence
  derived and/or modified sequence opt11 from VP1__Norovirus__AIV43174
augaaaauggccucaucagacgccaaccccagcgacggaucagccgccaaccucguccccgaaguaaacaacgaagucauggcacucgaacccgucgucggugccgcaaucgccgcacccguugccggccaacaaaacgucaucgaccccuggauccgcaauaacuucguacaggccccaggcggcgaguucaccgucucaccucgaaacgcacccggcgaaauacucugguccgcaccacucggacccgaccucaauccauaccucucucaucucgcccgcauguacaacggauacgcugguggcuuugaaguccaaguuauccucgccggaaacgccuucaccgccggaaaagucauuuucgcugccgugccacccaacuuccccacagaaggacucuccccaucacaagucaccauguucccccacaucguaguagacguacgccaacuagaacccguucucaucccccuucccgacguacgaaacaacuuuuaccacuacaaccaauccaacgaccccaccaucaaacuaaucgccaugcucuacacaccccuacgcgccaauaacgccggcgacgacgucuucacagucucaugccgcguccucacccgucccucccccgacuucgacuuuaucuuccuuguucccccuaccgucgaaucccgaaccaaaccauucuccgucccaguucuaaccguagaagaaaugaccaacucacgauuccccaucccucucgaaaaacuuuuuacagguccaucauccgccuucguaguccaaccccaaaacggacgaugcacuaccgacggagucuuacucggcaccacucaacucagccccgucaacaucugcaccuuccgaggagacgucacccacauuaccgguucccgcaacuacacaaugaaccuugcaucacaaaacuggaacaacuacgacccaaccgaagaaaucccagcaccacuuggcacccccgauuucguaggaaaaauucaaggcguccuaacccaaaccacccgcaccgacggguccacccgcgggcacaaggccaccgucuacacaggaagcgcugacuucucccccaaacuuggccgaguccaauucgaaacagacacagaccacgacuucgaagccaaccaaaacaccaaguucacaccaguaggcgucauccaagauggaggcaccacccaccgcaacgaaccacagcaauggguauuacccuccuacuccggccggaacaccccaaacguacaccucgcacccgcugucgcccccaccuuccccggcgaacaacuccucuucuuccgauccacaaugccaggaugcuccggcuaccccaacauggaucuagacugccuacucccacaagaauggguacaauauuucuaccaagaagcagcacccgcccaguccgaugucgcacuccucagauucgucaacccagacaccggucgaguccucuucgaaugcaaacuacauaaauccggcuaugucaccgucgcucacacgggccaacacgaccucgucauaccacccaacggauacuuccgcuuugacuccuggguaaaccaauucuacacacucgcacccaugggaaacggcaccggacgcagacgagcccucuaa

SEQ ID NO: 36205 - RNA, 1623 nt, Artificial Sequence
  derived and/or modified sequence opt11 from VP1__Norovirus__AIV43175
augaagauggcuuccucagacgccaaccccuccgacgguuccgcagccaaccucguccccgaagucaauaacgaagucauggcacucgaacccgucgucggcgcggccauagcugccccugucgcaggacaacaaaacgugauugaccccuggauucgcaacaacuucguccaagcccccggcggcgaguucacaguauccccucgaaacgccccaggggaaauccucugguccgcaccccucggcccagaccucaaccccuaccucucucaccuagcccgcauguacaaugguuacgccggaggcuucgaaguccaagucauccuagcaggaaacgccuucaccgcaggaaaaguaauauucgccgccgucccgcccaacuuccccaccgaaggccuaucucccucccagguaacaauguucccacacaucguuguggacgugcgacaacucgaacccguacuaaucccccuacccgauguccgcaacaacuucuaucacuacaaucaauccaacgaccccaccaucaaacuaaucgcaaugcucuacacaccccuccgcgccaacaacgcgggcgacgacgucuucaccguauccugccggguccucacccgccccucccccgacuuugacuucaucuuccuagucccacccaccgucgaaucucgaacuaaacccuucucaguccccguacucaccguugaagaaaugacaaacucacgcuuccccaucccacuagaaaaacuguuuacaggccccuccuccgccuucguaguccaaccacaaaacggucgaugcaccaccgacggcguacuccucggaaccacccaacuaucacccgucaacauauguaccuuccgcggugacguaacccacauaacuggcucacgcaacuacaccaugaaccuagccagccaaaauuggaacaacuacgaccccaccgaagaaauccccgcaccccucggcacaccugacuucgucggcaaaauccaaggcguacuuacccaaaccacccggacagacggcucaacccgcggccauaaagccaccgucuacacaggcagugccgauuucucccccaaacugggacgcguacaauucgaaaccgacaccgaccacgacuucgaagccaaccaaaacacuaaauuuacccccgucggugucauccaagacggcggcacaacccaccgaaacgaaccacagcaauggguacuccccucauacagcggacgaaacacgccaaacguucaccuagcccccgccgucgcccccacauucccaggugaacaacuccuauucuuccgcagcaccaugcccggcugcuccggcuaccccaacauggaccucgacugccuucucccccaagaauggguccaguacuucuaccaagaagccgcaccagcccagucagacgucgcccuucuccgcuucguaaacccugacaccggccgcguacucuucgaaugcaaacuccauaaauccggguacgucaccguagcccacaccggacaacacgaccuugucauaccacccaacggcuauuuucgauucgacuccugggucaaccaauucuacacccuugccccaaugggcaacggaaccggccgccgacgagcccucuaa

SEQ ID NO: 36206 - RNA, 1623 nt, Artificial Sequence
  derived and/or modified sequence opt11 from VP1__Norovirus__AIV43176
augaaaauggccuccuccgacgccaaccccucagacggcucugcagcgaaucuuguacccgaaguaaacaacgaagucauggcccuagaacccgucguaggcgccgcaaucgccgcccccgucgccggccaacaaaacgucaucgaccccuggauacgcaacaacuuuguccaagccccaggcggcgaauuuaccguaagccccagaaacgcaccaggcgaaauccucugguccgccccauuaggccccgaccucaaccccuaucuaucacaccuugcccgcauguacaaugguuacgccggcggauucgaaguccaagucauacuagccggcaaugcauucaccgccgguaaaguuaucuucgccgccgucccacccaacuucccuacugaaggccucuccccaucccaagucaccauguucccucacaucgucgucgacguccgucaauuagaaccaguacuaauuccccucccagacguccgaaacaacuucuaccacuacaaccaauccaacgaccccaccaucaaacugaucgccaugcucuacacucccuuaagagccaacaaugccggagacgacgucuucacggucuccugccgaguccucacacggcccucacccgacuucgacuucaucuuccucgucccucccaccgucgaaucacgcacaaaacccuucuccguacccguacuuaccgucgaagaaaugacuaacucacgauuccccauuccacucgaaaaacucuucacaggccccuccuccgccuucgucguccaaccccaaaauggccgcugcacaaccgacggcguccuccucggcacuacacaacucucccccguaaacauuugcacauuccgaggcgacgugacccacaucacaggcucccgaaacuacaccaugaaccucgcaucacaaaacuggagcaauuacgaccccaccgaagaaauccccgcaccccucggaacgcccgacuucgucggcaaaauacaaggcguauuaacacaaaccacccgcaccgacggcagcacucgcggccauaaagccaccgucuacacaggcuccgccgacuucgcccccaaacucggccguguccaauucgaaaccgacacagaccacgacuucgaagcuaaccaaaacaccaaguucacaccagucggagucauccaagacggcuccaccacccauagaaacgaaccacaacaauggguccuccccuccuacuccggccgcaauacaccgaauguacaccuugcacccgcaguagccccaaccuucccaggcgaacaacuacucuucuuccgcuccaccaugcccggcugcucaggauaccccaacauggaccuagacugccuccuuccccaagaauggguccaauacuucuaucaggaagcagccccagcucaauccgacgucgcgcuccuccgcuucgucaauccagacaccggacgagucuuauucgaaugcaaacuacacaaauccggauacgucacagucgcacacaccggacaacacgaccucguaaucccacccaacggcuauuucagauuugacucaugggucaaccaauucuauacccuagcccccaugggcaacggcacaggccgccgccgcgcacuguaa

SEQ ID NO: 36207 - RNA, 1623 nt, Artificial Sequence
  derived and/or modified sequence opt11 from VP1__Norovirus__AIV43177
augaaaauggcuuccucugacgccaaucccucagacggcuccgccgccaaccuaguccccgaagucaacaacgaaguaauggcgcucgaacccguaguuggggccgcuaucgccgccccaguagcaggacaacaaaacgucaucgaucccuggauccgcaacaacuucguccaagcucccggcggcgaauuuacagucagcccccgcaacgccccaggcgaaauccucugguccgcaccccucgguccugaccuaaaccccuaccucucacaccuugccagaauguacaacggauacgccggcggcuucgaaguccaagucauccucgcaggaaacgccuucaccgccggcaaagucaucuucgccgccgucccaccgaacuuccccacugaaggccucucccccucccaaguaaccauguucccacacaucgucguagacguacgacaacucgaacccguccucaucccccuccccgacguacgaaacaacuucuaccauuacaaccaaucaaacgaccccaccaucaaacuaaucgccaugcucuacacgccacuacgugcaaauaacgccggcgaugacgucuucacugucuccugcagaguccucacccgccccagccccgacuucgacuucaucuuccuaguucccccaaccgucgaaagccgaacaaagccuuucuccguaccaguccuaaccguagaagaaaugacaaacucacgcuuucccaucccccucgaaaaacucuucacuggaccuuccagcgccuucgucguccaaccccaaaauggacgaugcaccacggacgggguccuccuaggcaccacacaacucucccccgucaacaucugcacuuuccgcggcgacgucacccacaucaccggaagccguaacuauacaaugaaccucgcaucccaaaacuggagcaacuacgacccuacagaagaaaucccagcgccacucgguacacccgacuucgucggaaaaauccaagggguucucacccaaacaacccgcacagacggaucuacccgcggccacaaagccaccgucuacaccggcagcgcugacuucgcccccaaacuuggccgcguccaauucgaaaccgauacagaccacgauuucgaagccaaccaaaacaccaaauucaccccagucggcgucauccaagacggcggaaccacccaccgcaaugaaccacaacaguggguacuacccuccuacucaggccgcaacacaccuaacguacaccucgcacccgccguagcccccaccuucccaggcgaacaacuauuauucuuccgcuccaccaugcccggcugcucaggcuaccccaacauggaccucgacugccuucuaccccaagaauggguccaauacuuuuaucaagaagccgcacccgcacaauccgacgucgcccuccuccgauucgucaacccugauaccggccgcguccuauucgaaugcaaacuccacaaaucaggauacgucaccgucgcccacaccggccaacacgaccucguaauaccacccaacggcuacuuccgcuucgacuccuggguuaaucaauucuacacccucgcacccaugggaaacggcaccggaagacgacgcgcccucuaa

SEQ ID NO: 36208 - RNA, 1623 nt, Artificial Sequence
  derived and/or modified sequence opt11 from VP1__Norovirus__AIV43178
augaagauggcuucauccgacgccaaucccagcgauggcucagccgccaaccucguucccgaaguuaacaacgaagucauggcccucgaacccguagucggcgccgccaucgccgcccccguagccggucaacaaaacguaaucgaccccuggauccgcaauaauuucguacaagcccccggcggugaguucaccguaucaccccgcaacgcccccggugaaauacucugguccgcaccccucggcccagaccucaaccccuaccucucccaccucgcccgcauguacaacgguuacgccggaggauucgaaguucaagugauacucgccggcaacgccuucaccgcgggcaaaguaaucuucgccgccgucccuccuaauuuccccaccgaaggacuaucccccucccaagucacaauguucccccacaucgucguagacguucgccaacucgaacccguucuaaucccccuccccgacguccgaaacaacuucuaccacuacaaccaauccaacgacccaaccaucaaacuaaucgccaugcucuacacaccccuccgagccaacaacgccggcgacgacguauucaccgucuccugccgaguacucacccgcccaucacccgacuucgauuucauauuucuugucccacccaccguagaaagucgaaccaaaccauucucuguacccguccugacaguagaagaaaugaccaacucccguuuccccauaccccuagaaaaacucuuuaccggccccucauccgccuucguuguccaaccacaaaacggccgaugcaccaccgaugguguucuccuaggcacuacccaacucucccccgucaacaucugcacuuuccgcggcgacguaacccacaucacaggaucccguaauuacacuaugaaucuagccucacaaaacugguccaacuaugacccaaccgaagaaauacccgcaccccucggcacccccgacuucguuggcaaaauccaaggaaugcucacccaaaccacacgcacagauggcucaacccgcggccacaaagccaccgucuacacaggcuccgccgauuucgcacccaaacuaggacgcguccaauuugaaaccgacaccgaccacgacuucgaagccaaccaaaacacuaaauucaccccuguaggcgucauccaagacggcucaaccacccaccgaaacgaaccacaacaauggguccuacccucauacagcggccgaaacacccccaacguccaccuagcccccgccguagcccccaccuuccccggagaacaacuucuauucuuucgcuccaccaugcccggaugcucaggcuacccuaacauggaccucgacugccuccucccacaagaauggguccaauacuucuaccaggaagccgcacccgcacaaucagacguagcacuccuaagauuugucaaccccgacaccggacgcguccucuucgaaugcaaacuacacaaauccggcuacgucacugucgcacacaccggccaacacgaccucgucaucccucccaacgguuacuuccgguucgacuccuggguaaaccaauuuuacacccuagcucccaugggaaacggcacaggacgccgccgcgcacuauag

SEQ ID NO: 36209 - RNA, 1623 nt, Artificial Sequence
  derived and/or modified sequence opt11 from VP1__Norovirus__AIV43179
augaaaauggcauccuccgaugccaaccccuccgacggauccgcugccaaccucgucccagaaguaaauaacgaaguaauggccuuagaacccgucgucggcgccgccauagccgcucccguugccggccaacaaaacgucaucgauccauggauccgcaauaacuucguccaagccccugguggugaauuuaccgucucacccagaaacgcccccggcgaaauacucuggagcgcaccccuaggacccgacuuaaacccauaccucucacaccuagcccgaauguacaacggcuacgccgguggcuucgaaguacaagucauccucgccgguaaugccuucacagccggcaaagucauuuucgccgccgucccaccaaacuuccccacugaaggccuuucaccuucccaagucacaauguucccacacauagucgucgacguacgacaacuugaaccaguucucaucccccucccagacguccgcaacaacuucuaccacuacaaucaaucuaacgaccccacaaucaaacuuauagcaaugcucuacacaccucugcgcgccaacaacgcgggcgacgacguguucaccgucuccugccguguccuuacccgacccucccccgacuucgacuucaucuuccucguacccccuaccgucgaaucacgaaccaagcccuucucaguccccguccucaccguugaagaaaugacaaacucccgcuucccaauaccacucgaaaaacuauucaccggcccgagcuccgccuucgucguccagccacaaaauggcagaugcacuacagacggcguccuccuaggaaccacccaacugucccccgucaacauaugcacauuccgaggcgacguaacccacaucaccgggucccgcaacuacaccaugaaccuugcaucacaaaacuggucuaacuacgacccaaccgaagacaucccagcaccccuaggaacacccgacuucguaggaaaaauccaaggcguacucacacaaacaacccgcaccgacggcucuacccggggccacaaagccacagucuacaccggcuccgccgacuucgcccccaaacucggccgcguacaauucgaaaccgacaccgaucacgacuucgaagcuaaccaaaacacaaaauucaccccaguaggcguuauacaagacggaggcacaacccaccguaacgaaccccagcaauggguacucccgucauacucaggacgcaacacccccaacguacaccucgcccccgcagucgcccccacauucccuggcgaacaacuacuuuucuuccgauccacaaugcccggaugcucgggcuacccuaacauggaccucgauugccuacucccccaagaauggguccaguacuucuaccaagaagccgcaccagcacaaagcgacgucgcccuacuacgcuucguaaacccagacacuggccgcguccuguucgaaugcaaacuacacaaauccggauacguaaccguagcccacaccggccaacacgaccucgucaucccaccaaacggcuacuucagauucgacuccuggguaaaccaauucuacacccucgcaccaaugggcaacggcaccggcaggcgucgagcccuauaa

SEQ ID NO: 36210 - RNA, 1623 nt, Artificial Sequence
  derived and/or modified sequence opt11 from VP1__Norovirus__AIY27747
augaagauggccuccaacgacgcaaacccaucagacggauccgccgccaaccucgucccagaaguaaacaacgaagucauggcacuagaaccaguugucggcgccgccaucgcagcccccguagcuggccaacaaaacgucaucgaccccuggauccgcaacaacuucguccaagcccccggcggcgaguucaccguaagcccccgcaacgcccccggcgaaauccucugguccgccccucuagguccugaccuaaaccccuaccuaagccaccuagcucgcauguacaacggcuacgccggagguuucgaaguccaaguaauccuagcuggcaacgccuucaccgcaggcaaggucauauucgcugcagugcccccuaacuuccccaccgaaggccucucccccucccaagucaccauguucccacacauagucgucgaugugcgccaacucgaacccguccucaucccccucccagacguccgcaacaacuucuaccacuacaaccaauccaacgaccccaccauaaaauuaaucgccaugcucuacacaccccuccgcgcaaacaacgcaggcgacgacguuuucaccgucucaugccgcguacuaacccgccccucacccgacuucgacuucaucuuccuaguaccacccaccgucgaaucccgaacaaaaccauucagcguccccguccugacaguagaagaaaugaccaacucacguuuucccaucccucuugaaaaacucuuuaccgguccuucauccgccuucgucguccaaccacaaaacggucgcugcaccaccgacggaguucuacuaggcacaacccaacuaucucccgucaacaucugcacauuccguggagacguaacucacaucaccggaucccgcaacuacaccaugaaccuagccucccaaaacuggaacaacuacgauccaaccgaagaaauaccagcaccccucggcaccccagacuucgucgguaaaauccaaggcguccuaacacaaaccacucgcaccgacgguuccacccgcggccacaaagccaccgucuacaccggcagcgccgacuucgccccaaaauuaggacgcguacaguucgaaaccgacaccgaccacgauuucgaagccaaccaaaacaccaaauucacacccguuggaguaauacaagacggaucaacaacccaccgaaacgaaccccaacaauggguacuacccucuuacagcggacgcaacacccccaacguccaccucgcgccagccguagccccuaccuucccaggcgaacaacuucucuucuuccgaucuacaaugcccggcugcuccggcuauccuaacauggaccucgacugccuccuaccccaagaauggguacaauacuucuaccaagaagccgccccagcccaaucugacgucgcccuccuccgauucguaaaccccgacaccggccgcguccucuucgaaugcaaacuucacaaauccggcuacguuaccgucgcccacacgggccaacacgaccuugucauacccccaaacggcuacuuccgauucgacuccuggguuaaccaauucuacacccucgccccuaugggcaacggcacaggccgccgccgcgcccuguaa

SEQ ID NO: 36211 - RNA, 1623 nt, Artificial Sequence
  derived and/or modified sequence opt11 from VP1__Norovirus__AJA71387
augaaaauggccuccucugacgcaaaccccuccgacggcuccgccgccaaccuaguacccgaagucaacaacgaaguaauggcccucgaaccugucgucggcgccgccauagcagcuccggucgccggccaacaaaacgucaucgaccccuggauacgcaacaacuucguacaagcccccgguggagaguucacaguguccccacgcaacgcccccggcgaaauccuauggucagcuccccuaggccccgacuuaaacccuuaccucucccaccuagcccgcauguacaacggcuacgccggcggcuucgaaguacaaguuauccuagccggaaacgccuucaccgcuggcaaggucauauucgcagccgucccacccaacuuucccacugaaggccucucccccucccaaguuaccauguucccccacauaguagucgacguccgacaacuagaaccaguacucaucccccugccagacguccgcaacaacuucuaccacuauaaccaauccaaugauccaacaaucaaacucaucgcaauguuauacacaccccuaagagccaauaacgcuggcgacgacguuuucaccgucuccugccguguacucacccgucccagcccagacuucgacuucaucuuccucgugcccccaaccgucgagagccgcaccaaacccuuuucuguacccguacuaaccguagaagaaaugacaaacucacgauuccccauaccccucgaaaagcuauucaccggcccaucuucugccuucgucguccaaccccaaaacggccguugcacaaccgacggaguccuacuuggcaccacccaacucuccccaguuaacaucugcacuuuccgcggagacguaacccacauaaccggaucccgaaacuacacaaugaacuuagcaucacaaaacuggaacaacuacgaccccacggaagaaauccccgccccacucgggacccccgacuucgucggcaaaauccaaggaguccuaacucaaaccacccgaacagacgguuccacacgaggacacaaagccacagucuacacaggcucggcagacuucucgccuaaacucgguaggguccaauucgaaaccgacaccgaccacgauuucgaagccaaucaaaacaccaaauuuacacccgucggcguaauacaagacggcggcaccacccaucgaaaugagccccaacaauggguccuaccauccuacaguggccgcaacacaccaaacguucaccucgccccagccguagcaccaacuuuccccggagaacaacuccuauucuuccgaagcaccaugccaggaugcuccggcuaccccaacauggaccucgacugccuucucccccaagaauggguacaauacuucuaccaagaagccgcccccgcacaauccgacguagcccuccuccgcuucguaaaucccgacacaggccgcguccucuuugaaugcaaacuucacaaauccgguuacgucacagucgcacacaccggccaacacgaccuagucauuccaccuaacggcuacuuccgcuucgacuccugggucaaccaauucuauaccuuagcccccaugggcaacggcaccggacgccgccgcgcucuauag

SEQ ID NO: 36212 - RNA, 1623 nt, Artificial Sequence
  derived and/or modified sequence opt11 from VP1__Norovirus__AJA71388
augaaaauggcgucuucugacgcaaaccccuccgacggauccgccgccaaccucguccccgaagucaacaaugaaguccucgcccucgaacccguagucggcgccgcaaucgccgcccccguagccggccaacaaaacgucauagacccauggauacgcaacaacuucguccaggcccccgggggcgaguucaccgucuccccacgcaacgcaccuggcgaaauccuuuggucagcaccccucggacccgaccucaaccccuaccucucccaccucgcccgaauguacaacggauacgccggcggauucgaaguucaagucauucucgccggaaaugccuucacagcagguaaaguaaucuucgccgccgucccacccaauuuccccacugaaggccucucccccucccaagucacaauguucccacacaucgucgucgacguccgccaacucgaacccguccuaaucccacuccccgacguccgcaauaacuucuaccacuacaaccaaucuaacgaccccacaaucaaacuaauagcaaugcucuacaccccucugcgcgccaacaacgccggagacgaugucuucacagucucgugccguguacuaacccgaccaucaccggacuucgacuucauauuccuagucccaccaaccguagaaucacgcaccaaacccuucucggucccaauccuuaccgucgaagaaaugaccaacucacgcuuccccaucccccucgaaaaauuauucaccggccccuccagcgcuuucguaguacaaccccaaaacggccgaugcaccaccgacggcguccuccucggcacaacacaacuuagcccugucaacaucugcacauuccgaggcgacgucacccacaucacaggcucccacaacuacaccaugaaccuagcaucacaaaacugguccaacuacgacccaaccgaagaaauccccgcaccccucggcaccccagacuucgucggaaaaauccaaggcguccuuacccaaaccacccgcacugacggcuccacacgaggacacaaggccaccgucuacaccggaagcgcggacuucgcacccaaacucggccgaguccaauucgaaacagacaccgaccgcgacuuugaagccaaccaaaacacaaaguucaccccagucggcguaauccaagacggcgguacaacccaccgaaacgaaccccaacaauggguccuccccucauacuccggccgaaacacccccaacguucaccuggccccagccguggccccaacauucccaggagaacaacuacucuucuuccgauccaccaugccaggcugcuccggcuaccccaacauggaucucgacugccuccuaccacaagaauggguacaauacuucuaccaagaagcugcccccgcccaaucugacgucgcacuacuccgauucgucaaucccgacaccggaagaguccuauucgaaugcaaacuccacaaauccgguuacgucaccguugcccacaccggccagcacgaccucgucaucccucccaacggauacuuccgcuucgauucuuggguaaaccaauucuacacacucgcacccaugggcaauggcacaggccgccgacgagcacucuaa

SEQ ID NO: 36213 - RNA, 1623 nt, Artificial Sequence
  derived and/or modified sequence opt11 from VP1__Norovirus__AJA71389
augaaaauggccucauccgaugcaaaccccucagacggcuccgccgccaacuuaguacccgaagucaacaaugagguaauggcacucgaaccaguagucggcgcagccaucgcagcccccgucgccggccaacaaaacgucauugaccccuggauccgcaacaauuucguccaagcccccggaggggaguuuaccguaucaccccgcaacgcccccggugaaaucuuaugguccgccccucucggccccgaccucaacccauaccucucccaccucgcccgcauguacaacggcuacgccggcggauucgaaguacaaguuauacuagccggaaacgccuucacagccggcaaagucaucuucgcagccgucccacccaacuuccccacagagggacucucacccucccaaguaaccauguucccccacaucgucguagacguccgacaacucgaacccguacucaucccccuccccgacguccgcaacaacuucuaccacuacaaccaauccaacgaccccaccauaaaacuaaucgccaugcucuacacaccccuccgcgcaaacaaugccggcgacgacguauucaccguuuccugccguguucuaacccgccccucccccgacuucgacuucauuuucuuaguacccccaaccgucgaaucccgcaccaaacccuucuccguccccguccuaaccgucgaagaaaugacaaacucucgauucccuauccccuuagaaaagcuauucaccggccccuccuccgcauucgucguacaaccucaaaacggccgcugcaccacagacggaguccuccuuggaaccacacaacuuuccccaguaaacaucugcaccuuucgcggcgacguaacacacaucaccggaucccgaaacuacaccaugaaccuagcaucccaaaacugguccaacuacgaccccaccgaagaaauacccgccccucucggcacaccagacuucgucggaaaaauacagggcaugcucacccaaaccacaagaaccgacgguucaacccgcggccauaaagcaacagucuauaccggcagcgcagacuucgcaccgaaacucggacgcguccaauucgaaaccgacaccgaccacgacuucgaagccaaccaaaacacuaaauucaccccagucggcgucauacaagacggcuccaccacccaccgcaacgaaccacaacaauggguacuucccagcuacuccggacgcaacacuccgaacguccaccucgcccccgccgucgccccgacguuccccggcgaacagcuacucuucuuccgcagcaccaugcccggcugcucuggcuacccaaacauggaccuagacugccuacucccccaagaauggguacaauacuuuuaccaagaagccgccccagcacaauccgacguugcacuccuucgcuucgucaaccccgacaccggacgcguccuauucgaauguaaacuucacaaaucaggcuacgucaccgucgcacauacaggccaacacgaccuaguuauacccccaaacggcuacuucagauucgauuccuggguaaaccaauucuacacccucgcaccaaugggaaacggaacaggucgccgccgugcacucuaa

SEQ ID NO: 36214 - RNA, 1623 nt, Artificial Sequence
  derived and/or modified sequence opt11 from VP1__Norovirus__AJA71390
augaaaauggccagcuccgacgccaaccccuccgacggcucagccgcaaaccucgucccugaaguaaacaacgaagucauggcccuggaaccagucgucggcgcagcuaucgccgcccccgucgcaggccaacaaaacgucauagaccccuggauccgaaacaacuucguacaagcacccggcggcgaguucacuguuucccccagaaacgcccccggcgaaauccuuuggucugcaccccucggcccagaccucaaccccuaccucucacaccucgcccgaauguacaacggauacgccggcgguuucgaaguacaagucauccucgccggcaacgccuucacagcaggcaaagucauauucgccgccgucccucccaacuuccccaccgaaggacucucuccaucccaagucacgauguucccccacaucgucguggacgucagacaacuugaacccguccucauacccuuacccgacguccgcaacaauuucuaucacuacaaccaauccaaugacccaacaaucaaacuuaucgccaugcucuacacaccccuccgcgccaauaacgcuggagacgacgucuucacaguauccugucgaguccucacccgacccuccccagauuucgacuucaucuuccuuguaccacccaccgucgaaucccgcaccaagcccuucuccguacccguacucaccgucgaagaaaugaccaacucccguuuccccauaccacucgaaaaacuuuucacaggacccucauccgccuucgucguccagccacaaaaugggcgaugcacaaccgacggccuacuacucggcaccacacaacucucgcccgucaacauaugcacuuuucgcggagacgucacucacauuacaggcucacgcaacuacaccaugaaccucgccucccagaacuggagcaacuacgacccaacagaagagauccccgcaccacucggcacaccagacuucguaggcaaaauccaaggaguccucacccaaacaacucgcaccgacggguccacccgcggccacaaagccaccgucuacaccggcuccgccgacuucgccccaaaacucggccgcguccaauucgaaacagauaccgaccacgacuucgaagccaaccaaaacacuaaguucacacccguuggaguaauccaagacggaggcacaacucacagaaacgaaccacaacaauggguacucccuucauacagcggccgcaauacucccaacguccaucuagcccccgcugucgcgccaaccuuccccggcgaacaacuacucuucuuucgaucaaccaugccaggcugcuccggauaccccaacauggaccucgacugccuucugccgcaagaauggguccaauacuucuaccaggaggccgcuccagcccaauccgacgucgcucuccuacgauucguuaaccccgacaccggcagaguacuuuucgaaugcaaacuacacaaaucaggcuacgucaccguagcccauaccggccaacacgaccucguaaucccacccaacggcuacuucagguucgacucaugggucaaccaauuuuacaccuuagcccccaugggcaacggaacaggacgccgcagagcacuauaa

SEQ ID NO: 36215 - RNA, 1623 nt, Artificial Sequence
  derived and/or modified sequence opt11 from VP1__Norovirus__AJA71392
augaaaauggccuccuccgacgcaaaccccuccgacggcuccgccgcuaaccucguucccgaaguaaacaacgaagucauggcccuugaaccugucgucggagccgccaucgccgcccccgucgccggacaacagaacguaauagaccccuggauccgaaacaacuucguccaagcccccggcggcgaguucaccguauccccacgaaacgcccccggcgaaaucuuaugguccgcaccccuaggucccgaucucaacccauauuugucccaccuagcccgaauguacaacggcuacgccggcggauucgaaguacaggucauucucgccgguaacgccuucaccgccggcaaaguuaucuuugccgccguacccccgaauuucccaaccgaaggguuaucccccucucaaguuaccauguucccacacaucgucguagacgugcgacaacuagaacccguccucauccccuuaccugacguccgaaacaacuucuaccacuacaaccaaagcaacgaccccaccaucaaacuaaucgcaaugcucuacaccccacuccgagccaacaacgccggcgacgacguauucaccguaucuugccgaguacucacccgcccaucccccgacuucgacuucauauuccucguacccccaaccgucgaaucacgaaccaaaccauucucagucccgguccucacagucgaagaaaugaccaacucucgguucccuauaccccucgaaaaacucuucaccggccccucgagcgccuuugucguccaaccccaaaacggacgcugcaccaccgauggcgugcuccucggcacaacccaacuuuccccggucaacaucugcaccuuucgcggcgacguaacccacaucaccggaucccgaaacuacacaaugaaccucgccucccaaaauuggucaaacuacgaccccaccgaagaaauccccgcuccccucggaaccccugacuucguaggcaaaauacaaggcguccucacccaaaccacccgaacugacggcuccacuaggggccacaaagccacuguuuacacaggaucagccgacuucgcaccuaaacucggccgaguucaauucgaaaccgauaccgaccacgacuucgaagccaaccaaaacaccaaauuuacccccguuggcguuauccaagacggaucaaccacacaucgcaacgaaccacaacaauggguccuccccucauacuccggacgcaacacucccaauguccaccucgccccugccgucgccccaaccuucccaggcgaacaacuccuauucuuccguucaaccaugcccgguugcuccggcuacccaaauauggaccucgacugucuacuaccccaagaauggguucaauacuucuaccaagaagccgcaccagcgcaaucggacguagcacuccucagauucguuaacccagacaccggacgaguccuauucgaaugcaaacuucacaaauccggcuacgucaccgucgcccacaccggacaacacgaccucguaaucccacccaacgguuacuuccgauuugauuccugggucaaccaauucuacacccucgcacccaugggaaacggcaccggcagacgacgagcccucuga

SEQ ID NO: 36216 - RNA, 1623 nt, Artificial Sequence
  derived and/or modified sequence opt11 from VP1__Norovirus__AJA71393
augaagauggcaagcucggacgccaaccccuccgacggcuccgccgccaaucucguccccgaaguaaacaacgaagucauggcccuagaacccgucgugggggcagccaucgcggcccccgucgcuggccagcaaaacgucauugaccccuggauccguaacaacuucguccaagccccaggcggagaguucaccguaucaccccgaaacgcucccggcgaaauccuaugguccgcaccgcucggccccgaccucaaccccuaccuaucccaccuggcccgcauguacaacggauacgccggugguuucgaaguccaagucauccucgccggcaacgccuucacagcaggcaaaguuauauucgccgccgucccucccaacuuccccaccgaaggacucucccccucccaaguaaccauguucccucacauaguaguagacguacgucaacucgaaccuguccucauccccuuaccagacguacgcaacaacuucuaucacuacaaccagagcaacgacccgaccaucaaacucaucgcgaugcuuuacacaccccucagagcaaacaacgccggugacgacguauucaccgucuccugccgcguccucacccgacccagccccgauuucgacuucauauuucuuguacccccuaccguugaaucacgcacaaaacccuuuuccguccccguccuaaccgucgaagaaaugaccaacucucgcuuccccauacccuuagaaaaacuauucacaggaccaagcuccgccuucgucgugcaaccccagaauggccgcugcacuaccgacggcguccuccuaggcaccacgcaacucucaccaguaaacaucugcaccuuccgcggcgacgucacccauauaaccggcucacgcaacuacacaaugaaccuagccucccaaaacugguccaacuacgacccaaccgaagaaauccccgcaccccucggcaccccugacuucguuggaaaaauacaagguguacuaacccaaacaacccgcaccgacggcagcacacguggccacaaagccaccgucuacaccggcucugccgacuucgcccccaaacucggccgcguacaauuugaaaccgauaccgacagagauuucgaagccaaccaaaauaccaaauucacccccguaggcgucauacaagacggcggaaccacccaccgcaacgaaccucaacaauggguccuccccagcuacucaggccgcaacacaccaaacguacaucucgcacccgccgucgcaccaaccuuccccggugaacaacuacucuucuuccgcuccaccaugccaggaugcuccggcuaucccaacauggaccucgacugccuccucccccaagaauggguccaguacuucuaucaagaagccgccccggcacaaucugacgucgcccuacugcgcuucgucaaucccgacaccggucguguauuguuugaaugcaaacuccacaaaucaggcuacgugacagucgcgcacacagggcagcaugaccucgucauuccacccaacggauauuucagauucgacagcuggguaaaccaauucuacacccuagcacccaugggaaacggcacaggacgccgcagagcccucuaa

SEQ ID NO: 36217 - RNA, 1623 nt, Artificial Sequence
  derived and/or modified sequence opt11 from VP1__Norovirus__AJA71394
augaaaauggccuccucagacgcuaaccccucagacggcagcgccgccaaccucguccccgaagucaacaaugaagucauggcccucgaacccgucgucggcgccgcaauagccgcacccguugccggccaacaaaacguuaucgaucccuggauccgcaacaacuucguacaagccccaggaggugaguucaccguaucaccccgcaaugcaccaggcgaaauccuuugguccgcaccccucggcccugaccuuaacccauaccucucccaccuagcccgaauguacaacggcuacgccggaggcuuugaaguucaagucauccucgccggaaacgccuucaccgccggcaaaguaaucuucgcagcuguaccucccaacuuccccacagaaggccucucacccucccaagucacuauguucccccacaucgucgucgacgucagacaacuagaaccaguccucauaccccucccugacguccgcaacaacuucuaucauuacaaccaauccaacgaccccacaaucaaacuaaucgccaugcucuacacccccuuacgcgccaacaacgccggagacgacgucuucaccgugucuugccgcguccuaacacgacccagccccgacuuugacuucaucuuccuagucccaccuaccguugaaucccgaacuaaacccuucuccguccccguccucacagucgaagaaaugaccaacucacgcuuucccauaccccuagaaaaacucuucaccggccccagcuccgccuucgucguccaaccucaaaacggccgcugcacaacagacggaguacuacucggcaccacccaacuuucacccgucaauaucugcacauuccgaggagacgucacucacauaaccggaucucacaacuacaccaugaaucucgccucccaaaacugguccaacuacgacccaacggaagaaauucccgccccacuaggcaccccagacuucguagggaaaauccaaggcguacugacucaaacaacccgcacugacggauccacccgcggacacaaagccaccgucuacaucggcuccgccgacuuugcccccaaacucggccgcguccaauucgaaaccgacaccaaccaugacuucgaagccaaccaaaacaccaaauucacccccguaggagucauccaagacgguggaaccacccaccgaaaugaaccccaacaauggguacucccauccuacuccggacgaaauacccccaacguccaccuagcaccagcaguagccccaacauuccccggcgaacaacuacucuucuuccgcuccacaaugccgggcugcuccggcuaucccaacauggaccucgacugccuucucccucaggaauggguccaauacuuuuaccaagaagcagcacccgcacaauccgacgucgcccugcuccgcuucguaaacccugacacaggccguguacuauucgaaugcaaacuccacaaaucaggcuacguaaccgucgcccacaccggccaacacgaccuuguaaucccacccaacggcuacuuccgauucgacucccgcgucaaccaauucuacacacuagcccccaugggcaacggcacaggacgccgccgcgcccucuga

SEQ ID NO: 36218 - RNA, 1623 nt, Artificial Sequence
  derived and/or modified sequence opt11 from VP1__Norovirus__AJA71395
augaaaauggcaucauccgacgcgaaccccuccgacggauccgcagcaaaccucguccccgaagucaacaacgaaguaauggcacucgagcccgucgucggagcagcaauagccgcccccguagccggccagcaaaacguuauagacccauggauacgcaacaacuucguccaagcccccggcggagaguucaccguuuccccacguaacgccccgggugaaauccucuggagcgcccccuuagggcccgaccucaauccauaccuaucccaccuagcccgcauguacaacggauacgccggagguuucgaaguccaagucauacucgccggcaacgcuuuuacggccggcaaagucaucuucgccgccguacccccuaacuucccaacagaaggccuaucgcccucacaaguaaccauguucccccacaucguagucgacguccgccaacuugaaccaguccucaucccccuaccugacguccguaacaauuucuaccacuacaaccaauccaacgaccccacaauaaaacucaucgccaugcucuacacuccccuccgcgcuaacaacgccggcgacgaugucuuuaccguaagcugccgaguccucacccgccccucacccgacuuugacuucaucuuccuagugcccccgaccguagaaucucgcacuaaacccuucucgguuccgguacucaccgucgaagaaaugaccaacucccgcuuucccaucccccuagaaaaacucuucacuggacccucuagcgcauucgucguacaaccccaaaacggucgcugcaccaccgacggcguacuccucggaacuacccaacucucacccguaaauaucugcaccuuccgcggcgacgucacccacauuaccggcucgcgcaacuacacaaugaaccucgccucccagaacugguccaacuacgaccccaccgaagaaauacccgcccccuuaggaacaccugacuucguaggaaagauccaaggaguacucacacaaaccacccgaacagacggaucaacacguggacacaaagcaaccgucuacaccggcuccgcagacuucgcccccaaacucggccgcguucaauucgaaacugacacagaccacgacuucgaagcuaaccaaaacacaaaauucacucccgucggcguaauucaagacggcggcaccacccaccgcaacgaaccccaacaauggguccugcccuccuacuccggacgcaauacaccaaacguccaccucgcccccgccguagcccccacauucccaggagaacaacuacuguucuuccgcucaaccaugccaggcugcuccggcuaccccaacauggaccuugacugccuucucccccaggaauggguucaauacuucuaccaagaagcggcccccgcacaauccgacgucgcccuccuacgcuucgucaaccccgacaccggcagaguccucuucgaaugcaaacuucacaaaucaggauaugucacaguugcucacacuggacaacacgaccuagucauaccacccaacggcuauuuccguuucgacuccugggucaaccaauucuacacccucgcacccaugggaaacggcacuggccgccgacgcgcauuauaa

SEQ ID NO: 36219 - RNA, 1623 nt, Artificial Sequence
  derived and/or modified sequence opt11 from VP1__Norovirus__AJA71396
augaagauggccuccuccgacgcaaaccccuccgacggcucagccgccaaccucguuccggaagucaacaacgaaguuauggcacuggaaccugucguaggcgccgccaucgccgccccaguagccggucaacaaaacgucauugaccccuggauacgcaacaacuucguccaagccccaggcggcgaguucaccgucuccccacgaaacgcgccaggcgaaauccuaugguccgccccucucggacccgaccucaaccccuaccucucccaccuagcacgcauguacaacggcuacgccggaggauucgaaguacaagucauccuagcuggcaaugcuuucaccgccggcaaagucaucuucgccgccgucccacccaauuucccuacagaaggacucucccccagccaagugacaauguucccccacauuguaguagacguccgucaacuagaacccguacucaucccacucccugacgucagaaacaacuucuaccacuacaaccaaucaaacgaccccaccaucaaacucauagccaugcucuacacacccuuacgagccaacaacgcaggcgacgacgucuucaccguauccugccgaguccucacacgccccuccccagacuucgacuucaucuuccucgucccacccaccgucgaaagccgcacaaaacccuucuccguaccaguccucacaguagaagaaaugacaaacucccgcuucccaauaccacucgaaaaacucuucacaggcccauccucagcuuucguaguacaaccccagaacgggcgcugcaccacugacggaguccuacuuggcaccacccaacuaucacccguuaauaucugcacauuccgaggcgacgucacccacauaaccggaucccgcaacuauacaaugaaccuagcaucacaaaacuggagcaacuacgacccuaccgaagaaauaccugcaccccucggaacccccgacuucgucggaaaaauccaaggcaugcucacccaaacgacccgaacagacggcucgacacgaggacacaaagccacaguauacacagguuccgccgauuucgccccaaaacuaggacgaguacaauucgaaaccgacaccgaccacgacuucgaagccaaucaaaacaccaaauucacuccagucggagucauacaagacggcuccaccacccaucgcaacgaaccacaacaauggguacuacccucauacuccggacguaauacccccaacguacacuuagcccccgccgucgcacccaccuuccccggagaacaacuccucuuuuucagauccacuaugccaggcugcuccggcuaccccaacauggaccucgacugccuucucccccaagaauggguacaauacuucuaucaagaagccgccccggcacaauccgacguagcucucuuacgcuucgugaaccccgacacaggacgcguccuauucgaaugcaaacugcacaaaucaggcuacgucacugucgccuacaccggccaacacgaccuagucauaccacccaacgguuacuuccgauucgacuccugggucaaccaguucuacacacuagcacccaugggcaauggaaccggacgaagacgcgcccucuaa

SEQ ID NO: 36220 - RNA, 1623 nt, Artificial Sequence
  derived and/or modified sequence opt11 from VP1__Norovirus__AJA71399
augaaaauggccucgucagacgcaaacccaucagacgguucugcagcuaaccucguaccagaagucaacaacgaagucauggcccuggaacccguugucggcgcagccaucgccgccccagucgccggccaacaaaaugucaucgaccccuggauccgcaacaacuucguccaagcaccuggcggugaguucaccguuucgccgcgcaacgccccgggcgaaauccucuggucagcaccccuaggccccgaccuaaacccuuaucuaucccaccuagcacgcauguacaacggcuacgccggcggcuuugaaguccaagucauccucgcuggcaacgccuucaccgccggcaaagucaucuucgcugcaguaccacccaacuuucccaccgaaggccuaucccccucccaagucaccauguucccccacauagccgucgacguacgccaacucgaaccaguccucauaccacuacccgacguacgcaacaauuucuaccacuacaaccaauccaacgacccaaccaucaaacucaucgcaaugcuuuacacaccccuccgagcaaauaaugccggcgacgaugucuucaccguuuccugccguguccucacccgccccuccccagacuuugacuucauuuuccucgucccaccaacagucgaaucccgcaccaaacccuucuccguccccguccucaccguugaagaaaugaccaacucccguuuccccauaccccucgaaaaacucuucaccggaccauccucagcauucgucguccagccucaaaacggacgcuguaccaccgacggcguccuacuuggcacaacacaauuaucacccguaaacauaugcaccuuccgcggcgacgucacccacaucacaggcucucgcaauuacacgaugaaucuugccucacaaaacugguccaacuacgacccaacggaagaaauacccgcaccccucgguacaccugacuucgucggcaaaauccagggcguccucacccaaacuaccaggacugacggcagcacccgcggccacaaagccaccguauacaccggcucagccgacuucgcccccaaacugggacgcguccaauuugaaaccgacaccgaucacgacuucgaagcaaaccaaaacaccaaauucacaccagucggcguaauccaagacggagguacaacccaccgcaacgaaccacaacaauggguguuacccagcuauuccggacgcaacacacccaacguacaccucgcccccgccgucgccccaaccuuccccggcgaacaacuccuauucuuccgcuccaccaugcccggaugcuccggcuaucccaacauggaccucgauugccuccucccacaagaauggguacaauauuucuaccaagaagccgcccccgcccaaucagacguagcacuacuacgcuucguaaaccccgacaccggccgcguccucuucgaaugcaaacuccacaaauccggauacgucacaguugcccauaccggccaacacgaccucgucaucccaccaaacggcuacuuccgauucgacucauggguaaaucaauucuacaccuuagcccccaugggcaacggcacaggccgacgccgcgcccucuaa

SEQ ID NO: 36221 - RNA, 1623 nt, Artificial Sequence
  derived and/or modified sequence opt11 from VP1__Norovirus__AJA71400
augaaaauggccuccuccgacgcaaaccccucugacggcucggccgcgaaccucguccccgaagucaacaacgaagucauggcccuugaacccguagucggagcagccaucgccgcccccguagcuggccaacaaaaugucaucgaccccuggauucgcaacaauuucguacaggcccccggcggagaguucaccgucuccccacgcaacgcccccggcgaaauccucuggucagcaccccucggacccgaccuuaaccccuaccucucacaccucgcccgaauguacaacggcuacgccggaggauucgaaguccaagucauccucgccggcaaugccuucaccgccggcaaagucauauucgccgcaguacccccaaacuucccaaccgaaggacugucuccuucccaagucacaauguucccccacaucgucgucgacguccgacaacuagaacccguccucaucccucuacccgacguccgaaacaacuuuuaccacuacaaccaaucaaacgacccuaccaucaaacuaaucgccaugcucuacacaccccuacgagcaaacaacgccggcgacgacguauucaccgucucaugccgaguucucacccgacccagccccgacuucgacuucaucuuccuaguacccccaaccgucgaaucacgcaccaaacccuucucuguccccguccuuaccgucgaagaaaugaccaacucccgcuucccaaucccccucgaaaaacuauucaccggcccuucauccgccuucgucguccaaccccagaauggccgcugcaccacagacggcguccuccuaggcaccacccaacucucccccgucaacaucugcacauuccgcggcgacguuacacacaucaccgggucacgcaacuacaccaugaaccuagccucacaaaacugguccaacuacgacccaaccgaggaaauccccgcgccccuaggcacaccagauuucgucggaaagauccaaggaguccuuacccaaaccacccgcaccgacggcuccacacgcggccacaaagcuaccgucuacacaggcucagccgauuucgcacccaaauuaggccguguacaauuugaaaccgauacagaccgugacuucgaaacaaaucagaacaccaaauucacccccgucggagucauccaggacggcggcacuacccaccgcaacgaaccccaacaauggguacuccccaguuacuccggccgcaacacccccaacguccacuuagccccagccgucgcacccacauuccccggcgaacaacuccucuucuuuagauccacaaugccaggaugcagcggauaccccaacauggaccucgacugccuacuaccccaagaauggguccaauauuucuaccaagaggccgcucccgcacaauccgacgucgcccuccuccgcuucgucaaccccgacacuggacgaguucucuucgaaugcaaacuccacaaaagcggauacgucaccguagcccacaccggucaacaugaccucgucauacccccaaacggcuacuuccgcuucgacuccugggucaaccaauucuauacacucgcacccaugggaaacggaacaggccgcagacgcgcccucuaa

SEQ ID NO: 36222 - RNA, 1623 nt, Artificial Sequence
  derived and/or modified sequence opt11 from VP1__Norovirus__AJA71401
augaaaauggccucauccgaugcaaacccuucagacggcuccgccgcaaaccuugucccagaaguaaacaacgaagucauggcccuggaaccagucguaggcgcagcgaucgccgcccccguagccggacaacaaaacguaauagaccccuggauccgaaauaacuucguccaagcccccggcggugaguucacaguuucaccccgcaacgcccccggagaaauccucugguccgcaccccucggccccgaccuaaaccccuaccugucccaccucgccagaauguacaacggauacgccggcggcuucgaaguccaagucauccuagccggcaacgcuuuuaccgcaggcaaagucaucuucgcagcagucccucccaacuuucccaccgaaggucuaucccccucccaagucaccauguucccccacaucguaguggacguccgccaacucgaacccguccucaucccccuccccgacguccgcaacaacuucuaccacuacaaccaaucaaacgaucccacaauuaaacucaucgccauguuauacaccccacuacgagccaauaacgccggcgacgacgucuuuacugucuccugccgcguccuuacccgccccucacccgacuuugacuucaucuuccuagucccucccaccguugaauccagaaccaaacccuucuccguccccguccucacaguugaagaaaugacaaacucccgcuucccaaucccacucgaaaaacucuuuaccggccccucgucagccuucgucguccaaccacaaaacggcagaugcaccaccgacgguguccuccucggcaccacacaacucucccccgucaacauuugcacauuccgcggugacaucacacacaucaccggcucacgcaacuacacuaugaaccuagccucacaaaacugguccaacuacgaccccacugaagaaauucccgcaccccucggcacacccgacuucgucggcaaaauccaaggcguccucacccaaacuacccgcacggacggaucaaccagaggucacaaggccaccgucuacacuggaucagccgacuuugcccccaaacuaggaagaguccaauuuggcacagauacagaccacgacuuugaagccaaccaaaacaccaaguucacccccgucggcgucauccaagacggauccacaacacaccgcaacgaaccucaacaguggguccuccccagcuacuccggccgcaacacaccaaacguacaccuagcccccgccgucgccccaaccuucccaggugaacaacuccuauucuuccgauccaccaugcccggcugcuccgguuacccaaacauggaccuagacugccuccuaccccaagaauggguccaauacuuuuaccaagaagccgccccugcacaauccgauguagcccuucuaagauucgucaacccagacaccggccgaguccucuucgaaugcaaacuacacaaauccgguuacguuaccgucgcacacacgggacaacacgaccucguaaucccgcccaacggcuacuuccgcuucgacuccugggucaaccaauucuacacccuagcccccaugggcaacggcaccggacguagacgagcccucuaa

SEQ ID NO: 36223 - RNA, 1623 nt, Artificial Sequence
  derived and/or modified sequence opt11 from VP1__Norovirus__AJA71402
augaaaauggccagcuccgacgcaaacccaagcgacggcuccgccgccaaccucguccccgaaguaaacaacgaagucauggcccuagaacccgucgucggcgccgcaaucgccgcacccguagccggccaacaaaacgucaucgaccccuggauacgcaacaacuucguccaagccccaggcggagaguucaccgucucuccccgcaacgcacccggagaaauacucugguccgcaccccucggccccgaccucaauccauaccuaucccaucucgccagaauguacaacggauaugcaggagguuucgaaguccaagucauccuagccggcaacgccuucaccgccggcaaaguaaucuucgccgccguuccaccgaacuucccuacagaaggccucucacccucacaagucacaauguucccacauaucgucgucgauguacgccaacuagaaccaguccucauuccacuacccgacguacguaacaauuucuaccacuacaaucaaucaaacgaccccaccauaaaacucaucgccaugcuauacacaccccuacgcgcuaacaacgccggcgacgacgucuucaccgucaguugccgcguccucaccagaccaucccccgacuucgacuucaucuuccucguacccccgacagucgaaucgcgcacaaaaccuuucuccgucccaguccuaacagucgaagaaaugaccaacucccgauuccccaucccccuagaaaaacucuucaccggcccauccucugccuucgucguacaaccacaaaacggccgcuguaccacagacggcguacuacuggguacaacccaacuauccccagucaacauaugcacuuuccgcggcgacgugacccacaucaccggcucacgcaacuacaccaugaaccuagccucucaaaacuggucuaacuaugacccaaccgaagaaauccccgcaccacucggaacccccgacuucgucggaaaaauccaaggcguucucacccaaaccacucgcacagacggcuccaccagaggccacaaagcaacaguauauaccggcuccgccgacuucgcaccgaaacuuggaagaguccaauucgaaaccgacacagaccgcgacuucgaggccaaccaaaacacaaaauucacacccguaggcgucauccaagacggcggcacaacacaccgcaaugaaccccaacaauggguccugcccucauacagcggccgaaacaccccaaacguccaucucgccccugcagucgcucccacauuccccggagaacaacuucucuucuuccgcuccaccaugcccggaugcuccgguuaccccaacauggaccucgauugccuccuaccccaagaauggguucaauacuucuaccaagaagcagccccugcccaauccgacguagcccuccuccgcuucguuaacccugacacgggcagagucuuauucgaaugcaaacuccacaaaucaggauaugucaccgucgcccacacaggccaacacgaccucguaauacccccaaacgguuacuuucgcuucgacuccugggucaaccaauucuacacccucgcacccaugggcaacggcaccggcagacgacgagcccuauaa

SEQ ID NO: 36224 - RNA, 1623 nt, Artificial Sequence
  derived and/or modified sequence opt11 from VP1__Norovirus__AJA71403
augaaaauggcuuccuccgacgcuaaucccuccgauggcuccgccgcaaaccucgucccugaaguaaacaacgaaguuauggcccucgaacccgucguaggcgccgcgauagccgccccaguagcaggacaacaaaaugucaucgacccauggaucagaaacaacuucguccaagcccccggaggggaguucaccgucagcccacgaaaugccccaggcgaaauccuuuggagcgccccucuaggcccagaccucaaccccuaccucucacaucuugcccgcauguacaacggauacgcgggaggcuucgaaguacaggucauacucgccggaaacgccuucaccgccggcaaaguaaucuucgcugccguaccucccaacuuccccaccgaaggccucucccccucccaaguaaccauguucccccacauaguaguagacguacgccaacucgaacccguacuaaucccccuaccagauguccgaaacaacuucuaucacuacaaccaauccaaugaccccaccaucaaacucaucgccaugcuuuacaccccgcucagagccaacaacgcuggcgacgacgucuuuaccgugucaugucgcguucucacccgccccucccccgacuucgacuucaucuuccucgucccacccaccauagaaucacgcaccaaacccuuuucaguccccguacucaccgucgaagaaaugaccaacucaagauuccccaucccacuagaaaaacucuucaccggccccuccagcgcauucguaguacagccccaaaacggccgcugcacaaccgacggcguucuacucggcaccacccaacuauccccagucaacaucugcaccuuccgaggcgacguaacucauaucaccggaucccgaaauuacaccaugaaccucgcaucccaaaauuggaacaacuacgacccgacagaagaaaucccugcaccccucggcaccccugacuucgucggcaaaauacaagguguacuaacccagacaacacgcacagacggcuccacccguggccauaaagcaaccgucuacaccggcagcgccgacuucucccccaaacuaggacgaguacaauucgaaaccgacaccgaccacgacuucgaggccaaccaaaacacuaaauucacccccguuggcgucauccaagacggaggcaccacccaccgaaacgaaccccaacaguggguacuuccaucauacucaggacgcaacacacccaacguccaccucgcaccagccguagcaccaaccuuccccggcgaacaacuccuauucuuccgcagcaccaugccaggcugcucgggcuaccccaacauggaccucgacugccuacucccucaggaauggguacaauacuucuaccaagaagccgcccccgcccaauccgacguugcccuacuccgcuucgucaauccugacacaggccgcguacucuucgaaugcaaacuucacaaauccggcuacgucaccguagcacacacaggccaacacgaccucgucaucccgccaaacggauacuuccgcuucgauuccuggguuaaccaauucuacacacucgccccaaugggcaacggaaccggacgacgccgagccuuauaa

SEQ ID NO: 36225 - RNA, 1623 nt, Artificial Sequence
  derived and/or modified sequence opt11 from VP1__Norovirus__AJA71404
augaagauggcauccuccgacgcaaaccccuccgacggauccgccgcaaaccuaguaccagaaguaaacaacgaagucauggcccuagagccagucguaggugccgcaauagcugcccccgucgccggccaacaaaacguaaucgaccccuggauccgcaacaacuucguucaagccccaggcggagaguucacagucucuccacguaacgcccccggagaaauccucugguccgcaccccucggccccgaccucaacccauaucucucccaccucgcccguauguacaacggcuacgccggcggguucgaaguccaagucauccuugccggaaacgcauucaccgcaggaaaagucauauucgccgccguacccccaaacuucccaacagaaggccuaucccccucccaagucacuauguucccccacauagucgucgacguccgccagcucgagcccguccucauaccccuccccgacguccguaacaacuucuaccacuauaaccaauccaacgacccuaccaucaaacucauugccaugcucuacacaccccuccgcgccaacaacgccggugacgacgucuucaccgucuccugccguguacucacccgacccucccccgacuucgacuucauauuccucguacccccuaccgucgagucccgcaccaaacccuucuccgucccgguccucacaguagaagaaaugaccaauucccgcuuccccauucccuuagaaaaacucuucacaggaccauccagcgcauucgucguacaaccucaaaauggacgauguaccaccgacggaguccuacuuggaacaacacaacucucccccguaaacauaugcaccuuucgcggugacgucacacacaucacaggcucacgcaacuacaccaugaaccucgccucccaaaauuggucaaacuacgaccccacugaagaaaucccagcuccccuggguacccccgacuucgucggcaaaauccaagggguccuaacccaaaccacacgaaccgacggaucaacuagaggccacaaagccacaguauacacugguucugcugauuucgcacccaaacuaggacgcguacaauucgaaaccgauacagaccgcgacuucgaaacuaaccaaaacaccaaauucaccccaguaggcgucauccaagacggaggcaccacccaccgaaacgaaccccaacaauggguacuaccuucauacuccggacgaaacaccccaaacguccaccucgcccccgccguagcccccacauuuccaggcgaacaacuacucuucuuccgcuccacaaugccagguugcuccggauaccccaacauggaucucgauugccuccucccccaagaauggguccaguacuucuaccaagaagccgcccccgcccaauccgacguagcucuccuccgcuucguaaauccagacaccggccguguacucuucgaaugcaaacuccacaaauccggcuaugucaccguagcacauacuggacaacacgaccucgucauaccaccaaacggcuacuuccgcuucgacucaugggucaaccaauucuacacccuagccccaaugggcaacggcacuggacgucgccgcgcccuauaa

SEQ ID NO: 36226 - RNA, 1623 nt, Artificial Sequence
  derived and/or modified sequence opt11 from VP1__Norovirus__AJA71405
augaagauggccucauccgacgcuaacccuuccgacggcuccgcagcaaauuuaguccccgaagucaacaacgaagucauggcacucgaaccagucguuggcgcagcaaucgccgcgcccgucgccggccaacaaaacgucauagaucccuggauccgaaacaacuucguccaagcaccuggcggcgaguucaccgucagcccacgaaaugcccccggcgaaauucucugguccgcuccccucggccccgaccuaaaccccuaccuaucccaccucgcacgcauguacaacggauacgccggcggcuucgaaguccaagucauccuggcaggaaacgccuucaccgccggaaaggucaucuucgccgcagucccucccaacuucccuaccgaaggccucuccccaucccaagucaccauguucccccacauaguaguagacguccgccaacucgaacccguccuaauaccccuccccgacguucgaaacaacuucuaccacuacaaccaaaccaacgaccccaccauaaaacucaucgccaugcucuauacaccccuccgagcaaacaacgccggagacgacguauucaccguauccugccgcguccuaacgcgaccaagcccagacuucgacuucaucuuccuggugccacccaccgucgaauccagaacuaaacccuucucgguucccguacucaccguagaagaaaugaccaacucccgauuccccaucccccuagaaaaacucuucaccggccccuccuccgccuucgucguacaaccacagaauggccgcugcaccacagacggcguccuccucgguaccacacaauuaagccccgucaacaucugcacauucagaggcgauguaacccacaucaccggcucccgaaacuacaccaugaaccuugccucccaaaacuggaacaauuacgacccaacagaagaaaucccugccccacucggaauccccgacuuuguaggcaaaauccaaggaaugcucacacaaacuacacgaaccgacgguuccacuagagggcacaaggcuaccgucuacaccggauccguagacuucgccccuaaacucggccgcguccaguucgaaacagauaccgaccacgacuucgaagccaaccaaaauacaaaauucacucccgucggcguuauccaagacggguccaccacucaccggaacgaaccccaacaauggguacuaccauccuacucaggacgaaacacccccaacguccaccucgcaccggccgucgcaccaacauuccccggcgaacaacuucuauucuuccgcuccaccaugccaggcuguuccggcuaccccaacauggaccucgacugccuacucccccaagaauggguacaauacuucuaccaggaagccgcccccgcacaaucagacgucgcccuccuucgauucgucaaccccgacaccggccgcguccucuucgaaugcaaacugcacaaauccggauacgucacagucgcacauaccggacaacaugaccucguaauaccaccaaacggcuacuuccgcuucgacuccugggucaaccaauucuacacccuagcucccaugggcaacggcaccggccgccgccgagcccuauaa

SEQ ID NO: 36227 - RNA, 1623 nt, Artificial Sequence
  derived and/or modified sequence opt11 from VP1__Norovirus__AJA71406
augaaaauggccuccuccgacgcaaaucccuccgacggcucagcagcgaaccucguaccggaaguuaacaacgaaguaauggcccuagaacccguuguaggcgccgcaaucgcagcacccgucgcaggccaacaaaacgucaucgauccauggauccgcaacaauuucguccaagccccuggaggcgaguucacagucucacccagaaacgcacccggcgaaauccuaugguccgcaccacucggccccgaccuaaaccccuaccucucccaccucgcccgaauguacaacggcuacgcaggcgguuucgaaguacaaguaauacucgccggcaacgccuucaccgccggaaagguaaucuuugcagcagugcccccuaacuucccaaccgaaggccucucacccucccaagucacaauguucccucacaucgucgucgacguccgccaacuagaaccgguacucaucccgcuccccgacguccgaaacaacuucuaccacuacaaccaaucuaacgacccaaccaucaaacuaauugccaugcucuacaccccacuccgcgcgaacaaugcaggcgacgacguauucacaguaucaugccgcguacuaacccgccccucucccgacuuugauuucaucuuccuaguaccacccaccguugaaucccgaacuaagcccuucucuguccccguccuaacagucgaagaaaugaccaacucacgcuucccaauccccuuagaaaaacucuucaccggaccauccuccgcauucgucguacaaccccaaaacggccgaugcaccacagacggcguccuccucggcaccacgcaacugucacccgucaacaucugcacauuccgcggcgacgucacacacauaaccggcucccgcaacuacaccaugaaccucgcaucccaaaacuggaacaacuaugaccccacggaagaaauccccgcaccucuaggcaccccagacuucguuggcaaaauacaagguguccuuacccaaaccacccgaaccgacggaucaacccgcggacacaaagcaaccgucuacacaggaucagcagacuucgcaccaaaacuaggccgcgugcaauucgaaaccgacaccgaucacgacuuugaagccaaucaaaacaccaaauucacaccagucgguguaauccaagacggcagcaccacccaccgcaacgaaccccaacaauggguacuccccucauacuccggccgcaacacgcccaaugugcaccuugcacccgccguagcccccacauuccccggagaacagcuacucuucuuccgcuccacaaugcccgguugcaguggcuacccaaacauggaccucgacugccuccucccucaagaauggguccaauacuucuaccaagaagccgcacccgcccaaucggacguagcacuacuacgcuucguaaaccccgacacuggccgcguccuauucgaaugcaaacuccacaaauccggauaugucaccguagcccacaccggacagcacgaccucgucaucccaccaaauggcuacuuccgcuucgacucaugggucaaccaauucuacacccuagccccaaugggaaacggcacaggccgccgccgugcacucuaa

SEQ ID NO: 36228 - RNA, 1623 nt, Artificial Sequence
  derived and/or modified sequence opt11 from VP1__Norovirus__AJA71407
augaaaauggccucuagcgacgcaaccccgucagacggaucggccgcaaaccucguccccgaagucaauaacgaaguaauggcccuugagccaguugucggcgccgcuauagcugccccuguagccggccaacaaaacgucaucgacccauggauacgaaauaacuuuguacaagccccaggaggcgaguucaccgucucccccagaaacgcacccggcgaaauacucuggucagcaccucuaggccccgaccucaaucccuaccuaucccaucuagcccgcauguauaacggcuacgccggcggauucgaaguucaagucauucucgcaggcaacgcauucaccgccggcaaagucaucuucgccgccguuccucccaacuuccccaccgaaggccucucccccucucaaguuaccauguucccacauauagucgucgacguucgccaacuagaacccguacucaucccccuacccgacguccgaaacaacuucuaccauuacaaccaaucuaacgaccccacaauuaagcucauagccaugcucuacacuccccuccgcgccaauaacgccggagacgacguuuucaccguauccugcagaguccucacacgcccuucccccgacuuugacuucauauuccuagucccacccaccgucgaaucucgcaccaaacccuuuucaguccccguccucacagucgaagaaaugaccaacuccagauucccaaucccccucgaaaaguuauucacaggccccucuuccgcauucgucguccagccccaaaacggacgcugcaccaccgacggcguccuccuaggcaccacccaacuaucccccgucaacaucugcaccuuccgcggagacguaacucacauaacaggaucccacaacuacacuaugaaccucgcaucacaaaacuggaacaacuacgauccaacagaagaaauacccgcaccacucggaacccccgacuucgucgguaaaauccaaggaguccuaacccaaaccacccgaaccgacggcuccacccgcggccacaaagcgacuguauacaccggcucugccgacuucgccccuaaacuaggccgaguucaauucgaaacagacaccaaccacgacuucgaagcaaaccaaaacacuaaauucacccccgucggcgucauacaagacggcuccaccacccaccgaaacgaaccgcagcaauggguccuccccagcuacuccggccgcaacacacacaacguacaccuggccccagcaguggccccaaccuuccccggcgaacaacuacucuucuuucgcucaaccaugccaggcugcucuggcuacccaaauauggaccucgacugccuucucccccaagaauggguacaauacuucuaccaagaagccgcacccgcccaauccgacguagcccuacuacgcuucguaaaccccgauacaggccgcguccuuuucgaaugcaaacuccacaaauccggcuacguaaccguagcccauacuggacaacacgaucucgucauucccccuaacgguuacuuccgcuucgacuccugggucaaccaauucuacacccucgcccccaugggcaauggcacaggcagacgcagagccgucuaa

SEQ ID NO: 36229 - RNA, 1623 nt, Artificial Sequence
  derived and/or modified sequence opt11 from VP1__Norovirus__AJA71408
augaaaauggcaagcuccgacgccaaucccagcgacggcucagcagcaaaccuaguacccgaagucaauaacgaaguaauggcacuagaacccguaguaggcgcagcaaucgccgccccugucgcuggacaacaaaacguuaucgaucccuggaucagaaauaacuucguccaagcgcccggaggcgaguucaccgucuccccacgaaacgcacccggagaaauccuauggucugccccucucggccccgaccucaacccauaccuaucccaccucgcccgcauguacaacggcuacgcaggcggcuucgaaguccaaguaauccucgcaggcaacgccuucaccgcaggcaaaguaauuuucgccgcaguacccccuaacuucccaacagaaggccuaucaccuucacaagucaccauguucccccacaucgucgucgacguucgccaauuagagccaguacuaauccccuuaccagacguccgcaacaacuucuaccacuacaaccaauccaacgacccaacaaucaaacucauagccaugcucuacacaccacuacgagcaaacaacgcaggagacgacguauucacuguaucaugccgcguacuaacccgccccucccccgauuucgauuucaucuuccuagucccucccacgaucgaaucacgaaccaaacccuucucgguacccguccucaccguagaggaaaugacaaacucacgauuccccauaccccuugaaaaacucuucaccggccccuccuccgccuucguaguacaaccccaaaacggacgcugcaccaccgacggaguacuccuaggcaccacacaacucuccccaguaaacauaugcacauuccgcggcgacgucacucacaucaccggcucccgcaacuacacaaugaaccuagcuucucaaaauuggaacaauuacgaccccaccgaagaaauccccgcaccccuaggcaccccagacuucgucggaaaaauccaaggcguccuaacccagaccacacgcacagacggcuccacacguggacacaaagccacagucuauacaggcuccgccgacuucagccccaaauuaggccggguccaauucgaaaccgacacugaccacgacuucgaagccaaccaaaacacuaaauucacuccagucggcguaauccaagacggcggcacaacacaccgcaacgaaccccaacaauggguauuaccaucauacucuggccgcaauacuccaaacguccaccucgcccccgccgucgccccuacauuccccggagaacaacuucucuucuuccgcuccaccaugcccggcugcucagguuaccccaacauggaucucgauugccugcuaccccaagaguggguccaauacuuuuaucaagaagccgcccccgcccagucagaugucgcauuacuccguuucgucaaccccgacacaggccgaguacucuucgaaugcaaacuccauaaaucuggcuacgucaccguggcccacacuggccagcacgaccuagucaucccacccaacgguuacuuccgauucgacuccugggucaaccaauucuacacccuagcacccaugggcaauggaaccggccgccgccgcgcccuauaa

SEQ ID NO: 36230 - RNA, 1623 nt, Artificial Sequence
  derived and/or modified sequence opt11 from VP1__Norovirus__AJA71409
augaaaauggccagcuccgacgccaaccccuccgacggcuccgcugccaaccuagucccagaagugaauaacgaaguaauggcccucgaaccagucgucggagcagccaucgcugcacccgucgccggccagcaaaacgucauagacccauggauccgaaacaacuucguacaagcccccggcggcgaguucacagugagcccacgcaacgcccccggugaaauacuauggucagcaccccucgggccggaccuaaaccccuaucucucccaccuagcccgaauguacaacggcuaugccggcgguuuugaaguccaagucauccucgcaggcaacgccuuuacagccggcaaaguaaucuucgcagccguaccuccaaacuuucccaccgaaggcuuaucccccucccaagucaccauguucccccacauugucgucgacguccgccaacuagaaccaguucucauaccacucccagacguccgaaacaacuucuaccacuacaaccaaucgaacgaccccaccaucaaacucaucgccaugcuauacacaccccuccgcgcaaacaacgccggagaugacgucuucacaguauccugccgcguccucacacgcccaucacccgacuucgacuucauauuucucgucccacccaccguagaaucuagaaccaaacccuucuccguacccguacucaccgucgaagaaaugaccaacucucgauucccaaucccucuagaaaaacucuucacaggcccguccucugcauucgucguccaaccacaaaauggccgaugcacaaccgauggaguucuccucggcacaacacagcucagcccagucaacaucugcaccuuccgaggugacgucacucacaucaccggaucaagaaacuacacuaugaaccuagccucccaaaacugguccaauuacgaccccacugaagaaaucccagccccacucggcacaccagacuucguagguaaaauacaaggcguacucacccaaaccacucgaaccgacggcagcacccgaggccacaaagccaccgucuacaccggcagcgccgacuucgcccccaaacucggccgaguccaauucgaaacagacaccgaccgagacuucgaaaccaaccaaaauacaaaauucacccccguaggcgucauccaagacggcggaacaacccaccgaaacgaaccccaacaauggguccucccuuccuauucaggccgcaacacccccaacguccaccuagcaccagccgucgccccaaccuucccuggcgaacaacuccucuucuuccgcucaaccaugcccggcugcuccggcuaccccaacauggaccucgacugccuacuaccccaagaauggguucaauacuucuaccaagaagccgcucccgcccaauccgacgucgcacuacuccgcuucguuaacccugacaccggccguguccuuuucgaaugcaaacuacacaaaucuggauacgucaccguagcucauaccggccaacacgaccucguaaucccacccaaugguuacuucagauucgacagcuggguuaaccaauucuacacccuagcccccaugggcaacggcaccggacgaagacgcgcccuauaa

SEQ ID NO: 36231 - RNA, 1623 nt, Artificial Sequence
  derived and/or modified sequence opt11 from VP1__Norovirus__AJA71410
augaaaauggccuccuccgacgccaaccccucugacggaucagccgcaaaccucgucccagaggucaacaacgaagucauggcccucgaaccaguaguaggggcagcaauagccgcccccguggccggacaacaaaacgucaucgaccccuggauacgcaauaacuucguacaagcccccgguggcgaguucacagucucacccagaaacgcuccuggcgaaauccucugguccgcaccccucggccccgaccucaaccccuaccucucacaccucgcccgcauguacaacggcuacgccggaggcuucgaaguacaagucauacuugccgggaacgccuucacugccggcaaaguuauauucgcagcugucccacccaacuuccccaccgaaggacugucccccucccaagucacaauguucccccacaucgucgucgacguccgucaacuggaacccguucuaauaccucuccccgacguacgcaacaacuuuuaccacuacaaccaauccaacgacccaacaaucaaacucaucgcgaugcucuacacaccccuccgagcuaacaacgcaggcgacgacgucuucaccgucuccugccgaguccucacccgcccuucccccgacuucgacuucaucuuccucguuccaccaaccgucgaaucacgcacaaaacccuucuccguccccgucuuaacaguagaagaaaugaccaacagucgcuuccccaucccccucgaaaaacucuucaccggcccaucuucagccuucgucguacaaccccaaaacggucgaugcacaaccgacggagugcuccucggaacaacccaacuaucgccugucaacaucugcaccuuccgcggcgauguaacccacaucaccggcucucacaauuacacaaugaaccucgccucccagaacugguccaacuacgacccaaccgaggagauccccgcaccccucggcacccccgacuucguaggcaaaauccaaggcguacucacacaaaccacacgaaccgacggcuccacccgaggacacaaagccaccgucuacacaggcuccgccgacuucgccccgaaacucggccgcguccaauucgagaccgacaccgaccgcgauuucgaagccaaccaaaacacaaaauucacccccgucggcgucauccaagacggcggcacaacucaccgcaacgaaccacaacaaugggugcuccccuccuacuccggccgaaacacaccaaauguccaccucgcccccgccgucgcccccaccuuccccggagaacaacuccuauucuuccgcagcaccaugccaggaugcucaggauacccuaacauggaccucgacugucuccucccccaagaauggguccaauacuucuaccaagaagccgcacccgcccaaucagacgucgcccuccuccgcuucgucaacccugacaccggacgaguacucuucgaaugcaaacuacacaaauccggcuacgucacaguagcucacacaggucaacacgaucucgucauacccccaaacggcuacuuccgcuucgacucaugggucaaucaauucuacacccucgcaccaauggguaacggcacaggacgaagacgcgcacuuuaa

SEQ ID NO: 36232 - RNA, 1623 nt, Artificial Sequence
  derived and/or modified sequence opt11 from VP1__Norovirus__AJA71411
augaaaauggccuccucggacgccaaccccagugacggcucagccgcaaaccuugucccagaaguaaacaacgaaguaauggcccuugaaccagugguaggagcagccaucgcagccccagucgccggucaacaaaacguaauagacccauggauacgaaacaacuuuguccaagcccccggcggggaguucacuguaucaccucgcaacgccccaggagaaauucucuggucagccccacucggaccagaccucaaccccuaccucagccaccucgcacgcauguacaacggcuacgcagggggcuucgaaguccaggucauacucgccggaaacgccuucaccgcaggcaaagucauuuucgccgcagucccucccaacuuucccaccgaaggacucuccccgucccaaguaaccauguucccucacauagucguagacgucagacaauuagaacccguacucaucccacuaccagacguccgaaacaacuucuaccauuacaaccaauccaacgaccccaccaucaaacucaucgcaaugcuauacacaccccuccgagccaacaacgccggagacgacgucuucaccgucuccugccgcguacucaccagacccucccccgacuuugacuucauauuucucgucccacccacagucgaaucacgcacaaaacccuucucaguccccguccugaccguugaagaaaugaccaacuccagauuccccauaccccuagaaaaacuauucaccggcccaucuuccgcuuucgucguccaaccucaaaauggacgcugcaccaccgauggcguacuccuaggcaccacucaacuaucccccguaaacauaugcacauuccgcggcgacguuacucacaucaccggcucacguaacuacacaaugaaucucgccucacaaaauugguccaauuacgaccccaccgaagaaauaccggccccucucggcacccccgauuuuguuggcaaaauacaaggaguccuaacccaaaccacccgaaccgacggcucuacccgcggacauaaggcaaccgucuacaccggcucagcagacuucgcccccaaacucggucgcguccaguucgaaaccgacaccgaccacgauuucgaagccaaccaaaacaccaaauucacccccgucggcguaauucaagacggaggaaccacccaccgcaacgaaccccaacaauggguccuccccagcuacuccggccgcaacaccccaaacguccaccucgcaccagcagucgcacccacuuuccccggcgaacaacuauuauucuuccguucaaccaugccagggugcuccggcuaccccaauauggaccucgacugccucuuaccccaagaauggguacaauacuucuaccaagaagccgcacccgcccaauccgacguagcccuacucagauucgucaacccagacacgggccgcguccucuucgaaugcaaacuacacaaaagcggcuacguaacagucgcccacaccggccaacacgaccucguaauacccccuaacggcuauuuccgauucgacuccuggguaaaccaauucuacacacuagcucccaugggcaacggaaccggccgacgccgcgcccucuaa

SEQ ID NO: 36233 - RNA, 1623 nt, Artificial Sequence
  derived and/or modified sequence opt11 from VP1__Norovirus__AJA71412
augaaaauggccucaucugacgccaacccuuccgauggcucagccgcaaaucucguccccgaaguaaacaacgaaguaauggcacucgagcccguagucggagcugcaauagcugcaccagucgcaggccaacaaaacgucauagacccauggauuagaaauaacuucgugcaagcccccggcggcgaguucaccguuagcccacgaaacgcccccggcgaaauccuguggucugcuccccucggcccagaucuaaaccccuaucucucucaccucgcacgcauguacaacggauacgcuggaggcuucgaagugcaagucauccucgcaggcaacgccuucaccgcaggcaaaguaauauucgccgccgucccucccaacuuccccaccgaaggccuaucccccucacaagucaccauguucccgcacaucgucgucgacguacgacagcucgaacccguacuaaucccccuccccgacguccgaaacaacuucuaccauuacaaucaauccaacgacccaaccauaaaacuaaucgcaaugcuauacacccccuuacgagccaacaaugccggcgacgacgucuucacuguauccugcagaguccucacacgaccaucccccgacuucgacuucauuuuccucgucccuccaacagucgaaucccgaaccaaaccauucuccgucccaguccucaccguugaagaaaugaccaacucccgcuucccaauaccccucgaaaaacuauucacuggaccuucgagcgccuucgucguacaaccacaaaacggucgcugcacaaccgacggaguccuccucggcaccacccaacucucaccagucaacaucugcacauuccgaggcgacgugacccacaucaccggcucccgaaacuacacuaugaaccucgccucacaaaacugguccaacuacgacccaaccgaagaaauccccgccccacucggaacgcccgacuucgucggcaaaauccaaggaguccucacacaaaccacccgcaccgacggauccacccgcggacacaaggcaaccgucuauacaggcucggccgacuucgcccccaaacucggccgaguucaauucgaaaccgacaccgaccacgacuucgaagccaaccaaaacacaaaauucacacccgucggcgucauacaagacggcggcacaacccaccgcaacgaaccacaacaauggguccugcccaguuacucaggccgcaacacccccaacguacacuuagcccccgccgucgcacccaccuuccccggagaacaacuacuauucuuccgcucuaccaugcccggcugcucaggauacccgaacauggaccucgacugccuccucccccaagaaugggugcaauacuucuaccaagaagcugcacccgcccaauccgacguagcacuacuccgguucgucaacccagacaccggccguguccucuuugaaugcaagcugcacaaaaccggcuacguaaccguagcccacacuggccaacacgaccuugucaucccacccaauggcuauuuucgauucgauuccugggucaaccaauucuacacccuggcacccaugggcaacggcacaggccgccguagagcacuauaa

SEQ ID NO: 36234 - RNA, 1623 nt, Artificial Sequence
  derived and/or modified sequence opt11 from VP1__Norovirus__AJA71413
augaaaauggccuccuccgacgccaaccccucagacggcucagcagccaaucuuguacccgaagugaacaacgaagucauggcccucgaacccgucgucggcgccgccaucgcugcaccaguugcaggacaacaaaacguaaucgaucccuggauccguaauaacuucguccaagccccaggcggcgaguucaccgucucccccagaaaugccccuggcgaaauccuauggucugccccucuaggucccgaccuaaaccccuaccucucccaccucgcacgcauguacaacggauacgcaggcggcuucgaaguacaggucauccuagccggcaacgccuucaccgccgguaaagucauauucgcugccgucccacccaacuuccccaccgaaggccucucacccucccaagucacaauguucccacacaucgucgucgacguccgccagcucgaacccguccucaucccccuuccugacguccgcaacaacuucuaccauuacaaccaaucaaaugaccccacaaucaagcucaucgccaugcucuacacaccucuccgagcaaacaacgcaggcgacgacguuuucacagucuccugccgcguacucacucgccccucccccgacuucgacuucaucuuucucgucccgcccaccguagaaucacggaccaaacccuucuccguccccguacuuacaguagaagaaaugacaaacucacgauuucccauaccccucgaaaaacucuucaccggucccuccagcgcuuucguaguccaaccccaaaacggccgaugcaccacagacggcguccuccucggaacuacacaacuauccccaguaaacaucugcacauuccgcggcgauguaacucauaucaccggaucaagaaacuacacaaugaaccuagccucccaaaacuggucuaacuacgacccaaccgaagaaauaccagcgccccucggcacccccgauuucgucggcaagauccagggcguccuaacccaaacaaccagaaccgacggcuccacccgcggccacaaagccacagucuacacaggcuccgccgacuucgcccccaaacucggccgcguacaauucgaaacugauacagaccacgacuucgaagccaaccaaaacaccaaauucacccccguaggaguaauccaagacggcucaaccacacaccgcaaugagccccaacaauggguucuccccucauacuccggccgcaacaccccaaacguccaccucgcccccgccgucgcccccacauuccccggagaacaacuccucuucuuccgaucaaccaugcccggaugcucuggcuaccccaacauggaccucgacugccugcucccacaggaauggguacaauacuucuaccaagaagccgccccagcccaauccgacgucgcccuccuccgcuucgucaacccagacacagggcgcguccuauucgaaugcaaacuacacaaauccggcuacguuaccgucgcccacacaggacaacaugaccucgugauaccacccaacggcuacuuccgcuuugacucauggguaaaccaauuuuacacccucgcucccaugggaaacggcaccggcagacgacgugccuuauag

SEQ ID NO: 36235 - RNA, 1623 nt, Artificial Sequence
  derived and/or modified sequence opt11 from VP1__Norovirus__AJA71416
augaagauggccuccucagacgccaaucccuccgauggauccgccgccaaccucguccccgaaguaaacaacgaagucauggcccucgaaccagucgucggcgccgccaucgccgcccccgucgcaggccaacaaaacguaaucgacccauggauacgcaacaacuuuguccaagcccccggcggagaguucaccguaagcccaagaaacgcuccaggcgaaauccuuuggucugccccacucggcccagaccucaaucccuaccucucccaccucgccagaauguacaacggcuacgcaggcggguucgaaguccaggucaucuuagcuggcaacgcauucaccgccggaaaggucauauucgccgccgucccacccaacuuccccaccgaaggccuaagccccucccaagucaccauguucccucacauagucgucgauguacgccaacucgaacccguucuaauaccccuaccagauguccgcaacaacuucuaccauuacaaccaaucaaaugacccuaccauaaaauuaaucgcaaugcuuuacaccccacuacgagccaacaacgccggugacgacgucuucaccgucuccugccgcguacucaccagaccauccccagacuucgauuuuaucuuccucgucccacccaccguagaauccagaacuaaaccauucucagucccaguccuaacaguugaagaaaugaccaacucccgauuccccauccccuuagaaaaauuauucaccggcccuagcagcgccuucguuguccaaccccaaaacggccgcugcaccaccgacggcguacuacuaggcacaacccaacuaucacccgucaacaucugcacauuccgcggcgacgugacccacaucacaggcucccgcaacuauaccaugaaccucgcaucccaaaacugguccaauuacgaccccacugaagaaauccccgccccauuaggcacccccgacuucguaggcaaaauacagggcguacucacacaaacaacccgcacugacggcuccacccgcggccacaaagccacagucuacacaggauccgcggacuucgccccaaaacucggccgaguccaauucgaaaccgacaccgaccgcgacuucgaagccaaccaaaacaccaaauucacaccaguaggcgugauccaggauggcuccaccacacaucgaaacgaaccccaacaauggguccugcccucuuacuccggccgaaacacccccaacguucaccuagcccccgccgucgcacccacuuucccaggcgaacaacuccuauucuuccgcaguacuaugcccggaugcuccggcuacccaaacauggaccucgacugucuccuaccacaagaaugggugcaauacuucuaccaagaagccgcucccgcccaaucagacgucgcacuacuacgauucgucaacccagacaccggccgcguacuauucgaaugcaaacuccacaaaucaggcuaugucacuguagcccacacaggccaacacgaccuugucaucccucccaacggcuacuuccgauucgacucaugggucaaccaauucuacacccucgcccccaugggcaacggcaccggacgucgccgagcacuauaa

SEQ ID NO: 36236 - RNA, 1623 nt, Artificial Sequence
  derived and/or modified sequence opt11 from VP1__Norovirus__AJA71417
augaaaauggcauccucugacgccaaccccucugacggaucugccgcgaaccucguccccgaagucaauaacgaagucauggcucucgaacccgucgucggcgcagcaauagccgcacccgucgccggccaacaaaacgucaucgaccccuggauccgcaacaacuucguacaagcacccggaggagaguucaccgucuccccacgcaacgcacccggcgaaauacucugguccgcaccacuaggacccgaccuaaacccauaucucagccaucuagcccgcauguacaacggauaugccggcggcuucgaaguacaaguaauacuagccggaaacgccuucaccgccggcaaagucaucuucgccgcagucccucccaacuuucccaccgaaggccucucacccucccaaguaaccauguucccccacaucgucgucgacguccgccaacuagaacccguacucauaccgcuucccgacguccgaaauaacuucuaccacuacaaccaguccaacgauccaaccauaaaacucaucgcgaugcuauacacaccccuacgcgccaauaacgccggcgaugacgucuucaccguaagcugccgcguccuaacccgccccucccccgauuucgacuucauauuccucguuccacccaccgucgaaucccguacuaagcccuucagcguccccguacucacaguagaagaaaugacgaacucccgauuccccaucccccucgaaaaacucuucacaggucccuccuccgcauuuguaguccaaccccaaaacggacgcuguaccacugacggcguccuacucggaaccacccaacuauccccuguaaacaucugcacuuuccgcggagacgucacccacauaaccggcucccgcaacuacaccaugaaccucacuucccagaacugguccaauuacgaccccaccgaagaaaucccagcaccccugggcacccccgacuucgucggaaagauccaaggcaugcuaacccaaacuacccgcaccgacggauccacacgcggucacaaagccacggucuacacaggcucagccgacuucgcccccaaacucggccgaguccaauucgaaaccgacaccgaccacgacuucgaagccaaccaaaauaccaaauucaccccagucggcgucauacaagacgggucaacgacccaccgaaacgaaccacaacaauggguccuacccuccuauuccggcagaaacaccccaaauguucaccucgccccagccgucgcaccaaccuuucccggcgaacaacuacucuucuucagaucaacaaugcccggauguuccggcuaccccaacauggaucuagauugccuucuaccacaagaguggguacaauacuuuuaccaagaagccgcgccagcccaaucagaugucgcccuacuccguuuugucaaccccgacaccggccgaguccuauucgaaugcaaacuacacaaaucaggcuacguaaccguagcccacaccggccaacacgacuuagucauaccacccaacggcuacuucagauucgacucuugggucaaccaauucuacacacucgcccccaugggcaacggcaccggccgccgccgugccuuauaa

SEQ ID NO: 36237 - RNA, 1623 nt, Artificial Sequence
  derived and/or modified sequence opt11 from VP1__Norovirus__AJA71418
augaaaauggcaucauccgacgccucccccucagacggaucagccgccaaucucguacccgaagucaacaacgaagucauggcccuagagccuguaguaggagcagccaucgccgcccccgucgccggccaacaaaacgucaucgaccccuggauaagaaacaacuucguacaagcccccggcggagaguucaccgucucuccccgcaacgcccccggcgaaauacuaugguccgcaccccucggcccagaccucaaucccuaccucucccaccuagcacgcauguacaacggcuacgccggcggauucgaaguccaagucauccucgcaggcaacgcauuuacagccggaaaagucaucuucgccgccguaccuccaaauuucccaaccgaaggucucuccccaucccaagucaccauguucccacacaucgucgucgauguccgccaacucgaacccguccucaucccccucccagacguccgcaacaacuucuaccacuacaaccaaucaaacgaccccaccaucaaacucaucgccaugcuauauacuccacuccgcgcgaacaaugccggugacgacgucuucacagucucaugccgcguccucacucgacccucccccgacuucgauuucauauuccugguacccccaacugucgaaucucgcaccaaaccuuucucagucccaguccuuacaguagaggaaaugaccaacucaagauucccaaucccccuagaaaaacuauuuaccggccccagcuccgcauucgucguccagccacaaaauggccgcugcaccacagacggcgucuuacucggcacaacccaauuaucccccguaaacaucugcaccuuucgaggggacgucacucacaucaccggcuccagaaauuacacaaugaaccucgcuucccaaaacuggucaaacuacgaccccaccgaagaaauccccgcaccccuaggaaccccugacuucgucggaaaaauucaaggaguacucacccagaccacacgaaccgacggaucaacucguggacacaaagccaccguauacaccggcucagccgauuucgccccaaaacuuggacgaguacaauuugaaaccgacacagaccacgacuucgaagccaaccaaaacaccaaauucacucccgucggcgucauccaagacggcggcacaacacaucgaaacgaaccccaacaauggguucuccccuccuacucaggccgcaacacccccaacguccaccucgccccagcaguagcacccacauuccccggcgaacaacuacuauucuuccgcucuacaaugccuggcugcuccggguaccccaacauggaccuugacugccuccucccacaagaauggguucaauacuucuaccaagaagccgccccagcacaauccgacgucgcccuacuccgauucguaaaccccgauacuggcagaguccuauucgaaugcaaacuacacaaauccggcuacgucaccguagcgcacacaggccaacacgaccucgucaucccacccaacggcuacuucagauucgacuccuggguaaaucaauucuacacucucgcucccaugggcaacggcaccggaagacguagagcccucuaa

SEQ ID NO: 36238 - RNA, 1623 nt, Artificial Sequence
  derived and/or modified sequence opt11 from VP1__Norovirus__AJA71419
augaaaauggccucuuccgacgccucccccuccgacggcuccgcugccaaccucguccccgaagucaacaacgaagucauggcccuagaacccguagucggcgcagccauugccgcccccgucgcaggccaacaaaacgucaucgaccccuggauccgcaacaacuucguucaagcccccggcggcgaauuuacgguuagcccccgcaacgcucccggagaaauacucugguccgcaccacuaggccccgaccucaaucccuaccucucccaccucgcccguauguacaacgguuacgcaggaggguucgaaguacaagucauucucgccggaaacgccuucaccgccggcaaaguaaucuucgcagcaguaccacccaacuuccccaccgaaggccuaucccccucacaaguaaccauguucccgcacaucgucguagacguucgccaacucgaaccuguacuaaucccccuccccgauguccgcaauaauuucuaucacuacaaccaaucaaacgacccaacaaucaaacucauugccaugcuguacacgccccuccgcgccaacaacgcaggcgacgacgucuucacuguauccugccgaguacucacacgccccucaccagacuuugacuucaucuuucuaguacccccaacagucgaaagccgaaccaaacccuucucaguccccguccucaccgucgaagaaaugaccaacucccgcuucccaauaccccucgaaaaacucuucacuggcccaucauccgccuucgucguccaaccccaaaacggucgcugcaccaccgacgguguccuccucggaacaacccagcuaucccccgucaauaucugcaccuuccgaggcgaugucacccacauaaccggcucccgaaacuacaccaugaaccucgcgucccaaaacuggucuaacuaugaccccaccgaagaaauacccgcuccccuaggcacccccgacuucgucgguaaaauccaagguguucucacucagaccacccgaacagacgguuccacacgcggacacaaagccaccgucuacaccggcucagccgacuucgcaccaaaacuaggccgcguccaauucgaaaccgacacagaccacgacuucgaagccaaccaaaacacaaaguucacaccaguaggcguaauccaagacggcggcaccacccaccgaaaugaaccccaacaauggguccuacccuccuacuccggccgcaacacccccaacguccacuuagcacccgccguagcccccaccuucccaggcgaacaacuacucuucuuccgcuccacaaugcccggcugcucaggauaucccaacauggaccuugacugccuacuaccccaagaauggguccaauauuucuaccaagaagccgcccccgcucaguccgacguugcccuacuccgauuuguaaacccagacacaggccgcguacucuucgaaugcaaacuucacaaauccggauacguaaccgucgcccauacaggacaacacgaccuggucaucccacccaacggauacuuccguuucgacuccugggucaaccaauucuacacacucgcccccauggguaacggcaccggacgccgucgagcucucuaa

SEQ ID NO: 36239 - RNA, 1623 nt, Artificial Sequence
  derived and/or modified sequence opt11 from VP1__Norovirus__AJA71420
augaaaauggccuccuccgaugccaacccaucagacggcuccgccgccaaccuuguccccgaagucaacaacgaggucauggcccucgaaccaguugucggagccgccaucgccgcccccguagccggacagcaaaacguaaucgaucccuggauccgaaauaacuucguacaggcccccggaggugaguucacgguaucgccccgaaacgcaccuggagaaauacucugguccgcuccacucggccccgaccucaacccauaccucucucacuuagcccgcauguacaacggauacgccggcggcuucgaaguacaagucauccucgcaggaaacgccuucaccgcaggcaaagucaucuucgccgccguaccacccaacuuccccaccgaaggccucucccccucccaaguuaccauguuuccacacaucgucgucgacguacgacaauuagaacccguucucauaccucucccagacgucagaaacaacuucuaccacuacaaccaauccaacgacccuaccaucaaacucaucgcgaugcucuacacaccccucagagccaacaaugcaggcgacgaugucuuuaccgucuccugccgcguacuuacccgacccagccccgacuucgacuucaucuuccucguaccacccaccgucgaaagccgcaccaaacccuucagcguccccguccucaccguggaagaaaugaccaacucccgauuccccaucccccuagaaaaacucuucaccggccccuccucagccuucgucguccaaccacaaaacggacgaugcacuaccgacggcguucuucucgguacaacccaacuaucacccgucaacauaugcacauuccgaggcgacgucacccacauaaccggcucccgaaacuacaccaugaaccuugcaucccaaaacugguccaacuacgaucccacugaagaaaucccagcaccacucggcaccccagacuucgucggaaaaauccaaggaguucuaacacaaaccacucgcacagacggcucaacccgaggacacaaagccaccguauacaccgggucagccgacuuugcccccaaacucggucgcguacaauuugaaacagacaccgaccacgacuucgaagccaaccaaaacacuaaauucacacccguuggcgucauacaagacggcagcacaacacaccgaaaugaaccgcaacaauggguacuacccagcuacuccggucgcaacaccccuaacguccaccuagcucccgccguagcccccacauuccccggcgaacaacuccuauucuuccgauccaccaugccaggaugcucaggcuaccccaacauggaccuugacugucuccucccccaagaaugggugcaguacuucuaccaagaagccgcccccgcccaauccgacgucgcacuccuccgcuuuguaaacccagacacaggccgaguccucuucgaaugcaaacuacacaaauccggcuacgucacaguagcacacaccggucaacacgaccucguaaucccacccaauggcuacuuccgcuucgauuccugggucaaccaauucuacacccucgcccccaugggcaauggcacaggccgccgucgugcccuuuaa

SEQ ID NO: 36240 - RNA, 1623 nt, Artificial Sequence
  derived and/or modified sequence opt11 from VP1__Norovirus__AJA71421
augaaaauggccuccuccgacgcaaaccccucagacggcucagcagccaaccuaguccccgaaguaaacaacgaaguuauggcgcuugaaccaguugucggcgccgccaucgcggcacccgucgcaggacaacagaacguaaucgacccauggauacgcaacaacuucguccaagcacccggaggagaguucaccguauccccacgaaacgcgcccggcgaaauacucugguccgccccuuuaggccccgaccuaaaccccuaccucucccaccuagcccgcauguacaacgguuacgcuggcggcuucgaaguacaaguuauccuagcaggcaacgccuucacagccgguaaagucaucuucgcagccgucccucccaacuuccccacugaaggccucagccccucccaagucaccauguucccucacaucgucgucgacguuagacaacucgagcccguccuaaucccccuccccgacguucgcaacaacuucuaccacuauaaucaauccaaugaccccaccauaaaacucaucgccaugcucuacacuccacuccgcgccaacaacgcaggcgacgacguuuucacagucuccugccgaguccucacucgacccuccccugacuucgacuucauauuccucgucccaccaaccguagaauccaggaccaagcccuucuccgugcccguccuuacugucgaagaaaugacaaacucccgcuuccccaucccccuugaaaaacuguucaccggacccuccucagcauucgucguccaaccccaaaacggacgcugcaccacugacggcguccuccuugguaccacccaacucagccccgucaacauaugcaccuucaggggagacguaacccacauaacaggaucccgcaacuacaccaugaaccucgccucacaaaacuggucaaacuacgacccaaccgaagaaauucccgcuccucucggcacccccgacuucgucggcaaaauccagggcguccucacacaaaccacccgaaccgacgguuccacacguggucacaaagcuaccguauacacaggcuccgccgacuuugcaccaaaacucggacgcguccaauucgagaccgacaccgaccacgacuucgaagccaaccaaaacaccaaauucaccccaguaggaguaauccaagauggcggcacaacccaccgaaacgaaccacaacaauggguucuccccucuuacucaggacgcaacacccccaacguccaccucgcccccgccgucgcacccacauuccccggagaacaacuccucuucuuccgcagcaccaugccagguugcuccggauaccccaacauggaucucgacugccuccuaccacaggaauggguacaauacuucuaccaagaagccgcccccgcacaauccgacguagcacuacuccgcuucgucaauccagacaccggccgcguccucuucgaaugcaaacuccacaaauccggcuacgucaccguagcccauaccggccaacacgaccucguaaucccacccaacggcuacuuccgcuucgacuccugggucaaccaauucuacacgcuagccccaaugggcaacggaaccggccgacgccgcgcccucuaa

SEQ ID NO: 36241 - RNA, 1623 nt, Artificial Sequence
  derived and/or modified sequence opt11 from VP1__Norovirus__AJA71422
augaaaauggcaucuuccgacgccaacccaagcgacggcuccgccgcuaaccucguccccgaaguaaacaacgaaguaauggcucuagaacccgucguaggugccgccauagccgccccaguagccggccaacaaaacguuaucgaccccuggaucagaaacaacuucguacaagcuccaggaggagaguucaccgucuccccacgcaacgccccaggagaaauccuaugguccgccccacuaggccccgaccucaaccccuaucucucccacuuggcccggauguacaacggauacgcaggcggauucgagguccaaguaauucucgcaggcaacgccuucacagcuggcaaggucaucuucgcagccguacccccaaacuuccccacagaaggacucucccccucacaagucaccauguucccccacauagucgucgacguucgacaacucgaaccgguacuaauaccacuacccgacguccgcaacaacuucuaccacuacaaccaauccaacgacccaacaauaaaacucauagccaugcucuacaccccacuccgcgccaacaacgccggagacgacguauucaccgucucaugucguguccucacucggccaucacccgacuucgacuucaucuuccucgucccuccuaccaucgaaucacgcaccaaacccuucagcgucccaguccucaccguagaagaaaugacaaacucccgauucccaaucccccucgaaaaacuauucacaggccccuccucagccuucguaguacaaccccaaaacggcagaugcacuaccgacgguguccuccuuggaaccacccaacuaucccccgucaacaucugcaccuuccgcggcgacgucacccacaucacgggaucccgaaacuacacuaugaaccuugccucacaaaauuggaacaacuaugacccaaccgaagaaauccccgcaccccucgguacacccgacuucgucggcaaaauacaaggaguccucacacaaacuacccgcacagacggaucaacacgaggucacaaagccaccgucuacaccggcuccgccgacuucuccccaaaauuaggacguguucaauucgaaaccgacaccgaccacgacuucgaagccaaccagaacaccaaauucacccccgucggcgucauccaagacgguggaacuacccaccgaaacgaaccacagcaguggguacuccccuccuacuccggucgaaacacucccaacguccaccuagcccccgcagucgcaccaaccuuccccggagaacaacuacuauucuuccgauccaccaugccuggcugcuccggguaccccaacauggaccuagauugccuauuaccccaagaauggguccaguacuucuaccaagaagcagcccccgcacaaucagacgucgcccuccucagauucguaaaccccgacaccggccgcgucuuauucgaaugcaaacuccacaaaucaggcuacgucaccgucgcacacaccggccaacacgaucuuguaaucccacccaacggcuauuuccgcuucgacagcugggucaaccaauucuacacccucgcaccaaugggcaacggcacuggcaggagacgcgcauuauaa

SEQ ID NO: 36242 - RNA, 1623 nt, Artificial Sequence
  derived and/or modified sequence opt11 from VP1__Norovirus__AJA71423
augaaaauggccuccagcgacgccaaucccuccgacggguccgccgcaaaccucguccccgaagucaacaaugaagucauggcccucgaacccgucgucggcgccgccaucgcagcucccguagcuggccagcaaaacguaauagacccauggauccgcaacaacuucguacaagccccaggcggagaguucaccguaucuccccgcaaugcccccggcgaaauacuaugguccgccccacuuggccccgaccucaacccauaccuaucccaccucgcacgaauguacaacggauacgccggcgguuucgaaguccagguaauccuggccggaaacgccuucacagccggcaaaguaaucuucgcugccgucccacccaacuuucccaccgaaggccucucacccucccaagucaccauguucccacauaucgucgucgacguccgccaacucgaaccuguucucaucccccuacccgacgucagaaacaacuucuaccauuacaaccaauccaacgaccccaccaucaaacucaucgccaugcuguacacuccccuccgcgccaacaacgccggcgacgacgucuucaccguaucuugccgcguccuaacccgccccucuccagacuucgacuucaucuuccuaguaccaccaaccguagaaucccgcaccaaacccuucucagugccaguccuuaccgucgaagaaaugaccaacucccgguuccccaucccccuugaaaaacuauuuaccggcccaagcuccgcuuucgucguccaaccccaaaacggacgcugcaccacugacgguguccuccucggcaccacccaacuaucacccgucaacaucugcacauuccgcggcgacguaacacauaucaccggaucgcgcaacuacaccaugaaccuggcaucccaaaauugguccaacuacgaucccaccgaagaaauccccgcaccccuaggcaccccagacuucgucggaaaaauccaagguaugcuaacccaaacaacccgaaccgacggauccacccgcggccacaaagccaccgucuacaucggcggagccgacuucgcccccaaacucggacgcguccaauucgaaaccgauaccgaccaugacuucgaagcgaaccaaaacacaaaauucacccccguaggcgucauccaagacggcucaacuacccaccguaacgaaccccaacaauggguccuccccuccuacucaggccgcaacaccccuaacguccaccuagcucccgccgucgccccaaccuuccccggcgaacaacuccuauucuuuagaucaacaaugccaggaugcuccggauaccccaacauggaccuagacugccuccuuccacaagaauggguccaauacuucuaucaagaagcagcccccgcacaaucagacgucgcacuccuccgcuucgucaacccugauaccggacgaguccuauucgaaugcaaacuccauaaaucaggcuacgucacagucgcccacaccggccaacacgaccucgucauaccacccaacggcuauuuccgcuucgauucauggguaaaccaauucuacacccucgcacccaugggcaacggcacaggccgccgccgggcccucuaa

SEQ ID NO: 36243 - RNA, 1623 nt, Artificial Sequence
  derived and/or modified sequence opt11 from VP1__Norovirus__AJA71424
augaaaauggccuccuccgaugcaaaucccagcgacgguuccgccgccaaucucguccccgaaguaucaaacgaagucauggcccucgaacccgucguaggagcagcaaucgcagcaccuguagccggccaacaaaacgucaucgaccccuggauacguaacaacuucguacaagcccccggaggugaauuuacaguaucuccccgaaacgcaccuggcgaaauccuaugguccgcaccccuaggcccagaccuaaaccccuaccucucacaccucgcccgcauguacaacggcuacgccggaggcuucgaaguccaagucauccucgccggaaacgcuuucaccgcaggcaaagucaucuucgccgccguaccacccaacuuccccacagaaggacuaucccccucccaaguaacgauguucccccacauagucgucgauguccgacaacucgaaccaguacuaauuccccuccccgacguaagaaacaacuucuaccacuacaaccaauccaacgaccccacaaucaaacuaauagccaugcucuacaccccacuccgcgcuaacaacgccggcgacgaugucuucaccguauccugucgagugcucacccgccccucccccgacuucgacuucauauuccucguacccccaacagucgaaucccgaaccaagcccuucuccguccccguccucacugucgaagaaaugacuaacucccgcuuccccaucccccuagaaaaacucuucacaggaccauccuccgccuucgucguacaaccccagaacggacguugcacaaccgacggaguacuccuuggaacaacccaacuuuccccaguuaacaucugcaccuuccguggcgacgucacacacauuaccggcucucgaaacuacaccaugaaccuugccucucaaaauugguccaacuacgaccccacugaagaaauacccgcaccucucgguacccccgacuucgucggcaaaauacaaggaaugcucacacaaacaacccgaacagacggcucaacacgaggccacaaagccaccguauacaccggcagcgccgacuucgcaccaaaauugggccgcguccaauucgaaaccgacacagaccacgacuucgaagcuaaucaaaacaccaaauucacacccguaggcgucauccaagacggcuccaccacccaccgaaacgaaccucaacaauggguccuacccuccuacuccggccgaaauaccccuaacguucaccuagccccagcagucgcacccacuuuccccggcgaacaacuccuauucuuccgaucaaccaugccuggcugcucaggcuaccccaauauggaccucgauugccuacucccccaagaauggguacaauacuucuaccaagaagccgcccccgcccaauccgacgucgcgcuccuccgcuucguaaaccccgacaccggacgcguccucuucgaaugcaaacuacacaaaagcggcuacguaaccgucgcccacaccggccaacacgaccuagucauacccccaaauggcuacuuccgauucgacucaugggucaaccaauucuacacucuagcccccaugggcaacggcaccggacgaaaacgcgcgcucuaa

SEQ ID NO: 36244 - RNA, 1623 nt, Artificial Sequence
  derived and/or modified sequence opt11 from VP1__Norovirus__AJA71425
augaaaauggccucauccgacgcaaaucccucugacggauccgccgcuaaccucguacccgaaguaaacaacgaagucauggcacucgaacccgucguaggcgccgcaaucgccgcccccguagccggccagcaaaacgucaucgaccccuggauacgcaacaacuucguccaagcccccggcggcgaguucaccguuucaccccgaaacgcccccggcgaaauacucuggucggcaccacuaggccccgaccucaaccccuaccuaagccaccuagcacgcauguacaacgguuacgccggcggcuucgaaguacaagucauucucgcagguaaugcauucacagccggaaaaguaaucuucgcugccgucccgcccaacuuccccaccgaaggccuuucacccagccaaguaaccauguucccccacaucguagucgacguacgacaacucgaaccaguacucauuccccucccagacguccgcaacaacuucuaccauuacaaccaauccaacgacccgaccauaaaacucaucgcaaugcucuauacaccccuaagagccaacaacgcuggugacgacguuuucaccguauccugccgaguccucacccgacccucaccugacuucgacuucaucuuccucguaccgcccaccguagaaucucgcaccaaacccuucuccguacccguacuaaccguugaagaaaugaccaacucacgauucccugucccccuagaaaaacucuucaccggcccuuccucagccuucguaguacaaccccaaaacggacgcugcacuaccgacggcguacuacucggcaccacccaacucucccccgucaauaucugcacauuccgcggcgacgucacccacaucaccggcucccacaacuacaccaugaaccuagccucccaaaacuggucaaacuaugaccccacugaagaaauacccgcuccccucggcacccccgacuucgucggcaaaauccaaggcguccuaacccaaacaacccgcacagacggcucaacucgcggacacaaagccacagucuacaccgggagcgccgacuucgcccccaaacucgggagaguacaauucgaaaccgacaccgaccgcgacuucgaagccaaccaaaacacaaaauuuacaccagucggcguaauacaagacggaggaacuacccaucgcaacgaaccccaacaauggguacuccccucauacucaggccgaaacaccccaaauguucaccuagcccccgccguagcaccaacuuuccccggcgagcaacuacuuuucuuccgauccaccaugcccggaugcucaggcuaccccaacauggaccucgacugccuacucccccaagaauggguccaauacuucuaccaagaagcugcccccgcacaauccgacguugccuuacuccgguucgucaauccagacacagggcgcguccucuucgaaugcaaacuucacaaauccgguuacguaaccgucgcccacacaggccaacacgaccucgucaucccacccaacggcuacuucagauucgauucaugggucaaccaauuuuacacgcucgcaccaaugggaaacggcacuggccgccgccgcgcccuguga

SEQ ID NO: 36245 - RNA, 1623 nt, Artificial Sequence
  derived and/or modified sequence opt11 from VP1__Norovirus__AJA71426
augaaaauggcuuccuccgacgcaaaccccucagacggcucugcagccaaccuaguacccgaagucaacaacgaagucauggcccuagaacccguagucggcgcagcaaucgcugccccaguagccggacaacaaaacgucauugaccccuggauucgaaacaacuucguccaagcacccgggggcgaauuuaccguaagcccccgcaacgcccccggggaaauccucuggucggccccacucggcccagaccucaacccauaccuaucccaccuggcacgaauguacaaugguuacgccggagguuucgaaguacaagucauucuagcgggcaacgcauucacagccggcaaagucaucuucgcugcaguacccccgaacuucccaaccgaaggucucucccccucacaagucaccauguucccacacauaguaguugacguacgccaacucgaacccguucucauuccacuacccgacgucaggaacaauuuuuaccacuacaaccaauccaacgaccccaccauaaaacuaaucgcuaugcuguacacgccccuucgagcaaacaacgccggagacgacgucuucaccgucuccugccgaguacuaaccagacccuccccugacuucgacuucaucuuuuuagucccacccaccgucgaaucccgcacaaaacccuucuccguccccguacuaacagucgaggaaaugaccaacagccgcuuccccaucccccucgaaaaacucuucaccggcccauccucggcauucguuguccaaccucaaaacggacgcugcaccacagacggcguccuccuugguaccacccaacucucacccguaaacaucugcaccuuccgcggcgacguaacccacaucaccggaagccgaaacuacaccaugaaucuagccucccaaaacugguccuccuaugacccaaccgaagaaauacccgccccauuaggcacaccagacuucgucgguaaaauccaaggaaugcucacccaaacaacccgcacagacggcucaacacgcggccacaaagccacaguuuacacgggauccgcugacuucgcccccaaacuuggacgaguccaauucgaaaccgacaccgaccacgacuucgaagccaaccaaaacaccaaguucaccccugucggcguaauccaagacggcucaaccacccaccgcaacgaaccccaacaauggguccucccuuccuacuccggccgcaacacccccaauguccaccuagcucccgccgucgcccccaccuuccccggcgaacaacuccuuuucuuucguuccaccaugcccggcugcucaggcuaccccaacauggaccuagacugccuccucccccaagaauggguacaauacuucuaccaagaagcagcacccgcucaauccgacgucgcccuacuccgcuucguaaaucccgacacaggucgcguccucuucgaaugcaaacuccacaaaucaggauacguaaccguagcacacacaggccaacacgaccuaguaaucccucccaacggauauuuccguuucgacagcugggucaaccaauucuacacucucgcacccaugggcaacggcaccggcagacgucgagcccucuaa

SEQ ID NO: 36246 - RNA, 1623 nt, Artificial Sequence
  derived and/or modified sequence opt11 from VP1__Norovirus__AJA71427
augaaaauggcuucauccgacgccaaccccucagacgguuccgcugcaaaccucgucccagaagucaacaacgagguaauggcccuagaacccguagucggcgcagccauagccgcaccagucgccggccaacaaaacgucaucgacccauggauacgcaacaacuucguacaagccccaggcggugaguucacaguaucaccccgaaacgcccccggagaaauccuaugguccgcuccccuuggcccagaccucaaccccuaccuaucccaccuagcccgaauguacaacggcuaugccggaggcuucgaaguacaagucauacuagccggcaacgccuucaccgcugggaaaguaauauucgccgccgucccacccaacuuccccaccgaaggccuuuccccaagccaagucaccauguucccccacauuguaguugauguccgccaacucgaaccaguacucaucccccuacccgacguccgcaacaacuucuaccacuacaaccaauccaacgacccuacaauaaaacuaaucgccaugcucuacacaccccuccgggccaacaacgccggagacgaugucuucaccgucuccugccgcguccugacaaggcccucccccgacuucgacuucauauuccucguacccccaaccgucgaaucccgaaccaaacccuucuccgucccaguccucaccgucgaagaaaugaccaacucccgcuuuccuauaccccuagaaaaacuuuucaccggccccucuuccgccuucguuguccaaccucaaaacggccgcugcaccacagacggcguucuccuuggcacaacccaacuuucacccgucaacaucugcacauucagaggagacgucacccacaucaccggaucacgcaauuacaccaugaaccuagccagccaaaacuggggaaacuacgaucccaccgaagaaaucccagcccccuuaggcacacccgacuucguaggaaaaauccaaggcguacucacccaaaccacccgcacugacggcuccacaagaggccacaaagccacugucuacaccggcuccgccgacuucgcccccaaacuaggaagaguccaauucgaaaccgacaccgaucacgacuucgaagccaaccaaaacacuaaauucacccccguaggagucauccaagacggaagcaccacacacagaaacgaaccacaacaauggguccuccccucauacucuggaagaaacacuccuaauguacaccuugcuccagccgucgcgcccaccuuccccggggaacaacuacuauucuucagauccaccaugcccggcugcucuggauacccuaacauggaccucgacugccuccucccccaagaauggguucaauacuucuaucaagaagcagcuccagcccaaucagacgucgcacucuuacguuucgucaacccagacaccggacgcguccucuucgaaugcaagcuacacaaauccggcuacgucacagucgcccacaccggccaacacgaccucguuaucccacccaacggcuacuuccguuucgacuccuggguaaaucaauucuacacccuagcccccaugggaaacggcaccggccgccgccgagccuuauaa

SEQ ID NO: 36247 - RNA, 1623 nt, Artificial Sequence
  derived and/or modified sequence opt11 from VP1__Norovirus__AJA71428
augaaaauggccucuuccgacgcaaaccccuccgacggcagcgccgcgaaucuagucccagaagucaacaacgaagucauggcacuagaaccaguagugggagccgcaaucgccgcacccguggccggacaacaaaaugucaucgaccccuggauacgcaacaacuucguccaagccccuggcggcgaguucaccguaucaccucgcaacgcccccggcgaaauacuuugguccgcaccccucggccccgaccucaaccccuaccucucacaccuagcccgaauguauaacggcuacgccggcggcuucgaaguccaagucauacuagccggaaacgccuucacagcuggcaaagucauauucgccgccguaccacccaacuuccccacagaaggccuaucucccucccaagucaccauguuuccccacaucgucguagacguccgccaacucgaaccaguccucaucccccucccagauguccggaacaauuucuaccacuacaaccaauccaacgacccgaccauaaaacucaucgccaugcuauacaccccacuacgcgccaacaacgccggagacgacguauucaccguauccugccgcguucucacacgucccucaccagacuucgacuucaucuuccucgucccacccacugucgaaagucgcaccaaaccuuucuccgucccaguacucacagucgaagaaaugaccaacucccgcuucccaaucccccucgaaaaacuuuucaccgguccauccucagccuucgucguccaaccccagaauggccgcugcaccacagacgguguccuacucggaacaacccaacucuccccagucaacaucugcaccuuccgcggcgacguaacacacauuaccggcucccauaacuacaccaugaaccucgccucccagaacuggucaaacuaugaccccacagaagaaaucccagcuccccucggaaccccagacuucguaggcaaaauccagggaguccucacccaaaccacccgcacagacgguucuacccguggccacaaagcaacggucuauaccggauccgcagacuucgcacccaaacuaggacgcguacaauucgaaaccgacacugaccgcgacuucgaagccaaccaaaacaccaaauucacccccgucggaguaauacaagacggcggaacgacccaccgcaacgaaccacaacaauggguccuccccucauacuccggacgcaacaccccaaacguccaucuagcacccgccgucgcccccacauuccccggcgaacaacuccucuuuuuccggucaaccaugcccggcugcuccggcuacccaaacauggaucuagauugccuccuaccgcaagaauggguccaauacuucuaccaagaagcagcccccgcccaauccgacgucgcccuucuacgcuucgucaaccccgacacaggacgaguccuguucgaaugcaaacuacacaaauccggauacguaaccgucgcccacacaggacaacacgaucucguaaucccacccaacggcuauuuucgcuucgacucauggguuaaucaauucuacacccucgcacccauggguaacgguacgggccgccgccgcgcucucuaa

SEQ ID NO: 36248 - RNA, 1623 nt, Artificial Sequence
  derived and/or modified sequence opt11 from VP1__Norovirus__AJA71429
augaaaauggccuccuccgacgcaaacccuuccgacggauccacugccaaccucgucccagaaguaaacaacgaaguuauggcucuagaacccgucguuggagccgccaucgcagcacccguugcaggccaacaaaacgucaucgacccuuggauccgcaauaacuucguccaagcccccggcggcgaguucacugucaguccccgcaacgccccaggagaaauccucugguccgcuccccucggccccgaccucaacccauaccuaucgcaccucgcccgaauguauaauggguacgccggcggcuucgaaguccaaguuauccucgccggaaacgccuucaccgccggcaaaaucaucuucgccgccguacccccaaauuuccccaccgaaggacucuccccaucccaagucacaauguuuccacacauaaucgucgacguucgacaacuugaacccguacuaaucccccuacccgacguccguaacaacuucuaccacuacaaccaaucaaacgaccccaccauaaaacuaaucgcaauguuauacacaccacuaagggccaacaacgcaggagacgacgucuucacagucuccugccgcguacucacgcgccccucacccgauuucgacuucaucuuccucgugcccccaaccgucgaaucucgcacgaaacccuucuccguccccguccucaccgucgaagaaaugacaaacucccgauuccccaucccacuagaaaaacucuucaccggccccuccucagcauucauaguccaaccccaaaacggccgcugcacaacagauggcguccuacuaggaacaacccaacucagccccgucaacaucugcaccuucagaggcgacguaacucacaucucuggaucccgaaacuacacaaugaaccuagcaucacagaacuggaacuccuacgacccaacugaagaaacccccgcgccccuaggcacaccagacuucgucggaaagauccaaggaguccuaacccaaaccacacgcaccgacggaagcacccgaggacacaaggccacaguauacacaggcagcgccgacuucagcccaaagcucggacgcguacaauucgcaaccgacaccgacaacgauuucgucaccaaccaaaacacaaaguuuacccccgucggcgucauccaagacggcucaaccacaccccgcaacgaaccccaacaauggguccuacccuccuacagcggucgcaauacccacaacguccaccucgccccagccgucgcacccaccuuccccggcgaacaacuccuauucuuuagaucgaccaugcccggaugcucaggcuaccccaacauggaccucgacugccuccuaccacaagaauggguccaauacuucuaccaagaagccgcacccgcccaauccgacgucgcccuccuccgcuucgucaauccugacaccggacgaguccuguucgagugcaaacuacacaaaaccggauacgucaccgucgcccacaccggccaacacgaccuugucauacccccaaacggcuacuuccgauucgacuccugggucaaccaauucuacacucucgcgcccaugggcaacggaaccggaagaagaagaguccucuaa

SEQ ID NO: 36249 - RNA, 1623 nt, Artificial Sequence
  derived and/or modified sequence opt11 from VP1__Norovirus__AJA71430
augaaaauggcuuccagcgaugccaaccccucagauggaucagccgcuaaucucguacccgaaguaaacaacgaagucauggcccucgagcccguugucggcgcagcaaucgcugcgcccguagccggccaacaaaacguaaucgaccccuggauccgcaauaacuucguccaagccccaggcggagaguucaccgucucuccccgaaaugccccaggcgaaauccucugguccgccccacucggccccgaccucaacccuuaccucucccaccucgcacgcauguacaacgguuacgccggcggauucgaaguccaaguaauacuugcaggaaacgccuucaccgccggcaagguaauauucgccgccgucccacccaacuuccccacggaaggccuauccccaucccaggucacaauguuuccacacaucguaguagacguacgccaacuagaacccgugcucauaccccuccccgacguacgcaacaacuucuaccacuacaaccaaucaaacgaccccaccaucaaacugaucgcaaugcucuacacaccccuccgagccaauaacgccggagacgacgucuucaccgucucaugccgcguccuuacccgccccucccccgacuucgacuucauauuccucgucccacccaccgucgaaagucgcaccaaaccauucuccguccccguacucaccgucgaagaaaugaccaacucccgauuccccauaccgcucgaaaaacucuucaccggcccaucuuccgccuuugucguccaaccacagaacggccgcugcaccaccgacggcguccuccuaggaaccacccaacucagccccgucaacauaugcaccuuucgcggagacguaacacauaucaccggcagccacaacuacaccaugaaccucgcaagccaaaacuggucaaacuacgacccaaccgaagaaauccccgcuccauuaggcaccccagacuucguagguaaaauacaagguguacugacccaaacaacucgaaccgacggcuccacccgaggccacaaagcaaccgucuacacagguucagcagacuucgcucccaaacuaggacgcguucaauuugaaacagauacaaaccacgacuucgaugccaaccaaaacacuaaauuuacuccggucggcgucauacaggacggcggcaccacacaucgaaacgaaccccaacaguggguccucccuuccuacagcggccgaaacacccccaauguacaccuagcacccgcaguagccccgacauuccccggcgaacaacuccucuucuucagaucaaccaugccaggauguuccggauaccccaacauggaccucgacugccuacucccccaagaauggguccaauauuucuaccaagaagcagccccagcacaauccgacguagcccuccuacgauucguuaaucccgacacuggccgagucuuauucgaaugcaaacuacacaaauccggcuacgucaccguagcccacacuggucaacacgaccugguaaucccacccaacggcuacuucagauuugacagcugggucaaccaauucuacacccuugccccaaugggaaacggaaccggccgccgccgagcccucuaa

SEQ ID NO: 36250 - RNA, 1623 nt, Artificial Sequence
  derived and/or modified sequence opt11 from VP1__Norovirus__AJA71456
augaaaauggccagcuccgacgccaaucccucagauggcuccgccgcaaaccucguacccgaagucaacaacgaagucauggcccuagaacccguugucggcgccaccaucgcagcacccguagcaggccaacaaaacguaaucgaccccuggauccgcaacaacuuuguccaagccccaggaggagaguucacagucucaccccgcaacgcccccggugaaauccucuggagcgcaccccuaggucccgaccucaaccccuaucugagccaccuagcccgcauguacaacggcuacgccggcggcuucgaaguccaagucauauuagcaggaaacgccuucacugccggaaaagucauauucgcggcugucccacccaacuuccccacagaaggccuaucccccucacaagucacgauguucccacacauagucguggauguccgccaacucgaaccaguccuaaucccacucccagacguacgcaacaacuucuaccacuacaaccaauccaaugaucccaccaucaaacuaaucgccaugcucuacacaccccuccgcgccaacaacgcuggcgacgacgucuucaccgugucaugucgcguccucacacgaccauccccagacuucgacuucauauuccuuguaccucccaccgucgaaucgcgaacaaaacccuucucaguaccuauacuaaccgucgaagaaaugaccaacucccguuuccccauuccccucgagaaacucuucaccggacccuccucugccuucguaguccaaccacaaaacggccgcugcaccaccgacggcguccuccucgguaccacccaacuaucccccgucaacaucugcacauuccgcggcgacgucacccauaucaccggaucccguaacuacacuaugaaccuagccucccaaaacugguccaacuacgauccaacagaagaaaucccagcccccuuaggcaucccggacuucguaggcaaaauacagggcaugcuaacacaaacaacacgaaccgacggaucgacccguggucacaaggcaaccgucuauaccggcuccgccgacuucgcaccaaaauuaggccgaguacaauucgaaacagauaccgaccacgacuucgaagcuaaccaaaacacaaaauucacccccgucggcguaauccaagacggaucuaccacccaccgcaacgaaccccaacaauggguacucccauccuacagcggacgcaacacacccaacguccaccucgcacccgcagucgcccccaccuucccaggcgagcaacuacuauucuuccgaucaaccaugcccgguugcucaggcuaccccaacauggaucucgacugccuccucccccaagaauggguccaauacuucuaccaagaagcugcacccgcacaauccgacgucgcccuucuacgcuucgucaaccccgacaccggcagaguauuauucgaaugcaaacuacacaaaucaggauacgucaccguagcccacaccggacaacacgacuuagucauacccccaaacggcuacuuccgauucgacagcuggguaaaucaauucuacacccucgcaccaaugggcaacggcaccggacgccgccgggccuuauaa

SEQ ID NO: 36251 - RNA, 1623 nt, Artificial Sequence
  derived and/or modified sequence opt11 from VP1__Norovirus__AJA71457
augaaaauggcaucaucggacgccaacccauccgacggaagcgcagcuaaccuaguccccgagguaaacaacgaaguaauggcccucgaacccgucguaggcgcagcaauagccgcccccguagccggccaacaaaacgucauagaccccuggauccggaacaacuucguucaagcacccggcggugaguucaccgucucaccccgcaaugcacccggagaaauccucuggucugccccacucggacccgaucuaaaccccuaccucucucacuuggcccgcauguacaacggauacgccgguggcuucgagguacaagucauccuagcagggaacgcauucaccgcuggcaaaguaaucuucgccgccgugccacccaacuuccccacagaaggacucucacccucucaaguuaccauguuuccccacaucgucgucgacguccgccaacuagaacccguacucaucccccuccccgacgucagaaacaacuucuaucacuacaaccaaagcaacgaccccacaauaaaacuaaucgccaugcucuacacaccccuccgcgcuaauaacgcaggcgacgacgucuucaccguaucaugccgaguccuuacccgacccuccccagacuuugacuucaucuuccucgugccacccaccgucgaaucacgcaccaaacccuucuccguccccguacucaccgucgaggaaaugaccaacucgcguuuccccaucccccucgaaaaacucuucaccgggcccucaucagccuucgucguccaaccccaaaacggcagaugcacaacugacggcguccuacuuggcaccacacaacucucuccaguuaacaucugcaccuuccgcggcgacgucacacacaucaccggcucacgaaauuauaccaugaaccuagccagccaaaacugguccaacuacgaccccaccgaagaaaucccagcgccccucggaaccccagacuucguaggaaagauccagggcguccuuacacaaaccacccgaaccgacggaucaacccgaggccacaaagccaccgucuacacugguuccgccgacuucgcccccaaacuuggccgaguccaauucgaaacugauacugaccacgacuucgaagccaaccaaaacacuaaauucaccccagucggcguaauccaggacggcucaaccacccaccgcaacgaaccacaacaauggguucuucccuccuacucaggccgaaacacucccaacguccaccuagccccagcugucgcccccacauuucccggugaacaacuccucuucuuccgcuccaccaugccaggcugcucaggcuacccauccauggaccucgacugcuuacuaccacaagaaugggugcaauacuucuaccaagaggcagccccagcacagucagacguagcccuccuacgcuucgucaacccagacaccggacgaguucucuucgaaugcaaacuccacaaauccggcuacgucaccgucgcacacacuggccaacacgaccucguaauaccacccaacggauacuuucgcuucgacagcugggucaaccaauucuacacccucgcacccaugggaaacggcaccggccggcgcagagcccucuaa

SEQ ID NO: 36252 - RNA, 1623 nt, Artificial Sequence
  derived and/or modified sequence opt11 from VP1__Norovirus__AJA71458
augaaaauggccucaucugacgccaacccauccgacggcagcgcagccaaccugguccccgaaguaaacaacgaaguuauggcccucgaacccgucgucggagccgccaucgcagccccugucgccggucaacaaaaugucauagacccauggauucgcaauaacuucguacaagccccaggaggcgaguucaccguaagcccccgcaaugcucccggcgaaauucuaugguccgccccacucggcccagaccucaaccccuaccucucccaccucgcccgcauguacaacggcuacgccggcggcuucgaaguccaaguaauccuggccggaaacgccuucaccgcaggcaaaguuaucuucgccgcugucccuccaaacuuccccaccgaagggcucuccccuucccaagucaccauguucccccacauugucgucgacguccgucaauuagaacccguauuaaucccucucccugacguacguaacaacuucuaccacuauaaccaauccaacgaccccacgaucaagcucauagccaugcuuuacacaccccuccgagcaaacaacgccggcgacgacguguucacaguuuccugccgcguccuaacccgcccauccccugacuucgacuucaucuuccucgugccacccaccgucgaaagccgaaccaaaccuuucuccgucccaguccucaccgucgaagagaugacaaacucccgcuucccaaucccacucgaaaaacuuuuuaccggccccucauccgcuuucgucguucaaccccagaacggccgcugcaccaccgacggcguccuucucgguacaacacaacucagccccgucaacaucugcacauuccgcggcgacgucacccacaucaccggcucucacaacuacaccaugaaccucgccucccaaaacugguccaacuaugaccccgccgaagaaauucccgcaccacuaggaacacccgacuucguuggcaaaauacaaggcguacucacccaaaccacccgcaccgacggauccacccgaggccacaaagcaacagucuacacagguucagccgacuucgcccccaaacucggccgcguacaauucgaaaccgacacagaccgcgacuucgaagccaaccaaaacacaaaauucacaccugucggcgucauccaagacggagguaccacccaucgcaaugaaccccaacaauggguccucccaucauacuccggcagaaacacacccaacguccacuuagcccccgcggucgcucccaccuuccccggggagcaacuccucuucuuccgcucaaccaugcccggcugcuccgguuacccaaacauggaccucgacugucuccuaccccaagaauggguccaauauuucuaccaagaagcagcucccgcccaauccgacgucgcccuccuacgauucgucaaccccgacaccggccggguacucuucgaaugcaaacuccacaaaucggguuacguaacaguagcccacaccggacaacacgaccucgucaucccacccaacggcuacuuccgguucgacucaugggucaaccaauucuacacccucgcaccaaugggcaacggcaccggaagacgccgugcccucuaa

SEQ ID NO: 36253 - RNA, 1623 nt, Artificial Sequence
  derived and/or modified sequence opt11 from VP1__Norovirus__AJA71459
augaaaauggcauccucagacgcuaaccccuccgacggaucagcagcaaaccucguccccgaaguuaacaacgaagucauggcccuugaaccagucgucggugccgccauagcugccccugucgccggccaacaaaacguaaucgaccccuggauccgaaacaacuucguacaagcacccggcggagaauuuacaguaucaccacgaaacgcccccggugaaauccucuggucagcaccccucggccccgaccucaacccauaccuaucccaccucgcccgcauguacaacggauacgccggaggcuucgaaguccaagucauccuagccggcaacgccuucacagccggaaaaguaaucuucgccgcagugccaccaaacuucccaaccgaaggucucucucccucccaagucacuauguuuccacacaucgucguugacguacgccaauuagaacccguccucaucccccuaccugacgucagaaacaacuucuaccauuacaaccagucaaaugaccccaccauaaaacuuauagccaugcucuacacaccccuccgcgccaacaacgccggcgacgacgucuucaccgucucaugccgcguacucacccgacccucccccgacuucgacuucauauuccucguacccccaaccgucgaaucucgcaccaaacccuucuccguccccguccuuacggucgaagaaaugaccaacucccgauuccccaucccucucgaaaaacuauucaccggccccuccuccgccuucgucguccaaccgcaaaauggacgcugcacuaccgauggcguccugcucggcaccacccagcucucgcccgucaauauuugcacauucagaggagacguuacucacaucacaggcucucgcaacuacaccaugaaccucgcaucacagaacugguccaacuacgauccaacagaagaaauccccgccccgcugggaacaccagacuucgucggaaaaauccaaggcguacuaacccaaaccacucgcacagacggcuccacacgaggccacaaagcaacaguauacacgggcucuguugacuucgccccgaaacuaggccgcguacaauucgagacagacacugaccaugacuucgaagccaaccagaacaccaaauucacccccguaggcguaauccaagacggcuccaccacccaccgcaacgaaccucaacaauggguccucccuuccuacuccggccgaaacacucccaacguccaccucgcccccgcugucgcaccaaccuuccccggcgagcaacuucuauucuuccgcucaacaaugcccggcugcucaggcuaccccaacauggaccucgacugccuccucccccaagaauggguacaauauuucuaucaagaagccgcaccagcccaauccgacgucgcccuccuucguuucgucaacccugacaccggccgcguacucuucgaaugcaaacuccacaaauccggauaugucaccgucgcucacacaggccaacacgaccuggucaucccacccaacggauacuuccgcuucgauuccugggucaaucaauucuacacccucgcccccaugggcaacggcacaggacgccgccgcgcccucuaa

SEQ ID NO: 36254 - RNA, 1623 nt, Artificial Sequence
  derived and/or modified sequence opt11 from VP1__Norovirus__AJA71460
augaaaauggccuccagugacgcaaaccccucugacggcuccgcagccaaccucguacccgaaguaaacaacgaagucauggcccuagaacccgucgucggcgccgcuaucgcagcccccgucgccggccaacaaaacgucaucgaccccuggauacgcaacaacuucguucaggcgccuggaggagaauuuacagucagcccccgaaacgcccccggagaaauccuuuggagcgcgccccuaggccccgaucucaauccuuaccuaucccaccuagcccguauguacaacggcuacgccggaggcuucgaaguccaagucauacuugccggcaacgccuucacagcugguaaaguaaucuucgccgccguaccacccaacuuccccacagaaggccuaucccccucccaagucacaauguucccacacaucguugucgauguccgccaacucgaacccguacucauuccccuccccgacguccgcaacaacuucuaccacuacaaccaaucuaacgaccccaccaucaaacuuauagccaugcuauacaccccacuccgcgccaacaacgccggcgacgacgucuucaccgucuccugccgugucuuaacucgccccuccccagacuucgacuucaucuuccuaguacccccaaccaucgaaucuagaaccaaacccuucagcguccccguccuuaccgucgaagaaaugacaaacucccguuuucccauaccacucgagaaacuauucaccggacccucuucagccuucgucguucaaccgcaaaauggcagauguaccaccgacggcguccuccuaggcaccacacaacuaucccccguaaacaucugcaccuuucgaggcgaugucacacacauaaccggaucucgcaacuacaccaugaaccucgccucccaaaacuggaacaacuacgaccccaccgaagaaaucccagcuccccuagggaccccagacuucgucgguaaaauccagggcguccuaacccaaacuacacgaaccgacggcucuacacgaggucauaaagccaccguuuacacuggaucagccgacuuuucacccaaacuaggccgcgugcaauucgaaaccgacacagaucacgacuucgaagcaaaccaaaacacuaaguucacacccgucggaguaauacaagacggcggaaccacacaccgaaacgaaccacaacaauggguucuucccucauacucuggccgaaacacuccaaacguacaccucgcacccgcuguagcccccacauucccaggugaacaacuucuguuuuuccgaucaaccaugcccggcugcagcggauacccaaacauggaccucgacugccuucuaccccaagaauggguccaauauuucuaccaggaagcagccccagcccaauccgacgucgccuuacuacgcuucgucaauccagacaccggccgcguccuauucgaaugcaaacuucacaaauccggcuacgucacaguugcccacaccggccaacacgaccuugucauaccaccaaacggcuacuuccgauucgacucaugggucaaccaauuuuacacccucgccccaauggggaacggcaccgggcgccgccgcgcccuuuag

SEQ ID NO: 36255 - RNA, 1623 nt, Artificial Sequence
  derived and/or modified sequence opt11 from VP1__Norovirus__AJA71461
augaaaauggcauccuccgacgccaaccccucggacggcuccgcggcuaaccucgucccugaagucaacaacgaagucauggcccucgagcccgucgucggcgccgccaucgcggcccccgucgcagggcaacaaaacguaaucgaccccuggauccgcaacaacuucguacaagcucccgggggagaguucacugucucuccccgcaacgccccaggcgaaauccuauggucagcgccccucggccccgacuuaaaccccuacuuaucucaccucgcccgcauguacaacggcuaugccggaggcuucgaaguacaagucauacucgccggaaacgccuucacagccggaaaaguaaucuucgcagcagucccacccaacuuccccacugaaggccucagcccuucccaagucaccauguucccccacauaguaguagacguccgccaacucgaacccguccucaucccccuccccgacguccgaaacaauuucuaucacuacaaccaaucuaacgacccaaccaucaaacuuaucgccaugcucuacacaccccuaagagccaauaacgcaggcgacgacgucuucaccgucuccugccgcguccucacccgccccucacccgacuuugacuucaucuuccucguacccccaaccgucgaaucacgcaccaaaccauucagcgucccaguccucacaguugaggaaaugaccaacucacgcuuccccaucccacuagaaaaacucuucaccggccccuccucugcauucgucguccaaccccagaacggccgaugcacgaccgacggcguucuccucggcaccacucaacuuagccccguaaacaucugcaccuucagaggugacgucacccacauaacuggcucccgcaacuacaccaugaaccuagcuucccaaaacugguccaacuacgaccccaccgaagaaauaccugcaccccuggguaccccagacuucgucggcaaaauccaaggaguucucacccaaacuacccguaccgacggaucuacucgcggccacaaagccacagucuacacaggaucagccgacuucgcccccaagcucggccgcguucaauucgaaaccgacaccgaccacgacuucgaagccaaccaaaauacaaaguucacccccgucggcgucauacaagacggcucaaccacucaccgcaacgaaccccaacaauggguucucccuuccuauuccggccgcaacaccccaaacguccaccucgccccagccguugcacccacauuuccaggcgaacaacuacucuucuucagaucaaccaugccagguuguucaggcuaccccaacauggaucucgacugccuccuaccccaagaauggguacaauacuucuaccaagaagccgcacccgcccaauccgauguagcccuacuucgauuugucaaccccgacaccggccgcguacucuuugaaugcaaacuccacaaauccgguuacgucacagucgcccacaccggacaacacgaccucgucauaccaccaaacggcuacuuccgcuuugauucuugggucaaccaauucuauacccuagccccaaugggcaacggcacgggccgccgacgcgcgcucuaa

SEQ ID NO: 36256 - RNA, 1623 nt, Artificial Sequence
  derived and/or modified sequence opt11 from VP1__Norovirus__AJA71462
augaaaauggccuccagcgacgccaaucccuccgacggauccgccgccaaccuuguccccgaaguaaauaacgaagucauggcccucgaacccgucguaggcgccgccaucgcagcacccguugccggccaacaaaacgucauagaccccuggauacgcaacaacuucgugcaagcucccggaggagaauuuaccguaucuccccguaaugccccaggcgaaauacuaugguccgcccccuuggggccagaccucaaccccuaccuaucucaccucgcacgaauguacaacggcuacgccggaggcuucgagguacaggucauccucgccggcaacgccuuuacagcaggcaaagucauauucgcggccguacccccuaacuucccaacggaaggccuuucccccagccaagucaccauguucccacacauaguaguagacguccgccaacucgaaccaguccucauuccccucccugacguccgcaacaacuucuaccacuacaaccaauccaacgacccaacaaucaaacuaauagccaugcucuacaccccgcuacgagccaacaacgccggcgacgacguauucacaguaucgugccgcguacucacacgacccucaccagauuucgacuucaucuuccucguacccccaacagucgaaucccgaaccaaaccauucucaguccccguccucaccguagaggagaugaccaacagccgauuccccauaccacuugaaaaacucuucacuggacccuccucagccuucguaguccaaccccaaaacggacgcuguaccacggacggaguccuacucggcaccacccaacuguccccaguaaacaucugcaccuuucguggcgacgucacacacauaaccggcucacgaaacuacacgaugaaccuugccucccaaaacuggaacaacuacgacccaacagaagaaauacccgcaccccuagguaccccagacuucgucgguaaaauccaaggaguccuaacccaaacuacccgcacagacggcaguacccgcggacacaaggccaccgucuacaccggaucagccgacuucgcccccaaacuuggccgcguccaauucgagacugacaccgaccacgacuucgaagccaaccaaaacaccaaauucaccccugucggcgucauccaagacggcuccaccacccaccgcaacgaaccccagcaguggguacuccccucuuacuccggccgaaacaccccaaacguacaccuugcacccgcagucgcuccaaccuucccaggagagcaacuccucuucuuucgcuccacaaugccuggcugcuccggcuaccccaacauggaccuugauugccuccuaccccaagaauggguccaauacuucuaccaagaagcagcacccgcccaguccgacgucgcacuacuacgauucgucaacccagacaccggccgaguccucuucgaaugcaaacugcacaaauccggcuacguuacagucgcccacaccggccaacacgaccucgucauaccacccaacggauacuuccguuucgacuccuggguaaaccaauuuuacacccucgcacccaugggaaacggcaccggccgccgccgcgcacuauaa

SEQ ID NO: 36257 - RNA, 1623 nt, Artificial Sequence
  derived and/or modified sequence opt11 from VP1__Norovirus__AJA71463
augaaaauggccuccuccgacgcaucacccucagaugguuccgccgccaaccuagucccugaaguaaacaacgaagucauggcacuagaaccaguagucggcgccgccaucgcugcucccguagcuggacaacaaaacgucauugaccccuggauucgcaacaauuucguacaagcaccugguggugaguucaccguuaguccccgcaacgcccccggagaaauccuuugguccgcaccccuaggccccgaccuuaacccauaccucucacaccucgcccguauguacaauggcuacgccggcggcuucgaaguccaagucauccucgccggcaacgccuucaccgcaggaaaagucauauucgcagccguaccacccaacuuccccacagaaggccucucucccucacaagucacuauguucccccacaucgucgucgacguccgacagcucgaaccaguccuaauuccacuccccgacguacgcaacaacuucuaccacuacaaccaauccaacgaccccaccauaaaacuuaucgcgaugcuuuacacucccuuacgcgcaaacaacgccggcgacgacguuuucaccgucucaugcagaguacucacgcgacccucaccagacuucgacuucaucuuccucgucccucccacagucgaaucccgaaccaaaccauuuucagucccaguccuuaccguagaagaaaugaccaacuccagauuccccauuccacucgaaaaacucuucaccggacccagcuccgccuucgucguacaaccacaaaacggaagaugcaccaccgacggaguccuacucggcaccacacaacuuucccccguaaacaucugcaccuuccgcggugacguaacccacaucaccggcucccgcaauuacacuaugaaccuagcaucacagaacugguccaacuacgacccaacagaagaaaucccagcaccccucggcacccccgacuucgucggcaaaauccaagguguccuaacccaaacaacccgcacagacggcucuacccgcggacacaaagccaccguauacaccggcuccgccgacuucgcccccaaacucggccgcguccaauucgaaaccgacacugaccaugacuucgaagccaaccaaaacaccaaauucacacccguuggcguuauccaagauggcgguaccacacaccgaaacgaaccccaacaauggguccucccauccuacucgggccgcaacacaccaaacguccaccuagccccagcagucgccccuacauucccaggcgaacaacuccucuucuuccgcucuacaaugccaggcugcagcggcuacccaaacauggaccucgacugccuacuaccccaagaauggguacaauacuucuaucaagaagccgcacccgcccaaagcgacgucgcccuccuccgguuugucaaccccgacaccggucgcguccuauucgaaugcaaacuccacaaauccggauauguaaccguagcccauacaggacaacacgaccucgucaucccacccaacggauacuuccgcuuugacucaugggucaaccaguucuacacccuugcucccaugggcaacgggaccggccgccgcagggcccuauga

SEQ ID NO: 36258 - RNA, 1623 nt, Artificial Sequence
  derived and/or modified sequence opt11 from VP1__Norovirus__AJA71464
augaaaauggccuccucagacgcaaauccuucggacggauccgccgccaaucucgucccagaaguuaacaacgaagucauggcccuagaaccagucgucggcgcugccauagccgcaccugucgccggacaacaaaacguaaucgacccauggauccgcaacaacuucguccaagcccccgggggcgaguucacugucucaccccgcaacgcccccggcgaaauucucugguccgcaccccucgguccagaccuaaaccccuaccugucccacuuagcacgcauguacaacggcuacgccggcggcuucgaaguccaagucauccuagcaggaaacgcuuucaccgcagggaaagucauuuucgcagccguacccccaaacuuccccaccgaaggacucucucccucccaagucaccauguucccucacauagucgucgacguaagacaacuagaacccguucuuauuccccuucccgacguccgcaacaacuucuaccauuauaaccaauccaacgaccccaccaucaaauuaaucgcaaugcuuuacacaccccuacgugccaacaacgccggcgacgacgucuucaccgucagcugccgaguacuaaccagacccucccccgacuucgacuucaucuuccucgucccaccuaccgucgaaaguagaaccaaacccuucuccguccccguccuuaccgucgaagaaaugaccaauucccgauucccaauaccccuagaaaaacuauucacgggucccuccucugccuucguaguucaaccccaaaacggcagauguaccaccgacggcguccuccucggaaccacccaacuauccccugucaacaucugcaccuuccgaggugacgucacccauauaaccggcagucacaacuacacaaugaaccuagccucucagaauuggucaaacuacgaccccaccgaagaaauccccgcaccccucggcacaccggacuucgucggcaaaauccaaggcguacucacccaaacaacccguaccgacggcuccacacgaggccacaaggccacagucuauacaggcagcgccgacuucgccccaaaacucggucgcguccaauucgaaacugacaccgaccgcgacuucgaagccaaccaaaacacaaaauucaccccagucggagucauccaagacggcggcaccacccacagaaacgaaccccaacaauggguacuccccucuuacuccggccgaaacacccccaacguucaccuugcacccgccgucgcucccaccuuccccggagagcagcuccucuucuuccgcucuaccaugcccggaugcuccggauaccccaacauggaccucgauugccuccuaccacaagaauggguucaauauuucuaccaagaagccgccccggcacaauccgaugucgcccuucuccgcuucgucaacccagacaccggccgcguccucuucgaaugcaaacugcacaaaagcggcuacguaaccgucgcccacacuggccaacacgaccucgucaucccacccaacggcuacuuccgcuucgacuccugggucaaccaauucuacacccucgcccccaugggcaacggcaccggccgucgucgagcccuauaa

SEQ ID NO: 36259 - RNA, 1623 nt, Artificial Sequence
  derived and/or modified sequence opt11 from VP1__Norovirus__AJA71465
augaaaauggccuccucugacgccaacccaucagacgguucagccgccaaucuuguccccgaagucaacaacgaaguaauggcccuagaaccugucgucggagccgccaucgccgccccugucgcuggacaacaaaacguaaucgacccuuggauccgcaacaacuuuguccaagcccccggaggcgaguucaccguaucaccccgaaacgccccaggcgaaauccucugguccgcaccccucggcccggaccuuaaccccuaccuaucccaccucgcccgcauguacaacggcuacgccggcggcuuugaaguccaagucauccucgccggaaacgccuucacagccggcaaagucaucuucgcagcaguacccccuaacuuccccacagaaggccuaucccccucccaagucacaauguucccccauaucgucgucgacguccgccaacuagaaccaguccucaucccccuacccgauguccgcaacaacuucuaccacuauaaccaauccaacgaccccaccaucaaacuaaucgccaugcucuacacuccccuacgugccaacaacgcaggcgacgacgucuucaccguaucaugccgcguucugacucgacccagccccgacuucgacuucaucuuccuaguacccccgaccgucgaaucccgcacaaaacccuucucaguccccguccucaccgucgaagaaaugacaaacucacgcuuccccauaccccucgaaaaacuauucaccggaccaucuuccgccuucgucguucaaccccaaaacggccgcugcaccaccgacggaguucuacucggaacaacccaacuaagcccaguaaacauuugcacguuccgcggagacguaacacacauaacaggaucccacaacuacacaaugaaccuagcgucccaaaacuggucaaacuacgaccccacugaagaaauuccagcaccacucggaacaccagacuucgugggaaaaauccaaggaguacugacacaaaccacgagaacugacggauccacccgcggccacaaagcaaccguauacacagguucggccgacuucgcccccaaacuaggcagaguacaauucgaaaccgacaccgaccgagacuuugaagccaaccaaaacacaaaguucaccccaguaggagucauccaagauggcggcaccacccaccgcaacgaaccccagcaauggguccuccccucuuacucaggacgcaacacccccaacguccacuuagcccccgcugucgcccccaccuuccccggcgaacagcuacucuucuuccguucgacuaugcccggcugcucaggcuaucccaacauggaccucgacugccuacucccccaagaauggguccaauacuucuaccaagaggccgcccccgcccagucagacgucgcacuccuccgauucgucaaccccgacaccgggcgcguccuauucgaauguaaacuccacaaaucaggcuacgucacaguagcccacacgggccaacacgaccuugucauacccccaaacggauacuuccgcuucgacucaugggucaaccaauucuacacccuggcccccaugggcaacggcaccggccgacgccgugcccucuaa

SEQ ID NO: 36260 - RNA, 1623 nt, Artificial Sequence
  derived and/or modified sequence opt11 from VP1__Norovirus__AJA71466
augaaaauggcuagcagcgacgcuaaccccuccgacgggucagccgcgaaccuaguccccgaggucaacaaugaggucauggcucuagaaccagucguaggcgccgccaucgcagcccccgucgcaggccaacaaaacgucaucgaccccuggauccgaaacaaccucguccaagccccaggaggagaguucacaguaagcccccgcaacgcuccaggagaaauccuaugguccgcaccucuaggccccgaacuaaacccguaccuaucacaccucgcccgcauguacaacggcuacgccggcggcuucgaaguacaagucauacuagcaggaaacgccuucacugccgggaaagucaucuucgccgcuguaccacccaacuuccccaccgaaggccucagccccucacaaguaaccauguucccccacauaguugucgacguccgccaacucgaacccguacucauucccuuaccagacgugcgcaacaacuucuaccacuacaaccaaucaaacgaccccacaaucaaacuaaucgccaugcucuacacaccccuccgagccaacaacgccggcgacgacgucuucaccguauccugccgaguccugacccgccccucccccgacuuugacuucauauuccucgucccaccaacagucgaaucccgcaccaaacccuucucugucccaguccucaccgucgaagaaaugaccaacucacgcuuccccauaccacuagaaaaacucuuuaccggccccucuagcgcauucgucguccaaccucaaaacggacgaugcacaaccgacggcguccuacuuggcaccacccaacucucacccgucaauaucugcaccuucagaggagacgucacccacaucacaggaucccgcaacuacaccaugaaccucgccucucagaacugguccaacuacgaccccacagaagaaauaccagcaccgcuaggcacccccgauuucgucggaaaaauccaaggcguccuaacacaaacuaccagaaccgacggcuccacacgcggccacaaagccaccguguacacgggcuccgccgacuucgccccaaaacucggacgcguacaauucgaaaccgacacagaccgagacuucgaagccaaccaaaacacaaaauucacaccagucggaguuauacaagacgguuccaccacccaucgcaacgaaccucaacaauggguccuacccagcuacucaggcagaaacacacccaacguccaccuagccccagccguagcacccaccuuccccggcgaacaacuacuauucuuccgcagcacaaugcccgguugcuccggcuacccaaauauggaccuagauugccuacuaccacaagaauggguccaauacuuuuaccaagaggcagcacccgcccaaagcgacgucgcccuccuccgcuucgucaacccagacaccggccgcguacucuucgagugcaaacuucacaaaucagguuacgugacagucgcccacacagggcaacacgaccuagucauacccccaaauggauacuuccguuucgacuccuggguaaaccaauucuacacucucgcccccaugggcaacggaaccggacgccgacgcgcacuauaa

SEQ ID NO: 36261 - RNA, 1623 nt, Artificial Sequence
  derived and/or modified sequence opt11 from VP1__Norovirus__AJA71467
augaaaauggcauccucagacgccaaccccuccgacggauccgccgcaaaccucguccccgaaguaaacaacgaaguaauggcgcuagaaccagucguaggcgccgccaucgcagccccagucgcaggccaacaaaacgucaucgaccccuggauacgaaacaacuucguacaagcccccggcggagaguucaccgucuccccuagaaaugcaccuggcgaaauccucuggucagcaccccucggccccgaccucaaccccuaccuaucacaccucgcccgaauguacaacggcuacgccggcggcuucgaaguccaaguaauccucgccggcaacgccuucaccgcaggcaaagucauauucgccgcuguuccacccaacuuccccacugaaggccucagucccucucaggucaccauguucccacacauagucgucgacguccgacagcucgaacccguccuaaucccccuaccagauguacguaacaacuuuuaccacuauaaccaauccaacgaccccaccaucaaacucauagccaugcucuacacuccccuccgcgccaacaacgccggugacgacgucuucacuguuuccugccgaguccuaacccgccccucacccgacuucgacuucaucuuucucguaccucccaccgucgaaucccgaaccaaaccauuuucagucccaguccuaaccgucgaagaaaugaccaacucacgcuucccaaucccacucgaaaaacucuucacagguccauccagcgcauucgucguccagccgcaaaacggucgaugcaccaccgacggcguucuucuuggcaccacccaacucuccccaguaaacaucugcaccuuccgcggggaugucacccacaucacgggcucucgcaauuacacaaugaaccuagcuucccagaacuggaacaacuacgaccccaccgaagaaauccccgcgccauuaggcacuccagacuucgucggcaaaauccaaggcguccucacccaaaccacccgaacugacggcuccacucgcggccacaaagccaccguauauacuggcucagcagauuucgccccuaaacucggccgcguccaauucgaaacugacaccgaccacgacuucgaggccaaccaaaacacccgauucacacccguaggcguuauccaagacggagguacaacccacagaaacgaaccccaacaauggguacuacccuccuacuccggccgaaauacccccaacguacaccuugcacccgcagucgcacccacuuucccaggcgaacaauuacuauucuuccgauccaccaugcccggcugcucaggcuaccccaacauggaccucgacugccuccucccccaagaauggguccaacacuucuaccaagaagccgcccccgcacaaucugacguugcccuccuccgcuucgucaaccccgacacaggccgaguccuauucgaaugcaaacuacacaaauccggcuaugucaccgucgcccacacuggacaacacgaucucguuauucccccaaauggcuacuuccguuucgacucuuggguaaaccaauucuauacacuagcacccaugggcaacggcaccggccgccgccgugcccuauaa

SEQ ID NO: 36262 - RNA, 1623 nt, Artificial Sequence
  derived and/or modified sequence opt11 from VP1__Norovirus__AJA71470
augaagauggcaagcuccgacgccaaccccuccgacggcucagcagccaaccuaguuccugaaguuaacaacgaagucauggcccucgaacccgucgucggagccgcuaucgcagccccggucgccggccaacaaaauguaaucgaccccuggauccgaaacaacuucguacaagcuccaggcggcgaguucaccgucuccccucgcaacgcaccaggagaaaucuuauggucagcaccacucgggcccgaccuaaacccauaccuuucgcaccuagcacgcauguacaacgguuaugccggcggcuucgaagugcaagucauccucgccgguaacgcguuuaccgccggcaaagucaucuucgccgccgugccucccaacuuccccacugaaggucucucucccucccaaguaaccauguucccucacaucgucgucgacguccgacaacuagaacccguccucaucccccuucccgacguccgcaacaacuucuaccacuacaaucaaucuaacgacccaaccaucaaacugaucgcaaugcucuacaccccucuccgcgcaaacaacgccggcgacgacgucuucaccgucagcugucgcguacucacacgccccagccccgacuuugacuucaucuuccucgucccucccaccguagaaucccgaacaaaaccuuucucugucccaauccuaaccguagaagaaaugaccaacucacgcuuccccauaccccuagaaaaacucuuuacaggacccucauccgcauucguaguccaaccacaaaacggccgaugcaccaccgacggcguccuacucggaaccacccaacucucccccguaaacauaugcaccuuccgcggagacgucacacacaucaccggcucacgcaacuacacuaugaaccuagcaucccagaacuggucaaacuacgaccccacggaagaaauccccgcaccccuaggcauccccgacuucguaggaaaaauucaaggcaugcucacccaaaccacccgcaccgacggcuccacucgaggccacaaagcuacaguauacacugguuccgccgacuucgccccaaaacugggccgcguccaauuugaaacagacaccgaccacgacuucgaagccaaccaaaauacaaaguucaccccugucggagucauccaagacggcuccacuacacaccgcaacgaaccacagcaauggguccuaccauccuacuccggccgcaacacacccaacguacaccuagcacccgccgucgccccaacauuuccaggcgaacaacugcuuuucuuccgcucaaccaugccaggcugcucaggcuacccaaacauggaccucgacugccuacuaccccaagaauggguccaauauuucuaccaagaagccgccccagcgcaauccgacguagcacuucuccgcuucguaaacccagacaccggacgaguacucuucgaaugcaaacuucacaaauccggcuacgucacagucgcacacaccggacaacacgaccuagucauaccacccaacggauacuuccguuucgacagcugggucaaccaauucuacacucuagcccccaugggcaacggaaccggccgccgccgcgcccucuaa

SEQ ID NO: 36263 - RNA, 1623 nt, Artificial Sequence
  derived and/or modified sequence opt11 from VP1__Norovirus__AJA71471
augaaaauggccuccuccgacgcaaacccguccgacggauccgcagccaaccuaguccccgaagucaacaacgaagucauggcccuugaacccgucgucggcgccgccaucgccgccccaguagcuggccaacaaaacguuaucgaccccuggauucggaacaacuucguccaagccccaggaggcgaauuuaccguaucaccccgaaacgcaccuggcgaaaucuuaugguccgcaccccucggaccugaacuuaacccauaccuaucacaccucgcccgaauguacaacgguuacgccggcggauucgaaguccagguaauccucgccggaaacgccuucaccgccggaaaagucaucuuugccgccgucccaccaaacuuccccacagaaggccuaucccccagccaagucacaauguucccccacaucguagucgacguaagacaacucgaacccguacuaaucccccuccccgacguccgcaacaacuuuuaccacuacaaucaaucuaacgaccccacuaucaaacuuaucgcaaugcuuuacaccccacuccgagccaacaacgccggugacgacgucuucaccgucagcugucgaguccucacccggccaucucccgauuucgacuucaucuuccucguaccacccacaguugaaucccgaaccaaacccuucucaguccccguacucaccgucgaagaaaugaccaacucccgcuuccccaucccguuagaaaaacuuuucacagguccuuccuccgcauucgucguccaaccacaaaacggccgcugcacuaccgacggcguccuccucggcaccacccaacucucccccguaaacaucugcaccuuccgcggcgacgucacccacaucaccggcucccgaaacuacaccaugaaccuagccagccaaaacugguccaacuacgaccccaccgaagaaaucccagcgcccuuagguacacccgacuuugucggaaaaauccaaggcguccuaacacaaaccacccgcaccgacggauccacccgcggccacaaagccaccgucuacaccggcucagccgacuucgcccccaaacucggacgaguccaauucgaaacagacacagaucgcgacuucgaagcuaaccaaaacaccaaauucacccccgucggcgucauacaagacggaucaaccacacacagaaacgaaccccaacaauggguauuacccuccuacuccggccgcaacacacccaauguacaccucgcccccgccguagcacccacauucccuggagaacaacuacuuuucuucagauccaccaugcccggcugcucuggcuaccccaaccgcgaccuagacugcuuacucccccaagaauggguccaauacuuuuaccaagaagccgcccccgcccaaucagacguagcccuacugcgcuuuguaaaccccgacacaggacgaguccucuucgaaugcaaacuccauaaauccggcuacgucaccgucgcacacaccggccaacacgaccucgucauaccucccaacggauacuucagauucgacuccugggucaaucaauuuuacacacucgcccccaugggaaacggcaccggcaggagacgagcacucuag

SEQ ID NO: 36264 - RNA, 1623 nt, Artificial Sequence
  derived and/or modified sequence opt11 from VP1__Norovirus__AJA71472
augaaaauggccucaucagacgccaacccaucagacggcuccgccgccaaccucguccccgaagucaacaacgaagucauggcccucgaacccguagucggcgccgcaaucgccgccccagucgcaggccaacaaaacguuaucgacccauggauccgaaacaacuucguccaagcccccggcggugaguucacaguaucaccccgcaacgcacccggagaaauacuuugguccgcgccccucggucccgaacugaaccccuaccuaucacaccucgcccgaauguauaauggcuacgcuggcggauucgaaguccaaguaauacucgccgggaacgccuucaccgccggcaaagucaucuucgccgccguaccacccaacuuccccaccgaaggucucucccccucccaaguuaccauguucccccacaucguugucgacguccgccaacucgaacccguacuaaucccccuccccgacguacgcaauaacuucuaccacuacaaccaaucaaaugaccccaccaucaaacucaucgccaugcuuuacaccccacuccgagcaaacaacgcaggcgaugacgucuucacagucuccugccgcguucuaacccguccaucucccgacuucgacuuuaucuuccuuguacccccaacagucgaaucccguacaaaacccuucucuguccccguucucacagucgaagaaaugacuaacucccgauucccaauuccacuagaaaaacucuucacaggcccaucauccgccuucguuguacaaccccaaaacgggcgcugcaccacugacggaguccuccuaggcacaacccaacucucccccguaaacaucugcaccuuccgcggcgacgugacccacauaaccggcucccggaacuacacaaugaaccuggccucccaaaacugguccaacuacgaccccaccgaagaaauacccgcaccccuaggaacaccagacuucgucgguaaaauccaaggcguccuaacccaaacuaccagaaccgacggcuccaccagagggcacaaagccaccgucuacaccggcuccgcagacuucgcacccaaacuuggccgaguccaguuugaaacagacaccgaccgagacuucgaagcaaaccaaaacaccaaauuuacaccagucggcgucauacaggacggcucaaccacccaccgaaacgaaccccaacaauggguccuacccucauauucaggccgcaauacccccaacguucaccucgcccccgcuguagccccaaccuucccaggcgaacaacuacuauucuuccguucgaccaugcccggauguuccggcuaccccaacauggaccuagacugccuacucccccaagaguggguccaauacuucuaccaggaagcugcccccgcccaauccgacgucgcccuacugcgcuucgucaaccccgauaccggccgcguccucuucgaaugcaaacuccacaaaucuggauacgucaccgucgcccacaccggccaacacgaccucguaauucccccaaauggcuacuuccgauucgacucaugggucaaccaguucuacacccucgcccccaugggcaacggaaccggucgucgucgcgcgcucuaa

SEQ ID NO: 36265 - RNA, 1623 nt, Artificial Sequence
  derived and/or modified sequence opt11 from VP1__Norovirus__AJA71473
augaaaauggcaucauccgacgcuucuccauccgacggaucugccgccaaucucguccccgaagucaacaaugaagucauggcccucgaaccgguagucggagcagcaaucgccgcccccgucgccggccaacaaaacgucaucgaccccuggauccgaaacaacuucguccaagcaccuggaggcgaguucacugucagcccacgcaacgccccaggcgaaauccucuggucagcaccccucggccccgaccucaacccauaucucucccaccuugcccgcauguacaacggcuacgccggcggguucgaaguacaaguaauccucgccggaaacgccuuuacagccggaaaaguaaucuucgcagccguuccacccaacuucccaacugaagggcuauccccgucccaagucacaauguucccccacaucguaguagauguccgccaacuagaacccguacuaauaccucuccccgacguucgcaacaacuucuaccacuacaaccaauccaacgaccccaccaucaaacucauugccaugcuauacacuccccuacgcgccaacaacgcaggagacgaugucuucaccgucuccugccgaguacucacacgacccuccccagacuucgacuucaucuuccuaguacccccaacagucgaaucccgcaccaaaccuuuuuccguucccguucuaacagucgaagaaaugaccaacagccgauuucccaucccccucgaaaaacucuucacaggccccuccuccgccuuugucgugcaaccacaaaacggacgcugcaccacugacggaguccuccucggcaccacacaauuaucccccguaaacauaugcacguuucgcggcgacgucacccacaucaccggaucccgcaauuauaccaugaacuuagccucccaaaacuggucaaacuacgacccaacagaagaaaucccugcaccccucggcacacccgacuucgucgguaaaauacaagggguccucacccaaaccacacgcaccgacggauccacacgcggacacaaggccaccgucuacacaggauccgccgacuuugcccccaaacucggccgcguccaauucgaaaccgacaccgaccgagacuuugaagcuaaccaaaacacaaaauucacccccgucggcgucauucaagacggcggcacgacacaccgcaacgaaccccagcaauggguccucccaucuuacucagggcgaaacacacccaauguccaccucgccccugccgucgcucccacauuccccggcgaacaacuacucuucuuccgauccacuaugcccggcugcucggguuaccccaacauggaccucgacugccuccucccccaagaauggguccaauacuucuaccaagaagccgcccccgcccaaucagacguagcacuccuacgcuucguaaaccccgacaccggccgcguccucuucgaaugcaaacuucacaaauccggauacgucaccgucgcccacacaggucaacacgaccuagucauacccccaaacggauacuuccgauucgacagcuggguaaaccaauuuuacacacucgcacccaugggcaacggcaccggccggcgucgcgcucucuga

SEQ ID NO: 36266 - RNA, 1623 nt, Artificial Sequence
  derived and/or modified sequence opt11 from VP1__Norovirus__AJA71474
augaaaauggccuccagugacgccaaccccuccgacggaucugcagccaaccucgugcccgaagucaacaacgaaguaauggcucucgaacccguagucggugccgccauugccgcccccguagccggccaacaaaacguaauagaccccuggauccgaaacaacuucguccaagcgcccggcggcgaguucaccguaucgccccgaaacgcccccggcgaaauccucugguccgcaccccucggaccagaucucaaccccuaccucagccaccucgccagaauguacaacggcuacgccggcggauucgaaguccaaguaauccuagccgguaacgccuucaccgccggcaaaguaauauucgccgcaguucccccaaacuuccccacggaaggccucuccccaucacaagucacaauguucccacacauaguagucgacguacgacaacucgaacccgucuuaaucccacucccagauguacgcaacaacuucuaccacuacaaucaaagcaacgacccaaccaucaaacucauagcaaugcuuuacaccccacuccgcgccaacaaugcaggcgacgacgucuucacgguaagcugccguguccucacaagacccuccccagacuucgacuuuaucuuccucguacccccuaccgucgaaucacgaacaaaaccauucuccguaccaguccuaacaguagaagaaaugacaaacucccguuuccccaucccacuugaaaagcuguucaccggcccuuccuccgccuuugucguucaaccccaaaacggacgaugcacaacagacggcguacuacuaggaacaacacaacuuagcccaguaaauauauguaccuuccgaggcgacguuacccacaucacgggaucccgaaacuauacaaugaaccuggcaucacaaaacugguccaacuacgacccaaccgaagaaauacccgccccacucggcacacccgacuucguaggcaaaauacaaggagucuuaacccaaaccacacgcacagacggauccacccgcggccacaaagcaaccgucuacaccggcucagccgacuucgcacccaaacucggacgcguccaguucgaaacugacacagaccgcgacuucgaagcuaaccaaaacacaaaauuuaccccaguaggcguuauucaagacggcggaaccacccaucgcaacgaaccccaacaauggguccucccauccuacucaggccgcaacacacccaacguccaccuugcucccgcugucgcaccaaccuuccccggcgaacagcuccucuuuuuccgaucaaccaugccaggauguuccggcuaucccaacacugacuuagacugccuucuuccucaagaauggguccaauacuucuaccaagaagccgcucccgcacaaucagacguagcccuccuacguuucguaaacccagacaccggccgcguccuauucgaaugcaaacuucacaaaagcggcuacgucaccgucgcccacaccggccaacacgaccuagugaucccacccaacggauacuuccgauucgacucaugggucaaccaauucuacacacuagcccccaugggcaacggcacaggccgccgcagagcccucuaa

SEQ ID NO: 36267 - RNA, 1623 nt, Artificial Sequence
  derived and/or modified sequence opt11 from VP1__Norovirus__AJA71475
augaaaauggcauccuccgacgccaaccccucagacggaucugccgcaaaccucgucccagaagucaacaacgaggucauggcacucgaacccguagucggcgccgccaucgcagcccccgucgccggccagcaaaacgucaucgaccccuggauccgaaacaacuucguccaagcccccgguggcgaguucaccguuagccccaggaacgccccaggcgaaauacucugguccgccccacuuggaccagaccuaaacccauaccucucacaccuggcacguauguacaacggauacgccggcggcuuugaaguccaggugaucuuagccggcaacgccuucaccgccggaaaagucauuuucgcagccgucccacccaacuuccccacugaaggccuaucacccucccaggucacuauguucccacacaucgucgucgauguccgccaacuagaaccaguccucauaccauuacccgacguccgcaacaacuuuuaccacuacaaccaauccaacgaccccacaauaaaacuuaucgcaaugcuauacacaccccuccgagccaacaacgcaggagacgacgucuucacagucucuugccgcguccucacccgcccaucccccgacuuugacuucaucuuccuagugccacccaccgucgaaagccgcaccaaacccuucuccguccccguccucaccguagaagaaaugacaaacucacgcuuccccauaccccuagaaaaauuauucaccggccccucaucugccuucgucguccaaccccaaaacggacguugcaccaccgacggcguccuccucggcaccacccaacucucuccagucaacaucugcaccuuccguggagacgucacccacauaaccgguucccgaaauuacaccaugaaccucgccucacaaaauugguccaacuacgacccaacugaagaaaucccugcaccccucggcacacccgacuucgucggcaaaauccaaggaguccuaacccaaaccacacguacagacggcucuacucgcggacauaaagccacagucuacaccggcuccgccgacuucgccccuaaacucggacgaguacaauucgaaaccgacaccgaccacgacuucgaagccaaccaaaacaccaaauuuaccccagucggcguuauccaagacggcggcacaacacacagaaacgagccacaacaauggguauuacccucauacucuggcagaaacacccccaacguacaccucgcccccgcugucgcccccacauuccccggcgaacaacuccucuucuuccgcucuaccaugccaggaugcucgggauaccccaauauggaccuagacugccuccucccccaagaauggguccaauacuucuaccaagaagcagccccagcacaaucugacgucgcccuucucagauuugugaaccccgacaccggccgaguucucuucgaaugcaaacuccacaaauccgguuacguuaccgucgcacacacaggccaacacgaccuagucaucccacccaacggauacuucagauuugauuccugggucaaccaauucuacacccuggcccccauggguaacggcacaggccgccgcagagcacucuaa

SEQ ID NO: 36268 - RNA, 1623 nt, Artificial Sequence
  derived and/or modified sequence opt11 from VP1__Norovirus__AJA71476
augaaaauggcauccagcgacgccaaccccucagacgguuccgccgcaaaccucguccccgaagucaacaacgaagucauggcacuugaacccguuguaggcgcagccaucgccgcccccgucgccggacaacaaaacgucaucgaccccuggauacgcaacaacuucguccaagcacccggcggcgaguucaccguaucaccccgaaacgccccuggggaaauacuuugguccgcaccccucggccccgaccuaaaccccuaccucagccaccucgcccgcauguacaacgguuacgccggaggcuucgaaguacaaguaauccuagccggcaacgccuucaccgccgggaaagucaucuucgccgcagucccucccaacuuccccacggaaggccucucacccucccaaguaacaauguucccccacauugucgucgauguacgacagcucgaaccaguccuaauaccccuccccgacguccgaaacaacuucuaccacuacaaccaaucaaaugaccccacuauaaaacuaaucgcaauguuauacacaccccuacgcgccaacaacgccggcgacgacguuuucacagucucuugccgcguucucacacgaccauccccagacuucgacuucauauuccucguaccacccacagucgaauccagaaccaagccauucucaguccccguccucaccgucgaagaaaugacaaacucacgcuuccccauaccucucgaaaaacuauuuaccggcccaucaucugccuucgucguccaaccccaaaacggccgcugcacaaccgacggcguccuccuaggcaccacacaacuaucccccguaaacaucugcaccuuccgcggcgacgucacccacauaacaggcucccgaaacuacaccaugaaccucgccucccaaaacuggaacaacuaugaccccaccgaagaaauccccgcaccccucgguacaccagauuucgucggaaaaauccaaggcguccucacccaaaccaccagaaccgacggaucgacccgcggccacaaagcaacagucuauaccggauccgccgacuuugccccaaaacucggacgcguacaauucgaaaccgacaccgaucaugacuucgaagcaaaucaaaauaccaaguucacccccgucggaguaauccaagauggcuccaccacccaccgcaacgaaccccaacaauggguacucccaucguauuccggacgcaacaccccaaacguacaccucgcccccgcaguagcaccaacguuccccggcgaacaacuacuuuucuuccgcuccaccaugccuggaugcuccggauaccccaacauggaccucgacugccuccucccacaagaauggguccaguacuuuuaucaagaagccgcccccgcccaauccgacgucgcccuccuccgcuuuguaaacccagauaccggacgcguacucuucgaaugcaagcuacacaaauccggauacguaaccguagcccacaccggacaacacgaccuagucaucccacccaaugguuauuuccgcuucgauaguuggguaaaccaauuuuacacacucgcccccaugggcaacggcacaggccgccggcgcgcucuauaa

SEQ ID NO: 36269 - RNA, 1623 nt, Artificial Sequence
  derived and/or modified sequence opt11 from VP1__Norovirus__AJF21974
augaaaauggccuccuccgacgccaaccccagcgacggcuccgccgccaaucuaguacccgaagucaacaacgaagucauggcccucgaaccaguaguaggugcugcaaucgcagcacccgucgccggccagcaaaacguuaucgacccauggaucagaaacaacuucguacaagcacccggcggcgaguucacugucucacccaggaacgcaccuggagaaauccuaugguccgcgccccuaggccccgaccucaaccccuaccugucccaccuagcucgcauguacaacggcuacgccgguggcuucgaaguccgagucauccuagccggcaaugccuucacagccgguaaaguuaucuucgccgccgugccucccaacuuucccaccgaaggccucucacccucccaagucacaauguucccccacauugucgucgacguacgccaacucgaaccaguccucaucccccuccccgauguccguaacaauuucuaccacuauaaccaauccaacgaccccacaaucaaacucaucgcaaugcucuacacuccacuccgcgcaaacaacgcaggcgacgacguauucaccguauccugccgaguucucacccgccccuccccugacuucgacuucaucuuccucgucccacccaccgucgaaucccgcaccaaacccuucucaguccccauccucaccgucgaagaaaugacuaacucacgcuuccccaucccccucgaaaaacuauucacaggacccuccucugccuucgucguacaaccacaaaacggccgcuguaccacagacggcguccuccucggcacaacacagcucucacccguaaauaucugcaccuuucgaggcgacgucacacauauaaccgguucccgcaacuacacuaugaaccuagccucacaaaacuggucaaauuacgacccaaccgaagaaauccccgcaccccucggcauuccagacuucgucggaaaaauccaaggaaugcucacccaaaccacccggaccgacgguucaacccgcggccauaaagccacaguauauaccggcagcgcugacuucgcaccaaaacucggccgaguccaauucgaaacagacacagaccacgacuucgaagccaaccagaacaccaaauucacacccguaggcgucauccaagacggcucaaccacccaccgcaacgaaccacaacaauggguucuacccucauacuccggccguaacacccccaauguccaccuagcgccagccgucgccccuaccuuccccggagagcaacuccucuucuuccgauccaccaugccaggcugcuccggcuaccccaacauggaccucgacugccuccucccacaagaauggguccaauacuucuaccaagaggccgcacccgcacaauccgacgucgcccuccuccgcuucgucaaccccgacacuggccgcguccucuucgaauguaaacuccacaaauccgguuacgucacuguugcccacaccggccaacaugaccuaguuauaccacccaacggcuauuuccgauucgacucgugggucaaccaauucuacacuuuagcccccaugggcaacggcacaggcagacgccgcgcuuuauaa

SEQ ID NO: 36270 - RNA, 1623 nt, Artificial Sequence
  derived and/or modified sequence opt11 from VP1__Norovirus__AJF21975
augaaaauggccucaucagacgccaaccccucagacggcuccgccgccaaccucguacccgaaguaaacaacgaagucauggcccuagagcccgucgucggcgccgccaucgccgcaccagucgcaggacaacaaaacgucaucgaccccuggauccgcaacaauuucguccaagcacccggcggcgaguucacaguauccccacgaaacgcacccggcgaaauacucugguccgccccacucggccccgaccucaaucccuaccucucccaccuagcacgaauguacaacggcuacgcgggcggauucgaaguccaagucauccuugccggaaacgcauucaccgcaggaaaagucaucuucgcagcaguaccucccaacuuccccacugaaggccucucaccaucacaaguaacuauguucccacacaucgucguagacguacgccaacucgaacccguccuaaucccccuccccgacguccguaacaacuucuaccacuacaaucaauccaacgaccccacuauaaaauuaauagccaugcucuacacaccccuccgcgcaaacaacgccggagacgacgucuucaccgucucuugcagaguccuaacccgcccuucccccgacuucgacuucaucuuccucguuccgccuaccgucgaaucacgcaccaaaccauuuucaguccccguacuaacagucgaagaaaugacaaacucucgcuuccccaucccacucgaaaaacuuuuuacaggcccuucuuccgcauucguuguucagccacaaaacggacgauguacgaccgacggcguccuccucggcaccacccaacucagccccguaaacauaugcacauuccgcggcgacguaacccacaucacuggaucccgaaacuacaccaugaaccucgcaucccaaaacugguccaacuacgaccccacagaggaaaucccagcuccccuaggcacccccgauuucguuggcaaaauacaaggcguccucacacaaaccacacgcacagacggcuccacccgaggccacaaggccaccgucuauacagguucugccaacuucgccccaaaacucggacgcguccaauucgaaaccgacaccgaccacgacuucgaggcaaaccaaaauaccaaauucaccccagucggcguaauacaagacgguggcaccacccaccgcaacgaaccccaacaauggguccuccccucauacucaggccguaacacacccaacguccaccucgcccccgccguugcccccaccuucccuggcgaacaacuacuauucuuccgcucuaccaugccaggaugcucaggcuaucccaacauggaccucgacugucuccucccccaagaauggguccaauacuucuaccaagaagccgcaccagcacaaucagacguugcgcuccuccgcuuugucaaccccgacaccggaagaguucuauuugaaugcaaacuccacaaauccggcuacgucaccgucgcacacaccgggcaacacgaccucguuauaccucccaacggcuacuuccguuucgacuccuggguaaaccaauucuacacccucgcacccaugggcaacggcaccggacgccgacgcgcacuguaa

SEQ ID NO: 36271 - RNA, 1623 nt, Artificial Sequence
  derived and/or modified sequence opt11 from VP1__Norovirus__AJF21976
augaaaauggcauccucagaugccaaccccuccgacggauccgcggccaaccugguccccgaagucaacaacgaaguaauggccuuagaaccaguagucggcgccgcuaucgccgcccccgucgccggccaacaaaacgucauugaccccuggauaagaaacaacuucguccaagcccccggcggcgaauuuacaguuagcccccgcaacgcccccggcgaaauacucuggucggcuccccucggacccgaccuuaacccguaccuuagccaccucgcccgcauguacaacggcuacgccggaggauucgaaguccaagucauccuagccggcaaugccuucaccgccggcaaaguaauauucgccgccguacccccaaacuucccgaccgaaggccucucaccaucccaagucaccauguucccccacaucguaguagacguucgccaguuagaacccguacuaaucccccuacccgacguccgcaacaacuucuaccacuacaaccaaucaaacgaccccacaaucaaacugauagccaugcucuacaccccacuccgagccaacaacgcgggugacgacguauucaccgucuccugcagaguccucacccgcccaucccccgacuucgauuucaucuuccuugucccacccaccguagaaucccggaccaaacccuuuucaguccccguccugaccgucgaggaaaugaccaacucuagauuccccauuccccucgaaaaacucuucaccggccccuccuccgccuucguaguacaaccccaaaauggccgcugcaccacagacggcguccugcucgguacaacccaacucucaccagucaacauaugcaccuucagaggcgacgucacccacauaaccggcucccguaacuacacaaugaaccucgcaucccaaaacuggucaaacuaugaccccacagaagaaaucccagccccgcucggcaccccagacuucguaggcaaaauccaaggcaugcucacccagaccacccgaacagacggcuccacccgcggacacaaagccaccgucuacacgggaucagcagacuucgccccaaaauuaggacguguacaauucgaaaccgacaccgaccacgacuucgaagccaaccaaaacaccaaauuuacccccgucggaguaauacaagacggaucaacaacccacagaaacgaaccacaacaauggguucuccccucauacuccggucguaacaccccaaacguccaccuagcacccgccgucgcccccaccuucccaggcgaacaacuccuuuucuuucgauccacaaugccaggcugcucaggcuacccaaauauggaccuugacugccuacucccacaagaaugggugcaauauuucuaccaggaagccgccccagcucaauccgacgucgcccuccuacgcuuugucaaucccgacacugguagaguccucuucgaaugcaaauuacauaaauccggcuacgucacagucgcacacacaggucaacacgaccuagucaucccacccaacggcuacuuccgcuucgacagcugggucaaccaauucuacacccuagcccccaugggcaacggaaccggccgccgacgcgcccucuaa

SEQ ID NO: 36272 - RNA, 1623 nt, Artificial Sequence
  derived and/or modified sequence opt11 from VP1__Norovirus__AJF21977
augaaaauggccucaucagacgccaaccccagcgacggauccgccgccaacuuaguccccgaggugaauaacgaaguuauggcacucgaaccagucgucggagccgcuaucgccgcacccgucgccggacaacaaaacguaauagaccccuggauucgcaacaacuucguccaagccccuggcggagaguucacaguaucacccagaaacgcuccaggcgaaauccucuggucagcaccccucggccccgaucucaacccuuaccuaagccaccucgcccguauguacaacggcuacgccggcggcuucgaaguacaaguaauacucgccggcaaugccuucacagccggaaaaguaaucuucgcugcaguuccacccaacuuccccaccgaaggccuaucccccucccaaguaacaauguucccucacauuguaguugacguacgacaacucgaacccguccuaaucccacuuccggacguccgaaacaacuucuaccacuacaaccaaucaaacgacccgacaaucaaacuaaucgcaaugcucuacacaccccuuagagccaacaacgcaggcgacgacgucuucaccguuucgugcagaguccuaacccgccccuccccagacuuugacuucauauuccucguacccccuaccguagaaucccgaaccaaaccauucucuguacccguacuaaccgucgaagaaaugacaaacucccgcuucccaauccccuuagagaaacuuuucaccggacccucaucugcauucguuguccaaccacaaaacggacgcugcacgaccgacggaguccuccucggaaccacucaacuuucccccguuaacauuugcaccuuccgcggcgacgucacacacaucaccggaagccacaacuacaccaugaaccuagcaucacaaaacugguccaacuacgaccccaccgaagaaauacccgcaccacucgggacccccgacuuugucggaaaaauccaaggcguacuaacacaaaccacacguaccgacggcuccacuagaggccacaaagccaccgucuacaccggcuccgccgacuucgcccccaagcucggccgcguacaauucgaaaccgauacaaaccacgacuucgaagcuaaccaaaacaccaaauucacaccagucggcguaauccaagacggcuccacaacacaccgaaacgaaccccaacaauggguccucccuucuuacuccggccgcaacacacccaacguccaucucgccccagcagucgccccaacauucccaggugaacaacuacucuucuuccguuccacuaugcccggcugcucuggcuaccccaacauggaccuagacugccucuuaccacaagagugggugcaauacuucuaccaagaagccgcucccgcacaguccgacguggcgcuacuacgauucgucaaccccgacacaggccgaguccucuucgaaugcaaacuccacaaauccggcuacguaaccgucgcccacaccggacaacacgaccuagucaucccacccaacggauauuuccgauucgacuccugggucaaccaauucuauacccucgcccccaugggcaacggcacaggccgacgucgagcucucuaa

SEQ ID NO: 36273 - RNA, 1623 nt, Artificial Sequence
  derived and/or modified sequence opt11 from VP1__Norovirus__AJF21978
augaaaauggcaucaagcgacgcuaauccauccgacggaucugccgcaaaccucguucccgaagucaacaaugaaguuauggcacuugaacccgucgucggcgcagcaaucgccgcccccgucgccggccaacaaaacgucauagacccuuggaucagaaacaacuucguccaagcucccgggggcgaguucaccguaucaccccgaaaugccccaggagaaauacucuggucugccccacuaggcccagaucucaaccccuaccucucccaccucgcccgaauguacaacggauacgccggcggauucgaaguccaagucauccuagcaggcaacgcauucaccgccggaaaaguaaucuuugcagcagucccucccaacuuccccacagaaggccucucacccucccaagucacaauguucccacacaucguagucgacguccgccaacuagaacccguccuuaucccacuucccgacguccgcaacaacuucuaccacuacaaccaaucaaacgacccuaccaucaaacucaucgcaaugcuauacacaccccuacgcgcuaacaacgcaggcgacgacgucuucaccgucuccugccgcguacucacccgcccuucccccgacuucgacuucaucuuccuagucccgcccacagucgaaagccgaacaaaaccauucucuguacccguacuuaccgucgaagaaaugaccaacucccgauuccccaucccccuggaaaaacucuucacgggccccuccagcgccuucgucguacaaccacagaauggccgaugcaccaccgacggcguauuacucggcacaacccaauuguccccugucaacaucugcaccuuccgcggugacgucacccacauaaccggaucacgcaacuacaccaugaaccucgccucccaaaacugguccaauuacgacccgacggaagaaaucccggcuccucucggaacccccgacuucgucggcaagauccaaggcguacucacccaaaccacacguaccgauggcuccacccgcggccacaaggccacagucuacacaggcucagccgauuucgcccccaaacucggcagaguccaauucgagacggacacugaccacgacuucgaaacuaaccaaaauacaaaauucacccccgucggcguaauccaagacggcggcaccacccaccgcaacgaaccccaacaauggguacuaccuucauauucuggccgcaacacaccuaacguccaccucgcccccgccguugccccaacauuccccggcgaacaacuccucuuuuuccgcagcacuaugcccggcugcuccggcuaccccaacacagaccucgacugccuccucccacaagaauggguucaauauuucuaccaagaagccgccccagcacaauccgacguagcccucuuacgauuugucaaccccgacaccggcagaguccucuuugaaugcaagcuccauaaauccggcuacguaaccgucgcccacaccggccaacacgaccuuguaauaccucccaacggauacuucagauucgacagcugggucaaccaauucuacacccuugcaccaaugggaaacggcaccggccgccgacgagcccuauaa

SEQ ID NO: 36274 - RNA, 1623 nt, Artificial Sequence
  derived and/or modified sequence opt11 from VP1__Norovirus__AJF21979
augaagauggcauccagcgacgccaaucccuccgacggcagcgccgccaaccuaguucccgaagucaacaacgaaguaauggcucuagaaccagucguaggagccgccaucgcagcacccgucgcaggucaacaaaaugucaucgaccccuggauccgcaacaacuucguccaagcacccggaggcgaguucacaguaagcccccgaaacgcacccggagaaauauuaugguccgcaccccucggcccagaccucaaccccuaccucucccaccucgcacggauguacaacggcuacgccggaggcuucgaaguccaagucauccuagcugggaacgccuucaccgcaggcaaagucaucuucgccgccguaccuccaaacuuccccacagaaggccuaucacccucacaaguaaccauguucccccacaucguagucgauguacgacaacucgaacccguccuaaucccccuuccagacguacgcaacaacuucuaccacuacaaccaauccaacgacccaaccaucaaacucauagcaaugcuauacacaccacuccgcgccaacaacgccggcgacgacgucuucaccguguccugccgaguacugacaagaccaagccccgacuucgacuucaucuuccuagucccacccaccguagaaucccgcacuaaacccuucagcguacccguccucaccguagaagaaaugaccaacuccagauuucccaucccccucgaaaaacuauucaccgggccuucaagugccuucgucguccaaccacaaaacggacgaugcaccaccgacggaguccuacucggcaccacccaacugagcccagucaacaucugcaccuuccgcggagacgucacgcacauuaccggcucccacaacuacaccaugaaccuugcuucccagaacuggucaaacuacgauccaaccgaagaaaucccagcaccccucggcacccccgacuucgucggcaaaauccagggcguccucacccaaacaaccagaacagacgguagcacacgcggccacaaagccaccgucuacacaggcucagccgacuucgcaccaaaacuaggacgaguucaauucgaaacagacacaaaccaugacuucgaagcaaaccaaaacacaaaauucaccccuguaggaguaauccaagacggcggcacaacccaccgaaaugaaccgcaacaauggguacuacccucuuacucaggacgcaacaccccaaacguccaccucgcacccgccgucgcacccaccuuuccaggagaacaacuccucuucuuccgcucaacuaugcccggaugcucaggcuaucccaacauggaccucgacugccuucuaccccaagaauggguccaauacuucuaccaagaagccgcacccgcacaauccgaugucgcacuucuccgcuucgucaacccagacaccggccgcguccucuucgagugcaaacuccacaagagcggauacguuacagucgcucacaccggucaacacgaccucguaaucccucccaacggauacuucagauucgacuccuggguuaaccaauuuuacacacuagcccccaugggcaacggcaccggcagacgucgcgcacuauga

SEQ ID NO: 36275 - RNA, 1623 nt, Artificial Sequence
  derived and/or modified sequence opt11 from VP1__Norovirus__AJF21980
augaaaauggccuccagcgacgcaaaccccuccgauggauccgccgcaaaccucguccccgaaguaaacaaugaagucauggccuuagaaccagucguaggcgcugccaucgccgcccccguugccgggcaacaaaacguaaucgacccuuggauacgaaauaacuucguccaagcaccaggcggcgaguucacgguaucuccccgcaacgccccaggcgaaauacucugguccgcuccccucggccccgaccucaacccauaccucucccaccucgccagaauguacaacggcuacgcaggggguuucgaaguccaagucauacucgccggcaacgccuucaccgccggaaaagucaucuucgcagcagucccgcccaacuuccccacugaaggccucucccccucccaagucacaauguucccccacauaguuguagacguccgacaacucgaacccguccucaucccccuacccgacguccgcaacaacuucuaccacuacaaccaauccaacgacccuacaaucaaacuaauugccaugcuauacaccccacuccgagcuaacaaugccggcgacgacgucuucacuguuuccugccgcguucucacacgacccuccccugacuucgacuucaucuuccuaguaccacccaccguagaaucacgcaccaaacccuucuccguccccguccuaaccgucgaagaaaugaccaacucccgauuccccauaccacucgaaaaacuauucaccggacccuccucagccuucguuguccaaccacaaaacggccgcugcaccaccgacggaguccuccucggcaccacccaacuuucucccguuaacaucuguaccuuccgcggcgacgucacccacaucaccggcucucgcaacuauacaaugaaccucgccucacaaaacuggaacaacuacgacccaacugaagaaauacccgcaccccucggcacccccgacuucgucggcaaaauccaaggcaugcuaacccaaaccacccgcacagacggauccacccgcggacacaaagccacaguauauacaggcuccgccgacuuugcccccaaacuaggacggguacaauucgaaaccgacacagaccacgacuuugaagcaaaccaaaacacaaaauucacccccgucggagucauccaagacggcuccaccacccaccgcaacgaaccccagcaauggguccuaccuuccuacuccggacgcaacacccacaauguccaccucgcgccagcaguagccccuaccuucccuggagaacaacucuuguuuuuccgcuccaccaugccuggaugcucuggauaccccaacauggaccuugauugccuacuuccccaagaauggguccaguacuuuuaccaagaagcagcacccgcccaaucagacgucgcacuccuccgcuucguaaauccugacacaggacgcguccucuucgaaugcaaacuccacaaauccggcuacgucaccguagcccauaccggccaacacgaccucgugauaccacccaacggauacuucagauucgacagcuggguaaaccaauucuacacacuagccccaaugggcaacggcaccggccgccgacgggucgucuaa

SEQ ID NO: 36276 - RNA, 1623 nt, Artificial Sequence
  derived and/or modified sequence opt11 from VP1__Norovirus__AJF21981
augaaaauggcaagcuccgacgccaaccccucagacggcucugccgcuaaccucguaccggaagucaacaacgaaguuauggcauuagaacccgucguaggcgcagcaaucgcagcccccgucgcaggacaacagaacguuauagaccccuggauccguaauaacuucguccaagcucccgggggcgaguucacaguaucaccucgcaaugcucccggcgaaauccucugguccgcaccccuaggacccgaccucaacccuuaccucucucaccuagccagaauguacaauggcuaugccggcgguuuugaaguacaaguuauccuagcuggcaacgccuucacagccggcaaagucauuuucgcagccgucccaccaaacuucccuaccgaaggacucuccccaucccaagucacaauguucccccacauagucgucgacgucagacaacucgaacccguccucauaccacuacccgacguacgcaauaacuucuaccacuacaaccaaucaaacgacccaaccauaaaacucaucgccaugcucuacaccccucuccgcgccaacaacgcaggcgacgacgucuucaccgucuccugccgaguauuaacccggcccagcccugacuucgacuucauuuuccuaguacccccaaccgucgaaucgcgaaccaaacccuucuccgucccaauccuaaccgucgaagaaaugaccaacucccgcuucccaauaccccucgaaaaacuauucacgggccccuccuccgccuucguaguccaaccccaaaacggccgaugcacaaccgacggcguacuccugggcaccacacaacuuucaccaguuaacauaugcaccuucagaggcgacgucacccacaucacaggcucccgcaacuacacaaugaaucucgccucccaaaacugguccaacuacgaccccaccgaagaaaucccagcaccauuaggaauaccagacuucgucggcaagauccaaggaaugcuaacccaaaccacccguacagacggauccacccguggccacaaagccaccguuuacaccgguuccgcagacuucgcacccaaacucggccgcguccaauucgaaaccgauaccgaccacgacuucgaagccaaccaaaacaccaaauucaccccaguaggcgucauccaagacggcucgaccacacaccgcaacgaaccccaacaauggguccuacccuccuacucaggaagaaacacacccaacguacaccuagccccagccgucgcuccaaccuuucccggcgaacaacuccucuuuuuccggucuacaaugccaggcugcuccggauauccaaacauggaccuagacugccuccucccccaagaauggguccaauauuucuaccaagaagcagcccccgcacaaucggacgucgcccuacuccgcuucgucaauccugacaccggucgaguccucuucgaaugcaaacuacacaaauccggcuacgucaccguagcccacaccggucaacacgaccucguaaucccucccaacgguuacuuccgauucgacucauggguaaaccaauuuuacacauuagccccaaugggcaacggcacaggacgacgccgcgcccucuaa

SEQ ID NO: 36277 - RNA, 1623 nt, Artificial Sequence
  derived and/or modified sequence opt11 from VP1__Norovirus__AJF21982
augaagauggccagcucagacgcaaaccccagcgacggcagcgccgccaaccuagucccagaaguuaacaacgaaguuauggcccucgaaccagucguaggcgcagccaucgccgcuccuguagcuggacaacagaacgucaucgaccccuggauccgaaacaacuucguacaagcccccggcggcgaguucacaguaucaccacgcaacgcgccaggcgaaauccucuggucugcaccccugggacccgaccuuaaccccuaccucucacaccuagcccgcauguacaacggcuacgccggaggcuucgaaguccaagucaucuuagccggcaacgcauucacagccggaaaagucaucuucgcugccguaccacccaauuuccccaccgaaggccucucacccucacaaguuaccauguucccucacaucguagucgacguacgucagcucgaacccguucuaaucccccuccccgacguucgaaacaacuuuuaccacuacaaccagucuaacgaccccaccaucaaacucaucgcaaugcuauacacuccccuccgagccaacaacgccggcgacgacgucuucacaguuucuugcagaguacuaacacgccccucgcccgacuucgacuucauauuccucgucccacccaccguagaaucacgcaccaaacccuucagcguccccguccuaaccguugaagaaaugacaaacucccgguuccccauuccacucgaaaagcuauucacgggccccucuuccgcuuucgucguacaaccccaaaacggcagauguaccacagacggaguccuacuuggcaccacccaacucuccccagucaacaucugcaccuuccgcggcgacguaacacauaucacgggaucucacaacuacacaaugaaccucgccagccaaaacugguccaacuaugaccccaccgaagaaauccccgcaccccuaggcacaccagacuuugucggcaaaauccaaggaguacucacccaaaccacccgcaccgacgguucaacucgcggacacaaagccaccguauacaccggcuccgccgacuucgcccccaaacucggccgaguacaauuugaaaccgacacagaccgagacuucgaagccaaccaaaacacuaaguucacccccguaggggucauccaagacgggggaacaacacaucgaaacgaaccacaacaauggguacuccccuccuacucuggccgaaacacaccaaacgugcaccuagcacccgcaguagcccccaccuuccccggcgaacaacuacucuucuuucgcuccacaaugccaggauguuccgguuaucccaacauggaccuugacugccuccuaccacaagaauggguccaauacuucuaccaagaagccgcccccgcccaauccgacgucgcccucuuacgauucgucaacccagacacaggacgcguacucuucgaaugcaaacuacacaaaucaggcuacgucacuguagcccacacaggccagcacgaccuagucaucccacccaacggcuacuuccgcuucgacuccuggguaaaccaauucuauacacucgcacccaugggcaacggaacaggccgccgccgcgcacuguga

SEQ ID NO: 36278 - RNA, 1623 nt, Artificial Sequence
  derived and/or modified sequence opt11 from VP1__Norovirus__AJF21983
augaaaauggccucauccgacgccaaccccuccgacggcucagccgccucccuuguaccagaaguuaacaacgaagucauggcacuagaacccgucguaggcgccgccaucgcagccccuguagccggccaacaaaacgucaucgaccccuggauacggaacaacuucguccaagcccccggaggugaauuuaccgucucuccucgcaacgcccccggcgaaauccucugguccgccccacucggcccugaccuaaaccccuaucuuucccaccucgcccgcauguacaacggcuacgccggcggauucgaaguccaagucauccuggccggcaacgccuucacagccggaaaaguuaucuucgcugccguacccccaaacuucccuaccgaaggccuaucccccucgcaagucaccauguucccccauaucgucgucgacguccgacaacuagaaccaguccucaucccccuccccgacguucgcaacaacuucuaucacuauaaccaaagcaacgaccccacaaucaaacucaucgccaugcucuacacaccccuccgcgcaaacaacgcaggagacgacgucuucacaguauccugccgaguucucacacguccaucccccgacuucgacuucauauuccucguacccccuaccgucgaaucacguaccaaaccauucagcguaccuguacucaccgucgaagaaaugaccaacucacgauuccccaucccccuagaaaaacucuucacaggacccucuagcgcuuucguaguacaaccacaaaauggccgcugcaccacagacggcguccuccugggcacaacccaacuuucccccgucaacaucuguaccuuccgcggcgacguuacccacaucacaggcucccguaacuacaccaugaaccucgccucccaaaacuggaacaacuacgaccccaccgaagaaauccccgcaccccuagguacccccgacuucguaggaaagauccaaggcgucuuaacccaaaccacccgcacagacgguuccacacgcggccauaaagcaaccgucuacacaggcuccgccgacuucucccccaaacucggaagaguccaauucgaaaccgacacugaccgagacuucgaagcuaaccaaaacacaaaauucacccccgucggcgucauccaagacggaggcacuacacaccgaaacgaaccccaacaauggguacugccaucauacuccggccgcaacgcaccaaacguccaccucgccccagcuguugcccccacauuuccuggggaacaacuacucuucuuucguuccacaaugcccggcugcuccggcuaccccaacauggacuuagacugccuccuaccucaagaauggguccaauacuucuaccaagaagcagcccccgcgcaauccgacgucgcacuacuacgauucgucaacccagacaccggacgcguccuauucgaaugcaaacuccacaaaucaggcuauguaaccgucgcccacaccggccaacacgaccucgucaucccacccaacggcuacuuccgguucgacucauggguaaaccaauucuacacacuagccccaauggguaacggcacaggaagacgccgugcacucuag

SEQ ID NO: 36279 - RNA, 1623 nt, Artificial Sequence
  derived and/or modified sequence opt11 from VP1__Norovirus__AJF21984
augaaaauggccuccucagacgccaaccccucggauggauccgccgccaaccucguucccgaagucaauaacgaagucauggcccucgagcccgucguaggggccgccauagccgccccagucgcaggccaacaaaacguaaucgaccccuggauccguaacaacuucguccaagcaccaggaggcgaguucaccgucucaccccgcaacgccccaggcgaaauccuuugguccgcaccccucggacccgaccucaacccuuaccucucccaccuagcacgcauguacaauggcuacgccgguggauuugaaguacaagucauccucgccggcaacgccuucacagccggcaaagucaucuucgccgccguaccacccaacuuccccacugaaggccucucacccucacaagucacuauguuuccccacauugucguagacgucagacaacucgaacccgucuuaauaccccucccagacguacgcaacaacuucuaccacuacaaccaaucaaacgaucccacaauaaaacuaaucgccaugcucuacacaccccuacgcgcuaacaacgccggcgacgacguauucaccguaagcugucgcguacuaacccgacccucacccgacuucgacuucaucuuccucguaccaccaaccguagaaucccgcacgaaaccauucucugucccaguccuaaccguagaagaaaugacuaacagccgauucccaaucccccuagaaaaacuauucaccggacccucauccgccuucguaguccaaccacaaaacggacgaugcacaaccgacggcgucuuacuagggacuacacagcucagccccgucaacaucugcacauucagaggcgacguaacacacauuacaggcucucacaacuacaccaugaaccuagcaucccaaaacugguccaacuacgacccaaccgaagaaaucccagccccuuuaggcacccccgacuucguaggaaaaauucaaggcguccuaacacaaaccacaagagcagauggcucgacucgcggccacaaagcaacgguauacaccggcuccgcagauuucgcccccaagcugggacgcguacaauucgaaaccgacaccaaucacgacuucgaagcuaaccaaaacaccaaauucacaccagucggcgucauccaagacgguggaacuacacaccguaacgagccccaacaguggguacuccccuccuacuccggccguaacacccccaauguccaccucgcccccgccguagcaccaaccuucccuggcgaacaacuccuauucuucagaagcaccaugcccggcugcagcggcuaccccaacauggaccucgacugccugcucccccaagaauggguccaauacuucuaccaagaagcagccccagcacagagcgacgucgcacuucuccgcuucgucaaccccgacaccggacgcguucuauucgaaugcaaacuacacaaauccggauacgucaccgucgcccacaccggacaacacgaccuugucaucccaccaaacggcuacuuccgauucgacucuugggucaaccaauucuacacccucgcucccaugggaaacggaaccggcagaagacgagcgcuauaa

SEQ ID NO: 36280 - RNA, 1623 nt, Artificial Sequence
  derived and/or modified sequence opt11 from VP1__Norovirus__AKE37037
augaaaauggcuucaaacgacgcggcaccauccaacgacggcgccgccggccuuguccccgaaggaaacaacgaaacucucccucuagaacccgucgcaggcgccgcaauugcagccccggucaccggccaaaauaacaucaucgaccccuggauccgaaccaacuucguacaagcaccaaacggcgaauuuaccgugucccccagaaacagccccggcgaaauccugcucaaccucgaacucggccccgaccucaacccauaccucgcccaccuaagccgcauguacaacggcuacgccggcggugucgaaguccaaguacuacucgcuggcaaugccuucaccgccggcaaaauacucuucgcagcggucccacccaacuuccccguagaguucuuaucacccgcccaaaucaccaugcuuccccacuuaaucgucgacgugcguacccuagaaccuaucaugaucccccuccccgacguccggaacaccuucuuccacuacucaaaccaaccaaacucccgcaugcguuuggucgcaaugcuauacacaccccuccguuccaacggcuccggcgacgacgucuuuaccgucuccugccgaguccucacccgacccaccccggacuucgaguucacauaucuuguaccuccauccgucgaaucuaaaaccaaacccuucucacuacccauacuaacccuuucagaacucaccaauucacgcuucccugucccaaucgacucacucuucacugcccaaaacaacguccuccaaguccaaugccaaaacggacgcugcacacucgacggagaauuacaaggaaccacccaacuccuacccucagguaucugugccuuccgcggacgcguaaccgcacaaauaaaccaaagagaccgauggcacaugcaacuccaaaaccucaacggcaccaccuacgaccccacugacgacgucccagcaccccuaggcacccccgacuucaaaggcgugguauucggaauggucucacaacgaaacgucggcaacgacgcccccggaagcacucgcgcacagcaagccugggucucaaccuacuccccacaauuuguuccaaaacucggcucagucaaccuacgcaucuccgacaacgacgacuuccaauuccaacccaccaaauucaccccugucggcguuaacgacgacgacgacggccaccccuuccgccaaugggaacuaccaaacuauagcggagaacucacccuaaacaugaaccucgccccaccuguugcucccaacuuccccggagaacaacuucucuucuuucgcuccuucgucccaugcuccggaggcuacaaccaaggaauaaucgacugccucaucccccaagaauggauacaacacuuuuaccaagaaucagcacccucccaaucagacgucgcccucaucagauacgugaacccagacacaggucgaacacucuuugaagcuaaauuacaccgcuccggauacauaaccgucgcccacuccggcgacuacccacucgucgucccagccaauggccacuuccgcuucgacuccugggucaaccaauucuacagccuagcuccaaugggaacaggcaacggccggcgccgcgcacaauag

SEQ ID NO: 36281 - RNA, 1632 nt, Artificial Sequence
  derived and/or modified sequence opt11 from VP1__Norovirus__AKM20815
augaugauggccuccaaagacgcccccaccaacauggacgggaccuccggcgcuggccaacucgucccagaagcaaacacagccgaaccccuuccaauaaaacccgucgcuggagcagcaaccgccguagcaaccgccggccaagucaacaugaucgacccauggaucaugaacaacuucguccaagcuccccaaggugaauuuacaaucucacccaacaacacccccggagacauccucuucgaccuacaacucggcccucaccuaaacccauuccucgcccaucuuucacgaauguacaacggcugggucggcaauaugcagguacgcaucaugcucgccggcaacgccuucucagccggcaaaaucauagucugcugcaucccacccggcuucucaucccaauccauuuccaucgcccaggccaccauguucccacacguaauagccgacguccgaguucuagaacccauagacgucccccuagacgacguccgcaacguccuauuccacaacaacgacaauccccaaaccaugcgccuccucugcaugcucuauacaccccuacgcuccgguggcaccuccucaggaaccgacccauuugucauagccggacgcguccuaaccugccccaccccagacuucagcuuccucuuccucguaccuccagacauagaacaacgaaccaaaccauucucuguuccuaacauacccaugaaccucauguccaacucccgcgucucuaugcugauugauggaaugauggucucuaacgaucaaaaccaagucccccaguuccaaaacggccgagucacacuagacggacaacuacaaggaacuacaaccgucagcgcagccugcgucgcccguaugcgcggacgcaucuuuaacaacaauggaaacuacggagucaaccuuaccgaacuagauggcaaccccuaccacgccuuugauuccccugcaccccuggguuucccugacuucggcaacugcgaccuacacaugacauucguaaaaauaaacccaaacgaacucucuucaggcgacccaagcggcaaagucgucauacgcuccuaugacgccaccuucgccccucaucuuggcaccgucaaacucgaaaacgaugacgaacuagcccguuucgucggaaaagaagucguccuagaauuaacaugggucuccaaccgcgaaggcgccacccucaaccuuugggccguccccaacuacggcuccucucuuacucaagccucucaacucgccccacccaucuacccgcccggcuucggagaagcaaucgucuacuucaccuccacuuuccccaccgucucuaaccccaaaguccccugcacacucccccaagaguucgucucccacuucguaaacgaacaggcacccacccgcggcgacgccgcacuccuccauuacgucgaccccgacacccaccgcaaucucggcgaguucaaaauguaccccgaaggcuacaugaccugcguccccaacgccgguggcggaccacaaacccuuccaauaaacggcgucuucguauucauaucuugggucagccguuacuaccaacucaaaccgguaggcaccgcaggcgccgcacgccgccucggccuccgccgauccuaa

SEQ ID NO: 36282 - RNA, 1623 nt, Artificial Sequence
  derived and/or modified sequence opt11 from vp1__Norovirus__AKM20818
augaugauggcauccaaagacgcaccaaccuccccugacggcgccucuggcgccggucagcucguccccgaagcaaacaccgccgagcaaauauccauggacccagucgcaggagccuccaccgcaguagccaccgccggacaaguaaacaugaucgaccccuggaucuucaacaacuuuguccaggcaccacaaggagaauuuacaaucucacccaacaacacacccggcgacauccucuucgaccugcagcucggcccccaccuaaaccccuuccuagcacaccuaagccaaauguacaacggguggguaggcaacaugcgaguccgcauucuccucgccggcaacgccuucaccgccggaaagaucaucauaugcugcgucccacccggauucgacgcacgcauacucaccaucgcccaagccacccucuucccccaccucauugccgacguccgcacacucgaacccgucgaacuaccacuugaagacguccgcaacguccucuaucacaacagcucccaaccccaacccacaaugcgucuuguagccaugcucuacacgccccuacgcacuggaggcggcagcggcggaaccgacgcauucguagucgccggccgcguccucacaugcccagcccccgacuucuccuuccucuuucuuguaccacccucaguugaacagaaaacccgcgucuucuccguccccaauauuccccuaaaagaucuaagcaacucucgcguucccguccccauacaaggcauguucauguccccagacgucaaccaauccguccaauuccaaaacggccgaugccaaaucgacggacaacuacaagguaccaccccagucucacucucgcaacuaugcaaaauccgcggaaaaacaagcucgaacgcccgcguccuaaaucuaagcgaagucgacggcacaccauucauaccccucgaaucccccgcacccgucggcuuccccgaccucggcggaugcgacuggcacguaaauuucuccuuccaaacccaagaccgcgaccccucgcaaucagucaccuucgcaaccaacgacgcaucauucgucccauacuuaggcuccguaucaccucacaacggagaaggcuuccaagccggagacaucaucggcucccucggauggaucuccgcccccuccgacaacagccaguucaacgucugggcgaucccaaaauacggcuccucccuccccgacguaacccaccuggcuccugcugucuucccacccggauucggugaagucauacuauacuucuacuccacauuucccggaucuggacaaccaucccaacuccaaguccccugccuccucccccaagaauuuauaacacauuucugcaacgaacaggcccccauagcuggcgaagccgcccuacuccacuacguggaccccgauaccggacggaaucuuggagaguucaaacucuaccccgauggcuucaugaccugcgucccaaacuccguauccuccggaccccaaacucucccaauaaacggcguguucgucuucgucucuugggucucacgcuucuaccaacucaaacccgucggcaccgcaucugccgcaagacgccucgggcuccgccgcaucuaa

SEQ ID NO: 36283 - RNA, 1623 nt, Artificial Sequence
  derived and/or modified sequence opt11 from VP1__Norovirus__ALD83748
augaaaauggcguccaaugacgccgcccccuccaaugacggugccacaggucuugucccggaaguaaacaacgaaacccucccccucgaaccaguagccggcgccgcaaucgccgcgcccgucacaggccaaaacaacauaaucgaccccuggauacgcacuaacuucguccaagccccaaacggagaauuuaccgucucacccagaaacucccccggcgaaauccuacuaaaccucgaacucggccccgaccucaaucccuaccucgcccaccuaucccgcauguacaacggguaugccggaggcgucgaaguccaaguccuacucgcuggaaacgcuuucaccgccggcaaaauccucuucgccgccguuccucccaacuuccccgucgaguuccucagcccugcccaaauaaccaugcuaccccaccucaucgucgaugugcgcacccucgaaccuaucaugaucccacuccccgacguccgaaacacauucuuccacuacaacaaccaaccaacaaaccgcaugcgccuagucgccaugcuguacacaccccuccgaucaaaugguucaggcgacgacguguucaccguaaguugccgaguccucacccgccccacacccgacuucgaguucacuuaccucguacccccuucaguugaauccaaaaccaagccauucucccuccccauacucacaaucuccgaacucacaaacucccgcuuccccguaccagucgacucccuuuucaccgcacaaaacaacaaccucaacguccaaugccaaaacggccgcuguacccucgacggugaacuccaagguacuacccaacuacaacccucuggcaucugugcauuccgcggaaaaauaaccgcagacguucgacccaaccaugacgaccgauggcacaugcaacuuaccaaccucaacggcacccccuucgaccccaccgaagacguacccgccccucucggcacccccgauuucaccggccuucucuucggcgucgcaucccaacgaaacguacaacccaaccccaacaccacccgcgcccacgaagccgucauuuccaccaccuccucucaauucguucccaaacuaggcagcaucaacuucggcuccacuucagaagacuucaucgucggccaaccaaccaaauucaccccaguuggcauaaaaaucgaagacggccacgccuucgaccaguggacccuuccacgcuacucaggccaccucacacuaaacaugaaccuagccccucccgucgccccaaacuuccccggugaacaacuccucuucuuccgauccaacgucccaugcgccgguggcaucuccgacggcgucauugacugccugcucccccaagaauggauacaacacuucuaccaagaauccgcacccucgcaaagcgacgucgcccucaucagauacguaaaccccgacacaggacgcacacucuucgaagcaaaacuccaucgcaccgguuacauaaccguagcccacuccggcgauuacccacuugucgucccuuccaacggauacuucagauucgacucuugggucaaccaguucuauucccuagccccaaugggcaccggcaacggccgcagacgcguucaauaa

SEQ ID NO: 36284 - RNA, 1623 nt, Artificial Sequence
  derived and/or modified sequence opt11 from VP1__Norovirus__ALF12528
augaaaauggcaucauccgacgcaaaccccuccgacggaucaacagccaaccucguacccgaaguuaacaacgaaguuauggcccuugaacccguagucggugcagccaucgccgcccccgucgcgggccaacaaaauguaaucgaucccuggauacguaacaacuucguccaagcucccggcggcgaguucacagucucaccccgcaacgcaccaggagaaauccuuugguccgcccccuuaggccccgaccuaaacccauaucucucccaccuagcacgaauguauaacggcuacgccggaggcuucgaaguacaagucauccuugccggaaacgcauucaccgcaggaaaaauaauauucgcagcagucccaccuaacuuccccacagaaggacuaucacccucccaagucaccauguucccacacaucaucguagacguacgccaacuagaaccaguacucaucccccuccccgacguacgaaacaacuucuaccacuacaaccaauccaacgacccaaccaucaaacucaucgcuaugcuuuacacaccccuacgagccaacaacgcgggcgaugacguguucaccgucuccugccgcguccucacccgccccuccccagacuucgacuuuauauuccugguaccucccaccguugaaucccgcaccaaacccuucuccguacccauccucaccguugaagaaaugaccaacucccgauucccaaucccacucgaaaaacuauucaccggacccucauccaccuucguaguucaaccccaaaacggucgcugcaccacagacggcguacuacuaggaaccacacaauuauccccagucaacaucuguaccuuucgaggagacgucacccauauagccggaucacauaacuacaccaugaaccucgccucccaaaacuggaacuccuacgacccaaccgaagaaauacccgccccacuagguacccccgacuucgucggaaaaauccaaggaguccucacccaaacaacccgaaccgacggauccaccagaggccacaaagccaccguuuacacaggaucggcagacucaucaccaaagcucggcagaguccaauucgcaacagacaccgauaacgacuucguagcaaaccaaaacaccaaauucacccccguaggagucauccaagacggcggcaccgcacaccguaacgaaccccaacaauggguucucccaucauacuccggccgcaacacccacaacguccaccuugcacccgccgucgccccaacauuccccggcgaacaacuacucuucuuccgcuccaccaugcccggcugcuccggauaccccaauauggacuuagacugccuccucccacaagaauggguacaauacuucuaucaagaagccgcccccgcacaaucagacguagccuuacuccgcuucgucaacccagacaccggacguguccucuucgaaugcaaacuccacaaauccggcuacgucacccaagcccacacaggccaacacgaccuugucaucccacccaacggauacuuucgcuucgacagcugggucaaccaauucuacacacuugcccccaugggcaacggcaccggaagacgccgcgcacuauaa

SEQ ID NO: 36285 - RNA, 1623 nt, Artificial Sequence
  derived and/or modified sequence opt11 from VP1__Norovirus__ALF12529
augaaaauggccagcuccgacgccaaccccuccgacggcucugccgcaaaccucguuccagaagucaacaacgaagucauggcccuugaaccagucguaggagccgcaaucgccgcccccguugccggacagcaaaacgucaucgacccauggauccgcaacaacuucguccaagcaccaggcggcgaauuuaccgucuccccacgcaacgccccuggagaaauacucuggagugcaccccucggucccgaucucaaccccuaccuuucucaccucgcccgcauguacaacgguuacgcaggcggcuucgaaguacaaguaauccuagcaggcaacgcauucaccgccggcaaaaucguauucuccgcagucccaccaaacuucccaacagaagggcucucacccucacaggucacaauguucccccacaucaucgucgacguccgccaacuugaaccuguccucauuccccuaccagacguccgaaauaauuucuaccacuacaaccaauccaacgaccccaccaucaaacuaauagcaaugcuauauacaccccuccgagccaacaacgcuggagacgacguauuuaccgucagcugccguguucucacccgccccuccccagacuucgacuucaucuuccucguucccccaacagucgaaucccgaaccaaacccuucucuguacccauacuuaccgucgaagaaaugacaaacucccguuucccaauaccccuagaaaaacuauuuacaggaccauccuccacuuuugucguccaaccccaaaacggccgcugcaccaccgacggcguacuucuaggcaccacccaacuuuccccagucaacaucugcacauuccgcggagacgucacccacaucgcgggcucucgaaacuacaccaugaaccuagcaucccaaaacuggaauaguuacgauccaaccgaagaaaucccagcuccccucggaacccccgacuucgucggaaaaauccaaggcguacuaacacagaccacccgcacagacggcucaacccgaggccacaaagccaccgucuacaccggauccgccgacuuuucacccaaacucggacgcguccaauucgccaccgacaccgacaacgacuucgacgccaaccagaauacuaaguucacccccguaggcguaauccaggacggcaacaccgcccacagaaacgaaccccaacaguggguacuuccgucauacagcggccgcaacacacacaacguccaccucgcccccgccgucgccccgaccuuccccggagaacaacuccucuucuuccgcucaaccaugcccggcugcucaggauaccccaacauggaucuagacugccuccuuccacaagaauggguccaauauuucuaccaagaagccgcccccgcucaauccgauguugcccuucuacgauucgucaaccccgacaccggccgaguccucuuugaaugcaaacuccacaaauccgguuacguaaccguagcccacaccggccaacacgaccucguaauacccccaaacggcuacuucagauucgacucaugggucaaccacuucuacacucuagccccaguaggaaauggcaccggcagacgacgcgcccucuaa

SEQ ID NO: 36286 - RNA, 1623 nt, Artificial Sequence
  derived and/or modified sequence opt11 from VP1__Norovirus__ALF12530
augaaaauggccuccagcgacgccaaccccuccgacggauccacagccaaccucguacccgaagucaacaacgaaguuauggcacuagaacccgucgucggcgcagcaaucgcagcacccgucgccggccaacaaaacgucaucgaccccuggauccguaacaacuucguacaagccccaggcggcgaguucaccgucagcccccgcaacgcucccggagaaauccucugguccgcaccacugggcccggaccucaaccccuaccucagccaccucgcccgcauguacaacggcuacgccggcggauucgaaguccaagucauacucgcaggcaacgccuucacagcaggaaaaaucaucuucgccgcuguaccucccaacuucccaaccgaaggacucuccccaucgcaagugacaauguucccccacaucaucguagacguccgacaacucgaacccguucucauaccccucccugacgucagaaacaacuucuaucacuacaaucaauccaacgaccccaccaucaaacugaucgccaugcucuacaccccucuccgcgcaaacaacgccggcgacgauguuuuuaccguaucaugccgcguccuuacucgaccaucaccugacuucgacuucauauuccucgucccgcccacagucgaaucgcgaaccaaacccuucucagucccaauccucaccgucgaagaaaugaccaacucccgcuucccaauaccccucgaaaaacucuucaccggcccauccucugccuucguaguccaaccccaaaacggccgaugcacaaccgacgguguacuccuagguaccacgcaacucucacccgucaacauaugcacauuccgcggcgacgucacccacauagcaggaucccacaacuacaccaugaaccucgccucacaaaauuggaacuccuacgauccuaccgaagaaauccccgccccacucggaaccccagacuucgucgguaaaauacaaggcguacucacccaaacgacccgcgcggacggcuccacacggggacacaaagccaccgucuacacaggcagcgccgacuucagccccaaacuaggccgcguccaauucgcuacagacacaaacaacgacuucgacgccaaccaaaacaccaaauuuacacccgucggcgucauccaagacggcgaaaccgcacaccgcaacgaaccccaacaauggguacuacccagcuacuccggccgcaacauacacaacguccaccucgcccccgccguagcccccaccuuucccggagagcaacuucucuucuucagauccacuaugcccgggugcuccggcuaccccaacauggaacuagacugccucauaccccaagaguggguccaauacuuuuaccaggaagccgcccccgcccaaagcgacguugcacugcuccgcuucgucaacccagacaccgguagaguacuauucgaaugcaaauuacacaaaucuggcuacguaacaguagcccacaccggucaacacgaccucguaaucccucccaacggauacuuccgauucgacuccugggucaaccaauucuacacucuugcccccaugggcaacggcaccggccgucgcagagcccuuuag

SEQ ID NO: 36287 - RNA, 1623 nt, Artificial Sequence
  derived and/or modified sequence opt11 from VP1__Norovirus__ALF12531
augaaaauggcaaguucagacgcaaaucccagcgacggcucaacagccaaccuaguccccgaagucaacaacgaagucauggcccuagaaccagucguaggggccgcaaucgccgcccccgucgcaggucaacaaaacgucaucgaccccuggauccgaaacaacuucguccaagccccuggcggcgaauuuaccgucagcccccguaacgcccccggagaaauacucuggagcgcuccccucggacccgaccucaaccccuaccuaucacaccuagcccgcauguacaacggauacgccggaggauucgaaguccaagucauccuagccggaaacgccuucaccgcaggcaaaaucauauucgccgccguacccccaaacuuccccacagaaggccuauccccaucacaaguaaccauguucccccacauaaucgucgacguccgccagcuggaacccguacucauaccccuccccgacguccgaaacaauuucuaccauuacaaccaauccaaugacuccaccauaaaacuaaucgcaaugcuuuacacaccccuccgcgccaacaacgccggcgacgacgucuucacaguauccugccgcguccucacccgcccgagcccggacuucgacuuuauauuccucgucccucccacuguagaaucacgcaccaaacccuucucaguccccauccucaccgucgaagaaaugaccaacagccgcuucccuaucccccuugaaaaacucuucacuggccccucaucagccuucgucguccaaccccaaaacggucgcugcacaaccgacggcguccuacucggaaccacacaacuaagccccgucaacaucugcacuuuccgcggcgacgucacccacaucgcaggaagucgaaauuacaccaugaaccucgccagccaaaacuggaacucuuacgauccuacagaagaaaucccagcaccccuagaaacaccugacuucgucggcaagauacaagguguacucacacaaaccacgcgcaccgacggcuccacccgcggacacaaggccaccguauacaccggcuccgccgacuucuccccaaaacuuggaagaguccaauucgccaccgacacagauaacgacuucgauuccaaucaaaacacgaaauucacucccguaggcgucauacaagauggcggcaccacacaccguaacgaaccccaacaauggguacuacccagcuacucaggacgagacauccauaauguccaccucgccccagccguugccccaaccuucccaggagaacaacuccucuucuuccgguccacaaugcccggaugcuccggauaccccaauauggaccuagacugccuucuaccccaagaauggguccaauacuucuaccaagaagcagcaccagcccaauccgacgucgcccuccuaagauucguaaaccccgacacaggucgcgucuuguucgaaugcaaacuccacaaauccggcuacgucaccgucgcccacacaggccaacacgaccuaguuaucccacccaacggauacuuccgcuucgacucuugggugaaccaauucuacacccucgcccccaugggcaacggcacaggccgccgccgcguccuauaa

SEQ ID NO: 36288 - RNA, 1623 nt, Artificial Sequence
  derived and/or modified sequence opt11 from VP1__Norovirus__ALF12532
augaaaauggccucauccgacgcaaaccccuccgacggcucuaccgccaaccuaguuccagaagucaacaacgaagucauggcucuagaaccgguugucggcgcagccaucgcagcuccagucgccggacaacaaaaugcaauagacccauggauccgcaacaacuuuguccaagcccccggcggugaguucacaguaagccccagaaaugcccccggcgaaauucuaugguccgcaccacuaggccccgaccucaaccccuacuuaucccaccucgcccguauguauaacggauacgccggcggcuucgaaguccaaguaauacucgccggcaacgccuucaccgccggcaaaauaaucuucgccgccgucccacccaauuuccccacagagggccucucccccagccaagucaccauguucccucacaucaucgucgauguccgacaacucgaaccaguucucauaccccuacccgacguaagaaacaacuucuaccacuacaaccaaucaaacgauagcaccaucaaauugauagcaaugcuauacacgccccuccgcgcaaacaacgccggugacgacgucuucaccguuuccugccgaguucuaacccgcccuucccccgacuucgacuucaucuuccuugucccuccuaccguagaaagccgcacgaaacccuucucaguccccauccucaccgucgaagaaaugaccaacagcagauuccccaucccccuagaaaaacuuuucaccggaccuuccucugcauucgucguucaaccccaaaacggaagguguacaaccgacggcguccuacucgguacaacccaacucucgcccgucaacaucugcaccuuccgaggcgacguaacccacaucgcaggaucccgcaacuacaccaugaaccucgccucacaaaacuggaacucauacgaccccaccgaggaaauacccgcaccccucggcacccccgacuucgucggcaaaauucaaggcguccuuacucaaacaacucgcaccgacggcagcacccgcggccacaaggcaacugucuacaccggauccgccgacuucucaccaaaacucggccgaguccaauucgcaaccgacacagacaacgacuucgaugccaaccaaaacaccaaauucacccccguaggaguaauccaagacggcggaaccacacaccgcaacgaaccacaacaguggguccuccccuccuacagcggacgcaacauccacaacguccaccuagccccggcagucgcccccaccuuccccggcgaacaacuccucuucuuccgcucuaccaugcccggcugcagcggauaccccaacauggaccuagacugccuucucccacaagaauggguccaauacuucuaccaagaagccgccccugcccaaagcgacgucgcccuacuucgauucgucaaccccgacaccggacgcguccucuucgaaugcaagcuacauaaauccggcuaugucaccguagcccacaccggccagcacgaccuagucaucccaccuaacgguuacuuccgguucgacuccugggucaaccaguucuacacccucgcacccauggguaacggcacaggccguagacgcgcccucuaa

SEQ ID NO: 36289 - RNA, 1623 nt, Artificial Sequence
  derived and/or modified sequence opt11 from VP1__Norovirus__ALF12533
augaagauggcuucauccgacgcuaaccccucagauggcuccaccgccaaccuaguccccgaaguuaacaacgaaguaauggcccuugaacccguagucggugccgccauugcugcaccagucgccggacaacaaaacgucauagacccauggauacgcaacaacuucguccaagccccaggcggugaauuuaccguaucaccccgaaacgcacccggcgaaauccuaugguccgcaccccuaggccccgaccucaacccauacuuaucccaccucgcccgcauguacaacggauacgccggcggcuucgaaguucaaguuauccucgccggaaacgccuucaccgcaggcaaaaucaccuucgcagccguacccccuaacuuccccaccgaaggccuaucccccucccaagucaccauguucccccacaucauagucgacguacgccaauuagaaccuguccucauuccacuccccgacguacgcaacaacuucuaccacuacaaccagucuaacgacccaaccaucaaacucaucgcaaugcucuacacaccccuccgcgccaauaaugcaggcgacgacgucuucaccguauccugccgcguccuaacccgccccuccccagacuucgauuucaucuuccuggucccucccaccguagaaucccgaaccaaaccauucuccgucccaauccucaccgucgaagaaaugaccaacucccgauucccaauaccccuugaaaaacuauucaccggccccagcuccaccuucguaguccaaccccaaaacggccgcugcaccaccgacggcguccuacucggcacaacacaacuaucacccguaaacaucugcacuuucagaggcgacguaacccacaucaccggcagccacaacuacaccaugaaucucgcaucacaaaacugguccucauacgauccuaccgaagaaauccccgccccucucggcaccccagacuucguugguaaaauccaaggaguccucacccagaccacccgcaccgacggcuccacccgcggccacaaagcaaccgucuucaccggaucagccgacuucucuccuaaacuuggcagaguccaguucgccacagacaccgacaaugacuuugucgccaaccaaaacaccaaauucacacccgucggagucauacaagacggcggcacggcacaccguaacgaaccucaacaguggguacuucccagcuacuccggccgcaacauccacaacguucaccuugcccccgccgucgccccaacauuccccggcgaacaacuucucuucuuccguucuacaaugcccggaugcuccggcuauccuaacauggaccucgauugccuucucccacaagaauggguccaauacuucuaccaagaagcagcccccgcccagucagacguugcucuacuucgcuucgucaaccccgacaccggccgcguacucuucgaaugcaaacuccacaaauccggauacgucacggucgcacacacaggacaacacgaccucguuaucccaccuaacggauauuuccgcuucgacuccugggucaaccaauuuuacacucucgccccuaugggaaacggaaccggacgaagacgcgcccuauaa

SEQ ID NO: 36290 - RNA, 1623 nt, Artificial Sequence
  derived and/or modified sequence opt11 from VP1__Norovirus__ALF12534
augaaaauggccucauccgacgccaacccaagcgacggauccaccgcaaaccuuguccccgaaguuaacaaugaagugauggcucucgagcccgucgucggcgcagccaucgccgcccccgucgccggacaacaaaacgucaucgaucccuggaucagaaauaacuucguacaagccccaggaggugaguucaccgucucgccccgcaacgcaccuggcgaaauacucugguccgcaccccucggccccgaccucaacccauaccucucacaucucgcccgcauguacaacggcuaugcuggcggcuuugaaguccaagucauccuagcaggcaacgcauucaccgccggcaaaaucaucuucgccgccguaccacccaacuuccccaccgaaggcuuaucccccucccaagucacaauguucccccacaucaucgucgacguacgacaacuggaacccguacuaaucccccuccccgauguacgcaacaacuuuuaucacuacaaccaaucaaacgacuccaccauaaaacuuauagccaugcuauacacaccauuaagagccaacaaugcaggcgacgacgucuucaccgucuccugccgcguccuaacccgacccucaccagacuucgacuucaucuuccuuguacccccaacugucgaaucccgcaccaaaccguucucaguacccguccuaaccguugaagaaaugaccaacucccgcuuucccauaccccucgaaaaacuauuuaccggcccauccagcgcuuucgucguccaaccccaaaacggccgcugcaccacagacggcguacuccuagguaccacccaacuauccccagucaauaucuguaccuuccgaggcgacgucacccacaucccaggcucccgcaacuacaccaugaaccucgccucccaaaacuggaacucauacgacccaacagaagagaucccggcaccacucggcacucccgacuucgucggcaaaauacaaggaguccucacccaaaccaccagaaccaacggauccacccgaggccacaaagccaccgucuacacugguuccgcagacuucucacccaaacuaggccgaguucaauucgcgacugacaccgacaacgacuucgaaaccaaccaaaacaccaaauucacacccgucggagucauccaagacggaucaacaaccccacgaaacgaaccccaacaguggguacuccccucauacuccggcagaaacauacauaacguccaucucgccccugcaguggccccaaccuuucccggagaacaacuacuguuuuucagaagcaccaugcccgguugcagcggcuaccccaacauggaccuugacugccuacucccacaagaauggguacaauacuucuaccaagaagccgccccagcccaauccgacgucgcccuccuaagauucgucaaccccgacaccggccgaguccuauucgaaugcaaacuccacaaaagcggcuaugucacagucgcacacaccggccaacacgaccucguuauacccccaaacggcuacuuccguuucgacuccuggguaaaccaguucuucucccucgcccccaugggaaacggcaccggccgccgcagagcacuuuaa

SEQ ID NO: 36291 - RNA, 1623 nt, Artificial Sequence
  derived and/or modified sequence opt11 from VP1__Norovirus__ALF12535
augaaaauggccucaagcgacgccaaccccucugucggcucugcagccaaccuaguccccgaagucaacaacgaaguaauggcccucgaaccggucguuggcgccgccauagccgccccaguggccggucaacaaaaugucauagacccguggauccguaacaacuuuguccaagccccuggcggcgaguucaccgucucuccccgcaaugccccaggagaaauucuaugguccgccccacugggccccgaccucaaccccuaccucucacaccucgcccgcauguacaacggauacgccggaggcuucgaaguccucguuauccuagccggcaacgccuucacagcaggcaaaaucaucuucgcagcagucccaccgaauuuucccaccgaaggccucagcccaucccaaguaaccauguucccccacaucaucgucgauguacggcaacuugaacccgugcuaaucccccuccccgacguucgcaacaauuucuaccacuacaaccaaucuaacgacccaaccaucaaacucaucgcuaugcucuacacaccccuccgcgcaaauaacgcaggcgaugacgucuucaccgucuccugccguguccuaacccgccccucccccgacuucgauuucaucuuccuagucccaccuaccguagaaucaagaaccaagccauucuccguucccauccucaccgucgaagaaaugaccaacucccgauuccccaucccccucgaaaaacuauuuaccggcccaucauccgccuucgucguccaaccccagaauggcagaugcacaaccgauggcguacuccucggcacaacccaacuaucccccgucaacaucugcaccuuucgcggugacgucacucacaccaccggcucccacaacuacaccaugaaccuugccacccaaaacuggaacucauacgaccccaccgaagaaauccccgcaccacucggaaccccagacuucguuggcaagauucaaggcguccucacacaaacgacaaaaacggacggcuccacccgcggacacaaagcaaccguauacaccggaucagcagacuucgcacccaaacucggccgaguccaauuugcaaccgacaccgauaacgacuucgaagcaaaccaaaacaccaaauucacccccguuggagucauccaggacggcgguaccgcccaccgaaacgaaccccaacaaugggucuuacccuccuacuccggccgaaacacacacaauguacaccucgcacccgcaguagcccccaccuuccccggcgaacaacuacucuuuuuccgcuccaccaugcccggcugcuccggcuacccaaacauggaccucgacugccuccuaccccaagaauggguccaauacuucuaccaagaggcagcaccagcccaaagcgacgucgcucuccuacgcuucgucaaccccgacaccggccgaguccuuuucgaaugcaaauuacacaaaucaggcuacguaaccgucgcccacacaggcccccacgaccuaguaaucccucccaacggauacuuccguuucgacucaugggucaaccaauucuacacucuagcacccaugggcaacgggaccggccgucgccgagcacucuaa

SEQ ID NO: 36292 - RNA, 1623 nt, Artificial Sequence
  derived and/or modified sequence opt11 from VP1__Norovirus__ALF12536
augaaaauggccucaagcgacgccaaccccucagacggcuccgcugccaaccucguccccgaagucaacaacgaagucauggcucuagaaccagucgucggagcagccaucgccgccccagucgccggacaacaaaacgucaucgaccccuggauccgcaacaacuucgugcaggcccccggcggcgaguucacuguaucuccccgaaacgcccccggagaaauccucugguccgccccacugggccccgaccuaaacccguaccucucccaccucgcccgcauguacaacggcuacgcuggcggcuucgaaguucaaguaauccucgccggaaaugcguucacagccggcaaaauaaucuuugcagccgucccucccaacuuccccaccgagggacucuccccaucccaagucaccauguucccccauaucauagucgacguccgacaacuagaacccguccucauuccacucccugacguccgcaacaacuucuaccacuauaaccaaucaaacgacccaacuaucaaacuuauagccaugcuauauaccccacuccgcgccaacaacgcuggagacgacguuuucaccgucuccugucgcguccuaacccgccccucccccgacuucgauuucaucuuccucguacccccaaccgucgaaucccgaaccaaacccuucucugucccaauacucaccguugaagaaaugaccaacucucgcuuccccaucccacucgaaaaacucuucacaggaccguccuccgccuucgucguccaaccccaaaauggccgcugcaccacagacggcguccuacuaggcacaacacaacucucccccguaaacaucuguacguuccgcggagacgucacucacacaaccggcucacacaacuacacaaugaaccucgcaacacaaaacuggucaucguacgacccgaccgaagagauacccgcaccccuaggcacacccgacuucgucggcaagauccaagguguacucacccaaaccaccaaaacagacggaucuacccgcggccacaaagccaccgucuacaccgggagcgccgacuucgcgcccaaacucggcaggguccaauucgccaccgacacagacaacgacuuugaagccaaccaaaacaccaaauucacgccaguaggagucauccaagacggaaacaccgcucacagaaacgaaccccaacaauggguccuccccuccuauuccggacgcaacacccacaacguacaccucgcacccgcggucgcacccaccuucccuggcgaacaacuccucuucuuuagauccaccaugcccgguugcucaggcuaccccaauauggaccucgacugccuccucccccaagaauggguccaguauuucuaccaagaagcagcccccgcucaauccgacgucgcacuccuccgcuucgucaauccagauaccggccgcguccucuucgaaugcaaacuucacaaaagcggcuacguaacaguagcacacaccggcccccacgaccuuguaaucccgcccaauggauauuuccgcuucgacucuugggucaaucaauucuacacucuagcccccaugggcaauggcaccggacgccgccgagcacucuag

SEQ ID NO: 36293 - RNA, 1623 nt, Artificial Sequence
  derived and/or modified sequence opt11 from VP1__Norovirus__ALF12537
augaaaauggcuuccucagacgccaaccccuccgacggaucuaccgccaaccucgcccccgaaguaaacaacgaaguaauggcacuugaacccguugucggugccgccaucgccgccccagucgccggucagaaaaacguaaucgaccccuggauucgcaacaacuucguccaagccccaggcggagaguucaccguaagcccccgcaacgccccaggcgaaauccuaugguccgccccacucggacccgaccucaaccccuacuuaucacaucucgcacgaauguacaacggcuacgccggcggauucgaaguccaaguaauccucgccggcaacgcauucaccgccggaaaaauuaucuucgccgccgugccacccaacuuccccaccgaaggccucucccccucccaaguaacaauguucccccacaucaucguagacguccgucaacuagaacccguauuaauuccacuccccgauguucgcaacaacuucuaccacuacaaccaaucuaacgaccccacaaucaaacucaucgcuaugcucuacaccccucuccgcgccaacaacgccggcgacgacgucuucacugucuccugccgcguucuaacucgccccucaccagauuucgacuucaucuuccucgucccacccaccgucgaaucccgcaccaaacccuucuccgcacccguccucaccguagaagaaaugaccaacucaagauuucccaucccccucgaaaaacuauucacaggccccagcucagcauucguaguccaaccccaaaauggccgaugcaccaccgacggcguucuccucggcacuacccaacucucccccgucaacaucugcaccuuccgaggcgacguaacucacaucucuggcucccgcaacuacacaaugaaccucgcaucacaaaacuggaacuccuacgaucccacagaagaaauccccgcaccucuaggcacuccagacuucgugggcaaaauacaaggcguccucacucaaacuacccguaccaacggcuccacacgcggccauaaggcuaccguuuacacaggcucagccgacuucucccccaaacuuggacgcguucaauucgcaaccgauaccgacaacgacuucgaaacaaaccaaaauacuaaauuuacaccaguaggggucauacaagacggguccacaaccccacgcaacgaaccacaacaauggguccuucccuccuacuccggccgcaacacccacaacguucaccucgcccccgccguagcacccacauuccccggugaacaacuccucuucuuccgcucaaccaugcccggcugcucaggauacccaaauauggaccuugacugccuucuuccccaggaauggguccaauacuucuaccaagaagccgcccccgcccaauccgauguagcccuacuacgauucguaaacccugacaccggucgcguccucuucgaaugcaaacuucacaaguccggcuacgucaccguagcacacacaggccaacgcgaccuagucaucccacccaacggcuauuuccgcuucgacuccugggucaaccaauucuacucucucgccccaaugggcaacggcacgggacgacgccgagcccuauaa

SEQ ID NO: 36294 - RNA, 1623 nt, Artificial Sequence
  derived and/or modified sequence opt11 from VP1__Norovirus__ALF12538
augaaaauggcaucuucagacgccaaucccuccgacggauccacagcuaaccucgucccugaaguaaacaacgaaguaauggcccuugaacccgucgucggagcugcaaucgcggcacccgucgcaggacaacaaaauguaauagaccccuggauucgcaacaacuucguccaagcaccaggcggcgaauuuaccgucagcccucgaaacgccccaggcgaaauccucugguccgcaccacucggcccagacuuaaaucccuaccucucacaucucgcccgaauguacaacggauacgccggaggcuucgaaguacaagucauccuugcaggcaacgccuucaccgcuggcaaaaucaucuucucagccgucccacccaacuuccccaccgaaggacucucccccucccaaguaacaauguucccccacauaaucgucgacguccgccaacucgaaccuguccucauuccccuuccugacguccgaaacaacuucuaccauuacaaccaauccaaugacccuaccaucaaacuuaucgcaaugcucuacacaccccuccgcgcaaacaacgccggcgacgacguauuuacagucuccugccguguccucacccgccccucccccgauuuugacuucauuuuccuuguaccacccaccgucgaaucccgcacuaaacccuucuccguccccauucuaaccgucgaagaaaugacaaacucccgauuccccauaccccucgaaaaacucuucaccggccccuccuccgcuuucguuguccaaccccaaaacggaagaugcucuacugacggaguccuacucggcaccacccagcuuucccccgucaacauaugcaccuuccgcggcgacgucacacacaucgccggcucccacaacuacaccaugaaccucgccucccaaaacuggucauccuacgaccccaccgaagaaauccccgccccauuaggcaccccagacuucgucggaaaaauccaaggcguccucacccaaacuacacgguccgacggauccacacgcggccacaaagccaccguauacacaggcucagcagacuucucucccaaacuuggccgcguacaauucgcuaccgacaccgacaacgauuucgucuccaaccaaaacacaaaauucacacccgucggcgucauccaagacggugauacagcccaccgaaacgaaccacaacaauggguccucccaucuuacuccggccgcaacauccacaacguacaccuagcacccgccguugcccccacauucccaggcgaacaacuucucuucuuccgcagcaccauacccggcugcuccggcuauccuaacauggaccucgacugcuuacuaccccaagaauggguccaauacuucuaccaagaagcagcaccagcccaauccgacgucgcccuccuacgauucgucaaccccgacacaggacgcguccuauucgaaugcaaacuccacaagucaggcuacguuaccgucgcccauaccggccaacaugaccucgucaucccacccaauggcuacuuucgcuucgacucauggguuaaccacuucuacacucucgcccccaugggcaacgguaccggccgcagacgcguccucuaa

SEQ ID NO: 36295 - RNA, 1623 nt, Artificial Sequence
  derived and/or modified sequence opt11 from VP1__Norovirus__ALF12539
augaaaauggccuccuccgacgcaaaccccuccgacggauccacugccaaucucgucccggaaguaaacaacgaaguaauggcccucgaacccgucguaggcgcugcaaucgcagcaccaguagccggccaacaaaaugucaucgaccccuggauccggaacaacuuuguacaagcuccaggaggcgaguucacaguaucaccccgaaacgccccaggagaaauucuuugguccgcaccgcuaggccccgaccuaaacccauaccucucccaccuugccagaauguacaacggcuacgccggaggcuucgaaguacaaguaauauuagccggcaacgccuucacugccggcaagaucaucuucgcggcugucccacccaacuuccccaccgaaggacucucaccgucccaaguaaccauguucccucgcaucauagucgacguacgucaacucgaaccgguacuaauaccccuccccgacguccgcaacaacuuuuaccacuacaaccaauccaacgacccaaccauuaaacuaaucgccaugcuuuacacaccccuccgcgccaacaaugcaggcgacgacgucuucaccguaucaugccgcguacucacccgcccaagcccagacuucgacuucaucuuccucguaccacccacagucgaaucaagaacaaaacccuucucaguucccauccucaccgucgaagaaaugacaaacucccgcuuccccaucccccucgaaaaacuauucaccggcccauccuccgcguucgucguccaaccacaaaacggccgcugcuccaccgacggaguccuccucgguaccacccaacuaucaccaguaaacaucugcacuuuccgaggcgacgucacacacauagccggcucccacaacuacaccaugaaccucgccagccagaacugguccucuuaugaccccacagaagaaauacccgccccacucggaacccccgacuucgucggcaaaauacaaggaguccuaacccaaaccacccgcacagacggcuccacccgaggccacaaggccaccgucuacaccggcuccgcagacuucagccccaaacugggacgcguccaauucgccacugacacaaacaacgauuucgaauccaaccaaaacaccaaauucgcacccgucggagucauccaagacggaggcaccgcacaccgcaacgaaccccaacaauggguacuacccuccuacucaggccguaacauccacaacguacaccuagcccccgccgucgcacccaccuuccccggagaacaacuacucuuuuuccgcucaacaauacccggauguucgggcuaccccaacauggaccuugacugccuccuaccucaagaauggguccaguacuucuaccaagaagcugccccugcccagucugacgucgccuuacuucgguucgugaaccccgacacaggccggguucuauucgaaugcaaacuacacaaaucaggauacgucacagucgcacacacuggacaacacgaccuagucauacccccuaacggguacuuccgcuuugauuccuggguuaaccaauucuacacacucgcccccaugggcaacggcaccggccgacgacgagcccuguaa

SEQ ID NO: 36296 - RNA, 1623 nt, Artificial Sequence
  derived and/or modified sequence opt11 from VP1__Norovirus__ALF12541
augaaaauggcaagcucagacgcaaaccccuccgaugguuccaccgcaaaucugguccccgaagucaacaacgaagugauggcccucgagcccgucgucggagcagccaucgcagccccggucgccggccaacaaaacguaaucgacccuuggauccgcaacaacuucguccaagcacccggaggcgaguucaccgucuccccaagaaacgccccuggggaaauccuauggagcgcaccccuuggacccgaucucaauccauaccucucacaccucgcucgcauguacaacggcuacgcaggcggauucgaaguccagguaauccuagucgggaacgccuucaccgcgggcaaaaucaucuucgccgccguacccccaaacuucccaacagaaggccucucaccaucacagguaacaauguucccccacaucaucguggacguccgacaacucgaaccaguacucauaccccuucccgacgucagaaauaacuucuaccacuacaaccaauccuccgacucaaccaucaaacucaucgcaaugcucuacacaccccuccgagccaacaaugccggcgaugacguuuucaccgucucaugccgcguacucacccgucccucccccgacuucgacuucaucuuccucgucccacccaccguagaaagucgaaccaaacccuucuccguccccguccucacaguagaagaaaugacaaacucccgcuuccccaucccacuagaaaaacucuucacaggacccuccucagccuucguaguacaaccacaaaacggacgaugcaccacggacggcgugcuacucggaacaacacaacuaucacccguaaacaucugcaccuuucgcggagacgucacccacauaucaggaucccacaacuacaccaugaaccucgcuucccaaaacuggaacucauacgacccaacagaagaaaucccagccccucuaggcacccccgacuucguaggcaaaauacaaggcguacucacccagaccacccgcaccgacggcaguacccgcggccacaaagccacaguauacaccggauccaccgacuucacccccaaacucggccgagcacaauucgcaacagacaccgacaacgacuucgaaaccaaccaaaacacaaaauucacucccgucggcgucauccaagacggcggaacaacccaccgcaacgaaccccaacaauggguacuccccagcuauuccgggagaaauacccacaacguccaccuagcccccgccgucgcacccaccuuccccggcgaacaacuccucuucuuccgcuccaccaugcccggaugcuccgguuacccaaacauggaccuagacugccuacuuccccaagaauggguccaauacuucuaccaagaagcagcccccgcccaauccgacgucgcccuacuacguuucguaaaccccgacaccggccgcguucuguuugaaugcaaacugcacaagucaggcuacgucacaguagcacacaccggccaacacgaccucgucauacccccaaacggcuacuuccgcuucgauuccugggucaaucaauuuuacacccucgccccuaugggcaacggaaccggccgucgacgcgcccuguaa

SEQ ID NO: 36297 - RNA, 1623 nt, Artificial Sequence
  derived and/or modified sequence opt11 from VP1__Norovirus__ALF12542
augaaaauggcauccuccgacgcgaaccccuccgacgguuccgcugccaaccuagucccagaaguuaacaacgaagucauggcacucgaacccgugguaggagcagccaucgcagcccccgucgcgggccaacaaaacguaaucgaccccuggauccgcaauaacuucguccaagcucccggcggagaguucaccgucagccccagaaacgcccccggugaaauccuauggagcgcaccccuaggacccgaccuaaaccccuaccucucccaccucgccagaauguacaacggauacgccggaggcuucgaaguccaaguaauucucgccggaaacgccuuuacagccggcaaagucaucuucgccgcaguucccccuaauuucccaaccgaaggccuaucaccuucccaagucaccauguucccccacauugucgucgacguccgccagcucgagccaguacucaucccccuccccgacguacgaaacaacuucuaccauuacaaccaaucgaacgacccaacaaucaaacucaucgccaugcucuacacacccuuacgagccaacaacgccggcgacgacguauucaccguaagcugccgcguccucacaagacccuccccagacuucgacuuuaucuuccucguacccccaaccgucgaaucccgcacaaaacccuucuccguccccguccucaccgucgaagaaaugaccaacucacgcuucccaaucccccucgaaaaacucuucaccggucccuccucagccuucguaguccaaccccaaaacggcagaugcaccaccgacggaguccuccucggcaccacucaacucagccccgucaacauaugcacauuccgaggcgacgucacacacauaacaggcucacgcaacuacacuaugaaccucgcaucacaaaacuggaacaauuacgaccccacggaagaaauaccugcaccccucggcgcccccgacuucguagggaaaauccaaggcaugcucacccaaaccacacgcgcggacggaucaacccgcggacacaaagccacugucuacacaggcuccgccgacuucgcacccaaacuaggccgcguccaauucgaaacagacacagaccacgacuucgaagccaaccaaaacaccaaauucaccccagucggugucauacaagacggauccacuacccaccgcaacgaaccacaacaauggguacuacccucauacuccggccgcaacacccauaacguccaccucgccccagcagucgcccccaccuuccccggggaacaacuccuauucuuccgcuccacaaugccgggcugcucaggcuaccccaacauggaucucgacugccuccuuccacaagaauggguacaauauuucuaccaagaagccgcccccgcacaaucugacgucgcucuacuacgguucguaaacccagacaccggcagaguacucuucgaaugcaaauuacacaaguccggcuacgucacaguagcacacacaggacaacacgaccucgugauaccacccaacggauacuucagauucgacuccugggucaaccaauucuacacacuagcccccaugggaaacggcgcaggccgccgccgagcacucuaa

SEQ ID NO: 36298 - RNA, 1623 nt, Artificial Sequence
  derived and/or modified sequence opt11 from VP1__Norovirus__ALF12543
augaaaauggccagcucagacgcaaacccuuccgacggauccgccgcaaaccucguccccgaaguaaacaaugaagucauggcccucgaacccgucgucggcgcagccaucgccgcccccgucgccggucaacaaaacgucaucgaccccuggauucgcaacaacuucguccaagcccccgguggagaguucaccgucucacccagaaacgcacccggcgaaauccucugguccgccccacuaggccccgaccucaaccccuaccuaucccaccucgcccgaauguacaacggcuacgccgguggcuucgaaguccaaguaauccucgcaggcaacgcauucacagccggaaaaaucaucuucgccgccguucccccaaacuucccaaccgaaggacuauccccaucucaaguaacaauguucccccacaucaucgucgacguccgccaacucgaacccguccucaucccccuccccgauguccgaaacaacuuuuaccacuacaaccaauccaacgacucaaccaucaaacucaucgccaugcuuuacaccccacuacgcgcaaacaaugccggagacgacgucuucaccguauccugucgaguccucacccgccccucaccagacuucgacuucaucuuccucgucccucccaccgucgaauccaggaccaaacccuucuccguccccguucucacagucgaagaaaugacuaacucacgauuucccaucccccucgaaaaacucuucacaggaccauccagcgccuucguaguccaaccccagaacggccguugcaccacagacggaguccuccucggaacuacacaacucucaccugucaacaucugcacuuuccgcggcgacgucacccacaucacagguucacgcaacuacaccaugaaccuugcaucacaaaacuggaacaacugcgaccccacagaagaaaucccagcaccccucggcacccccgacuucgucggcaaaauccaaggcaugcucacucaaaccacacgcaccgacggaucaacucgaggccacaaagccaccguauauaccggcucugccgacuucgcaccaaaacucggccgcguccaguucgaaaccgacacggaccacgauuucgaagccaaccaaaacacuaaauucacccccguaggagucauccaagacggcagcaccacccaccgaaacgaaccccaacaauggguacucccauccuauucuggccgaaacacccacaacguucaccuagccccagcagucgccccaacauuuccaggcgaacaacucuuguucuuccgcuccacaaugcccggcugcuccggcuaccccaacauggaccucgacugccucuuaccccaagaauggguacaauacuucuaccaagaagccgcccccgcucaauccgacguugcacuacuccgcuucguaaacccagacaccggacguguccucuucgaaugcaaauuacacaaaucaggcuaugucaccgucgcccacaccggccaacacgaccuagugauacccccaaacgguuacuuccgauucgacuccugggucaaccaauucuacacacuugcucccaugggcaacggcacgggccgacgccgagcgcucuga

SEQ ID NO: 36299 - RNA, 1623 nt, Artificial Sequence
  derived and/or modified sequence opt11 from VP1__Norovirus__ALF12546
augaaaauggcaucauccgacgcaaacccauccgaaggcuccaccgcaucccucguccccgaagucaacaaugaagucauggcucuagaacccgucgccggagccgccaucgccgcccccguagcaggccaaguuaacguaauagaccccuggauccgcaacaacuucguccaagcacccggcggcgaguucaccguuucaccccgcaacgcccccggcgaaauacucugguccgccccacuaggacccgaccucaaccccuaccucucacaccucgcccguauguacaacggcuacgccggcggcuucgaaguucaagucauccuggccggcaacgcguucaccgccggcaagaucaucuucgcugccgucccgcccaacuuccccacagaaggccuaagccccagccaagugaccauguucccucacaucaucguagacguacgacaacuagaacccguccucaucccacuacccgacguacgaaacaacuuuuaccacuacaaccaaucaaacgaacccaccaucaaacucgucgcaaugcucuauacaccccuacgcgccaacaacgccggcgacgaugucuucaccgucucuugucgcguccucacccgacccagcccugacuucgacuuuauauuccuggucccacccaccguggaaucacgcaccaaacccuucuccguccccauccugaccguagaagaaaugaccaauucacguuuucccaucccccuggaaaaacucuucaccggucccuccucauccuucgucguccaaccacaaaacggacgcugcaccacugacggcguccuccuaggcaccacccaacucucccccguuaacauuugcacauucagaggcgacgucacccacauauccggaucccgcaaccacacuaugaaccucgcuucucaaaacuggaacuccuacgaccccaccgaagaaauccccgccccgcuugguacccccgacuucgucggcaagauccaaggaguccucacccaaaccacccgcuccgaugguuccacucguggacacaaagcuaccguuuacaccggaucugccgacuucuccccuaaacucgggcggauccaauucgccacagacaccgacaacgacuucgaaaccaaccaaaacacuaaauucacaccugucggagucauccaagacggaggcacaacccaccggaaugaaccccaacaauggguacuucccaccuacucaggacgcaacacccacaacguacaccuagcccccgccgucgcccccaccuuccccggagaacaacuacuauucuuccgcuccacaaugcccggcugcucaggauacccagauauggaccuugacugccuacuaccccaagaauggguacaacacuuuuaccaagaagccgcccccgcacaauccgacgucgcccuacuccgcuucgucaaccccgacacaggccgaguccucuucgaaugcaaacuccacaaagccggcuacgucaccguagcacauaccggacaacacgaccuagucauacccccaaacggcuacuuccgcuucgacucauggguuaaccaauucuucacccucgcccccaugggcaacgguacaggccgacgccgcgcccuuuaa

SEQ ID NO: 36300 - RNA, 1623 nt, Artificial Sequence
  derived and/or modified sequence opt11 from VP1__Norovirus__ALF12547
augaaaauggccucguccgacgcaaacccauccgacggauccgccgccaaccucguacccgaaguaaacaacgaagucauggcacuugaaccaguaguuggagcagccaucgccgccccuguagccggccaacaaaacgucauugaccccuggauccggaacaacuucgugcaagcccccggcggagaauuuaccgucucaccccgcaacgcacccggcgaaauacuauggucugcaccccucggacccgaccuaaaccccuaccuaucccaccucgcccguauguacaacggauacgccggaggcuucgaaguacaagucauccucgccggcaacgccuucacagcaggcaaaauaaucuucgccgccgucccaccuaacuuucccacagaaggacucucccccucccaagucaccauguucccacacaucaucguagacguccgccaacuugaacccguacucauaccacuacccgacguccgcaauaacuucuaccacuacaaccaauccaacgaccccaccaucaaacucauagcaaugcucuacacuccccuacgcgcaaacaacgcgggugaugacgucuucaccgucucaugucgaguccucacccgcccaucccccgacuucgauuucauuuuccucguuccaccaaccgucgaaucuaggacaaaacccuucuccguaccuguacuaacagucgaagaaaugaccaacagccgcuucccuaucccccuagaaaaacucuucaccggacccuccagcgccuuuguaguacaaccucaaaacggccguuguacaaccgacggcguacuccuuggcaccacccaacuaagccccgucaacaucugcaccuuccgcggcgacguaacucacaucaccggaucacgcaacuauacuaugaaccucgccagccaaaauuggaacaacuacgaccccacagaagaaauaccggcaccccuaggcacucccgauuucgucggcaaaauccaaggcaugcuaacccaaaccacccgcacugacggauccacccgaggacacaaagccaccguauauaccggcucagcagacuucgcaccaaagcucggccgaguacaauucgaaaccgacaccgaccacgacuuugaagccaaccaaaacaccaaauucacacccgucggcgucauccaagacggauccaccacacaccgaaacgaaccccaacaauggguccuccccuccuacucaggccgauccgcccacaacguacaccucgcccccgccgucgccccaacauucccuggcgaacaacuccucuucuuccguuccaccaugcccggcugcucuggcuaucccaacauggaccucgacugccuccucccccaagaauggguccaauacuuuuaccaagaagccgccccugcccaaagcgacgucgcccuccuccgcuuuguuaaccccgacacaggccguguccuauucgaauguaaacuccacaaauccggguacgucaccguagcccacaccggccaacacgaccucgucauacccccgaacggauacuuucgauucgauuccuggguaaaccaauucuacacacucgcuccaaugggcaacggcaccggucgucgcagagcccuauaa

SEQ ID NO: 36301 - RNA, 1623 nt, Artificial Sequence
  derived and/or modified sequence opt11 from VP1__Norovirus__ALF12560
augaaaauggcaagcuccgacgccaaccccuccgacggauccaccgccaaccucguacccgaagucaacaacgaagucauggcccucgaacccgucguaggcgccgcaauugcagcacccgucgcuggccaacaaaacgucaucgaccccuggaucagguccaacuucguccaagcccccggcggcgaguucaccgucucuccccgaaacgccccaggcgaaauccucugguccgcaccccuaggccccgaccucaaccccuaccucucccaccuagcccgcauguacaacggcuaugccggcggcuucgaaguccaagucauccuagccggaaacgccuucaccgcaggaaaaaucaucuuugcagccguaccacccaacuuccccaccgaaggacucucucccucccaagucacaauguucccacacaucaucguagacguccgccaacuugaacccguccucauuccucucccagacguccgaaacaacuucuaccacuacaaucaguccaacgacccaacuaucaaacucaucgccaugcucuacaccccucuacgcgcuaacucagccggagacgacguauucaccguauccugucgcguccucacccgucccucucccgacuucgauuucaucuuccucgucccacccaccguagaaucacgcacaaaaccauucuccgucccaauccuaaccgucgaagaaaugacaaacucucguuucccaauaccucuggaaaaacucuucaccggaccauccuccgccuucguaguccaaccucaaaacggccgcugcacaacagacggcguccuacucggaacuacccaacucucccccgucaacauaugcuccuuccgaggcgacgucacccacaucgccggaucacgaaacuacaccaugaaccuagcaucccaaaacuggaauagcuacgacccaaccgaagaaaucccagcaccccucggcacaccagacuucgucggcaaaauacaaggaguccucacccagacaacgcgaaccgacggcucuacccgcggccaccgagccaccguauacacuggcuccgccgacuucucacccaaacucggaagaguacaauuugcuaccgacacugacaacgacuucguagccaaccaaaacacaaaauucacccccgucggcgucauccaagacggugacaccgcccaccggaacgagccacaacagugggucuuacccuccuacucaggccgcaacauacacaacguucaccucgcccccgccgucgcccccaccuucccuggcgaacaacuccuauucuuccgcucaaccaugcccggcugcuccggcuaccccaacauggaccuagacugccuccuuccccaagaauggguccaacacuucuaccaagaagccgcccccgcccaaucagacguagcccuccuccgauucgucaaccccgacaccggccgcguacucuucgaaugcaaacugcacaaauccggcuacgugacgguagcacacacaggccaacacgaccucguaaucccaccaaacggcuacuucagauucgacucaugggucaaccaauucuacacacucgcaccuaugggcaacggaaccggcagacgccgagcccucuaa

SEQ ID NO: 36302 - RNA, 1623 nt, Artificial Sequence
  derived and/or modified sequence opt11 from VP1__Norovirus__ALF12562
augaaaauggccuccucagacgccaaccccucagauggcucaacagccaaccucguacccgaagucaacaacgaagugauggcacucgaacccgucgucggugccgccauugcugccccaguagccggacaacaaaacguaaucgaucccuggauacgcaacaauuucguccaagcuccaggcggcgaguucaccgucuccccacgcaacgcccccggagaaauacuuuggagcacaccccucggccccgaucucaaccccuaccucucgcaccuagcccguauguacaacggauacgccggcggauucgaaguccaaguuauccuggcaggaaacgccuucaccgcaggcaaaauaauauucgccgcaguuccaccuaacuucccaaccgaaggccuuucccccucacaaguuaccauguucccccauaucauaguugacguccgccaacucgaaccgguccuaauaccucucccagacgucagaaacaacuucuaucacuacaaccaaaguaacgacccuacaaucaaauuaauagccaugcucuacacaccccuccgcgcaaacaacgcuggugacgacguguucaccgucuccugucggguccucacccgucccucccccgacuucgacuucaucuuccuagucccucccacagucgaaucaagaaccaagccauuuuccguacccguccucaccgucgaagaaaugacaaacucaagauucccaaucccacucgaaaaacucuucacaggacccagcuccgccuucgucguccaaccccaaaacggacgcugcacaacagacggaguccugcuuggcaccacgcaacuauccccugugaacauaugcaccuuccgcggcgacgucacccacauuucaggcagccgcaacuacacaaugaaccucgcaucucaaaacuggaacucauacgacccuaccgaagaaauccccgcaccccucggcacccccgauuucgucggcaaaauacaaggcguccucacacagacuacccgaaccgacggcucaacuagaggacacaaagccaccgucuacaccggaucagccgacuucucccccaaacuaggccgcguccaauucgccaccgacacagacaacgauuucgaaaccaaccaaaacaccaaguucaccccagucggcguaauccaggacggauccaccacacaccgcaacgaaccacaacaauggguccuccccucauacagcggccgcaacacucauaauguucaucucgcccccgccguugcccccaccuuccccggcgaacaacuccuauucuuccgauccaccaugcccggcugcucaggcuaucccaacauggaccucgacugccuccucccccaagaauggguucaauacuucuaccaagaagccgcccccgcccaaucagacgucgcacugcuccguuucguaaaccccgacaccggccgaguacucuucgaaugcaaacugcacaaaucgggauacgucaccgucgcccauacaggacaacacgaucuugucaucccaccaaacggauacuucagauucgacuccuggguaaaccaguucuacacacucgccccaaugggaaacggaaccggacgccgacgcgcacucuaa

SEQ ID NO: 36303 - RNA, 1623 nt, Artificial Sequence
  derived and/or modified sequence opt11 from VP1__Norovirus__ALF12564
augaaaauggcuuccucagaugccaacuccuccgauggauccgccgccaaccucguccccgaagucaacaacgaaguuauggcccucgaacccgucguaggagccgcaaucgccgccccugucgccggacaacaaaacgucauagacccauggauccgcaacaacuucguccaagcccccggaggagaguucaccgucucaccccgaaacgcccccggagaaauccuaugguccgccccauuaggcccugaccuuaaccccuaccuaucacaccuugcccgcauguacaacggauacgcaggcggauucgaaguacaagucauccuagccggcaacgccuucaccgccggcaagauaaucuucgccgcaguacccccaaacuuccccacggaaggucucucacccucccaagucacaauguuuccccauaucaucgucgauguucgucaacucgaacccguccuaauaccacucccugacguccgaaacaacuucuaccacuacaaucaguccaacgacccaacaauaaaauuaaucgccaugcucuacacuccccuacgugcuaacaaugcaggcgacgacgucuuuacugucuccugccgcguauuaacccgacccucaccagacuucgacuucauuuuccuagucccuccaacagucgaaucccguaccaaaccauucuccguccccauacucaccgucgaagaaaugaccaacagucgcuuccccauaccccucgaaaaauuauucaccggacccucuuccgccuucguaguccaaccccaaaacggccgcugcaccaccgacggaguccuacuaggaacuacucaacucucccccgucaacaucuguacauuccgaggggacgucacccauauaacaggcucccgaaacuacaccaugaaccucgccacgcaaaacuggaacucauacgacccaaccgaagaaaucccagcaccccuaggcacacccgacuuuguaggaaaaauucaggggguccucacucaaacaaccaagaccgacggguccacacgcggccacaaagccaccgucuacaccggcuccgccgacuucgcacccaaacucggacgaguacaauucgcaacagacacagacaacgacuucgaagcaaaccaaaacaccaaauucacacccgucgguguuauccaagacggaggcacgacccaccgcaaugaaccccaacaauggguccuccccucauacucaggacgaaacacccacaacguccaccucgccccagcaguagcaccaaccuuuccaggcgaacaacuccucuucuuucgcagcaccaugccgggaugcuccggcuaccccaacauggaccucgacugccuccucccucaagaauggguccaauacuucuaccaagaggccgcuccggcacaaucugacgucgcccuccuaagauucgucaaccccgacaccggccgaguccucuucgaaugcaaacuacacaaauccggcuacgugaccgucgcccacaccggcccccacgaccucguaaucccacccaacggauacuuccgauucgacuccuggguuaaucaguuuuacacccucgcacccaugggaaacggcacaggaagacgccgcgccacauaa

SEQ ID NO: 36304 - RNA, 1623 nt, Artificial Sequence
  derived and/or modified sequence opt11 from VP1__Norovirus__ALF12566
augaaaauggccucauccgacgccaacccaucagacggcuccgcagcaaaccucgucccagaaguuaauaacgaagucauggcccuagaaccagucgucggugccgccaucgcugcccccgucgcaggccaacaaaacgucauagaccccuggauccgcgacaacuucguccaggcacccggaggggaguuuaccgucucaccaagaaacgcccccggagaaauccucugguccgcaccccucggcccagaccuaaaccccuaccuaucgcaccucgcccgcauguacaacgguuaugccggcggcuucgaaguccaagucauacucgccggcaacgccuucacagccggcaaagucaucuuugccgccguaccacccaacuuccccaccgaaggccucucgcccucccaagucacuauguucccccacaugauaguugacguacgccaacucgaaccaguacucaucccacucccugacguccgcaacaauuucuaccacuacaaccaauccaacgaccccacccucaaacucaucgccaugcuguacacaccccucagagcuaacaacgcaggagacgacgucuucaccgucucaugccgcguacucacccgccccagucccgauuucgacuucauauuccucgucccacccaccguugaauccaggaccaagccauucucaguccccguccucaccgucgaagagaugaccaacucccgauuccccauuccacuagaaaaacucuucaccggccccagcuccgccuucgucguccagccccaaaacggccguugcaccaccgacggaguccuccuaggaaccacacaacucucuccuguaaacauaugcacauucagaggcgacguuacacacaucacuggcucccguaacuacacaaugaaccucgcaucccaaaacuggaacaacuaugaccccacagaagagaucccugcaccccuuggcgcccccgacuucgucggcaagauccaaggcaugcugacccaaacaacccgaaccgacggaucuacccgaggccacaaggccaccguauacaccggcucagccgacuucgccccaaaacucgggagaguacaauucgaaaccgauaccgaccacgauuucgaagcuaaccaaaacacaaaauucacccccgucggcguaauacaagacgggucaaccacccaccgcaacgaaccccaacaauggguccuaccauccuacuccggacgaaacacccacaacguccaccucgcccccgccgucgcacccacauuccccggcgaacaacuccucuucuuccguuccaccaugcccggcugcuccggcuaccccaacauggaccucgacugccuccuuccccaagaauggguacaguacuuuuaccaagaagccgccccagcccaauccgacguagcacuacuacgcuucgucaacccagacacaggccgcguccuauucgaaugcaaacuccauaaaucaggcuacguaaccgucgcccacacuggucaacacgaccuagucaucccuccaaacggauacuuccgcuucgacagcugggucaaccaauucuacacacucgcccccauggguaacggaaccggacgacgccgaaucguauaa

SEQ ID NO: 36305 - RNA, 1623 nt, Artificial Sequence
  derived and/or modified sequence opt11 from VP1__Norovirus__ALF12569
augaaaauggcauccucagaugcuaaccccuccgacggcucagcagccaaccucguucccgaagucaacaaugaagucauggcgcucgaaccggucgucggagccgccaucgcugcaccagucgccggccaacaaaacgucauagacccauggaucagaaacaacuucguccaagcucccggcggagaguucacagucuccccacgcaacgcccccggcgaaauccucugguccgccccacuaggucccgaccucaaccccuaccuaucccaccuagcccgaauguacaacggcuaugccggcggcuucgaaguccaagucauccuagcaggcaacgccuucacugccggaaaaaucaucuucgccgcagucccucccaacuuucccaccgaaggccucagcccaucgcaagucacaauguucccccauaucauaguugacguacgccaacucgaaccuguccuaaucccccucccagacguccgaaacaacuucuaccacuacaaccaaucuaacgacucaaccauaaaacuaaucgccaugcuauacaccccacuccgcgccaacaacgccggagacgacgucuucacaguuuccugccgcguccucacccgccccagcccagacuuugacuucaucuuccucgucccacccacgguagaaucccgaaccaaacccuucuccguacccguccucaccguagaagaaaugaccaacagccgauuccccauaccccuagaaaaacuuuucaccggaccgucaucagccuucguaguccaaccucaaaacggccgcugcaccaccgauggcguccuccucggaacaacccaacucucccccguaaacauaugcacauuccgcggcgacgucacucacauaaccggcucccgcaauuacaccaugaaccuagccucccaaaacuggaacaacuacgacccaacggaagaaaucccagcaccccucggcacccccgacuucgucggcaaaauccaaggaaugcucacucaaaccacacgaaccgacggauccacccgcggccacaaagccaccguuuacacuggcuccgccgauuucgcccccaaacuaggucgcguucaauuugaaacugacaccgaccacgacuucgaagccaaccaaaacacaaaauucacccccguaggaguuauccaggacgguucaaccacccaccgcaacgaaccccaacaauggguccuaccuucauacucaggacgcaacacccauaauguacaccucgcucccgccgucgcccccacauuccccggcgagcaacuccccuucuuucguuccacaaugccaggcugcuccggcuaccccaacauggaccucgacugccuauuaccccaagaauggguccaauacuucuaccaagaagccgccccagcccaauccgacgucgcccuccuacgcuucguaaaucccgacaccggucgaguccucuucgaaugcaaacuacacaaauccggcuacguaaccgucgcccacaccggccaacacgaccucguuauaccacccuacggauacuuccgcuucgacuccuggguaaaccaauucuacacacucgcccccaugggcaacggcaccggucgcagacgcgcccuauaa

SEQ ID NO: 36306 - RNA, 1623 nt, Artificial Sequence
  derived and/or modified sequence opt11 from VP1__Norovirus__ALQ28762
augaaaauggcauccaacgacgcagcccccuccaacgacggcgcagcaggccucguacccgaaggcaacaacgaaacgcucccccucgaacccguagccggcgccgccaucgccgccccagucaccggacaaaacaacaucauagacccauggauucgcaccaacuuuguccaagccccaaauggagaguucacaguaucuccccgcaacucccccggcgaaauccuccucaaccucgaacuuggccccgaccucaaccccuaccuagcacaccugucccgcauguacaacgguuacgccggcggcgucgaaguccaaguacuccucgccggaaacgccuuuaccgcaggcaaaauccucuucgccgccgucccucccaacuuccccgucgaauuucucucucccgcccaaaucacaaugcuuccacaccuuaucgucgacguccgcacccuagaacccauaaugaucccacuuccagacgucaggaacacuuucuuucacuacuccaaccaacccaacucccgaaugcgacucgucgccaugcucuacaccccacuccgcagcaacggcuccggcgacgacgucuucacagucuccugccguguccuaacccgccccacacccgacuucgaauuuaccuaccuaguacccccuuccgucgaauccaaaaccaaaccauucucucuacccauccuaacuuuauccgaacucacaaauucacgcuucccaguccccauugacucccucuucaccgcccaaaacaacguccuccaaguccaaugccaaaauggccgcugcacccucgacggcgaacuccaaggcaccacacaacuacuacccucaggaaucugcgccuuccgaggcagaguaaccgcccaaaucaaucagcgcgacagauggcacaugcaacuccaaaaccuaaacggcaccaccuacgaccccaccgacgacgucccagcuccccucggaaccccagacuucaaaggcgucguuuucggcauggucucccaacggaaugucggaaacgacgccccaggcuccacccgcgcccaacaagccugggucucuacauacuccccucaauucgucccgaaacugggcagcgucaaccuccgcauauccgacaacgacgacuuccaauuucaaccuaccaaauucacaccggucggcgucaaugacgacgacgacggacauccauuccgacaaugggaacuccccaacuacuccggcgaacucacacucaauaugaaccucgcaccaccuguugcccccaacuucccaggcgaacaacuacucuuuuuccgcuccuucgucccaugcuccggaggauauaaucaagguauaauagacugccucaucccccaagaauggauacaacacuucuaucaagaaucagcucccucccaaucagacguugcccucauccgcuacgucaaucccgacacuggccgcacccuauuugaagccaaacuccaccgcucaggcuacaucacagucgcccacucuggcgacuacccucucgucguccccgccaacggccacuuucgauucgacagcuggguaaaucaauucuauucacuugcccccaugggcaccggaaacgggcguagacgcgcccaauaa

SEQ ID NO: 36307 - RNA, 1632 nt, Artificial Sequence
  derived and/or modified sequence opt11 from VP1__Norovirus__ALS03883
augaaaauggccuccaaugacgccgccccuaguaacgacggcgccgcaggccuaguccccgaaaucaacaacgaaaccauggcccucgaaccaguagcgggcggagccauugccgcuccccucacaggccaaaccaacuuuaucgacccuuggauaagaggaaauuacguccaggccccaaacggagaguucaccgucagcccacgcaacucucccggcgaaauccuccucaaccuugaacugggccccgaacucaacccauuccuaucccaucuuucccgcauguacaacggcuacgccggcggcaucgacguccaagucauuauggcgggcaacgcuuucacggccggcaaaaucaucuuugccgccaucccuccccacuuccccgucgaaaaccuaucacccccacaaaucacaauguucccacauauaaucgucgacguccgcacacuugaacccauaaacauacccguaccugacguccgcaacaacuucuuccacuacaaccaaaacaacgaaucccguaugcgccuagucgccaugcuauacacaccccucagauccaacggcuccgccgaagacgucuucaccgucagcugccgcguacucaccaaaccgagcgcugacuucgaguucaacuaccucgucccacccaccguagaaucccgaaccaaacccuucaccauucccauccuaacuauaggugaaaugaccaacucccgauuccccguccccaucgacaugcuccacaccucacccaccgaaaacaucguuguccaaccccaaaacggccgcugcacaaucgacggcgaacuacucggaaccacccaacucaucaccuccaauauaugcuccuuccgaggauccaucuccggacacgaaggaaacgacgaccaacaccucuggcacuucaacaucaccaaccccaacggcacacccuucgaccccacagaagacguacccgcaccacuaggcaccccagauuuccggggacaacucuacggagucaucucccaacgagaccgcgaaggcacaccaagcgaaaacaaccaaaaggcaaaccguucccaccagggcguaaucuccacaaucucccccaaauucguaccuaagcucggcuccguuaugauaggcacauggaccaccgacgacaucaaaaaccaacccuccaaauucacgcccauaggccuaaacgacgacgacaacuucaagcaaugggaacuacccaacuacuccggcgcccuaacccuaaacaugggacucgcccccucaguauuucccaccuacccaggcgaacaaauccucuucuuccgcuccuaccucccacuaaaaggaggcuacggcuccccguuuauagacugccucgucccacaagaaugggucgcccauuucuaccaagaauccgcaccagcccagacagacgucgcccucauccgcuacgucaacccugaaacaggacgaguccuauucgaggccaaacuacaccgccaaggcuuuaucaccgucgcuaaaucaggcgacucccccauaaacguaccggccaacgguuacuucagauucgacuccugggucaaccaauucuauucccucgcacccaugggcaccggcaacggucgccgccgcauccaauga

SEQ ID NO: 36308 - RNA, 1617 nt, Artificial Sequence
  derived and/or modified sequence opt11 from VP1__Norovirus__ALT06546
augaaaauggccuccaacgacgcagcccccuccaacgacggcgcugccggccucguacccgaaggcaacaacgaaacccucccccuugaacccguagcaggagccgccauagcagcccccgugacaggccaaaacaacaucaucgaccccuggauccgcaccaacuucguccaagcccccaacggcgaauucaccguaagcccccgcaacucaccaggggaaauccuccucaaucucgaacucggacccgaccuuaauccuuaccuagcccaccucuccagaauguacaacggcuacgcaggaggugucgaaguccaaguacuccucgccgguaacgcuuucaccgcuggcaaaauccucuucgccgcuguuccucccaacuucccaguagaauuccuaucccccgcacaaauaaccaugcuaccacaccucaucgucgacguccgcacccucgaacccauuaugaucccccuccccgacguacgcaacaccuucuuccacuacaacaaccaaccaaacucccgcaugcgccucgucgcgaugcuauacaccccauuacgauccaacggcuccggcgacgacgucuuuacagucuccugccgcguccucacacgcccaacaccugacuucgaauucaccuaccucgucccucccuccguagaauccaaaacaaaacccuucucucuucccauucucacccucuccgaacucaccaacucaagauucccaguccccaucgacucccuauuuaccgcccaaaacaacguacuccaaguccaaugucagaacggccgcuguacccucgacggagaacuacaaggcacuacccaacuccuccccagcggcaucugugcauuccgcggccgcgucacagccgaaaccgaccaccgcgacaaguggcauaugcaacugcaaaaccucaacggcacuaccuacgacccuaccgacgacguccccgcuccccuuggaacccccgacuucaaaggaguagucuucggaauggcaucccaacguaacguaggcaacgacgccccaggcuccaccagagcacacgaagcagugauaucaacuuacuccccccaauucguacccaaacuaggcucggucaacuuccgcucuaacgacaaugacuuccaacuacaaccuacuaaauucacacccguaggcauuaacgacgacggcgaucacccuuuccgacaaugggaacuccccgacuacucaggaccccucaccuuaaacaugaaccuagcccccccaguugcacccaacuuccccggagaacaauuacuauucuuccgcucauucguccccugcagcggcggauacaaccaaggcauuguagacugccuaauaccacaagaauggauccaacacuucuaccaagaaucagcaccaagucaauccgacguugcccucauccgcuaugucaaccccgacaccggaaggacacucuucgaagccaaacuccaccgcuccggcuacaucaccgucgcccacuccggagacuacccacucgucguucccgccaacggauacuuccgauucgacucaugggucaaucaauucuacucucucgcccccaugggcaccggcaacggcagacgucgagcucaauga

SEQ ID NO: 36309 - RNA, 1647 nt, Artificial Sequence
  derived and/or modified sequence opt11 from VP1__Norovirus__BAG30939
augaaaauggcuuccaacgacgccacaccaucaaacgacggugccgccggccuagugcccgaaaucaacaacgaagcuauggcccucgaccccgucgccggcgccgcaaucgccgcuccccuaaccggccaacaaaacauaauugaccccuggaucaugaacaacuucguacaagccccaggaggagaguucaccgucuccccacgcaacucccccggcgaaguccuucuaaaccucgaacuaggccccgaaaucaacccauaccuagcucaccuugccaggauguacaacggcuacgccggcggauucgaaguucaagucguacuagcuggaaacgccuucaccgccggcaagaucauauucgccgcgaucccacccaacuuccccauagauaaccucucagcaagacagaucaccauguguccacacgucaucguagacguccgccaacuagaacccguaaaucucccuaugcccgacguccgcaacaacuucuuccacuacaaccaaggcagcgacucccgccuccgacucaucgccaugcucuacacuccccuccgcgcuaauaacucaggcgacgacguauucaccgucagcugcagaguccucacccgcccaucacccgacuucucauucaacuuccucgugccacccacugucgaaucaaaaaccaaaccauucacacugccuauccuaaccaucucagaaaugucaaacucccguuuccccgucccaauagacucacuccacacuucccccaccgaaaacaucgucguccaaugccaaaacggccgcgucacccucgacggagaacucaugggcacaacccaacuccuccccucccaaaucugugccuucaugggcguccucacccgcaguacaucccgugccuccgaccaagccgauaccgccacuccccgccucuucaauuacuauuggcacauccaacucgacaacccuaacggcacccccuacgacccugcugaagacauccccggaccucuuggcacccccgacuuccgcggcaaagucuucggaguagccucccaaagaaacccagacuccacaaccagagcccacgaagccaaggucgacaccacagccggccgcuucacacccaaacucggcucccucgaaaucucaaccgaauccgaugacuuccaccaaaaccaaccuacacgcuucaccccugucggcaucggcguagacaaugaagccgacuuccaacaauggucccuacccgacuacuccggacaauucacccacaauaugaaccuagcacccgcagucgcaccaaauuuccccggcgaacagcuccucuucuuccgaagccaacuccccuccuccggaggccgcuccaacggcauccucgacugccuaguaccucaagaauggguacagcacuucuaccaagaaagugccccaucacaaacccagguagcacucguacgcuacgucaaccccgacacaggccgaguucuauucgaagcaaaacuacacaaacuggguuucaugaccaucgccaaaaacggagacucaccuaucaccguaccacccaacggcuacuuccgauucgaaucuugggucaaccccuucuacacccucgcccccauggguaccggaaacggucgccgccgaauccaauaa

SEQ ID NO: 36310 - RNA, 1623 nt, Artificial Sequence
  derived and/or modified sequence opt11 from VP1__Norovirus__BAG70428
augaaaauggcauccaacgacgcuaaccccuccgacggcuccgcagccaaccucgucccagaaguaaacaacgaagucauggcacuagaacccgucgucggcgccgcuaucgccgccccaguugcuggccaacaaaacgucaucgaccccuggaucagaaacaacuucguacaagcacccggaggcgaguucaccgucucaccccguaaugcaccaggagaaauacuaugguccgcaccccucggucccgaccucaacccuuaccucucacaccuagcccgcauguacaacggcuacgccggcggcuucgaaguccaagucauacucgccggcaacgccuucaccgccgguaaaaucaucuucgcggccguaccacccaacuuccccacagaaggccuaucucccucacaagucacaauguucccccacauaaucgucgacguccgccaacuagaacccguccuaaucccccucccagacguacgcaacaacuucuaccacuacaaccaaucaaacgacucuaccaucaaacucauagccaugcuauacacaccccuacgcgccaacaacgccggagaagacgucuucaccguaagcugccgaguucuaacccgccccucgcccgacuucgacuucaucuuccugguaccacccacaguagaaucccgaaccaaacccuucacugucccaauccucacugucgaagaaaugaccaacucucguuuucccaucccccucgaaaaacucuucacuggccccaguggcgcauucgucguccaaccccaaaacggucgcuguaccacagacggcguacuccucggaacaacccagcuaucacccgucaacaucugcacguuccgcggagacgucacccacaucgcagguucuagaaacuauaccaugaaccucgccucucucaacuggaacaacuacgacccuaccgaagaaaucccugcaccccuuggcacacccgacuucguaggcaagauacaaggcguccucacacaaaccaccaaaggugacggcuccacacgcggccacaaagccaccgucuacaccggcucugcccccuucacccccaaauugggcuccguccaauuuuccaccgacaccgaaaacgacuuugaaacucaccaaaacacaaaauucacaccggucggcguaauacaagacggcuccacaacacaucgaaaugaaccacaacaauggguacuaccauccuacuccggcaggaacguccacaauguacaccucgcccccgccguugcaccuacauuccccggcgagcaacuccuauucuuccgaucaacaaugcccggaugcucuggcuaccccaacauggaccucgacugccuccucccacaagaauggguacaacacuucuaccaagaagcggcacccgcacaauccgacguagcacuacuacgcuucgucaaccccgacaccggacgcguacucuuugaaugcaaacuacacaaauccggcuacgucacagucgcccacacuggccaacaugaccucguuauacccccgaacggcuacuucagauucgacuccugggucaaccaauucuacacccuagccccaaugggcaacgguaccggucgcagacgagcacucuag

SEQ ID NO: 36311 - RNA, 1623 nt, Artificial Sequence
  derived and/or modified sequence opt11 from VP1__Norovirus__BAG70431
augaaaauggccuccaacgacgccaaucccucggacggcucagccgcaaaccuugucccugaagucaacaacgaagucauggcccucgaacccgucgucggagccgcaaucgccgccccagucgcaggucagcaaaacguuaucgaccccuggauccguaacaacuucguacaagccccaggcggcgaguucaccguauccccacgaaaugcacccggcgaaauacuaugguccgccccacuaggcccggaccucaaccccuaccucucccaccucgcccgaauguacaacggcuacgccggcggcuucgaaguacaaguaauacucgcaggaaacgcuuucacagccggcaaaaucauuuucgccgccgucccacccaacuuccccaccgaaggccuuuccccaagccaagucacuauguucccacacaucaucguagacguccgccaacucgaaccaguccuaaucccccuacccgacguacgcaacaauuuuuaccacuacaaccaaucaaacgacuccaccauaaaacuuauagccaugcucuacacaccccuacgggccaacaacgccggcgaagacguuuucaccguaucaugccgcguccucacccgacccuccccagacuucgacuucaucuuccuaguucccccaaccgucgaaagccgaacgaagcccuucaccgucccaauccucacagucgaagaaaugacaaacucacgauuuccuaucccucucgaaaaacucuucaccggccccuccggugccuucgucguccaaccccaaaacggucgcugcaccacagacggcguacuacucggaacuacacaauuaagccccgucaacauuugcaccuuccgaggcgacguaacacacaucgccggcucccgaaacuacaccaugaaccuugccucguuaaacuggaacaacuacgacccgaccgaagaaauacccgccccucucggaacccccgacuucguaggaaaaauccaaggcguccuaacucaaaccaccaaaggcgacggcuccacccgcggccacaaagcgaccguauacacaggaucagcccccuucacccccaagcucggcucaguccaguucuccacagacaccgaaaacgacuucgaaacccaccaaaacaccaaauucaccccuguaggcguuauacaagacggcucaaccacacaccgaaacgaaccccaacaauggguccuccccuccuacagcggccgcaauguccacaacguucaccuagcacccgcaguagcccccaccuuucccggcgaacaacuccucuuuuuccggucaacuaugccaggcugcuccggcuaccccaacauggaucuagacugucuccuaccccaagaguggguccaacacuucuaccaagaagccgcacccgcacaaucugacguugcccuccuaagauucguaaaccccgacaccggacgaguacucuucgaaugcaaacuacacaaaucaggcuacgucacagucgcccacacaggccaacacgaccuuguuaucccucccaacggcuacuuucgcuucgacucauggguaaaccaauucuacacccuagcccccaugggcaacgguacuggccgccgccgcgcccucuaa

SEQ ID NO: 36312 - RNA, 1623 nt, Artificial Sequence
  derived and/or modified sequence opt11 from VP1__Norovirus__BAG70434
augaaaauggccucgaacgacgcaaaccccuccgacggcuccgccgccaaccucgucccagaggucaacaacgaagucauggcacuagaacccgucgucggugcagcaauagccgcacccguagccggacaacaaaaugucaucgaccccuggauaagaaauaacuucguucaagcacccggcggcgaguucaccgucucuccccggaaugcacccggcgaaauccucugguccgcaccucucggccccgaucuaaacccauacuuaucccaccucgcccgaauguacaacggauacgcuggcggcuucgaaguccaagucauccuagccggcaacgccuuuacagcaggaaaaauaauuuucgcugccgucccacccaacuucccaaccgaaggccuuucccccucccaaguaaccauguucccccacaucaucgucgacguccgccaacucgaacccguccuuaucccccuacccgacguccgcaacaacuucuaccacuauaaccaauccaacgacagcaccauaaaacucauagccaugcuauacacaccccuccgcgccaacaacgcaggagaagacgucuuuaccgucagcugucggguacuuacacgcccaucccccgacuucgacuucaucuuccucgugccacccacugucgaaucacgcaccaaacccuuuaccguccccauacucacagucgaggagaugaccaacucccgcuuccccaucccccucgaaaaacucuucacuggccccuccucugcuuucgucguccagccccaaaacggaagaugcacgaccgacggcguccuccuaggaaccacccaacuauccccgguaaacaucugcaccuuccgaggagacgucacccacauagccggcucccgcaacuacaccaugaaccuagccucccucaacuggaacaacuacgaucccacugaggaaauccccgccccacuagggaccccugacuucgucggcaaaauacaaggcguacucacccaaacaaccaaaggagacggcucaacccgcggccacaaagccaccgucuacaccggcucagcccccuuuacacccaaacucggcuccguccaauucuccacagacaccgaaaacgacuucgaaacccaccaaaacacaaaauucacccccgucggaguaauccaagacgguuccaccacccaccgaaacgaaccccaacaauggguccuccccuccuacuccggccgcaacgcccacaacguccaccuugccccugcaguagcaccaacauuccccggugaacaacuccucuucuuccgguccacaaugcccggcugcuccggauaucccaacauggaccucgauugccuccucccccaagaauggguccaacacuuuuaucaagaagccgcaccagcucaaucugacgucgcccuccuccgcuucguuaaccccgacacaggccgcguacucuucgaauguaaacuccauaaauccggcuaugucaccguugcgcacaccggacaacacgaccucgucauaccucccaauggcuauuuccguuucgacucaugggucaaccaauucuacacccuagcacccaugggcaacggaaccggccgacgccgcgcccucuaa

SEQ ID NO: 36313 - RNA, 1623 nt, Artificial Sequence
  derived and/or modified sequence opt11 from VP1__Norovirus__BAG70437
augaaaauggcaucgaacgacgcaaaccccuccgauggcucaaccgcaaaucucguaccagaagucaacaacgaagucauggcucucgaaccugucguaggugcagccaucgccgccccagucgccggacagaccaacguaaucgaccccuggauccgaaacaacuucguccaagcaccaggcggugaguucaccgucucaccccgcaacgccccaggagaaauccucugguccgcaccccucggcccagaccucaauccauaccuaucccaccucgcacgcauguacaacggauacgcaggcggcuucgaaguccaagucauacuagccggaaaugcauucaccgcaggcaaaaucaucuucgcaaaggucccaccaaauuuccccaccgaaggccucucccccagccaaguaacuauguucccccacaucaucgucgacguccggcaacuagaacccguccucaucccacucccagacguccgcaacaacuucuaucacuacaaccaaagcaacgacucaaccaucaaacucaucgccaugcuuuacacuccccuacgagcaaacaacgccggagaagacguauucaccguaucaugucgcguccuaacccgaccaucucccgacuucgacuucaucuuccucguaccucccaccguagaaucacgaaccaaacccuucaccguaccaauccucaccgucgaagaaaugacaaacucacgauucccaaucccccuagaaaaacucuucaccggucccucaggcgccuucguaguacaaccccaaaacggccgcugcacuaccgacggcguccuucuaggcacaacacaacucucaccagucaacaucugcaccuuccgcggagacgucacacacaucgcaggcagcaggaacuacacaaugaaccucgccucccugaacuggaacaacuaugaccccaccgaagaaauacccgccccucuagguacccccgacuucgucggcaaaauccaaggcguccucacacaaaccacaaaaggcgacggcagcacacgcggccacaaagcaacaguauacacaggauccgccccauucacccccaaacucggcuccguacaauucuccaccgacaccgaaaacgacuucgaaacgcaccaaaacaccaaauucacccccgucggcgucauccaagacggauccaccacccaccgcaacgaaccacagcaauggguacuccccagcuacuccggcaggaacguccacaacguccaccucgcccccgccgucgcccccaccuucccaggagaacaacuucuauucuuccguucaaccaugcccggaugcucagguuaccccaacauggaccuagacugccuccucccacaagaguggguccaacacuucuaccaagaagccgccccugcccaauccgacgucgcacuccuccgcuuugucaaccccgacaccggacgcguccuauucgaaugcaaacuccacaaaucaggcuacguaacaguagcccacaccggccaacacgaucucgucauacccccuaacggauacuuccgcuuugacuccugggucaaccaauuuuacacccuagcccccaugggcaauggaacaggccgccgccgagcccuuuga

SEQ ID NO: 36314 - RNA, 1623 nt, Artificial Sequence
  derived and/or modified sequence opt11 from VP1__Norovirus__BAG70440
augaaaauggccucaaacgacgccaacccauccgacggcucaaccgcaaaccucguacccgaaguaaacaaugaagucauggcccuagaacccgucguaggcgccgcaaucgccgcaccaguagccggucaacaaaacgucauugacccuuggauccgcaauaacuucguccaagcccccgguggcgaauuuaccguuucaccacgcaacgcaccaggagaaauucucuggucggcaccccucggacccgaucucaacccguaccucagccaccucgcccgaauguacaacggcuacgccggcggauucgaaguccaagucauccuugccggcaacgccuucaccgccggcaaaaucaucuuugcagcaguacccccaaacuucccaaccgaaggacucucccccucacaagucaccauguucccccacauaaucgucgacguccgacaacucgaacccguccucaucccacuccccgacguccguaacaacuucuaccacuacaaccaaagcaacgacuccaccauuaaacucaucgcaaugcuauacacaccccuacgcgccaacaacgccggcgacgacguauucaccgucagcugccguguacucaccaggccaucucccgacuuugacuuuauuuuccucgucccuccuaccguagaaucacgaaccaaacccuucaccgucccaauccuaaccguagaagaaaugacaaacucccguuuccccaucccccucgaaaaacuauuuacaggcccauccagcgccuucgucguacaaccccaaaacggacgcugcacaacagauggcguacuacuaggcaccacccaacucucccccguaaacaucugcaccuuccgaggugacgucacccacaucgcuggaucccgcaacuacaccaugaaccucgcaucccucaacuggaacaacuacgaccccaccgaagaaaucccagccccacucggcacccccgacuucgucggcaaaauccaaggcguccuaacacaaaccaccaaaggcgacggcuccacccgcggucacaaagccacaguauacaccggcuccgcucccuucacaccaaaacuaggcuccguccaauucuccaccgacacagaaaacgacuucgaaacccaccaaaacaccaaguucacucccgugggcgucauccaagacggcggaaccacacaccgcaacgaaccucaacaauggguccuccccuccuacucaggccgaaauguccacaacguccaccucgcccccgccgucgcccccacauuccccggcgaacaacuccuuuucuuccgcaguaccaugcccggcugcuccggauaucccaacauggaucuagauuguuuacucccccaagaauggguccaacacuucuaccaagaagcagcacccgcccaauccgacguagcccuguuaagauucguaaacccugacacaggccgcguccucuucgaauguaaacuccauaaauccggcuacguaacaguagccuacaccggacaacacgaccucgucaucccuccuaauggauacuucagauucgacuccuggguaaaccaauucuacacucucgcgccuauggguaacggcaccggccgccgacgagcccucuaa

SEQ ID NO: 36315 - RNA, 1623 nt, Artificial Sequence
  derived and/or modified sequence opt11 from VP1__Norovirus__BAG70446
augaaaauggccucaucagacgccaaccccagcgacggcucaaccgccaaccucguccccgaagucaacaaugaagucauggcacucgaaccagucguaggugccgcaauugccgcccccguagccggccaacaaaacguaaucgaccccuggauaagaaacaacuucguccaagccccgggcggagaguucaccguaucccccagaaacgcucccggcgaaauccucuggucagcaccacuaggucccgaccucaacccauaccucucccaccuugcccgaauguacaacucuuacgccggcggcuucgaaguccaaguuauccuugcuggcaacgcguucaccgcgggaaaaaucaucuucgccgccgucccacccaauuuucccaccgaaggacuauccccaucucaagucacaauguucccccacaucauagucgacguccgacaacucgaaccaguccuaauaccccuccccgacguuagaaacaacuucuaccacuacaaccaauccaacgaccccaccauuaaacuaaucgccaugcucuauaccccacuccgugccaauaacgcaggcgacgacguguucacagucucaugccgcguccucacacgacccucaccagacuucgacuuuauauuccucguacccccaaccguagaaucgcgcaccaaaccauucuccguccccauccucaccgucgaagaaaugacaaacagccgcuucccaaucccccucgaaaaacucuuuacaggccccucuuccgcauucguuguccagccccaaaacggacgcuguacaaccgacggaguccuccucggcaccacccaacuaucucccgucaacauaugcaccuuccgcggcgacgucacccacaucgccggcacacaagaauacaccaugaaccucgccucacaaaacuggaacaacuacgaccccaccgaagaaauccccgcccccuuaggaacccccgacuucgucgguaaaauccaaggcguacucacccaaaccacccgccgcgacggcuccacucggggccacaaagcaacagucuccaccggcuccguccacuucacccccaaacucggccgcauacaauucagcaccgacaccucuaacgacuucgaaaccggccaaaacacccgcuuuacccccgucggcguaguccaagacggcuccaccacccaccaaaacgaaccccaacaauggguccucccaaacuacucaggccgcgauucccauaacguccaccuugcccccgcagucgccccuuccuucccaggcgaacaacuccucuucuuccgcucuaccaugccuggaugcucuggcuauccaaacaugaaccucgacugccuacucccccaagaauggguccaacacuucuaccaagaagcugcccccgcacaaucagacgucgcccuccugcgcuucguaaacccagacaccggacguguacucuucgaaugcaaacuacacaaaucaggcuacguuacuguagcccacacaggccaacacgaccuugucauaccucccaacggcuacuuucgcuuugacucaugggucaaccaauucuacacccuagcucccaugggcaacggcaccggccgccgccgcgcccucuaa

SEQ ID NO: 36316 - RNA, 1623 nt, Artificial Sequence
  derived and/or modified sequence opt11 from VP1__Norovirus__BAG70449
augaaaauggccucaaacgacgcuaacccaucagacggauccgcggccaaucucgucccagaagucaauaacgaagucauggcccuagaacccgucgucggugccgccaucgcagccccagucgccggccaacaaaacguaaucgacccauggauccgaaacaacuucguccaagcacccggaggcgaguucaccguaucaccccguaacgccccaggcgaaauccucuggucagcaccccugggucccgaccucaaucccuaccucucccaccucgcacgaauguacaacuccuacgccggcggcuucgaaguccaagucauccucgcaggcaacgccuucaccgcuggaaaaaucaucuuugcagccguacccccgaacuuccccacggaaggacucucaccaucccaagucaccauguucccccacauuaucguagacguccgacaacucgaacccguccucauaccccuacccgacguucgaaacaacuucuaccacuacaaccaaagcaacgacccaaccaucaaacuaauagcaaugcuguacacaccacuccgagcaaacaacgccggcgaagacgucuucacuguaucaugccgaguccuuacccgaccaucaccagacuucgacuucaucuuccuagucccucccaccgucgaaucaagaaccaaacccuucaccgucccaauccucaccgucgaagaaaugacuaacucaagauucccuauaccacuagaaaaacuguucacaggccccuccggagcauuugucguacaaccccaaaacggccgaugcaccaccgauggcguccuccucggaaccacccaacucuccccagucaacaucugcacauuccgcggcgacgucacacauaucgccggcagcagaaacuauaccaugaaccucgccucucucaacuggaacaacuacgaccccaccgaagaaaucccugcuccccucggaacacccgacuucguaggaaaaauccaaggaguccugacccaaaccacaaaaggcgacggcuccacccgaggucauaaagccaccguauacaccggauccgcuccauucacacccaaacugggaucgguccaauuuucaaccgacacagaaaaugacuucgaaacccaccaaaacaccaaauucacccccgucggcguuauccaagacggaucaaccacccaccgcaacgaaccucaacaauggguccucccaucauacuccggacgcaacguccacaacguacaccucgcccccgcaguagcccccaccuuccccggagaacaacuccuuuucuuccgaucuacaaugccuggaugcucagguuaccccaacauggaccuagacugcuuacucccccaagaauggguccaacacuucuaccaagaagcagcgcccgcacaauccgacguagcccuacucagauucgucaacccagacaccggccgaguccuauucgaaugcaaacuccacaaauccggauacgucaccgucgcacacaccggccagcacgaccuggucaucccacccaauggcuauuuccgcuucgauucauggguaaaccaauucuacacacucgccccaaugggcaacggcaccggacgacgccgcgcacucuag

SEQ ID NO: 36317 - RNA, 1623 nt, Artificial Sequence
  derived and/or modified sequence opt11 from VP1__Norovirus__BAG70452
augaaaauggccucuaacgacgccaacccuucagacggcagcgccgcaaaccuagucccagaaguuaacaacgaagucauggcccucgaaccagucgucggagccgcaaucgcagccccagucgccggacagaccaacgucauagacccuuggauaagaaacaacuucguccaggcccccggcggagaguucacagucagcccccgcaacgccccaggcgaaauauuaugguccgccccucucggccccgaccuaaaccccuaccucucacaccucgcaagaauguacaacggcuacgccggcgguuucgaaguacaagucauccucgccggaaacgccuucaccgcuggcaaaaucaucuucgcagcagucccacccaacuuccccaccgaaggacucucacccucccaagucaccauguucccacacauaaucguugacguccgccagcuugaacccguacucauaccccucccagacguucgcaacaacuucuaccacuacaaccagcuaaacgacuccaccauaaaacuaaucgcaaugcucuacacuccacuaagagcaaacaacgccggugaagacgucuucacuguauccugccgcguccuuacacgccccuccccggacuucgacuucaucuucuuagucccucccaccgucgaaagccgaaccaaaccauucacagucccgauccucaccgucgaagagaugaccaacagccgcuuccccaucccccucgaaaaacucuucacaggacccuccggcgccuucgucguucaaccccagaacggccgcugcacaaccgauggcguucuccucggaaccacccaacucuccccagucaacaucugcacauuccgcggcgacguaacccacauagcuggcuccagaaacuacaccaugaaucucgccucacuaaauuggaacaacuacgaccccaccgaagaaauccccgcaccccucggcacucccgacuucguagguaaaauacaaggcguacuaacccaaaccacuaaaggagacggaucuacccgaggucacaaggccaccgucuacaccggcuccgcccccuucacaccaaaacucggcuccguccaauucucaacagacaccgaaaaugauuucgaaacccaccaaaacaccaaauucacccccguaggcgucauucaagacggaucaaccacccaccgcaacgaaccacaacaguggguccucccuagcuacucuggcagaaacguccacaacguucaccucgccccagccguagccccaacauuccccggagaacaacuacucuucuuccgcuccacgaugccaggcugcuccggcuaccccaacauggaccucgacugccuccuaccccaagaauggguccaacauuucuaccaagaagcagcccccgcacaauccgacgucgcacuccuccgauucgucaacccagacaccggccgaguccucuucgagugcaaacuccauaaauccggcuacgucacaguagcacacaccggccaacacgaccucguuaucccacccaacggcuacuuccgauucgacuccugggucaaucaauucuacacucuagcccccaugggcaacggcaccggccgacgccgcgcccuauaa

SEQ ID NO: 36318 - RNA, 1623 nt, Artificial Sequence
  derived and/or modified sequence opt11 from VP1__Norovirus__BAG70458
augaagauggccagcaacgacgccaaccccucugacggaucagccgcgaaccucguccccgaagugaacaacgaagucauggcccucgaacccgucguaggcgccgccaucgcugccccugucgcaggacagaccaacgucauagacccauggauccgcaacaacuucguccaagcacccggcggcgaguucaccgucucaccccguaacgccccaggagaaauccuuugguccgcaccacucggccccgaccucaaccccuaccucucccaccuggcccgcauguacaacggcuacgccgggggcuucgaaguccaagucauacucgcuggcaacgcauucacagcaggcaaaauuauauucgccgcagucccacccaacuuccccaccgaaggccuaucccccucccaggucaccauguucccucacauaaucgucgacguucgccaacucgaacccguccucauaccccuccccgacguccgcaacaacuucuaccacuacaaccaaagcaacgacagcaccaucaaacuaaucgcaaugcucuacacuccccuccgagcgaacaacgccggcgaagacgucuucaccguauccugccgcguacucacccgccccagucccgacuucgauuucaucuuccucgucccucccaccgucgaauccagaaccaaacccuucacaguccccauccuaacuguugaagaaaugaccaacucccgauuccccaucccccuagaaaaacuauucaccggcccuucaggcgccuucgucguccaaccacagaacggccguugcaccacagacggcguucuccucggcaccacacaacucagccccguaaacaucugcaccuuccgcggagacguaacccacauagccggaucccgcaacuauacuaugaaccucgccucccucaacuggaacaacuaugacccaacagaagaaaucccagcaccccucggcaccccagacuuugucggaaaaauccaagguguccuaacccaaaccaccaaaggagacggcucaacacggggccacaaagccaccgucuacaccggaucugcuccuuucacccccaaacuaggcucuguucaauucuccacagauaccgaaaacgacuucgaaacccaccaaaacaccaaauucaccccaguuggcgucauccaagacggcagcacaacccaccguaacgaaccacaacaauggguucuccccuccuauuccggaaggaacguccacaacguccaccuugcccccgccgucgcccccaccuuccccggugaacaacuccuuuucuuccguuccaccaugcccgguugcucuggcuaccccaacauggaccucgacugccuucucccucaagaauggguccaacacuucuaccaagaagccgcccccgcccaaucagacguagcucuccuccgcuucguaaaccccgacaccggccgcguccuuuucgagugcaaacuccacaaauccggcuaugucacaguagcccacaccggccaacacgaucucguaauacccccuaacggauacuuccgcuucgacucgugggucaaccaauucuacacacuagcaccgaugggaaacggaaccggccgucgccgcgcccuauaa

SEQ ID NO: 36319 - RNA, 1623 nt, Artificial Sequence
  derived and/or modified sequence opt11 from VP1__Norovirus__BAG70461
augaaaauggcuucaaacgaugccaaccccuccgacggcagcgccgcuaaccucguccccgaagucaacaacgaagucauggcccucgaacccgucgucggagccgccauagcagcacccgucgccggacaacaaaaugucaucgaccccuggauacgcaacaacuucguccaagcaccaggcggagaauuuaccgucagcccccgaaacgcccccggagagauccucuggucagcaccccuuggaccggaccucaacccauaccucucgcaucucgcccgcauguauaacggauacgccggcggcuucgaaguccaaguaauccuagccggaaacgccuucacugccggaaaaaucauauucgccgccgucccacccaauuuccccacagaaggacuuucccccucacaagucaccauguucccccacauaaucgucgacguccgccaacuugagccaguccucauaccccugcccgauguacgcaacaacuucuaucacuacaaccaaagcaaugacucuaccaucaaacucauugccaugcuauacacaccacuccgcgcgaacaacgccggcgaagacgucuucaccgucuccugcagaguacucacccgccccucucccgacuuugacuucaucuuccucgucccacccaccguagaauccagaacuaaacccuucacgguccccauccucacagucgaagaaaugacuaauucccgcuuccccaucccccucgaaaaacucuucacgggcccauccuccgccuucgucguacaaccccaaaacggucgaugcaccaccgauggcguccuccucggcaccacacaacucucccccgucaacaucugcaccuuccgcggcgacguaacacacaucgccgguucccgcaauuacacaaugaauuuagccucccucaacuggaacaacuacgaccccacugaagaaauccccgcgccccuugggacaccagacuucgucgguaaaauccaaggaguccuaacccaaaccaccaagggcgacggauccacccgcggccacaaagccacagucuacaccggcucagcacccuucacccccaaacuaggcuccguucaauucuccacagauacagaaaacgacuucgaaacccaccaaaacaccaaauucacccccgucggcguuauccaagacggcuccaccacacaccgcaacgaaccccaacaauggguccuaccaucauacucuggcagaaacguccagaacguccaccuugccccagccguagcacccaccuucccaggcgaacaacuccucuucuuccgcuccaccaugcccggaugcuccggcuaccccaacauggaccuugacugccuccucccucaagaauggguacaacacuucuaccaagaagccgcaccagcccaaucugacguugcucuuuuacgcuucgucaacccugacaccggccgcguccuauucgaaugcaaauuacacaaauccgguuacguaaccguugcacacaccggucaacacgauuugguaauacccccaaacggcuacuuccguuucgacuccugggucaaccaguucuacacacucgccccaauggguaacggcaccggccgccgacgcgcccuuuaa

SEQ ID NO: 36320 - RNA, 1623 nt, Artificial Sequence
  derived and/or modified sequence opt11 from VP1__Norovirus__BAG70464
augaaaauggccuccaacgacgcaaacccauccgacggaucagccgccaaucucguccccgaagucaacaacgaagucauggcacucgaacccguaguaggcgccgccaucgcugccccaguugccggccaacaaaacgucaucgacccauggauacgcaacaacuucguacaagcccccggcggcgaguucaccgucucaccccgcaacgcccccggagaaauacucugguccgcuccccuuggaccagaccucaaucccuaccucucacaccucgcccgcauguacaacggcuacgccggcggauucgagguacaaguuauacuagccggcaacgccuucaccgccggaaaaaucauauucgcagccguucccccuaacuuccccaccgaaggccuaagcccaucacaaguuacuauguuuccccacaucaucgucgacguacgacaacucgaacccguccucaucccccuacccgacguccgaaacaacuucuaccacuauaaccaguccaacgacuccacaaucaaacucaucgccauguuauacaccccacuacgcgccaacaacgccggagaagacgucuucacaguaucaugccgcguccucacccgacccucaccagacuucgacuucauauuccucgucccaccaaccgucgaaucgcgcaccaaaccauuuacaguccccauccucacagucgaagaaaugaccaacucccgcuuccccauaccccuagagaaauuauucacgggccccuccuccgccuucgugguacaaccacaaaacggccgcugcacgaccgacggcguccuccuuggaaccacccaacuauccccagucaacaucugcaccuuccgcggcgacguaacucacauagccggcucccgaaacuauaccaugaaccucgccucccuaaacuggaacaacuacgaccccacagaagagaucccugcaccccucggcaccccagacuucgucggaaaaauccaaggcguccucacacaaaccaccaaaggcgacgguuccacccgcggccauaaagccacagucuauaccggcucagcccccuucacacccaaacuuggaucuguccaauuuuccaccgacaccgaaaacgacuucgaaacccaccaaaacaccaaauucacccccgucggcguaauacaagaugguuccaccacccacagaaacgaaccucaacaauggguccuaccaagcuacagcggacgcaacguacaaaacguccaccuugccccagccgucgcccccaccuuccccggcgaacagcuucuauucuuccgaucaaccaugcccggaugcucaggcuaccccaacauggaccucgacugucucuuaccccaagaauggguacaacacuucuaccaagaagccgcccccgcacaauccgacgucgcacuccuacguuucguuaacccugacaccggccgcguacucuucgaaugcaaacuccacaaaucaggcuacgucacuguugcgcacaccggacaacacgaccucgucauuccacccaacggcuauuuccgcuucgacuccugggugaaccaauucuacacccuagcacccauggguaacggcacaggucgacgccgagcccucuaa

SEQ ID NO: 36321 - RNA, 1623 nt, Artificial Sequence
  derived and/or modified sequence opt11 from VP1__Norovirus__BAG70467
augaaaauggccagcaacgacgccaaccccuccgacggcucggccgccaaccuuguucccgaagucaacaacgaagucauggcacuagaacccguggucggagccgcaauagccgcacccguagccggacaacaaaacguaaucgacccauggaucagaaauaacuucguccaggcacccggcggcgaguucacagucuccccgcguaaugcccccggcgaaauauuaugguccgcaccccucggccccgaccucaacccauaccuaagccaccuagcccgcauguacaacgguuacgccggcggcuucgaaguccaagucauacucgccggcaacgccuucaccgcggggaaaauuaucuucgcagccguaccaccuaauuucccaaccgaaggccuuucccccucgcaaguuaccauguucccccacauaaucguagacguccgacaauuagaacccguacucauaccauugccagacgucagaaacaacuucuaucacuacaaccaauccaacgacagcacuaucaaacucauugccaugcuauauacaccccuccgagccaacaaugcaggagaagacguuuucaccguauccugccguguacuaacccgccccucccccgacuucgacuucauauuccuagucccuccaaccgucgaaucacgcaccaaacccuuuacaguccccauccucacuguugaagaaaugaccaacucccgauuccccaucccccuggaaaaacucuucaccggccccuccucugcauucgucguccaaccccaaaacggccgcuguacaacagacggcguccuacuaggcaccacccaacucucaccuguuaacaucugcaccuuccgcggcgacguaacacauauagccggcucccgcaacuacacaaugaaccucgccucccucaacuggaacaacuaugacccgacugaagaaauccccgcccccuuaggaaccccagacuuugucggcaaaauacaaggcguccuaacacaaaccacaaagggcgacggcuccacacgcggacacaaagccaccguauacaccggcuccgcacccuucacccccaaacuaggcuccguccaauuuucaaccgacacagaaaacgacuucgaaacacaccaaaacacaaaauucacaccaguuggcgucauccaagauggaagcaccacccaccgcaacgaaccacaacaauggguccucccaucuuacucagggcgcaacguccaaaacguucaccuagcccccgccgucgccccaaccuucccaggcgaacaacuccucuucuuccgaucaaccaugcccggcugcuccggcuaccccaacauggaccucgacugccuccucccccaagaauggguacagcacuucuaucaagaagccgccccagcccaaagcgacguggcccugcuccgcuucgucaacccagacaccggccgaguccucuucgaaugcaaacuccacaaaucaggcuacgucaccgucgcccacacuggccaacacgaccuugucauaccacccaacggcuacuuccgcuucgacucauggguaaaccaauucuacacucucgcuccaaugggcaacggaacaggacgcagacgcgcacuuuaa

SEQ ID NO: 36322 - RNA, 1623 nt, Artificial Sequence
  derived and/or modified sequence opt11 from VP1__Norovirus__BAG70470
augaaaauggcuucaaacgacgcgaaucccuccgacggcuccgcagcaaacuuaguacccgaagucaauaacgaagucauggcacucgagccagucgucggagcugccauagccgccccugucgcagggcaacaaaacguuauugauccuuggauacguaacaauuucguucaagcacccggcggcgaguucacuguauccccacgcaacgccccaggagaaauacuauggucagcaccccucggccccgaccucaaccccuaccucucccacuuagcccgaauguacaacgguuaugccggcggcuucgaaguccaagucauacuagccggcaacgccuucaccgcaggcaaaaucaucuucgcagcuguucccccaaacuuucccacagaagggcucuccccuucccaagucaccauguucccccacaucaucguagacguccgacaacucgaacccguccuaaucccccuucccgacguacgcaacaacuucuaccacuacaaccaauccaacgacuccaccaucaaacuaaucgccaugcucuauacgccccuuagagcaaacaacgcuggcgaagacgucuucaccgucuccugccgcguacuaaccagaccaucccccgacuucgacuucaucuuccucguacccccaaccgucgaaucacgcaccaaacccuucacaguccccaucuuaaccgucgaagaaaugacuaacucacgcuuccccauaccccuagaaaaacuuuucaccggccccucaggagccuucgucguacagccccagaacggacgcugcaccaccgacggcguccuccucggcacaacccaacucucccccguuaacauauguaccuuccgcggcgacgugacccacaucgccggaucacgcaacuauaccaugaaccuagcgucacucaacuggaacaacuacgaccccacagaagaaauccccgcaccacucggcacccccgacuucgugggaaaaauacaaggcguacugacccagacaacaaaaggagacggauccacaagaggccacaaagccacagucuacaccggauccgcaccguucacccccaaacuaggcucaguccaauucagcaccgacacagaaaacgacuucgaaacccaccaaaacaccaaauucacacccgucggaguaauccaagacggcuccacaacccaucggaacgaaccacaacaauggguccucccaagcuauuccggccgcaacguacacaacguacaccucgcacccgcagucgcaccaaccuuccccggagaacaacuccucuucuuccgaucaacuaugcccggcugcuccggcuacccaaacauggaccucgacugccuccucccccaagaauggguccaacacuucuaccaagaagcagcaccagcccaauccgacgucgcccuucuucgauuugucaacccagacaccggccgcguccuauucgaauguaaacuccacaagagcggcuacguaaccgucgcccacaccggccaacacgacuuaguaauaccacccaacggcuacuuccgauucgacucuugggucaaccaauucuacacccucgcacccauggguaacggcaccggccgccgacgcgcccuauga

SEQ ID NO: 36323 - RNA, 1623 nt, Artificial Sequence
  derived and/or modified sequence opt11 from VP1__Norovirus__BAG70473
augaaaauggccuccaacgacgccaacccaucagacggauccgccgcuaaucucguccccgaaguaaacaacgagguaauggcccucgaacccguagucggugccgccauugccgcccccgucgcaggccaacaaaacguaauagacccauggaucagaaauaacuucguacaagcccccggcggagaauuuaccgucucaccccgcaacgcaccaggagaaauccuuugguccgcaccauuaggcccagaccucaaccccuaccucucccaucuagcccguauguacaacggcuacgccggugguuucgaaguccaagucauccucgccggcaacgcauucacagccggaaaaaucaucuucgcagccguaccaccaaacuuccccacggaaggacuuucaccaucccaagugacuauguucccacacaucaucguagauguccgccaacucgaacccguacucauaccccuaccagacguccgaaacaacuucuaccacuacaaccaauccaacgacucgaccaucaaacucaucgccaugcucuacacuccccuacgagcgaacaacgcgggcgaagaugucuucacgguaucaugccguguccucacccgccccagccccgauuucgacuucaucuuccucguacccccaacagucgaaucacgcaccaaacccuuuaccgucccaauacucaccgucgaagaaaugaccaacucccgcuuucccauuccccuagaaaaacuauucaccggccccuccggcgccuucguaguccaaccccaaaacggccgcugcacaaccgacggcguccuccucggcacaacccaacuaucccccguuaacaucugcacauucagaggcgacguaacccacaucgccggaucccggaauuacaccaugaaccuagcuucucuuaacuggaauaacuacgaccccaccgaagagauacccgcaccccuaggcacaccagacuucguaggaaaaauucaaggcguccucacccaaacaaccaaaggagacggcagcacccguggccacaaagccacagucuauacuggcucagcccccuucaccccuaaacuuggcuccguccaauuuucaacugacaccgaaaacgacuucgagacucaccaaaacaccaaauucacacccgucggcgucauccaagacggcagcaccacccaccguaacgaaccccagcaauggguucuucccucauacagcggucgcaacguccacaacguccaccuugcccccgccguagcaccaaccuuuccgggcgaacaacuccucuucuuucgaucaaccaugcccggaugcucuggcuaccccaacauggaccucgacugccuccucccucaagaauggguccaacacuucuaucaggaagccgcccccgcacaaucagacgucgcacuccuacgcuucguaaacccagacacgggccguguccucuucgaauguaaacuacacaaauccggguacguaacagucgcccacaccggccaacacgaccucgucaucccacccaacggcuacuuccgauucgacuccugggucaaccaauucuacacccuagccccaaugggcaacggaaccggccgacgccgagcacucuaa

SEQ ID NO: 36324 - RNA, 1623 nt, Artificial Sequence
  derived and/or modified sequence opt11 from VP1__Norovirus__BAG70476
augaagauggccuccaacgacgccaacccauccgacggcucagcagcaaaccucguccccgaaguaaacaaugaagucauggcccucgaacccguagucggcgcugcuaucgccgccccagucgcuggacaacaaaacguaauugaccccuggauccgcaacaacuuuguccaagcccccgggggcgaguucacaguaucuccucgcaacgccccaggagaaauccugugguccgcaccacuaggaccagaccuuaacccauaccucucccaccucgcacgcauguacaacggcuacgcaggcggcuucgaaguccaggucauccucgccggcaaugcauucacggccggaaaaauaauauucgcagcaguuccacccaacuuccccacagagggccucucccccucccaggucaccauguucccacauaucaucgucgacguacgccagcuagaacccgucuuaauccccuuaccagacguccgcaacaacuuuuaccacuacaaccaguccaacgacagcaccaucaaacuaaucgcaaugcucuacacaccccuucgcgcaaacaaugccggcgaagacgucuucaccgucuccugccgcguacuaacccgccccagccccgacuucgacuucaucuuccucguaccucccaccguagaaucgcgaaccaaacccuuuaccguccccauccucaccgucgaagaaaugaccaacucacgcuuccccaucccccuugaaaaauuauucacuggccccucaggagccuucgucguacaaccucaaaacggccguugcacaaccgacggcguacuccuaggcaccacccaacucuccccagucaacauaugcacauuucgaggcgacgucacccacaucgcaggcucccgaaacuauacuaugaaccucgccagccucaauuggaacaacuacgacccuaccgaagaacuaccggcaccccugggaacccccgacuucgucggcaaaauccaagguguacucacccaaaccaccaagggugacggcuccacacgcggccacaaagccaccgucuacaccgguucagcccccuucacccccaaacuugguuccguccaguucagcaccgacaccgaaaacgacuucgaaacacaccaaaauaccaaauucaccccagugggcguaauacaagacggcucaacaacacaccgcaacgaaccacaacaauggguccuacccuccuacucuggccgcaauguacacaacguccaccuagcccccgccguagcacccaccuuucccggcgaacaacuccucuucuuccgcagcacuaugccaggcugcuccggauaccccaacauggaccuagacugccuccucccccaagagugggugcaacacuucuaccaagaagccgccccagcccaauccgacguagcccuccuacgauucguaaaccccgacacaggccgcguacuuuucgaaugcaaacuccacaagucgggcuacgucaccgucgcccauaccggacagcacgaccuugucauacccccaaauggauacuuccguuucgacucuuggguaaaccaauucuacacccuagccccuaugggcaacggcaccggacgcagacgcgcccucuaa

SEQ ID NO: 36325 - RNA, 1623 nt, Artificial Sequence
  derived and/or modified sequence opt11 from VP1__Norovirus__BAG70482
augaaaauggccuccaaugacgccaacccauccgacggaucagcagccaaccuagucccagaaguuaacaacgaaguaauggcacuagaacccguagucggcgcagcaauagcagccccagucgcaggccaacaaaaugucaucgaccccuggauucgaaacaacuucguccaagccccaggcggcgaguucacagucagcccacgcaacgcacccggcgaaauccuaugguccgcaccccuaggccccgaccuaaacccauaucuuagccaccucgcccgcauguauaacggcuacgccggcggcuucgaaguacaagucauccucgccggcaacgcguucaccgccggaaaaaucauuuucgcagcaguuccucccaacuuccccaccgacggacucucgcccucccaagucaccauguucccacacauaaucgucgacguccgccaacuugaacccguccuuaucccacuaccagacguccgcaauaacuucuaccacuacaaccaauccaacgacuccacaaucaaacuuaucgcaaugcucuacacaccccuccgcgccaacaacgccggagaagacgucuucacagucagcugccgcguccucacacgccccucccccgauuucgacuuuaucuuuuuagugccacccaccguagaaucucgcaccaaacccuucaccguccccauccucaccgucgaagaaaugacaaacucaagauuccccaucccucuugaaaaacucuucaccggccccuccucugcuuucguaguccaaccacaaaacggccgaugcaccaccgacgguguacuacucggcacaacccaacucagcccaguaaacauaugcaccuuccgaggagacguaacacacaucgcaggcucccgcaacuacacaaugaaccucgcuucucucaacuggaacaacuacgaccccacugaagaaauccccgcuccccucggcacacccgacuucgucggaaagauccaaggcguccucacacaaacuaccaaaggcgacggcucaacucgcggacauaaggcaacugucuacaccggcuccgcgccauucacccccaaacucggcuccguccaauucuccaccgacaccgaaaacgacuucgaaacccaccagaacaccaaauucacgcccguaggagucauccaagacggcggaaccacccaccgcaacgaaccucaacaauggguacuacccuccuacucuggccgcaauguccacaacguccaccucgccccagccgucgcgcccacuuucccuggggaacaacuacucuucuuccggucaaccaugcccggcugcucuggauacccaaacauggaccucgauugccuacuaccacaagaguggguucaacacuucuaccaggaggccgcccccgcacaaucagacgucgcuuuacuucgauucguuaacccagacacaggucgcguccucuucgaaugcaaacuccacaaaucaggcuacguuaccguggcccacaccggccaacacgaccucguaauaccacccaacggcuacuucagguucgacuccuggguaaaccaauucuacacccuugcccccaugggcaacggcaccggccgacgccgcgcccucuaa

SEQ ID NO: 36326 - RNA, 1623 nt, Artificial Sequence
  derived and/or modified sequence opt11 from VP1__Norovirus__BAG70485
augaaaauggccagcaacgacgccaaccccuccgacggcuccgccgccaaucuaguaccugaagucaacaacgaagucauggcacucgaacccguuguuggagcagcaaucgccgcccccguagccggccaacaaaacguaaucgacccauggauucguaauaacuucguacaagcacccggaggcgaguucaccguaagcccucgcaacgcccccggagaaauacucugguccgcaccacucggcccagaccucaacccauaccuaucccaccucgcccgcauguacaacggcuacgccgguggcuucgaaguccaagucauacuugcuggcaaugccuucaccgccggcaaaauaaucuucgcagcugucccucccaacuuccccaccgaaggccucucccccucgcaagucaccauguucccccacaucaucguagacguccgacaacucgaaccaguucugauccccuuacccgauguccgcaacaacuucuaucacuacaaucaauccaacgacuccaccaucaaacuaauugccaugcuauacacccccuuacgcgccaacaacgccggcgaagacgucuucaccgucucaugccgcguccucacccgcccuuccccagacuuugacuucauauuccucgucccacccaccgucgaaucacgcaccaaacccuucacugucccaauccuaaccgucgaagaaaugacuaacucccgcuuucccauaccccuagaaaaacucuucaccggucccuccucagcuuucgucguccaaccucaaaacggccgaugcacaaccgacggcguccuucucgguacuacccaacucucccccgucaacaucugcaccuuucgcggagacguaacacacauugccggcucccgcaacuacaccaugaaccucgcaagccuaaacuggaacaacuacgaccccaccgaggaaauccccgcuccacucggcaccccugacuucgucgguaaaauccaaggaguacuaacccaaaccacaaaaggagacggcagcacacgcggccacaaagccacagucuacacaggcucagccccauucaccccaaaacuuggcuccguccaauucucgacugacaccgaaaacgacuucgaaacccaccaaaacacaaaauucacccccgucggcguaauccaggacggaagcaccacacaccgcaacgaaccccaacaguggguccuccccuccuauuccggaagaaauguacaaaacguacaccucgcccccgccgucgcccccaccuucccaggcgaacaacuacucuucuuccgcuccacuaugcccggcugcuccggcuacccuaacauggaucucgacugccuacuuccccaagaauggguccaacacuucuaccaagaagcagcucccgcucaauccgacgucgcccuccuccgcuucguaaaccccgacaccggccgcguccucuucgagugcaaacuccacaaauccggcuauguaaccgucgcccacaccggacaacacgaccucguaaucccacccaacggcuauuuccguuucgacucguggguaaaccaauucuacacacucgcccccauggguaacggcaccggccgccgccgugcccucuaa

SEQ ID NO: 36327 - RNA, 1623 nt, Artificial Sequence
  derived and/or modified sequence opt11 from VP1__Norovirus__BAG70488
augaaaauggccuccaacgacgccaaccccagcgacggcagcgccgccaaccucgucccagaaguaaacaacgaaguaauggcccuagagcccguuguaggcgcagcaaucgccgcacccgucgcaggccaacaaaacguaauagacccauggaucagaaacaacuucguacaagccccagguggcgaguucacgguaagcccccgcaacgcccccggcgaaauccucugguccgccccacucggucccgaccucaaccccuaccuaucacacuuagcccgaauguacaacggcuacgccggaggauucgaaguccaagucauccucgcaggcaacgccuucacagcaggcaaaauaauuuucgccgcagucccacccaacuuccccacagaaggccucucccccagccaagucaccauguucccccauauaaucguagacguacgccaacucgaacccguccucaucccccuccccgacguccggaacaacuuuuaccacuacaaccaaucgaacgacucaaccaucaagcucaucgccaugcucuacacaccccuucgagcaaacaacgccggcgaagacgucuucaccgucucaugcagaguccucacccggccaagcccagacuucgacuucaucuuucucguaccacccacgguagaaucucgcaccaaacccuucacaguucccauccucaccgucgaagaaaugacaaacucccgcuuccccaucccccucgaaaaacucuucaccggccccuccucagccuucgucguccaaccacaaaacggccgcugcacaaccgacggaguacuccuaggaaccacccaacuaucacccgucaacauaugcaccuuucgaggcgacgucacacacauagccggcuccagaaacuacaccaugaaccuugccucccucaacuggaacaacuacgaccccacagaagaaaucccagcaccacuaggcacccccgacuuugucggaaaaauccaaggcguccucacacaaaccaccaaaggagacggcuccacccgcggacacaaagcaaccguauacaccggauccgcccccuucacucccaaacuaggcucaguccaauucucaaccgacaccgaaaacgacuucgaaacccaucaaaacaccaaauucaccccagucggaguaauccaagacggcuccaccacccaccgaaacgaaccacaacaauggguccuccccucuuauagcggccgcaaugugcagaacguccaccuagcucccgccgucgccccaaccuucccuggagaacaacuccuauucuuccgcucaaccaugccuggauguuccggcuacccuaacauggaccucgacugccuccucccacaagaauggguccaacacuucuaccaagaggcagcaccagcucaaucugauguagcacuccuccgcuucgucaacccagacaccggacgcguccuauucgaaugcaaacuacacaaauccggcuacgucaccguagcccacacaggccaacacgaccucgugauaccacccaauggcuacuuucguuucgacucaugggucaaccaauucuacacucucgcgccaaugggaaacggaacagggcgccgacgagcacuauaa

SEQ ID NO: 36328 - RNA, 1623 nt, Artificial Sequence
  derived and/or modified sequence opt11 from VP1__Norovirus__BAG70491
augaaaauggccuccaacgacgcaucccccuccgacggcuccaccgcaaaccucguccccgaagucaacaacgaagucauggcccucgaacccgucgucggcgcagcaaucgccgcacccgucgcuggccaacaaaacgucaucgaccccuggauacgcaacaacuucguccaagcacccggcggagaguucaccgucucaccucgaaacgccccaggagaaauccucuggucggcccccuuaggcccagaccugaaccccuaccucucccaccuagcacguauguacaacgguuacgccggcggcuucgaaguacaagucauacucgcaggcaacgccuucacagcuggcaaaaucaucuucgcugccgucccucccaacuuccccaccgaaggacucuccccaagccaagucaccauguucccgcacaucaucgucgacguacgacaacuggaaccaguccucaucccacuccccgacgucagaaacaacuucuaccacuacaaccaaucuaacgacuccaccaucaaacuuauagccaugcucuauaccccacuacgcgccaacaacgcaggcgacgacguauucacagucuccugccgcguccucacaagacccucaccagacuucgauuucaucuuccucguuccacccacagucgaaagccgaaccaaacccuucacuguccccauccuuaccgucgaagaaaugacaaacucucgauucccaaucccacucgaaaaacuuuucaccggccccucaucagcauucgucguacaaccccaaaacggccgcugcaccaccgauggcguccuccuugguaccacccaacucuccccaguaaacaucugcaccuuccgcggagacgucacccacaucccaggaacucgcacuuaccgcaugaaccucgccucccaaaauuggaacaacuacgaccccacagaagaaaucccagcaccccuaggcacacccgacuucguaggcaaaauccaaggcaugcuaacccaaaccaccaaaggcgacggcucuacacgaggccacaaagccaccgucucaaccgguucagucgacuucacccccaagcucgggucaguccaauucgccaccgacaccgacaacgacuucgaaaccgggcaaaacacacgauucaccccaguaggugugauccaagacggcuccuccacccaccgaaacgaaccacaacaauggguacuucccgacuauucaggccgcacagcacacaacguccaccucgcccccgccgucgcacccaccuuccccggugaacaacuacuuuucuucagauccaccaugcccggcugcucaggcuaccccaacauggaccucgacugccucuuaccucaagaauggguccagcauuucuaccaagaagccgcaccaucucaaagugacgucgcccuucuacgcuucgucaaccccgacacuggccgaguccucuucgaaugcaaacuucacaaagcuggcuacgucacggucgcacacaccggucaacacgaccucguaauucccccaaacggcuacuuccgcuucgacuccuggguaaaccaauucuacacacucgcaccaaugggcaacggcgcaggccgcagacgcgcccucuaa

SEQ ID NO: 36329 - RNA, 1623 nt, Artificial Sequence
  derived and/or modified sequence opt11 from VP1__Norovirus__BAG70494
augaaaauggccagcaacgacgcuaacccaagcgacggcuccgccgccaaccuaguccccgaaguaaacaacgaagucauggcucucgaacccguaguuggagcagccaucgccgcacccgucgccggccaacaaaacguaauagaccccuggaucagaaacaacuucguacaagcacccggcggcgaguucacagucucaccccgcaacgcaccuggcgaaauccucugguccgccccacucggucccgaucucaaucccuaucucucccaccucgcacgaauguacaacggcuacgccggaggcuucgaaguacaaguaauacucgccgguaacgccuucaccgccggcaaaaucaucuucgccgccgucccacccaauuuccccaccgaaggccuguccccaucccaagucaccauguucccccacaucaucgucgacguccgccagcuagaacccguacucauuccccuaccagacguucgaaacaacuuuuaccacuacaaccaaagcaaugacucaaccaucaaacucaucgccaugcuuuacacuccccuccgcgccaacaacgccggagaagacguauucacuguuuccugccgcguccucaccaggccguccccggauuucgacuucaucuuccucgucccacccaccguagagucaagaacaaaaccauucaccguaccgauacuaacagucgaagagaugacuaauucccguuucccaaucccacuagaaaaacucuucaccggccccucuggagcuuucgucguccaaccccaaaauggccgcugcacaaccgacggaguauuacucggcacaacacaacucucucccgucaacauaugcaccuuccgcggugacguaacccacaucgcaggaucccgcgacuacacuaugaaccucgcgucccuaaacuggaacaacuacgauccaaccgaagaaauccccgcaccacucggaacacccgacuucgucggaaaaauacaaggcguccuaacacaaaccacaaaaggcgacggcucaacccgcggccacaaagccaccgucuacacaggcuccgcccccuucacccccaagcucggaucgguccaauucuccacagacacagaaaacgacuucgagacacaccaaaacacaaaauucacccccgucgguguuauccaagacggcuccacgacccaccgcaacgaaccccaacaguggguccucccaucauacuccggccgcaacguccacaacguacaccuugccccagccgucgcccccacuuuuccaggcgaacaacuccucuucuuccgauccaccaugcccggaugcucuggauacccaaacauggaucucgacugccuacucccucaggaauggguccaacauuucuaccaagaagcggcucccgcccaaucagacgucgcccuacuucgauucgucaaccccgacaccggaagaguccucuucgaaugcaagcuacacaaaucaggcuacguuacagucgcacacaccggccagcacgaccuaguaauacccccaaacggguacuuccgauucgacuccugggucaaccacuucuacacccucgcacccaugggcaauggcacaggccgccgacgugcucucuaa

SEQ ID NO: 36330 - RNA, 1623 nt, Artificial Sequence
  derived and/or modified sequence opt11 from VP1__Norovirus__BAG70497
augaaaauggccucuaacgacgcaaaccccuccgauggcuccgccgcaaaccuagucccagaagucaacaacgaagucauggcacucgagcccgucgucggcgcagccauagccgcaccuguagccggccaaacaaacgucaucgaccccuggauacgcaauaauuuuguacaagcccccggcggagaguucaccgucuccccacgcaacgcacccggcgaaauccuuuggucagcaccccuuggacccgaccucaaccccuaccucucccaccuggcccgcauguauaacggcuacgccggcggcuucgaaguccaagucauccuugccggaaacgccuuuaccgccgguaagauaaucuucgccgcagucccacccaacuuccccacagaaggacuaucccccucccaagucacaauguucccccacauaaucgucgacguccgucaacucgagcccguucucauuccccuacccgacguuagaaacaacuucuaccauuauaaucaauccaaugacuccacaaucaaacuaaucgcaaugcucuacacuccccuacgagccaacaacgccggagaggacgucuucaccgucucaugccgcguacucacccgcccaucaccagacuucgacuucaucuuucucguaccacccaccgucgaaucccgaacuaaaccauucaccguuccuauacucacgguagaagaaaugacaaacucacgcuucccuaucccccucgaaaaacucuuuaccggcccaucaggcgccuucgucguccagccccaaaacggcagauguacaaccgacggaguucuccucggcaccacccaacucucccccgucaacaucugcaccuuccgcggcgacguaacccacauagcaggcucccgcaacuauaccaugaaccucgccagccucaacuggaauaacuacgaccccaccgaagaaauccccgcaccccucggaaccccagacuucguuggcaagauucaaggcguccucacacaaaccacuaaaggcgacggcuccacccgaggccacaaagcuaccguauacaccgguuccgccccauucacaccuaaacuaggcuccguccaguucucaacagauacagaaaacgacuucgagacacaccaaaacacuaaauucacccccgucggcgucauccaagacggcuccaccacacaccgaaacgaaccccagcaauggguccuccccucuuacuccggacgcaauguucacaacguccaccucgcucccgcgguagcccccacauuccccggagaacaacuacucuucuuccguuccacaaugccaggcugcuccggcuaccccaauauggaccuagauugucuccuaccacaagaauggguacaacauuucuaccaagaagcugcccccgcccaauccgacguagcccuucuacgcuuuguaaaccccgacacaggccgaguccucuucgaaugcaaacuccacaaauccggcuacgucaccgucgcccacaccggccaacacgaccucgucauuccacccaacggcuacuuccgauucgacuccugggucaaccaauucuacacccucgcacccauggguaacggcaccggccgacgccgcgcccuauga

SEQ ID NO: 36331 - RNA, 1623 nt, Artificial Sequence
  derived and/or modified sequence opt11 from VP1__Norovirus__BAG70503
augaaaauggccuccaacgacgccaaccccuccgacggauccgcagcuaaccuuguacccgaagucaacaacgaagucauggcccuagaaccagucguaggagccgccaucgccgcccccgucgcaggccagcaaaauguaaucgaccccuggauccgaaacaacuucguacaagcucccggcggagaguucacaguaucuccucgaaacgcccccggcgaaauccuuuggucugcccccuuaggccccgaccuaaaccccuaccuaagccaccuugcacgcauguacaacggauacgccgguggauucgaaguccaaguaauccucgcaggcaacgcauuuaccgccggcaaaaucaucuucgccgccguacccccaaacuuccccacagaaggccucucacccucucaggucacaauguucccacacaucaucgucgacguacgccaacucgaaccaguccuaaucccacucccagacguccgaaacaacuuuuaccacuacaaccaaucuaaugacucaaccaucaaacucauagcaaugcucuacacuccccugcgcgcaaacaacgccggcgaagacguuuucaccgucagcugccgcguacucacaagacccucccccgacuuugacuucauuuuccucguuccacccaccgucgaaucccgcacuaaacccuucaccguccccauacucacagucgaagaaaugacaaacucucgcuucccaauaccccucgaaaaacucuucacaggccccuccggagccuucguaguccaaccucaaaauggccgaugcacaaccgacggcguucuccucggaacaacccaacuauccccagucaacaucuguaccuuccgcggcgacguaacacauaucgcaggcacgcguaacuacacuaugaaccuagccucccugaacuggaacaacuacgaccccacugaagaaauucccgcaccccucggaacccccgacuucgucggcaaaauccaaggcguccucacccaaacaaccaaaggugacggcuccacccgcggccacaaggccaccguauacaccggauccgcacccuucacccccaagcucggcagcguccaauucuccaccgacaccgaaaacgacuucgaaacccaccaaaacaccaaauucacccccguaggcgucauacaagacggcggcacuacacaucgaaaugaaccacaacaauggguccucccauccuacuccggccgcaacguccacaacguccaccucgcucccgcggucgccccaaccuuucccggagaacaacuucuauucuuccgauccaccaugcccggcugcuccgguuacccgaacauggaccucgacugccuacucccccaagaauggguccagcacuucuaccaagaagccgcccccgcccaaagugacgucgcccuaaugcgcuucgucaacccugacacuggccgcguccucuucgaauguaaacuacauaaauccggcuacguaaccgucgcacacacaggccagcaugaccucgucauacccccaaacggauacuuccgcuucgauuccuggguuaaucaauucuacacucucgcacccaugggcaacggcacuggaagaagacgagcccucuaa

SEQ ID NO: 36332 - RNA, 1623 nt, Artificial Sequence
  derived and/or modified sequence opt11 from VP1__Norovirus__BAG70506
augaaaauggcaucaaaugacgcuaaucccagcgacggauccgccgccaaccuuguaccagaaguaaacaacgagguaauggcccuagaacccguagucggcgcagcaaucgccgcccccgucgcaggccaaacaaacguaaucgaccccuggauccgaaacaacuucguacaagcccccggaggcgaguucacaguauccccacgcaacgcccccggcgaaauccucugguccgcaccccuaggccccgaccucaacccauaccuuucacaccuugcccggauguacaacggcuacgcaggaggcuucgaaguccaaguuauucuagccggcaaugccuucacagcaggcaaaauaaucuucgccgcuguucccccaaacuuccccacagaaggccuauccccaucgcaagucaccauguuuccccacaucaucgucgacguccgucaacuagaacccguccucaucccccuccccgacguccgaaacaacuucuaccacuacaaucaauccaacgacucgacaauuaaacuaaucgccaugcucuacacaccccuucgcgccaacaaugcaggcgaagacguauucaccguaucaugccgaguccucacccgacccucacccgacuucgacuuuauauuccuuguacccccuaccgucgaaucccgcaccaaacccuuuacaguaccgauccucaccguagaggaaaugaccaacucccgauucccuauaccccuagaaaaacuuuuuacuggaccuucaggcgccuucgucguccaaccucaaaacggcagaugcacaaccgacggcguccuacucgggacuacccaacuuucccccgucaacauaugcacauuccgcggcgacgucacccacauagccggcagccgaaacuacaccaugaaccucgccucccucaacuggaacaacuacgaccccacagaagaaauccccgcaccccuaggaaccccagauuucgucgguaaaauccaaggcguccucacccaaacaacaaaaggcgacggcuccacacgcggccacaaagccaccgucuacaccggcucagccccauucacccccaaacucggcucaguacaauucucaaccgacacugaaaacgacuucgaaacccaccaaaacaccaaauucacacccgucggcgucauacaagauggaagcacaacacaucgcaacgaaccccaacaauggguacuccccucauacucaggccgcaacguccauaacguccaccucgccccagccgucgcaccuacauuccccggcgaacaacuacuuuucuuccguuccaccaugccuggcugcuccggcuacccaaacauggaccucgacugccuccucccccaagaauggguucaacacuucuaccaggaagccgcccccgcccaaucagaugucgcccuacuccgcuucgucaacccagacacaggacgcguccuauuugaaugcaaacuccacaaauccggcuacguaacugucgcccacaccggccaacacgaccucgucauaccacccaacggcuacuuucgcuucgacagcugggucaaccaauucuacacccucgccccuauggggaacggcaccggccguagacgagcccuauaa

SEQ ID NO: 36333 - RNA, 1623 nt, Artificial Sequence
  derived and/or modified sequence opt11 from VP1__Norovirus__BAG70509
augaagauggcaucaaacgacgccaaucccuccgacggcucagccgcaaaccucgucccggaaguuaauaacgaaguaauggcucucgaacccguagucggagccgcaaucgcagcccccgucgcaggccaacaaaauguaaucgacccauggauccgaaacaacuucguccaagcacccggaggagaguucaccguaucuccccgcaacgcuccaggagaaauccucugguccgcaccccuaggaccagaccucaaccccuaccuaucccaccucgcccgcauguacaacggauacgcuggaggcuucgaaguccaagucauccuugccgguaacgccuuuaccgcaggcaaaaucaucuucgccgccgucccaccaaacuuccccaccgaaggacucucccccucccaagucacaauguucccccacaucauaguugacguccgacagcuagaacccguacucaucccccucccagacguacgcaacaacuucuaucacuacaaccaaucaaacgacuccaccaucaaacuuaucgccaugcucuacacgccccuucgagcaaacaacgccggugaagauguauuuaccgugucaugcagaguccucacccgacccucacccgacuucgacuucauauuccucguacccccaaccgucgaaucccguaccaaacccuucaccgucccaauccucacagucgaagaaaugacaaauucccgauucccuaucccccucgaaaaacuauucacugguccauccggagcauucgucguccaaccacaaaacggucgauguacaaccgacggcguccuacucggcaccacacaacuaucccccgucaacauuugcaccuuccgcggcgacguaacccacaucgcuggcacucgcaacuacaccaugaaccucgccucccuaaacuggaauaacuacgaccccaccgaagaaauccccgccccacucggcacccccgacuucguaggaaaaauccaaggcguacucacccaaaccacaaaaggcgacggcuccacccgcgggcacaaagccacagucuacaccggcuccgcacccuucacccccaaacucggcucagugcaauucucuacagacacugaaaacgacuucgaaacccaccaaaacaccaaauucacaccaguuggcgucauccaagacggaggcacaacacacagaaacgaaccacaacaauggguccuacccuccuacuccggccgcaacguccacaacguacaccuagcccccgccguagcccccaccuuccccggcgaacaacuacuuuucuuccguucaaccaugccaggcugcuccggcuacccaaacaugaaccuagacugucuccucccacaagaauggguccagcacuuuuaccaagaagcagcccccgcccaaucagacgucgcccuucucagauucguuaaccccgacacaggucgcguccucuucgaaugcaaacuccacaaauccggauacgucaccguagcucacaccggccaacacgaccucgucauaccacccaacggcuacuuccgcuucgacucuuggguaaaccaauucuacacccucgcucccaugggcaacggcaccggcagacgccgcgcccuuuaa

SEQ ID NO: 36334 - RNA, 1623 nt, Artificial Sequence
  derived and/or modified sequence opt11 from VP1__Norovirus__BAG70512
augaagauggcauccaacgacgcgaacccuagcgacggcucugccgccaaccuaguccccgaagucaacaaugaagucauggcccucgaaccagucgucggcgccgccaucgccgcaccagucgccggccaacaaaacgucaucgaccccuggauccgcaacaacuucguccaagcccccgguggagaguucacaguuucccccagaaacgcccccggcgaaauccucuggucugcccccuuaggccccgaccucaacccauaccucucacaccuagcacgcauguacaacggcuacgcaggcggauucgaaguccagguaauccucgcaggcaaugccuuuacagcaggaaaaauaaucuucgccgccgucccacccaacuuccccaccgaaggacuauccccaucacaagucaccauguucccccacaucauagucgacguacgccaacucgaacccguacucauaccacuccccgacguacgcaacaacuucuaccacuacaaccaguccaacgacucaacuaucaaacucaucgccaugcuauacacaccccuccgcgcuaacaacgcgggcgaagacgucuucacagucuccugcagaguccuaacccgccccucaccagacuucgacuucaucuuucuagucccaccaacagucgaauccagaaccaaacccuucacaguccccauacucaccgucgaagaaaugaccaacucacguuucccaaucccacuagaaaaacuuuucaccgggccauccggcgccuucgucguacaaccccaaaacggacgcugcacaacggacggcguccuucuaggaacaacacaacucuccccugucaacaucugcacauuccgcggcgacguaacacauaucgccggcacacgcaacuacaccaugaaccuagcuucacuauccuggaacaacuaugacccaaccgaagaaauccccgcaccacuuggcaccccagacuucgucggaaaaauacaaggaguccucacccaaacaaccaaaggcgacggaagcaccagaggccacaaagccaccgucuauaccggaucagcaccauucacacccaaacucggcucaguccaauucuccaccgacaccgaaaacgacuuugaaacacaucaaaacacuaaauucacacccgucggugucauccaagacggcggcacaacacaccggaacgaaccacagcaguggguacuacccucuuacucaggacguaacguccauaacguucaccuggccccugcaguagcccccacauuccccggcgaacaacuccuauucuucagaucuaccaugcccgggugcuccggauaccccaacauggaucuagacugccuccuaccacaagaauggguccaacauuucuaccaggaagcugcccccgcccaauccgacgucgcacucaugcgguucgucaaccccgacaccggccgcguccuuuucgaaugcaaacuacacaaaucaggauacgucacagucgcccauaccggccaacaugaccuagucauaccaccaaacggauacuucagauuugacagcugggucaaccaauuuuacacucuugcucccaugggcaacggcaccggccgccgccgagcacucuaa

SEQ ID NO: 36335 - RNA, 1623 nt, Artificial Sequence
  derived and/or modified sequence opt11 from VP1__Norovirus__BAG70515
augaaaauggcgaguaacgacgccaacccaagcgacggcagcgcugccaaccucguccccgaagucaacaacgaaguuauggcccuagaacccgucgucggcgccgcaaucgccgccccagucgccggacaacaaaacguaaucgacccauggauccgcaacaacuucguucaagcccccggcggugaguucacggucagcccucgcaacgcccccggcgaaauacucugguccgcaccccucggccccgaccucaaccccuaccucucccaccucgcccgcauguacaacggauacgccggcggauucgaaguccaaguaaucuuagccggcaacgccuucaccgccggcaaaauaaucuucgccgccgucccucccaacuuccccaccgaaggccuuucccccucccaggucacaauguucccacacaucaucguugacguacgccaacuagaaccaguccucauaccccugcccgacguccgcaacaacuuuuaccacuacaaccaauccaacgacuccacaaucaaacucaucgccaugcuauacaccccacuucgcgcuaacaacgccggcgaagacgucuucacagucuccugccgcguacucaccagacccuccccagacuucgauuucauauuccuaguaccacccaccguugaaucccgcaccaaacccuucaccgucccaauccuaaccguagaagaaaugacaaacucccgcuuuccaauaccccuugaaaaacucuucaccggaccaucuggcgccuucgucguacagccccaaaacggacgaugcaccaccgacggcguccuccuaggcacaacccaacucucacccguuaacaucugcacuuuucggggagacguaacccacauugcaggcucccgcaacuacacuaugaaccucgccucccugaauuggaacaacuaugaccccaccgaagaaaucccagcaccccucggcacccccgacuucgucggcaagauccaaggucuacuaacccaaacaaccaaaggagacggcuccacacgaggccacaaagccacggucuauaccgguuccgcccccuucacccccaaacucggcuccguccaauucucuacggacaccgaaaacgacuucgagacacaccaaaacaccaaauucacacccguagggguaauccaagacggaagcacgacccaccgcaacgaaccccaacaauggguccuccccagcuacuccggucgcaacguccacaacguacaccuagccccagcagucgcccccacauuccccggcgaacaacuacucuucuuccguuccaccaugccaggaugcucaggcuacccuaacauggaucucgacugccuccucccacaagaauggguccaacacuucuaccaagaagccgccccagcccaaucagacguagcccuacuacgcuucgucaaccccgacacuggacguguccucuuugaaugcaaacuccacaaauccggauacguuacuguagcccacaccggccagcacgaccuggucaucccaccaaacggauacuuccgauucgacuccugggucaaccaauucuacacccucgcacccauggguaacggcacuggacgacgccgcgcacucuga

SEQ ID NO: 36336 - RNA, 1623 nt, Artificial Sequence
  derived and/or modified sequence opt11 from VP1__Norovirus__BAG70518
augaaaauggccuccaacgacgcaaaccccuccgacggcuccgccgccaaccucguccccgaaguaaacaaugaaguaauggcacuggaacccgucgucggcgcugcaauagcagcccccgucgccggccagcaaaacgucauagacccuuggauccguaauaacuucguccaagcacccgguggagaauuuaccgucucaccacgcaacgccccuggcgaaauccuaugguccgcaccccucggaccagaucucaacccauaccuuucucaccuagcccggauguacaacggcuacgccggaggcuucgaaguccaagucauccuagcugguaacgccuucacugccgguaaaauaauauucgcggcaguaccacccaacuuccccaccgaaggccucucaccuucccaaguaacuauguucccccacaucaucguugacguccgccaacucgaacccguccuaaucccccuccccgacguucgcaacaacuucuaucacuauaaccaaucaaacgacuccaccaucaaacuaauagcaaugcuuuacacaccccuccgagccaacaacgcaggcgaagacgucuucaccguaagcugccguguacucacccgcccauccccagacuucgacuucaucuuccucgucccacccaccguagaaucaagaaccaaacccuucacuguacccauccucaccgucgaagaaaugacaaacucccgcuuccccauaccccucgaaaaacuauucaccggccccucaggcgcuuucgucguccaaccacagaacggacgaugcacuaccgacggcguacuccuaggaaccacccaacuaucucccgucaacaucugcaccuuccgcggcgacgucacccacauagccggcucucgcaacuacacaaugaaccuagccucccucaacuggaacaacuacgaccccaccgaggaaauuccagccccacucggcacucccgacuucguaggaaaaauacaaggccuccucacccaaaccacaaaaggugacgguucaacucgcggacacaaagcaaccguuuacaccggcagcgccccauucacccccaaacucggaucaguccaauucucaacagacacagaaaacgacuucgaaacucaccaaaacacaaaauucaccccuguuggcgucauccaagacggcuccacaacccaccguaacgaaccccaacaguggguucuccccuccuacuccggccgcaacguccacaacguccaccucgcccccgcaguagcacccacauucccaggcgaacaacuccuauucuuccgcucuacaaugcccggcugcuccggcuaccccaacauggaccuagauugccuacuaccccaagaguggguucaacacuucuaccaagaagccgcuccugcucagucagacguugcacuccuccgcuucgucaaccccgauacuggccgcguccuauucgaaugcaaacuacauaaauccggcuacgucacggucgcccacacuggucaacacgaccucguuaucccacccaacggauacuuccgauucgacucaugggucaaccaauuuuacacccucgcccccaugggaaacggcacaggacgccgacgcgcccuauaa

SEQ ID NO: 36337 - RNA, 1623 nt, Artificial Sequence
  derived and/or modified sequence opt11 from VP1__Norovirus__BAG70521
augaaaauggcauccuccgacgccaacccaucagacggcucaaccgccaaccucguccccgaaguuaacaacgagguaauggcacuagaacccgucgucggugccgccaucgcagcaccugucgcaggacaacagaacgucauagaccccuggauucgcaacaacuucguccaagccccugguggcgaguucaccgucucaccccguaacgcccccggagaaauacuuugguccgcgcccuuaggccccgaccuaaaccccuaccuaucccaccucgccagaauguacaacuccuacgcaggaggauuugaaguccaggucauccuugcaggaaacgccuucaccgcaggaaaaaucauauucgccgcugucccgcccaacuuccccaccgaaggccucucccccucccaaguuaccauguucccccacauaauaguagacguccgccaacuugaaccaguccuaaucccccuacccgacguucgcaacaacuucuaccacuacaaccaauccaaugaucccacuauaaaacuaauagcaaugcuuuacaccccacuccgggcuaacaaugcaggagacgacguauucaccguauccugccgaguacucacccgaccaagccccgacuucgacuuuaucuuccugguaccgcccacagucgaaucccgcaccaaacccuucuccguccccguccucaccgucgaagaaaugacaaacucaagauuccccaucccccuagaaaaacuauucacaggccccagcuccgccuucgugguacaaccccaaaacggacgcugcaccacugacggaguccuccucgguacaacacaauuaucccccguaaacauuugcaccuuccgcggagacgugacccacauagccggcacccaagaauacaccaugaaccucgccucccaaaacuggaacaacuacgacccuaccgaagaaauaccagcaccccucggcacaccagauuucgucgguaaaauccaaggcguccucacccagacaacacgccgagacggauccacucgaggccacaaagccaccgucucaacgggcuccguacacuucaccccaaagcucggccgcauccaauucuccacagacaccuccaaugacuucgaaacaggacaaaacacacgcuuuacccccgugggcgucguacaagacggcggcacaacccaccaaaacgaaccccagcaaugggucuuacccaacuacuccggucgagacucccacaauguucaccucgccccagccgucgcccccuccuuccccggcgaacaacuccucuucuuccgcucuaccaugccaggaugcucaggguaccccaacaugaaucucgacugucuauuaccccaagaauggguacaacacuucuaucaggaagcagcacccgcccaauccgacgucgcccuccucagauucguaaaccccgacacaggccgaguacucuucgaaugcaaacuacacaaguccggcuacgucacagucgcccacacaggccaacacgaccucgucaucccacccaacggcuacuuccguuucgacuccugggucaaccaauucuacacccucgcccccaugggcaacggcacugggcgccgucgcgcacuauaa

SEQ ID NO: 36338 - RNA, 1623 nt, Artificial Sequence
  derived and/or modified sequence opt11 from VP1__Norovirus__BAG70524
augaaaauggccuccaacgacgccaacccaucggacggcucagcagccaaccuuguccccgaagucaacaaugaagucauggcccucgaaccagucguaggcgcugcaaucgcugcaccugucgccggccaacaaaacgucaucgaccccuggauaagaaacaauuucguccaagcccccggcggagaguucacagucucaccccgaaacgcccccggagaaauccuauggucugcaccccucggccccgaucuaaacccuuaccuaagccaccucgcccgcauguacaacggcuacgcuggcggauucgaaguccaaguuauccuagcaggcaaugccuucaccgccggcaaaaucaucuucgcagcaguaccacccaacuuccccaccgaaggccuaucucccucccaaguaaccauguucccccauauaaucguggauguccgccaacuagaacccguccuuaucccccuccccgacguccgaaacaacuucuaccacuacaaccaauccaacgacucaacuauuaaacucaucgccaugcuauacacaccccuccgcgccaacaaugccggagaagacguguucaccgucucaugccgaguccucaccagacccuccccagacuucgacuucaucuuccucguaccacccaccguagaaucacgaaccaagcccuucaccguucccauccucaccguagaagaaaugaccaacuccagauuccccaucccacucgaaaaacucuucaccggccccuccggagccuucguaguccaaccccaaaacggccgaugcaccacagacggcguacuccuuggcaccacacagcucucaccuguaaacauaugcaccuuccgaggcgaugucacccauaucgcuggcucccgaaacuacaccaugaaccucgcaucccucaacuggaacaacuacgaccccacagaagaaauccccgcaccccucggcacccccgacuucgucggaaaaauccagggccuccucacccaaaccaccaagggagacggaucaacacgcggccacaaggccacuguauacacagguagcgcccccuucacccccaaacuuggcucaguacaguuuuccaccgacaccgaaaaugacuucgaaacccaccaaaacacaaaauucacccccgucggagucauccaagacggaagcaccacccaccgaaaugaaccacaacaauggguucuccccuccuacuccggcaggaacguccacaacguccaccucgccccagcaguagcccccacauuccccggagaacaacuaauauucuuccgauccaccaugcccggcugcagcggcuacccaaacauggaccucgacugccuccucccacaagaauggguucaacauuucuaccaagaagcagcuccugcccaauccgacgucgcacuccucagauucgucaacccagauacaggccgaguacucuucgaaugcaaacuccacaagucaggcuacgucacagucgcccauaccggccaacacgaccucguaaucccgcccaauggauacuuccgcuucgauucuuggguaaaccaauucuacacccuagcccccaugggaaacggaaccggacgaagacgagcccuauga

SEQ ID NO: 36339 - RNA, 1623 nt, Artificial Sequence
  derived and/or modified sequence opt11 from VP1__Norovirus__BAG70527
augaaaauggcgucuaacgacgccaaccccuccgacggcucagcugcaaacuuaguccccgaaguaaacaacgaaguaauggcccucgaacccgucguuggcgccgcaaucgcagccccaguagccggccaacaaaacgucaucgacccuuggauacgaaacaauuucguccaggcccccggcggcgaguucacugucagcccccgcaacgccccaggcgaaauacuauggucggccccucuaggacccgaccuaaaccccuaccuaucccaccucgcacgcauguacaacggcuacgccggcggauucgaaguacaagucauccuagccggcaacgccuucaccgcaggaaaaauuaucuucgcagccguaccaccaaacuucccaaccgaaggccucuccccaucccaaguaaccauguucccccacauaaucguagacguacgccagcucgaaccaguccuaauaccccuaccagacguccgcaacaacuucuaccacuacaaccaauccaaugacucaacaaucaaacuuaucgccaugcuauacaccccacuucgcgccaacaacgccggcgaagacgucuucaccgucuccugccgcguccuuacacgcccauccccugacuucgacuucaucuuccugguaccacccaccgucgaaucacgcacuaaacccuucacagucccgauccucaccgucgaagaaaugaccaacucccgcuuccccauuccccucgaaaaacuauucaccggaccauccggcgccuucguuguccaaccccaaaacggccgauguaccacagacggcguacuccuaggcacuacacaacucucucccgucaacaucugcaccuuccgcggcgacguuacacacauugccggcuccagaaacuauaccaugaaccuugccucccucaacuggaacuccuacgaccccacugaagaaauaccggcuccccuaggcacccccgacuucgucggcaaaauccaaggacuucuuacacaaaccaccaaaggagacggaucaacccgcggccacaaggccacuguuuacacuggauccgccccauucacccccaaacuaggcuccguccaauucuccacugauaccgagaacgacuucgaaacccaccaaaacaccaaauuuacacccguuggaguaauccaagacggcuccacgacccaccgaaacgaaccccagcaauggguucucccauccuacuccggccgcaauguacacaacguacaccucgcccccgccgucgcccccacguucccaggggaacaacuacuauucuuccgaucaaccaugcccggaugcucgggcuaccccaacauggaccucgacugcuuacucccccaagaauggguccaacacuucuaccaagaagccgcccccgcccaauccgacgucgcccuccuucgcuucguuaacccggacaccggcagagugcuauucgaaugcaaacuacacaaaucuggcuacguaacugucgcccacaccggccaacacgaucuagucaucccucccaacggcuacuuccgcuuugacucuugggucaaucaauucuacacucucgcccccaugggcaacgguaccggcagacgccgcgcacucuga

SEQ ID NO: 36340 - RNA, 1623 nt, Artificial Sequence
  derived and/or modified sequence opt11 from VP1__Norovirus__BAG70530
augaaaauggccuccaacgacgcuaaccccucagacggcuccgccgcaaaucuaguccccgaaguaaacaacgaaguaauggcacucgaacccguuguaggagcagccauagccgcacccgucgcuggacaacaaaacgucaucgaccccuggauccgcaauaauuucgugcaagcccccggcggcgaguucaccguguccccacggaacgccccuggugaaauccucuggucugccccgcuuggaccugaccucaaucccuaccucucacaccucgcgcgcauguacaacggcuacgccggcggcuuugaaguccaaguaauacuugccggaaacgccuucaccgccggcaaaaucaucuucgccgcagucccacccaacuucccuaccgaaggauuaucccccucucaagucacaauguucccucacaucaucgucgacguccgacaacucgaacccguacucaucccucuccccgauguccguaacaacuucuaccacuauaaccaauccaacgacuccaccaucaaacucaucgccaugcucuacacgccccuacgcgccaacaacgcaggcgaagauguauucacaguauccugccgcguccucacccgccccagccccgacuucgacuucaucuuccucguacccccaacugucgaaucccgaaccaaaccuuucaccguucccauccucacggucgaagaaaugacaaacucccguuuccccaucccccucgaaaaacucuucacaggcccaucaggcgccuucgucguacaaccccaaaacggccgcugcaccaccgacggcguccuacucggcaccacucaacucucccccguaaacaucugcacauuccgcggagacgucacgcacaucgcaggcucccguaacuacacaaugaaucuagccagccucaauuggaauaacuacgauccaaccgaagagauacccgcuccccucggaacgcccgacuucguaggcaaaauccaaggucugcucacccaaaccaccaaaggcgauggcucaacacgaggccacaaagccaccguauauaccggaucagccccuuucacacccaaacucggcuccguccaauucagcaccgacaccgaaaacgacuucgaaacacaccaaaauaccaaauucaccccagucggcgucauccaagacgguucuacaacccaccgcaacgaaccacaacaauggguucuccccuccuauucaggccguaacguccacaacguacaccucgccccagcgguagcccccaccuucccuggcgaacaacuccuuuucuuccgcucaacaaugccuggauguuccggauaccccaacauggaccucgacugccuccuaccccaagaauggguccaacacuucuaccaagaagccgcacccgcacaauccgacgucgcccuccuccgcuucgucaaccccgacaccggccguguccucuucgaaugcaaauuacacaaauccggcuacgugaccguagcacacaccggacaacacgaccuugucaucccacccaacggcuacuucagauucgauuccuggguaaaccaauucuacacccuagcccccaugggcaacggcaccggaagacgccgcgcccuuuga

SEQ ID NO: 36341 - RNA, 1623 nt, Artificial Sequence
  derived and/or modified sequence opt11 from VP1__Norovirus__BAG70533
augaaaauggccuccaacgacgccaaccccuccgacggcuccgcagccaaccucguacccgaaguaaacaaugaaguaauggcccucgagcccguuguaggcgccgccauagcugcccccguugccggccaacaaaacguuaucgacccauggauccguaacaacuucguccaagcccccggcggcgaguucacaguauccccacgcaaugccccaggcgaaaucuuauggucagcgccccucggccccgaccuaaaccccuaccuaucacaccucgcccgcauguacaacggauacgccgggggcuucgaaguccaagucauccucgccggcaacgccuucacagcuggcaaaaucaucuucgccgcaguaccacccaacuuucccacagaaggccuaucccccucacaagucaccauguucccccacauaaucguggacguccgacaacucgaacccguccuaaucccucuccccgacguucguaacaacuucuaccacuauaaccaaucaaacgacucgaccaucaaacuuauagccaugcuuuacacuccccuccgugccaacaacgccggugaagauguguucaccgucucaugucgaguucuaacccgcccaagcccagacuucgacuucaucuuccuagucccacccaccgucgaaucucgcaccaaacccuucaccguacccauccucaccgucgaagaaaugaccaacucccgcuucccaauaccccuagaaaaacucuucacgggacccucaggagccuucgucguccaaccccaaaacggccguugcaccacagacgguguacuccucgguaccacacaacucagcccaguaaacaucuguaccuucagaggcgacgucacccacaucgcgggcucccgcaacuacacaaugaaccucgccucccucaacuggaacaacuacgaccccaccgaagaaauacccgcaccccuaggcacacccgacuucgucggcaaaauccaaggucuccuuacccaaaccacaaaaggugauggcuccacacgaggccacaaagccaccguuuauacaggcuccgccccauucacccccaaacucggcuccguucaauucuccacagacacagaaaacgacuucgaaacacaccaaaacaccaaauucaccccugucggagucauacaagacggauccaccacacaccgcaacgaaccccaacaguggguacuaccaucauacucaggucgcaauguacacaacguucaucucgccccagccgucgccccaacuuuccccggcgaacaacuccucuucuuucgcuccacaaugcccggaugcuccggauaccccaacauggaccucgacugccuccuaccccaagaauggguccagcacuucuaccaagaagccgccccagcccaauccgacgucgcucuccuucgcuucguuaacccagacaccggucguguccucuucgaaugcaaacuccacaaaucagguuacgucacaguagcccacaccggccaacacgaccucguaaucccuccaaacggauacuuccgcuucgauuccugggucaaccaauucuacacacucgccccaaugggcaacggaaccggccgacgacgcgcccucuaa

SEQ ID NO: 36342 - RNA, 1623 nt, Artificial Sequence
  derived and/or modified sequence opt11 from VP1__Norovirus__BAG70536
augaaaauggccagcaacgacgccaaccccucagacggcuccgcagcaaaccucguccccgaaguuaacaacgaaguaauggcccucgaaccagucgucggcgcagccauagccgcacccgucgccggccaacaaaaugucauagaccccuggauacgcaacaacuucguccaagccccaggaggagaauuuaccgucucccccagaaacgcacccggcgaaaucuuauggucagcaccccuugggcccgaccucaaccccuaucucucccaccucgcccgcauguacaacggauacgccggcggauucgaaguacaagucaucuuagcaggaaacgccuucacggccggcaaaaucauauucgcagcggucccgcccaacuuucccaccgaaggccucucacccucccaagucaccauguucccccacauaaucgucgacgucagacaacuagaaccaguacucaucccauuaccagacguccgaaacaacuucuaccacuacaaccaaucaaaugacucaacaauuaaacucauagccaugcucuacacuccccuccgcgcaaacaacgcaggagaagacgucuucaccgucucaugcagaguccucacccgcccaucuccggacuucgacuucauauuccucgucccacccaccguagaaucgagaaccaaaccauucaccguucccauccucaccguagaagaaaugaccaacucccgauuccccaucccacucgaaaaacuauucaccggccccaguggcgccuucguaguacaaccccaaaacggccgaugcaccaccgacggcguccuccucggcaccacccaacucucccccguaaacaucugcaccuuccgcggcgacgucacccacaucgccggcucccgcaacuauaccaugaaccucgccucccuaaauuggaacaacuacgaccccacagaagaaaucccagcaccccuaggcacccccgacuucgucggcaaaauacaaggccuauuaacccaaaccacaaaaggcgacggcuccacccgcggucacaaagccaccgucuacaccggcuccgcccccuucacaccaaaacuaggcuccguccaguucuccacggacaccgaaaacgacuucgaaacccaccaaaacacaaaauuuacacccgucggcguaauccaagacggaucaacuacacaccgaaacgaaccacaacaguggguuuuaccauccuacuccgggcgcaacguccacaacguccaucuggccccagccgucgcaccaacauucccaggagaacaacuacucuucuuccgcagcaccaugccaggcugcucaggcuauccuaacauggaccuagacugccuccucccccaagaauggguacaacacuucuaccaagaagccgcucccgcacaaucugacgucgcccuccuccgcuucguaaacccagacaccggacgcguacucuucgaauguaagcuccacaaaucaggcuacguaaccguagcacauacaggccaacacgaccuagucaucccuccaaacggcuacuuccgauucgacuccugggucaaccaauucuauacgcuagcacccauggguaacggcacaggccgccgcagagcacucuaa

SEQ ID NO: 36343 - RNA, 1623 nt, Artificial Sequence
  derived and/or modified sequence opt11 from VP1__Norovirus__BAI70518
augaaaauggcguccaacgacgccaaccccuccgauggauccgcagccaaccucguucccgaaguuaacaacgaaguaauggcacucgagccggucguaggagccgccaucgcagcaccagucgccggccagcaaaacguaaucgaccccuggauacgcaacaacuucguacaagccccaggcggcgaguucaccguaucaccccgcaacgcccccggcgaaauccuaugguccgcaccccucggcccagaccucaaccccuaccucucccaccucgcccgcauguacaauggauacgcaggaggcuucgaaguacaagucauccuagccggcaacgccuucaccgccggcaaaauaauuuucgccgccguacccccaaacuuucccaccgaaggccucucacccucacaagucaccauguucccccacaucaucgucgacguccgccagcucgaacccguucucaucccccuccccgacguccgcaacaacuuuuaccacuacaaccagucaaacgacucaacaauaaaacucaucgcaaugcucuacacaccccugcgcgccaacaacgccggagaagacgucuucaccgucuccugccgcgucuuaacccgccccagccccgacuucgacuucaucuuccuaguaccaccuaccguagaaucccgaaccaaacccuucaccguuccaauacuaaccguagaagaaaugaccaacucccgauuccccaucccccucgaaaaacucuucacaggcccauccuccgccuucgucguucaaccucaaaacggacgguguaccaccgacggaguccugcuaggcacuacacaacuaucccccgucaacaucuguacauuccgcggagacguaacucacauugccggcagccguaacuacacaaugaaccuugccucccucaauuggaacaacuacgaccccacagaagaaaucccggcuccccucggaacccccgacuucguuggaaaaauacaaggcguccucacccaaacaaccaaaggcgacggcuccacccgaggccacaaagcaaccgucuacaccggguccgcccccuucaccccaaaauuaggcucaguccaauucuccaccgauacugaaaacgacuucgaaacccaccaaaacacaaaauucacacccgucgguguuauacaagacggcggcacaacacacagaaacgaaccccaacaauggguacucccaucuuacucaggaagaaacguccccaacguccaccuagcccccgccguggccccaacauuccccggcgaacaacuccucuucuucagaucuaccaugcccggcugcuccgguuaucccaacauggaccuagacugccuucucccccaagaauggguccaacacuucuaccaagaagccgccccagcccaauccgacgucgcucuacucagauucgucaaccccgauaccggccgaguucucuucgaaugcaaacuccacaaguccggauacgucaccgucgcccacaccgggcaacacgaccucguaauaccucccaacggauacuuccgauuugacucaugggucaaccaguucuacacccucgcacccauggguaacggcacgggccgccgcagagcgcuuuag

SEQ ID NO: 36344 - RNA, 1623 nt, Artificial Sequence
  derived and/or modified sequence opt11 from VP1__Norovirus__BAJ13508
augaaaauggcauccaacgacgcaaacccuuccgacggcuccacagcaaaccuagucccagaagucaacaacgaaguaauggcucuagagcccgucgucggcgccgccaucgccgcccccgucgccggccaacaaaacgucauagaccccuggauccgcaacaacuucguccaagcacccggaggcgaguucaccguaucaccucguaacgcacccggagaaauccuauggucagcaccccucggcccagaucucaacccuuaucugucucaccuugcccgaauguacaaugguuacgccggaggcuucgaaguccaagucauccuugcaggcaacgcauucaccgccggcaaaaucaucuucgccgcagucccgcccaacuucccuaccgaaggacucuccccaucucaagucaccauguucccgcacaucaucguagacgugcgccaauuagaacccguccucaucccucuccccgacguccgcaacaacuucuaccacuacaaccaauccaacgaccccacuaucaaacucauagccaugcuauacaccccacuacgcgccaacaacgccggagacgacguauucaccgucuccugccgcguucuaacccgucccucacccgacuucgacuucaucuuccuaguacccccaaccgucgaauccagaacaaagcccuucacggucccaauccuuacaguggaagaaaugaccaacucgcguuuccccauuccacucgaaagacuauacaccggccccuccagcgcauucgucguacaaccccaaaacggccgcugcaccaccgacggugucuuacucggcaccacacagcuauccgcagucaauaucugcaccuuccgaggcgacguuacccacaucgcaggcucccgaaacuacacuaugaaccucgcaucccaaaacuggaauaacuacgauccuaccgaagaaauaccagcaccccuaggcaccccagacuucgucggcaaaauccaagguauguuaacccaaacaacacgcucugacggcucaacccgcggacacaaggccaccguccucacuggcagcgccgacuucgcccccaaacuaggccguguccaauucgccacagacacagacaacgauuucgaauccggccaaaacaccaaauucaccccaguaggaguaauacaagauggcucaacuacacaucgcaacgaaccccaacaguggguccuccccaauuacuccggacgcacaggccacaacguccaccuugcccccgccguagcccccacauaccccggcgaacagcuucucuucuuccgcucaaccaugccuggcugcuccggcuaccccaacauggaccuagacugucugcucccccaagaauggguccaacauuucuaccaagaagccgcccccgcccaauccgacauggcccuccuccgcuucgucaaccccgacacaggacgaguccuauucgaaugcaaacuccacaaaucgggcuacgucaccgucgcccacacaggccaacacgaccucgucaucccucccaacggauacuuccgauucgacucaugggucaaccaauucuacacucuagcccccaugggcaacggcaccggccgccgccgcgccgucuaa

SEQ ID NO: 36345 - RNA, 1623 nt, Artificial Sequence
  derived and/or modified sequence opt11 from VP1__Norovirus__BAJ13513
augaaaauggcaucguccgacgcaaacccucccgacggcucagccgcaaaccuuguccccgaagucaauaacgaagugauggcucucgaacccguagucggagccgcuaucgccgcaccggucgccggccaacaaaacgucaucgacccguggauaagaaacaacuucguccaagcccccggcggcgaguucaccgucucaccaagaaacgcccccggcgaaauacuauggagcgccccgcuuggcccagaucucaacccauaccucucccaccuagcacgcauguacaacggcuacgccggcggauucgaaguccaagucauccucgccggcaacgcauucacagccggcaaaaucaucuucgcagcaguacccccaaacuuccccacagaaggccuaucacccucacaagucaccauguucccccacauaaucgucgacguucgacaacucgaaccaguccuaauuccccucccagauguucgaaacaacuucuaccacuacaaccaaucaaacgacagcacaaucaaacucaucgccaugcucuauacaccccuccgcgcaaauaacgcaggggaagacguauucaccgugucaugcagaguacuaaccaggcccagccccgacuucgacuucauauuccucguacccccaacagucgaaucccgcaccaaacccuucaccguccccauacuuaccgucgaagaaaugaccaauucccgcuuccccauaccccucgaaaaacucuuuaccggcccaucuggcgccuucgucguacaaccccaaaacggacgaugcaccaccgacggcguacuccucggcacaacacaacuuagccccgucaacauauguacauuccgaggagacgccacccacaucgcuggcagccgaagcuacaccaugaaccuugccucacucaacuggaacaauuacgaccccaccgaagaaaucccugcaccccuaggcacaccugacuucgucggcaaaauccaaggcaugcuaacccaaaccaccaaaggcgacggcuccacccgcggccacaaagccaccgucuacaccggcucagcaccauucaccccgaaauugggaucaguccaauucuccaccgacaccgaaaaugacuuccaaacacaccaaaacacuaaauucacaccaguaggcgucauccaagacggcuccaccacccaccgcaacgaaccucaacaauggguacuacccuccuacagcggccgcgacguccacaacguccaccuugcacccgccgucgccccaaccuucccuggagaacaacuauuauucuuccgcucaacaaugcccggcugcuccggauaccccaacauggacuuagacugccuccucccacaagaauggguccaacacuucuaccaagaagccgcccccgcccaaagcgacguagccuuacuccgcuucguaaaccccgacacaggacgaguccucuucgaaugcaaacuacacaaauccggcuacgugaccgucgcacacaccggccaacacgaccuagucauaccuccaaacggguacuuccgcuucgauuccugggucaaccaguucuacacccuagcccccaugggcaauggaaccggacgccgcagagcccuauaa

SEQ ID NO: 36346 - RNA, 1623 nt, Artificial Sequence
  derived and/or modified sequence opt11 from VP1__Norovirus__BAJ13520
augaaaauggccagcuccgacgccaaccccucagacggcucugccgccaaccuaguccccgaagucaacaaugaaguaauggcccucgagcccgucgucggugccgccaucgccgcccccgucgcgggccaacaaaacgugauugacccauggauccguaacaacuucguccaagcccccggcggcgaguucaccguaagcccccgaaacgcucccggagaaauacucugguccgcaccccucggucccgaccucaaccccuaccucucccaccucgcccgaauguacaacgguuaugccggaggcuucgaaguccaagugauccuggccggcaaugccuucacagccggcaaaauaauuuucgccgccguacccccaaacuucccaacugaaggccuuucccccucccaagucaccauguuuccucacaucaucgucgauguaagacaacuagaacccguacuaaucccacuccccgacguccgaaacaacuucuaccacuacaaccaauccaacgacucaaccauaaaacuaauagccaugcuuuacacaccccuccgagccaacaacgcaggagaagauguauucaccgucuccugucgugugcuaacccgaccuucacccgacuucgacuucaucuuucucgucccacccacaguagaaucccgaaccaaaccuuuuacugucccuauccucaccgucgaagaaaugaccaacucuagauucccaaucccccuagaaaaauuauucacaggccccuccggcgccuucgucguacaaccccaaaacggccgauguaccacagacggaguauuacuagguacaacgcaacucucacccguaaacauaugcacauuccgaggagacguuacccacaucgcgggcucacgcaacuauaccaugaaccuugcaucccucaacuggaacaacuacgaccccaccgaagaaaucccagcaccccuuggcacacccgacuucgucggaaaaauccagggcaugcucacgcaaacaaccaaaggcgacggcagcacaagaggccacaaagccacaguauacaccggcucugcccccuucaccccaaaacuaggcaauguccaauucucaacagacaccgaaaacgacuuugaaacucaccaaaacaccaaauucaccccagucggcgucauccaagacggcuccacuacccaccgcaacgaaccccaacaauggguccucccaucauacucuggacgcgacguccacaacguccaucuagcccccgccgucgcaccaacguuccccggcgaacaacuccucuucuuccgcuccaccaugcccggaugcuccggcuacccaaacauggaccucgauugccuccuuccucaagaauggguacaacacuucuaccaagaagccgccccagcccaauccgauguggcccuacugcgcuucguaaaucccgacacgggucgaguccucuucgaaugcaaacuccacaaauccggcuacgucaccguagcccacacgggccaacacgaccuugucauaccucccaacggcuacuuccguuucgacuccuggguaaaucaauucuacacccuagcacccaugggcaacggcaccggacgacgacgagcacuuuaa

SEQ ID NO: 36347 - RNA, 1623 nt, Artificial Sequence
  derived and/or modified sequence opt11 from VP1__Norovirus__BAJ13534
augaaaauggccucuaacgacgcaaaucccucagacggcucugccgccaaccucguaccagaaguuaacaacgaagucauggcccuugagcccgucgucggcgccgcaaucgccgcccccgucgcaggccaacaaaauguaauagacccauggauucgcaacaacuucguccaagcccccggaggcgaguucaccguaucuccccgcaacgccccaggagaaauccucugguccgcaccccuaggcccagaccuaaacccauaccucucccaccucgcccgcauguacaacggcuacgccgguggcuuugaaguacaaguuauccucgcaggaaacgccuucacugccggcaaaaucaucuucgccgccgucccacccaacuuccccaccgaaggccuaucccccucccaagucacaauguucccccacauaauagucgacguacgccaacuggaacccguccuuauaccacuccccgacguccgcaacaacuuuuaucacuacaaccagucauccgacuccacaaucaaacucauagcuaugcucuacacaccccuacgcgccaacaacgcaggcgaagacgucuucaccguaucaugccgcguacuaacccgacccucccccgauuucgacuuuaucuuccucguacccccaaccgucgaaucacgcaccaaacccuucacagucccaauccuaacagucgaggagaugacaaacucucguuucccuauaccacuagaaaaacuauucaccggaccauccggugccuuugucguccaaccacaaaacggcagaugcaccacugacgguguccuccucggaacuacacaacucuccccagucaacauaugcaccuuccgcggagacgucacccacauagccggaucacgcaacuacacuaugaaccucgccucccucaauuggaacaauuacgacccgaccgaagaaauccccgcuccacucgggacccccgacuucgucggaaaaauccaaggcguccucacccaaaccacaaaaggcgacggauccacccgaggccacaaagcaacaguauacacaggauccgccccauucacacccaaacucggcucaguccaauucuccaccgacaccgaaaacgacuucgaaacccaccaaaacaccaaauucacaccagucggcgucauccaagacggcuccacaacccaccgcaacgaaccacagcaauggguccuacccagcuacuccggcagaaacguccauaacguccaccucgcccccgccguggccccaaccuucccaggcgaacaacuacucuucuuccgcucuaccaugcccggcugcucaggauaccccaauauggaccucgacugucuauuaccacaagaguggguccaacacuuuuaccaagaagcagcccccgcccaguccgacgucgcccuccuccgcuucgucaaccccgacaccggccgcguccucuucgagugcaaacuacacaaauccggcuacgucacagucgcacacaccggccaacacgaccucguaaucccaccaaauggcuacuuucgcuucgacaguugggucaaucaauucuacacucucgcccccaugggcaacggcaccggccgcagacgcgcccucuaa

SEQ ID NO: 36348 - RNA, 1623 nt, Artificial Sequence
  derived and/or modified sequence opt11 from VP1__Norovirus__BAJ13537
augaagauggccuccuccgacgccaaccccagcgacggcucaaccgccaaccuaguaccagaagucaacaacgaaguaauggcccucgaacccgucguuggugcagccaucgccgcaccagucgccggacaacaaaacguaaucgacccauggauccgcaacaacuuuguucaagcccccggaggggaguucaccguaucaccccgaaacgcccccggagaaauccugugguccgccccacucggccccgaccucaauccauaucuaucccaccucgcccgcauguacaauggcuacgcuggcggauucgaaguacaagucguccucgcaggcaaugcauucacugcaggaaaaaucauuuucgcagcaguuccucccaacuuccccaccgaaggccucucacccucacaagucaccauguuuccccacaucaucgucgacguacgccaacuagaaccaguacucaucccccuccccgacguccgcaacaacuucuaccacuauaaucaaucgaacgaccccaccaucaaacucaucgccaugcucuacacuccccuacgagccaacaacgccggagacgacgucuucacagucuccugccgcguccucacccgccccucacccgacuucgacuucaucuuccucgucccgcccaccgucgaauccagaaccaaacccuucuccguccccauccugaccgucgaagaaaugacaaacucccgcuucccaauaccucuagaaaaacucuucaccggccccuccuccgccuucguaguccaaccccaaaacggccgcugcacaaccgacggcguacugcuaggcaccacacaacuauccccuguuaacauuuguacauuccgcggagacgucacccacaucaccggcagccgcaacuacacaaugaaccuagcuacacaaaacuggaacuccuacgaccccaccgaagaaauacccgccccacucggaaccccggacuucgucggaaaaauacaaggaguacuaacccagaccacccgcgccgacggguccacccgcggccacaaagccacaguauacaccggauccgccgacuucgcccccaaacuuggacguguacaauucgccacggacacagauaacgacuucgacgccaaccagaacaccaaguucaccccagucggagucauccaagacggcgacaccgcccacagaaacgaaccccaacaauggguacuccccaguuauucuggccgcaacaaccauaacguacaccuggcccccgccgucgccccaaccuuccccggcgaacaacuacuauucuuccgauccacaaugcccggcugcuccgguuaccccaacauggaccucgacugccuccucccgcaagaauggguccaauacuucuaccaagaagcagccccagcccaaucagacgucgcccuucuccgauucguaaaccccgacaccggccgagucuuauucgaaugcaaacuacacaaauccggcuacguaaccgucgcgcacacaggccaacacgaccuuguaaucccucccaacggauauuuccgcuucgacucuugggucaaccaauucuacacacucgcacccaugggcaacggcacaggccgccgccgcgcacuuuga

SEQ ID NO: 36349 - RNA, 1623 nt, Artificial Sequence
  derived and/or modified sequence opt11 from VP1__Norovirus__BAJ13540
augaaaauggccagcaacgacgcaaaucccucggauggaucagccgcaaaccucguccccgaagucaacaacgaagucauggcccucgaacccgucgucggugcagcaaucgccgcccccguugcaggccaaaccaacguaaucgaccccuggauccgaaacaacuucguccaagcacccggcggcgaauuuaccgucucuccucgcaacgcccccggagaaauccucugguccgcuccccuaggcccugaccucaaucccuaccuaucccaccuugccagaauguacaacggcuacgccggaggauucgagguacaagucauccuugcaggcaacgccuucaccgccggcaaaauaaucuucgccgcaguaccacccaacuucccuaccgaaggccucucccccucacaagucaccauguucccccacaucaucguagacguccgccaacucgaacccguacuaaucccccuuccagacguaagaaauaacuucuaccacuacaaccaaucaaacgacuccaccaucaaacuaaucgccaugcucuacaccccacugcgcgcaaacaacgcaggagaggacguauucaccguuuccugccggguacucacccggcccagcccagacuucgacuucauauucuuaguaccucccacagucgaaucccgaaccaaacccuucacagucccaauccucaccguagaagaaaugacaaauucacguuuccccaucccacuagaaaaacuauucaccggcccuuccggcgcuuucguaguacaaccccaaaacggacgcugcacuacagacggcguccuccucggaacuacacaacucuccccugucaacaucugcaccuuccgcggcgacguaacccacaucguuggcucccgcaauuacacaaugaaccucgccagccucaacuggaacaacuacgaccccaccgaggaaauccccgccccacucggcacaccugacuucguuggaaaaauucaaggaguacuaacacaaaccaccaaaggagacgggagcaccagaggacacaaagccaccgucuacaccggcuccgcccccuucacgccuaagcucggcuccguacaauuuuccaccgacacagaaaacgauuucgaggcacaccaaaacaccaaauucacacccguaggcgucauccaggacggcuccacuacacaccgcaaugaaccccaacaauggguccuacccuccuacagcggacgcaauguccaaaacguccaccucgcccccgccgucgcccccaccuuccccggcgaacaacuccucuucuucagauccaccaugcccgguugcucaggcuauccaaauauggaccuagacugccuucuaccccaagaguggguccaacacuucuaccaagaagccgcccccgcccaaucugacgucgcccuucuacgcuucgucaacccagacacaggccguguccuauuugaaugcaaacuccacaaauccggcuacgucacagucgcccacaccggccaacacgaccucgucaucccacccaacggcuacuuccgauucgacuccuggguaaaccaauucuacacccuagcccccaugggcaacgggaccggacgccgcagagcccuauaa

SEQ ID NO: 36350 - RNA, 1623 nt, Artificial Sequence
  derived and/or modified sequence opt11 from VP1__Norovirus__BAJ13543
augaaaauggcaucuaacgacgccaaucccuccgacggaucugcggccaaccugguccccgaagucaacaacgaaguuauggcgcuagaaccagucguaggcgccgccauagccgcccccguggccggccaacaaaaugucaucgacccauggauccgcaacaacuucguccaagcaccugguggcgaguucaccgucucuccccgcaacgcacccggcgaaauacuaugguccgccccucucggacccgaccuaaacccauaucucagucaccuggcucgcauguacaacggcuacgccggcgguuucgaaguacaaguaauacucgcuggcaaugcauucacggcaggcaaaaucauuuucgccgccgucccacccaacuuccccacagaaggccucuccccaucccaggucacuauguuuccccacauaauagucgacguccgacagcucgaacccguacucauuccccuccccgauguccgcaacaacuucuaccacuacaaccaaucuaacgacuccaccaucaaacucauugccaugcucuacaccccgcuucgcgccaacaaugccggcgaagacgucuucaccgugucuugccgcguacucacccgcccuucccccgacuuugacuucaucuuccucgucccaccaacugucgaauccagaaccaaacccuucacagucccuauccucaccgucgaagaaaugacaaauucccgcuuccccaucccccuagaaaaacucuucaccggacccuccuccgccuucguuguacaaccacaaaacggccgauguaccaccgacggaguccuccuuggaacaacccaacucagccccguaaacaucuguaccuuucgcggagacgucacccacauagccggcucccgcaacuacacuaugaaccucgcaucccucaacuggaacaacuaugauccaaccgaagaaaucccagcuccccugggcacaccagacuucgucggcaaaauccaaggcguccucacccaaaccaccaaaggugacggaucuacacgcggucacaaagccaccgucuacaccggcucggcccccuucacccccaaacucggauccgugcaauucuccacagacacagaaaacgacuucgaaacacaccaaaacacaaaauuuacccccgucggcguaauccaagacgguuccaccacccaucgcaacgaaccacaacaauggguucucccaucuuacuccggccgaaacgcacacaacguccaccucgcccccgccguagcacccaccuuccccggcgaacaacuacuauucuuucgauccaccaugcccgguugcucaggcuacccaaacauggaccucgacugccuacucccacaagaauggguacaacacuucuaccaagaagccgcccccgcacaauccgacgucgccuuacuacgcuucgucaacccggacaccggucgcguacuauucgaaugcaaacuacacaaauccggcuacgucaccgucgcucacaccggacaacacgaccucgucauacccccaaacggcuacuuccgcuucgacuccuggguaaaccaauucuacacccucgccccaaugggcaacggaaccggccgacgccgugcucuuuaa

SEQ ID NO: 36351 - RNA, 1623 nt, Artificial Sequence
  derived and/or modified sequence opt11 from VP1__Norovirus__BAJ13549
augaaaauggcauccaacgacgcaaaccccuccgacggcucagccgccaaccucgucccagaaguaaacaaugaaguuauggcacucgaacccgucgucggugccgccauugccgcccccgucgccgggcaacaaaacguuauagacccauggaucagaaauaacuucguccaagccccaggaggcgaguucaccguaucaccccgcaacgcucccggcgaaauccucugguccgccccacucggcccagaccuaaaccccuaccucucacaccuagcccgcauguacaacggcuacgccggcggcuuugagguccaagucauacucgcuggcaacgccuuuaccgccggcaaaauuaucuucgccgcugucccucccaacuuccccaccgaaggccucucacccucucaagucaccauguucccccacaucaucgucgacguacgacaacuggaaccaguacuaauaccccuacccgacguccgcaacaacuucuaucacuauaaccaauccaacgacagcacaaucaaacucaucgccaugcucuacacaccccuccgcgcaaacaacgcaggagaagaugucuucacagucuccugccgcguacuuacccgcccaucccccgacuucgacuuuaucuuccucguaccuccaacaguugaaagccgaaccaaaccauucacaguuccaauccucacugucgaagaaaugacaaacucccgcuuccccauuccccucgaaaaacucuucacaggccccucuagcgcuuuugucguccaaccacaaaauggccgcugcacaacagacggcguacuucucgggaccacucaacuaucacccgucaacaucuguaccuuccguggcgacguaacacacauugcaggaucccgcaacuauaccaugaaccucgccucacuaaacuggaacaacuacgaccccacagaagagauccccgcaccccucggcaccccagacuucgucggaaaaauccaaggcguccucacacaaaccaccaaaggcgacggaucaacucgcggccacaaagccacugucuacaccggcucagcccccuucaccccaaaacuaggcuccguacaauucuccaccgacaccgagaacgauuucgaaacccaccaaaacaccaaauucacccccgucggcguaauccaggaugguuccaccacccaucgaaacgaaccccaacaauggguccuaccuucauacuccggccgcaacgcccauaacguccaccuugcccccgccgucgcccccaccuuucccggcgaacaacuccuauucuuccgaucaaccaugccgggaugcucaggauaccccaacauggaccucgacugccuacuaccccaagaauggguccaacacuucuaucaagaagcugcacccgcccaaucagaugucgcccuccugcgcuucgucaauccggacaccggacgcguccucuucgaaugcaagcuccacaaauccgguuacguaacggucgcccauacuggacaacacgaccucgucaucccacccaacgguuacuuccgcuuugacuccugggucaaccaauucuacacucucgcacccauggguaacggcaccggccgacgacgcgcacuauga

SEQ ID NO: 36352 - RNA, 1623 nt, Artificial Sequence
  derived and/or modified sequence opt11 from VP1__Norovirus__BAJ13552
augaaaauggcauccaacgacgcaaaccccucagauggcuccgccgccaaccugguccccgaagucaacaacgaaguaauggcgcuagaacccgucguuggcgcagccaucgccgcccccgucgccggacaaaccaacguaauagauccguggauccgcaacaacuucguucaagcacccggcggagaguucaccgucucccccagaaacgccccaggagaaauauuaugguccgcaccccuaggccccgaccucaauccauaucucucccaccucgcccgcauguacaacggguacgccggagguuucgaaguacaagucauucucgccggcaacgccuucaccgcaggcaaaaucaucuuugccgcagucccacccaacuucccaaccgaaggcuuaucaccaucucaagucacaauguucccccacaucauaguugacguacgacaacucgaaccuguccucauuccccuccccgacguacgcaacaacuucuaccacuacaaccaaucaaacgauucaacaaucaaacucaucgcaaugcucuacacaccccuacgcgcaaacaaugccggcgaagauguauucaccguauccugccgcguccucacccgacccuccccagacuucgacuucaucuuucucgucccacccacagucgaaucccgcaccaaaccauucaccgucccaauccucaccguugaagaaaugaccaacucacgcuucccaaucccccuagaaaaacuauucaccggccccucuggcgcauucguaguccaaccccaaaacggacgcugcaccaccgacgguguccuccucgguaccacacaacucuccccaguuaacauauguacauuccgcggagacguaacccacauagcaggaucccgcaacuacacgaugaaccuugccucccucaacuggaacaacuacgauccgaccgaagaaauaccagccccucuaggcaccccagacuucguaggaaaaauacagggcguccucacccaaaccaccaaaggggacggcagcacccgcggucacaaagcaaccgucuacaccgguucugcccccuucacaccaaaauuaggcuccguacaauucucaaccgauacagaaaacgacuucgaagcccaccaaaacacaaaauucacccccguaggcguuauccaagacgguucaacuacccaccgaaacgaaccccaacaauggguccucccauccuacucaggacgcaacguacaaaacguccaucuagccccugccgucgcacccaccuuccccggcgaacaacuacucuucuuccgcuccaccaugccaggcugcucaggcuaucccaacauggaccucgauugccuccuaccucaggaauggguccaacacuucuaccaagaagccgcgcccgcacaaucagacgucgcccuucugcgguucguaaaccccgacacaggucgcguccuuuucgaaugcaaacugcacaaauccggcuacguuaccgucgcccacaccggccaacacgaccucgucaucccacccaauggauacuuccgcuucgacucaugggucaaccaauucuauacccucgcacccaugggcaacggcaccggucgacgccgagcccucuaa

SEQ ID NO: 36353 - RNA, 1623 nt, Artificial Sequence
  derived and/or modified sequence opt11 from VP1__Norovirus__BAJ13555
augaaaauggcguccaacgaccccucacccucagacggauccgccgccaaccucguccccgaagucaacaacgaagucauggcccucgaaccagucgucggcgcagcaaucgccgcacccgucgccggccaacaaaacgucaucgacccauggaucagaaacaacuucguacaagcacccggcggugaguuuaccgucuccccuagaaacgccccaggagaaauacucuggucagccccacuaggccccgaccucaauccauaccucucgcaccucgcccgcauguacaacgguuacgcaggaggauucgagguucaagucauccuagcuggcaacgcauucaccgccggaaagaucaucuucgccgccguaccaccaaacuucccaaccgaaggccucucucccucacagguuaccauguucccccacaucauaguagauguacgacaacuagaaccgguccuaaucccacuacccgacguccgaaauaauuucuaccacuacaaccaauccaacgacucaaccaucaagcugaucgcaaugcucuacacaccucuacgcgccaacaacgccggcgaagacgucuucacagucuccugcagaguccucacccgcccaucaccagacuucgacuucaucuuccucgucccaccaacaguggaaucccgaacaaaacccuucacagucccaauccuaaccguagaggaaaugaccaacucacgguuccccaucccccucgaaaaacuauucaccggacccuccuccgccuucgucguacaaccgcaaaacggccgcugcaccacagacggcguccuccugggcaccacucaacucucacccguaaacaucugcacauuccguggcgacgucacccacaucgcaggcagccgcaacuacacuaugaaccucgccucucucaauuggaacaacuacgaccccaccgaggaaauaccagcaccacucgguaccccagauuucgucggcaaaauacaaggcguccuuacacaaaccacaaaaggagacggcuccacacgcggacacaaggccaccguauacaccggauccgccccauucaccccuaaacucggcuccguccaauucuccaccgacaccgaaaacgacuucgaaacccaccaaaacaccaaauucaccccagucggcgucauccaagacggaggaacaacccaccgcaacgaaccccaacaauggguacuccccuccuacuccggccgagacguccaaaacguacaccuagcaccagccgucgcccccacguucccaggcgagcagcuacuauucuucagaucaaccaugcccggaugcucaggcuacccaaacauggaccuagacugccuuuuaccccaagaguggguacaacacuucuaccaagaagcagcccccgcccaauccgauguagcccuccugcgauucgucaacccggacacaggccgcguccuauucgaaugcaaacuucauaaaagcggcuacguaacagucgcacacacaggacaacaugacuuaguuaucccucccaacggcuacuucagauucgacuccugggucaaccaguucuacacccuagcccccauggguaacggcacaggacgccgcagagcccucuaa

SEQ ID NO: 36354 - RNA, 1623 nt, Artificial Sequence
  derived and/or modified sequence opt11 from VP1__Norovirus__BAJ13558
augaaaauggcauccaacgacgccaaccccuccgacggcuccgccgccaaccuaguccccgaagucaacaacgaagucauggcccuagagcccguagucggcgccgccauagccgcacccgucgccggccaaaccaacgucaucgaccccuggauacgcaacaacuucguacaagcccccggcggagaguucacuguaucaccccgcaacgcaccaggcgaaauccucuggagugccccacucggcccugacuuaaaucccuaccucucacaucucgcacgcauguacaacggcuacgcaggcggcuucgaaguccaagucauccucgccggaaacgcuuucacagccggcaaaauaaucuucgcggccguaccacccaacuuccccacagaaggccucucacccucccaagucacuauguucccccacauaaucguagacguccgccaauuagaacccguacucauaccucuccccgacguacguaacaacuuuuaccacuacaaucaguccaacgacuccaccaucaaacuaauagccaugcucuacacaccccuccgugcuaacaacgcaggcgaagacgucuucaccguuuccugccgaguacucacucgcccaucccccgacuucgacuucaucuuccucguacccccaaccgucgaaucccgaacaaaaccguucacuguccccauacuaacagucgaagaaaugaccaacuccagauuccccauaccacuagaaaaacuauucaccggaccauccggcgcauuugucguacaaccccaaaauggccgaugcaccaccgacgguguacuccucggcaccacccaacucucccccgucaacauaugcaccuuccguggggacgucacccacaucgccggcucgcgaaacuacaccaugaaccucgccucucuaaacuggaacaacuaugaccccaccgaggagauacccgcaccccucgggacccccgacuucgucgguaagauccaaggcguccucacacaaacaacuaaaggcgacggcuccacccgcggacacaaagccaccgucuauaccggcuccgccccauucacaccaaaacucgguucgguccaauuuuccaccgacaccgaaaacgauuucgaagcccaccaaaacaccaaauucacccccgucggaguaauccaagacggcuccacuacccaccgcaacgaaccacaacaauggguccucccauccuacuccggacgcaacguucaaaacguccaccucgcccccgccguagccccgaccuucccaggagaacaacuacucuucuuucgcucaaccaugcccggcugcuccggcuaccccaacauggaccucgacugucuccucccccaagaauggguccaacacuucuaccaagaagccgcaccagcccaauccgacguagcgcuacuacgcuuugucaaccccgacaccggccgaguucucuucgaaugcaaacuacauaaaucagguuacgucaccgucgcccacaccggacaacacgaccuggucaucccacccaacggcuacuucagauuugacuccugggucaaccaauucuacacccucgcccccaugggaaacggaaccggccgacgccgcgcccuuuaa

SEQ ID NO: 36355 - RNA, 1623 nt, Artificial Sequence
  derived and/or modified sequence opt11 from VP1__Norovirus__BAJ13561
augaagauggccuccaacgacgcaaacccauccgacggcuccgccgccaaccucguacccgaaguaaacaacgaaguuauggcacucgaacccgucgucggugcagcaaucgccgccccuguagcaggccaaacuaacguaaucgaccccuggaucagaaacaacuucguccaagcccccggcggagaguucaccgucucaccccgcaacgcccccggagaaauccuuuggagcgcaccacucggccccgaccucaaccccuaccuaucccaccucgcccguauguacaacggcuacgcaggcgguuucgaaguccaagucauucucgccggaaacgcauucaccgcgggaaaaaucauuuucgccgccguacccccaaacuuccccaccgaaggccuaucacccucccaagucaccauguucccucacaucaucgucgacgucagacaacuagaacccguacucaucccccuaccagacguccgcaacaacuucuaucacuacaaccaauccaacgacucuaccaucaaauuaaucgcaaugcucuauaccccacuccgcgccaacaaugccggcgaagacgucuucaccguaucuugccgcguccucacccguccuucgcccgauuuugacuuuaucuuccuagucccaccaacagucgaaagccgaaccaaacccuucaccguacccauccuaacugucgaagaaaugacaaacucacguuucccaauuccacuugaaaaacuauucaccggcccaucaggcgccuucgucguccaaccccagaacggccgcugcaccaccgacggcguccuacucggcacaacccaacuuucccccgucaacaucugcaccuuccgaggcgacguaacacacaucgcagguucacgaaacuacaccaugaaucucgcuucccucaacuggaauaacuaugaccccacagaagaaauccccgcaccccuagggaccccugacuucguaggcaaaauccaaggaguccucacccaaaccaccaagggcgacggcuccacacgaggccacaaagcaaccguuuacacuggcagcgcccccuuuacccccaaauuaggcagcguccaauucuccaccgacaccgaaaacgacuuugaaacacaccaaaacaccaaauucacccccgucggcgucauccaagacggaucaaccacacaucgaaacgaaccccaacaguggguacugcccuccuacuccggccgaaacguccacaacguccaccucgccccagccgucgccccaaccuuccccggagaacaacuacuauucuuucgcuccaccaugcccgggugcuccggcuauccuaauauggaccuugacugccuccucccccaagaauggguacaacacuucuaccaggaagcugcacccgcccaauccgacgucgcucuccuccgauucgucaaccccgacaccggccgaguacucuucgaaugcaaacugcacaaauccggauacgucacagucgcgcacaccggucaacacgaccuuguuauacccccaaacggcuauuuccgcuucgacagcugggucaaccaauucuauacucucgcaccaauggggaacggcaccggccgucgccgcgcccucuag

SEQ ID NO: 36356 - RNA, 1623 nt, Artificial Sequence
  derived and/or modified sequence opt11 from VP1__Norovirus__BAJ13564
augaaaauggccucuaaugacgcaaaccccuccgacggcucagcagccaaccucguaccagaagucaauaacgaagucauggcacucgaacccgucgucggcgccgcuauagccgcuccugucgcgggccaacaaaacgucaucgaucccuggauaagaaacaacuucguccaagcaccaggcggcgaauuuaccgucuccccacgcaacgccccaggcgaaauacuaugguccgccccacucggacccgaccugaauccguaccucucccaccuugcccgcauguacaacggauacgccggaggauucgaaguucaagucauccucgcaggcaacgcuuucaccgcaggcaaaauaauuuucgccgcaguucccccaaacuucccaacagaaggccucucacccucacaagucacaauguucccccacaucaucgucgacguccgccaacuugaaccaguccucaucccacucccagacguucgcaacaacuucuaccauuacaaccaaucuaacgacuccacaaucaagcucaucgccaugcucuacacuccccuacgcgcaaacaacgccggagaagauguauuuaccguauccugucgcguacuuacacgcccaucccccgacuucgacuucauuuuccuuguacccccuaccgucgaaagccguaccaaacccuucaccguccccauccuuaccgucgaagaaaugaccaacucccgguuccccauaccccucgaaaaacucuucacaggccccuccuccgccuucgucguccaaccccaaaacggccguugcaccacagacggcguccuccucggaaccacccaacuaagccccguaaacaucugcaccuuccgaggcgacguaacacauaucgcaggaucacgcaacuacaucaugaaucuugccucccuaaacuggaacaacuacgacccaaccgaggaaauccccgcaccccucggcaccccagacuucguaggcaaaauccaaggcguccucacacaaaccaccaaaggcgacggauccacccgcggucacaaagccaccguauacaccggcucagcccccuucacucccaaacucggcucgguccaguucagcaccgauaccgaaaaugacuuugaaacccaccaaaacaccaaauucacacccguaggcgucauacaagacggauccacaacccaccgcaacgaaccccaacaauggguccucccaucuuacucaggccgcaacguacacaacguccaucucgcccccgcagucgcaccaaccuuccccggcgaacaacuccucuucuuccgcuccaccaugcccggcugcagcggauaccccaacauggaccucgacugccuccucccacaagaauggguucaacacuucuaccaagaagccgccccugcacaauccgacguagcccugcuccgcuucgucaacccagacacaggccgcguccuauucgaaugcaaacuccacaaauccggauacgucaccgucgcccacacaggacaacacgaccucguaaucccacccaacggcuacuuccgauucgacuccugggugaaccaauucuacacacucgcccccaugggcaacggcacgggacgccgccgcgcccucuaa

SEQ ID NO: 36357 - RNA, 1623 nt, Artificial Sequence
  derived and/or modified sequence opt11 from VP1__Norovirus__BAJ13567
augaaaauggcuucuaacgaugccaaucccuccgacggcucagcagcaaaccuuguccccgaaguaaacaacgaagucauggcacuagaaccagucgucggcgccgccaucgccgcccccguagcaggccaacaaaacguuauagaccccuggauccgcaacaacuucguacaagcucccggaggcgaguucacagucucacccaggaacgccccuggcgaaauucuaugguccgccccacuaggccccgaccucaacccauaccucucccaccucgcccgcauguacaacggcuacgcaggcggauuugaaguccaagucauccucgcagguaacgccuucaccgcuggcaaaauaaucuucgcagccguucccccuaacuuccccacugaaggacucucucccucucaagucacgauguucccucacaucaucgucgacguccgucaacucgaacccguacucaucccacuucccgacguccguaauaacuuuuaccacuacaaccaauccaacgacuccacaauuaaacuaaucgccaugcuauacacaccccucagagcaaacaacgcaggagaagacgucuuuacagucuccugccgcguccucaccagaccaucacccgacuucgacuucauuuuccuagucccacccaccgucgaaucacgcaccaaacccuucacaguccccauacucacaguagaagaaaugaccaacucccgauucccaauuccccucgaaaaacuauucaccggccccucauccgccuucguuguacagccccaaaauggucgaugcaccacugacggaguccuucucggcaccacccagcucucuccaguaaacaucugcaccuuccgcggagaugucacccacaucgccggcagccgcgauuacaccaugaaccucgccucccuaaacuggaacaacuacgaccccaccgaagaaaucccagcuccccuaggcacccccgacuucgucggaaaaauccaaggcguccucacccagaccaccaagggagacgguuccacccgaggccauaaagccaccgucuacacaggauccgcacccuuuaccccaaaacuagguuccguccgcuucuccacagacacggaaaacgacuucgaaacacaccaaaauaccaaauucacccccgucggaguaauccaggacggcuccaccacccaccguaacgaaccacaacaauggguccucccaucauacuccggacgcgauguacacaacguccaccuagcccccgccgucgcccccacauuccccggcgaacaacuccuauucuuccgcucaaccaugccaggaugcuccggcuaccccaacauggaccucgacugccugcucccgcaagaauggguccaacacuucuaucaagaagccgcccccgcacaauccgacgucgcucuacuccgcuucguuaaucccgacaccggacguguccuauucgaaugcaaacuccacaaaccaggcuacguaaccgucgcccauaccggccaacacgaccuaguaauacccccaaacggcuacuucagauuugacucgugggucaaucaauucuacacccucgcaccaaugggcaacggcacaggacgccgccgcgcccucuaa

SEQ ID NO: 36358 - RNA, 1623 nt, Artificial Sequence
  derived and/or modified sequence opt11 from VP1__Norovirus__BAJ13573
augaaaauggccucuaacgacgcaaaucccagcgacgguucggcggccaaccucguccccgaaguuaacaacgaagucauggcacuagaacccgucgucggcgcagcuauagcagcccccguagccggccagaccaacgucauagaccccuggauccgaaacaacuucguacaagcccccggcggugaauuuaccguaucuccccgcaacgcgccaggcgaaauacuaugguccgcaccccucggucccgaccucaaccccuaccucucucaccuagcccggauguacaacggcuacgccggcggcuucgaaguucaggucauacuggccggcaacgccuucaccgccggcaaaaucaucuucgccgccguuccucccaacuuccccacagaaggccucucaccaucccaagucaccauguucccacacaucaucguugacguucggcaacucgaacccguacuaaucccccuacccgacgugagaaacaacuucuaccacuacaaccaauccaaugacuccaccaucaaacucaucgccaugcuauacacaccucuacgcgccaauaacgccggcgaagacguauucaccgucucaugccgcguacucacccgcccauccccugacuucgacuuuaucuuccucgucccaccaaccgucgaaagccgcaccaaaccauucaccguaccaauccuuaccgucgaagaaaugacgaacucacgcuucccaauacccuuagaaaaacuauucaccggccccucaggcgcauucgucguccaaccccaaaacggccgcugcaccaccgacggcguacuacucggcacaacacaacuuucccccguaaacaucugcacauuucgcggcgacguuacccacauagcaggaucccgcaacuauacaaugaaccucgccagucucaacuggaacaacuacgaccccacugaagaaauccccgccccacuaggcaccccagacuucgucggaaaaauacaaggcguccucacucagaccaccaaaggagacggcuccacacgcggucacaaagccacagucuacacuggauccgccccauucacacccaaacucggcuccguacaguucucaacagacacagaaaacgacuucgaagcacaccagaacacaaaauucacccccgucggaguuauucaagacggcagcaccacccaccgcaacgaaccacagcaauggguccucccaucguauuccggccgcaacguccaaaacguccaccuagcccccgccguagcacccaccuucccaggggaacaacuccucuucuuccgcucaaccaugcccggcugcuccggauaccccaauauggaccucgacugucuacuuccccaagaauggguccaacacuucuaccaagaagccgccccugcccaaucugacgucgcccuccuccgcuucgucaaccccgacaccggacguguccuauucgaaugcaaacuacacaaaagcggauacguaaccguugcccacacuggccaacacgaucuagucaucccacccaacggcuacuuucgcuucgacucaugggucaaccaauucuacacacucgcccccaugggcaauggcacaggacgccgccgcgcucuauaa

SEQ ID NO: 36359 - RNA, 1623 nt, Artificial Sequence
  derived and/or modified sequence opt11 from VP1__Norovirus__BAJ13576
augaaaauggccucuaacgacgccaacccguccgacggcuccgccgccaaccuuguccccgaagucaacaacgaaguuauggcccuagaaccagucgucggcgccgccaucgccgcucccgucgccggacaacaaaacguaaucgacccauggauccgcaacaacuucguccaagcccccggaggcgaauuuaccguaucaccccgaaacgcccccggagaaauccccugguccgaaccccucggccccgaccucaacccauaccuaucccaccucgccagaauguacaauggcuacgcagggggauucgaaguccaaguaauccucgcaggcaacgcauucaccgccggcaagaucaucuucgccgcggucccacccaacuuccccacagaaggccuuuccccaucacaagucaccauguucccccacauaaucgucgacguucgacaacuagaaccaguccucaucccccugcccgacgucagaaauaacuucuaucacuacaaccaauccaaugacuccacaauaaaauuaauagcaaugcucuacacaccccuacgagcaaacaaugccggcgaagacguauucaccgucuccugccgaguccucacccgccccucccccgacuucgacuucauauuccuugucccacccaccgucgaaagcagaacuaaacccuucaccguccccauccucaccguagaagaaaugacaaacucccgauuccccaucccccucgaaaaacucuucacaggccccuccagcgccuucguaguccaaccccaaaacggccgaugcacaacagacggaguccuccucggaaccacccaacucagccccguaaacauuugcaccuuccgcggcgacguaacacacaucgcaggcucccgaaacuacaccaugaaccuagcaucacucaacuggaacaacuacgacccaacagaggaaauccccgccccacuaggaacaccagacuucguuggcaaaauccaaggaguauuaacacaaacaacaaagggugacggauccacccgcggacacaaagccacuguauacaccggauccgccgacuucacaccaaaacuaggcucaguccaguucuccaccgacaccgaaaacgacuucgaaacccaccaaaacaccaaauucacacccguuggcgucauccaagacggcggcacaacccaccgcaaugagccccaacaauggguccuaccuagcuacuccggacgcaacguacacaacguucaccuagcaccagcagucgcuccaaccuucccaggcgaacaacuacuguucuuccgcagcacaaugcccggcugcagcgguuaccccaacauggaccuagacugcuuauuaccccaagaauggguccaacacuucuaccaagaagcagcgcccgcucaauccgacguagcacuccuucgauucgucaaccccgacaccggccgcguccuuuucgaaugcaaacuacacaaauccgguuacgucaccgucgcucacacaggccaacacgaucucguaaucccaccgaacggcuacuuccgauucgacucaugggucaaccaauucuacacucucgcacccaugggaaacgguaccggucgacgccgcgccuuauga

SEQ ID NO: 36360 - RNA, 1623 nt, Artificial Sequence
  derived and/or modified sequence opt11 from VP1__Norovirus__BAJ13579
augaaaauggccagcaacgacgccaacccauccgacggcucagcagccaaccucguacccgaagucaacaacgaagucauggcucuagaacccgucguaggcgcagcaaucgccgcaccaguagcagggcaacagaacgucauagacccauggauacgcaacaacuucguccaagcccccggcggugaguucaccguaucaccccgaaaugccccuggcgaaauucugugguccgcaccccucggacccgaccuaaaccccuaccucucccaccuagcccgcauguacaacgguuacgccggcggcuucgaaguccaagucauacuagccggcaacgcauucacagccggcaaaaucauauucgcagcaguaccacccaauuucccaacagaaggacuaagcccuucccaagucacuauguucccacacaucaucgucgacguacgccagcucgaacccguacucaucccacuccccgacguccguaacaacuucuaccacuauaaccaauccaacgacucaacaauaaaacuaauagccaugcuauacacaccccuccgcgccaacaacgcaggcgaagacgucuucaccgucucuugccgcguccucaccagacccuccccagacuucgacuucauauuccucgucccacccacaguugaaucucgcaccaaacccuucacuguucccauacuuacagucgaagaaaugaccaauucacgcuucccaaucccacucgaaaagcuauucacaggccccuccagcgccuucgucguccaaccacaaaacggccgcuguaccacagacggcgucuuacucggcacaacccaacucucccccgucaacaucugcacuuucagaggcgauguuacccacaucgccggcuccagaaacuacacaaugaaccucgccucacucaacuggaacaauuacgaucccaccgaagaaaucccugcaccccuaggcacccccgacuucgucggcaaaauucagggcguccuuacccaaaccacaaaaggcgacggcuccacccguggccacaaagccacaguauacaccggauccgcagacuucaccccuaaacucggauccguucaauucucaacugacaccgaaaacgauuucgaaacccaccaaaacaccaaauucacccccgucggcgucauacaagacggcggcacaacccaccgaaacgagccacaacaauggguccuccccucauacucaggucgcaacguccacaacguacaccuagcccccgcaguagccccuaccuuccccggcgaacaacucuuauucuuccgcucgacaaugcccggcugcagcggcuaccccaacauggaccucgacugccuauuaccucaagaauggguccaacacuucuaccaagaagccgcccccgcccaauccgacguugcccuccugcgcuucguuaaccccgacaccggccgaguccuauucgaaugcaaacuucacaaaucgggcuacgucaccgucgcccacaccggacagcacgaccucguuaucccacccaacggguacuuccgcuucgacuccugggucaaccaauucuacacccuagcucccaugggcaacggcaccggcagacgccgggcccucuag

SEQ ID NO: 36361 - RNA, 1623 nt, Artificial Sequence
  derived and/or modified sequence opt11 from VP1__Norovirus__BAJ13582
augaaaauggccuccaaugacgcuaaccccuccgacggauccgccgccaaccuaguacccgaaguaaacaacgaagucauggcccuagaaccagucgucggcgccgcgaucgccgcaccugucgcaggacaacaaaacgucauagaccccuggaucagaaauaacuucguccaagcacccggaggagaguucaccguaucuccccggaacgcccccggagaaauccuaugguccgcuccccucggcccagaccucaaccccuaccucucgcaccuagcccgcauguacaacggauaugccggcgguuucgaaguacaaguaauccucgccggcaacgccuucaccgccggcaaaauaaucuucgccgccguuccaccaaauuucccuacggaaggccucucccccucacaaguuaccauguucccacacauaaucguagacguccgccaacucgagcccguacugaucccucuaccagacguccgcaacaacuucuaccacuacaaccaaucaaaugauucaaccauaaaacucauagccaugcucuacacaccacuucgagccaacaacgcuggcgaagacgucuucaccgucuccugccgaguccucacacgccccuccccagauuucgacuucaucuuccuugucccacccacaguagaaucccgcaccaaacccuucaccguccccauccuaaccguugaagaaaugaccaacucucgauucccaaucccgcucgaaaaacucuucaccggcccuaguggcgcauucguaguacagccccaaaacggccgcugcaccaccgacggcguccugcucgggacaacacaacuaucccccgucaacaucugcaccuuccgcggugacgucacccacauagcaggcucccgcaacuauacaaugaaccucgccucccucaacuggaauaacuacgacccaaccgaagaaauccccgcaccccucggaaccccagacuucgucggcaaaauacaaggcguccuaacacaaacaaccaaaggcgacggcuccacccgcggucacaaagccaccgucuacaccggcuccgcgcccuucacaccaaaacucggauccguacaauucucuaccgacacggaaaacgacuucgaaacccaccaaaacacaaaauucacccccgucggcgucauacaagacggaucaacaacacaccgcaacgaaccccagcaauggguccucccauccuacucaggacgcaacguccacaacguacaucucgcccccgccguugccccaaccuucccaggagagcaacuauuauucuuccguucaaccaugccaggaugcuccggauaccccaacauggaccucgacugccuucucccccaagaauggguacaacacuucuaccaagaagccgcccccgcccaauccgacguagcccuucuaagauucguaaacccagacacuggccguguccucuucgaaugcaaacuccacaaauccggcuacguaaccguggcccauaccggacaacacgaccuagucauuccacccaacggcuacuuccgauucgacucaugggucaaccaauucuacacccucgccccaaugggcaacggaacaggacgccgcagagcacucuaa

SEQ ID NO: 36362 - RNA, 1623 nt, Artificial Sequence
  derived and/or modified sequence opt11 from VP1__Norovirus__BAJ13585
augaaaauggccucaaacgacgcaaacccaagcgacggcucagccgcaaacuuaguccccgaagucaauaacgaagucauggcgcucgaacccguagucggcgccgcaauagccgcccccgucgccggucaacaaaacguaaucgaccccuggauccgaaacaauuuuguccaagccccaggaggagaguucaccgugagcccacgcaacgccccaggcgaaauccucugguccgcaccccuaggaccagaccuaaaccccuaccucucccacuuagcacgaauguacaacggcuacgccggaggcuucgaaguacaagucauacucgcaggaaacgccuucacagccggcaaaauaaucuucgccgccgucccaccaaacuucccaacugaaggacuuucacccucgcaggucaccauguucccccacaucaucguugacguccggcaacucgaacccguccuaauccccuuaccugacguccggaacaacuucuaccacuacaaucaauccaacgacagcaccaucaaacucaucgccaugcuguacacaccccuccgagccaacaacgccggcgaagacguauuuaccgucuccugccgcguacucaccagaccaucccccgacuucgauuucauauuucucgucccacccaccguugaaucaagaaccaagcccuucaccguucccauccucaccgucgaagaaaugacuaacucacgcuuccccaucccccuagaaaaacucuucacaggacccuccuccgcauucgucguccaaccacaaaacggacgcugcacaaccgacggcguacuacucgguaccacccaauuaucccccgucaacaucugcaccuuccgcggcgacgucacacacaucgccggaucucgcaacuacaccaugaaccuagccucccucaacuggaacaacuacgaccccacagaagaaauccccgcaccccuaggaaccccagacuucgucggcaagauccaaggcgucuugacccagaccaccaaaggcgacggauccacccgcggacacaaagccacugucuacacaggcucagcccccuucacccccaaacugggaagcguacaauucagcacagacaccgaaaacgacuucgagacccaucaaaacacaaaauucacccccgucggcguaauacaagacggaggaaccacgcaccgaaacgaaccccaacaauggguccucccauccuacuccggccgcaauguacccaacguccaccuagcccccgccgucgccccuacauuuccaggcgaacaacuccucuucuuucgcucaacaaugccaggcugcucuggcuacccaaacauggaccucgacugccuccuaccacaggaauggguacagcacuucuaccaagaggccgccccugcacaguccgacgucgcccuccuacgauucgucaaccccgauaccggcagaguccuauucgagugcaaacuccacaaguccggauacgucacaguugcccacacuggccaacacgaccucgucauacccccaaacggcuacuucagauucgacuccuggguaaaccaauucuacacccucgcacccaugggcaacggcaccggacgccgccgagcccucuga

SEQ ID NO: 36363 - RNA, 1623 nt, Artificial Sequence
  derived and/or modified sequence opt11 from VP1__Norovirus__BAJ13591
augaaaauggccuccaacgacgcuaaccccagcgauggcuccgccgcaaaucuuguacccgaaguaaacaacgaagucauggcacucgaacccgucgucggagcagcaaucgccgcccccgucgccggccaacaaaacguaaucgacccuuggauccgcaacaacuucguccaagcccccggaggagaguucaccguaucaccccgcaacgcccccggagaaauccucugguccgcaccccucggcccagaccuaaaucccuaccucucccaccucgcccguauguacaacggauacgccggcggcuucgaaguccaaguaauccucgccggcaacgccuucaccgccggcaaaaucaucuuugcagcaguaccacccaauuucccaaccgaaggacuaucccccucucaaguaacuauguucccucacaucaucgucgacguccgacaacuagaaccaguccucaucccucuacccgacguccgcaacaacuucuaccacuacaaccaaucaaacgacuccacaauuaaacucaucgcaaugcucuacaccccacuacgcgcaaauaaugccggcgaagacguauucaccguaucaugccguguccucacgcguccaucacccgacuucgacuucaucuuccugguacccccgacagucgaauccagaacaaaaccguucacaguacccauccucacagucgaagaaaugaccaacucccgauuccccauaccccucgaaaaacuauucacaggacccuccuccgcauucgugguccaaccccaaaacggccggugcaccacagacggcguccuccuaggcaccacucaacuaucccccgucaacaucugcaccuuccgcggagacgucacccacaucgccgguucacgaaacuacaccaugaaccucgccagccuaaacuggaacaacuacgaccccacagaagaaauccccgccccacuaggaaccccugacuucgucggcaaaauacaaggcguccuaacccaaaccacaaaaggcgacggcuccacccgcggccacaaagccacaguauacaccggcucggcacccuucacccccaaacuaggcucaguacaauucucuaccgacacagaaaacgacuucgagacccaccaaaacaccaaauucacccccguaggagucauacaagacggaggcacuacccaccgaaacgaaccccaacaauggguccuccccuccuacucagggcgaaauguccccaauguccaucuagcacccgccguagcacccacauucccaggcgaacaacuacucuucuucagauccaccaugcccggcugcuccggguacccaaacauggaccucgacugccuccucccccaagaauggguacaacauuucuaccaggaagccgcuccagcccaguccgacguggcacuccucagguucgucaacccagacacaggccgaguccucuucgaaugcaaacucuacaaauccggauacgucacggucgcccacacuggacaacacgaccucgucaucccucccaacggcuacuuccgauucgacuccuggguaaaccaauucuacacccucgcccccauggggaacggcaccggacgucgacgugcccucuaa

SEQ ID NO: 36364 - RNA, 1623 nt, Artificial Sequence
  derived and/or modified sequence opt11 from VP1__Norovirus__BAJ13594
augaaaauggccagcuccgacgcaaaccccuccgacggcagcgccgccaaccuagucccugaagucaacaacgaaguuauggcccucgagccugucguuggcgccgccaucgccgcaccuguagcgggucaacaaaacgucaucgaccccuggauacgaaacaacuucguccaagcaccaggcggcgaauuuaccguuagcccccgaaacgcuccuggcgaaauccuauggucugcaccccucggcccagaccucaaccccuaccuaucccaccuagcccgcauguacaacggauacgccggcggauucgaaguccaaguuauccucgccggcaacgccuucacugccggaaaaaucaucuuugccgccguaccaccaaacuuuccaacagaaggccuaucccccucucaagucacuauguucccccacaucaucgucgacguccgccaacuggaaccagucuuaaucccccuacccgacguccgcaacaacuucuaccacuacaaccaaucaaacgauucaaccaucaaacuuaucgcaaugcuauacaccccacuccgagcaaacaacgccggugaggacgucuucaccgucucaugccgaguccucacccguccaagccccgacuucgacuucauauuccucguucccccaaccgucgaaucacguacaaaacccuucacaguaccuauccuaaccgucgaagaaaugacaaacuccagauucccaaucccccucgaaaagcucuuuacaggccccucaggcgccuucguaguccaaccucaaaauggacgcugcaccacagacggcguccuccucggcacgacucaacuauccccugucaacauaugcaccuuccgcggagacguaacccacaucgccggaucccgcaacuacaccaugaaccucgcaucacuaaacuggaacaacuacgacccaaccgaagaaauacccgcaccccucggcacccccgacuucguagguaaaauucaaggcaugcucacccaaaccaccaaaggcgacggauccacacgaggucauaaagccacagucuacacgggcuccgcccccuucacccccaaacuaggcuccguccaauucuccaccgacaccgaaaaugacuucgagacccaccaaaauaccaaguucacacccgucggcgucauacaagacggauccacaacccaccgcaaugaaccacaacaaugggucuuaccuuccuauucaggccgcgauguucacaacguccaccucgccccagccguagccccaacauucccaggagaacaacuccucuucuuccgcagcaccaugcccggcugcucaggauacccaaacauggaccuagacugccuccuaccccaagaauggguucaacacuucuaccaagaagccgcccccgcccaauccgacgucgcccuccuaagguucguuaaccccgacaccggccgaguccuauuugaaugcaaacuccacaaaucaggcuacgucacaguugcccacaccggccaacacgaccucgucaucccacccaacggauacuuccgcuucgacucuuggguuaaccaauucuacacccuugcccccaugggcaacggcacaggccgccgccgagcacucuaa

SEQ ID NO: 36365 - RNA, 1623 nt, Artificial Sequence
  derived and/or modified sequence opt11 from VP1__Norovirus__BAJ13597
augaagauggcaucgaacgacgcaaacccaucugacggcucagccgccaaccucgucccagaggucaacaacgaagucauggcccucgaaccaguuguuggagccgccaucgccgccccagucgcaggucaaacaaacgucauagacccauggauaagaaacaacuucguccaagcaccaggaggcgaguucaccguaucccccagaaacgccccaggugaaauccucuggagcgcaccccuuggacccgaccuuaacccauaccuuagccaccucgcaagaauguacaacggcuacgccgguggauucgaaguccaagucauucucgcuggcaacgccuucaccgccggcaaaauaauauucgccgcagucccucccaacuuccccaccgaaggacucuccccaucccaagucaccauguucccccacauaaucgucgacguccgccaacucgaacccguccucaucccgcucccagacguacgcaacaacuucuaccacuacaaccaauccaacgacucgaccauaaaauuaaucgcaaugcuauacacucccuugcgcgccaacaacgcaggagaagacguguuuaccgucagcugucgaguccuuacccgccccuccccagacuucgauuucaucuuccucguuccacccacaguugaaucacgcaccaagcccuucaccguccccauacucacagucgaagaaaugaccaacucccgcuuccccaucccccucgaaaaacucuucacuggccccucaggcgccuuugucguacagccccagaauggacgcugcacaaccgacggaguccuccuugguaccacccaacucucacccgucaacauaugcaccuuccgcggagacgucacucacauugccggcagccggaauuacaccaugaaccuggcaucccucaacuggaauaacuacgaccccacagaagaaauccccgcaccccucggaacgcccgacuucguugguaagauccaagguguccucacacaaaccaccaaaggagacggcuccacccgcggccacaaagccacagucuacaccggcucagcccccuucacucccaaacucggcuccguacaauuuagcaccgacaccgaaaaugauuucgaagcacaccaaaacaccaaauucacaccagucggcguaauccaagacggcucaacaacccaccgaaacgaaccccaacaguggguacuaccuuccuacuccggccgcaacguucaaaacguccaccucgcccccgcugucgcccccaccuuccccggugaacaacuccucuucuuucgcagcacaaugcccggaugcuccggauaucccaacauggaccucgacugccuccugccacaagaauggguccaacacuuuuaccaagaagcagccccagcccaauccgacgucgcacuacuccgcuucgucaaccccgacaccggccgcguauuauuugaaugcaaauuacacaaaucaggguacgucaccguggcccacaccggccagcacgaccugguaaucccucccaacggauacuuccgcuuugacuccugggucaaccaauucuacacccucgccccaaugggcaacggcaccggccgccgucgcgcucucuag

SEQ ID NO: 36366 - RNA, 1623 nt, Artificial Sequence
  derived and/or modified sequence opt11 from VP1__Norovirus__BAJ13603
augaaaauggccucaaacgacgccaacccauccgacggcuccgccgccaaccuaguccccgaagucagcaacgaagucauggcacucgaacccgucgucggagccgccaucgccgcacccgucgccggccaacaaaacguaaucgaccccuggauaagaaacaacuuuguccaagcgcccggcggcgaguucaccguauccccacguaacgccccuggcgaaauccucuggucagccccacucggccccgaccuaaaccccuaccuaucccaucuugcacgaauguacaacggauacgcaggcggcuucgaaguccaagucauccucgccgguaacgccuucaccgccggaaaaauuauauucgcagccgucccacccaacuuucccacagaaggucuaucccccucccaagucacaauguuuccccacaucaucgucgacguacgccagcuagaacccguacucaucccacuccccgacguucgcaacaacuucuaccacuacaaccaaucaaacgacucaaccauaaaacucaucgccaugcucuacacaccacuacgcgcaaacaacgcaggagaagacgucuucaccgucucaugccgaguuuuaacacgucccucccccgacuucgacuucaucuuucuugucccacccaccguugaaucacgcaccaaacccuuuaccguaccaauacucacagucgaagaaaugaccaacagccgcuucccaaucccgcucgaaaaacuauucaccggcccauccuccgcauucgucguccaaccccaaaacggacgcugcaccaccgacggcguacuccucggaacaacacaacuaucccccgucaacauaugcacauuccgcggcgacgucacacacaucgccggaucacguaauuacaccaugaaccuagccucccucaacuggaacaacuacgacccuaccgaagaaauacccgccccacuaggaacccccgacuuuguaggaaaaauccaagggguccucacccaaacuacuaaaggcgauggaucuacccgcggccacaaagcuaccgucuacaccggcucagcacccuucacaccaaaacuaggcagcguccaauucucuaccgacaccgaaaacgacuucgaaacccaucaaaacacaaaauucacuccaguaggcgucauccaagacggaggaaccacccaccgcaacgaaccccaacaauggguacuacccuccuacucagggcgcaacguuccaaacguacaccucgcccccgccgucgcccccaccuuccccggcgaacaacuccucuucuuccgcuccaccaugccaggcugcuccggauacccaaacauggaccucgacugccuccucccccaagaauggguacaacacuucuaccaagaagccgccccggcccaaucagacguagcacuacuacgcuucguaaacccagacaccggccgaguccuauucgaaugcaaacuccacaaauccggauacguaacaguagcacacacaggacaacacgaccuggucauacccccaaacggcuauuuccguuucgacuccugggucaaccaauucuacacccuagcgccaaugggaaauggcaccggccgccgccgcgcucucuaa

SEQ ID NO: 36367 - RNA, 1623 nt, Artificial Sequence
  derived and/or modified sequence opt11 from VP1__Norovirus__BAJ13606
augaaaauggcaagcagcgacgcaaaucccucagacggaagcgccgcaaaccucguccccgaaguaaacaacgaagucauggcccucgaacccgucgucggcgccgccauagcagcacccgucgccggacaacaaaaugucauagacccauggauccgcaacaacuuuguucaagccccaggcggcgaguucacagucucaccgcgcaacgcaccaggagaaauccuaugguccgcgccccucggccccgaccucaaucccuaucucucccaccuagcccgcauguacaacggcuacgccggaggauucgagguacaagucauacucgcuggcaacgccuucacugcagguaagaucaucuucgcagccguaccacccaacuuccccacagaaggccucucccccucccaaguaaccauguucccacacaucaucgucgacguacgacaacucgaacccguacucaucccccuacccgacguacgaaacaacuucuaccacuacaaccaaucaaacgauucaaccauaaaacuaaucgccaugcucuacacaccccuccgagcaaacaaugcaggcgaagacgucuuuaccguauccugccgcgugcucacccgacccucaccagacuucgacuucaucuuccucguacccccaaccgucgaaucuagaaccaaaccauucaccguccccauacuaaccgucgaagaaaugacaaacucacgcuucccuaucccucuagaaaagcuauucaccggccccuccagcgcuuucgucguccaaccucaaaacggccgcugcacuaccgacggaguacuccuaggcacgacccaacucucacccgucaacaucugcaccuuccgaggagacgucacacacaucgccggaucacgcgacuacacuaugaaccucgcaucacuuaacuggaauaauuacgaccccacagaagaaauuccagcaccacucggcacccccgacuucgucggcaagauccaaggcguccucacccaaacaacaaaaggagacggauccacacgcggccacaaagcuaccgucuacaccggcuccgcccccuucacacccaaacucggaucaguccaauucucaacagacaccggcgacgauuuccagacccaucaaaacaccaaauucacacccgucggagucauccaagacggcggcacaacccaccgcaacgaaccacaacaauggguccuacccagcuacuccggccgaaacguucccaacguacaccucgcacccgccgucgccccaacuuuccccggagaacaacuacuauucuuucgaucaacaaugcccggcuguuccggcuaccccaacauggaccucgacugccugcuaccccaagaauggguccaacacuucuaccaagaagcugcacccgcacaauccgacgucgcccuccuccgguucguuaacccugacacaggucgaguccucuucgaaugcaagcuccauaaagcuggcuacguaacggucgcccacaccggccaacacgaccucgucauacccccaaauggcuauuuccguuucgacuccuggguaaaccaauucuacacacuagcccccaugggaaacggcaccggacgucgccgcgcauuauaa

SEQ ID NO: 36368 - RNA, 1623 nt, Artificial Sequence
  derived and/or modified sequence opt11 from VP1__Norovirus__BAJ13609
augaaaauggcaucuaaugacgccaaccccuccgacggcucagccgcaaaccuaguccccgaagucaacaacgaagucauggcccuggaaccagucgugggcgccgccaucgccgcaccugucgcuggccaacaaaacguuaucgauccauggaucagaaacaauuucguccaggcccccggcggcgaauuuaccgucucaccccgcaacgcacccggcgaaauacuguggucagcaccccucggccccgaucucaacccauaccuaucccaccucgcccgcauguauaacggcuacgccggcggauucgaaguacaagucauacuagccggaaacgcauucaccgccggaaaaaucauauucgcagccgucccacccaacuucccaaccgaagggcucucccccucccaagucaccauguucccacacauaaucgucgacguccgccaacucgaaccaguccucaucccccuccccgacguccgaaauaacuucuaccacuacaaccaaagcaacgacucaaccaucaaacucauugcaauguuauacaccccacuacgcgccaacaacgccggugaagacguuuucacgguauccugucgcguccucacacgacccucccccgacuucgacuucaucuuccuagugcccccaaccguagaaucucgcacaaaaccuuucaccguucccauccucaccguagaagaaaugaccaacucucgcuuccccauaccccuugaaaagcucuuuacuggcccuucauccgccuucguaguccaaccccaaaacggacgcugcaccaccgauggcguccuucuaggcacuacccaacuaucccccguaaacauuugcaccuuuagaggugacgucacucacaucgcaggauccagaaauuacaucaugaaccucgcauccuuaaacuggaacaacuacgaccccaccgaagaaaucccggcaccccuaggaacccccgacuucgucggcaagauccaaggcguacuaacccaaacuaccaaaggcgacggcuccacccgcggccacaaagccacuguuuacaccggcuccgcccccuucaccccgaaacuaggaucaguacaauucuccaccgacacagaaaacgacuucgaaacccaccaaaacaccaaauucacacccgucggcguaauacaagacggcuccacuacccaccgcaacgaaccacaacaauggguccuacccuccuacuccggacgcaacguacacaacguccaccuagcccccgccgucgcacccaccuuccccggagaacaacuacucuucuuccgcuccaccaugcccggcugcuccggcuaccccaacauggaccucgacugccuccucccccaagaauggguacaacacuuuuaccaagaagcagccccagcccaaucagacgucgcccuccuaagauuuguaaaccccgacacaggccgcguccucuucgaaugcaaacuccacaaauccggcuacgucacaguagcgcacaccggccaacacgaccucgucaucccaccuaacggcuacuuccgauucgacagcuggguaaaccaauucuacacacuuacccccaugggaaacggcaccggccgccgccgagcccuuuaa

SEQ ID NO: 36369 - RNA, 1623 nt, Artificial Sequence
  derived and/or modified sequence opt11 from VP1__Norovirus__BAJ13612
augaaaauggcguccaaugacgccaacccaucagacggaagugccgcuaaccucguacccgaagucagcaacgaagucauggcacucgaaccagucgucggcgccgcaaucgcugccccaguagcuggccaacaaaacgucaucgacccauggauccgcaacaacuucguacaagcccccggcggcgaguucaccguuucaccucgcaacgccccaggcgaaauacuaugguccgccccucuaggccccgaccuaaaccccuaccuaucccaccuagcacgaauguacaacggcuacgcaggaggauucgagguccaaguaauccucgcaggcaacgccuucaccgccggaaaaauaauuuuugcagccgucccacccaacuuccccacagaaggccuaucccccucccaaguuaccauguucccccacaucaucgucgacguccgacaauuagaacccguacuaaucccccucccagauguacgaaacaacuuuuaccacuacaaccaaucaaacgacuccaccaucaaacucaucgccaugcuauacacgccacuccgcgccaacaacgcaggcgaggacgucuucaccgucuccugccgcgugcuaacaagacccuccccagauuucgacuucaucuuccucguucccccuacagucgaaucccgcacaaaacccuucacaguaccaauccucacaguagaagaaaugaccaacucccgauucccaaucccacucgaaaaacuauuuacuggcccguccggagccuucguaguccaaccacaaaauggccgaugcaccaccgauggcguccuacuaggaaccacccagcuaucccccgucaacauaugcaccuucagaggcgacgucacccacaucgcaggaucccgaaacuacaccaugaaccucgccucacucaacuggaacaacuacgaccccacugaggaaauacccgccccacucgguacaccagauuucgugggcaaaauacaaggcguccucacccaaaccaccaaaggcgacgguuccaccagaggacacaaagccacagucuacaccggcuccgccccauucacacccaagcuaggcuccguacaauucuccacagacaccgaaaacgacuucgaaacccaccaaaauaccaaguucacucccgucggcgucauacaagacggcggaacaacacaccgcaaugagccacaacaauggguccuucccucauacuccgggcgagacguucacaacguacaccuagcccccgcuguagcacccaccuuccccggcgaacaacuacucuucuuccgaucaacaaugccaggcugcucagguuaccccaacauggaccucgauugccuccuuccucaagaguggguccaacacuucuaccaagaagccgcucccgcccaaagcgaugucgcccuacugcgcuucgucaaccccgacaccggccguguccucuucgaaugcaaacuccacaaauccggauacguaaccgucgcccacacaggacaacacgaccuaguaaucccacccaacggauacuuccgguucgacuccugggucaaccaauucuacacacucgcccccaugggcaacggcaccggccgacgucgcgcccuauaa

SEQ ID NO: 36370 - RNA, 1623 nt, Artificial Sequence
  derived and/or modified sequence opt11 from VP1__Norovirus__BAJ13615
augaaaauggcaucgaaugacgccaaccccuccgacggauccgcugcaaaccucguacccgaagucaacaacgaagucauggcacucgaacccgucguaggcgcugcaaucgcggcucccgucgcaggccaacaaaacgugaucgacccauggaucagaaauaacuuuguacaagcccccgguggcgaguucacagucucuccccgcaacgcaccaggagaaauccuuugguccgcaccccucggcccugaccucaacccguaccucucgcaccuagcccgaauguacaacggcuacgccggcggcuucgaaguucaagucauccuagccggcaaugcauucaccgcagguaaaaucaucuucgcugccguaccaccuaacuuuccaacagaaggccucuccccuucccaaguaacaauguucccccacaucaucgucgacguacgccaacuagaacccguccuaaucccccuacccgaugucagaaacaacuucuaccacuacaaccaauccaacgacucuaccaucaaacucaucgcaaugcucuacacaccccuccgugccaacaacgcuggcgaagacgucuucacagucuccugccgaguacucacccgccccucacccgacuucgacuucaucuuccuaguacccccaacaguagaaucccgaaccaaacccuucacaguaccaauacucaccgucgaagagaugaccaacucccgauucccuauuccccucgaaaaacuauucacaggacccucaggcgccuucguaguacaaccccagaacggccgaugcaccacagacggaguccuacucggaaccacacaacucucacccguuaacaucugcaccuuccgaggagacguaacccacauugccggcucccgaaacuacacaaugaaccuugcuucccucaacuggaacaacuacgaccccacagaagaaaucccagccccacucggaacaccagacuucguuggaaaaauucaagggguacugacccagaccacaaaaggcgacggauccacucggggucauaaagccacugucuacaccggcucagccccauucacccccaaacuaggcuccguacaauucuccaccgacaccgaaaacgacuucgaaacccaucaaaacacaaaauucacccccgucggcgucauccaagacggaggcaccacacaccgaaacgaaccccaacaauggguucucccaucauacuccggccgcaacguccacaacguccaucuagcccccgccguagcacccaccuuccccggagaacaacuccuuuucuuccgcucaaccaugccagguugcuccgguuacccaaacauggaccuagacugccuccucccccaggaauggguccaacacuucuaucaagaagccgccccagcccaauccgacgucgcucuccuccgcuucguaaaccccgacacaggccgcguccuauucgagugcaaacugcacaaaucgggcuacgucaccgucgcacacaccggccagcaugaccucguaauacccccaaacggcuacuuccgcuucgauuccuggguaaaccaauucuacacacucgcccccaugggcaacggcaccggacgccggcgcgcacucuga

SEQ ID NO: 36371 - RNA, 1623 nt, Artificial Sequence
  derived and/or modified sequence opt11 from VP1__Norovirus__BAJ13618
augaaaauggccucuaacgacgcaaacccaagcgacggcuccgccgcuaaucuuguacccgaaguuaacaacgaagucauggcucucgaacccguagucggagccgcgauagcugcacccgucgcaggacaacaaaacguaaucgacccauggaucagaaacaacuuuguccaagcccccggaggagaguucaccguaucuccccgcaaugccccaggcgaaauccuuugguccgcuccccucggcccagacuuaaaccccuaccuaucccaccuagcccgaauguacaacggcuacgccgggggcuucgaaguccaagucauccuagccggcaacgccuucacagccggcaaaaucaucuucgccgccguuccacccaacuuccccaccgaaggccuuuccccaucccaaguaaccauguucccccacaucauaguagacguucgccaacucgagcccguacuuaucccccuaccagacguccguaauaacuucuaccacuauaaccaauccaacgauucuaccauaaaacuuauagccaugcuauacaccccucuacgagccaacaacgccggugaagacgucuucaccgucucaugccgaguacuuacccgccccucccccgacuucgacuucaucuuccucguuccaccuacagucgaaucccgcaccaaaccauucaccguccccauacuaacagucgaagaaaugacuaacucacguuucccaaucccccuagaaaaacucuucaccggccccucauccgcuuucguuguacaaccacaaaacggccgcugcacaacagacggaguccuucuaggcaccacccaacuaucccccgucaacauaugcaccuuucgaggagacgucacccacauagccggaucccgcaacuacacuaugaaccucgccucccucaacuggaacaacuacgaucccaccgaggaaauuccugcaccccucggaacccccgacuucguaggcaagauucaaggaguccuaacacagaccacaaaaggagacggcuccaccagaggccauaaagccaccgucuacacaggcuccgccccauuuaccccaaaacucggcuccguccaauucucaacugacaccgaaaacgacuucgaaacccaccaaaauaccaaauucacccccgucggcguaauacaagacggcuccaccacccaccgaaacgaaccccaacaauggguccucccaucauacuccggacgcaacguccaaaacguacaccuugcccccgccgucgcacccacauuccccggcgaacaacuacuauucuuccgcuccacuaugcccgggugcuccgguuacccaaacauggaccucgacugccuccugccccaagaauggguacaacacuucuaccaagaagccgcccccgcccaaucagacgucgcgcuccuccguuucgucaaccccgacaccggccgcguccucuucgaaugcaagcuccacaaauccggauacguuaccguugcccacaccggccaacacgaucuaguuauacccccaaacggcuauuuccgauucgacucaugggucaaccaauucuacacacucgcccccaugggcaacggagccggcagacgccgcgcccucuaa

SEQ ID NO: 36372 - RNA, 1623 nt, Artificial Sequence
  derived and/or modified sequence opt11 from VP1__Norovirus__BAJ13621
augaaaauggcaucuaacgacgccaaccccuccgacggaucggcagccaaccucguccccgaagucaacaaugaagucauggcacucgaacccguagucggcgccgccaucgcagccccagucgcaggucaaaccaacgucauugaccccuggauccgcaacaacuucguccaagcacccggcggagaauuuaccguaucaccccgcaacgcaccaggcgagauucucuggagugcaccccucggacccgaccucaaccccuaucuuucucaccucgcccgcauguacaacggauacgccggaggcuucgagguccaagucauacucgcaggcaacgcauucaccgcaggcaaaaucaucuucgccgccguuccaccaaacuuccccaccgaaggccucucccccucacaagucaccauguucccccacaucaucguugacguccgccaacucgaaccaguucucauaccccuucccgacguccgcaacaauuucuaccacuacaaccaaucaaacgacuccacaauaaagcucauugcuaugcucuacacgccccuacgcgccaacaacgccggugaggacgucuucaccgucuccugccgcgugcucacucgccccuccccagacuucgacuucaucuuccucguacccccaaccgucgaaucccgcacaaagcccuucacagucccaauacucaccgucgaagaaaugaccaacucccgauuccccaucccccucgaaaaacucuucacaggucccucaggcgcauucgucguccaaccacaaaauggccgcugcacuacagacggagucuuacuaggaacaacccaacucucacccgucaacaucugcaccuuccgcggcgacgucacccauaucgccggaucccguaacuacacaaugaaccucgccucccuaaacuggaacaacuacgaccccacagaagagauccccgcaccccucgguacccccgacuucgucggcaagauacaagggguccucacacaaaccaccaaaggagacggauccacgcgaggccacaaagccaccguauacaccggaucugcccccuucacccccaaacucggcagcguccaauucuccaccgacacagaaaacgacuucgaaacccaccaaaacacaaaauucacccccguaggaguaauccaagacggauccacuacccaccgaaacgaaccccaacaauggguccuccccagcuacuccggccgcaacguccacaauguccaccucgcccccgcugucgcccccaccuuucccggcgaacaacuccuauucuuccgcucuacaaugcccggauguuccggauaccccaacauggacuuagacugccuacuaccacaagaauggguccaacacuucuaccaagaagcagccccugcccaauccgacguagccuuacuacgcuucgucaacccugacacgggcagaguacucuucgaaugcaaacuccacaaauccggcuacgucaccguagcccacaccggccaacacgaccucgucaucccacccaauggcuacuuccgauucgacucauggguaaaucaguucuacacccuugcacccaugggcaacggcaccggccgacgccgagcacuauaa

SEQ ID NO: 36373 - RNA, 1623 nt, Artificial Sequence
  derived and/or modified sequence opt11 from VP1__Norovirus__BAJ13624
augaagauggcauccaacgaugccaacccauccgacggaucggccgcaaaccuuguccccgaaguaaacaacgaagucauggcacucgaacccgucgucggcgcggcuaucgccgcaccagucgcuggacaacaaaacgucaucgaccccuggauccgcaacaacuucguccaagcccccggcggugaguucaccgucucaccacgcaacgcaccuggcgaaauccuuuggucugcaccccuuggacccgaccucaaccccuaccucucacaccuagcccgcauguacaacggcuacgccggcggguucgaaguucaaguaaucuuagcaggaaacgcuuuuaccgccggcaaaaucauauucgccgccgucccacccaacuuccccacagaaggccuaucacccucccaagucacaauguucccacacaucaucguugacgugcgccaacucgaacccguccuuaucccccuccccgacguccgcaacaacuucuaccacuacaaccaaucaaacgacuccaccaucaaacuuaucgccaugcuuuacacaccccuccgcgccaacaacgcaggcgaggacgucuuuaccgucucuugucgcguccucacccgccccucacccgacuucgacuucaucuuccuagucccucccaccguagaaucccgcaccaaacccuucaccguccccaucuuaaccgucgaagaaaugaccaacagccgcuucccaaucccccucgaaaaacucuuuaccggccccucauccgcauucgccguccagccacaaaacggccgcugcaccaccgacggaguccuccucggcacaacccagcuaucacccguaaacaucugcaccuuccggggcgacguaacccauaucgccggcucgcguaacuacacaaugaaccucgccucccucaacuggaacaacuacgaccccacagaagaaauacccgccccacucgguaccccugacuucguaggcaaaauccagggcguacuaacgcagaccacaaaaggcgacgguucgacacgcggccauaaagccaccguuuacaccggcuccgccccauucaccccaaaauuaggcagcguccaauuuucuaccgacaccgaaaacgacuucgaaacccaccaaaacaccaaauuuacccccguaggcgucauucaagacggcuccaccacccaccgcaacgaaccacaacaauggguacucccaucauacucaggccgcaacgucccaaacguccaccucgcccccgccgucgccccaacauuuccaggcgaacaacuccuauucuuccgcucaacaaugcccggcugcuccggauacccaaacauggaccucgacugccuacucccacaagaauggguccaacacuucuaccaagaagcugcaccagcacaauccgacgucgcacuccuccgauucguuaacccagacacaggaagaguacucuucgaaugcaaacuacacaaauccggauacguaaccgucgcccacaccggccaacacgaccuuguaauacccccaaauggauacuucagauucgacuccugggucaaucaguuuuacacucucgcccccaugggcaauggcacaggccggcgcagagcacucuaa

SEQ ID NO: 36374 - RNA, 1623 nt, Artificial Sequence
  derived and/or modified sequence opt11 from VP1__Norovirus__BAJ13627
augaaaauggcauccaacgacgccaaccccuccgacggcagcgccgccaaccucguacccgaaguaaacaacgagguaauggcacuagagccuguaguuggcgcagccaucgccgcccccguugccggucaacagaacguaauagacccguggauacgcaacaacuucguacaagccccaggaggcgaguucacagucucaccacguaacgccccgggcgaaauccucugguccgcaccucucggaccagaccugaacccauaccuaucccaccuagcacgcauguacaacggcuacgccggaggcuuugaaguccaggucauacucgccggcaaugcauucaccgccggcaaaauaaucuucgccgccguacccccuaacuuccccaccgaaggccucagccccucucaaguuacuauguucccacacaucaucgucgacguccgccaacuagaacccguccuaauuccccuaccugacguccgaaacaacuucuaccacuacaaccaaucaaacgacagcacaaucaaacucauugccaugcucuacacuccccuccgagcuaacaaugccggcgaagacguauucaccgucuccugccgaguccucacccgcccuuccccagauuuugacuucauuuuccucgucccacccaccgucgaaucccgcacaaaacccuucacaguccccauccuaaccgucgaagaaaugaccaacucacgcuucccaauaccucuagaaaaacuauucacaggucccuccggugcauucguuguccaaccacagaacggacgcugcacaaccgacggaguccuccucggaacaacccaacucucccccgucaacauaugcaccuuccgaggcgacgucacacacaucgccgguucucgagacuacacaaugaaccucgccucccucaacuggaacaacuacgaucccacugaagaaauacccgcaccccucggcacccccgacuucguuggaaaaauccaaggcguacuuacacaaaccacaaaaggcgacggaagcacccgaggccauaaagccaccgucuacaccggcagcaccccguucacccccaagcuaggcagcguccaauucagcaccgacaccgaaaacgacuucgaaacacaccaaaacaccaaauucacccccgucggcgucauccaagacggcuccacuacccaucgaaacgaaccccaacaauggguccuccccuccuacagcggccgcaacguccaaaacguacaccucgcccccgccgucgcacccaccuuccccggggaacaacuacucuucuuccgcuccaccaugcccggcugcuccggauaccccaacauggaccuagauugccuucucccacaagaauggguacaacacuuuuaccaagaagccgcaccagcccaauccgacguggcacuacuacgcuuuguaaacccagacaccggccguguacuuuucgaaugcaaacuccauaaaucuggcuacguaaccgucgcacacacaggccaacacgaccuagucauuccucccaacggcuauuuccgauuugacagcuggguaaaccaguucuacacacuagcccccaugggcaacggaaccggacgccgccgagcacucuaa

SEQ ID NO: 36375 - RNA, 1623 nt, Artificial Sequence
  derived and/or modified sequence opt11 from VP1__Norovirus__BAJ13630
augaaaauggcaucuuccgacgccaaccccucagacggguccgcagcaaaccucguccccgaaguaaacaaugaagucauggcccucgaaccagucgucggugcagccauagcugcaccagucgccggccaacaaaacgucaucgaccccuggaucagaaacaacuucguccaagcucccggcggcgaguucaccgucucccccagaaacgcccccggcgaaauccucugguccgcaccacucggccccgaccucaaccccuaccuuucacaccucgcacguauguauaacggauacgcaggcggcuucgaaguccaaguaauccuagccggcaacgccuucaccgcaggcaaaaucaucuucgccgccguaccacccaacuuccccacagaaggacuuucgcccucccaagucaccauguucccucacauuauaguagacguacgccaacucgaacccgugcucauaccccugcccgacguacgcaacaacuucuaccacuauaaccagagcaacgacuccaccauaaaacuaaucgccaugcucuacacaccccuaagagcaaacaacgcaggcgaagacgucuucaccgucucaugccgcguacuuacccggcccucacccgauuucgacuucaucuuccucgucccacccaccguagaaucaagaacuaaacccuucaccgucccaauccuuaccgucgaagaaaugaccaacucacgcuuccccaucccccucgaaaaacucuucaccggccccuccuccgcuuucguaguccaaccccaaaacggccgcugcaccacagacggcguccuacuaggcacaacccaacucucccccgucaacauauguacauuuagaggagacgugacccauaucgcaggcucccgcaacuacaccaugaaccucgccucacucaacuggaacaacuacgacccaaccgaagaaaucccugccccucuaggcacccccgacuucgucggaaaaauacaaggcguccucacccagacuaccaaaggcgacggcuccacacgugggcacaaagcuaccguuuacacaggcuccgccccauuuaccccaaaacuuggcuccguucaauucuccaccgacaccgaaaacgacuucgaaacccaccagaacaccaaguucaccccugucggaguaauacaagacggcggcacaacacaccgcaacgaaccccaacaauggguccuccccuccuacucuggccgcaaugucccaaacguccaccuagcccccgccgucgcccccaccuucccaggcgaacaacuacuguucuuccgcuccaccaugcccgguugcuccggcuaucccaacauggaccucgacugccuacuaccccaagaauggguacaacacuucuaccaagaagccgcacccgcacaauccgacguagcacuacuacgcuucguaaauccagacacuggacguguccucuucgaaugcaaacuccacaaagccggauacguaaccgucgcacauacaggacagcacgaccucgucaucccacccaacggcuacuucagauucgacuccugggucaaccaauuuuacacucuagcucccaugggaaacgguaccggccgucgccgagcgcucuaa

SEQ ID NO: 36376 - RNA, 1623 nt, Artificial Sequence
  derived and/or modified sequence opt11 from VP1__Norovirus__BAJ13633
augaaaauggccuccaacgaugcaaaccccucagauggaucagccgccaaccucguccccgaagucaacaacgaagucauggcacuugaaccagucgucggagcagcaaucgcagcaccugucgcaggucaacaaaacguaaucgacccauggauccgaaacaacuucguccaagcccccggcggggaauuuacagucucaccccgcaaugcccccggagaaauccucugguccgcaccacuagguccagaccugaacccauaccuaucccaccucgcccguauguacaacggcuacgccggcggcuucgaaguacaaguaauacuagcaggcaacgccuucaccgccggcaagauaaucuucgcagccgucccucccaacuuccccaccgaaggccucucacccucacaaguuacuauguucccccauaucauuguagacguccgacaacucgaaccaguccuaaucccacucccagacguccgcaacaacuucuaccacuauaaccaauccaacgacuccaccaucaaacuuaucgccaugcuauacaccccacuccgagccaacaacgcaggcgaagacguauucaccguauccugucgcguccucacccgcccaagccccgacuucgacuucaucuuccuaguaccucccaccgucgaaucgcgaaccaagccauucaccguccccaucuuaaccguagaagaaaugaccaacucacgcuuccccauuccccuagaaaagcuauucaccggacccuccucagccuucgucguacaaccacaaaacggacgaugcacaaccgacggaguccuccucggcaccacacaacugagcccuguaaauauaugcaccuuccgaggcgacgucacacacaucgcaggcucacguaacuacaccaugaaccucgccucccucaacuggaacaacuacgacccuaccgaagaaauaccagcuccccucggcacccccgacuucgucggcaaaauucaaggagugcuaacucaaaccacuaaaggcgacggcuccacccgcggccacaaagccaccgucuacaccggcucagccccauucacccccaagcucggcucuguucaauucuccaccgacacagaaaacgacuucgaaacacaccaaaacacccgcuucacacccguaggcgucauccaagacggcggcacaacucaccgaaacgaaccucaacaauggguucuccccucauacuccggccgcaacguacccaacguccaucuagcccccgccguagcaccaaccuuccccggcgaacaacuccucuucuuccgcuccaccaugcccggcugcuccggcuaccccaacauggaccucgacugccuccuaccccaggaauggguccaacacuucuaucaagaagcagcccccgcccaauccgacguagcccuccuccguuucgucaaucccgacacaggccgcguccucuucgaaugcaaacuccacaaauccggcuaugucacugucgcccacaccggucaacacgaccuagucauaccacccaacggcuacuuccgcuucgacuccuggguaaaccaauucuacacacucgcucccaugggcaacggcaccggcagaagacgcgucucauag

SEQ ID NO: 36377 - RNA, 1623 nt, Artificial Sequence
  derived and/or modified sequence opt11 from VP1__Norovirus__BAJ13636
augaaaauggccuccaacgaugcaaacccaucugacggauccgcugccaaccucguaccagaaguaaacaacgaagucauggcccuugaacccguaguaggcgcagccaucgcagccccagucgcaggccaaaccaacguaauagaccccuggauccgcaauaacuucguccaagcccccggaggagaguucaccgucagcccccgaaacgcacccggagaaauacucugguccgcaccccuuggccccgaccucaaccccuaccuaucacaccucgcucguauguacaacggcuacgcaggcggcuucgaaguccaagugauacucgccggcaacgccuucacugcuggcaaaaucaucuucgccgccguaccucccaacuuucccaccgaaggccucucucccucucaagucaccauguucccccacauaauaguugacguucggcaacucgaacccgugcucaucccccuccccgacguacgcaauaacuucuaccauuauaaccaauccaacgacuccacuaucaaacuaaucgccaugcucuacacaccccuacgugcaaacaacgccggugaagacguauucaccguuucaugccguguccuaacccgacccucccccgacuucgacuuuauauuccucguaccucccaccgucgaaucacgcaccaaaccuuucaccguccccauacucacaguagaagaaaugaccaacucccgauuccccaucccccucgaaaaacuauucaccggccccucgggcgcauucgucguccaaccucagaacggccgcugcaccaccgacggcguccuccucggcaccacacaacuaucaccuguaaacauaugcacuuuccgaggcgacguaacccacauagcaggcagccgcaacuacacaaugaaccucgccucucuaaacuggaacaacuacgaccccaccgaggaaauccccgcgccccuagguacacccgacuucgucggcaagauccaaggcgucuuaacacaaaccaccaaaggagacgguucaacacgaggccacaaggccaccguauacaccggcuccgcccccuucacaccaaaacuaggauccguacaauucucaacagacacagaaaacgacuucgaagcccaccaaaauaccaaauucacccccguaggaguaauacaggacggcagcaccacccaucggaacgaaccacaacaauggguccuaccaucauauucaggacgaaacguccaaaacguacaccucgcccccgcagucgccccaacauucccaggcgaacaacuucucuucuuucgcucuaccaugcccggaugcuccgguuauccaaacauggaccucgacugccuacucccacaagaauggguccagcacuucuaccaagaggcagcccccgcgcaauccgacgucgcccuccuacgcuuugucaaccccgacacaggacgcguccucuucgaaugcaagcuccacaaauccggauacguaaccguugcccacacaggucaacaugaccuagugaucccuccuaacggauacuuccgcuucgacuccugggucaaccaauuuuacacccucgcaccuaugggcaacggaacaggccgacgcagagcccucuaa

SEQ ID NO: 36378 - RNA, 1623 nt, Artificial Sequence
  derived and/or modified sequence opt11 from VP1__Norovirus__BAJ13639
augaaaauggcuuccaacgacgcuaaccccagcgauggaucagcagccaaccuaguacaagaagucaacaacgaagucauggcccucgaaccagucguuggcgcagccauagcggcccccguagcaggccaacaaaauguaaucgaccccuggaucagaaacaacuucguccaagcacccggcggcgaauuuacagucagcccacgaaaugcacccggagaaauacucugguccgcaccccuaggaccugaccuaaauccuuaccuaucccaccuagcccgcauguacaacggauacgcaggcggguuugaaguacaaguaauccucgccggaaacgccuucacggccggcaaaaucaucuuugccgcaguuccacccaacuuccccaccgagggccucucccccucccaaguuaccauguuuccccacaucaucguggacguccgccaacucgaacccguacucauuccccuccccgacguccgcaacaacuuuuaucacuacaaccaauccaacgacucaaccauuaaacucauagcaaugcucuacacaccacuccgcgccaacaacgcaggcgaagacgucuucaccguaucaugccgaguccuuacccgccccucaccagacuuugacuucauauuccucgucccacccacggucgaaucacggaccaaacccuucaccguccccauacuaaccgucgaagaaaugaccaacuccagguuccccauaccacucgaaaaacucuucaccggcccauccucugccuucgucguccaaccacaaaacggccggugcacaacagacggcguccuccuaggcaccacucaacucucccccguaaauaucuguaccuuccgaggcgacgucacucauauagccggcucccgcaacuacaucaugaaccucgccucccuaaacuggaacaauuacgacccuacagaagaaaucccagcuccccuagguaccccugacuucgucggcaaaauccaaggaguccucacccaaacaaccaagggcgacggcagcaccagaggccacaaagccaccgucuacacaggauccgcucccuucaccccaaaacuaggauccguucaauucaguacugacacugaaaacgacuucgaaacccaccaaaauaccaaauuuacccccguuggaguuauccaagacggcucaaccacacaccgcaacgaaccccaacaauggguccucccuuccuacuccggcggcaacguacacaacguccaccucgccccagccguagcccccacauucccaggcgagcaacuucuauucuuccgauccaccaugcccggcugcucuggcuauccuaacauggaucucgacugucuacuaccccaagaauggguacaacacuucuaccaagaagccgcccccgcucaaucugacguagcacuccuucgauucguaaacccagacacuggacguguacuauucgaaugcaaacuccacaaguccggauacgugaccguagcacacaccggccaacacgaccucgucaucccacccaacggauacuuccgauucgacucgugggucaaccaauucuacacccucgcccccaugggcaauggcacaggaagacgccgcgcucucuaa

SEQ ID NO: 36379 - RNA, 1623 nt, Artificial Sequence
  derived and/or modified sequence opt11 from VP1__Norovirus__BAJ13642
augaagauggccucaaaugacgcuaaccccuccgacggaucugcagcaaaccucguacccgaaguaaauaacgaagucauggcacucgaacccgucguaggcgccgccaucgccgccccaguagcuggccaaacaaacgucaucgaccccuggaucagaaacaacuucguacaagcuccuggaggcgaguucaccgucuccccucgcaacgcccccggcgaaauacucuggucagccccucuuggccccgaccucaaccccuaccuaucucaccuagcccgcauguacaacggcuacgccgguggcuucgaaguccaaguaauccuagccggcaacgcauuuaccgcggguaaaauaauauucgccgcaguuccuccaaacuucccaaccgaaggacuaagcccaucccaggugaccauguucccccacauaauaguagauguacgacagcucgaacccguucucaucccucuacccgacguccguaacaacuucuaccacuacaaccaauccaacgacucaacaaucaaacucauagccaugcuauacaccccacuccgcgcaaacaacgccggagaagacgucuucaccguaucuugcagaguccucacucgccccucccccgacuucgacuucauauuccugguaccacccaccguagaaucaagaaccaaaccauucacuguccccauauuaaccgucgaagaaaugaccaacagccgcuuccccaucccacucgaaaaacucuucacaggacccuccggcgcauucgucguccaaccacaaaacggacgaugcaccaccgacggcguacuacuaggaaccacccaacucucccccgucaacauaugcaccuucagaggcgacgucacccacauagcuggcucgcgcaacuacaccaugaaccucgccucccuaaacuggaauaacuacgaccccaccgaagaaauccccgcaccccucggcaccccagacuucguaggcaaaauccaaggaguccucacacagacaaccaaaggcgacgguuccacccgcggacacaaagccacagucuacaccgguagcgcccccuucacccccaaauuaggcucuguacaauucuccaccgacaccgaaaacgacuucgaagcccaccaaaacacaaaauucacccccgucggugugauccaggacggcagcacuacacaccgcaaugaaccacaacaauggguccuacccagcuacuccggcagaaacguacaaaacguccaccucgcccccgccguugccccaaccuuccccggagaacaacuccucuucuuccgcucgacaaugcccgguugcuccggcuacccaaacauggaccuagauugccuccucccccaagaauggguccaacacuucuaccaggaagcugcacccgcacaaucugacgucgcacuacuccgcuucgucaaccccgacaccggccgcgucuuauucgaaugcaaacuccacaaauccgguuacgucacagucgcacacacaggccaacaugaucuagucaucccucccaacggcuauuuccgcuucgacuccugggucaaccaauucuacacccuggcaccuaugggcaauggcacaggccgccgcagagcccucuaa

SEQ ID NO: 36380 - RNA, 1623 nt, Artificial Sequence
  derived and/or modified sequence opt11 from VP1__Norovirus__BAJ13648
augaaaauggccucaaacgacgccaaccccagcgacggcuccgccgcaaacuuagucccagaagucaacaacgaaguaauggcccucgaaccaguaguaggugccgccaucgccgccccugucgcaggccaacaaaacgucaucgaccccuggauccgaaacaacuucguccaagccccgggcggcgaguucaccgucuccccgagaaacgccccuggggaaauccucugguccgcuccccucgguccagaccuaaacccauaccucucacaccuagcccgcauguacaacggauacgccggcggauucgaaguacaagucauccucgccggaaacgccuucacggccggcaaaauaauauucgccgcagucccacccaacuuccccacagaaggacucucccccucccaaguaacaauguucccccacaucauuguagacguccgacaacucgaaccaguccuuaucccccuacccgacguucgaaacaacuucuaccacuacaaccaauccaacgacagcacaauaaaacuuauagccaugcucuacaccccacuucgcgcaaacaacgcaggcgaagacguauucacagucuccugccgcguccuaacccgccccucccccgacuucgacuucaucuuccucgucccucccaccguagaaucccguacaaaacccuucaccguccccauacuaacagucgaagaaaugaccaacucccgcuucccaaucccccucgaaaaacuuuucacaggucccuccggcgcguucgucguccaaccccaaaacggccgcugcaccacugacggaguccuccucggcaccacacagcugucccccgucaacaucuguaccuuccgcggcgacgucacccacaucgcgggcagccgcaacuauacaaugaaccuugcaucacucaacuggaacaauuacgaccccacagaagaaaucccagcaccccucggcacacccgauuucgucggcaaaauucaaggcguccuaacacaaaccaccaaaggcgacggauccacucgcggccacaaagccaccguauacaccggcuccgccccauucacacccaaacuaggauccgugcaauucucaaccgacaccgaaaacgauuuugaaacccaccaaaacaccaaauucaccccagucggagucauacaggauggcggcacuacccaccgaaacgaaccacaacaauggguucuccccuccuacucaggaagagacguccacaacguccacuuagcaccagccguagcccccacauuccccggcgaacaguuacucuucuucagauccacaaugcccggcugcucaggauaucccaauauggaccucgacugccuacucccccaagaauggguccaacacuuuuaccaagaagccgcacccgcacaaucugacgucgcacuacuacgcuucgucaaucccgauaccggacguguccuauucgagugcaaacuacacaaaagcggcuacgucaccguagcccacacgggccaacacgaccucguuauucccccaaacggcuauuuccgguucgacucaugggucaaccaauucuacacauuagccccaaugggcaacggaacaggacgccgacgcgcacucuag

SEQ ID NO: 36381 - RNA, 1623 nt, Artificial Sequence
  derived and/or modified sequence opt11 from VP1__Norovirus__BAJ13651
augaaaauggcguccaacgacgcaaacccuuccgacggauccgccgcaaaccuaguccccgaaguaaauaacgaagucauggcacuagaaccagucgucggcgccgcaaucgccgcccccgucgcuggacaacaaaacgucauugaccccuggauccgcaacaacuucguccaagcgcccggaggcgaauuuaccgucucaccccgaaacgcccccuccgaaauacuuugguccgcaccccuagguccagaccucaacccauaucucucacaccucgcccgcauguacaacggcuacgccggaggauucgaagugcaaguaauuuuagcuggcaacgcauucaccgcgggcaaaaucaucuucgccgccgucccucccaauuuccccacagaaggccuuucaccaucucaagucaccauguucccccacaucauagucgacgugcgacaacuagaaccaguacucauuccccuccccgacguucgcaacaacuuuuaccacuacaaccaauccaacgacucgacaaucaaacucaucgccaugcucuacacaccccuacgcgccaacaacgcaggggaagacgucuucaccgucuccugccgcgugcuuacccgucccucacccgacuucgacuucauauuccucguacccccaaccgucgaaucccgaacgaaaccauucacuguccccauccucaccgucgaagaaaugaccaauucccgcuuccccaucccacucgaaaaacucuuuacaggcccaucgucagcauucguuguacagccacaaaacggccgcugcacuacagacggaguccuccucggcacuacccaacucucccccgucaacaucugcaccuuucgcggcgacgucacccacaucgcaggcucacgcaacuacacaaugaaccucgcauccauaaacuggaacaacuacgaccccaccgaagaaauccccgccccacucggaacacccgacuucguagggaaaauucaaggaguccuaacccaaaccacuaaaggagacggcuccacccguggacacaaagccaccgucuacaccggcagcgcaccauuuacccccaaacucggauccguacaauucucaacugauaccgaaaacgacuucgaaacccaucaaaacaccaaauucaccccagucggcgucauacaggacggaggcaccacucaccaaaaugaaccucaacaaugggugcuccccggcuacuccggccguaauguacccaacguacaccucgcaccagccguagcaccaaccuucccaggagaacaacuccuuuucuuccgaucaacuaugcccggcugcuccggauaccccaacauggaccucgacugccuacuuccacaagaguggguccaacacuucuaccaagaagccgcccccgcgcaauccgacguggcccuccuccgguuugucaaccccgauaccggacguguccucuucgaaugcaaauugcacaaaucaggcuacgucacagucgcacacacgggccaacacgaucucguuaucccucccaacggcuacuuccgauucgauuccugggucaaccaauucuacacccucgcacccaugggcaauggcaccggacgccgccgugcacucuaa

SEQ ID NO: 36382 - RNA, 1623 nt, Artificial Sequence
  derived and/or modified sequence opt11 from VP1__Norovirus__BAJ13654
augaaaauggcaucaaacgacgccaaccccuccgacggaucagccgccaaccucguacccgaagucaacaaugaaguaauggcgcuugaacccgucgugggcgccgccauagccgccccagucgccggccaacaaaaugucaucgaccccuggauccgcaauaacuuuguccaagcccccggcggagaguucaccgucuccccacgcaaugcacccggcgaaauccucuggucagcaccccucggccccgaccucaaccccuauuuaucccaccucgcucgcauguauaacggauacgccgguggcuuugaaguccaaguaauccucgccggaaacgcauucaccgccggcaagaucaucuuugccgccguacccccaaacuucccaacagaaggccucucccccucccaagucacaauguucccccacauuaucgucgacguacgacaacucgaaccuguccucauuccccucccagacguccgaaacaacuucuaccacuauaaccaauccaacgacuccacuaucaaacuaauugcaaugcuuuacacgccccuccgcgcaaacaaugcuggagaagaugucuucacagucaguugccgcguacucacgcgcccaucccccgacuucgacuucaucuuccuuguacccccaaccaucgaaucccgcacaaaacccuucacuguaccaauacucaccguggaagaaaugacaaacucacgcuuccccauuccccucgaaaaacucuucaccggccccuccggcgccuucgucguacaaccccaaaauggacgcugcaccaccgacggcguccuacuugguaccacccaacuaucccccgucaacaucuguaccuucagaggcgauguaacccauaucgccggaucccgcgauuauaccaugaaucuggcuucacuaaacuggaacaacuacgacccuaccgaagaaauccccgccccacucggcacccccgauuucgucggcaagauccagggcguccucacacaaacaaccaaaggcgacggcagcacccguggacacaaagccaccgucuacaccgguucagcccccuucaccccuaagcucggcuccguccaauucucaaccgauaccgaaaacgacuucgagacccaccaaaacaccaaauucaccccagucggagucauccaggacggaagcaccacccaccgcaacgaaccucaacaauggguccuacccuccuacuccggccgaggaguccacaacguacaccucgcuccagcuguagcccccaccuuccccggagaacaacuacuauucuuccgcuccacaaugcccgggugcuccgguuaccccaacauggaccuugacugucuacucccccaagaauggguccaacacuucuaccaagaagcagcccccgcccaaucagacgucgcacuccuccgcuucguaaaucccgacaccggacgaguccucuucgaaugcaagcuacauaaauccggcuacguaaccgucgcccacacaggccaacacgaccucgucaucccacccaacggcuacuuccgauucgacuccugggucaaccaauucuacacgcucgcucccaugggcaacggcacaggccgccgccgcgcccucuaa

SEQ ID NO: 36383 - RNA, 1623 nt, Artificial Sequence
  derived and/or modified sequence opt11 from VP1__Norovirus__BAJ13657
augaaaauggccucaaacgacgcuucccccuccgacggcuccgccgccaaccuagucccagaagucaacaacgaagucauggcccuagaacccguaguaggcgcagcaaucgcugcccccguagccggccaacaaaacguaaucgacccuuggauccgcaacaacuuuguacaagcacccggaggcgaguucaccguaucccccagaaacgcacccggagaaauacucugguccgcuucucucggcccagaccucaacccuuaccucucccaccuagcccgcauguauaacgguuacgccggaggauucgaaguacaaguaauccuugcaggcaacgccuucacugccgggaaaauaauauucgccgccgucccacccaacuuccccaccgaaggccuaucacccucacaaguuacaauguucccccacaucaucguagacguccgccaacucgaacccguccuaaucccccuacccgacguccgcaacaacuucuaccauuacaaucaauccaaugacuccaccaucaagcucaucgccaugcucuacacaccacuacgcgcgaacaacgccggagaagacgucuucacagugucaugccgcguccucacaagaccaucccccgacuucgacuucauauucuuagucccaccaaccgucgaaucacgcacuaaacccuucaccguccccauccucaccgucgaagaaaugaccaacucacguuuccccauccccuuagaaaaacucuucacaggccccucaucagcuuucgugguacagccccaaaacggacgaugcacaacagacggaguccugcuaggcaccacccagcucagccccguaaacaucugcaccuuuagaggcgacgucacccacaucgcaggcucccgaaacuauacaaugaaccuagccucccuaaacuggaacaacuacgacccaaccgaagaaauccccgccccucucggcacacccgacuucgucgguaaaauccaaggcgucuuaacccaaacaacaaaaggugacggcuccacccgcggacacaaggccacugucuacaccggcucagcccccuuuacccccaaacucggcucaguacaauucuccaccgacaccgaaaacgacuucgaaacgcaccaaaauacgaaauucacacccguaggagucauccaagacggcggaacaacacaccgcaacgaaccacaacaaugggugcuccccuccuacagcggccgcaacguacaaaauguacaccucgcccccgccgucgcucccaccuuccccggcgaacagcuacucuucuuccgcucuaccaugcccggcugcuccggcuacccaaacauggaccuggacugucuccucccccaagaguggguccaacacuucuaccaagaagccgcaccagcccaauccgacgucgcucuccugcgcuucgucaaccccgacaccggccgaguccucuucgaaugcaaacuccacaaauccggcuacguaaccgucgcacacacaggccaacacgaccucgucauaccucccaauggauacuuccgcuucgauucuuggguaaaccaauucuauacccuagcccccaugggaaacggcacaggcagaagacgagcccucuga

SEQ ID NO: 36384 - RNA, 1623 nt, Artificial Sequence
  derived and/or modified sequence opt11 from VP1__Norovirus__BAJ13660
augaagauggcuucaaacgacgcaaacccauccgacggauccgcagccaaccucguaccagaaguaaacaacgaagucauggcacuagagcccguggucggcgccgccaucgcagcacccguagccggccaacaaaacgucaucgacccuuggauccgaaacaacuucguucaagcuccaggcggcgaauuuaccgucagcccccgcaaugcccccggagaaauaccaugguccgcuccccucggccccgaccucaauccuuaucuaucccaccuggcccguauguacaacggauacgccggagguuucgaaguccaaguaauccuagcugguaaugcauucaccgccggcaagaucauauuugccgcagucccucccaacuuccccaccgaaggccuaucacccucucaagucacaauguucccccauaucaucgucgacguccgccaacucgaacccguccucaucccccuccccgacguccgcaacaauuucuaccacuacaaccaaucaaacgacucuaccaucaaacucaucgccaugcucuacacaccccuccgcgcaaacaacgccggcgaagacguuuucaccgucucaugccgcguccucacccgccccucacccgauuucgacuucaucuuccucguaccaccaaccguagaaucacgcaccaaaccuuuuaccguccccauccucacagucgaagaaaugacuaacucccgcuucccaaucccucucgaaaaacuauucaccggcccauccuccgccuucgucguccaaccccaaaacggccgaugcaccaccgacgguguccuccuaggaaccacccaacucagccccgugaacaucugcacauuccgcggcgacgucacacacaucgccggcucacgagacuacaccaugaaccuagccucacucaacuggaacaacuaugacccaaccgaagaaauccccgcaccccuaggcacgcccgacuucgucggcaagauccaagguguccucacccaaacaaccaaaggcgacggcucaacccguggccacaaggccacagucuacacuggcucagccccauucacaccaaaacuaggaucaguacgcuucuccacagauaccgagaacgacuuugaaacacaccaaaacaccaaauuuaccccagugggcgucauccaagacggcuccaccacacaccgcaacgaaccccaacaauggguccuucccuccuauuccgggcgagauguccacaacguacaucucgcucccgccgucgcccccaccuuccccggcgaacaacuacucuucuuccggaguacaaugccaggcugcuccggcuaccccaauauggaccuagacugccuccucccccaagaauggguacaacacuucuaccaagaagccgcaccagcccaauccgacgucgcccuccuccgcuucguaaacccagauacgggcagaguucucuucgaaugcaaacuucacaaauccggguacgucacaguagcacacaccggacagcacgaccucguaauucccccaaacggauacuuccgcuucgacuccugggucaaccaguucuacacccucgcacccauggguaacggcaccggccgccgccgcgcccucuaa

SEQ ID NO: 36385 - RNA, 1623 nt, Artificial Sequence
  derived and/or modified sequence opt11 from VP1__Norovirus__BAJ13663
augaaaauggccuccaacgacgccaacccauccgacggaagugccgccaaccucgucccagagguaaacaaugaaggcauggcacucgaacccgucgucggugccgccaucgccgcccccguagccggccaaaccaacgucaucgacccauggauccgaaacaacuuuguacaagcccccggcggcgaguucaccguaucccccagaaacgcgcccuccgaaauccuaugguccgccucacuuggccccgaccucaaccccuaccucucucaccuagccagaauguacaacggauacgcaggcggauucgaaguccaaguaauccucgccggaaacgccuucaccgccggaaaaauaauuuucgccgccguacccccaaacuucccaacugaaggacucucacccucccaagucacuauguucccccacauaaucgucgacguccgacaacuagaacccguacucaucccacuacccgacguaagaaacaacuucuaccacuacaaccaaucuaacgacucaaccauuaagcucauagccaugcuauacaccccucuccgcgccaacaaugcaggcgaagacguauucaccgucuccugcagaguucucacacgcccuucuccagacuucgacuucaucuuccucguuccacccacugucgaaucccgcaccaaacccuucacaguccccauccucacaguagaagaaaugacaaacucacguuuucccauaccccuagaaaaauuauucacugggcccucaggagccuucgucguccaaccacaaaauggccgcugcaccaccgacggcguacuccuaggcaccacgcaacucucccccguuaauauuugcaccuuccgcggcgacgucacacacaucgcaggcucacgcaacuacaccaugaaccucgccucccuaaacuggaacaacuacgaccccaccgaagaaauacccgcaccccuaggaacccccgacuuugucggaaaaauacaaggcguccucacccagacaaccaaaggcaacgguucaacacggggucacaaagccacggucuacaccggcuccgccccuuucaccccgaaacucggcuccguccaauucucaaccgacacagaaaacgacuuugaaacccaccaaaacacaaaauucacaccugucggcguaauccaagacggaucaacaacucaccgcaaugaaccacagcaauggguacucccauccuacuccggucgcuccguacacaacguccaccucgcccccgcugucgcacccaccuuccccggcgaacaacuacuauucuuccgcucaaccaugcccggcugcuccggcuaccccaacauggaccuagacugccuccucccgcaggaauggguccaacacuuuuaccaagaagccgcucccgcacaaagcgacguagcacuccuccgcuuuguaaaccccgacacaggucgaguucucuucgaaugcaagcuccacaagagcggauacguuaccguugcccauaccggccaacacgaccucgucauucccccuaacgguuacuuccgauucgacuccugggucaaccaauucuacacccuugccccaauggguaacggcacaggucgccgccgcgcccuauaa

SEQ ID NO: 36386 - RNA, 1623 nt, Artificial Sequence
  derived and/or modified sequence opt11 from VP1__Norovirus__BAJ13666
augaaaauggccucuaaugacgcaaaucccuccgacggauccgccgcuaaccucguccccgaaguuaacaacgaagucauggcucucgaacccgucgucggcgccgcuaucgccgcccccguagccggccaacagaacguaaucgaccccuggauccgaaacaacuucguccaagccccaggcggcgaguucaccgucagcccccgcaacgccccaggagaaauccuaugguccgccccacucggccccgaccucaacccauaccuuucccaccucgcccgcauguacaacggauacgccggaggauucgaaguccaagucauacucgccggcaacgccuuuaccgccggcaaaaucaucuuugcagcaguaccucccaacuuccccaccgaaggccucucccccucucaagucaccauguucccccacauaauagucgacguccgacaacucgaacccguacuuaucccccuccccgacguacgaaacaacuucuaccacuacaaccaauccaacgacucaaccauaaaacuuaucgcuaugcucuacacuccccucagagcaaacaaugccggcgaagacgucuucaccgucagcugccgcguccuaaccagacccucuccagacuuugauuuuaucuuccuugucccacccaccgucgaaucacgcaccaaacccuucaccguccccauccucaccgucgaagaaaugaccaacucucgcuuccccauaccccucgaaaaacuauucaccggccccuccuccgcuuucguaguccaaccccaaaacggacgaugcaccaccgacggcguacuucuggguaccacccaacucucccccguaaacaucugcaccuucagaggugacaucacccacauugcaggcucccgcaacuacaccaugaaucuugccucccuaaacuggaacaacuacgacccgacagaagaaauccccgcaccccucggcacccccgacuucguaggcaaaauccaaggcguccuuacccaaaccacaaaaggcgacggauccacucgcggccacaaagcuaccgucuacaccggcucugcacccuuuacccccaaacuaggcaguguccaauucuccaccgacacagaaaacgacuucgaaacacaccagaacaccaaauucaccccugucggugucauccaagacggcagcacgacccaccgaaacgaaccccaacaauggguucuccccuccuacuccggucgcaaugcccacaacguccaccucgcccccgcaguagcacccacuuucccgggcgaacaacuucucuucuuccgcucuaccaugcccggcugcucaggcuacccaaacauggaccucgacugccucuuaccacaagaauggguacaacacuuuuaccaagaagcagcacccgcacaaagcgacguggcacuccuccguuucguaaaccccgacacaggccgaguccucuucgagugcaaacuucacaaauccggcuacgucaccguggcccacaccggucaacaugaucucguaauaccuccaaacggcuauuuccgcuucgauuccuggguaaaccaauucuacacacucgcacccaugggcaacggcacaggacgccgccgcgcacucuaa

SEQ ID NO: 36387 - RNA, 1623 nt, Artificial Sequence
  derived and/or modified sequence opt11 from VP1__Norovirus__BAJ13669
augaaaauggcauccaacgacgcaaaccccuccgacggcucagccgcuaaccucguucccgaagucaacaacgaagucauggcauuagaaccaguaguaggagcggccaucgccgcccccguagccggccaacaaaacguaaucgacccauggauccgcaacaauuuuguccaagcucccggcggagaauuuaccgucagcccacgcaacgcucccggcgaaauacuuuggucugcgccccuaggacccgaccucaaccccuaucucucccaccuagcccgcauguacaacggguacgcaggcggauucgaaguccaagugauauuagcaggaaacgcauucaccgccggcaaaaucauauucgccgcagucccacccaacuuccccaccgaaggccuaucccccucacaggucacaauguucccccacaucaucguagauguccgccaacucgaaccaguccuaaucccccucccagacguacgcaacaacuucuaucacuacaaccaaucgaaugacucaaccaucaaacucauagccaugcucuacacuccccuccgcgcaaacaacgccggcgacgacgucuucaccguaagcugccgcguacucacacgcccaagccccgacuucgacuucaucuuucucgucccacccacuguagaaucacgcacgaaaccauucacagucccaauacugaccgucgaagaaaugaccaacucaagauuccccaucccccuagaaaaacuguucacuggccccucauccgccuucgucguacaaccccaaaacggccgcugcaccaccgacggaguucuccuaggaacaacccaacucuccccggucaacaucugcacauucagaggagacguaacacacaucgccgggucccgcaacuacaccaugaaccuagccucccucaacuggaacaacuacgaccccacagaagaaauacccgccccacucggcacucccgacuucgucggcaaaauccaagggguccucacacaaaccacaaaaggagacggcucaacacgcggccacaaagccaccgucuacaccggaagcgccgauuuuacccccaaacucggcuccguacaauuuggaaccgacacagaaaacgacuucgaaacacaccaaaacaccaaauucaccccuguaggcgucauccaagacggcagcaccacacaccgaaacgaaccacaacaauggguacuacccucauacuccggcagaaacguacacaauguccaccucgcucccgccgucgcacccaacuucccaggagaacaacuccuauucuuccgcagcacaaugcccggcugcuccggcuaucccaacauggaccucgacugccuccucccucaagaauggguccaacacuucuaccaggaagccgcacccgcacaaucugacgucgcccuccuacgcuucgucaaccccgacacaggacgaguccucuucgaaugcaagcuacacaagucaggcuacguaaccguugcccacacaggccaacacgaccucgugauaccacccaacggcuacuuccgcuucgacagcugggucaaccaauuuuacacgcuagccccaaugggaaacggcacaggacgccgccgugcuuuauaa

SEQ ID NO: 36388 - RNA, 1623 nt, Artificial Sequence
  derived and/or modified sequence opt11 from VP1__Norovirus__BAJ13672
augaagauggccagcaaugacgccaaccgcuccgacggcuccgccgccaaccucguccccgaaguaaacaacgaagucauggcccuagaacccgucgucggcgccgccaucgcugcccccgucgccggacagcaaaacguuauagacccauggauacgaaacaauuucguacaagccccaggaggcgaguucacugucagccccagaaacgcaccuggcgaaauccucuggucagcuccccuaggcccagaccucaaccccuaccuaucccaccuagcacgcauguauaacggauacgccggcggcuucgaaguacaagucauccucgcaggcaacgccuucaccgcaggcaagauuauuuucgcagccguacccccaaacuuccccacagaaggacuaucccccucccaagucaccauguucccccacaucaucgucgacgucagacaacucgaacccguccuaaucccccucccagacgucagaaacaacuucuaccacuacaaccaaucuaacgacagcaccaucaaacucaucgccaugcuguacacucccuuacgagccaacaacgccggagaagacguauucaccgucuccugccgcguccucacaagacccagcccagauuucgacuucauauuccucguaccacccaccguugaaagccgcacaaaaccauucaccguacccauacucaccguagaagagaugacaaacucccgauuccccaucccacucgaaaaacucuuuacuggccccucgagcgcuuucguaguccaaccacaaaacggccguugcacaaccgacggcguccuucuaggcaccacccaacucucccccguaaacaucugcaccuuccgaggcgacgucacccauaucgccggcagccgaaacuacacaaugaaccucgcaucccuaaacuggaacaacuaugacccaaccgaagagauccccgcuccccucggaacacccgacuucgucggcaaaauccaagguguacuaacccagaccaccaaaggagacggcagcacccgcggccacaaagcaaccgucuauaccggcuccgcccccuuuacacccaaauuaggaagcguccaauucuccaccgacacugaaaacgauuucgaaacccaccaaaacaccaaauucacccccgucggcguuauccaagacggcucaaccacccaccgcuccgaaccccagcaauggguccuucccuccuacucaggacgaaacguccccaacguccaccucgcccccgccguugcccccaccuucccuggagaacaacuacuuuucuuccgcuccacaaugccaggaugcuccggauaccccaauauggaccuagacugucuccucccccaagaauggguacaacauuucuaccaagaagccgcccccgcccaguccgacguagcccuccuccgcuucgucaacccagauaccggccgcguacucuucgaaugcaaacuccacaagucuggcuacgugaccgucgcccacacaggccaacacgaccuagucaucccacccaacggcuacuuccgcuucgacagcugggucaaccaauucuacacucucgcccccaugggaaacggcacuggacgacgccgcgcucuauaa

SEQ ID NO: 36389 - RNA, 1623 nt, Artificial Sequence
  derived and/or modified sequence opt11 from VP1__Norovirus__BAJ13675
augaaaauggcauccaacgacgcgaaccccagcgacggcuccgcagccaaucucguccccgaggucaacaacgaagucauggcccucgaaccagucgucggagccgccaucgcagccccuguagcaggucaacaaaacguaauagaccccuggauacgaaacaacuucguucaagcacccggcggcgaguucaccgucucaccccgaaacgccccaggagaaauccuuuggucagcaccccucggccccgaccucaaccccuaccuaucccaccuugcacgcauguacaacuccuacgccggcggcuucgaaguacaagucauccuagccggaaacgccuucaccgcaggcaaaaucauauucgccgccgugcccccaaacuuccccacagaaggccucuccccaucccaagucaccauguucccccacaucauagucgacguacgacaacuagaacccguccuaauccccuuacccgacguccgaaacaacuucuaccacuacaaccaguccaacgacucuaccauaaaacuaaucgcaaugcucuacaccccucuccgcgccaacaaugccggcgaagacgucuucaccgugucaugccgcguucucacccgccccucccccgacuucgauuuuaucuuccucguacccccuacugucgaaucuaggaccaaacccuucaccgucccaauacucacagucgaagaaaugaccaacucccgcuuccccaucccgcucgaaaaacucuucacaggccccucauccgcauucgugguccaaccccaaaacggacguugcacaacagauggcguccuacuaggaaccacccaacucucaccagucaacaucugcaccuuccgcggagacgugacccacaucgccggcucccgaaacuacacaaugaaccucgccucacucaacuggaacaacuacgaccccacagaagaaaucccagcaccgcucggaacccccgacuucgucggcaaaauccaaggcguccucacccaaaccaccaagggagacggauccacucguggucacaaagcaacaguauacaccggcuccgcuccuuucacaccaaaacugggcucaguccaauucucuaccgauaccgaaaacgacuucgaaacccaccaaaacaccaaauucaccccagucggaguuauacaagacggcgguaccacucaccgaaacgaaccucaacaauggguccuaccuucauacuccggacgugacguccacaacguccaccuagcaccagccgucgccccuaccuuccccggcgaacaacuacucuucuuccgaagcaccaugccaggcugcucgggcuaccccaacauggaccuggacugccuccuuccacaagaauggguccaacacuucuaccaagaggccgcacccgcccaauccgacgucgcccuccuacgauucguaaacccagacacaggacgcguucuauucgaaugcaaacuccacaaauccggauacgucaccguagcccacacgggccaacacgaucucguuaucccacccaacggcuacuuccgcuucgacucauggguuaaccaauucuacacacuagccccaaugggaaacggaacaggacgaagacgcgcccuauaa

SEQ ID NO: 36390 - RNA, 1623 nt, Artificial Sequence
  derived and/or modified sequence opt11 from VP1__Norovirus__BAJ13678
augaaaauggccuccaaugacgccaacccuucagacggcuccgcagcuaaccuaguaccugaagucaacaacgaagucauggcccuagaacccguaguaggcgcagcgaucgcggcacccgucgcaggccaaaccaacgucaucgaccccuggauacgaaacaacuucguccaagcccccggcggcgaguucacagucagcccccgaaacgcucccggagaaauccucuggucagcuccccuuggacccgaccucaacccguaccucucccaccucgcccgcauguacaacggcuacgccggcggcuucgaaguccaaguuauccuagcaggcaacgccuucaccgccggcaaaaucaucuucgcagccgucccacccaauuuccccaccgaaggccucucccccagccaagugaccauguucccccacauuaucgucgacguccgccaacucgaacccguucuuaucccccuccccgacguccgcaacaacuucuaccacuacaaccaaucaaacgacucaaccaucaaacuuaucgcaaugcuuuacacaccccuacgcgcaaacaacgcuggcgaagacgucuucaccguaucaugccgaguccucacccgacccucccccgacuuugacuucauauuccucgucccacccaccgucgaauccagaaccaagcccuucaccgucccuauacucaccguagaagaaaugacaaacucccgcuuccccauaccccuagaaaaacuguucaccgguccauccggagcauucguuguacaaccccaaaacggccgaugcaccacagacggaguccuacucggcaccacccaacuuucccccguaaauaucugcacguuucgcggcgacguuacacacaucgccggcucacgcgacuacaccaugaaccucgcuuccuuaaauuggaacaauuacgaccccacugaagaaauccccgcaccccucggaaccccagacuucgucggcaaaauccaaggcguccugacccaaacaaccaaaggugacggguccacccgcggucacaaagccaccguauacaccggcuccgccccauucaccccaaaacucggcucaguccaauucucgacagacacagaaaaugacuucgaagcccaccaaaacacuaaauucacaccaguaggcgucauccaagacggcucuacuacccaccgcaaugaaccacaacaauggguccuaccuuccuacaguggacgaaacguccaaaacguacaccuagcccccgccguugcacccaccuuucccggagaacaauuacucuucuuccgcuccaccaugccaggaugcuccggauauccuaacauggacuuagauugccuccuaccccaagaauggguacaacacuucuaccaagaagccgcucccgcccaaucagacgucgcucuccuccgcuucgucaaccccgacacgggccguguccuguucgagugcaaacuccacaaaagcggcuacgucaccguugcucacaccggccaacacgaccucgucaucccgcccaacggcuacuuccgauucgacuccuggguuaaccaauucuacacacuagcacccaugggcaauggaacaggccgacgccgagcccucuaa

SEQ ID NO: 36391 - RNA, 1623 nt, Artificial Sequence
  derived and/or modified sequence opt11 from VP1__Norovirus__BAJ13681
augaaaauggccuccaacgacgcaucaccuucagacggcuccgccgccaaccuaguccccgaaguaaacaacgaaguuauggcccucgaacccgucguaggugcagcuaucgccgcacccgucgcaggccaacaaaacgucauagacccauggauccgcaauaacuucguccaagcccccggcggagaguucaccguaucaccgagaaacgccccaggcgaaauccuauggucagccccacucggaccagaccucaaccccuaccucucacaccucgcccgaauguacaacggcuacgcaggcggcuucgaaguccaagucauccucgcagguaacgccuucacagccggaaaaaucaucuucgcagccguucccccaaacuuccccaccgaaggacucucgcccucccaagucaccauguucccacacaucaucgucgacguccgccaacucgaaccaguccuaaucccacuacccgauguccgcaacaacuucuaccacuauaaccaaucaaacgacagcaccauuaaacuuauugcaaugcucuauaccccacuucgagccaacaacgccggggaagacgucuuuaccguauccugccgcgucuuaacacgacccucacccgacuucgacuucaucuuccucgucccacccacgguagaaucccgaaccaaacccuucacagucccaauacuaacagucgaagaaaugaccaacucacgauuccccaucccccucgaaaaacuauucacgggacccucauccgccuuugucguccaaccccaaaacggucgaugcaccaccgacggaguccuacuaggcaccacacagcuaucucccgucaacaucugcaccuuccgcggcgacgucacccacaucgccggaucccgaaacuacaccaugaaucucgcaucacucaacuggaacaacuacgacccaaccgaagaaauacccgcaccucucgguacacccgacuucguaggcaaaauacaaggaguccucacccagaccaccaaaggcgacggcuccaccagaggccacaaagccaccgucuacaccggcagcgccccuuucacccccaaacuaggcagcguccaauucuccacagacaccgaaaacgacuucgaaacccaucaagacaccaaauucacuccagucgguguaauccaagacggaggaaccacacaucgcaacgaaccacaacaauggguccuccccuccuacucaggaagaaacguacaaaacguccaccucgcccccgcaguugcacccaccuuccccggagaacaacuuuuauucuuccguuccacaaugcccggcuguucuggauaccccaacauggaccucgacugccuccuaccccaagaauggguccaacacuucuaccaagaagccgcaccagcccaaucagacguugcccuacuacgcuucgucaacccggacaccggacguguacucuucgagugcaaacuccacaagucaggcuacgucaccguagcacacacgggacaacacgaucuagucauaccaccaaacggcuacuuccgcuucgacucaugggucaaccaauucuauacccucgcccccauggguaacggaaccggccgacguagagcacucuaa

SEQ ID NO: 36392 - RNA, 1623 nt, Artificial Sequence
  derived and/or modified sequence opt11 from VP1__Norovirus__BAJ13684
augaaaauggcauccaacgacgcaagccccucagacggguccgccgccaaccucguacccgaagucaacaaugaagucauggcccuagaacccguaguuggcgccgcaaucgcagcgccagucgccgggcaacaaaacguaaucgaccccuggauccgaaacaacuuuguacaagcccccggcggcgaguucaccgucucaccacgaaacgccccaggcgaaauacuaugguccgccccacuaggccccgaccucaacccauaccucucccaccuagcccgaauguacaacggcuacgccggaggcuucgaaguacaagucauucucgccggcaacgcauucacagccggaaaaauuaucuucgcagccgucccacccaacuuccccacagaaggacucucccccagccaagucacaauguucccccauaucaucgucgacguucgccaacucgaaccaguacucauaccccuacccgacguacgaaacaacuucuaccacuacaaccaauccaacgacuccaccaucaaacuaaucgcaaugcucuacacaccccuucgcgccaacaacgcuggugaagacgucuucaccgucagcugccgcguucucaccaggccaagccccgauuucgacuucaucuuucuugucccucccaccgucgaaucacgcacuaaacccuucaccguccccauccuaaccgucgaagaaaugacuaacucccgcuucccaaucccccuggaaaaacucuuuaccggccccucgagcgcauucgucguacaaccgcaaaacggccgcugcaccaccgacgguguacuacucggcacaacucaacucucccccguuaauaucugcaccuuccgcggcgacgucacccacauagccggcucccgaaacuacaccaugaaccucgucagccuuaacuggaacaacuacgaccccaccgaggaaaucccagcuccccucggaacccccgacuucguuggcaaaauccaaggcguacucacacaaacaacgaaaggggacggaucaacccgcggccacaaagccacagucuacacaggcuccgcccccuucaccccuaaacuugguuccguccaauucuccaccgacaccgagaaugacuucgaaacccaccaaaacaccaaauucacccccguaggcguaauccaagacggcucaaccacccaccguaacgaaccacaacaauggguccuaccaucauauagcgggcgcaacguccacaacguacaccuagcaccagccgucgcccccaccuuccccggugaacaacuccucuuuuuccgcucaacuaugccaggcugcucaggcuaccccaauauggaccucgacugccuccucccccaagaguggguccaacacuucuaccaagaagccgcuccugcccaauccgaugucgcccuacuacgauucguaaaccccgauaccggcagaguccuauucgaauguaaacuucacaaauccggcuacguuacugucgccuacaccggccaacacgaccucguuaucccucccaacggauacuuccgguuugauucaugggucaaucaauucuacacacucgcccccaugggcaauggcaccggcagacgccgcgcucucuaa

SEQ ID NO: 36393 - RNA, 1623 nt, Artificial Sequence
  derived and/or modified sequence opt11 from VP1__Norovirus__BAJ13687
augaaaauggcauccaaugacgccaacccauccgacggauccgcagcaaaccuaguccccgaagucaacaacgaagucauggcccucgaacccguaguuggcgccgccaucgccgcuccggucgccggacaacaaaacgucauagaccccuggauccgaaauaacuucguccaagccccaggcggcgaauuuaccguaucaccccgaaacgcacccggagagauccuuugguccgcaccccucggcccagacuuaaaccccuaccuaucccaccucgcccgcauguacaacggauaugccggcggcuuugagguccaaguuauacucgcugguaaugccuucaccgcuggcaaaauaaucuuugccgccgucccucccaacuuccccacggaaggccucucccccucacaaguaacaauguucccccacaucauagucgacguacgccaacuagaacccguacucauuccacucccagacguccguaauaacuucuaccacuacaaccaguccaacgacuccaccaucaaacuaaucgccaugcucuacacuccccuccgagcuaacaacgccggagacgacgucuucacagucuccugccgcguccuaacccgccccagcccugacuucgacuucaucuuccucgucccaccaaccguugaaucacgaaccaagcccuucacggucccaauccuaaccgucgaagaaaugaccaacuccagauuccccaucccacucgaaaaacuauucacaggacccucauccgccuucaucguacaaccucaaaacggccgcugcacaacagacggaguccuccucggaaccacccaacucucccccgucaacaucugcaccuuccguggcgacguaacacacaucgccggcucccgcaacuacacaaugaaccucgcaucccuuaacuggaacaacuacgaucccaccgaagaaauccccgcgccccuagguaccccagacuucguaggcaaaauccaaggaguccuaacccaaaccaccaaaggugacggcagcaccagagggcacaaagccaccgucuacacaggcuccgccgacuuuacccccaaacucggauccguccaguucgguaccgacaccgaaaacgacuucgaaacacaccaaaacacaaaauucacccccguaggaguaauccaggacggaagcacaacacaccgaaacgaaccacagcaauggguacuccccuccuacucaggccgcaacguacacaacguacaccucgcacccgcagucgccccgaacuuucccggcgaacaacuccucuucuuccgcucaacaaugccuggcugcuccggcuaccccaacauggaccucgacugccuccucccccaagaauggguccaacacuucuaccaagaagccgcaccagcccaauccgacgucgcccuacuacgauucgucaaucccgacaccggacgcguccuuuucgaaugcaaacuccacaaaucaggcuacguaacugucgcacacaccggccaacaugaucuugucauacccccaaacggauacuuccgauucgacuccuggguaaaccaauucuacacacucgccccaaugggcaacggcacuggccguagacgagcacuauaa

SEQ ID NO: 36394 - RNA, 1623 nt, Artificial Sequence
  derived and/or modified sequence opt11 from VP1__Norovirus__BAJ13690
augaaaauggccucaaacgaugcuaaccccuccgacgguucagccgcaaaccugguccccgaagucaacaacgaaguaauggcacuagaacccguugucggagcagcaaucgccgcaccagucgccggccaacaaaacguuauagaccccuggauucgaaacaacuucguccaggcuccaggcggcgaguucaccguuuccccacgcaacgcccccggugaaauccucuggucugcaccccuuggacccgaccuaaauccauaccuuucccaccucgcccgcauguacaacggcuacgcaggcgguuucgaaguccaaguaauacucgccggaaacgccuucaccgccggcaaaaucaucuucgccgccgucccacccaacuucccaacugaaggccucucccccucccaagucaccauguucccacauaucaucgucgacguacgacaacuggaacccguccucauacccuuaccagacguccgaaacaacuucuaccacuacaaucaaucaaacgacagcaccauaaaauuaaucgcaaugcuauacacaccacuccgugcaaacaacgccggugacgacgucuucacagucucaugccggguccuuacccguccauccccagacuucgacuucaucuuccucguacccccuaccgucgaaucccgaacuaaacccuucaccguccccauucuaaccgucgaagaaaugacuaacucacgcuuccccaucccccucgaaaaacuauucacaggcccaagcucagccuucgucguccaaccacaaaacggacgcuguacaacugacggcguccugcugggcaccacccaacucucaccugucaacaucugcaccuuccgcggcgacgucacacacauagccggcucucgcaauuacaccaugaaccucgcaucccuaaacuggaacaauuacgaccccacagaagagauccccgccccacucggcacaccagacuucgucggcaaaauucaaggcgugcuaacacaaacaaccaaaggcgacggcuccacucgaggccacaaagcaacagucuacaccggcucagcccccuucacccccaaacucggaucaguccaauucucuacagacaccgaaaacgacuucgagacacaccaaaacacaaaauucaccccaguuggagucauccaagacggcuccaccacacaccgcaacgaaccccaacaauggguacuaccauccuauuccggucgcaacguacacaacguacaccucgccccugcaguugccccaaccuuccccggcgaacaacuccucuucuucagauccaccaugcccggcugcagcggcuacccaaacauggaccucgacugccuccucccacaagaauggguccaacacuuuuaccaagaagcagcccccgcccaauccgacguagcacuccucagguucgucaaccccgacaccggccgaguccucuucgaaugcaaacuccacaaaucaggcuacgucaccguggcccacaccggccaacacgaccuaguaauaccuccuaauggauacuuccgcuucgacuccuggguaaaccaauuuuacacccucgcccccaugggaaacggaacaggcagacgccgcgcccuauga

SEQ ID NO: 36395 - RNA, 1623 nt, Artificial Sequence
  derived and/or modified sequence opt11 from VP1__Norovirus__BAJ13693
augaaaauggccucaaacgacgccaaccccuccgacggcuccgcagcaaaccucguccccgaagucaacaacgaagucauggcccucgaacccguagucggugccgccaucgccgcccccguagccggccaacaaaacgucauagacccuuggauacgcaacaacuuugucaaagccccaggcggcgaguucacaguuucuccccgaaacucccccggcgaaauccucugguccgcuccccuaggccccgaccucaaccccuaccucucccaccucgcccgcauguacaacggcuacgcaggcggcuuugaaguacaagucauccuagccgguaacgccuucacagcaggcaaaaucauauucgcagccguacccccuaacuuccccaccgaaggacucucucccucccaagucaccauguucccacacauaaucgucgacguacgccaacuagaaccaguacucaucccccuccccgacguccgcaacaacuucuaccauuauaaccaguccaacgacucaaccauaaaacuaaucgcaaugcuauacacaccccuccgggccaacaacgccggcgacgacgucuucaccgucucaugccgcguacuaacucgccccuccccagacuucgacuuuauauuccucgugccaccuacuguugaaucccgcaccaagcccuucacaguacccauacucaccgucgaagaaaugaccaacucacgcuuccccaucccacucgagaaacucuuuaccggcccuuccuccgccuucauuguccagccccaaaauggccggugcaccaccgacggaguacuacuuggcaccacccagcucuccccugucaacaucugcacauuucgcggcgacgucacccacaucgccggcucccgcaauuacacaaugaaccuugcaucccucaacuggaacaacuacgaccccaccgaagaaguacccgcaccucuaggaacacccgacuuuguaggcaaaauacaagguguauuaacacaaacuaccaaaggugacggcucaacccguggccacaaagccaccgucuacaccggcucagcugacuuuacucccaaauuaggcuccguccaauucggcaccgacacagaaaacgacuucgaaacccaccaaaacaccaaauucaccccaguaggcgucauccaagacggcucaaccacacaccgcaacgagccacaacaauggguccuccccagcuacucgggccgcaauguccauaacguacaucuagccccagccguugccccuaacuuccccggcgaacaacuccuuuucuuccgcaguacaaugcccggcugcucaggauaccccaacauggaccuagacugccuccucccccaagaauggguacaacacuucuaccaggaagccgccccggcccaaucagacgucgcccuccuacgcuucgucaaccccgacaccggacggguacuuuucgaguguaaacuccacaaauccggcuacgucacugucgcccacaccggccaacacgaccuugucaucccacccaacggcuacuuucgcuucgacuccuggguaaaccaauuuuacacucuagcccccaugggaaacggcaccggacgccgacgcgcacuauaa

SEQ ID NO: 36396 - RNA, 1623 nt, Artificial Sequence
  derived and/or modified sequence opt11 from VP1__Norovirus__BAJ13696
augaaaauggcauccaacgacgccaaccccuccgacggcucagcggcuaaccucgucccugaagucaacaacgaagucauggcccucgaaccaguuguaggcgcagccauagccgccccgguagcaggacaacaaaaugucaucgaccccuggauccgaaacaacuucguccaagccccuggcggagaguucaccgucucaccccgcaacgcccccggagaaauacucuggucagcaccccuaggccccgaccucaaccccuacuuaucccaccuugcccguauguacaacggcuacgccggcggcuucgaaguacaaguaauuuuagcaggcaacgccuucacugccggaaagaucaucuucgccgcagucccacccaacuuccccacagaaggcuuaucucccucacaagucaccauguucccccacaucaucguagacguucgccaacucgaacccguccuaaucccacucccagacguccgcaacaacuuuuaccacuacaaccaauccaacgacucuaccauuaaacucauagcaaugcuauacacgccccuacgcgccaacaacgccggugaagaugucuucaccgucagcugccggguccucacccgacccagccccgacuucgacuucaucuuucucgucccgcccacagucgaaucacgcaccaaacccuucaccguccccauccucaccguagaagaaaugaccaacucccgcuuccccaucccccucgaaaaacucuucaccgguccauccuccgccuucguaguccaaccccaaaacggccgaugcacaaccgacggcguccuccucggcacaacacaacuaucgccagucaacaucugcaccuuucgcggagacgucacccacaucgcagguucccgcaacuacaccaugaaccuugcaucacucaauuggaacaacuacgaucccaccgaagaaauccccgcaccccucggcacacccgacuucguaggaaaaauccaaggcguacuaacccaaaccacaaaaggcgacggcucaacccgcggccacaaagccaccgucuacaccggcuccgccccauucacccccaaacucgguuccguccaauuuuccaccgacacugaaaacgauuucgaaacccaccaaaacacccgauucaccccugucggagucauccaagacggcggcacaacccaccgaaacgaaccacaacaauggguacuccccuccuacucaggccgcaacguucccaacguccaccuggcccccgccgucgcccccacauucccaggcgaacaacuccuauucuucagauccacuaugcccggcugcucaggauauccaaacauggaccuagacugccuacuaccccaagaauggguccagcauuucuaccaagaagccgccccagcccaauccgacgucgcccuacuccguuucguuaacccagacaccggucgcguacucuucgaaugcaaauuacacaaaucaggauacguuaccgucgcccacaccggccaacacgaccucguaauuccgcccaacggcuacuuccgcuucgacucuuggguaaaccaauucuacacucuagccccaaugggaaauggaacuggucgccgccgaguccuuuaa

SEQ ID NO: 36397 - RNA, 1623 nt, Artificial Sequence
  derived and/or modified sequence opt11 from VP1__Norovirus__BAJ13699
augaaaauggcauccaacgacgcaaaucccagcgauggcucagccgccaaccucguucccgaaguuaacaacgaagucauggcccucgaacccguugucggggccgccaucgcugcucccgucgcaggccaacaaaacgucauugaccccuggauacgaaacaacuucguccaggcuccuggcggggaauuuaccgucucuccccgcaaugcaccaggcgaaauucuaugguccgcaccccucggucccgaccuaaaccccuaccuuucccaccuagcccguauguacaacggcuacgccggaggcuucgagguacaaguaauccuggccggcaacgccuucaccgccgguaaaaucauuuucgccgccgucccaccaaacuuccccaccgaaggccuauccccaucccaaguaaccauguucccacacauaaucguagacgugcgacaacuugaacccguacucauuccccuucccgauguccguaacaacuucuaccacuacaaccaauccaacgacuccaccauaaaacugaucgccaugcucuacacaccccuucgugcgaacaacgccggcgaagacgucuucaccguauccugccgcguucucacacgacccucccccgacuucgacuucaucuuccuaguaccacccaccgucgaaucccgaaccaaacccuucacaguccccauacucaccguugaagaaaugaccaacucccguuuccccaucccucuagaaaaacuauucaccggcccuucaggcgcauucgucguccaaccccaaaacggccgaugcaccacugacggcguccuacucggcaccacccaacucucuccagucaacaucuguacauuccgcggcgacgucacacacaucgccggcucccgcaauuacaccaugaaucucgcagcccucaacuggaacaauuacgaccccacagaagaaaucccugcgccccucggcaccccagacuucguuggaaaaauacaaggcguccucacacagaccacaaaaggagacggauccacgcguggccacaaagccacugucuauacaggcucugccgacuuuacccccaaacuaggcuccguccaguucucaacagacacagaaaacgacuucgaaacccaccaaaacacaaaauuuacucccguuggcgucauccaggacggcucaacaacccaccgcaacgaaccccaacaauggguacucccauccuacuccggccgaaacguccacaacguccaccucgcccccgccgucgccccaaccuuccccggcgaacaacuucucuucuuccgcuccaccaugcccggcuguuccggcuaccccaacauggaccucgacugucuaaucccccaagaauggguacaacacuucuaccaagaggccgcccccgcccaauccgacguagcacuccuccgauucgucaaccccgacaccggccgcguccucuucgagugcaaacuacacaaauccggcuacgucaccguagcccacaccggccaacacgaccuugucauaccgcccaacgguuauuuccgcuuugacuccugggucaaccaguucuacacgcuagcccccaugggaaauggcgcgggccgacgacgagcacuauaa

SEQ ID NO: 36398 - RNA, 1623 nt, Artificial Sequence
  derived and/or modified sequence opt11 from VP1__Norovirus__BAJ13702
augaaaauggccuccaacgacgccaaccccuccgacggcuccgccgccaaccuaguacccgaagucaacaacgaaguuauggcacucgaacccgucgucggcgccgcaaucgccgcccccgucgccggacaaaccaauguuauagaucccuggauacgcaacaacuucguccaagcccccgguggcgaguucaccgucucaccccgcaacgcaccuggcgaaauacucuggucggcaccccugggccccgaccuuaacccauaccucucccaccuagcccgcauguauaacggcuacgcaggcggcuucgagguccaagucauacuggccggaaacgccuucaccgccggcaaaaucaucuucgccgcaguacccccaaacuuucccaccgaaggacuauccccaucccaagucaccauguucccucacaucaucgucgacguccgccaacucgaacccgucuuaaucccacucccugacguccgaaacaacuucuaccacuacaaccaauccaacgauucaaccauaaaacucaucgcaaugcuauacacaccccuccgagccaacaacgccggagaagacguauucaccgucucaugcagaguccucacccgccccagccccgacuuugacuucaucuuucucgucccucccaccguugaaucuagaaccaaacccuucacgguccccauacuaaccgucgaagaaaugacaaauucccgcuuccccauuccucucgaaaaacucuucaccggacccagcggcgcauucgucguacaaccccaaaauggacgcugcaccaccgacggcguccuccucggaaccacacaacucucccccgucaauauaugcacauuccgcggcgacgucacccacaucgccggcucacgaaacuacaccaugaaccucgccuccuuaaacuggaauaacuacgacccaacagaagaaaucccugccccacuaggaacacccgacuucguagguaaaauucaaggaguccucacccaaaccacaaaaggcgacggauccacucggggccacaaagccaccgucuacaccggaucggcccccuucaccccuaaacucggcuccguacaauucuccaccgacacagaaaacgacuucgaagcccaccaaaauacaaaauuuacucccgucggcgucauucaagacggauccaccacccaccgcaacgaaccccaacaauggguccucccguccuauucuggucgcaacgcccaaaacguccaccuugcacccgccguagcccccaccuuccccggcgaacaacuacucuucuuccgaagcaccaugccuggaugcuccggauacccaaacauggaccuagacugucuccucccacaagaguggguccaacacuuuuaccaagaagccgccccagcacaaucagacgucgcccuucuccgcuucgucaacccagacaccggccgcguccucuucgaaugcaagcuccacaaaucugguuaugucaccgucgcccacacaggacaacacgaucucgucaucccucccaacggauacuuccgcuuugacuccugggucaaccaauucuacacccucgcccccaugggcaacggcaccggacgaagacgagcacucuaa

SEQ ID NO: 36399 - RNA, 1623 nt, Artificial Sequence
  derived and/or modified sequence opt11 from VP1__Norovirus__BAJ13711
augaaaauggcauccaacgacgccaaccccucugacggcuccgcagccaaccucgucccugaagucaacaaugaagucauggcccucgaacccgucguaggagcagcaaucgccgcaccagucgcagcccaacaaaacguaauugacccauggauacgcaauaacuucguacaggcccccggcggagaguucaccguaucuccccgaaacgcaccauccgaaauccucugguccgccccacucggaccagaccugaaccccuaccucucacacuucgcccguauguacaacugcuacgccggcggauucgaaguucaagucauucuagccggaaacgcauucaccgcaggcaaaaucauuuucgccgcagucccacccaacuuccccaccgaaggccuaucccccucucaaguaaccauguucccccacauaaucgucgacguccgccaacucgaacccguacucauaccccuccccgacguccgcaacaacuucuaccacuacaaccaguccaacgacucaaccaucaaacucaucgcaaugcucuacacaccccuccgagccaacaacgccggcgaagacgucuucaccgucucaugccggguccuaacccgccccucacccgauuucgacuucaucuuccucgucccacccaccguagaaagccguaccaaacccuuuaccguccccauccuuacagucgaagaaaugacaaacucccgauuccccauaccccucgaaaaacucuucaccgguccauccucagcauucgucguccaaccccaaaacggccgcugcaccaccgacggcguccuacucggcaccacccagcuaucacccguaaacaucugcaccuuccgaggcgacgucacccacauagccggcucucgcaacuacacaaugaaccuugccucucuaaacuggaacaacuacgacccaaccgaagagauaccagcaccucucggcaccccugacuucgucggaaaaauccaaggcguacuaacccaaaccaccaaaggcgacggcuccacacgcggacacaaagccacaguguacaccggcucagcaccauucacccccaaacucggcuccguucaauucucuaccgacaccgaaaaugacuucgaaacacaccaaaacaccaaauucacccccguaggcguuauccaagacggagguaccacccaccgaaacgaaccucaacaauggguccucccuuccuacucuggccgcaacguccccaacguccaccucgcccccgccguagcccccacauuccccggagaacaacuccuauucuuccgauccaccaugccuggcugcucaggcuacccaaauauggaccuagacugccuucuuccccaagaauggguccagcacuucuaucaagaagcagcccccgcccaaucugacguagcauuacuccguuucgucaaucccgauaccggacgcguccucuucgagugcaaacuacacaaaucuggcuacguuaccgucgcccacaccggccaacacgaccuggucauacccccuaacggauacuuccgcuucgacuccugggucaaccaauucuacacccucgcccccaugggcaacggaacaggccgaagacgcgcacuauag

SEQ ID NO: 36400 - RNA, 1623 nt, Artificial Sequence
  derived and/or modified sequence opt11 from VP1__Norovirus__BAJ13714
augaaaauggcuuccuccgacgccaaccccuccgacggcucagcugccaaccucguacccgaagucaacaaugaagucauggcacuagaaccugucgucggagccgccaucgccgcccccgucgccggccagcaaaacgucauagacccguggauucgcaacaacuucguccaagcacccggcggagaguucaccguaaguccccgcaaugccccaggcgaaauccucugguccgccccgcuaggccccgaccuuaaccccuaccucucccaccuagccaggauguacaacggguacgcaggcggauucgaaguacaagucauccuagccggaaacgccuucaccgccggaaaaaucauuuucgcagccgucccaccuaacuuccccaccgaaggccucucccccucccaagucaccauguucccacacauaaucgucgacguccgacaacucgaaccaguccucaucccccuaccagacguccguaacaacuucuaccacuacaaccaauccaaugacuccaccaucaaacuaaucgccaugcuuuacaccccucuccgcgcaaacaacgccggcgaagacgucuucacagucucaugucgaguccucaccagaccuagcccagacuucgacuucaucuuccucguucccccuacaguagaaucccgcaccaaaccauucacuguccccauccucaccgucgaagaaaugaccaauucccgcuuccccaucccccucgaaaaacucuucaccggacccucaggagccuucgucguccaaccccaaaacggucgaugcacaacagacggcguccuucuaggaaccacucaacucagcccagucaacaucugcaccuuccgcggcgacguaacccacaucgcuggcucccgaaacuacaccaugaaccucgccucacucaacuggaacaacuacgaccccacagaagaaauccccgcaccccucggaacccccgacuucgucggaaaaauccaaggaaugcucacccagaccaccaaaggugacggaucuacccgcggccauaaagccacagucuacaccgguuccgcuccauucacccccaaacucggcucaguccaauuuucuaccgacacagaaaacgacuucgaaacacaccaaaacaccaaauucaccccaguagguguuauccaggacggcuccacaacccacagaaacgaaccccaacaguggguccuacccuccuacucaggcagagacguccacaacguacacuuagcaccagcagucgcaccaaccuuccccggugaacaacuccucuucuuccgauccaccaugcccggcugcucaggcuaccccaacauggaccucgacugccuacucccccaagaauggguccaacacuucuaccaagaagccgcaccagcucaauccgacgucgcccuacuccgcuucguaaaccccgacaccggccgcguucuauucgaauguaaacuccacaaaucuggcuacgucaccgucgcccacaccggccaacacgaccucgugaucccacccaacggauacuucagauucgacagcugggucaaucaauucuacacucuagcacccaugggcaacggcacaggacgccgacgcgcacuauaa

SEQ ID NO: 36401 - RNA, 1623 nt, Artificial Sequence
  derived and/or modified sequence opt11 from VP1__Norovirus__BAJ13717
augaaaauggcaucaaacgacgcaaaccccuccgauggcuccgccgccaaccuagucccagaagugaacaacgaggucauggcacucgaacccgucgucggugcagcaauagccgcucccgucgcgggccaacaaaacguaauagacccauggauccguaacaacuucgugcaagccccaggcggcgaguucaccgucucgccccgaaacgcucccggagaaauauuaugguccgcaccccucggacccgaccuaaaccccuaccuuagccaccucgcccgcauguacaacgguuacgccgguggauucgaaguccaaguuauccucgccggcaacgccuucacagcaggcaagauaauauucgccgccguaccucccaacuuucccaccgaaggccucucacccucacaagucaccauguucccccacauaauagucgacgucagacaacuagaaccaguacucauaccccucccggacguccgaaacaacuucuaccacuacaaccaauccaaugacuccaccauaaaacucauagcuaugcuauacacaccccuucgagccaacaacgccggugaagacgucuucaccguaagcugccgcguccuaacccgccccucccccgacuucgauuucaucuuucucguuccacccaccgucgaaucccgcaccaaacccuucaccguccccauccucaccgucgaagagaugaccaacucacgcuuccccaucccccuagaaaaacuauucaccggcccuucuagcgcauucguaguacaaccccaaaauggccgcugcacaaccgacggcguccuacucggcacaacccaacucucccccguaaacaucugcacauuccgcggcgacgucacacaugucgcaggcucgcgcaacuacauuaugaaccucgcaucacucaacuggaacaacuacgacccaaccgaagaaauucccgcuccccucggcacacccgacuucgucggcaaaauccaaggcguucucacacaaaccaccaaaggcgacggcucuacacgaggccacaaagccacagucuacacaggauccgcccccuucacacccaagcucggcuccguccaauucagcaccgacaccgagaacgacuucgaaacacaccaaaacaccaaauucacccccgucggcgucauccaagacggcuccacaacccaccgaaacgagccccaacaauggguucuuccaucauacucaggccgaaacguccauaacguccaccucgccccagccgucgcacccacauucccaggagaacaacuauuauucuucagaucaacaaugcccgggugcucaggauacccaaacauggaucucgacugccuccuuccccaagaauggguccaacacuucuaccaagaggccgcaccagcucaaucagacgucgcacuccuccgcuucgucaaccccgacaccggccgcguacucuucgaaugcaaacuccacaaaucuggcuacgucacggucgcacacaccggccagcacgaccuuguaaucccacccaacggauacuucagauucgacuccugggucaaccaauuuuacacccucgcccccaugggcaacggaaccggucgucgccgggcccucuaa

SEQ ID NO: 36402 - RNA, 1623 nt, Artificial Sequence
  derived and/or modified sequence opt11 from VP1__Norovirus__BAJ13720
augaaaauggccucgaacgacgcaaaccccucugacggcagcgcagcaaaccuagucccagaaguaaacaacgaaguaauggcccuggaacccgucguaggcgccgccaucgccgccccugucgcaggacaacaaaacgucaucgaccccuggaucagaaacaacuuuguccaagcacccggaggagaguucacaguaagcccgcgaaacgcccccggcgaaauacucugguccgcaccccuaggacccgaucuaaaccccuaccucucccaccucgcccgcauguacaacggcuacgccggcggcuucgaaguacagguuauacucgccggcaacgccuucacggccggaaagauaaucuuugccgcugucccacccaacuuccccaccgaaggacuuucaccaucccaagucacgauguucccccacaucaucguagacguccgacaacucgaacccguacucauccccuuaccugacgucagaaauaacuuuuaccacuacaaccaauccaacgacuccaccaucaaacuaaucgccaugcucuacacaccccuucgcgcaaacaacgccggcgaagacgucuucaccgucuccugcagaguccuaacacguccaucaccagacuucgacuucauauuccucguuccacccaccgucgaaucccgcaccaaacccuucacaguacccauacucacagucgaagaaaugaccaacagccgcuuccccaucccacucgaaaaacuauucaccggcccaagcuccgccuucgucguccaaccccaaaacggccgcuguaccaccgacggcguccuccucggaacaacacaacucucacccgucaacguaugcaccuucagaggagacgucacccacaucgccggaagccguaacuacacuaugaaccuagccucacuaaauuggaacaauuacgaccccacugaagaaaucccagcaccccuuggcacccccgacuucguaggcaaaauacaaggcguacuaacccaaacaaccaaaggagacggcuccaccagaggacacaaagccaccguauauaccggaucagccccauucacacccaaacucggcucaguccaauucucuaccgacacggagaacgacuucgaaacccaccaaaacaccaaauucaccccagucggcgucauccaggacggcggcacgacccaccgaaacgaaccccaacaauggguacuucccagcuacucuggacgugacguccccaacguccaccuagccccggccgucgcaccuaccuuccccggcgaacaacuacuauucuuccgcagcacuaugccaggaugcucaggauaccccaacauggaccuagacugccuacucccacaagaguggguacaacacuucuaccaagaagccgcaccagcacaaucagaugucgcacuacucagauucgucaauccugacaccggccgcguacuauucgaaugcaaacuccacaaaucaggauacgucacggucgcucacaccggccaacacgaccuagucaucccacccaacggauauuuccgauucgacuccugggucaaccaauucuacacacucgccccaaugggcaacggcaccggccgcagacgcgcucucuga

SEQ ID NO: 36403 - RNA, 1623 nt, Artificial Sequence
  derived and/or modified sequence opt11 from VP1__Norovirus__BAJ13723
augaaaauggccucaaacgacgcaaaccccuccgacggcuccgccgcuaaccuaguccccgaaguaaacaacgaagucauggcccucgaacccgucgucggagccgccauagccgccccuguagccggacaacaaaacguaauagaccccuggauccgcaacaacuucguccaagccccaggcggcgaguucaccgucucaccccgcaacgcccccggcgaaauacuaugguccgcaccacucggcccagaucucaaccccuaccucucacaccucgcacgaauguacaacggcuaugccggcggcuucgaaguucaagucauccuagcaggcaacgccuucaccgcaggcaaaaucauauucgccgccgucccacccaacuucccaaccgaaggacucucacccucacaaguaaccauguucccccacauaaucgucgacguacgccaacucgaacccguacucaucccccuacccgacguacgcaacaacuucuaccacuacaaccaauccaacgacucuacaauaaagcucauugcaaugcucuacacaccccuccgcgccaacaaugcaggagaagacguguucaccgucucuugccgcguccugaccagaccaucacccgacuucgacuucaucuuccucguucccccaacaguagaaucccgcaccaaaccauucaccgucccuguacucaccgucgaagaaaugaccaacucacgcuuccccauaccccuugaaaaacuauucaccggccccuccuccgccuucgucguccaaccccaaaacggccgaugcacaacagacggcguccuccuaggcaccacccaacuaagccccgucaacaucugcaccuuccgcggcgacgucacacauauagcaggcucaagggauuacaccaugaaccuagcaucccucaacuggaacaacuacgaccccaccgaagaaauuccagcaccccucggcacacccgacuucgucggcaaaauacaagguguccucacccaaaccacccgaggcgacggaagcacaagaggccacaaggccaccguauacaccggaucagcccccuucaccccaaaacuaggauccguccaauucucaacagacaccgaaaacgauuucgagacccaccagaacaccaaauucaccccaguagggguaauccaagacgggggcaccacccaccgcaaugaaccacaacaauggguacuacccuccuacucagggagaaacgucccaaacguccaccucgcaccagccgucgcaccaaccuuccccggcgaacaacuccuauucuuccgauccaccaugccaggcugcuccggauaccccaacauggaccucgacugccuccucccccaagaauggguacagcacuucuaccaagaagccgccccagcccaauccgacgucgcccuacuccgauucguaaaccccgacaccggucgcguacucuucgaaugcaaacugcacaaauccggcuacgucaccgucgcacacaccggccagcacgacuuaguaaucccacccaacggcuacuuccgcuucgacuccuggguuaaccaauucuacacgcucgcaccaaugggcaacgggaccggcagacgacgggcccuauaa

SEQ ID NO: 36404 - RNA, 1623 nt, Artificial Sequence
  derived and/or modified sequence opt11 from VP1__Norovirus__BAJ13726
augaaaauggccuccaacgacgccaacccuuccgauggaucagccgccaaccuaguacccgaagucaacaacgaaguaauggcccucgaacccgucgucggcgcagcaauagcagcacccgucgccggacaacaaaacgucaucgaccccuggauccgcaacaacuucguccaggcccccggaggggaguucaccguaagcccccguaaugcccccggagaaauccucuggucggcaccccuaggccccgaccuuaacccuuaccucucucaccucgcccgcauguacaacgguuaugccggcgguuucgaaguucaagucauccucgcaggcaacgcuuucaccgccggcaaaaucaucuucgccgcagucccacccaacuuccccacagaaggacuaucccccucacaagugaccauguuuccccacauaauaguagacguacgccaacuagaacccguacuaauaccccugcccgauguacgcaacaacuucuaccauuacaaccaauccaacgacuccaccaucaaacucaucgccaugcuauauaccccacucagagccaacaacgccggcgaagacgucuucacaguauccugccguguccucacccgcccuucccccgacuucgacuucaucuuccucguacccccaacaguagaaucccguaccaaacccuucaccgucccaauccucacagucgaagaaaugacaaacucacgcuuccccauuccacuagaaaaacucuuuacgggacccucuagcgccuucgucguccaaccccaaaacggccgcugcaccacagacggaguccuacuaggcaccacacagcucuccccaguaaauaucugcaccuuucgcggcgacgucacgcacaucgccggcucccgcaacuacaccaugaaccuagccucccucaacuggaauaacuaugaccccacagaagaaaucccagcaccccucggcacucccgacuucgucggcaaaauacaaggcguccuuacccaaacaacaaaaggcgacggauccacccguggccacaaggccacagucuacaccggcuccgcacccuucacgccaaaacucggcucaguacaguucagcaccgacaccgaaaacgauuucgaaacacaccaaaacacuaaguucacccccgucggagugauacaggacggcggcacaacccaccgcaacgagccacaacaauggguccuccccucauacucagggcgaaauguccauaacguccaccucgccccagcagucgcccccaccuuccccggugaacaacuacucuucuuccgauccaccaugccagguuguuccggcuaccccaacauggaccucgacugccuacucccucaagaauggguccaacacuucuaccaagaagccgcacccgcccaauccgacgucgcacugcuccgauucguaaaccccgacaccggcagaguacuuuucgaaugcaaacuucacaaaucaggauaugucaccgucgcccacacaggccaacacgaccucgucaucccucccaacggcuacuuccgguucgacagcugggucaaccaauucuacacccuagcccccaugggcaacggaacaggccgccgacgagcccucuga

SEQ ID NO: 36405 - RNA, 1623 nt, Artificial Sequence
  derived and/or modified sequence opt11 from VP1__Norovirus__BAJ13729
augaagauggccucaucagacgccaaccccuccgacggcucagccgccaacuuaguacccgaagucaacaacgaagucauggcccucgaaccagucgucggagccgcaauagcagccccagucgcaggacaacaaaauguaauagaccccuggauacgcaacaacuucguccaagcccccggcggagaguucaccgucucuccacgcaacgcccccggcgaaauccucuggucggccccacucggccccgaccuaaacccauaccuaucgcaucucgcccgaauguacaacggcuacgccggaggcuucgaaguccaagucaucuuagcaggaaacgcuuucacugccggcaaaaucaucuucgccgcagucccacccaacuucccaaccgaaggcuuaucaccaagucaagucacaauguucccccacaucauugucgacguucgacaacuagaacccguccucaucccgcuccccgacguccgcaacaacuucuaucacuacaaccaauccaacgacuccacaaucaaacucauagcaaugcucuauacaccccuacgggccaacaacgcaggcgaagacguauucaccgucuccugucgcguuuuaacccgacccucacccgacuucgacuucauauuccucgucccucccaccgucgaauccagaaccaagcccuucaccgucccuauucuaaccgucgaagaaaugacaaacucccgcuuccccaucccucuugaaaaacuuuucacaggaccuucaggagccuucgucguccaaccccagaacggccgcugcaccacagacggcguccuacuaggcacaacccaacucucucccgucaacaucugcaccuuucgcggcgacguaacccacaucgccggcucccgcaacuacacaaugaaccucgccucccucaacuggaacaacuacgacccaaccgaagaaauccccgcuccccucgguacccccgacuucgucggcaaaauucaaggcaugcuuacacaaacuacgaaaggagacggaagcacccguggccauaaagcaacuguauacacaggcucagcucccuucacccccaaacuaggauccguccaguucuccaccgacaccgaaaaugacuucgaaacccaucaaaacaccaaauucacgccaguuggcguaauacaggacggcucaacaacccaccgcaacgaaccacaacaauggguccuacccucauacuccggccgagacguacacaacguccaccuagccccagccguagcccccacauucccaggcgaacaacuccuauucuuccgauccaccaugccaggaugcuccggauaucccaacauggaccuagauugccuccucccccaagaauggguacaacacuucuaucaagaggcugcaccagcccaauccgacgucgcacuucuccgcuucgucaaccccgacaccggacggguccucuucgaaugcaaacuacauaaauccggcuacgucaccguagcccacaccggccaacacgaccucguaaucccacccaacggcuacuuccgauucgauucauggguaaaccaauuuuauacacucgcucccaugggcaacggcacaggacgccgccgagcccucuga

SEQ ID NO: 36406 - RNA, 1623 nt, Artificial Sequence
  derived and/or modified sequence opt11 from VP1__Norovirus__BAJ13732
augaaaauggccagcuccgacgcuaaccccuccgacggcuccaccgccaaccucguucccgaaguaaacaacgaagucauggcacucgaaccaguaguaggcgcagccaucgccgcucccguagccggccaacaaaacgucaucgaccccuggauccgcaacaacuucguccaagcccccgguggcgaauuuaccgucucacccagaaacgcacccggcgaaauccucugguccgccccacucgguccagaucuaaacccauaccucucccaccuugcccgcauguauaauucauacgccggaggcuuugaaguacaagucauucuugcaggcaacgccuucaccgccggcaaaaucauauucgcagcggucccaccaaacuucccaacggaaggacucucuccuucgcaaguaaccauguuuccccacauaaucguagacguaagacaacucgaacccgucuuaaucccccugcccgacguccguaauaacuucuaucacuacaaccaaucaaacgaccccacaaucaaacucauagcaaugcuauacacaccccuccgcgccaacaacgccggcgacgacguauucaccguauccugcagaguacucacccguccaucccccgacuuugacuucaucuuccuaguucccccgaccgucgaaucucgcacuaaaccuuucuccguacccauccuaaccgucgaagaaaugaccaacucucgcuucccaauaccccucgaaaaacuauucaccggccccucaucugcauucguaguacaaccucaaaacggcagaugcaccaccgacggaguccuccucggaacaacgcaacuguccccagucaacaucuguaccuuccgcggcgacguuacccacaucgccggaacccaagaauacaccaugaaccuagccucccaaaacuggaauaacuacgaccccacagaagaaauccccgcaccccuuggcaccccagacuucgucggcaaaauccaaggagugcucacccaaaccacacgcagagacggaagcacacgcggccacaaagccacugucuccacaggcuccguccacuucaccccaaaacucggccguauacaauucucaaccgacaccuccaacgauuucgaaaccggccaaaacacacgauucaccccugucggcgucguacaagacgguucaacaacucaccaaaacgaaccccaacaauggguccuccccaacuacagcggccgcgacucccacaacguccaccucgcccccgccgucgcccccucauucccaggcgaacaacuccucuucuuccgauccaccaugcccggcugcucuggcuaccccaacaugaaccuugacugccuucucccgcaagaauggguccaacacuucuaccaagaagcagcacccgcccaaucugacgucgcacuucuccgauucguuaaccccgacaccggccgcgucuuauucgaaugcaaacuacacaaaucuggauauguaaccgucgcacacaccggccaacacgaccucguaauacccccaaacggcuacuuccgauucgacuccugggucaaccaauucuacacacucgcccccaugggcaacggaacaggccgccgacgugcccucuaa

SEQ ID NO: 36407 - RNA, 1623 nt, Artificial Sequence
  derived and/or modified sequence opt11 from VP1__Norovirus__BAJ13738
augaaaauggccagcaacgacgcaaauccauccgacggcucggccgccaaccucguccccgaaguuaacaacgaaguuauggcucucgaaccagucguuggagcagccaucgccgcccccgucgcuggccaaaccaacgucaucgaccccuggauccgaaacaacuucguccaagcacccggcggcgaguucaccguaucuccccgcaacgcacccggcgaaauccuaugguccgcaccacuaggaccagaccuuaauccuuaccucucccaccuagcucgaauguacaacggcuacgccggaggcuucgaaguccaagucauccucgccggcaacgccuucacugcaggcaaaaucaucuucgccgccgucccacccaacuucccaaccgaaggccucucucccucacaagucaccauguucccccacaucaucguggacguccgccaacucgaacccguccuaaucccucuucccgacguccgcaacaauuucuaccacuacaaccaaucaaacgacucaaccaucaaacuaauagccaugcuuuacacaccccuccgagccaacaacgccggagaagacgucuucaccguaucaugccgcguacuuacccgacccucccccgacuucgauuucaucuuucuaguaccuccaaccguagaaucaagaaccaaaccauucaccguccccauacucaccguagaagaaaugacuaauuccagauuccccaucccucucgaaaaacucuucacaggccccuccggugcauuugucguacaaccccaaaacggucgcugcacaaccgacggcguccuccucggaacaacccaacucucacccguaaacaucugcaccuuccgcggcgacgucacccauaucgccgguagccgcaacuacacaaugaacuuagcuucccuaaacuggaacaacuacgacccaaccgaagaaauacccgcgccccuuggcaccccagacuucgucgguaaaauccagggcguacuaacccaaacuacaaaaggagacggcagcacccguggccacaaagccacagucuacaccggaagcgccccauucaccccaaaacucggcucaguucaauucucaaccgacaccgagaacgacuucgaaacccaccaaaacaccaaauucacacccguaggaguaauacaagacggaucaaccacccaccgcaaugaaccacaacaguggguccuaccguccuacuccggccgaaacguccacaauguccaccucgccccugcuguagcacccacuuuccccggagaacaacuccucuuuuuccgauccaccaugcccggcugcucaggcuaucccaauauggaccucgacugccuccuaccccaagaauggguccaacacuucuaccaagaagccgcccccgcccaauccgacguugcccuccuacgcuucgucaacccagacaccggucgcguccuuuucgaaugcaaacuccacaaaucaggcuacgucaccgucgcccacaccggacaacacgaccucgucauacccccuaacggcuacuuccgcuucgacucuugggucaaccaauucuacacucucgcgcccaugggaaacggcacaggccgccgccgcgcccuauaa

SEQ ID NO: 36408 - RNA, 1623 nt, Artificial Sequence
  derived and/or modified sequence opt11 from VP1__Norovirus__BAJ13741
augaaaauggccucaaacgacgccaaccccagcgauggcuccgcagcaaaccucguccccgaagucaacaacgaaguuauggcccucgaaccagucgucggagccgccaucgcagcccccgucgcaggccaacaaaacgucaucgaccccuggaucagaaacaacuucguccaggcccccggcggagaguucaccguuucuccccgcaacgcccccggagaaauccucugguccgccccucuaggcccagaccuuaaccccuaccucucacaccucgcacgcauguacaauggauaugcuggcggauuugaaguccaagucauccuagccggcaaugccuucacagcaggcaaaaucauuuucgcagcagugcccccuaacuuccccacagaaggccuauccccaucccaaguuacaauguucccccacaucauagucgacguccgacaacucgaacccguccuuauaccccuccccgacguucgcaacaacuucuaucacuacaaccaaucaaacgacaguaccauaaaacucaucgccaugcucuacaccccacuucgagcaaacaacgccggugaagacguauucaccgucuccugccguguccuaacccgccccucccccgacuuugacuucaucuuccuaguacccccaaccgucgaaucccgcacaaagcccuuuaccguccccauccucacagucgaagaaaugaccaacucccgauuccccauaccacuagaaaaacucuucaccggccccuccggcgcauucgucguucaaccccaaaacggccgaugcaccacagacggaguccucuuagguaccacacaacuaucccccgucaacaucugcaccuuccgcggagacguaacacacaucgcaggaucccgcaacuacacaaugaaccuugccucuuuaaacuggaacaauuacgaccccacugaagaaaucccagcaccacucgggacccccgacuucguaggaaaaauacaagguguacuaacucagacaaccaaaggcgacggaagcacccgcggccauaaagccacuguauacaccggcucugcccccuucaccccaaaacucggcuccguccaauucucgaccgacaccgaaaacgacuucgaaacacaucaaaacaccaaauucacacccgucggcgucauccaagauggcucuaccacccaccgaaacgaaccccagcaguggguccuccccagcuacucuggccguaacguacacaacgugcaccuagcacccgcaguagcucccacuuuccccggcgaacaacuccuauucuuccgcucaacaaugcccggcugcuccggcuaccccaacauggaccuagacugccuacuaccccaagaauggguccaacacuucuaccaagaagcagccccagcccaaucagacgucgcacuccuccgauucguaaacccugacacaggucgcguccuauucgaaugcaaacugcacaaaucaggcuaugucacugucgcccacaccggccaauacgaccucgucauaccacccaacggcuacuucagauuugacuccugggucaaccaauuuuacacccucgcccccaugggcaacggcaccggccgccgccgcgcccuauaa

SEQ ID NO: 36409 - RNA, 1623 nt, Artificial Sequence
  derived and/or modified sequence opt11 from VP1__Norovirus__BAJ13744
augaaaauggccuccaacgaugccaaccccucggauggcuccgccgcaaaccucgucccagaagucaacaacgaagucauggcccucgaacccgucgucggagccgccaucgccgcccccgucgcaggccaaaccaauguaauugaccccuggauccgaaauaauuucguacaagcacccggaggcgaauuuacaguuuccccucgcaacgcacccggcgagauacucuggucggcuccccucggccccgaccucaacccauaccuaucccaccuagcccguauguacaaugguuacgccggcggcuucgaaguccaaguaauacuugccggcaacgccuucaccgccggcaaaaucauauucgccgccgugcccccaaacuuccccacagaaggccucucacccucacaaguaaccauguuuccccacaucauagucgacguccgccagcuagaacccguacucaucccacuucccgacguccgaaacaacuucuaccacuacaaccaauccaaugauuccaccaucaaacucauugccaugcucuacaccccacuacgcgccaacaacgccggcgaagacguuuuuaccguauccugccgaguccucacccgcccaucaccggacuucgacuucauauuccucgugccacccaccguagaaucccgcacuaaaccauucaccgucccuauacucaccgucgaagaaaugacuaauucgcgcuucccuaucccccuagaaaaacuauuuaccggucccucaggagcauucgucguacaaccccaaaacggccgaugcacaaccgacggaguccuucucggcaccacccaacucucccccgucaacauaugcaccuucagaggagaugucacccauauugcaggcucccgcaacuacacaaugaaccucgccucacucaacuggaacaauuacgaccccacagaagaaaucccagcaccccucggaacaccugacuucguaggcaaaauccaaggcguccuuacucaaaccacaaaaggcgacggauccacucgcggccacaaagccaccgucuacacaggaucugcccccuucacccccaaacucggcagcguccaauucucaaccgacaccgaaaacgacuucgaagcccaccaaaacaccaaauucacccccguaggagucauacaagacggcuccacuacccaccgcaaugaaccccaacaauggguccuccccucauacucaggacgaaacguccaaaacguccaccuagcccccgcugucgcacccaccuucccaggcgaacaacuccucuucuuccgcucuacuaugcccggcugcucaggcuaccccaacauggaccucgacugccuacucccacaagaauggguccaacacuucuaccaagaagccgcaccagcacaaucagacguagcccuucuccguuucgucaacccagacacaggcagaguccucuucgaaugcaaacuccacaaaagcggcuacgucaccguugcacacaccggacaacacgaccuagucaucccaccaaacggcuacuuccgcuucgacuccugggucaaccaguucuacacacuagcucccaugggcaacgguaccggcagacgccgcgcccuauag

SEQ ID NO: 36410 - RNA, 1623 nt, Artificial Sequence
  derived and/or modified sequence opt11 from VP1__Norovirus__BAJ13747
augaaaauggcaagcucagacgccaacccuucagacggcucuacugcgaaccugguccccgagguaaacaacgaagucauggcccuagaaccagucgucggcgccgcaaucgcagcccccgucgcaggccagcaaaacgucaucgaucccuggauacgcaacaacuuuguccaagccccuggcggcgaauuuaccgucucuccacgcaacgcccccggcgaaauacuauggucggcaccccucgggcccgaccucaaccccuaccucucacaccuugcccgaauguacaacgguuacgccggaggcuucgaaguccaagucauucucgccggcaacgcuuuuaccgccggcaaaaucauuuucgcagcaguacccccaaacuuucccaccgaagggcucucaccaucccaagucaccauguuuccccacaucaucgucgacguccgacaacucgaacccguucucaucccccuccccgacguccguaacaacuucuaccacuacaaccaauccaacgacccaacaaucaaacuaaucgccaugcuuuacacaccacuccgagccaauaaugcaggcgacgacgucuuuacagucucuugucgcgugcuaacacgccccucucccgacuucgacuucauauuccuaguaccacccacagucgaaucacgcaccaaacccuucagcguccccauccucacagucgaagaaaugaccaacuccagauuucccaucccccuagaaaaacucuucacagggcccuccuccgccuucguaguccaaccucaaaacggacgaugcaccaccgacggaguccuccucggaacuacccaacucucacccguaaacauaugcacauucaggggcgacgucacccacaucaccgggucccgcaacuacacaaugaaccuagcaacccaaaauuggaacuccuacgaccccacggaagaaauaccagcuccccuuggaacccccgacuucgucggcaagauacaaggcguucuaacgcagacaacccgcgccgacggcuccacccgcggucacaaggccaccguuuacaccggguccgccgacuucgccccaaaacucggccgaguccaauucgcaaccgacaccgacaacgacuucgacgcaaaccaaaacaccaaauucacaccaguaggagucauccaagacggcgacaccgcacaccgaaacgaaccacaacaauggguacuccccuccuauucaggccgcaacagccacaacguccaccuagccccagccgucgccccuacauucccaggagaacaacuccuauuuuuccgauccacaaugcccggcugcucaggcuaccccaacauggaccuggacugccuccuuccccaagaguggguccaauacuucuaccaagaagcagcccccgcccaaucagacguugcccuccuacgcuucguaaaccccgacacaggacgcguacuauucgaaugcaaacuccauaaaucaggcuacgucaccguagcccacaccggccaacacgaccuagucauaccaccaaacggcuacuuccgauuugacuccugggucaaccaauuuuacacgcuagccccuaugggaaacggcacuggacgacgucgcgcccuauaa

SEQ ID NO: 36411 - RNA, 1623 nt, Artificial Sequence
  derived and/or modified sequence opt11 from VP1__Norovirus__BAJ13750
augaaaauggcauccaacgacgccaaccccagcgacggcucugccgcaaaccucguacccgaagucaacaacgaagucauggcacucgaacccgucgucggcgcagccauagcagcaccuguugccggccaacaaaacgucauugacccauggauucgaaacaacuucguacaggcccccggcggugaguucaccgucucuccucgcaacgcccccggcgaaauccuauggucagccccacucggccccgaccuaaaccccuaccucucacaccucgcccgcauguacaacggcuacgccggcggcuucgagguccaagucauccucgccgggaacgccuuuaccgccggcaaaaucaucuucgcagccgucccucccaacuuccccaccgagggccucucucccucccaaguaacuauguucccccacauuaucgucgacguccgccaacucgaacccguauuaauuccccucccugacguacgaaauaacuucuaucacuacaaccaauccaacgacagcaccaucaaacucaucgccaugcucuacacaccccuacgcgccaacaacgccggcgaagacgucuuuaccgucucuugccgcguacuaacccgacccucccccgacuucgacuucauauuucucgucccucccacugucgagucacgcaccaaacccuucaccguccccaucuuaacaguagaagaaaugaccaacucccgcuuccccauccccuuagaaaaacucuucacugguccauccuccgcauucgucguacaaccacaaaacggucgcugcacuaccgacggcguccuccucggcaccacacagcucucacccgucaacaucugcacauuucgaggugacgucacccauaucgcaggcuccagaaacuacacaaugaaccuugccucccuaaacuggaauaacuacgacccaacugaagaaaucccugccccacucggcacacccgacuucguaggaaaaauucaaggcgugcucacccaaacaaccaaaggagacggcuccacccgaggccacaaagccaccgucuacaccggcuccgcccccuucacacccaaacucggauccguccaauucucgaccgacaccgaaaacgacuucgagacacaucaaaacaccaaauucacccccguaggagucauccaagacggaggaacaacccaccgaaacgaaccucaacaauggguacuccccucauacuccggccgcaacguucccaacguccaccucgccccagccgucgcacccacauucccaggugaacaauuacucuuuuuccguuccaccaugcccggaugcucaggcuaccccaauauggacuuagacugccuucuaccccaagaauggguccaacauuucuaccaagaagcagcccccgcccaauccgacgucgcccuucuccgauucgucaacccugacacuggccgcguacuuuucgaaugcaaacuccacaaauccgguuacgucacgguagcacacaccggccaacacgaucucgucauaccaccaaacgguuauuuccgauucgacuccuggguaaaccaauuuuacacccucgcccccaugggcaacggcaccggacgccgacgcgcccucuaa

SEQ ID NO: 36412 - RNA, 1623 nt, Artificial Sequence
  derived and/or modified sequence opt11 from VP1__Norovirus__BAJ13753
augaaaauggccucgucugacgccaaccccuccgacggcucaaccgccaaccucguccccgaagucaauaacgaaguaauggcccucgaacccgucguaggagccgccaucgcagccccagucgccggacaacaaaacguaauugacccuuggauucguaacaacuucguacaggccccuggcggagaguucaccgucuccccacgaaacgccccgggagaaauacuuugguccgccccacuaggcccagaccuaaauccauaccucagccaucucgcccgcauguacaacggauacgccggcggguucgaaguccaagucauacuagcgggcaaugcauucacagccggaaaaauaaucuucgccgcaguacccccgaacuuccccacugaaggacucucccccucacaagucaccauguucccccacaucauaguagacguacgucaacucgaacccguccuaauaccacuccccgacguccgcaacaacuucuaucacuauaaccaguccaacgaccccaccaucaagcuaauagccaugcucuacaccccacuccgugccaacaacgccggcgaugacgucuucaccguauccugccgaguccucaccagacccucccccgacuucgauuucaucuuucucgucccacccaccgucgaaucccgaaccaaacccuuuuccguccccauccucaccgucgaagaaaugacaaacucccgcuuccccaucccccucgaaaaacucuucaccggccccucaucagcuuucgucguccaaccucaaaacggucgaugcacaacagacggaguccuccuaggaaccacccaacucuccccagucaacaucuguaccuuccguggcgacguaacacacauaaccggaucccgaaacuacacaaugaaccucgcaacacaaaacuggaacuccuaugaccccacagaagaaauccccgcaccccuuggcacgccugacuucgucggcaaaauccaaggcguacucacacagacaacccgcgccgacggcuccacacgcggccacaaagccacagucuacacaggcagcgcagacuucgcaccaaaacuaggccgaguccaauucgccacugacacagacaacgacuucgacgccaaccaaaacacaaaauucacgccagucggagucauacaagacggagacacugcccaccgcaacgaaccacaacaauggguccuccccagcuacucgggccguaacucacacaacguccaccucgcuccugccgucgccccuaccuuccccggcgaacaacuccuguucuuccgcucaaccaugcccggaugcucaggcuaccccaacauggacuuagacugccuacuaccccaagaauggguacaauauuucuaccaagaagccgcaccagcccaaucagacguugcccuccuacgauucguuaacccagacacuggccgcguccuuuucgaaugcaaacuacacaaaucaggcuacgucacuguugcgcacaccggacaacacgaccuagucaucccacccaacggcuacuuccgauucgacucauggguuaaccaauuuuacacccuagcccccaugggaaacggaacuggccgucgacgcgcccuuuaa

SEQ ID NO: 36413 - RNA, 1623 nt, Artificial Sequence
  derived and/or modified sequence opt11 from VP1__Norovirus__BAJ13756
augaaaauggccuccucugacgccaauccacccgacggcuccgccgcaaaccuagucccagaagucaacaacgaagucauggcccucgaacccgucgucggcgccgccauugccgcacccguugcaggccaacaaaacgucaucgacccauggauucgaaauaacuuuguccaagcccccggaggcgaauuuacaguaucuccccgcaacgcacccggcgaaauacuuugguccgcaccccuaggccccgaucucaacccauacuuaucccaccuugcacguauguacaacggcuacgccggcggauucgaaguacaagucauccucgccggaaacgcauucaccgcaggcaaaaucaucuucgcugccguaccacccaacuucccaaccgaaggccuuuccccgucccaggucacaauguucccacauaucaucgucgacguccgacaacuagaaccaguccugauaccccuccccgacguccggaacaacuucuaccacuacaaccaaucaaaugacucuaccaucaaacuaaucgccaugcuauacacuccccuacgagccaacaacgccggcgaagacguuuucacggucuccugcagaguccuaacacguccuucccccgacuucgauuucauuuuccucgucccucccaccguugaaucccgaacuaaacccuucacaguacccauacuuaccguugaagaaaugacuaacucacgauuccccaucccucuagaaaaacucuucaccggcccaucaggcgccuucgucguacaaccacaaaacggccgcuguaccacagacggaguacuccucggcacaacccaacucuccccaguaaacauaugcaccuuccguggcgacgucacccauaucgccggaucccgcucauacaccaugaaccuagccucccuuaacuggaacaacuacgaccccacagaagaaauccccgcuccccucgguaccccagacuucgucggaaaaauccaaggaaugcucacccaaacuacaaaaggcgacggcuccacccgaggacacaaagccacagucuacaccggauccgccccauucacuccuaaacuaggcuccguccaguucagcaccgacacagaaaacgacuuccaaacacaccaaaacaccaaauucaccccagucggcgucauccaagacggaucuacaacccaccguaacgaaccccaacaauggguacuacccuccuacuccggacgcgacguccacaacguacaccucgcccccgccgucgcacccaccuuccccggcgaacaacuacucuucuuccgcaguaccaugcccggcuguagcggcuacccaaacauggaccuagacugccuucuuccccaagaauggguucaacacuucuaccaggaagccgcuccagcccaaucagacgucgcccuacuccgcuucgucaaccccgacaccggccgaguccucuucgaaugcaaacuacacaagucaggcuacgucaccguugcacacaccggccaacacgaccuagucauucccccaaacggcuacuuccgcuucgacucgugggucaaccaauuuuacacccucgcccccaugggaaacggaaccggccgcagacgagcccucuaa

SEQ ID NO: 36414 - RNA, 1623 nt, Artificial Sequence
  derived and/or modified sequence opt11 from VP1__Norovirus__BAJ13759
augaaaauggcauccaaugacgcgaaccccucugauggaucagccgcuucccucguccccgaagucucaaacgaaguaauggcccuagaaccagucguaggcgccgcuauugcagcaccugucgccggacagcaaaacgucauagacccauggauacgaaacaacuucguacaagccccaggcggcgaguucaccgucucacccagaaacgcccccggcgaaauccuauggucagcaccccucggaccugaccucaaccccuaccuaucucaccucgcccgaauguacaaugguuacgccggcggcuucgaaguccaagucauccuggcagguaaugcauucaccgccggcaaaaucauauucgccgccguaccucccaacuuccccacagaaggccuuucacccucacaagucaccauguucccccacaucaucgucgacguccgccaacuugaacccguccucaucccccuucccgacguccgaaauaacuucuaccacuacaaccaaucaaacgacuccaccauaaagcuaaucgccaugcucuacacaccccugcgcgccaacaacgccggagaagacguauucaccguauccugccguguccucacacguccaucccccgacuucgacuucaucuuccucguaccacccaccgucgaaucccgaaccaaacccuucacaguucccauacucaccgucgaagaaaugacaaacucucgauuccccaucccccucgaaaaacucuucaccggacccucuggcgccuuugucguucaaccacaaaacggccgaugcaccacugauggaguccuccuugguaccacucaacucucacccguaaacauaugcaccuuccgcggcgacgucacccauaucgccggaucccgcaacuacacaaugaaccucgccucccuaaacuggaacaacuacgaccccaccgaagaaauaccagccccacuaggcaccccagacuucguaggcaaaauccaaggcguccucacccaaaccacgaaaggagacggauccacccguggacauaaagccaccgucuacaccggcuccgccccauucaccccaaaacucggcuccguccaauucucgaccgacaccgaaaacgacuucgaaacccaccaaaacaccaaauucacacccguuggagucauccaagaugguucuaccacccaccgcaacgaaccacaacaauggguccuaccaucauacuccggcagagauguacacaacguacaccucgcccccgcagucgcccccaccuucccaggcgaacaacuccucuucuuccgcuccaccaugcccggcuguagcggcuaccccaacauggaccucgacugccuacucccccaagaauggguccaacacuucuaccaagaagccgcacccgcacaaucagacgucgcccuccuacgcuucgucaaccccgacacaggccgcguccucuucgaaugcaaacuccacaaauccggcuacguaaccguagcccacaccggccaacacgaucucguuaucccacccaacggcuacuuccgcuucgauuccuggguaaaccaauuuuacacacucgccccgaugggcaacggaaccggacgacgccgcgcccuauga

SEQ ID NO: 36415 - RNA, 1623 nt, Artificial Sequence
  derived and/or modified sequence opt11 from VP1__Norovirus__BAJ13762
augaaaauggcaucgaacgacgcuaaccccagcgacggauccgccgcaaaccuaguccccgaaguaaacaacgaaguaauggcacuagaacccgucguaggcgccgccaucgccgcccccgucgccggccaacaaaacguaaucgacccauggauaagaaacaauuucguccaagcaccuggaggagaauuuaccgucaguccccgaaacgcaccgggcgaaauccuuuggagcgcaccacuaggcccagaccucaauccauaccuaucacaucuagcaagaauguacaacggcuacgccggcggcuucgaaguccaaguaauccuugccggaaacgcauucaccgcuggcaaaaucaucuucgcagcugucccaccaaacuucccaaccgaaggccucucaccaucacaagucacaauguucccccacauaaucgucgacguacgccaacucgaacccguccucauaccccuacccgacguccgaaacaacuucuaccacuacaaccaauccaacgacucuacaauaaaacuaaucgccaugcucuacacaccacuacgcgccaacaacgcaggcgaagacgucuucaccguuuccugccgcguccuaacccguccuucacccgacuucgacuucauauuccuagucccacccaccgucgaaucccgaaccaaaccauucacaguccccauccucaccgucgaagaaaugacuaacucccgauucccaauaccccucgaaaaacucuucacaggacccuccuccgcuuucguaguccaaccccaaaacggccgcugcacaaccgacggcguccuucucggcaccacccaacucucucccgucaacaucugcacauuccgcggcgacguuacccacaucgcagguuccagaaauuacacaaugaaccuugccucccucaacuggaauaacuacgacccaaccgaagaaauacccgccccgcucggcacccccgacuucgucggcaaaauccaaggcguauuaacccaaacaaccaaaggagacgguucaacccgcggccacaaggcuaccguuuacacgggcuccgcccccuucacccccaaacuaggaagcguccaauucuccaccgacaccgaaaacgacuuugaaacacaccaaaauaccaaauucaccccugucggcgucauccaagacggcggcacuacccaccgcaacgaaccacaacaauggguccuacccuccuacucaggacgcaauguccccaacguccaccucgcccccgcaguugcacccaccuuccccggcgaacaacuacuauucuuccgaucaacuaugccuggaugcuccgguuaccccaauauggaccucgacugccuccucccacaggaauggguccaacacuucuaccaagaagcugcaccagcccaauccgacguugcccuucuccgcuucgucaacccugacaccggccgaguccucuucgaaugcaaacuacacaagucaggcuacgucaccguagcccacacaggccaacacgaccuaguaaucccacccaacggcuacuucagauucgacuccugggugaaccaguucuacacacuugcacccauggguaacggcacaggcagacgucgcgcccucuaa

SEQ ID NO: 36416 - RNA, 1623 nt, Artificial Sequence
  derived and/or modified sequence opt11 from VP1__Norovirus__BAJ13765
augaaaauggccucaaacgacgccaaucccagcgacggcuccgccgccaaccucguccccgaagucaauaacgaaguaauggcacuugaacccguugucggugccgcaaucgcagcacccguagccggucaacaaaauguaaucgacccauggauccgcaacaacuucguacaggcccccggaggagaguucaccguaucaccccgcaacgcucccggcgaaauacucugguccgcaccccucggacccgaccucaaccccuaccuaucacaccuugcccgcauguacaacggcuacgcuggcgguuucgaaguucaagucauacuagccggcaacgccuucaccgccggaaaaaucauuuucgcagccguaccacccaacuuccccaccgaaggacuuucccccucccaagucaccauguucccccacaucaucgucgacguacgacaacucgaacccguccuaauaccccuccccgacguccgcaacaacuucuaccacuacaaccaaagcaacgacuccaccauaaaauuaaucgccaugcucuacacaccccuacgcgcaaacaacgccggggaagacgucuucaccguuuccugccgcguucucacccgacccuccccagacuuugacuucauauuccucguuccacccaccgucgaaucacgcaccaaaccauucaccgucccaauccucaccgucgaagaaaugaccaacucccgauuccccauacccuuagaaaaacucuucacaggccccagcucugccuucguaguccaaccucaaaacggacggugcaccacugacggcguccugcugggcacuacccaacuauccccagucaacaucugcaccuuccgcggugaugucacccacauagcuggcucccgaaacuacaccaugaaucuagccucucucaacuggaacaauuacgaucccaccgaagaaauccccgcuccccucggcacccccgacuucgucggcaaaauccaaggaguccucacacaaaccaccaaaggcgacggaucaacccgcggccacaaagccaccgucuacaccggcucagccccauucacccccaaacucggcuccguccaauucuccacagacacagaaaacgacuucgaaacccaccaaaacacaaaauucacccccguaggcgucauacaagacggcggcacaacccaccguaaugaaccccaacaauggguacuacccuccuacucaggccguaacguccccaacguccaccucgccccagccgucgccccaaccuuccccggcgaacaacuccuguucuuccguucaaccaugcccggaugcucuggauacccaaacauggaccuugauugccuccuuccucaagaauggguacaacacuucuaccaagaggcagccccagcacaauccgacgucgcauuacuccgcuucguaaaccccgacaccggccgcguccucuucgaaugcaaacuacauaaaucaggcuacgucacagucgcccacacagggcaacaugaucucguuauuccaccgaacggcuacuuccgcuucgacucaugggucaaccaauucuacacccucgcuccaaugggaaacggcacaggacgccgccgcgcccucuaa

SEQ ID NO: 36417 - RNA, 1623 nt, Artificial Sequence
  derived and/or modified sequence opt11 from VP1__Norovirus__BAJ13768
augaaaauggccuccaacgacgccaaccccagugacggcucugccgccaaucucguccccgaagucaauaacgaaguuauggcccucgaacccgucgucggagccgcaaucgccgcacccguagcuggccaacaaaacguaauugaccccuggauacgcaacaacuucguacaggccccaggcggcgaauuuaccguaucaccccgcaacgcccccggcgaaauccucugguccgcuccccuaggccccgaccuuaaccccuaccuaucccaccucgcucgaauguacaacggcuacgccggaggcuucgaaguccaagucauccucgcgggcaacgccuucaccgccggcaaaaucaucuucgcggcagucccucccaauuuccccacagaaggccucucccccucacaaguaacaauguuuccccacaucaucgucgaugucagacaacuagaacccguccucaucccccucccagacguacgaaacaacuucuaccacuacaaccaauccaacgacaguaccauaaaacucaucgccaugcuauacaccccucuacgcgcuaacaacgccggagaagacgucuucacugucuccuguagaguacucacacgacccucaccugacuucgacuucaucuuccucguuccacccacagucgaaucccgaacaaaaccauucacaguccccauccucaccgucgaagaaaugaccaacucccgcuuucccauaccacuagaaaaacuauucaccggcccuuccagcgccuuugucguacaaccccaaaauggacgcugcacaacugacggcgucuuacuaggaacuacucaacucucuccagucaacaucugcaccuuucgcggcgacguaacucacaucgcaggcucacgcaacuacaccaugaaccucgcaagccucaacuggaacaauuacgaucccaccgaagaaauccccgcaccccucggaaccccagacuucgucggcaaaauccaaggcguacuaacccaaacaaccaaaggagacggaucaacccgaggccacaaagccacagucuauaccggcuccgcccccuucacccccaaacucggcuccguacaauucuccaccgacaccgaaaacgacuucgaaacacaccagaacaccaaauucacaccaguuggaguuauacaagacgguggcaccacacaccgaaacgaaccacaacaauggguacuaccuuccuacagcggacgcaacguccacaacguccaccucgcccccgccgucgcccccaccuuccccggcgaacaacuacuauucuuucgaucaacgaugcccggcugcucaggcuaccccaacauggaccucgacugucuucuaccucaagaauggguccaacacuucuaccaagaagccgcgccagcccaaucugacgucgcccuccuccgcuucgucaacccggacacuggccgcguccuauucgaaugcaagcuacacaaaucaggcuacguaacagucgcacacacuggccaacacgacuuagucauaccacccaauggcuacuuccgcuucgacagcuggguaaaccaauucuauacccucgcccccaugggcaacggaacaggccgacgccgagcccuuuaa

SEQ ID NO: 36418 - RNA, 1623 nt, Artificial Sequence
  derived and/or modified sequence opt11 from VP1__Norovirus__BAJ13771
augaaaauggccucuaacgacgccaacccaucugacggcucugccgccaaccuaguaccagaagucaacaacgaagucauggcccucgagcccgucguaggagccgccaucgcugccccuguagccggccaaacaaacgucaucgaccccuggauccgaaacaacuucguccaagcccccggcggagaguucaccgucucaccacgcaacgccccgggcgaaauccucuggucugcugcacuaggccccgaccuuaaccccuaccuaucacaccucgcacgaauguacaacggauacgccggcggauucgaaguccaagucauucuagccggcaacgcauuuacugccggcaaaaucaucuucgccgcagucccucccaacuuucccaccgaaggacuaucgcccucccaagucaccauguucccccacaucaucgucgacguccgucaacucgagcccguacuuaucccccuccccgacgugcgcaacaacuucuaccacuacaaccaaucuaacgacucaaccauuaaacucauagccaugcucuacacaccccuacgcgcgaacaacgcaggagaagaugucuucaccgugucaugucgcguacuaaccagacccucccccgacuucgacuucaucuuucuaguacccccaaccgucgaaagucgcacuaaaccauucaccguccccaucuuaacugucgaagaaaugaccaacucccgcuuucccaucccccucgaaaaacucuucaccggacccuccggcgccuucgucguccaaccacaaaauggucgcuguaccaccgacggcguacuccuagguacaacacaacuuucacccgucaacaucugcacuuuccgcggggacguaacucacaucgcaggcuccagaaacuacacaaugaaccuagcuucacucaacuggaacaacuacgacccaaccgaagaaauucccgcaccccucggcaccccagauuucgucggcaagauccaaggcguccuaacccaaaccacaaaaggcgacggcucuacccgcggccauaaagccacagucuacaccggcuccgccccauucacccccaaacuuggcagcguccaauucuccaccgacacagagaacgauuucgaaacccaccaaaacacaaaauucacccccguaggcguuauacaagacggaagcacaacacaccgcaacgaaccccaacaauggguccucccauccuauucaggccgaaacguacacaacguccaccuagccccagccgucgccccuaccuuccccggcgaacaacuacucuucuuccgcuccacaaugcccggcugcuccggcuaucccaauauggaccucgacugccuucucccccaagaauggguacaacacuucuaccaagaagccgcccccgcccaaucagaugucgcccuccuucguuucgucaaucccgacacaggacgaguccucuucgaaugcaaacuccauaaaagcggcuacguaacaguagcacacaccggccagcaugaccuagucaucccucccaacggauacuuccgcuucgacuccugggucaaccaauucuacacacucgcccccaugggcaauggcaccggcaggcgccgcgcccucuaa

SEQ ID NO: 36419 - RNA, 1623 nt, Artificial Sequence
  derived and/or modified sequence opt11 from VP1__Norovirus__BAJ13774
augaaaauggcaucaaacgacgccaaccccuccgacggaucagccgcuaaccucguaccagaaguaaacaacgaaguaauggcccucgaaccagucguaggagcagcaaucgccgcccccgucgcaggccagaccaacgucaucgaccccuggaucagaaacaacuucguucaagcacccggaggcgaguucaccgucucuccccgaaacgccccuggagaaauccucugguccgccccacucggcccagaccuaaacccauaccucucacaccucgcccgaauguacaacgguuacgccgguggcuucgaaguccaagucauccuagcaggcaaugcauucaccgccgggaaaaucauauucgccgccgucccacccaacuuccccaccgaaggucucucgcccucccaaguuacaauguucccccauaucaucgucgacgucagacaacuagaacccguacuaaucccccuccccgacguacguaacaacuucuaccacuacaaccaaucaaaugacucuaccauuaaacuuauagcaaugcucuacacaccccuacgcgcuaacaacgcgggagaagacgucuucaccguauccugccggguccucacucgacccagccccgacuuugacuucaucuuccucguacccccuacugucgaaucccggaccaaacccuucaccguccccauacucacaguagaagaaaugacaaacucccgcuuucccaucccacuagaaaaacucuucaccggccccuccggcgccuucguaguccaaccccaaaacggacguugcaccaccgacggaguacuccucgguaccacacaacucucccccgucaacaucugcaccuuccgcggcgacguaacccacauagccggaucucgcaacuacaccaugaaccucgccucccuaaacuggaacaacuacgauccaaccgaagaaaucccugcaccccucggcacacccgacuuuguaggaaaaauccaaggcguccuuacccaaaccaccaaaggcgacggcuccacccgaggacacaaagccacagucuacacuggauccgcccccuucaccccuaaacuuggcuccguucaauucuccacugauaccgaaaacgacuucgaagcccaccaaaacacaaaguucacccccgucggcguuauccaggacggcuccaccacacaucguaacgaaccccagcaauggguacugccaucuuacagcggucgaaacguacagaacguucaccuugccccagccgucgcaccuaccuuccccggcgaacagcuacuauucuuccgcuccacaaugccaggcugcucuggcuaccccaacauggaccuagauugccuccuuccacaagaauggguacaacacuucuaucaagaagccgccccagcacaauccgacgucgcccuccuccguuucgucaauccagacacuggccgcguacucuucgaauguaaacuccacaaaucagguuacgucaccguagcccacaccggccaacacgaccucguaauaccacccaacggauacuuccgcuucgacagcugggucaaccaauuuuacacccucgcacccaugggcaacggcacaggccgacgccgagcccuauaa

SEQ ID NO: 36420 - RNA, 1623 nt, Artificial Sequence
  derived and/or modified sequence opt11 from VP1__Norovirus__BAJ13777
augaaaauggccucgaacgacgcgaaccccagcgacgguuccgccgcaaaccucgucccagaagucaacaacgaagugauggcccucgaaccagucgucggcgccgcaaucgcggcacccguagcuggccaaaccaacgucaucgaccccuggauccguaacaacuucguucaagcccccggaggcgaguucacagucucaccccgcaacgcccccggugaaauccuaugguccgcaccacuaggucccgaucucaacccauaccucucccaccucgcacgcauguacaacggcuacgcuggcggcuucgaaguccaagucauccuagcaggcaacgccuuuacagccggcaagauaauauuugcagccgucccacccaacuuccccacugaaggacucucccccucacaagucaccauguucccccacaucauaguagacgucagacaacucgaacccguccucauaccacucccagacguccgcaacaacuucuaccacuacaaccaguccaacgacucaacaauaaaacuuaucgccaugcucuacacaccccuacgagccaacaacgcaggcgacgacgucuucacagucuccugccgggucuuaacccgccccucccccgacuucgacuucauauuccucguaccucccaccguagaaucacgcacaaaacccuuuacaguccccauccucaccgucgaagaaaugacuaauucccgcuuucccauacccuuagaaaaacuuuucaccggccccucuggcgccuucgucgugcaaccccaaaacggccgaugcaccaccgacgguguccuacuaggaacuacccaacucucccccgucaacaucugcaccuuccgcggagacgucacacacaucgcagguucccgcaacuacacaaugaaccuagcaucccuaaacuggaacaacuacgaccccacagaagaaauccccgcccccuuagggacccccgacuucgucggcaaaauccagggcguccugacacagaccacaaaaggcgacggauccacacgcggacacaaagccaccgucuacaccggcuccgcccccuucacccccaaacucggcucaguacaauucuccaccgacaccgaaaacgauuucgaagcccaccaaaauaccaaauucacucccguuggcgucauccaagacggaucuacaacccaccgaaacgaaccacaacaauggguccucccauccuauuccggccgaaacguccaaaacguacaccucgccccugccgucgcccccaccuuccccggcgaacaacuccuauucuuccgcuccacaaugcccggauguucgggauaccccaacauggaucuagacugccuucuaccacaagaauggguccaacacuucuaccaagaagccgccccagcacaaucggacguagcccuccuccgcuucguaaaucccgauaccggccgaguccuuuucgaaugcaaacuccauaaauccggcuacguaacagucgcccacacaggccaacacgaccucgucaucccucccaacggauacuuccgauucgacuccugggucaaccaauucuacacccucgcccccaugggcaacggcacaggccgccgccgcgcccuauaa

SEQ ID NO: 36421 - RNA, 1623 nt, Artificial Sequence
  derived and/or modified sequence opt11 from VP1__Norovirus__BAJ13780
augaaaauggccuccaacgacgccaaccccucggacggcucugccgccaaccuaguccccgaaguaaacaaugaagucauggcgcucgaacccgucgucggcgcagccaucgcagcacccgucgcaggccaaaccaacguuaucgaccccuggauccgaaacaacuucguccaagcucccggaggcgaauuuaccgucucgccccgcaacgcacccggagaaauucucugguccgcaccccuaggccccgaccuaaaccccuaccuaucccaccucgcccgaauguacaacggcuacgccggaggcuucgaaguccaggucauccuagcuggcaacgccuucaccgcggguaaaauaaucuucgcagccgucccacccaacuuccccaccgaaggacucucucccucccaagucacaauguucccccacauaauagucgacguccgccaacuggaacccguccucaucccccuccccgauguccguaacaacuucuaccacuacaaccaaucaaacgacucaaccaucaaacuaauagccaugcucuacacgccccuccgugccaacaacgccggagaagacgucuucaccguauccugccgcguccucacccgacccucccccgacuuugacuucaucuuccuaguaccucccaccgucgaaucacgcaccaaacccuucaccguacccaucuuaaccgucgaagaaaugaccaacucccgauuccccaucccccuagaaaaacucuucaccggacccucaggugcauucguaguucaaccccagaacggacgcuguaccaccgacggcguccuucuugggaccacacaacuaagccccgucaauaucugcaccuucagaggagacgucacccacauagccggcucucguaacuacaccaugaaccucgccucccucaacuggaacaacuacgaccccacggaagaaauacccgcaccccuaggcaccccagacuucguagguaaaauccagggcguacucacucaaacuacuaaaggcgacggauccacccgaggccacaaagccacagucuacacuggcucagccccauucacaccaaaacuuggaagcguacaguucagcaccgacaccgagaacgacuuugaagcccaccaaaacaccaaauucaccccagucggcguaauccaagacggcagcaccacccaccgaaaugaaccccaacaaugggugcuacccuccuauuccggcagaaacguccaaaacguacaccuugcacccgccgucgcccccaccuuucccggcgaacaacuccucuucuuccgcuccaccaugccaggcugcagcggcuacccaaacauggaccuugacugccuccucccacaagaauggguccaacacuucuaccaagaagcugccccagcgcaaucagacgucgcccuccuacgguucguuaacccagacacaggccgaguccuauucgaaugcaaacuccacaagucaggcuacgucacagucgcccacaccggacaacacgaccuagucaucccacccaacggauacuuccgauucgacagcugggucaaccaauuuuacacccuagcccccaugggcaacggcacaggccgccgacgcgcacucuaa

SEQ ID NO: 36422 - RNA, 1623 nt, Artificial Sequence
  derived and/or modified sequence opt11 from VP1__Norovirus__BAJ13783
augaaaauggcguccaacgacgccaaccccuccgacggcucggccgccaaccucguccccgaagucaauaacgaaguuauggcccuagaaccgguagucggcgccgccaucgccgcccccgucgcuggacaaacaaacgucaucgacccauggauacgaaacaacuucguccaagcacccggcggcgaauuuaccguaucccccagaaacgcaccuggcgaaauucuuugguccgcaccacucggaccagaccuaaaccccuaccuaucacacuuagcccgcauguacaacggcuacgccgguggauucgaaguccaaguaauucuagccggaaacgcauucacggcaggcaaaaucaucuucgccgcagucccacccaacuuccccacagaaggccuaucccccucacaagucacaauguucccccacaucauagucgacguccgacaacuggaaccuguacucaucccccucccagacguccgcaacaauuucuaccacuacaaccaauccaacgacuccaccaucaaacugauagccaugcucuacacaccccuccgcgccaacaaugcaggagaagacgucuucaccguuucuugccgcguccucaccagaccaucccccgacuucgacuucauauuccucguuccacccaccgucgaauccagaacaaaacccuucacaguucccauccucaccgucgaagaaaugacgaacucccgcuuccccaucccccucgaaaaacucuucaccggccccuccggcgcauucgucguccaaccacaaaauggccgcuguacaacagacggaguccuacucggaaccacccaacucucccccgucaacauaugcacauuucgaggcgacgucacccacaucgccgguucccgcaacuacaccaugaaccuagccucacuaaacuggaacaacuacgaccccaccgaagaaauccccgcaccccuaggcacaccggacuuugucggcaaaauccagggaguacuaacccaaacaacaaaaggcgacggcagcacccgcggccacaaagccaccguauacacaggaagcgcccccuucaccccaaaacucggcucuguacaauucuccaccgacaccgaaaacgacuucgaagcccaccaaaacacaaaauucaccccagucggagucauacaagacggcagcaccacacaccgaaacgaaccacaacaauggguccuaccauccuacucaggccgaaacguccaaaacguacaccucgcccccgcagucgcuccaaccuucccaggcgaacagcuccucuucuuccgcuccaccaugcccgggugcuccggauaccccaauauggaccucgacugccuccucccucaagaauggguacaacacuucuaccaggaagccgccccugcccaauccgacguagcacuucuccgauuugucaacccugacacgggacguguauuauucgaaugcaaacuacacaaauccggcuacgucacaguagcucacacaggacaacacgaccuagucaucccucccaacggcuacuuccgauucgacucaugggucaaccaauucuacacccuagcucccaugggaaauggcacagggcgacgacgcgcccucuaa

SEQ ID NO: 36423 - RNA, 1623 nt, Artificial Sequence
  derived and/or modified sequence opt11 from VP1__Norovirus__BAJ13786
augaaaauggccuccaaugacgccaaccccuccgacggcucagccgcaaaccuaguacccgaaguaaacaacgaagucauggcccucgaaccugucguuggcgcugccaucgccgccccagucgcaggacaacaaaacgucauugaccccuggauccggaacaacuuuguccaagcaccaggcggcgaauuuaccgucucaccacgcaacgcccccggcgaaauccucugguccgcaccccugggacccgaccucaaccccuaccuaucacaccucgcccgaauguacaacggcuacgccggcgguuucgagguacaagucauccucgccggcaacgccuucaccgccggcaaaaucaucuucgcagccgucccacccaacuuccccacagaaggccucucgcccucccaagucaccauguucccccacaucaucguagacguccgccaacucgaaccuguccucaucccccuacccgacguccgcaacaacuucuaccauuacaaccagucaaacgacucuacaaucaaacuaaucgccaugcucuacacaccccuccgcgcaaacaacgccggcgaagacguauucaccgucucuugccgcguacuaacucgccccucaccagacuucgacuucaucuuccucguucccccaaccgucgaaucuagaacaaagcccuucaccguaccuauacuaaccguagaagaaaugacaaacucucgcuuucccauaccccuagaaaaacucuucaccggaccaucuuccgccuucguaguacaaccccaaaacggucgaugcaccacggacggcguacuacuaggcacaacgcaacuauccccagucaacaucugcaccuuccgcggugacguuacccacaucgccggcucccgcaacuacaccaugaaccucgccucacucaauuggaacaauuacgaccccacagaagaaauccccgcaccccuuggcacacccgacuucgucggcaagauacaaggcguccucacccaaacaacaaaaggcgacggaucuacacgcggccacaaagccacugucuacaccggaucugcaccauucaccccaaaacuuggcucaguccaauucuccaccgacaccgaaaacgacuucgaaacacaucaaaauaccaaauucacccccgucggcgucauccaagacggcggcaccacacaucgcaacgaaccacaacaauggguacuccccucuuacagcggccgaaacguccccaacguccacuuagcccccgcaguagcccccacauuccccggcgaacaacuacucuucuuccgcucgacaaugccgggaugcucagguuauccaaacauggaccucgacugccuucuuccgcaagaguggguacaacacuucuaccaagaagcagcacccgcccaauccgacgucgcacuacuccgcuucgucaaccccgauaccggacgcguacucuucgaaugcaaacuccacaaauccgguuacguuaccgucgcccacacaggucaacacgaccuggucaucccgccaaacgguuacuuccguuucgacagcugggucaaccaauucuacacucucgcccccaugggcaacggcaccggacgccgacgcgcccucuaa

SEQ ID NO: 36424 - RNA, 1623 nt, Artificial Sequence
  derived and/or modified sequence opt11 from VP1__Norovirus__BAJ13792
augaaaauggccucaaacgacgccaacccaagcgacggcuccgccgccaaucucguacccgaagucaacaacgaaguaauggcccucgaaccaguagucggcgccgccauugcugcccccguugcgggccaacaaaacgucaucgaccccuggauccgcaacaacuucguccaagcacccggcggcgaguucaccguguccccaagaaacgccccaggagaaaucuuaugguccgcuccccucggccccgaccuaaacccauaccucucacaccuugcccgcauguacaacggcuacgccgguggcuucgaaguccaaguuguacuagccggcaacgcauucaccgccggcaaagucaucuucgcagccgucccgcccaacuuccccacagaaggccucucccccucccaagucaccauguucccccacaucaucguggacguccgccaacucgaaccaguccuaaucccuuuacccgacguccgcaauaauuucuaccacuacaaccagagcaacgacuccaccauuaaacucaucgccaugcucuacaccccucuccgcgcaaacaaugcaggagaagacguauucaccguauccugccgaguacugacacgacccucacccgacuucgacuucauuuuccucguaccuccaaccgucgagucacgaaccaaacccuucacaguccccauacugacagucgaagaaaugaccaacucacgcuuccccauaccccucgaaaaacucuucacaggacccucaggugccuucgucguccaaccccaaaacggucgaugcaccaccgacggcguccugcucggaaccacacaacucucacccguaaacaucugcaccuuccgcggcgaugucacacacaucgccggcucccgcaacuacaccaugaaccucgcaucccuaaacuggaacaacuacgacccuacugaagaaauccccgcaccccuagguacccccgauuuuguuggaaaaauacaaggaguccuaacccaaacaaccaaaggugacggcucuacacguggccacaaggccaccgucuacaccggcuccacccccuucacccccaaacucggcuccguccaauuuucgacagacaccgaaaacgacuucgaaaaccaccaaaacaccaaguucacucccguuggugucauccaagacggcggcacuacccaccgaaacgaaccucaacaauggguccuacccucguacuccggacgaaacguccagaacguccaccucgcccccgcagucgcccccacuuucccuggugaacaacuccuauucuuccgaucaaccaugcccggcugcagcggguaccccaacauggaccucgauugccuccucccccaagaguggguccaacacuucuaucaagaagccgcaccagcacaauccgacgucgcccuccuacgcuucgucaaccccgacaccggacggguccucuucgaaugcaaacuacacaaauccggcuacgucaccguugcccacaccggccaacacgaccucgucaucccucccaacggauacuuccgcuucgacuccugggucaaccaauucuacacccucgcccccaugggcaacggcaccggccgccgccgagcccucuaa

SEQ ID NO: 36425 - RNA, 1623 nt, Artificial Sequence
  derived and/or modified sequence opt11 from VP1__Norovirus__BAJ13795
augaaaauggccuccaacgacgccaaccccagcgacgguuccgcagccaaccucguaccugaaguaaacaacgaagucauggcccucgaacccguaguaggcgccgccauugccgccccaguugcaggccaacaaaaugucaucgaccccuggauacgaaacaacuucguacaagcccccggcggcgaguucaccgucucgccacgcaacgcccccggugaaaucccauggucagcaccccuaggccccgaccucaacccuuaccucucacaccuugccagaauguacaacggauaugccggugguuucgaaguccaaguugucuuagcaggcaacgcauucaccgcaggaaaagucauauuugcagccgucccacccaacuuccccacagaaggacucucaccuucucaagucacaauguucccccacaucauagucgacguacgccagcuugaaccaguccuaaucccccucccagacguucguaacaacuucuaccacuauaaccaaucaaacgacuccaccauaaaacucaucgcaaugcuauacaccccauuacgugcaaacaacgcaggcgaagacgucuucacagucuccugcagaguccucaccagaccauccccagacuucgacuucaucuuccucgucccacccaccguugaaucacgcaccaaacccuucacaguacccauacucacaguagaagaaaugacuaacucacgauuccccaucccccucgaaaaacuauuuacaggccccuccggcgccuucgucguccaaccccagaacggccgcugcacaaccgacggcguccuccuaggcacaacacaacucucucccgucaacauauguacauuccgaggcgacgucacccacaucgcaggaagccgcaacuacaccaugaaccuagccucacuaaacuggaacaacuacgacccaacagaagaaauccccgcaccucucggcacccccgacuucgucggaaaaauacaaggcguccuaacacagacaaccaaaggagacgguuccacacgcggccacaaagccacaguuuacaccgguuccacccccuuuaccccaaaacuaggcuccguccaguucucaacugacacugaaaaugacuucgaaaaccaccaaaacacaaaauucaccccgguaggcgucauccaagacgggggcaccacacaccgaaacgaaccccaacaauggguacucccauccuacuccggccguaacguccagaacguccaccucgcacccgccguagcaccaaccuuccccggcgaacaacucuuauucuucagauccaccaugcccggcugcuccggcuaucccaacauggaccucgacugccuccuuccccaagaauggguacaacacuucuaccaagaagccgcccccgcccaaucagacguagcacuacuccgguucguaaaccccgacacaggacguguccucuucgaaugcaagcuacacaaauccggcuacgucaccguugcacacaccggacaacacgaccucguuaucccacccaacggcuauuuccgcuucgacagcugggucaaccaauucuacacccuagcacccauggguaacggaacuggacgccgccgagcccucuaa

SEQ ID NO: 36426 - RNA, 1623 nt, Artificial Sequence
  derived and/or modified sequence opt11 from VP1__Norovirus__BAJ13801
augaaaauggccucaaacgacgccaaccccucagacggaucagcagcaaaccuaguccccgaagucaacaacgaagucauggcucuggaaccagucgucggagccgcaaucgcagcccccguugccggacaacaaaacguaaucgacccguggauccgcaacaacuucguacaagcccccggcggcgaauuuaccguaucuccccgaaacgcccccggagaaauacucugguccgcaccccucggcccagaccucaaccccuaccucucucaccucgcccgaauguacaacggauacgccggcggcuucgaaguccaaguaguccuagccggaaacgcauucacagccggcaaaaucaucuucgccgccguaccacccaacuucccaaccgagggccucuccccaucacaaguaaccauguucccacacauaaucgucgacguacgccaacuggaacccguacuuauuccucuccccgacguccgaaacaacuucuaccacuacaaccaaucaaacgauuccaccaucaaacucaucgccaugcucuacaccccacuccgagcgaacaacgcuggcgaagacgucuucaccgucucaugccgaguacucacucgcccuuccccagauuucgacuucaucuuucugguaccacccaccgucgaaagccgcaccaaacccuucacuguacccauccucaccgucgaagagaugaccaacucacgauuccccaucccccuggaaaaacuauucaccggcccguccggagccuucguaguccaaccccagaacggacgaugcacaacagauggcguccuccucggcaccacccaacucucaccaguaaacaucugcaccuuccgaggcgaugucacccauaucgccgggucccgaaacuacacaaugaacuuagccucacucaacuggaacaauuacgaccccaccgaagagaucccagccccacuuggcaccccagacuucguaggcaaaauucaaggcguacuaacccaaaccaccaaaggcgacggcuccacucgaggccacaaagccaccgucuacacaggcucaacacccuucacacccaaauuaggcuccguccaauuuuccaccgacaccgaaaacgacuucgaaaaccaccaaaauaccaaguucacccccguaggagucauacaagauggcggcaccacacaccguaacgaaccacaacaauggguacuccccuccuacucaggccguaacguccaaaacguccaccucgccccugccgucgcucccaccuucccaggagaacaacuccuauucuuccgauccaccaugcccggcugcuccggcuacccaaacauggaccucgacugccuacuaccccaggaauggguacaacacuucuaccaagaagccgcacccgcacaauccgacgucgcccuucuucgcuucguaaauccugacacuggccgcguacucuucgaauguaaacuacacaagagcggcuacgugaccguugcacacaccggacaacacgaccucguaaucccacccaacggcuacuuccgauucgacuccugggucaaccaguucuacacccuugcaccaaugggcaacggaaccggacgaagacgugcucuauaa

SEQ ID NO: 36427 - RNA, 1623 nt, Artificial Sequence
  derived and/or modified sequence opt11 from VP1__Norovirus__BAJ13804
augaagauggccuccaacgacgcaaacccauccgacgggucugccgccaaccucguccccgaaguaaacaacgaggucauggcccucgagcccgucguaggcgccgccaucgcagcccccgucgcaggccaacaaaacgucauagaccccuggauccgcaacaacuucguucaggcacccggaggagaauuuaccgucucaccccgaaacgcccccggggaaauccuaugguccgcuccacuaggccccgaccuaaaccccuaccucucacaccucgcccguauguacaacggcuacgccggaggcuucgaaguacaagucauccucgccggcaacgccuucaccgccggcaaaauaaucuuugccgcaguaccacccaacuuuccaaccgaaggucucucacccucacaagucacaauguucccgcacauaaucguugacguccgccaacuagaaccuguccucaucccccucccagacguacgcaacaacuuuuaucacuacaaccaaucuaacgacuccaccaucaaacucaucgcuaugcucuacacaccccucagggccaacaaugccggagaagacgucuucaccgucuccugccgaguccuaacccgucccucacccgacuucgacuucaucuuuuuagucccacccaccgucgaaucccgcaccaaacccuucaccguacccauccucaccguagaagaaaugaccaacucccgcuuccccaucccacucgaaaagcucuuuaccgguccaucuucagccuucguaguccaaccacagaacggcagaugcaccacagacggcguacuacucggaaccacccaacucucccccgucaacaucugcaccuuccgcggugauguaacccacaucgccggcucucgcaauuacacaaugaaucuagccucucucaacuggaacaacuacgaccccaccgaggagauuccugcaccccucggcacccccgacuuugucggaaaaauccaaggcguacucacacagaccacaaaaggcgacggcuccacccgaggacacaaagccacagucuacacaggcucagccccguucaccccuaaacucggauccguccaauucuccacugauacagaaaacgacuucgaaacccaccaaaacaccaaauucaccccagucggagucauccaggacggcgguacuacccaccgcaacgaaccccaacaauggguacucccaucguacucaggacgcaacguccaaaacguccaccucgcccccgccgucgcaccuaccuuccccggcgaacaacuccucuucuucaggucaaccaugccaggaugcucaggauaccccaacauggaccucgacugccuacuaccacaagaauggguccaacacuucuaucaagaagccgcccccgcccaauccgacguugcccuacuccguuucgucaaucccgacacuggccgaguccuauucgaaugcaaauuacacaaaucuggcuacguaaccguagcccacacaggccaacacgaucucgucaucccacccaacggcuacuuucgcuucgacuccugggugaaccaauuuuacacccucgcccccaugggcaacggcaccggccgccgccgcgcgcucuaa

SEQ ID NO: 36428 - RNA, 1623 nt, Artificial Sequence
  derived and/or modified sequence opt11 from VP1__Norovirus__BAJ13807
augaaaauggccucaaaugacgcaaaccccuccgauggcuccgccgccaaccucgucccagaggucaacaaugaagucauggcccuagaaccagucgucggcgcugcaaucgccgcccccguagcaggccaacaaaacgugauugaccccuggauccguaacaacuucguccaagcccccggcggagaguucaccguuuccccacgcaacgcaccaggugaaauccuaugguccgcaccacucggacccgaccuuaacccauaccucucccaccuagccagaauguauaacggcuacgccggcggauuugaaguccaagucauacuagccggaaacgccuucaccgccggcaaaaucaucuucgcugccguaccaccaaacuuccccacagaaggccucucaccaucacaaguaaccauguucccccacauaaucgucgauguccgucaacucgaaccaguccucaucccacucccagacguacgcaacaacuucuaccacuacaaucaauccaacgacucaacaaucaaacuaauagcaaugcuauacaccccacuucgagcaaacaacgcuggcgaagacgucuucaccgucuccugccgcguccucacccguccaagccccgacuucgacuucaucuuccucgucccuccuaccgucgaaucacgcacuaaacccuucaccguacccauacuaacaguugaagaaaugacuaacucccgcuucccuaucccccuugaaaaacuuuucacaggcccaucaucagccuucgucguccaaccacagaacggacgcugcacaaccgacggcguacuucuuggcacaacccaacuaucaccagucaacaucugcaccuuccgcggcgacguaacacacaucgccgguucacguaacuacaccaugaaccuggccucacucaacuggaacaacuacgaccccaccgaagaaauccccgccccacucggcacaccugacuucgucggaaaaauacaaggaguacuaacccaaaccaccaaaggcgacggcuccacccgcggucacaaagcaaccgucuacacaggcucugcacccuucacccccaaacucggcucaguacaauucuccaccgacaccgaaaacgauuucgaaacccaccaaaacaccaaauucacuccaguuggcgucauacaagacggaggcacuacccaccgcaacgaaccccaacaauggguucugcccuccuacagcggucgcaacguccccaacguccaccuagccccggccgucgcucccacguucccaggcgaacaacuacucuucuuccgaucuaccaugccaggcugcucaggcuaccccaacauggaucucgacugcuuacuuccccaagaauggguccaacacuucuaccaagaagccgcccccgcccaguccgacgucgcccuccuucgcuucgucaacccagacaccggacguguucuauucgaaugcaagcuccacaaauccggauaugucaccguagcacacacaggccaacacgaccucguaaucccacccaacggcuauuucagauucgacuccugggucaaucaauucuacacccuagcccccaugggcaacggcaccgggcgccgccgcgcccucuaa

SEQ ID NO: 36429 - RNA, 1623 nt, Artificial Sequence
  derived and/or modified sequence opt11 from VP1__Norovirus__BAJ13810
augaaaauggccucaaacgacgcaaauccuuccgacggcuccgccgccaaccuaguuccagaaguaaacaacgaaguaauggcccuagaacccguagucggcgccgcgaucgccgcccccgucgccggccaacaaaacgucaucgacccguggauccgcaacaacuucguucaagcaccaggcggagaguucacagucucgccccgcaacgcuccuggagaaauccucuggucugcaccacucgggccugaccucaaucccuaccuaucccaccucgcccgcauguacaacggauacgccggcggcuucgaaguccaggucauccuugccggcaacgcuuucacagcaggaaaaauaaucuucgcagcagucccacccaacuuccccaccgaaggccucucccccucccaagucacaauguucccccacauuaucguagacguaagacaacuagaacccguccucauaccccuacccgacguccgaaauaacuucuaucacuacaaccaaucuaacgacuccaccaucaaacucaucgcuaugcucuacacaccccuccgugccaacaaugcaggagaagacgucuucacaguaagcugucgcguccucacuagacccucccccgacuucgacuuuaucuuccucguaccacccacggucgaaucccguacaaaacccuucaccguccccauacucaccgucgaagaaaugaccaacucgcgcuucccaaucccauuagaaaaacucuuuacuggccccucauccgccuucgugguacaaccccagaacggucgcugcaccaccgacggcguacuacuuggcaccacccaacuuucacccgucaacauaugcacuuuccgcggcgacgucacccacaucgccggcucccgcaacuauaccaugaaucuagcaucccuaaacuggaacaacuacgacccuaccgaagaaauccccgcuccccucggaaccccugacuucguagguaaaauccaaggcguccuaacccaaacaaccaaaggagauggauccacccgcggccacaaagccaccguuuauaccggcuccgccccauucacacccaaacucgguuccguccaauucucuacugacaccgaaaacgacuucgaaacccaccaaaacaccaaauucacccccgucggagucauccaagacggcggcaccacccacaggaacgaaccacaacaauggguccuccccagcuauagcggccgcaacgugcaaaacguccaccucgccccugccguugccccaacauucccuggagaacaacuccucuuuuuccgaucaaccaugcccggaugcuccggcuacccaaacauggaccucgacugccuauuaccacaagaauggguccagcacuucuaccaagaagccgccccggcccaauccgacgucgcacuccucagauucgucaaccccgacacaggacgcguccucuucgaaugcaaacuccacaaaucuggcuacgucacaguagcccacacgggccaacacgaccuugucaucccuccuaacggcuacuuccgauucgauuccugggucaaccaauucuacacucucgcgcccaugggcaacggcaccggccgccgccgcgcccucuga

SEQ ID NO: 36430 - RNA, 1623 nt, Artificial Sequence
  derived and/or modified sequence opt11 from VP1__Norovirus__BAJ13816
augaaaauggccuccaacgacgccaaccccucugacggauccgcagcaaaccuaguccccgaaguaaacaacgaagucauggcccucgaaccugucgucggcgcagcuaucgccgcacccgucgccggacaacaaaacguuauugaccccuggauacgcaacaacuucguacaagcccccggaggagaguucacagucucaccccgcaaugcccccggcgaaauccuaugguccgcgccccucggccccgaccucaaccccuaccucucccaccucgcacguauguacaacggauacgccggaggcuucgaaguccaagucauuuuagccggcaaugccuucaccgcuggaaaaaucauauucgccgcagucccacccaacuuccccaccgaaggacucucccccucccaagucaccauguucccccacauaaucgucgacguccgccaacucgaaccuguccucaucccacuaccagacguccgaaacaauuucuaccacuacaaccaauccaacgacucaacaaucaaacuuaucgcaauguuauacacaccccuccgcgcgaacaacgccggcgaagacgucuucaccgugucaugccgaguccuaacccgucccagccccgacuucgacuucaucuuccuuguacccccuacagucgaaucacgcacaaaacccuucacaguccccauccuaaccgucgaagaaaugacaaacucccgcuucccuaucccccucgaaaaacuauucacaggcccauccucagcauucgucguccaaccccaaaacggccgaugcaccacugacggaguccuacucggcaccacacaacuaucccccgucaacaucugcaccuucagaggugacgucacccacaucgccggaucccgcaacuauacgaugaaccucgcaucacucaacuggaacaacuacgaccccaccgaagaaauaccggcaccccucggaaccccagacuuugucggcaaaauccaaggggucuuaacccaaaccaccaaaggggacggcuccacuagaggacacaaagccacagucuacaccggcagcgcacccuucacccccaaacugggauccguccaauucucaaccgacaccgaaaacgacuucgaaacucaccaaaacacaaaauucacaccagucggcgucauccaagacggaggaacaacccaucgcaaugaaccccaacaauggguccuccccaguuauucaggaagaaacguccaaaacguacaccucgcccccgccgucgcccccaccuuccccggugaacagcuucuguucuuccgcucaaccaugcccggcugcucaggcuauccaaacauggaccuugacugccuccucccacaagaauggguccagcacuucuaccaagaagccgcccccgcucaguccgacgucgcacuccucagauucgucaaccccgacacuggccggguacucuucgaaugcaaacuucacaaauccggcuacgucacagucgcucacacaggucaacacgaccuaguuaucccucccaacggcuacuucagauucgacuccugggucaaccaauucuacacccuagcccccaugggcaacggaaccggccgccgccgugcacucuaa

SEQ ID NO: 36431 - RNA, 1623 nt, Artificial Sequence
  derived and/or modified sequence opt11 from VP1__Norovirus__BAJ13819
augaaaauggccucaaaugacgccaaccccucugacggcuccgccgcaaaccuagucccagaagucaacaacgaagucauggcacuagaacccgucgucggcgccgcaauagcggcacccgucgccggccagcaaaacgucauagaccccuggauccgcaacaacuucguacaagcccccggcggagaguucacagucuccccacgcaaugcucccggcgaaauccuauggagcgcaccacuaggacccgaccuaaacccauaccuaucucaccuagcccgcauguacaacggcuacgcaggaggauucgaaguccaaguaauccuagcaggaaacgcuuucaccgccggaaaaauaaucuucgccgccguacccccaaauuuccccacagaaggccuaagcccaucccaagucaccauguucccccauaucaucgucgacguccgacaauuagaacccguccucaucccccuccccgacguccguaacaacuucuaccacuacaaccaaucgaacgacucaaccauaaaauuaaucgccaugcuauacacaccccuccgcgcaaacaacgccggagaagacgucuucaccgucuccugccgaguacucacccgccccagcccagacuucgacuucaucuuccucgucccacccacagucgaaucccgaacuaaacccuucacaguccccauccuuacagucgaagaaaugaccaacucccgcuuccccaucccccucgaaaaacucuucacaggcccauccggcgcauucguuguacaaccccaaaacggccgauguacaaccgauggcguccugcuaggcacaacacaacucuccccaguaaacaucugcaccuuucgcggggacguaauccacauagccggaucccgcaauuacaccaugaaccucgccgcccucaacuggaacaacuacgaccccacagaagaaauccccgcaccccucggcaccccagacuucgucggcaaaauccaagggguccucacccaaaccacaaaaggugacggcuccacccgaggccacaaagccaccguauacaccggauccgcagacuuuaccccaaaacucggauccguucaauuuucuaccgacacagaaaacgacuucgaaacacaucagaacacaaaauucacccccgucggcgucauccaggacggcucgaccacccaucgaaacgaaccacaacaguggguccugccgucauacuccggccgaaacgugcacaacguacaccuggcccccgccguagcucccaccuuucccggcgaacaacuacucuucuuccgcuccaccaugcccggaugcuccggcuaccccaacauggaccuagacugccuccuaccccaggaauggguccaacacuucuaccaagaagccgcccccgcacaauccgacgucgcucuacuacgcuucgucaaccccgacaccggacgcguccucuucgaaugcaaacuccauaaaucagguuacgucaccguagcccauacuggccaacacgaccucguuaucccacccaauggcuacuuccgcuucgacucaugggucaaccaauucuacacucucgcacccaugggcaacggaaccggacgacggagagcccucuaa

SEQ ID NO: 36432 - RNA, 1623 nt, Artificial Sequence
  derived and/or modified sequence opt11 from VP1__Norovirus__BAJ13822
augaaaauggccagcaacgacgccaacccuagcgacggcuccgcagccaaucucguccccgaagucaacaacgaaguaauggccuuagaaccagucgucggcgccgcuaucgccgcacccgucgccggacaacaaaaugucaucgaccccuggauccgaaacaacuucguccaagccccaggcggagaguucaccguaagcccccggaacgccccaggagaaauccuuugguccgcaccccucggaccggaccuaaaucccuaucucucucaccucgcccgcauguacaacggcuacgccggcggcuucgaaguacaagucauccucgccgggaacgccuucaccgcaggaaaaauaaucuucgccgccguuccacccaacuuccccaccgaaggacucuccccaucacaagucaccauguucccccacaucaucgucgacgucagacaacucgaacccguccucaucccccuccccgacguccgcaacaacuucuaccacuacaaccaauccaacgacuccacuaucaaacuaaucgcuaugcuuuacacaccccuaagagccaacaacgcaggcgaagacgucuucaccgucuccugcagaguccuaacccgacccucacccgacuucgacuucaucuuucuagucccacccaccgucgaguccagaaccaaacccuuuacugucccaauccuuacaguagaagaaaugacuaacucccgcuucccaaucccccuugaaaaacuauucacaggccccucauccgcauucgucguccaaccacaaaacggccgaugcacaacagacggaguccuccuggguacuacacaacuauccccaguuaacaucugcaccuuccgaggagacgucacccacaucgccggaucucgcaauuacaccaugaaccucgcaucccucaacuggaacaacuacgacccaaccgaagaaauaccagcaccccucggcacaccggacuucgucggcaaaauacaaggaguacucacccaaacaaccaaaggcgacggcucaacacgcggccacaaagccaccgucuacaccgguucagcccccuuuacaccaaaacucggcucaguccaauucuccaccgacacugaaaacgacuucgaaacccaccaaaacacgaaauucacaccaguaggagucauccaggacggaggaaccacccaccgaaacgaaccccaacaauggguccuccccuccuauuccggucgcaacguacaaaacguccaccucgcccccgccgucgccccaacauuccccggcgaacaacuacucuucuuucgcagcacgaugccaggcugcucuggauacccaaacauggaccucgacugccuccugccccaagaauggguucagcacuuuuaccaagaggccgcucccgcccaauccgacguagcauuacuccguuucguaaaccccgacacaggcagaguacucuucgaaugcaaacuacauaaauccggauacguaacagucgcacacaccggucaacacgaccuagucaucccacccaauggcuacuuccgcuucgauucauggguaaaccaauucuacacacucgcccccaugggcaacggcacaggcagacgacgcgcccucuaa

SEQ ID NO: 36433 - RNA, 1623 nt, Artificial Sequence
  derived and/or modified sequence opt11 from VP1__Norovirus__BAJ13825
augaagauggcuagcaacgacgcaaacccuucagacggauccgccgcaaaccucguccccgaaguaaacaacgaaguaauggcccucgaacccgucgucggagccgcaauagccgcacccgucgcaggccagacaaacgucauugacccauggauccgcaacaacuucguacaagcccccggaggagaauucaccguaucaccccgaaacgcccccggcgaaauccucuggucugcuccacucggcccugaccucaaccccuaucucucccaccucgcccgaauguacaacggcuacgccggcggcuucgaaguacaagugauacuugccggaaacgcauucaccgccggaaaaauaaucuucgccgcaguuccaccuaacuuccccaccgaaggacuaucccccucccaagugaccauguucccgcacaucaucgucgacguacgccaacucgaaccaguucucauccccuugcccgacguacgaaacaacuucuaccauuauaaccaaucaaaugauuccaccaucaaacuaaucgcuaugcucuauacuccccuccgagccaacaacgcgggcgaagacguauucaccgucuccugucgcguccugacacgcccaucccccgauuucgacuucaucuuccucaccccccccaccgucgaaucccgcacaaaacccuucaccguccccauccuaacagucgaagaaaugaccaacucccgcuucccaauaccacuagaaaaacuuuucacaggccccucaggcgccuucgucguacaaccccaaaacggccgcuguaccaccgacggaguccuacuaggaacaacccaacucuccccagucaacaucugcacauucagaggcgacguaacccacauugccggcucccgcaacuacaccaugaacuuagccucucucaauuggaacaauuacgaccccaccgaagaaauccccgccccccuaggcaccccagacuucguaggcaaaauucaagguguccuaacccaaacaacaaaaggcgacggaucuacccggggccacaaggccacuguauauaccggcuccgcccccuucaccccaaaacucggcuccguccaauucuccaccgacaccgaaaaugacuucgaagcccaccaaaacaccaaguucacccccgucggcguaauacaagauggcucaaccacccaccgaaacgaaccccaacaauggguacugcccucguacuccggacgcaacguccaaaacguccaccucgccccagccgucgcacccaccuucccaggcgaacaacuccuauucuuccgcucaacuaugccuggcugcuccggguaccccaacauggaccucgauugccuccucccccaagaauggguccaacauuucuaccaagaagccgccccagcccaauccgacuuagcccuacuacgauucguuaaccccgacaccggacgaguccucuucgaaugcaaacuccauaaauccggcuacgucaccguugcacacaccggccaacacgaccucgucauacccccgaauggauacuuccgauucgacuccugggucaaccaauucuacacacucgcaccaaugggcaacggcaccggccgccgacgcgcccuuuga

SEQ ID NO: 36434 - RNA, 1623 nt, Artificial Sequence
  derived and/or modified sequence opt11 from VP1__Norovirus__BAJ13828
augaaaauggcaucuaacgacgcaaaccccuccgacggcuccgccgccaaccucguacccgaagucaacaaugaaguaauggcccucgaaccagucgucggcgcugccauagccgcaccaguagcaggccaacaaaacguuaucgaucccuggauccgaaacaacuucguacaagccccaggaggagaauuuaccgucucaccccgcaacgcacccggggaaauacucuggucggccccacucggucccgaccuaaaccccuaccucucccaccuugcucgcauguacaacggcuacgccggcggauucgaaguccaagucauccucgccggaaacgccuucacugccggcaaaaucauauucgccgccgucccacccaacuuccccaccgaaggauuaucuccuucacaagucacaauguucccccacaucaucgucgacguccgccaacucgaacccguacucaucccacuacccgacguccgcaacaacuucuaucacuacaaccaaagcaacgacagcaccauaaaauuaauagccaugcucuacaccccucuccgcgccaacaacgcaggcgaagacguauucaccguauccuguagaguccucaccagacccucuccagacuucgacuucauauuccucguaccacccaccgucgaaucccgaaccaaacccuucacuguacccauacuaaccgucgaagaaaugaccaacucccgauuccccauccccuuagaaaaacucuuuaccggcccaagcuccgccuucgucguucaaccccaaaacggccgcugcacaaccgacggaguccuccuaggaaccacccaacucucccccguaaacaucugcacauuucgcggagacguuacccacaucgccggcucccgaaacuacacuaugaaccuagccucccucaauuggaacaacuacgacccuaccgaagaaauccccgcuccacucggcacccccgauuuugucggcaagauccaaggcguccuaacccaaaccaccaaaggcgauggcuccacacgaggacacaaagccacgguauacaccggaucugcccccuucacaccaaaacuuggcuccguccaauucucuaccgacaccgaaaacgacuucgaaacccaccaaaacaccaaauucacccccguaggcgucauccaagacggcgguacaacccaucgcaacgaaccccaacaauggguccuaccuuccuacuccggccgaaacguucccaacguacaccuagcucccgcagucgcccccacauuccccggcgaacacucccuauacuuccgcucaaccaugcccggcugcaguggauacccuaacauggaccuagacugccucuuaccccaagaauggguacagcacuucuaccaagaagcugccccagcccaaucagacguagcacuccuccgauucgucaacccagacaccggacgcguacuauucgaaugcaaacuacacaaauccggcuacgucaccgucgcacacacaggccaacacgaccuagucauaccaccaaacgguuauuuccgcuucgacuccugggucaaccaauucuacacccuggcccccaugggaaacggcaccggccgacgccgcgcccuuuga

SEQ ID NO: 36435 - RNA, 1623 nt, Artificial Sequence
  derived and/or modified sequence opt11 from VP1__Norovirus__BAJ13831
augaaaauggccucaaacgacgcuaaucccagcgauggcuccgccgccaaccuagucccagaagucaacaacgaggucauggcccucgaaccagucgucggcgccgccaucgccgcccccgucgccggucaacagaacgucauagaccccuggauacgaaacaacuucguccaagcccccggaggcgaguucacagucucuccccguaaugcaccaggcgaaauccucugguccgcaccccucggccccgaccucaaucccuaccucucccaccuugcccgcauguacaacggcuacgccggcggcuucgaaguccaagucauccucgccggcaacgccuuuaccgccggcaaaaucauauucgccgcuguucccccuaacuucccaaccgaaggccuaucccccucccaagucaccauguucccccauaucaucgucgacguccgacaacucgaacccguccucaucccacuccccgacguacgaaacaacuucuaccacuacaaccaauccaaugacuccaccaucaaacucauagcuauguuauauacaccccuaagagccaacaacgcuggcgaagacguauuuaccgucucaugccgaguacucacccgcccuuccccugacuucgacuucaucuuccucguaccacccaccguagaaucacgaaccaaaccuuucaccguacccauccuaaccguagaagaaaugaccaacagccgcuucccaaucccccuagaaaaacucuucacaggcccaucauccgccuucgucguacaaccacaaaacggccgcugcacaaccgauggaguccuccugggcaccacccaacucucaccaguaaacauaugcacauuccgcggcgacguaacacacaucgccggaucucgcaacuacaccaugaacuuagcaucccuuaacuggaacaacuacgaccccaccgaagaaauccccgcaccccucggcacacccgacuucguaggcaaaauccaaggcguacuaacucaaaccacaaaaggagacggcuccacacgcggccacaaagccaccgucuacaccggguccgcccccuucacaccuaaacuaggaagcguccaauucuccaccgacaccgaaaaugacuuugaaacccaccaaaacaccaaauucacuccaguaggcgucauccaagacggcgguaccacucacagaaaugaaccacaacaauggguccucccuucauacucaggccgcaauguacccaacguacaccucgcccccgcagucgcacccaccuuccccggcgaacagcucuuauucuuccgcuccaccaugcccgggugcucaggauacccaaacauggaccuagacugccuccucccacaagaauggguacaacauuucuaccaagaagccgcccccgcacaauccgacgucgcacuccuacgcuucguuaaccccgacaccggccgcguacucuucgaaugcaaacugcacaaauccggauacgucaccguugcccacacaggccagcacgaucuagucaucccacccaauggcuacuuccgcuucgacuccuggguaaaccaauucuacacccuagcacccaugggcaacggcaccggucgucgccgagcccucuaa

SEQ ID NO: 36436 - RNA, 1623 nt, Artificial Sequence
  derived and/or modified sequence opt11 from VP1__Norovirus__BAJ13834
augaaaauggcauccaacgacgcuaaucccagcgacggaucagccgccaaccuuguccccgaagucaacaacgaagucauggcucuagaacccgucguuggcgccgcuauugccgcccccguagcaggccaaacaaacgugaucgaccccuggauccgcaacaacuucguccaagcacccggaggagaauuuacugucuccccacgcaacgcacccggagaaauacucuggucagcaccacuaggcccagacuuaaacccauaccuaucucaccucgcccgaauguacaacggcuacgccggcggcuucgaaguccaagucauccuagcuggcaacgcauucacugccggaaaaauaaucuucgccgccgucccacccaacuuccccacagaaggacucucccccucccaggucacaauguucccccacaucaucguagacguccgccaacucgaacccguccucauaccucuccccgauguccgcaacaacuucuaccacuauaaccaauccaacgacuccaccaucaaacuaauagcaaugcucuacacaccccugagagccaacaacgccggcgaagacguauucaccgucucaugccgcguccucaccagacccucccccgauuucgacuucaucuuccuaguaccaccaacagucgaaucccgaaccaaaccauucacaguaccaauccuaaccgucgaagaaaugaccaacucaagauuccccauaccacuugaaaaacuauucacuggccccuccggagcauucgucguccaaccccaaaacggccgcugcaccaccgacggaguacuacuuggcaccacccaacucucaccugucaacaucugcaccuuccgcggagacgucacccacauagccggaucccgcaacuacacgaugaaccuggccucccuaaacuggaacaacuacgaccccaccgaagaaaucccugccccacucgggacccccgacuucguagguaaaauccaaggcguccucacccagacuaccaaaggcgacggcuccaccagaggccacaaagcaacagucuacacaggauccgccccauucacccccaaacucggcuccguucaauucucaacagauaccgaaaacgacuucgaaacucaccagaacaccaaauuuacacccgucggagucauccaagacggcaguaccacacaccgcaaugaaccccaacaauggguccuucccucauacucaggccgaaacguccacaacguacaccuagccccagcaguagcccccaccuucccaggagaacaacuacuguucuuucgauccaccaugcccgguugcucuggauacccaaacauggaccucgacugccuucucccccaagaauggguccaacauuucuaccaagaagcagccccagcccaauccgacgucgcacuccuccguuucguaaaccccgacaccggccggguccucuucgaaugcaaacuccacaaaagcggauacgugacagucgcacacaccggccaacacgaccucgucaucccacccaacggauacuuccgguucgacuccugggucaaccaauucuacacccucgcccccaugggcaacggcacuggacgccgccgcgcccucuaa

SEQ ID NO: 36437 - RNA, 1623 nt, Artificial Sequence
  derived and/or modified sequence opt11 from VP1__Norovirus__BAJ13837
augaaaauggcuuccaacgacgccaacccauccgacggcucagcugccaaccucgucccagaggucaacaacgaagucauggcccuagaaccaguagucggugccgcaaucgcggcccccgucgcuggacaacagaacgucaucgaucccuggauccgcaacaacuucguacaagccccaggaggcgaguucacagucucaccccgcaacgccccgggagaaauccuaugguccgcaccccuaggccccgaccuaaacccuuaccugucacaccucgcccgaauguacaacggguacgccgguggcuucgaaguccaagucauacuagccggcaacgcauuuaccgccggcaaaaucaucuucgcagccguaccaccaaacuucccaaccgaaggccucagccccucccaaguaaccauguucccacacauaaucgucgacguacgccagcucgaacccguccucaucccccuucccgacguacgaaacaacuucuaccacuauaaccaaagcaacgauucaaccaucaaacucauagccaugcucuacacuccccuccgcgccaacaacgccggcgaagacgucuucaccgucagcugccgcguucuaacccgccccuccccugacuucgacuucauauuucucguacccccaaccgucgaaucccgcaccaaacccuucaccguuccuauucucaccguagaagaaaugacuaacagccgcuuccccaucccacucgaaaaacuauucaccggcccuuccucagccuucgucguccaaccccaaaacggccgaugcacaaccgauggaguucuccuugguacaacacaacuaucacccgucaacaucugcaccuucagaggcgacguaacacacaucgcaggcucaagaaacuauaccaugaaccuagcuucacucaacuggaacaacuacgacccuaccgaagaaauccccgcaccccucggcaccccagacuuuguaggaaaaauacaagguguacuuacacaaacaacaaaaggugacgggucuacccgaggccacaaagccaccgucuauaccggauccgcccccuucacaccaaaacucggaucaguccaauucuccacagacaccgaaaacgacuucgaaacccaccaaaacacaaaauucacucccguaggcgucauacaagauggaggcaccacacaccgcaacgaaccacaacaauggguacucccauccuacuccggccgaaacguccccaacguccaccucgccccagccgucgcccccacauuccccggcgaacaacuccucuucuuccgcucaacuaugccuggcuguuccggauaccccaacauggaccucgacugccuccucccccaagaauggguccaacacuucuaccaagaagccgcacccgcacaauccgacgucgcccuccuccgauucgugaaccccgauaccggacgcguccucuucgaaugcaaacuacacaaauccggauacgucaccguagcccacaccggccaacacgaccuagucauaccaccaaacggcuacuuccguuucgauuccugggucaaccaguuuuacacccuugcacccaugggcaacggaacgggacgacgccgugcacucuaa

SEQ ID NO: 36438 - RNA, 1623 nt, Artificial Sequence
  derived and/or modified sequence opt11 from VP1__Norovirus__BAJ13840
augaaaauggccagcaacgacgccuccccaucagacggcuccgcagccaacuuaguacccgaaguuaacaacgaaguaauggcccuagaaccagucgucggcgccgcaaucgccgcaccuguugccggacaacaaaacgucauugacccauggaucagaaauaacuucguccaagcacccggcggcgaguucacagucuccccacgaaacgcacccggcgaaauacucuggucugcaccccucggcccagaccucaacccguaccucucccaccuugcccgcauguacaacggcuaugccggcggcuucgaaguacaagucauacucgccggaaacgcauucacagccggcaaaaucauauucgcagccgucccacccaacuuccccaccgaaggccuuucacccucccaagucacaauguucccacacauaaucgucgacguacgccaacuagaacccguacuuauaccccuccccgacguccgaaacaauuucuaccacuacaaccaauccaacgauuccaccauaaagcucaucgccaugcucuacaccccucuccgcgccaacaacgcaggcgaagacguauucacuguaucuugccgcguccucacccgccccucccccgacuucgacuucaucuuccuaguaccaccaacagucgaaucaagaaccaaacccuucaccguaccaauccucaccguagaagaaaugaccaacagccgcuuccccauaccccucgaaaaacucuucacgggacccuccggagccuucgucguccaaccucagaacggccgaugcacaaccgacggcguccuacucgggaccacacaacuaucccccgucaacaucuguacuuuccgcggcgauguaacacacauugccggaucacgcaacuacacaaugaaucuagccgcacucaacuggaacaacuacgaccccaccgaagaaauccccgcaccccucggcacaccugauuuugucggcaaaauccaaggaguccucacacaaaccaccaaagccgacggcaguacacgaggccacaaagccaccgucuacacgggcuccgccgucuucaccccaaagcucggcuccguccaauuuucaaccgacaccgaaaacgauuucgaaacgcaccagaacaccaaauucacucccgucggcgucauacaagacgguucaaccacccacaggaacgaaccccaacaauggguccuccccuccuacaguggccgaaacguacacaacguccaccucgcacccgcagucgcgcccacauucccaggcgaacaacuacuuuucuuccgcagcaccaugcccgguugcucuggcuacccuaacauggaccucgacugccuacucccacaagaauggguccaacacuucuaccaagaagccgcccccgcccaaucagacguugcccuccuccgcuucgucaaccccgacacaggccgcguacucuucgagugcaaacuccacaaauccggcuacguaacagucgcucacacaggacaacacgaccucguaauaccacccaacggcuacuuccgguuugacuccugggugaaccaauucuacacccucgcacccaugggcaacggaacaggccgcagacgagcccuauaa

SEQ ID NO: 36439 - RNA, 1623 nt, Artificial Sequence
  derived and/or modified sequence opt11 from VP1__Norovirus__BAJ13843
augaaaauggccagcaacgacgcuaacccaucagacggcagcgcagcaaacuuagucccugaagucaauaaugaaguaauggcacucgagcccguugucggcgcugcuaucgccgcccccgucgccggacaacaaaauguaaucgauccauggauccguaacaacuucguccaagccccaggcggcgaguucaccguuuccccacgaaacgcccccggcgaaauccuauggucagccccacucggacccgaccuaaaccccuaucuuucccaccucgcacgcauguacaacggcuacgcuggcggcuucgaaguccaagucauacucgccggcaacgcauucaccgccggcaagauaaucuucgccgccgucccaccgaacuuccccacagaaggccucucaccaucccaagucacuauguucccacacauuaucguagacguccgucaacuagaacccguccucaucccacucccagauguccgcaacaacuucuaccacuacaaccaauccaacgauuccaccaucaaacuuauagcaaugcucuacacaccccuuagagcaaacaacgccggagaagacgucuucacagucuccugccgaguccucacacgcccaucacccgacuucgacuucauauuccuagucccacccaccgucgaaucccgcaccaaacccuucaccguacccauacuaaccgucgaagaaaugaccaacucccgcuuccccaucccccuugaaaaacucuucaccggaccaucuuccgccuucguaguucaaccccaaaacggccgcugcacgacggacggcguccugcuaggcacaacccaauuaagccccgucaacaucugcacauuccgaggcgacguuacacacaucgccggcucacgcaacuacacaaugaaccucgccucccucaacuggaacaauuacgaccccacagaagaaauccccgcaccacuagggacgcccgacuucgucggaaagauccaagguguccuaacucaaaccaccaaaggcgauggauccacccgcggccacaaagccaccgucuacacaggcucagcuccauucacccccaaacuuggcuccguccaauucucaacagacaccgaaaacgacuucgaaacacaucaaaacaccaaauuuacacccgucggaguaauacaagacggaggaaccacacacagaaacgaaccccaacaauggguccuaccuuccuacucaggccgaaacguacccaacguacaccucgcucccgccgucgcccccaccuucccaggcgaacaauuacuguucuuccgcagcacaaugcccggcugcucaggcuauccuaacauggaccuagacugccuccuaccacaagaauggguacaacacuucuaccaagaggccgcccccgcacaaucugacgucgcccuccuaagauucguaaaccccgacaccggccgcguccucuucgaaugcaaacuccacaaaagcggcuacguaaccguugcccacaccggacaacacgaccucgucauucccccaaacggauacuuccgcuucgacuccugggucaaccaauucuacacccuugcacccaugggcaacggcacuggccgccgccgcgcucuauaa

SEQ ID NO: 36440 - RNA, 1623 nt, Artificial Sequence
  derived and/or modified sequence opt11 from VP1__Norovirus__BAJ13846
augaaaauggcauccaacgacgccaacccuucugacggcagcgcagcaaaccuaguccccgaaguaaacaacgaaguaauggccuuagaaccggucgucggcgccgccaucgcagcccccgucgccgggcaacaaaacgucaucgaccccuggauccgcaacaacuucguccaagcuccaggcggagaguucacugucucaccccgcaacgccccaggcgaaauccuaugguccgcaccccucggcccugaucucaaccccuaccucucacaccuagcccguauguacaacggcuacgccggcggcuuugaagugcaaguaauccucgcuggcaacgccuucacagccggaaaaaucaucuucgccgcagucccucccaacuuucccaccgaaggccucagcccaucccaaguaaccauguucccccacauaauagucgacguccgacaacucgaacccguacuaaucccccuccccgacguccgcaacaacuucuaccacuacaaccaauccaacgacucuacgauaaaacucauagccaugcucuacacaccccuacgcgcuaacaacgccggcgaagacguauucaccgucagcugccguguucucacaagacccucucccgacuucgacuucauauuccuuguacccccaaccgucgaaucccgcaccaaacccuucaccgucccgauccuaaccgucgaagaaaugacaaacucacguuuccccaucccacucgaaaaacucuucacaggacccucaagcgccuucgucguccaaccacaaaacggacgaugcacaaccgauggggugcuacucggaacuacccaacucucaccagucaacauaugcaccuuccgaggagacguuacucacaucgccggcucccgcaacuacacaaugaaccucgccucccucaacuggaacaacuacgaccccacagaagaaauccccgcaccacucggcacccccgacuucgucggcaaaauccaaggcguacucacccaaacaaccaagggcgacggcucuacccguggucauaaagccacugucuacaccggcagugcccccuuuacacccaaacucggcuccguccaauucuccacagacacugaaaacgacuucgaaacccaccaaaacacaaaauucacaccagucggcguaauucaagacggcggcaccacccacagaaacgaaccacaacaauggguccucccuuccuacagcggacguaauguucccaacguccaccucgccccagcaguagccccaaccuuccccggcgaacaauuacucuucuuccgcuccacaaugccaggcugcucaggcuaccccaacauggaccuagacugccuacuuccccaagaauggguccaacacuucuaccaagaagcugcccccgcacaauccgacgucgcacuccucagauuugucaaccccgacaccggccgcguccucuucgaaugcaaacuacacaaauccgguuaugucacuguagcccacaccggccaacacgaccucguaaucccacccaacggcuacuuccgcuuugacuccugggucaaccaauucuacacccucgcccccaugggcaacggaaccggccgacgccgcgcccuuuaa

SEQ ID NO: 36441 - RNA, 1623 nt, Artificial Sequence
  derived and/or modified sequence opt11 from VP1__Norovirus__BAJ13849
augaaaauggccucaaacgacgccaaccccucagauggcagcgccgccaaccugguccccgaaguuaacaacgaagucauggcccucgaacccgucgucggagccgccaucgccgcccccguagcaggucaacaaaacguaauagacccauggauuagaaacaacuucguccaagcacccgguggcgaauuuaccguaucaccccguaacgcccccggcgaaauucuuuggucagcaccccuuggacccgaccucaaccccuaccucucccaccucgcccgcauguacaacgguuacgccggaggcuucgaaguccagguuauacucgccggcaacgccuucaccgccggcaaaauuaucuucgccgccgucccucccaacuuccccaccgaaggccucucccccucacaaguuaccauguucccccacaucaucguagacguucgccaacuagaacccguguuaauaccccuaccagacguccgcaacaacuucuaccacuauaaccaauccaacgauucaacaaucaaacuaaucgccauguuauacaccccacuacgcgccaacaacgcuggcgaagacguauucaccgucucuugucgcguacucacacgucccuccccugacuucgauuuuaucuuccucgucccgcccaccgucgaaucccgcaccaaacccuucaccguccccauacucaccgucgaagagaugacuaauucuagauuuccaaucccccuagaaaaacuuuucacaggacccucaucugcauucguaguccaaccccaaaauggacguugcaccaccgacggcguccuccuaggcaccacacaacuaucccccguaaacaucugcaccuuccgcggcgacgucacccacaucgcaggcucacgcaacuacacaaugaaccuagccucccucaacuggaacaacuacgacccuaccgaagaaauccccgcaccccuaggcacacccgacuucgucggcaagauccaaggcguccuaacacaaaccaccaaaggcgacggcucaacacgcggccacaaagcaaccgucuacacaggcucagcucccuucacgccaaaacucggcucugugcaauucuccacagacaccgaaaacgacuuugaaacccaccagaacacaaaauucacccccgucggcgucauucaagacggcggcacuacacaccguaacgaaccccaacaauggguccuccccucguacuccggccgaaacguccccaacguccaccuugcacccgccgucgcccccacuuuccccggcgaacaacuacuauucuuccgcucaaccaugcccggcugcagcggauaccccaauauggaccucgauugccuccucccccaagaauggguacaacacuucuaccaagaagccgcccccgcucaaucugaugucgcccuccuccgcuucgucaaucccgacacuggccgaguccuauuugaaugcaaacuccauaaauccggcuacgucacagucgcccauaccggacaacacgaccucguaaucccacccaaugguuacuuucgcuuugacucauggguuaaucaauucuacacccuagcucccaugggcaacggaacaggacgucgccgggcccucuaa

SEQ ID NO: 36442 - RNA, 1623 nt, Artificial Sequence
  derived and/or modified sequence opt11 from VP1__Norovirus__BAJ13852
augaaaauggccucaaacgacgcaaaccccucagacggauccgccgcaaaccucgucccagaagucaacaacgaagucauggcccucgaacccgucguaggagcagccaucgcagcaccugucgccggacaacaaaacgucauagaccccuggauacguaacaacuucguccaagcccccgguggcgaauuuaccguuucaccccgaaaugcccccggagaaauacuauggagcgcaccacuaggucccgaccucaacccauaccucucccaccuagcacgcauguacaacggcuacgccggcggcuucgaagugcaggucauccucgcaggcaacgccuucacagccggcaaaauaauauucgccgccguaccacccaacuuccccacggaaggccuaucacccucacaagucaccauguucccccacauaaucgucgacguaagacaacucgaacccguacucaucccgcuacccgacgucagaaacaacuuuuaccacuacaaccaguccaaugacucaacuaucaagcucaucgccaugcucuacacuccccuacgcgcaaacaacgcaggagaagacgucuucaccgucuccugccgaguccucacccgaccaucaccagacuucgacuucauauuccucgucccacccaccguagaauccagaaccaaacccuucacaguccccauccuuacaguagaagaaaugaccaacucaagauucccuaucccccucgaaaaacucuucaccggacccucuuccgccuucguaguccaaccccaaaacggacgcugcaccaccgacggcguacuccucggaaccacacaacucucacccguaaacauaugcacauucagaggugacgucacucacaucgccggauccagaaacuacaccaugaaccucgcaucucuaaacuggaacaacuacgaccccacagaagaaauccccgccccacuggggacuccagacuucgucggaaaaauccaaggagugcucacacaaaccacaaaaggcgacggcuccacccgaggucacaaagccaccguauacaccggauccgcacccuucacacccaaacucggcucaguccaauucuccacagacaccgaaaacgacuucgaaacccaccaaaacaccaaauucacccccgucggaguaauacaggacggcggcaccacacaccgcaacgaaccacagcaauggguccuccccuccuacucuggccgaaacguacccaacguacaccucgcccccgccgucgcacccaccuuuccaggcgaacaacuccucuuuuuccggucuacuaugcccggcugcuccggauauccaaacauggacuuagacugccuacucccacaagaauggguacaacacuuuuaccaagaagccgcucccgcccaauccgacgucgcccuacuccgcuuugucaaccccgacaccggcagaguccucuucgaaugcaaacuccacaaaccagguuacguaaccgucgcucacacaggacaacacgaccuagucauccccuccaacggcuacuuccgauucgacucauggguaaaccaauucuacacuuuagcacccaugggcaacggcacaggccgacgacgcgcccucuaa

SEQ ID NO: 36443 - RNA, 1623 nt, Artificial Sequence
  derived and/or modified sequence opt11 from VP1__Norovirus__BAJ13855
augaaaauggccucaaaugacgcaaaccccuccgauggcucugccgcaaaccuaguaccagaagugaacaacgaaguuauggcccucgacccagucgucggcgcagccaucgccgccccagucgcaggacaacaaaacguuaucgaucccuggauacgaaacaacuucguccaagcacccggcggcgaauuuacagucuccccucgcaacgcccccggcgaaauacuaugguccgcaccccuaggacccgaccucaaccccuaccucucacaccucgcccgcauguacaacggcuacgccggcggcuucgagguucaaguaauucuugccgguaacgccuucaccgccggcaaaauaauauucgcugccguuccaccaaacuucccaacugaaggacucucccccucacaagucaccauguucccccacaucaucgucgacguccgacaacucgaaccaguacucaucccccuaccagacguacgaaacaacuucuaucacuacaaccagucaaacgacuccacuauaaaacucauagcuaugcucuacacaccccucagagccaacaacgccggcgaagauguauuuaccguauccugccgaguacucacccgcccaucccccgacuucgacuuuauaugccuagugccucccaccgucgaaucacgcacuaaacccuucaccguaccgauccuaaccguagaagaaaugacuaacucccguuuccccaucccacucgaaaaacucuucacaggccccucuuccgccuucgucguccaaccacagaacggccgcugcaccacagacggcguccuacuagguaccacccaacucucccccgucaacaucuguaccuuccgcggagacguaacacacaucgccggaucacgcaacuacacaaugaaccucgccucacucaacuggaacaacuacgacccgaccgaagaaauaccagccccgcuaggaacccccgacuuugucggaaagauccaaggcguccuuacccaaacaaccaagggugacggcagcacacgcggacacaaagccaccgucuacacuggaucagcccccuucacccccaaauuaggcucaguccaauucuccacagacaccgaaaacgacuucgaaacccaccaaaacacaaaauucacacccgucgguguuauccaagacggcggcaccacccaccgaaaugaaccccaacaguggguacucccuuccuacuccggucgcaacguccccaacguccaucucgcccccgccgucgcccccaccuucccaggagaacaacuccuuuucuuuagaucaaccaugcccggauguuccggcuaccccaacauggaccuagacugccuacucccacaagaauggguacaacacuucuaccaagaagccgcacccgcccaauccgacgucgcacuccuccgcuucgucaacccagacaccggccgaguacucuucgagugcaaacuccacaaauccggcuacgucaccgucgcccacacuggccaacacgaccucgucauaccacccaacggauacuuccgcuucgauucuugggucaaccaauuuuacacccuagccccaaugggcaacggcacaggccgccgacgagcacuuuaa

SEQ ID NO: 36444 - RNA, 1623 nt, Artificial Sequence
  derived and/or modified sequence opt11 from VP1__Norovirus__BAJ13858
augaaaauggccuccaacgacgccaaccccuccgacggauccgcagccaaccucguucccgaaguaaacaacgaaguaauggcacuagagccagucgugggagccgccauagcagccccagucgccggacaacaaaacgucaucgaccccuggaucagaaacaacuucguccaagcccccggcggagaguucaccgucagcccccgaaacgcccccggcgaaauacucugguccgccccacuaggcccggaccucaaccccuaucuaucccaccuagcacgaauguacaacggcuacgccggaggguucgaaguccaagucauacucgccggcaacgcauucaccgccggaaaaauaaucuucgccgccguucccccaaacuucccaacugaaggacuaucccccucccaagucaccauguuuccccacaucaucgucgacguccgccaacucgaaccaguccucaucccacuccccgacguccgcaacaacuuuuaccacuacaaccaauccaacgacuccaccauaaaacucaucgccaugcucuacacgccccuaagggccaacaacgccggagaagacgucuuuaccgucuccugccgggugcucacccgacccuccccugacuucgacuucauauuccuugucccaccaaccgucgaaagccggaccaaaccauucaccguccccauucucacaguugaagaaaugaccaacucccgcuuccccauaccacucgaaaaacuauucacuggccccucaucagcauucgucguacaaccccaaaacggccgcugcaccacagacggcguccucuuaggcaccacccaacucucccccgucaauaucugcacauuccgcggcgacguaacacacaucgccggcuccagaaauuacaccaugaaccuagcaucccuaaauuggaauaacuacgaccccaccgaagaaauuccagcaccccuagggacccccgacuucgucggcaagauccaaggcguccucacccaaacaaccaaaggcgacggcuccaccagaggccauaaagccaccguauacacaggcuccgcccccuucacaccaaaacucggaaguguacaauucagcaccgacacagaaaacgacuucgaaacacaccaaaacaccaaguucaccccugucggagucauccaagacgggucaacaacccaccgaaacgaaccacaacaauggguccugcccuccuacuccggccgcaacguacacaacguacaccuugcacccgccguugcacccacauuccccggcgaacaacuacuauucuuccgcucaaccaugccuggcugcuccggcuaccccaacauggaccuagacugccuccuaccucaagaauggguucaacacuucuaccaagaagccgcccccgcccaauccgacguagcccuacuccguuucgucaaccccgacaccggacgaguccucuucgaaugcaaacuccacaaauccgguuacgucaccguugcccacaccggccaacacgaccuuguaaucccaccaaacggcuacuucagauucgacuccuggguuaaccaauucuacacacucgccccaaugggaaacggcaccggacgccgacgcgcccuauaa

SEQ ID NO: 36445 - RNA, 1623 nt, Artificial Sequence
  derived and/or modified sequence opt11 from VP1__Norovirus__BAJ13861
augaaaaugcgcuccucagacgcaaaccccucagacggcuccaccgcaaaccucguccccgaaguuaacaacgaagucauggcacucgaacccgucgucggggccgccauugcagccccaguagcaggccaacaaaacguuauugauccauggauccgcaacaacuucguccaagcacccggcggagaauuuacaguuucucccagaaacgcacccggggaaauacuuuggucagccccacuuggucccgaccuaaacccauaccuaucacaccucgcccgaauguacaaugguuacgccggcggcuucgaaguccaagucauccucgccggcaacgcauuuaccgccggcaagaucaucuucgcagccgucccuccaaacuuccccaccgaaggccugagccccucccaagucacaauguucccucacaucaucgucgacgugcgccaacuagaacccguucuaaucccccuacccgacguccgcaacaacuuuuaccacuacaaccaaucuaacgaccccaccaucaaacugauagcuaugcuuuacaccccgcucagagccaacaacgccggcgacgacgucuucacaggcagcugucgcguccucacuagaccaucccccgacuucgacuucaucuuccuuguuccucccaccgucgaauccagaaccaaacccuucucagucuccuucuucacaggagaagagaugacaaacucccgcuucccaaucccccucgaaaaacucuucaccggcccauccucagccuuugucguccaaccacaaaacggccgcugcacaaccgacggaguccuacugggcaccacacaacuuuccccagucaacauauguaccuuccgcggagacgucacacacauaaccggaucacgcaacuacaccaugaaccucgccacccaaaacuggaacucuuacgaccccaccgaggaaauacccgcaccccuaggaacucccgacuucgucgguaaaauccaaggaguacucacccaaacaacccgagccgacggcuccacccgcggacacaaagccacagucuacacuggcucagccgacuucgccccaaaacuaggccgcguacaauucgccaccgacacagacaacgacuucgacgcuaaccagaacaccaaauucaccccagucggcgucauccaagacggcgauaccgcccaucgcaaugaaccucaacaauggguacuccccuccuauagcggacgcaacucacauaauguccaccuugcaccagccguugccccaaccuucccuggcgaacaauuacucuucuuccgcuccacaaugcccgguugcucaggauaccccaacauggaccucgauugccuccucccccaagaauggguccaauauuucuaccaagaagccgcucccgcccaauccgacgucgcccuccuucgcuucguaaaccccgauacgggacgaguacuauuugagugcaaacuacacaaaagcggcuacgucaccgucgcccacaccggccaacacgaccuuguuaucccacccaacggcuacuuccgcuucgacucaugggucaaccaauucuauacacucgccccaaugggcaacggcaccggccgucgcagagcacucuaa

SEQ ID NO: 36446 - RNA, 1623 nt, Artificial Sequence
  derived and/or modified sequence opt11 from VP1__Norovirus__BAJ13864
augaaaauggccuccaacgacgccaaccccucagacggcucugcggccaaccuaguccccgaaguaaacaacgaagucauggcacuagaaccugucguaggcgcagcaaucgcggccccaguagccggccaacaaaacgucauagaccccuggauccgcaacaacuucguacaagcccccggcggagaguucaccgucucaccccgcaacgcccccggcgaaauccucugguccgcaccccuuggccccgaccuaaaccccuaucucucccacuuagccagaauguacaacggcuaugccggcggcuucgaaguacaaguaauccucgccgguaacgccuucacagccggcaaaaucaucuucgccgccguaccucccaacuuucccacagaaggacuauccccaucacaagucaccauguucccccacauuaucgucgacguccgccaacucgaacccguccucaucccccuuccagacguccgaaacaacuucuaccacuacaaccaaagcaacgacuccacaaucaaacucauagcaaugcucuacacuccacuccgagcaaacaacgcaggcgaggacgucuuuacagucucaugccgaguucucacccgaccaucaccggacuucgacuucaucuuccucgucccacccaccguugaaucccgcaccaaaccauucaccgucccaauccucacagucgaagaaaugacuaacagucgcuucccuaucccccucgaaaaacuuuucaccggccccucuuccgccuucgucgugcaaccacagaacggacguuguacaaccgacggcguacuucucggcaccacgcagcuuuccccggucaacauaugcaccuuccgaggcgacgucacacacauagccggcucacgcaacuacacaaugaaccuagccucacucaacuggaacaacuacgaccccaccgaagaaauccccgcaccccuaggcaccccagacuucguaggaaaaauucaaggcguccuuacccaaaccaccaaaggugacggcuccacccgcggccacaaagccacagucuauaccggcucagcccccuucaccccaaagcucggaagcguccaauucuccacagauaccgaaaacgacuucgaaacccaccaaaacaccaaguucacaccagucggcguaauccaagacggaagcaccacccaccgaaacgaaccccaacaauggguccuaccauccuauuccggccgcaacguucacaacguccaccucgccccugccgucgccccuaccuucccaggcgagcaacuacuuuucuuccgauccaccaugcccggcugcuccggcuacccaaacauggaccucgacugccuccuaccccaagaauggguacaacacuucuaccaagaagccgcccccgcccaaucagacguugcacuccuccgcuucguaaaccccgacaccggacgcguccucuucgaaugcaagcuccacaaauccggcuacguuaccgucgcacacaccggccaacacgaccuggucaucccgcccaacggcuacuuucgcuucgacucaugggucaaccaauucuauacccuugcccccaugggaaacggaacaggccgccgccgcgcccucuaa

SEQ ID NO: 36447 - RNA, 1623 nt, Artificial Sequence
  derived and/or modified sequence opt11 from VP1__Norovirus__BAJ13867
augaaaauggccucaucagacgccaacccuuccgacgguuccaccgcuaaucucguacccgaaguuaacaacgaagucauggcccuagaaccagucgucggagcagccaucgccgcccccguugcuggccaacaaaacgucaucgaccccuggauccgcaauaacuuuguccaagcccccggaggcgaguucacuguaucaccccgaaacgcccccggcgaaauacucugguccgccccucuuggcccugaccucaacccauaccuaucccaccucgcccgcauguacaacggcuacgccggcggcuucgaaguccagguaauucucgccggcaacgccuucaccgccggcaaaauaaucuucgccgcaguaccacccaacuuccccaccgaaggacucucccccucacaagucacaauguucccccacaucaucguugacguccgccaacuugaaccaguccucaucccccucccagacguccgcaacaacuucuaucacuacaaccaaucaaaugaccccaccaucaaacucaucgcaaugcuuuacacaccccuccgggcaaacaacgccggagacgacguauucaccgucucaugucgcguacucacccgccccuccccagacuucgacugcauccucgaccuuccacccaccguugaaucccgaaccaaaccauucuccguccccauacucaccgucgaagagaugacgaacucucgauuccccaucccccucgaaaaacuauucaccggccccucauccgccuucgucguccaaccccaaaacggucgcugcacaaccgacggcgugcuccucggcaccacccaacugucgccaguuaacauaugcaccuuccgcggcgacgucacccacaucacaggcucacgcaacuacaccaugaaccucgccacccagaacuggaacagcuacgacccaaccgaagagauccccgcuccccucggcacccccgacuucguaggaaaaauccaaggcguccucacccaaaccacacgugcagacgguucaacaaggggacacaaagccacaguuuacacagguucugccgacuuugcccccaaacuuggccgcguacaguucgccaccgacacagacaacgacuucgacgccaaucaaaacaccaaauucaccccuguaggaguaauccaagacggcgacacagcacaccgcaacgaaccccaacaauggguccuccccucuuacuccggccgcaacagccacaacguccaccucgcaccagccgucgcccccacuuuccccggagaacaacuccucuuuuuccgauccacgaugcccggcugcucaggcuaccccaacauggaccuugacugccuccucccucaagaguggguccaauacuucuaucaagaagcugcaccagcacaauccgacgucgcccuccuaagauucgucaacccagacaccggacgaguacucuucgaaugcaaacuccacaaaagcggcuacgucaccgucgcccacaccggacaacacgaccuagucauaccacccaacggauacuucagguucgacuccugggucaaccaauuuuauacacucgcccccaugggcaacggcacaggacgccggcgcgcccucuaa

SEQ ID NO: 36448 - RNA, 1623 nt, Artificial Sequence
  derived and/or modified sequence opt11 from VP1__Norovirus__BAJ13873
augaaaauggcauccuccgacgccaaccccucagacggaucggccgccaaccugguccccgaaguaaacaacgaaguaauggcccucgaacccgucgucggcgcagcaauagccgccccagucgcaggccaacaaaacgucauugaccccuggauccgcaauaacuucguacaggcaccaggcggcgaguucaccgucucaccccgaaacgccccaggcgaaauccucugguccgcuccccuagggccagaccucaacccauaccucucccaccuagcccgcauguacaacggcuacgccggcggcuucgaaguccaaguaauucucgccggcaacgcauucaccgccggaaagaucaucuucgcagccguacccccaaacuucccuacagaaggccuaucccccucccaagucaccauguucccccacaucaucgucgacguccgccaacuagaaccaguccucauaccccuccccgacgucagaaacaacuucuaucacuacaaccagucuaaugacucaaccauaaaacucaucgccaugcuauacaccccacuacgcgccaacaacgccggcgaaguuguauucacaguauccugccgcguccucacacgaccuuccccagacuucgacuucauaugccuuguaccacccaccguagagucacgaaccaagcccuucacaguccccauccuaaccgucgaagaaaugaccaacucgcgcuuccccaucccccucgagaaacucuucacaggccccucaagcgcauucguuguccaaccccaaaacggccgcugcaccacggacggaguccuccucggaacaacacaacuaucaccuguuaauauuugcaccuuccgcggcgacgucacacacaucgcuggaucacgcaacuacaccaugaaccucgccucacucaacuggaauaacuacgaccccaccgaagaaauuccagcuccccucggcacacccgacuucguuggcaaaauccaaggcguacuuacacaaacaacaaaaggcgacggcuccacacgaggacacaaagccaccgucuacacagguucagcccccuuuacaccaaaacucggcagcguccaauucucaaccgacacagaaaaugacuucgaaacacaccaaaacacaaaauucacgcccgucggcgucauacaagacggaggcacuacccaccgaaacgaaccccaacaauggguacuaccuucauauucaggacgcaacgucccaaacguacaccuugccccagccgucgcccccacauuccccggagaacagcuccucuucuuccgcucaacuaugcccggauguuccggcuaccccaacauggaccucgacugccuccucccccaagaauggguacaacacuuuuaccaagaagccgccccugcacaauccgacgucgcccuucuccgauucgucaaucccgacaccggcagaguccucuucgaaugcaaacuccacaaaccaggcuacgucacagucgcccacaccggucaacacgaccucgucauccccucuaacggauacuuccgauuugacuccugggucaaccaauucuacacccuagcgccaauggguaacggcaccggcagacgacgcgcacuauaa

SEQ ID NO: 36449 - RNA, 1623 nt, Artificial Sequence
  derived and/or modified sequence opt11 from VP1__Norovirus__BAJ13876
augaaaauggccucaaacgacgcaaaccccuccgacggcuccgccgccaaccucguuccagaagucaacaacgaaguaauggcccuagaacccgucguaggagcugcaaucgccgcaccuguugccggccaacaaaacguaaucgaccccuggauacgaaauaacuucguccaagcccccggcggcgaauuuaccgugagcccccgcaacgccccaggagaaauccuuuggucugcuccccucggucccgaccucaacccauaccuuucacacuuggcacgcauguacaacggcuacgccggcggcuucgaaguccaagucauccucgccggcaacgcauucaccgccggaaaaauaaucuucgccgcuguaccacccaacuuucccaccgaaggccucucccccucccaagucacaauguuuccacacaucauaguagauguacgccaacuugaacccguacucauuccucuccccgacguccgaaacaacuucuaccacuacaaccaauccaacgauucaaccauaaaacucaucgccaugcucuacaccccacuccgagcaaacaaugcaggagaagacguauucaccgucucaugucguguacucacccgccccagccccgacuuugacuuuaucuuccucguacccccaaccgucgaaucccgcacgaaacccuucaccguccccauccuaaccguagaggaaaugaccaacucccgauuucccaucccucucgaaaaacucuucaccgguccaucaggcgccuucgucguccaaccccaaaacggccgcuguaccacagacggcguccuccuagguacuacacaacuaucucccgucaacaucugcacuuuccgcggugacguaacccacaucgcgggcucgcgcaacuacacaaugaaucucgccgcuuuaaacuggaacaacuacgacccuacagaagaaauacccgccccacucggaacaccggacuucgucggcaaaauccaaggcguacucacacaaaccaccaagggcgacggcuccacucgcggccacaaggccaccgucuacacagguucugccgacuucacacccaaacuaggcuccguccaauucucaaccgacaccgaaaacgacuucgaaacccaccaaaacaccaaauucacccccgucggaguuauccaagacggauccacaacccaccgcaacgaaccacaacaauggguccucccuuccuacucaggaagaaacguccacaacguccaccuggcuccugcagucgcccccaccuuccccggcgaacaacuacucuucuuccgaucaaccaugcccggcugcucgggauacccaaacauggaccucgacugucuacucccccaagaauggguacaacacuucuaccaagaagccgcucccgcccaaucagacguagcacuccuacgcuucguaaaccccgauacaggccgcguccucuucgaaugcaaacuucauaaauccggcuacguaaccguagcccacacugggcaacacgaccuaguaaucccacccaauggauauuuccgcuucgacagcugggucaaucaauucuacacacuagcccccaugggcaacggcacaggccgccgccgcgcccucuaa

SEQ ID NO: 36450 - RNA, 1623 nt, Artificial Sequence
  derived and/or modified sequence opt11 from VP1__Norovirus__BAJ13879
augaaaauggccuccaacgacgccaaccccucugacggcucagcagccaaccuaguccccgaaguaaacaacgaagucauggcccuugagccaguugucggcgccgcaaucgcagcacccguagcaggccaacaaaacgucaucgacccauggauacgcaacaacuucguacaagcccccggaggagaguucaccgucucccccagaaacgcccccggagaaauccuuugguccgcaccccucggaccagacuuaaauccuuaccuaucccaccuugcacgaauguauaacgguuacgcaggcgguuucgaaguccaagucauccucgcaggcaacgccuucacagccggcaaaaucaucuucgcagccgucccucccaacuuccccaccgaaggacucucacccucccaagucaccauguucccccacaucauaguagacguucgccaacucgaaccaguccuaaucccccuucccgacguacgcaacaacuucuaccacuacaaccaguccaacgacuccacaaucaaacuaauagcaaugcucuauacaccccugagagcaaacaacgcaggagaagacgucuuuaccgucucaugccgcguccucacccgacccuccccagauuucgacuuuaucuuccucgucccacccacuguagaaucccgcacuaaacccuucaccguacccauccuaaccgucgaagaaaugaccaacucacgcuuccccaucccacuagaaaaacuauucacaggacccuccuccgccuucgucguccaaccacagaacggcagauguacgacagacggcguccuccucggcacaacucaacucuccccaguaaacauaugcacauucagaggcgacgucacccauaucgccggcucacgcaacuacaccauggaccucgccagccuaaacuggaacaauuaugacccaacugaagaaauacccgcuccccuaggcaccccagacuucgucggcaagauccaaggaguacuuacccaaaccacaaaaggcgacggcucaacccgaggccacaaggccaccgucuacaccggaucugccccauucaccccuaaacucggaucaguccaauucucgacugacaccgaaaacgacuucgaaacacaucaaaacacgaaauucacucccgucggcgucauccaagacggaggcacuacacaccgaaaugaaccccaacaauggguccucccaucauauuccggccgcaacguacccaacguacaccucgcacccgcaguugccccuaccuuucccggcgaacaacuucuauucuuccgauccaccaugccaggaugcuccggcuaucccaacauggaucucgacugccuccucccccaggaauggguccaacauuucuaccaagaagccgcccccgcccaguccgacguagcacuccucagauucgucaaucccgacacaggccgaguccuguucgaauguaaacuccacaaauccggauacgucacagucgcccacaccggccaacacgaccuagucaucccucccaacggcuacuucagauucgacuccugggucaaccaguucuauacccuagcacccaugggcaacgggacaggccgccgccgcgcacucuaa

SEQ ID NO: 36451 - RNA, 1623 nt, Artificial Sequence
  derived and/or modified sequence opt11 from VP1__Norovirus__BAJ13882
augaaaauggccucgaacgacgccaaccccuccgacggcagcgccgccaaccuugucccagaagucaacaacgagguaauggcacucgaaccagucgucggcgcagccauugcagcucccgucgcaggacaaaccaaugucaucgaucccuggaucagaaacaacuucguccaagcccccggaggcgaguucacagucuccccacgaaacgcaccaggugaaauccuuuggucagcccccuuaggccccgacuuaaaccccuaccuuucccaccuugcacgcauguacaacggcuacgcuggcggcuucgaaguccagguuauccucgcaggcaaugccuucaccgcuggcaaaaucaucuucgccgccgucccacccaauuuccccaccgaaggccuuucaccgucacaagucaccauguucccacacaucauuguagacguccgacaacucgaacccguacucaucccccuaccagacguacgcaauaacuucuaucacuacaaccaauccaacgacucuaccauaaaacucaucgcgaugcucuacacuccccuccgagcaaacaaugccggcgaagacgucuucaccguauccugccgcguccucacccgacccucccccgacuucgacuucaucuuccucguucccccgacagucgaauccagaaccaaaccauucaccguccccauucuuaccguagaagaaaugaccaacucccgcuuccccauaccccuagaaaaacuuuucacuggcccaagcggcgccuucgucguccagccccagaacggccgcugcaccaccgacggcguccugcucggaaccacccagcuaucccccgucaacaucugcaccuuccgcggcgacgucacccacauugcagguucccgcaacuacacaaugaaccucgcaagccucaacuggaacaacuacgaccccaccgaagaaauacccgcuccacuaggaaccccagacuucguaggcaaaauacaaggaguccuaacccaaaccacaaaaggagacggcuccacccgcggccacaaggccaccguuuacaccggcucggcccccuucaccccgaaacuaggaucuguacaauucuccaccgacaccgaaaacgacuucgaaacacaccagaacacuaaauucaccccagucggagucauccaagacggcuccaccacccaccguaacgaaccacaacaaugggugcuccccuccuacaguggccgcaacguucacaacguacaucucgcccccgccgucgccccuaccuuccccggcgaacaacuccuauucuuucgcuccaccaugccagguugcagcggcuaccccaauauggaccucgacugccuccucccccaagaauggguacaacacuucuaccaagaagccgccccugcccaguccgacgucgcuuuacuccgcuucguaaaccccgacaccggccgcguacucuucgaaugcaaacuccacaaauccggauacguaaccguagcccacacaggccaacacgaucucgucauuccaccaaacggcuacuuccgcuucgacuccuggguuaaccaauuuuacacacucgcacccaugggaaauggcaccggccgccgacgagcacuauaa

SEQ ID NO: 36452 - RNA, 1623 nt, Artificial Sequence
  derived and/or modified sequence opt11 from VP1__Norovirus__BAJ13885
augaaaauggccagcucagacgccaacccuucagacggaucuacugcaaaccucgucccagaagucaacaacgaagucauggcacuagaacccgucgucggcgcagcaaucgccgcccccguagccggacaacaaaacguaaucgacccauggaucagaaacaacuucguccaggcccccggcggcgaauuuacagucucaccccgcaaugccccaggagaaauccuaugguccgccccacucggccccgaccuuaaccccuaccucucucaccuugcucgcauguacaacggauaugccggcggcuucgaaguccaagucauacucgccggcaacgccuucaccgcuggcaaaaucaucuucgccgcaguacccccaaacuuccccaccgaaggccucucuccaucacaagucaccauguuuccccacauaaucgucgacguccgccaacucgaacccguccucaucccccuaccugacguccgcaacaacuucuaccacuacaaccaauccaacgaccccaccaucaaacuuaucgcaaugcucuacacaccccuccgcgcaaacaacgccggagacgacgucuucaccgucucaugccggguccucacccggccaucaccagacuucgacuuuaucuuccucgucccacccaccgucgaaucacgcaccaaacccuucucuguacccauacuaaccgucgaagaaaugacaaacucccgcuuccccaucccacucgaaaagcucuuuaccggcccuuccucggccuucgucgugcaaccccaaaacgggcgaugcaccaccgacgguguacuccucggcaccacacaacuuagccccguuaacauaugcaccuuucgcggcgacgucacccauaucaccggcucccgcaacuacaccaugaaccuagcuacccaaaacuggaacucuuacgacccaaccgaagaaaucccagcuccccucggcacccccgacuuugucggcaaaauccaagggguacuaacacaaaccacccgcgccgacgggaguacucgcggccacaaagcaaccguauacaccggcuccgccgacuuugcccccaaacucggccgcguacaguucgccaccgacaccgacaacgacuucgacgcaaaucaaaacaccaaauucacacccgucggagucauccaagauggaaacaccgcccaccgaaacgaaccccaacaauggguccuacccuccuacuccggcagaaacagccacaacguccaccucgcccccgccguugcacccaccuucccuggcgaacaacuccucuucuuccgguccaccaugcccggcuguucaggcuacccaaacauggaccucgauugucuccuaccacaagaauggguccaauacuucuaccaagaagcagccccagcccaguccgacgucgcccuccugcgcuucgugaauccugauaccggacgagucuuauucgaaugcaaacuccacaaaaguggcuacguaaccgucgcccauaccggacaacacgaucucguaauaccucccaauggcuacuuccgcuucgacucuugggucaaccaauucuacacacuggcucccaugggcaacggcaccggccgcagacgcgcccucuaa

SEQ ID NO: 36453 - RNA, 1623 nt, Artificial Sequence
  derived and/or modified sequence opt11 from VP1__Norovirus__BAJ13891
augaaaauggcaucaagugacgccaacccaagcgacggcuccaccgccaaccucguccccgaaguuaacaacgaaguuauggcccuagaaccagucguaggagccgcaaucgcagccccaguagcuggacaacaaaacguaaucgaccccuggaucagaaacaacuucguacaagccccuggaggcgaguucaccgucucuccccgcaacgcccccggcgaaauacucugguccgccccacucggcccggaccucaaccccuaccucucccaccuagcuagaauguacaacggcuacgccgguggauucgaaguccaagucauccuugcuggcaacgccuucaccgcaggcaaaaucaucuucgccgccgucccucccaacuucccaacagaaggacucucacccucucaaguaaccauguucccccacauaaucguagacguacgccaacucgaaccaguccucauaccccuacccgacguacgcaacaacuucuaucacuacaaccaauccaacgaccccacaauaaaacucaucgcaaugcucuacacaccccuacgugcaaacaaugccggcgacgacguauucaccguuucaugccgaguccugacccgcccaucacccgacuucgacuucaucuuccucguaccacccaccgucgcuucccgcaccaagcccuucucaguaccauccgucaccgucgaagaaaugaccaacucccgcuuccccaucccacucgaaaaacucuucaccggccccuccucagccuucguaguacaaccccaaaacggucgcugcacaaccgacggcguccuccucggcaccacucaacucuccccagucaacauaugcaccuuccgcggcgacgucacccacaucacuggcagccgaaacuacaccaugaaccucgcaacccaaaacuggaacuccuacgacccaaccgaggaaauacccgcaccucuaggcaccccugacuucguagguaaaauccaaggcguacuaacccaaaccaccagagccgacggcucaacccguggccacaaagcaacaguauacaccggcucagccgacuuugccccuaaacucggcagaguacaguucgcaacagacacagauaacgacuucgacgccaaccaaaacaccaaauucacccccgucggcgugauccaagacggagacacagcccaccgaaacgaaccccaacaauggguccucccauccuauagcggacgaaacucccacaacguacaccuugcccccacagucgcaccgaccuucccaggcgaacaacuccuauucuucagaagcaccaugccaggcugcucaggauauccaaacauggaccucgacugccuccucccacaggaauggguccaauacuucuaccaagaagccgcacccgcccaauccgacgucgcccuccuacgauuuguuaacccugacaccggccguguccuauucgaaugcaagcuccacaaauccggcuacgucacuguagcccacaccggccaacacgaccucgucaucccucccaacggcuacuuccgcuucgacucgugggucaaccaauucuacacccucgcccccaugggcaacggcaccggccgacgccgcgcccucuaa

SEQ ID NO: 36454 - RNA, 1623 nt, Artificial Sequence
  derived and/or modified sequence opt11 from VP1__Norovirus__BAJ13894
augaaaauggccucaaacgacgccaacccauccgacggcucaaccgccaaccucgucccugaaguaaacaacgaagucauggcacuugaacccguagucggugccgccaucgccgcccccguagcuggacaacaaaacgucauagauccauggauccgaaacaacuucguccaggccccaggcggcgaauuuacugucucaccucaaaacgcacccucagaaauccucuggucagcuccccucggcccagaccucaaccccuaccucucccaccucgcccgcauguacaacgguuaugccggcggcuucgaaguccaagucauacuagccggcaacgccuucaccgccggcaaaauaauuuucgcugccgucccucccaacuuccccacagaaggacuuucucccagccaagucacaauguucccccacaucaucgucgacguacgucaacuagaacccguacucaucccacugcccgacguacgaaacaauuucuaccacuauaaccaauccaacgaccccaccauaaaacugaucgccaugcucuacaccccacuacgcgcuaacaacgccggcgacgacgucuucacagucuccugccgaguccuaacacgaccaucaccggacuucgacuuuaucuuccuuguaccucccaccgucgaaucccgcaccaaacccuucacgguccccauccucaccguagaagaaaugacaaacucccgcuuccccaucccccuugaacgauuauacacaggccccuccucagccuucgucguccaaccccaaaacggacgcugcaccacagacgguguccuacuaggcacaacacaacucuccgcaguaaacauaugcaccuuccgcggcgacgucacucacaucgccggcucucguaauuacacaaugaaccucgccagccaaaacuggaacaacuacgacccgacagaagaaauacccgcaccccuugguacccccgacuucgucggaaaaauccaaggaaugcucacccaaaccacucgaucagacggcucaacccgcggacacaaagccacaguccucaccggcucagccgauuucgcacccaaauuaggccgcguccaauucgccacagauaccgacaacgauuuugaauccggccaaaacacuaaauucacacccgucggcguaauccaagauggcuccacaacacaccgcaacgaaccccaacaguggguccucccuaauuacagcggccgcacaggucacaacguacaccucgcccccgccgucgcacccaccuacccaggagaacaacuccuguucuuccguuccacaaugcccggaugcuccgguuaccccaacauggaucuagacugccuucucccacaggaauggguccaacacuucuaccaagaagccgcacccgcacagucagacguugccuugcuccgcuucguaaacccagacacuggccguguacuauucgaaugcaaacuccacaaauccggauacgucaccguagcacacacuggacaacacgaucucgucauaccacccaacggcuauuuccgcuucgacuccuggguaaaucaguucuacacccucgcccccaugggcaacgguaccggacgucgccgcgccgucuaa

SEQ ID NO: 36455 - RNA, 1623 nt, Artificial Sequence
  derived and/or modified sequence opt11 from VP1__Norovirus__BAJ13897
augaaaauggccuccuccgacgcaaaucccuccgacggcagcaccgcaaaccucgucccugaagucaacaacgaggucauggcacucgaacccgucgucggcgcagcaauagccgcucccguugccggccaacaaaacguaaucgacccauggauacgaaacaacuucguccaagcaccaggaggcgaguucacagucucaccccgcaaugcccccggcgaaauacucugguccgcaccccuaggacccgaccucaacccauaccucucccaccucgcccgaauguauaacggcuacgcuggcggcuucgaaguacaagucauccuagcaggaaacgcauucaccgccggcaaaaucauauucgccgcaguacccccaaacuucccaacagaaggacucucccccucccaagucaccauguucccccacauaaucguagacguacgacaacucgaacccguccuaaucccccucccugacguccgcaacaacuucuaccacuacaaccaaucaaacgaccccaccaucaaacuaaucgccaugcucuacacaccccuccgcgcaaacaacgccggcgacgacgucuucaccgucuccugccgaguccuaacccgccccucacccgacuucgacuuuaucuuccucgucccgcccacagucgaaucccgaaccaaacccuucucuguacccauccucacaguagaagaaaugacaaacuccagauucccaaucccccuagaaaaacucuucacgggcccaagcuccgccuucguuguacaaccccaaaacggcagaugcaccacagacggaguucuccuaggcaccacccagcucuccccaguaaacaucugcaccuucagaggcgacgucacacacaucacgggcucccgcaacuauacuaugaaccuagccacccagaacuggaacuccuacgacccaaccgaagaaauccccgcaccccuuggcacccccgacuucguuggcaaaauacaaggaguacucacccaaacaacccgagccgacgguuccacacguggacacaaagccaccguuuauaccgguucugcugacuucgcccccaaacucgguagaguacaauucgccaccgacacagacaacgacuucgacgccaaccaaaacaccaaauucaccccagucggcgucauccaagacggcgacaccgcccaccgcaacgaaccacaacaauggguccuccccuccuacuccggacguaacucccacaacguccacuuagcacccacagucgcccccaccuucccaggcgaacagcuacucuucuuucgcuccaccaugcccggaugcagcggauaccccaacauggaccucgauugucuccuaccccaagaauggguacaauacuucuaccaagaagccgccccugcacaaagcgacgucgcacuccuccguuucgucaaucccgacacaggccgaguacucuucgaaugcaaacuccacaaauccggauacgucaccguagcccacacaggucaacacgaccucgucaucccacccaacgguuacuuccgauucgauucaugggucaaccaauucuauacccucgcccccaugggaaacggaacagggagacgacgcgcccucuaa

SEQ ID NO: 36456 - RNA, 1623 nt, Artificial Sequence
  derived and/or modified sequence opt11 from VP1__Norovirus__BAJ13900
augaaaauggccucaaacgacgcuaacccuuccgacggaucuaccgccaaccuaguacccgaagucaacaacgaagucauggcccucgaaccagucgucggagcugccaucgccgccccaguugccggacaacaaaacguaaucgaccccuggauccgcaacaacuucguccaagcccccggaggcgaauuuaccguaagcccucguaacgcccccggagaaauccucuggucugccccacucggcccagaccucaaccccuaccuaucccaccucgcccgcauguacaacggcuacgcaggaggauucgaaguccaagucauccuagcaggaaacgccuucaccgccggcaaaauaauauucgcagcaguaccacccaacuuccccacagaaggacucucacccucacaaguaaccauguucccccacaucaucguggacguacgccaacucgaacccguccucaucccacucccagacguacgcaacaacuucuaccacuacaaccaauccaacgaccccaccaucaaacuaauagccaugcucuacacaccccugagagcaaacaacgcaggcgacgacgucuucaccgucuccugcaggguccuaacgcgaccaucuccagacuucgacuucauauuccuagucccaccaaccgucgaaucccgcaccaaacccuucaccguccccauccuaaccguagaagaaaugaccaacucacgcuuccccauacccuuagaacgccucuacaccggcccaucuucagcauucgucguccaaccccaaaacggccggugcaccacagacggcguccuacucggcacuacucagcucuccgcugucaacauaugcaccuuccgcggagacgucacucauaucgccggcucccgaaacuacacaaugaaccucgccucucaaaacuggaacaacuacgaccccacugaagaaauacccgcaccccucggaacuccagauuucguaggcaaaauccaaggcaugcuaacccaaacuacacgauccgacggcuccacacgagggcacaaagccacaguccucacuggcuccgccgacuucgcaccaaaacuuggucgcguccaauucgccaccgacacggacaacgacuucgaauccggccaaaacaccaaauucacccccguaggcgucauccaagacggaagcacaacccaccgaaacgaaccccaacaauggguacuccccaacuacaguggccgaaccggccacaacguccaucucgccccagccgucgcccccaccuaccccggugaacaacuccucuucuuccguuccacaaugcccggcuguucaggcuaccccaacauggaccucgacugccuucucccacaagaauggguccaacacuucuaccaagaagccgcccccgcacaauccgacguagcccuccuacguuucgucaaccccgacaccggccgcguccucuucgaaugcaaacuacacaaaucuggcuacgugacagucgcacacacaggccaacacgaccugguuaucccacccaacggcuauuuccgauucgacuccuggguaaaccaauucuacacccucgccccaaugggaaacggcacaggacgaagacgcgccgucuaa

SEQ ID NO: 36457 - RNA, 1623 nt, Artificial Sequence
  derived and/or modified sequence opt11 from VP1__Norovirus__BAJ13903
augaaaauggccucaaaugacgccaaucccucugacggcuccgccgccaaccucgucccugaagucaacaacgaagucauggcccucgaaccaguagucggagcagcuauagccgcccccguagccggacagcaaaaugucauagaccccuggauacgcaauaacuucguacaagcacccggaggcgaguucaccguaucaccacguaacgcacccggcgaaauccuguggucugcaccccucggacccgaccucaaccccuaccugucccaccuugcaagaauguacaauggcuacgccggcggauucgaaguacaagucauacucgcagguaacgccuucacagcaggcaaaaucaucuucgccgccguucccccuaacuuuccaaccgaagggcuaucccccucucaagucaccauguucccacacauaaucgucgacguccgccaacucgaacccguucuuaucccacucccagauguacgcaacaacuucuaccacuacaaccaaucgaacgacucaaccaucaaacucaucgccaugcuuuacacgccccuuagagcaaacaacgccggagaagacguauucacagucuccugccgaguccuuacccgccccucacccgauuucgacuucaucuucuuagucccacccaccguagaaucacgcaccaagcccuucaccgucccaauccuaaccguagaagaaaugaccaacucccgcuuuccaauccccuuagaaaaacuauucaccggacccuccggcgccuuuguaguccagccucaaaacggccgcugcacaaccgacggcguccuccuaggcacaacccaacuauccccggucaacaucugcacauuccgcggcgacguaacacacauagccggaucucgcaacuacacaaugaaccucgcagcauuaaacuggaacaacuacgaccccaccgaagaaaucccggcaccccucggcaccccggacuucguaggaaaaauccaaggaguccucacccaaacaaccaaaggagacggcucaacucgaggacacaaagccaccgucuauacaggcagcgccgacuucaccccaaaacucgguuccguucaauucucaacagacaccgagaacgauuucgaaacccaccagaacaccaaauucacccccgucggcgucauccaagacggcuccaccacccaccgcaacgaaccccaacaauggguccuucccucauacuccggacgcaacguccacaacguccaccucgccccggccgucgcccccacauuccccggagaacaacuacucuucuucagauccaccaugccgggaugcuccggauaccccaacauggaucuagacugccuccucccacaagaauggguccaacacuucuaccaagaggccgcuccagcucaauccgacgucgcucuccuucgauucguuaaccccgacaccggccgcguccuauucgaaugcaaacuccacaaauccggauacgucacaguagcacacaccggccaacacgaucucguaauacccccaaacggcuauuuccgauucgacuccugggucaaccaauuuuacacacucgcccccaugggcaacggaacaggacgccgacgagcacuauaa

SEQ ID NO: 36458 - RNA, 1623 nt, Artificial Sequence
  derived and/or modified sequence opt11 from VP1__Norovirus__BAJ13906
augaaaauggccagcaacgacgcaaaccccucugacggcagcacugcaaaccuuguccccgaagucaauaacgaagucauggcacucgaacccgucgucggagccgcaaucgcagccccagucgccggccaacaaaacguaauagaucccuggauaagaaacaacuucguucaagcacccggcggagaguucaccgucucaccacgcaacgcccccggagaaauccuguggagugccccucuuggcccagaccucaacccauaucuaucucaccucgcccgcauguauaacggcuacgcaggcggcuucgaaguccaaguuauccucgccggcaacgcauucacagccggcaaaaucauauucgccgcuguaccgccuaacuuccccacugaaggccucuccccgucccaaguuaccauguucccccauaucauaguagacguccgccaacuagaacccguacucauaccccuuccagacguacgcaacaacuucuaccacuacaaccaguccaacgaccccaccaucaaauuaauagcaaugcucuacacuccucuccgcgccaacaacgccggcgacgacguauucaccguauccugccggguacucacacgccccucaccagacuucgacuucaucuuccuaguacccccaaccgucgaaucccgaaccaaacccuucaccguccccauccucaccgucgaagaaaugacaaacucccgauuucccaucccgcuugaaaggcucuacaccggccccuccuccgcauuugucguucaaccccaaaacgguagaugcacaacggauggcguccuccuuggcaccacccaacuaagcgcaguaaacaucuguaccuuccgaggagacgucacccacauagccggaucccgcaacuacaccaugaaccucgccucacaaaacuggaacaacuacgaccccaccgaagaaauccccgccccacucgguaccccagacuucgucggcaaaauccaaggcaugcuaacacaaaccacccgcuccgauggauccacacgcggacacaaagcuaccguccuaaccggauccgcagacuucgcucccaaacuuggacgaguccaauuugccaccgacaccgacaacgacuucgaaucaggccaaaauacaaaauuuacccccgucggaguaauacaagacggcuccacaacccaccgaaacgaaccacaacaauggguacuccccaacuacagcggacgcacaggccacaacguacaccuagcccccgccgucgcccccacauaccccggcgaacaacuacucuucuucagauccacaaugcccggcugcucuggguacccaaacauggaccucgacugccuccucccacaagaauggguccaacacuucuaccaagaggccgcccccgcccaaucagacgucgccuuauuaagauucguaaaccccgacaccggcagaguacuauucgaaugcaaacuccacaagagcggauacgucaccgucgcccacaccggacaacacgaccucguaaucccacccaacggcuacuuccgauuugacagcuggguaaaccaauucuacacccuggcacccaugggcaacggcacaggccgacgacgugccguauaa

SEQ ID NO: 36459 - RNA, 1623 nt, Artificial Sequence
  derived and/or modified sequence opt11 from VP1__Norovirus__BAJ13909
augaaaauggcaagcaacgacgcaaaccccuccgacggcuccgccgcaaaucucguuccugaaguaaacaacgaagucauggcccucgagcccguagucggugccgccaucgcagcccccguagccggacaacaaaacgucaucgaccccuggauucguaacaacuucguccaagcgcccggaggcgaguucacagucucuccccgcaacgcuccaggcgaaauacucuggucagcaccccucgguccagaccuaaaccccuaccucucacaccucgcacguauguacaacggcuacgcaggcggauucgaaguccaagucauccucgcaggaaacgccuucaccgccggcaaaaucaucuucgcagccguaccacccaacuuccccaccgaaggccuaucaccaucccaaguuaccauguucccacacaucaucgucgacguucgccaacucgaaccaguccuuauaccacuccccgacguccguaacaauuucuaccacuacaaccaauccaacgacucgaccauaaaacuaaucgccaugcucuacaccccacuccgggcaaacaaugccggcgacgacgucuucacaguaucaugccgaguccuaacccgaccaucccccgacuucgacuucaucuuccucguacccccaaccgucgaaucacgcaccaaaccauucaccgucccaauacugacugucgaggaaaugacaaacucccgauuccccauuccccucgagaagcuguucacaggccccuccuccgcuuucguaguacaaccacaaaacggacgauguaccacagacggcguccuccucggcaccacucaacuaucgcccguaaacaucugcacuuuccgcggcgacgucacccacaucaccggcagccgcaacuacaccaugaaccucgccucacucaacuggaacaacuacgaucccaccgaagaaauacccgccccauuaggcacccccgacuuuguaggcaaaauucaaggcguacucacccagaccaccaaaggagauggcagcacgcgaggccauaaagcaacagucuacaccggaagcgccgacuucacacccaaacuaggcucaguccaauucgccaccgacaccgaaaacgacuucgaaacacaccaaaacaccaaauucacccccgucggcgucauccaagacggcggaaccacccacagaaacgaaccucaacaauggguacuccccagcuacagcggucgcaacguacacaacguccaucuugccccugcagucgcccccaacuuccccggagaacaacuccuauucuuccgaagcaccaugccaggcugcuccggcuaccccaacauggaccuagacugccuacuuccccaagaauggguucaacacuucuaccaagaagccgccccagcccaauccgacguagcccuccuccgcuucguaaaccccgacaccggucgcgugcuauuugaaugcaaacuccacaaauccgguuacguaacagucgcacacaccggacaacacgaccuuguaaucccucccaacggauauuuccgcuucgacuccugggucaaccaauucuacacccucgcacccaugggcaacggcaccggcaggcgccgcgcacucuaa

SEQ ID NO: 36460 - RNA, 1623 nt, Artificial Sequence
  derived and/or modified sequence opt11 from VP1__Norovirus__BAJ13912
augaaaauggccucaaacgacgccaaccccuccgauggcuccgcggccaaucucgucccggaaguaaauaacgaagucauggcucuagaacccgucgucggagccgccaucgcagcucccguagccggacagaccaacgucaucgaccccuggauccgaaacaacuucguccaagcccccggcggcgaauuuacaguaagcccacgcaacgcccccggcgaaauccucugguccgcgccucucgggcccgaccuuaacccauaucucucccaccuagcacgcauguacaacggcuacgcaggcggcuucgaaguccaagucauccuagcaggcaacgccuucaccgcaggcaaaaucauauucgcagccguacccccuaacuucccaaccgaaggacuauccccaucacaagucacaauguucccccacauaaucgucgacgucagacaacuagaaccaguccuuaucccccuacccgacguccgcaacaacuucuaccacuacaaccaauccaacgacuccacaaucaaacucaucgccaugcucuacacaccccuccgugcuaacaaugccggcgaagacgucuucaccgucucuugccgcguucuuaccagacccucacccgacuucgauuucauauuccuaguaccacccacagucgaaucacgcaccaaacccuucacaguccccauacugaccguagaagaaaugaccaacuccagauuccccauuccccucgaaaaacucuucaccgguccuuccggcgcauucguaguccaaccacaaaacggccgcugcaccaccgauggcguacuccuaggaacaacacaacuauccccaguaaacaucuguacauuccgaggcgacgucacccacaucgcuggcucccggaacuacaccaugaaucucgccucccucaacuggaacaacuacgacccaacagaggaaauccccgccccacucggcacucccgacuucguaggcaaaauacaaggaguccucacccaaacaaccaaaggcgacgguuccacccgcggucacaaagccaccgucuacacaggcuccgcccccuucaccccaaaacucggcucuguacaauucuccacugacacagaaaacgauuucgaaacccaccaaaauacaaaauucaccccugucggcguaauccaggacggcucaaccacacaccgaaacgaaccccaacaauggguacuccccuccuacagcggccgaaacguccacaacguccaccucgcccccgcagucgcucccaccuuucccggagaacaacuccucuucuucagaucaaccaugccaggcugcucagguuaccccaacauggaccucgauugccuucucccacaagaauggguacaacacuucuaccaagaagccgcacccgcccaauccgacguagcccucuuacgcuucgucaacccagacaccggcagaguccucuucgaaugcaaauuacacaagucaggauacgucacggucgcccacacuggccaacacgaccucguaaucccgcccaauggcuacuucagauuugacucguggguaaaccaauucuacacccucgcccccaugggcaacggcaccggucgucgucgagcauuauaa

SEQ ID NO: 36461 - RNA, 1623 nt, Artificial Sequence
  derived and/or modified sequence opt11 from VP1__Norovirus__BAJ13918
augaaaauggccucaaaugacgccaaccccuccgacggcuccgccgcaaaccuaguccccgaagucaacaacgaagucauggcacuugaaccagucgucggcgccgccaucgccgcacccguugcaggccaacaaaacguaaucgaccccuggauccgcaacaacuucguacaagcccccggcggcgaguucacuguaucaccccgaaacgcaccaggagaaauacuaugguccgcaccccuaggccccgaccucaaccccuaccucucccaccuagccagaauguauaacggauacgccggcggauucgaaguccaagucauccucgccggcaacgccuucacagccggcaaaaucauauucgcagccgucccacccaauuuccccaccgaaggacucucacccucccaggucaccauguucccccacaucaucgucgacguccgacagcucgaaccaguccucaucccacucccagacgucagaaacaauuucuaccacuacaaccaaagcaacgacucaacaauaaaacucaucgccaugcucuacacuccacuacgugccaacaacgccggcgacgacguauucaccgucuccugcagaguccuuaccagacccagcccagauuucgacuuuaucuuccucguuccacccaccguagaaucacgcacaaaacccuucacaguccccauccucacuguagaagaaaugaccaacucacgcuuccccaucccccuagaaaaacucuucaccggacccuccuccgccuucguaguccaaccacaaaacggccgcugcaccacagacggcguacuuuuagguacaacucaacuuucccccguaaacaucuguaccuuccgcggcgacgucacccacaucgccggcucccgaaacuacaccaugaaccuagccucccuuaacuggaauaacuacgacccgacagaagaaaucccagcuccacucggcaccccagacuucguaggcaaaauccaaggaguacucacccaaaccacaaaaggcgacggcagcacgagaggccacaaagccacggucuacaccggcucugccgacuucacccccaaacuaggcucgguacaauucggcaccgacaccgaaaacgacuuugaaacccaccagaacaccaaauucacucccgucggcgucauccaagacggcuccacaacccaucguaacgaaccacagcaguggguacuccccuccuacucaggacgaaacguccacaacguccaccucgcccccgcagucgccccaaauuuccccggagaacaacuccuguucuuccgaucaaccaugcccggcuguuccggauacccaaacauggaccucgacugucuccucccccaagaauggguacaacacuucuaccaagaagccgccccagcccaauccgacgucgcccuccuccgauucguaaacccagacaccggcagaguccuuuucgagugcaaacuccacaaauccggauacguuaccgucgcccacacaggucaacacgaccucguaauaccacccaacggcuacuuccgauucgacuccuggguaaaccaauuuuacacccucgcaccaauggguaacggcaccggccgccggcgcgcccucuaa

SEQ ID NO: 36462 - RNA, 1623 nt, Artificial Sequence
  derived and/or modified sequence opt11 from VP1__Norovirus__BAJ13924
augaaaauggccucaaacgacgccucccccucagacggcuccgccgccaaucucgucccagaggugaacaaugaagucauggcacucgaacccgucguuggagcugccaucgcugccccagucgcaggccaacaaaacgucaucgaccccuggauccgcaacaacuucguacaagcccccggcggcgaguucacagucucuccucgaaacgcccccggagaaauccuguggucagcaccccucggaccagaccucaaccccuaucuaucccaucucgccagaauguacaacggauacgcuggcggauucgaaguccaagucauccuugccggcaacgcauucaccgcuggcaaaauaauauucgccgccguaccucccaacuuccccaccgaaggccucagccccucacaaguaaccauguucccccacaucaucgucgacguccgacaacuagaacccguccucauaccccugccagacguccgcaacaacuucuaccacuacaaccaaagcaacgacuccaccaucaaacucaucgcaaugcucuacacaccccuucgcgccaacaacgcaggcgaagacgucuucaccgucuccugccgaguucucacccgaccaagccccgacuucgacuucaucuuccuagugcccccaaccgucgaaucacgcaccaaacccuucacagucccaauccucaccgucgaggaaaugaccaacucccgauucccuauaccacuagaaaaacuuuucaccggccccucaucugccuucguaguccaaccccaaaacggccgaugcaccaccgacggaguccuccucggcacaacccaacucucccccguaaacauauguacuuuccgcggagacgucacucacaucgccggcucccgcaacuacaccaugaaccucgccagucucaacuggaacaacuacgaccccaccgaagaaauaccugcaccccuagggaccccugacuucgucggaaaaauacaaggcguacuaacgcaaaccaccaaaggagacggcuccacccgcggccacaaagccaccguauacaccggcagcgcccccuucacccccaaacuaggcuccguacaguucucaacugacacagaaaaugacuucgaaacccaccaaaacacaaaauucacccccguaggcgucauccaagacggaggcaccacccaucgcaacgaaccccaacaauggguccuacccucauacucaggucgaaacguccaaaacguccaccuggcccccgccgucgcccccacauuccccggcgaacaacuacucuucuuccgcuccacaaugccaggcugcucaggcuaccccaacauggaccuagacugccuacuaccccaagaauggguccaacacuucuaccaagaagccgccccugcccaaucugacgucgcauuacuccgcuucguaaacccagauaccggccgaguccuguucgaaugcaaacuccacaaaucugguuacguaacugucgcccacacaggacaacacgaccucgucaucccaccuaacggauauuuccgauucgacuccugggucaaccaauucuacacccucgcccccaugggcaacggcaccgggcgacgucgcgccuuauaa

SEQ ID NO: 36463 - RNA, 1623 nt, Artificial Sequence
  derived and/or modified sequence opt11 from VP1__Norovirus__BAJ13927
augaaaauggcauccaacgacgccaacccuucagacggcucggcugcaaaccuagucccagaagucaacaacgaagucauggcacuggaacccguggucggcgcugccaucgccgccccagucgcuggccaaaccaacguaaucgaccccuggauccgcaauaacuucguccaagccccaggcggcgaguucaccguaucuccccgcaacgcccccggcgaaauacuauggucggccccacuaggccccgaccuuaaccccuaccucucccaccuugcccgcauguacaacggcuacgcaggaggcuucgaaguccaaguaauacucgcgggcaacgcauucaccgcaggaaaaaucaucuuugccgcagucccacccaacuuccccaccgaaggccucucacccucccaagucaccauguucccccacauaaucguagacguccgacaacucgaaccaguccucaucccacucccagacguacgcaacaacuucuaccacuacaaccaaagcaacgacucuacuaucaaauuaauagccaugcuauauacaccacuccgcgccaacaacgccggcgaagacgucuucaccguuucaugccgaguccucacccgccccagcccagacuucgacuucauauuccuaguuccacccacagucgaaucacggaccaaacccuuuaccguacccauccucaccgucgaagaaaugacuaacucccgcuuccccaucccacuagaaaaacuauucaccgguccauccggcgcauucgucguccaaccacaaaacggucgauguacaacagacggcguccuccucggcacaacccaacucuccccugucaauaucugcaccuuucgaggagacgucacccacaucgccggaucccgcaacuauaccaugaaucucgcuagcuuaaacuggaacaacuacgaccccacagaagaaauccccgcaccccuaggcacccccgauuucgucggcaaaauacaaggaguccuaacccaaacuaccaaaggagacggcuccaccagaggacacaaggcaacuguauauacagguggcgccccauucacccccaaacucggcuccgcccaauucagcaccgacacagaaaacgacuucgaaacccaucaaaacaccaaauucacccccguaggcgucauccaagacggcggcacuacacaccggaacgaaccacaacaauggguucuaccguccuacaguggacgcaacguccauaacguccaccucgccccggcaguugccccaaccuuccccggagaacaacuucucuucuuccgcucuaccaugcccggcugcuccgguuacccgaacauggaccucgacugccuccuuccacaagaauggguacaacacuucuaccaagaagcagcaccagcacaauccgacgucgcccuccuccgcuucguaaaccccgacacaggacgcguccucuucgaaugcaaacuucacaaaucaggcuacgucacugucgcccacacuggccaacacgaccuugucaucccacccaacggcuacuuccgauucgacuccugggucaaccaauucuacacccucgcccccaugggaaacggcaccggccgacgacgcgcacucuaa

SEQ ID NO: 36464 - RNA, 1623 nt, Artificial Sequence
  derived and/or modified sequence opt11 from VP1__Norovirus__BAJ13930
augaaaauggccuccaaugacgcaaaccccuccgacggaagcgccgcuaaccugguccccgaaguuaacaacgaaguaauggcacucgaacccgucgucggagcagccaucgccgcccccgucgccggccaacaaaacguaaucgaccccuggauucgaaacaacuuuguacaagcccccgguggcgaguucacagucuccccacgcaacgcccccggugaaauccuauggucagccccacucgacccagaccucaacccuuaccuaucacaacucgcccgcauguacaacggcuacgccggcggcuucgaaguccaggucauccuagccggcaaugccuuuaccgcaggaaaaauaaucuucgccgcagucccacccaacuuccccacagaaggccuuagcccgucucaagucaccauguucccacauaucaucguagacguccgccaacuugaacccguccucaucccacuucccgacguccgaaauaacuucuaccacuacaaccaaaguaaugauucuacaaucaaacuaaucgccaugcucuacacaccucuacgagccaacaacgcaggcgaagacgucuucacagucuccugccgcguacuaacacgcccuuccccugacuucgauuucauauuccuagucccacccaccguagaaucccgcacaaaacccuucacuguccccauacuuaccgucgaagaaaugacaaacagcagauuccccaucccacucgaaaaacucuucaccggccccuccucagccuucgucguccaaccacaaaacggccgaugcacuacagacggagugcuacuaggcacgacccaacucucacccguaaacauaugcaccuuccguggggaugucacccacaucgcaggcucccgcaacuacacaaugaaccuagcguccuuaaacuggaacaacuacgaccccacagaagaaauaccagcuccucuuggcaccccagacuucgucggcaaaauccaaggcguccucacccaaacaaccaaaggcgacggauccacccgcggacacaaagcuaccgucuacaccggauccgccccauuuacaccaaaacucggcucuguccaauucucaaccgacaccgaaaacgacuucgaaacccaccaaaacaccaaauucacacccgucggcgucauacaagacggcggcaccacccaccgcaacgaaccacaacaauggguacuaccuuccuacuccggacgaaacgucccaaacguacaccuagcccccgccgucgcccccacauuccccggcgaacaacuccuauucuuccguucuaccaugccuggcugcucaggcuaccccaauauggaccuagacugccuacucccccaagaauggguacaacauuucuaccaagaagccgcccccgcccagucagacguagcucuccuccgcuucgucaacccagacaccggccgcguacucuucgaaugcaaacuccauaaguccggcuacgucacagucgcccacaccggacaacacgaucucgucaucccacccaauggauacuuccgauucgauuccugggucaaccaauucuacacccuagcacccaugggaaacggaaccggccgccgccgcgcccucuaa

SEQ ID NO: 36465 - RNA, 1623 nt, Artificial Sequence
  derived and/or modified sequence opt11 from VP1__Norovirus__BAJ13933
augaaaauggcuuccaacgacgccaaccccuccgauggaucagccgccaaccuuguaccagaagucaacaacgaagucauggcccuagagcccguaguaggugcagccaucgccgccccagucgccggccagcaaaacgucaucgauccuuggauccgaaacaacuuuguacaagccccuggaggcgaguucacuguauccccgcgcaacgcccccggagaaauccucugguccgcaccccucggccccgaccuuaaccccuaccuaucccaccucgcccgcauguauaacggcuacgcaggcggguucgaaguccaaguaauccucgccggcaacgcauuuaccgcaggaaaaaucaucuucgcugcuguucccccaaacuuccccacagaaggccuaucaccaucucaagucaccauguuuccacacaucaucgucgacguacgacaacucgaaccaguccuaaucccacuccccgacguccgcaacaacuucuaccacuauaaccaaucaaacgacucuaccaucaaacucaucgccaugcucuacacuccccugcgcgcuaacaacgcuggcgaagacgucuucaccgucucaugucguguccucaccagacccuccccagacuuugacuucaucuuucucguacccccaacagucgaaucucguaccaaacccuucaccguacccauccucaccgucgaagaaaugaccaacucccgcuuccccaucccacuugaaaaacucuucaccggccccucauccgcauucguaguccaaccacaaaacggccgcugcacuacugacggcguacuacuuggcaccacccaacucuccccggucaauaucugcaccuuccgcggcgacgucacacacaucgcaggcucucgaaacuacacaaugaacuuagccucccuaaacuggaauaauuacgaccccaccgaagaaauacccgcuccccucggcaccccagacuucgucggcaagauccaaggaguucucacccaaaccacuaaaggcgacggcuccacucgcggacacaaggccacagucuauaccggcucagcccccuucacacccaaacucggcuccguccaauucucuacagacacagaaaacgacuucgaaacacaccaaaacaccaaguucacacccgucggcguaauccaagacggcuccacaacccaccgcaaugaaccgcaacaauggguccuaccaagcuacucaggacgaaacguccacaauguccaccuagccccagccgucgcccccaccuucccaggcgaacaacuccuguucuucagaucaaccaugccuggcuguucuggcuaccccaauauggaccucgacugccuucucccucaagaauggguccaacauuucuaccaagaagccgcacccgcacaaucagacgucgcccuccuccgcuucguaaacccagacaccggccgcguccuuuucgaaugcaaacugcacaaauccggcuacguuacaguagcccacacgggccagcacgaccucguuauacccccuaacggcuacuuccgcuucgacuccuggguaaaccaauucuacacccucgcaccaaugggaaauggaaccggccgccgccgagcccuauaa

SEQ ID NO: 36466 - RNA, 1623 nt, Artificial Sequence
  derived and/or modified sequence opt11 from VP1__Norovirus__BAJ13936
augaaaauggcaucuaacgacgcaaaccccucagacggcagcgccgcuaaucuagucccagaagucaacaacgaaguuauggcccuggagcccgucgucggcgccgccaucgcagccccagucgcaggucaaacaaacgucaucgacccguggauacgcaacaacuucguacaagcccccggaggcgaguucacggucucaccacgcaacgccccuggcgaaauucuguggucagcaccccucggaccagaccucaaccccuaccuaucccacuuagcccgcauguacaacggcuacgccggcggcuucgaaguacaaguaauucuagccggaaacgccuucaccgccggcaaaaucauuuucgccgccguacccccuaacuuccccacagaaggccucucccccucccaagucaccauguuuccacacaucauagucgacgucagacaacucgaacccguccuaaucccucucccagacguccgcaauaacuucuaucauuacaaucaauccaacgacucaaccaucaaacucaucgccaugcuuuacacaccccuaagagccaauaacgccggcgaagacguauucaccgucuccugccgcguccucacccgaccaucccccgauuucgacuucaucuuccucgucccucccaccgucgaaucccgcacaaaacccuuuaccguccccauacuaacagucgaagaaaugacuaacucccgcuuccccauuccccucgaaaaacuauucaccggccccuccggcgcauucgucguucaaccccaaaacggccgcugcacaacagacggaguccuccuaggcaccacccaacucucccccguaaacauaugcacauuccguggcgacguaacacacauagccggcucacgcaacuacaccaugaaccucgccucccucaacuggaacaacuacgacccaaccgaagaaauacccgcuccccucggcacuccagacuucguuggaaaaauccagggaguccucacccaaaccacuaaaggagacggcucuacccgaggccacaaagccaccguauauaccggcuccgcacccuucacuccaaaacucggauccguccaauucuccacugacacagaaaacgacuucgaaacucaccaaaacaccaaauucacccccgucggcguaauucaagacggcuccaccacacaccgcaacgaaccacagcaauggguacucccaucuuacucaggccguaauguccacaacguccaccucgcccccgcaguagccccgaccuuccccggcgaacaacuccuuuucuuccgcucuacaaugcccggcugcucaggcuaccccaacauggaccucgacugccuccucccccaggaguggguacaacacuucuaucaagaagccgcgcccgcccaaagcgacguugcacuccuucgcuucguaaaccccgacaccggccgaguucuauucgaaugcaaacuccacaaauccggauacgucacaguagcacacaccggccaacacgaccucgucauacccccaaacggcuacuuccgcuucgacuccuggguuaaccaauucuacacccuugcaccaaugggaaacggaaccggacgccgccgcgcucuauaa

SEQ ID NO: 36467 - RNA, 1623 nt, Artificial Sequence
  derived and/or modified sequence opt11 from VP1__Norovirus__BAJ13939
augaaaauggccuccaaugaugccaacccauccgacggcucagccgccaaccuuguacccgaagucaacaacgaagucauggcccucgaaccagucgucggugccgcaaucgccgcucccgucgccggacagcagaaugucaucgaccccuggauccgaaauaacuucguacaagccccuggaggcgaguucacaguauccccgcgcaacgccccaggggaaauccucuggagcgcaccccugggaccugaccucaaucccuaccucucacaccucgcacgaauguacaacggauacgccggaggcuucgaaguccaagucauccucgcaggcaacgcauuuaccgccggcaagaucauauucgccgcaguuccacccaacuuccccaccgaaggccucucacccucacaagucaccauguucccccacaucaucgucgacguccgacaacuagaacccguccucauuccccuccccgacguccgcaacaauuucuaccacuacaaucaaucaaaugacucaaccaucaaacuaauagcaaugcuauacaccccacucagagccaacaacgccggcgaagacgucuucacagucagcugcagaguccuuacucgcccaucaccugacuucgacuucaucuuccugguucccccgacagucgaaucacgaaccaaaccguucaccgucccaauccucacagucgaagaaaugacgaacucacgauucccaaucccacucgaaaaacuauucaccggaccauccagcgccuuuguaguccaaccccagaacggccgcugcaccaccgauggcguacuacuaggcaccacgcaacuaaguccugucaacaucugcaccuuucgcggugacguuacccacaucgccggcucacgaaacuacacaaugaaccucgccagccucaacuggaacaacuacgaccccacagaagaaauacccgcaccccuaggcaccccagacuucgucggcaaaauacaaggcguccucacacaaacaaccaaaggcgacggaucaaccagaggccacaaagccacuguauacaccggcagcgcccccuucaccccaaaacucggcucaguccaauucagcaccgacaccgagaaugacuucgagacacaccaaaacaccaaauucacccccgucggagugauacaagauggcggcacaacccaccgcaacgaaccacaacaauggguccuaccauccuacagcggccgcaacguuccaaacguccaccuagccccagccgucgccccuaccuuccccggagaacaacuucucuucuuccgcuccaccaugccaggcugcuccggcuaucccaacauggaccuagauugccuucucccacaagaauggguccaacacuucuaccaagaagccgcccccgcccaaagcgacgucgcccuccuccgauucguaaaccccgacacgggccgcguccucuucgaaugcaaacuccacaaauccggcuacgucaccgucgcacacacaggccagcacgaccucgucauucccccaaacggcuacuuucgcuucgacucuugggucaaccaauucuacacccuagccccaaugggaaacggaaccggccgacgccgcgcccuuuaa

SEQ ID NO: 36468 - RNA, 1623 nt, Artificial Sequence
  derived and/or modified sequence opt11 from VP1__Norovirus__BAJ13942
augaaaauggccuccaacgacgccaaccccagcgacggcuccgccgccaaccucguccccgaagucaacaacgaagucauggcucuagaacccgucgucggcgccgcuaucgccgcccccguagcaggccaaacuaacgugaucgacccauggaucagaaauaacuucguacaagcacccggaggagaguucacagucucuccccgcaacgcacccggcgaaauccuuugguccgcaccccucggccccgaccuuaacccauaccuuucucaccucgcccgcauguacaacggauaugccggcggcuucgaaguccaaguaauacuagcaggcaaugcauucaccgccggaaaaauaauauucgcagcagucccacccaacuucccaacagaaggucucucuccaucacaagucaccauguucccccauaucauagucgacguacgacaacucgaacccguccuaaucccacuaccggauguccgcaacaauuucuaccacuacaaccaauccaacgacagcacuauaaagcucaucgccaugcuuuacacaccccuacgcgcaaacaacgcaggcgaagacgucuucaccgucuccugcaggguacucacccgucccucacccgacuuugacuucaucuucuuagucccgcccaccgucgaaucacgcaccaagccuuucaccgugccaauucuaaccgucgaagaaaugacaaacuccagauucccaaucccccuagaaaaacuuuucaccggacccuccggcgccuucgucguccagccccaaaacggccgaugcaccaccgacggcguccuacucgguaccacccaacucucacccgucaacaucuguaccuucagaggcgacgucacacauaucgcuggaucacgcgacuacaccaugaaccuugccucucuaaacuggaacaacuacgacccuaccgaagaaauacccgcaccccuuggcaccccggacuucgucggcaaaauacagggcguccucacccaaaccaccaaaggcgacgguuccacacgcggccacaaagcaacagucuacacuggcucagcacccuucacuccaaaacucggcucaguccaauucuccacagacacagaaaacgacuucgaaacacaccaaaacaccaaauucacccccgucggaguaauccaagacggcgggaccacccaccgaaacgaaccccaacaguggguacuccccucuuacuccggccgcaacguacacaacguucaccucgccccugccgucgcacccaccuuccccggcgaacaacuccucuucuuccgcuccaccaugcccggcuguuccgguuaucccaacauggaccucgacugucuacuaccccaagaauggguccaacacuucuaccaagaagccgccccagcccaauccgacgucgcucuccuccgguucguaaaccccgauaccggccgcguccuauucgaaugcaaacuacacaaaaguggauaugucacagucgcccacacaggacaacacgaccuagucauacccccuaacggcuacuuucgauucgacuccugggucaaccaauucuacacacuagcacccaugggaaacggcaccggccgacgacgugcccucuaa

SEQ ID NO: 36469 - RNA, 1623 nt, Artificial Sequence
  derived and/or modified sequence opt11 from VP1__Norovirus__BAJ13945
augaaaauggccuccaacgacgccaaccccuccgacggauccgccgcuaaccuaguaccagaagucaacaacgaagugauggcacucgagcccguagucggcgccgccaucgcagcccccguagccggccaacaaaaugucaucgacccauggauccgcaacaacuucguccaagccccugggggcgaguucaccgucucaccccgcaacgccccaggcgaaauccucugguccgcuccccucggacccgaccucaaccccuaccucucccaccuagcccgcauguacaacggcuacgccggaggcuucgaaguccaagucauccuggcaggcaacgccuucacagcaggaaaaaucauauucgccgccguaccacccaacuuccccaccgaaggccucucacccucucaaguaacuauguucccccacauaaucguugacguacgccaacucgaacccguacucaucccacuacccgacguccgaaacaacuucuaccacuacaaucaaagcaacgauagcaccaucaaacuaauagcaaugcucuauacuccccucagagccaacaacgccggcgaagacguauucaccguaucgugcagaguccucaccagacccucucccgacuucgacuucaucuuccucgucccucccaccguagaaagccgcacuaaacccuucacaguccccauccucaccguugaagaaaugacaaacucccgcuucccaaucccacuugaaaaacuauucacuggacccuccuccgccuucguuguccaaccccaaaacggccgaugcacaaccgacggcguccuccuagguaccacucaacucucacccguaaacaucugcaccuuccgcggugacgucacccacaucgcaggaucucgaaacuacacuaugaaccuagccucacucaacuggaacaauuacgauccuacugaagaaauacccgccccacuaggcacccccgacuuuguaggaaaaauccaaggcguccuaacccaaaccaccaaaggagacgguuccacccgcggacacaaagcaaccgucuacaccgggagcgccccuuuuacacccaaacuaggaucgguccaauucuccacagacacggaaaacgacuucgaaacccaccaaaacacaaaauucacgccugucggcgucauacaagacggcggcacaacgcaccgcaacgaaccacaacaguggguccucccauccuauuccggccgaaacguccaaaacguccaccuagcgcccgcuguagcccccacauuccccggcgaacaacuccucuucuuccgauccacaaugccaggcugcucuggauaccccaacauggaccucgauugccuccuaccccaagaauggguacaacacuuuuaccaagaagccgccccagcacaauccgacguagcgcuccuccgcuucguuaaucccgacaccggccgcguccuuuucgaauguaaacuccacaaauccggcuacguaaccgucgcacacaccggacagcacgaccuugucauucccccaaacggcuauuuccgcuucgacagcugggucaaccaauucuacacccucgcccccaugggaaacggcaccggccgucgccgagcccucuaa

SEQ ID NO: 36470 - RNA, 1623 nt, Artificial Sequence
  derived and/or modified sequence opt11 from VP1__Norovirus__BAJ13948
augaaaauggccuccaacgacgccaaccccucagacggcuccgcagcaaaucucguucccgaagucaauaacgaagucauggcacucgaaccagucguaggagccgccaucgccgcgcccgucgccgggcaacaaaacgucauagacccauggauccgcaacaacuucguccaagcccccggaggagaguucaccgucucuccacgcaacgccccuggcgaaauccuuugguccgcaccccucggccccgaccucaauccauaccucagccaucucgcacgcauguacaacggauacgcaggcggcuucgaaguacaagucauccucgccggcaacgccuucaccgcuggcaaaaucaucuucgccgcuguaccacccaacuucccaacagaaggacucucaccuucacagguaacaauguucccccacaucaucgucgacgugcgacaacucgaaccuguccuuaucccccuacccgacguccgcaacaacuucuaccacuacaaucaaucaaacgacagcacuauaaaauuaauagcaaugcucuacacaccccugcgcgccaacaacgccggugaagaugucuucaccgucuccugccgcguccucacccgaccaucacccgacuucgacuuuaucuuccucguucccccaaccguugaaucgcgaacaaaaccauucacgguaccgauacucaccguugaagaaaugacaaacucacguuuccccauucccuuagaaaaacucuuuacaggccccucauccgcauucguaguccagccccaaaacggucgaugcaccacagacggcguccuacucggcaccacccaacuauccccaguuaacaucugcacauuccgaggcgacgucacccacaucgcaggcucccgcaacuacaccaugaaccucgccucgcuaaacuggaacaacuacgauccaacagaagaaauaccagcaccacucggcacacccgacuucgucggcaaaauccagggcguacucacccagacaaccaaaggagacggcucuacccgaggccacaaagcaacaguauacaccggauccgcacccuucacccccaaacuaggcucaguacaauucuccacagacaccgaaaacgacuucgagacacaccagaacaccaaauucacccccgucggcguaauccaagacggcaacaccacgcaccgcaacgaaccccaacaauggguccuacccagcuauuccggacgcaacguccagaacguacaccucgccccagccgucgcacccaccuuccccggagaacaacuucuuuucuuccgcagcaccaugcccggaugcagcggauacccaaacauggacuuagacugccuccucccccaagaauggguccaacacuucuaccaagaagccgcacccgcccaaucagacguugcucuauuacgauucguaaaccccgacacaggucguguccuauucgaaugcaaacuacacaaaucagguuacgucaccguagcccacaccggccaacacgaccuagucaucccaccaaacggcuacuuccgcuucgacagcugggucaaccaauucuacacccuugccccaaugggaaacggcaccggccgucgucgcgcccucuaa

SEQ ID NO: 36471 - RNA, 1623 nt, Artificial Sequence
  derived and/or modified sequence opt11 from VP1__Norovirus__BAJ13951
augaaaauggcauccaacgacgccaaccccuccgacggauccgccgcaaaccuaguccccgaaguuaacaacgaagucauggcccuagaaccagucgugggagcagcaauagccgcaccaguagccggccaacaaaacguaauagaccccuggauccggaacaacuuuguccaagcccccggaggagaguucacagucucaccccgcaacgcacccggagaaauccuaugguccgcaccccucggccccgaccuaaaccccuaccuaucccaccucgcccgcauguacaacggcuacgcuggaggcuucgaaguccaagugauacucgccggcaaugccuuuaccgccggaaaaaucauauucgcggccguuccacccaacuuccccacagaaggccucucccccucccaaguaaccauguucccccacaucaucguagacgucagacaacuugaacccguccucauccccuuaccggacguccggaacaacuucuaucacuacaaccaauccaacgacucuaccaucaaacucauugccaugcucuacacuccccugcgcgcaaacaacgcuggcgaagacgucuucaccgugagcuguagagugcuaacgcguccaucucccgacuucgacuucaucuuccucgucccaccaaccgucgaaucccgaacaaagcccuucaccgucccaauccuaaccgucgaagaaaugaccaacucccgcuuucccauaccgcuagaaaaacucuucacaggacccagcuccgcauucgucgugcaaccccaaaacggacgaugcaccaccgacggcguacuccugggcaccacccaacucucaccugucaacaucugcaccuuccgcggagacgucacacacauagccggaucacgaaacuacacaaugaaccucgccucacucaacuggaacaacuacgaccccacugaagaaauccccgcuccccucggcacccccgacuuugucggcaaaauccaaggcguccucacccaaacuaccaaaggcgacggaagcacccgcggucacaaagccacuguauacaccggcuccgcuccauucacaccaaaacucgguuccguccaauucuccaccgacacagaaaacgauuucgaaacacaccaaaacaccaaauucacaccagucggcgucauacaagacggcuccaccacccacagaaacgaaccccaacaauggguccuucccucuuauuccggccgaaacguccacaacguccacuuagcccccgccguugcaccaacauuccccggcgaacaacuccuuuucuucagaucaacaaugcccggcugcucaggcuacccaaacauggaccucgacugccuccuaccccaagaauggguccaacacuuuuaccaagaagccgcccccgcacaaucagacgucgcacuucuccgcuucguaaacccugacaccggccguguccuauucgaaugcaaacuucacaaauccggauacgucaccgucgcccacaccggccaacacgaccuaguuauuccacccaacggcuacuuccgcuucgacuccuggguuaaccaauucuacacccuagcccccauggguaacggcacaggaagacgcagagcacucuaa

SEQ ID NO: 36472 - RNA, 1623 nt, Artificial Sequence
  derived and/or modified sequence opt11 from VP1__Norovirus__BAJ13954
augaaaauggcuuccaacgacgcaaacccaucagacggauccgcagcaaaccuaguaccagaagucaacaacgaagucauggcacucgaacccgucgucggcgcagcuaucgccgccccaguagccggccaacaaaacguaaucgacccauggauccgaaacaacuucguacaagcccccggaggcgaguucacuguuuccccucggaacgcgcccggcgaaauccuauggagcgcaccacucggaccagaccucaacccauaccuaucucaccuagcacgcauguacaacggcuacgcaggaggcuucgaaguacaagucauccuagccggcaacgccuucacagcuggcaaaaucauauucgcagccgucccgcccaacuuccccaccgaaggccuaucccccucccagguaaccauguucccacacaucaucguagacguccgucaacucgaaccaguccugaucccucucccagacguucguaacaacuucuaccacuacaaccaauccaacgacagcaccaucaaacuaauagcgaugcucuacacgccccuccgugcaaacaaugccggugaagacguauucaccgucuccugccgaguacucacccgcccuucaccagacuuugacuucaucuuccucguacccccaaccgucgaaucucgaacaaaacccuucaccgucccaauacuaaccgucgaagaaaugaccaacucccgcuuccccaucccccucgaaaaacucuucaccggccccuccuccgccuucgucguucaaccccaaaacggccgcugcaccacugacggcguccuccucggaacaacccaacucucccccgucaacaucugcaccuuucgcggcgacgucacacacaucgccggaucccgcaacuacacaaugaaucucgccucccucaacuggaacaauuacgacccaacagaagaaauccccgccccacucgggacccccgacuucgucggcaaaauccaaggcaugcucacccaaaccacaaaaggcgacggcuccacaagaggccacaaagccaccgucuacacaggcagcgcccccuucaccccaaaacucggaucuguacaauucucaaccgacacagaaaacgauuuugagacccaccaaaacaccaaauucacacccgucggcgucauacaggauggaaacaccacgcaccgaaacgaaccacaacaauggguccucccaucuuacuccggccguaacguacaaaacguacaccucgcccccgccgucgcccccaccuuucccggcgaacaacuacuauucuucagaucuaccaugcccggcugcagcgguuacccaaauauggaccuagacugccuacuaccccaagaguggguucaacacuucuaucaggaagccgccccagcucaaucagacgucgcccuccuaagauucgucaaccccgacacuggucgcguacuauucgaaugcaaacuacacaaauccggcuacgucaccguagcccacaccggacaacacgaccucgucauacccccaaacggcuacuuccgcuucgacucgugggucaaucaauucuacacacuagcccccaugggcaacgggaccggacgacgccgcgcccuuuaa

SEQ ID NO: 36473 - RNA, 1623 nt, Artificial Sequence
  derived and/or modified sequence opt11 from VP1__Norovirus__BAJ13957
augaaaauggccucuaaugacgccaaccccuccgacggcucagccgcuaaccucguuccagaagucaacaacgaaguaauggcgcucgaacccguugucggagccgcuauugccgcccccguagccggccaaaccaacgucauagaccccuggauccgcaauaacuucguccaagcuccuggcggcgaguucaccguaagcccacgcaacgcccccggcgaaaucuuauggucagccccaagcggaccugaccucaacccauaucuaucccaccuugcccguauguucaacgacuacgcaggaggauucgaaguccaagucauccucgccggcaacgccuuuaccgccggaaaaaucauauucgcagcaguaccaccaaacuuccccaccgaaggccucaguccuucgcaagucaccauguucccacacaucaucgucgacguaagacaacuugaacccguccuaaucccccuucccgacguccgcaacaacuucuaccacuacaaccaaucaaacgacucaaccaucaaacuuaucgccaugcucuacacaccacucagggcaaacaacgccggcgaagacgucuucacaguauccugccgcguccuaacccgacccucacccgacuucgacuuuaucuuccuagucccacccaccgucgaaucccgaaccaaacccuucacaguaccgauccucaccgucgaagaaaugacaaacucccgcuuucccaucccccucgaaaaacuauuuaccggcccaucaggagccuucgucguccaaccccaaaacggacgaugcaccacagauggcguccuccucggaacaacccaacuaucucccgucaacaucugcacauuccgcggagacgucacccacaucgcagguucccguaacuacaccaugaaucucgcuagcuuaaacuggaacaauuacgacccaacugaagagaucccagcaccccucggcaccccugacuucguuggcaaaauacaaggaguacuuacccaaaccacaaagggcgacggcagcaccagaggacacaaagccaccgucuacacaggcuccgcacccuucacccccaaacucggauccguccaauucuccacagacaccgaaaacgacuucgaagcccaccaaaacaccaaauucacccccguuggaguaauccaggacggaucgacaacccaccgaaacgaaccccaacaauggguccucccuucauacuccggucguaacguccaaaacguccaccuugcccccgccgucgcccccaccuucccuggagaacagcuccuguucuuccgcagcacaaugcccggcugcuccggcuaucccaauauggaccucgauugccuacucccucaagaauggguccaacauuucuaucaagaagccgcccccgcccaaucugacgucgcccuccuccgcuucgucaaccccgacaccggcagaguccucuucgaaugcaaacuccacaagagcggcuacgucaccgucgcacacaccggucaacaugaucuaguaauacccccaaacgguuauuucagauucgacucauggguuaaccaauucuacacccucgcccccaugggcaauggcaccggccgcagacgugcccuauaa

SEQ ID NO: 36474 - RNA, 1623 nt, Artificial Sequence
  derived and/or modified sequence opt11 from VP1__Norovirus__BAJ13960
augaaaauggccaguaacgacgccaacccuuccgacggcagcgccgccaaccucgucccagaagucaacaacgaagucauggcccuugaaccuguuguaggagccgcaaucgcagcccccgucgccggccagcaaaacgucaucgacccauggaucagaaacaacuucguccaagcccccggcggagaauuuacagugucaccccgaaacgcucccggcgaaauccuuugguccgcaccacucggccccgacuuaaacccauaccuuucccaccucgcccgaauguacaauggcuacgccggaggauucgaaguccaggucauccucgcaggaaacgcauucacagccggcaaaaucauauucgccgccgucccaccuaacuucccgaccgaaggccucucccccucucaagucaccauguucccccacauaaucguagacguacgacagcuugaacccguucuuauaccccuucccgacguccgcaacaacuucuaucacuacaaccaaucaaacgacuccaccauaaaacucauugccaugcuauacacaccccuaagagccaacaacgccggugaagacguauucaccguaucaugccgcguacucacccgcccaucccccgacuucgauuucaucuuccucgucccacccaccguagaaagccgcacuaaacccuucaccguuccuauccuuacagucgaagaaaugacaaacucccgcuucccuauaccacuugaaaaacucuucacaggacccuccucagccuucguuguacaaccccaaaacggacgcugcacuaccgacggaguccuccuagggaccacacaacucucucccguuaacaucugcaccuuucgcggagacgucacacacaucgccggaucacgcaacuacaccaugaaccucgccucccucaacuggaacaacuacgaccccacagaagaaauaccugcaccccucggcacccccgacuucgucggcaaaauccaaggcguccuuacccaaaccaccaaaggggauggcuccacacgaggccacaaagccaccgucuacaccggcuccgcccccuucacuccuaaacucggauccguucaauucucuacugacacagaaaacgacuucgaaacccaccaaaacaccaaauucaccccagucgguguaauacaagauggugggaccacccaccgcaacgaaccccaacaauggguacucccauccuacuccggccgcaacguccccaacgugcacuuagccccugccgucgcccccacauucccuggcgaacaacucuuauucuucagauccacaaugcccgguugcuccggcuaccccaacauggaccucgacugucuccucccccaagaauggguccaacacuucuaccaggaagccgcaccagcacaauccgacgucgcacuccuccguuucgucaaccccgacaccggacgcguacucuucgaaugcaaacuccacaaaucuggauacgucaccgucgcccacaccggccaacacgaccuagucaucccaccuaacggcuacuuccguuucgacucauggguaaaucaauucuacacacucgcacccaugggcaacggcacgggucgccgccgagcccuauaa

SEQ ID NO: 36475 - RNA, 1623 nt, Artificial Sequence
  derived and/or modified sequence opt11 from VP1__Norovirus__BAJ13963
augaagauggcaagcaacgacgccaaccccagugaugguuccgcagccaaccucguccccgaagucaacaaugaaguaauggcccucgaacccgucguaggcgccgccaucgccgcccccgucgccggccaacaaaacguuaucgaccccuggauccggaacaacuucguacaagcccccggaggcgaauuuacagucucuccccgcaacgcccccggcgaaauacucuggucagccccgcucggccccgaccucaaccccuaccucucccaccucgcccgcauguacaauggauacgcaggaggcuucgaaguccaaguaauacucgcaggcaacgccuuuaccgccggcaaaauaaucuucgcugcaguaccuccaaacuuccccaccgaaggucucucccccucccaggucacaauguucccacacauuaucgucgacguccgccaacuagaacccguacucaucccccugccagacguccgcaacaacuucuaccacuacaaccaauccaacgacuccaccaucaaacuaauugcaaugcucuacacaccccuccgagccaacaaugccggcgaagacgucuucaccguauccugccgcgugcucacccgucccuccccagacuucgacuucaucuuccuaguucccccuaccgucgaaucccgcacaaaaccguucacagucccaauccucaccguagaagaaaugaccaacucacgauucccuaucccacuagaaaaacuauucacaggccccucauccgccuucgucguccagccccaaaacggccgcuguaccaccgacggaguccuccucggcaccacgcaacucuccccaguaaacaucugcaccuuccgcggagaugucacacacaucgccggcucccgcaacuacaccaugaaccucgcuucucucaacuggaacaacuacgaucccacugaagaaauacccgccccacuaggcacacccgacuucgucggaaaaauccaagguguccucacccaaaccacaaaaggagacggauccacacgcggucacaaagcaaccgucuacacaggcuccgcucccuucacccccaaacuaggcucaguccaguucuccacagauaccgagaaugacuucgagacccaccaaaauaccaaauucacacccguaggcguaauacaagacggcggcacuacacaccgcaacgaaccccaacaauggguacuccccucuuacuccggucgcaacgucccaaacguccaccuagcacccgccgucgccccaaccuuccccggagaacaacuccucuucuuccgcagcacaaugcccggcuguucugguuaccccaacauggaccuagacugccuccucccacaagaauggguccaacacuuuuaccaagaagcugcacccgcacaauccgacgucgcccuccuccgcuucguaaacccugacaccggccgaguccuauucgaaugcaaacuacacaaauccggcuacgucacugucgcccacacaggccaacacgaccuugucaucccacccaacggcuacuuccguuucgacuccugggucaaucaauucuacacccucgcucccaugggcaacggcaccgggagacgucgagcccuauaa

SEQ ID NO: 36476 - RNA, 1623 nt, Artificial Sequence
  derived and/or modified sequence opt11 from VP1__Norovirus__BAJ13966
augaagauggccucaaacgacgccaaccccuccgacggcuccgccgccaaccucguacccgaagucaacaacgaagucauggcccucgaacccgucgucggcgcagcaauagccgcucccguagcaggucaacaaaacguuaucgacccauggauaaggaacaacuucguccaagcccccggcggagaguucacuguaucuccacgcaacgcccccggcgaaauccuaugguccgcuccccuuggcccggaccuaaaccccuaccucagccaccucgcccgcauguacaacggcuacgccggcggcuucgaaguccaaguaauccucgccggaaacgccuucaccgcaggcaaaauaaucuucgccgcuguaccacccaacuuccccaccgaaggcuuaucccccucacaaguaacaauguucccccacauaaucguugacguccgacagcuagaaccaguccucaucccccuccccgacguccgaaacaacuucuaccacuacaaccagucaaacgacucaaccaucaaacucaucgcaaugcucuacacuccccuccgcgccaacaacgccggcgacgacguauucaccgucucaugccgaguacucacccgcccaucuccagacuucgacuucaucuuccuaguuccacccaccguagaaucccgaacuaaaccauucaccguccccauccuuaccguagaagaaaugacuaacucccgcuuccccaucccccucgaaaaacucuucacaggaccuucaucugcauucgucguccaaccacaaaacggccggugcaccacagauggaguacuacucggaacaacccaacuuucccccgucaacauuugcacauuuagaggcgacgucacccacaucgcaggaucccgcaacuacacaaugaaccuagccucccucaacuggaacaacuacgauccaaccgaagaaauaccggccccuuuaggcacacccgacuucgucggaaaaauccaaggcguacucacacaaacaacuaagggcgauggcagcacaagaggucacaaagcaacugucuacaccggcuccgcagacuucacacccaaacuaggguccguccaguucggaaccgacaccgaaaacgauuucgagacccaccaaaacaccaaauucacccccguuggcgucauacaagacggcuccaccacccaccgaaacgaaccccaacaauggguacuaccaucauacucaggccgcaacguccacaacguacaccuagcccccgccgucgccccaaacuucccaggugaacaacuccucuucuuccgcuccacuaugccuggcugcuccggcuaccccaacauggaccucgacugccuccuuccucaagaauggguccaacacuucuaccaagaagccgcccccgcacaaucagacgucgcccuccuucgcuucgucaacccagacaccggucgcguacuauucgaaugcaaacuacacaaaucaggcuacgucacaguagcccacacaggccaacacgaccucgucauaccacccaaugguuacuuucguuucgacucaugggucaaccaauucuacacacucgcccccaugggaaacggcaccggccgcagacgagcacucuga

SEQ ID NO: 36477 - RNA, 1623 nt, Artificial Sequence
  derived and/or modified sequence opt11 from VP1__Norovirus__BAJ13969
augaaaauggccuccaacgacgccaacccauccgauggcucagccgccaaccucguucccgagguuaacaacgaagucauggcuuuagaacccgucgucggcgccgccauagccgccccagucgccggccaaaccaacguuaucgacccauggauccgaaacaacuucguucaagcccccggcggcgaguucacugucagcccccgcaacgcaccaggcgaaauccuuugguccgcgccccuaggccccgaccucaacccuuaccucucucaccucgccagaauguacaacggauacgccggcggauucgaaguccaaguuauccucgccggcaacgccuucaccgccggcaaaaucaucuuugccgcaguacccccaaacuucccaaccgaaggccucucacccucacaagucacuauguucccccacaucauugucgacguacgccaacucgaacccguacucaucccccucccagaugucagaaauaacuucuaccacuacaaccaaucaaacgacuccaccauuaaacucaucgcaaugcuauauacuccccuccgcgccaacaaugcuggcgaggacgucuucaccguuuccugccgcguccuaacccgaccaucccccgacuucgacuucauauuccuaguuccacccaccgucgaaucgcgaaccaagcccuucaccguccccauacucaccguagaagaaaugaccaacucgagguuccccaucccucuagaaaaacucuuuaccggaccauccggcgccuucgucguccaaccccaaaacggccgcugcaccacagacggcguccuucucggcacuacccaacuaagcccagucaacauuugcaccuuucgcggcgacgucacccauaucgcaggcucacgcaacuacacaaugaaccuagcaucacuaaauuggaacaacuacgaucccaccgaagagauacccgcuccacucggcaccccugacuucgucggcaaaauccaaggaguacucacccaaaccacuaaaggcgacggauccacccgcggccacaaagccacagucuacaccggcucagccccauucacccccaaacucggcucaguccaguucuccaccgacaccgaaaacgacuucgagacccaccaaaacacaaaguucacccccgucggcgucauccaagacgguucaaccacccaccgcaacgagccacaacaauggguucuccccucuuacuccggucgcaacguccacaacguccaccuagccccagcaguugcccccacuuucccaggggaacaacuccucuucuuucgaucaaccaugccaggcugcuccggcuaccccaacauggaucucgacugccuccucccacaagaauggguccaacacuuuuaccaggaggccgcccccgcccaauccgacgucgcccuacucagauucgucaaccccgacaccggccgcguccucuucgaaugcaaacuccacaaaucaggcuacgucacaguugcccacaccggacaacacgaccuugucaucccacccaacggcuacuuccgcuuugauuccuggguaaaccaguucuacacccucgccccaaugggaaacgguaccggccgccgccgagcccucuaa

SEQ ID NO: 36478 - RNA, 1623 nt, Artificial Sequence
  derived and/or modified sequence opt11 from VP1__Norovirus__BAJ13972
augaaaauggcauccaacgacgcaaaccccagcgacggcuccgcagcuaaccucguaccagaagucaacaacgaagucauggcccucgaaccagucguuggcgccgccaucgccgccccaguagccggccaacaaaacguuauugacccauggauaagaaacaacuucguucaagcccccggcggcgaauuuaccguaucaccacgaaacgcccccggcgaaauauuaugguccgcaccccuagguccagaccuuaacccauaucucucacacuuagcccgcauguauaacggauacgccggcggcuucgaaguacaaguuauacucgccggcaacgcauucaccgcaggaaaaaucauauucgcagcagucccaccaaacuuccccacugaaggccuaucacccucccaaguaaccauguucccccacaucaucgucgacguccgacaacucgaaccaguacucauaccccugccggacguacgcaacaacuucuaucacuacaaccaaucuaacgacagcacaaucaaacuaaucgccaugcuguacaccccacugcgcgccaacaaugcaggcgaagacgucuucacaguauccugucgcguacucacccgucccucacccgacuucgacuucaucuuccucgucccacccaccguagaaucucgcacaaaacccuucaccguacccauccuaaccgucgaagaaaugaccaacucccgcuucccaaucccccucgaaaaacuauucaccggccccucuggcgccuucguaguccaaccccaaaacggccguugcaccacugacggcguacuacucggcacaacgcaacucucucccgucaacaucugcacuuucagaggagacguaacccacaucgccggcucacgugacuacaccaugaaccucgccucccugaacuggaacaacuaugaccccaccgaagaaauacccgcuccccucggcaccccugacuucgucggcaaaauucagggcguccuaacccaaaccaccaaaggugacggcucaacacgaggccacaaagcaaccguauacaccggcuccguucccuucacucccaaacucggcucagugcaauucuccaccgacacagaaaacgacuucgaaacccaccaaaacacuaaauucacacccguaggagucauccaagacggcuccaccacccaccgaaacgaaccacaacaauggguccuuccaucauacucgggccgcaacguccacaacguucaccuagcccccgccgucgcaccaaccuuccccggagaacaacuccucuucuuccgauccacuaugcccggcugcuccggcuaccccaacauggaccuggacugccuccuaccccaagaauggguccaacauuucuaccaagaagccgcccccgcccaaucagacgucgcacuacuacgcuucgucaaccccgacaccggccgcguccucuucgaaugcaaacuccacaaaagcgguuacgucaccgucgcacacaccggccaacacgaccuagucauaccaccgaacggcuacuuccgauucgacuccugggucaaccaauucuacacacucgcacccauggguaacggcacaggucgacggcgagcacucuaa

SEQ ID NO: 36479 - RNA, 1623 nt, Artificial Sequence
  derived and/or modified sequence opt11 from VP1__Norovirus__BAJ13975
augaaaauggccucaaacgacgccaacccauccgacggaucagccgccaaccucgugccagaagucaacaacgaagucauggcccucgaaccaguagucggggcagcuaucgcagcccccgucgccggccaacagaauguaauugacccauggauccgaaacaacuucguacaagcacccggcggcgaauuuaccgucuccccucgaaacgcacccggcgaaauccucuggucagcaccccucggacccgaccucaacccauaucucucccaccuggcccgaauguacaacggcuacgccggcggcuucgaaguacaaguaauccucgccggcaacgccuucaccgccggcaaaauaaucuucgcugcagucccacccaacuucccgacagaaggccucagccccucccaaguaaccauguucccccacaucauaguagacguccgccaacucgaacccguacucauaccgcucccugacguccgcaacaacuucuaccacuacaaucaaagcaacgacucaacaauaaaacucaucgccaugcuauacacgccccuccgcgcaaacaacgccggagacgacgucuucaccgucuccugccgcguccuaacacgacccuccccugacuucgacuuuaucuuccuagucccgcccaccgucgaaaguagaaccaaacccuucacaguaccuauccucacagucgaagaaaugacaaacuccagauuccccaucccucuagaaaaacucuuuaccggcccuucauccgccuucgucguccaaccccaaaacggccguugcacaacugacggcguccuccuaggcaccacacaacucucuccagucaacaucugcaccuuccgcggcgacgucacacacaucgcaggcucccgcaauuacaccaugaaccucgcuucccuuaacuggaacaacuacgaccccaccgaagaaauccccgcaccccuagguaccccugacuucgucggcaaaauccaaggaguccuaacccaaaccaccaaaggcgacggcuccacccgaggucacaaagccaccgucuacaccggaucggccgauuucaccccaaaacuuggcucgguccaauucgccaccgacacagaaaaugacuucgaaacccaccaaaacacuaaauucacaccagucgguguaauucaagacggcggcaccacccaccgaaacgaaccucaacaauggguacuacccagcuacucaggccgaaauguccacaauguccaccucgcacccgccgucgcucccaacuucccuggagaacaacuccucuucuuccgauccacaaugcccggaugcucaggauaccccaacauggacuuagacugccuucuaccacaagaauggguccaacacuucuaccaagaagccgcccccgcccaguccgacguggcccugcuccgcuucguaaaccccgacaccggccgaguccuguucgaaugcaaacuccacaaaucaggauacgucacaguagcacacaccggacaacacgaccucgucaucccacccaacggauacuuccguuucgacucgugggucaaccaauuuuacacccuagcccccaugggcaacggaaccggccgccgccgagcccucuaa

SEQ ID NO: 36480 - RNA, 1623 nt, Artificial Sequence
  derived and/or modified sequence opt11 from VP1__Norovirus__BAJ13978
augaaaauggccuccaacgacgcaaaccccuccgacggcuccgccgcaaaccucgucccagaagucaacaacgaagucauggcacucgaacccguaguaggugccgccaucgcagccccagucgccggccaacaaaacgucaucgaccccuggauccgcaacaacuucguccaagccccaggaggcgaguucaccguauccccgcgaaacgccccaggcgaaauccucugguccgcaccccucgggcccgaccuaaaccccuaccuuucccaccuagcucgaauguacaacggcuacgcaggcggcuucgaaguacaaguaauccuagccggaaacgccuuuacagcagguaaaauaaucuucgcugccgucccacccaacuuccccacagaaggcuuaucaccgucccaaguaaccauguucccccacaucauaguagacguacgccagcuagaacccguucuaauuccccucccagacguccgcaacaacuucuaccacuacaaccaaucaaacgacuccacaaucaaacucaucgccaugcucuacaccccauugcgcgcaaacaacgccggagaagacguauucacaguauccugccgcguccuaacccgcccaagcccugacuucgacuucauauuccuaguuccucccaccgucgaaucacgcaccaaacccuucaccguacccauccuaaccguagaagaaaugacaaacucccgcuuccccauaccacucgaaaaacuguuuaccggcccauccggcgcuuucguaguccaaccccaaaacggacgaugcacuaccgacgguguacuccuagguaccacccaacuauccccagucaacauaugcacuuuccgcggcgacguaacacacaucgccggcucccgaaauuacaccaugaaccuagccucccuaaacuggaacaacuacgaccccaccgaagaaaucccggcaccccucggaaccccagacuucguaggcaaaauccaaggcguccucacccaaaccacaaaaggcgacggcuccacccgcggccacaaagccacugucuacaccggcagcacacccuucacccccaaacucggauccguccaauucuccacagacacugaaaaugacuucgaaacccaucaaaauaccaaauucacccccguaggcgucauucaagacggauccaccauacaccgaaacgagccacaacaauggguccuccccagcuacucaggccgaaacguacaaaacguucaccuagcccccgccguugcccccaccuuucccggugaacaacuacucuucuuccgcucuaccaugcccggaugcucaggauaccccaacauggaccucgacugccuucuaccccaagaauggguucagcacuucuaccaagaagccgccccagcccaaagcgacgucgcccuccuacguuucgucaacccagacacgggccgcguccuauucgaaugcaaacuacacaaaucaggcuaugucacaguagcccacacaggccaacacgaccucgucaucccacccaacggcuacuuccgcuucgacuccuggguuaaccaauucuacacccucgcccccaugggcaacggaacaggccgccgccgagcacuguaa

SEQ ID NO: 36481 - RNA, 1623 nt, Artificial Sequence
  derived and/or modified sequence opt11 from VP1__Norovirus__BAJ13981
augaaaauggccuccaacgacgccaacccaucagauggcuccgcagccaaccucgucccagaggucaacaacgaaguaauggcauuagaacccguaguaggcgcagcuaucgcugcaccagucgccggccaacaaaacgucauagaccccuggauccgcaacaauuuuguccaagcccccggaggugaguucaccguuucaccccgcaacgcccccggcgaaauacucuggucugccccacuuggaccagaccuaaacccauaccuuucccaucuagcacgcauguacaacggcuacgccggcggcuucgaaguccaaguuauccuugcaggcaacgcauucacagccggcaaaauaauauucgccgccguacccccaaacuuccccacagaaggccucucccccagucaagucaccauguucccccacaucaucguagacguacgucagcuagaacccguccuaauaccccuacccgacguacgaaacaacuucuaccacuacaaucaauccaacgauuccacaaucaaacucaucgccaugcuauacaccccacuccgagcgaauaacgccggagaagacgucuucaccgucuccuguagaguccucaccagacccucaccugacuucgacuucaucuuccucgucccacccaccgucgaaucacgcaccaaacccuucaccguucccauacucaccgucgaagaaaugacaaacucacguuuccccauaccacucgaaaaacucuucacaggccccuccucagcauuuguaguccaaccccaaaacggaagaugcacaacagacgguguacucuuaggaaccacccaacucucacccgucaacaucugcacauuccgcggagacgucacccacaucgccggaucccgcaacuacaccaugaaccucgccagucuaaacuggaacaacuacgacccaaccgaggaaauccccgcaccccucggcacuccagacuucgucggaaaaauucaaggcguccuaacccaaaccaccaaaggcgacggcuccacccgcggccacaaagccaccguauacacuggcuccgccccauucacaccaaaacucggcuccguccaauucuccacagacaccgaaaacgacuucgaaacccaccaaaacacaaaauucacccccguuggcgucauucaagacggcggcaccacucaucgcaaugaaccccaacaauggguacucccauccuacucaggaagaaacguacccaacguccaccuugcccccgccguagccccaaccuuuccuggcgaacaacuacuguucuuccgcucuacaaugcccggaugcuccggcuacccaaacauggaccuagacugccuccucccccaagaauggguccaacauuuuuaccaagaagccgcccccgcccaaagcgacguagcccuccucagauucgucaacccagacaccggccgcguacucuucgaaugcaaacuacacaaauccggauacgucaccgucgcccacacaggccaacacgaccuagucaucccacccaacggcuacuuccgcuucgacucgugggucaaucaauucuauacacucgcccccaugggcaacggcaccggccgccgacgcgcccucuaa

SEQ ID NO: 36482 - RNA, 1623 nt, Artificial Sequence
  derived and/or modified sequence opt11 from VP1__Norovirus__BAJ13984
augaaaauggccucaaaugacgccaaccccuccgacggcucagccgccaaccuagucccagaaguaaacaaugaaguuauggcccucgaacccguaguaggugccgccauagccgccccgguagccggccaaaccaacguaaucgaccccuggaucagaaacaacuuuguccaagcacccggcggcgaguucaccguauccccaagaaacgcccccggcgaaauacuuugguccgcaccccucggccccgaucuaaacccauaucuaucccaccuagcccgcauguacaacggauacgccggcggcuucgaaguccagguaauccuagcaggcaacgcuuucaccgcaggcaaaauaaucuucgcagccgucccaccuaacuuccccaccgaaggccucucacccucccaagucacaauguucccacauaucaucgucgacguucgccaacucgaaccuguucuaauaccccuacccgacguccgaaacaacuucuaccacuacaaccaaucuaacgacucaaccauaaaacucauagccauguuauacacaccccuccgugccaacaaugccggagaagacgucuucacugucucaugucgcguccucacucgccccucccccgacuucgacuucaucuuucucguacccccaaccgucgaaucucgcaccaaaccauucaccguucccauccucaccgucgaagaaaugaccaacuccagauuccccaucccccucgaaaaacucuucacaggacccucuggcgccuucgucguacaaccacaaaacggacgaugcaccacugacggcguccuccucggcacuacacagcuaucaccagucaauauaugcaccuuccguggcgacgucacucacaucgccggcucacgcaacuacacaaugaaccucgccucccuaaacuggaauaacuacgaccccaccgaagaaaucccugcaccacucgguacccccgacuucgucggaaaaauccaggguguacuaacccaaacaacuaaaggcgauggcuccacucgaggccacaaagccaccgucuacacaggauccgcacccuucacccccaaacuaggcuccguacaauucucuaccgacaccgaaaacgacuucgaaacccaucaaaacaccaaauucaccccaguuggaguaauccaagacggauccacaacacaccgcaacgaaccacaacaauggguacuccccucauacuccggcagaaacguccacaacguccaccucgcccccgcaguagcgcccacauuccccggcgaacaacuacucuucuuucguuccacaaugcccggaugcucuggcuaccccaacauggaucuagacugccuacucccccaagaauggguccaacacuucuaucaggaggccgcccccgcacaaagcgacguagcccuacuuagguucguaaaccccgacacaggccgcguccuauucgagugcaaacuacacaaaagcggcuacguaaccgucgcccacaccggccaacacgaccuugucaucccucccaacggcuacuuccgauucgacucaugggucaaccaguucuacacccuggcccccaugggcaacggcacaggucgacgacgcgcccucuaa

SEQ ID NO: 36483 - RNA, 1623 nt, Artificial Sequence
  derived and/or modified sequence opt11 from VP1__Norovirus__BAJ13987
augaaaauggccucaaacgacgccaaccccagcgacggcuccgccgcaaaccuagucccugaagucaacaacgaagucauggcacucgaaccuguaguaggcgccgccaucgcugcccccgucgccggccaaacaaacgucauagaccccuggaucagaaacaacuucguccaagcccccggaggcgaguucacaguaucucccagaaacgcucccggagaaauacuguggucggcgccacucgguccagaccucaacccauaccugucccaucucgcacgcauguauaacggcuacgcaggcggcuuugaaguucaagucauccuugcaggaaacgccuucacggccggcaaaauaaucuuugccgccgucccgcccaacuuucccacugaaggccuaucucccucccaaguuaccauguucccccauaucaucgucgacguacgccaacuagaaccaguacucaucccccuaccugacguacgcaacaacuucuaccacuacaaccaaucuaacgacagcaccaucaaacucauagcaaugcucuacaccccucucagagcaaacaacgccggcgaagacguauucaccgucuccugccgugucuuaacccgcccauccccagacuucgacuucaucuuccuugucccacccaccguagaaucacgcaccaaacccuucaccgucccuauccuaaccgucgaagaaaugacaaacagccgcuuccccaucccacuugaaaaacucuuuaccggucccuccggcgccuucguuguucaaccacaaaacggccgcugcaccacagacggaguccuccucggaacaacucaacucagccccgucaacaucugcaccuuccgcggagaugucacucacaucgcaggaucacgcaacuacacaaugaaucuagccucacucaacuggaacaauuacgaccccaccgaagaaauccccgccccacucgguacccccgacuucgucggcaaaauccaaggaguccucacccaaacaaccaaaggcgacggcuccacccgcggacacaaagcaacggucuacaccggcucagccccuuucaccccaaaacuaggauccguccaauucuccacagacaccgaaaacgacuucgaaacccaccaaaacaccaaauucacccccguaggagucauucaagacgguagcacaacccacagaaacgaaccgcaacaauggguacuacccucauacucuggccgcaacgugcacaauguucaucucgcccccgcagucgcccccaccuucccuggcgaacaacuauuauucuuccgaagcaccaugccaggaugcuccggcuacccuaauauggaccucgacugccuccuaccacaagaauggguccaacacuucuaccaagaagcugcccccgcccaaucugacgucgcccuucuccgauucgucaaucccgacacaggccgaguccucuucgaaugcaaacugcacaaauccggcuacgucaccgucgcccacaccggacaacacgaccuuguaauaccacccaacggcuacuuucgcuucgacagcuggguaaaccaauucuauacccucgccccuaugggaaacggcaccggccgacgccgcgcccucuaa

SEQ ID NO: 36484 - RNA, 1623 nt, Artificial Sequence
  derived and/or modified sequence opt11 from VP1__Norovirus__BAJ13990
augaaaauggccagcaacgaugcaucccccagcgauggauccgccgccaaccucgucccagaagucaauaacgaagucauggcacuagaacccgucgucggcgcagcaaucgccgccccugucgccggacaacaaaaugucaucgaccccuggaucagaaacaacuuuguucaagcccccggcggcgaguucacuguauccccgcgcaacgcccccggcgaaauccuuugguccgccccacucggacccgaccuaaaccccuacuuaucucaccuugcucgcauguacaacgguuacgcaggcggcuucgaaguccaggucauccuagcaggcaacgccuucacagccggcaaaaucaucuucgcggccgucccacccaacuucccaacagaaggccucagcccaucucaagucaccauguucccccacaucaucguagaugucagacaacucgagcccguccucaucccucucccugacguacgcaacaacuucuaucauuacaaccaaagcaacgacuccacaaucaaacuaauagcaaugcucuacaccccacucagagccaacaaugccggcgaagacguguucacaguauccuguagaguccuuaccaggcccucucccgacuucgacuucauauuccucguacccccaaccgucgaaucacgcaccaaacccuucaccguacccauacuaaccgucgaagaaaugacaaacucccgauuccccaucccccuagaaaaacucuucaccggccccucuucagcauucguaguccaaccccaaaacggacgaugcaccacagacggcguccuccucggcacaacccaacucucccccgucaacaucuguacauuccggggcgacguaacccacauagccggcucuagaaacuauacaaugaaccucgcaucacucaacuggaacaacuacgaccccacugaagaaaucccagcuccccucggaacccccgacuucgucggcaaaauacaaggcguucucacccaaacaaccaaaggcgacggauccacccgcggccacaaagccaccguauauacaggcuccgccccauucacccccaaacucggaucaguccaauucagcacagacaccgaaaacgacuucgaaacccaccaaaacacaaaauucacccccgucggcgucauacaagacggcggaaccacccaccgcaaugaaccccaacaauggguacuaccauccuacuccggccgaaacguuccaaacguucaccuagcccccgccgucgcucccaccuucccaggugaacaacuccuauucuuccgcuccaccaugccaggcugcucugguuacccaaacauggaccuugacugccuacucccucaagaguggguacagcacuucuaccaagaagccgccccagcccaaucagacguagcacuccuacguuucgucaacccagauaccggccgcguccucuucgaaugcaaacuccacaaauccggcuacgucaccgucgcccacaccggccaacacgaccucgucauacccccaaacggauacuuccgcuucgacuccugggucaaccaauucuacacucucgcacccaugggcaacggcaccggccgccgacgcgcccucuga

SEQ ID NO: 36485 - RNA, 1623 nt, Artificial Sequence
  derived and/or modified sequence opt11 from VP1__Norovirus__BAJ13993
augaaaauggccuccaacgacgcuaaccccuccgacggaucagccgccaaccucgucccagaagucaacaaugaagucauggcacucgaaccaguugucggcgccgccauagcugccccaguugcaggccaaacuaauguaauagacccauggauccgcaacaacuuuguccaagcacccggcggcgaguucaccgucucaccccguaacgccccuggcgaaauucucugguccgcuccccuaggcccagaccucaaccccuaccuaucccaccucgcccgaauguacaacggauacgccggcggcuucgaaguccaagucauccuugccggaaacgcauucaccgccggcaaaaucauauucgccgccgugccacccaauuuucccacugaaggccuaucccccucccaagucacaauguucccacacaucaucgucgacguacgacaacuagaacccguacucaucccccuuccagacguccgcaacaacuuuuaccacuacaaccaaucaaacgacuccacaaucaaacugauagccaugcuauacacaccucuccgagccaacaacgccggcgaagacguauucaccguaagcugccgcguccucacccguccaucccccgacuucgacuuuauauuccucguuccucccacagucgaaucccgcaccaaacccuucaccguccccauacucaccguugaagaaaugaccaacucccgauuccccaucccacucgaaaaacucuucacuggccccucaggcgcauucgucguccaaccccaaaacggacgaugcaccacagacggcguccugcuaggcaccacccagcucucccccgucaacauaugcaccuuccgcggcgacgucacccacaucgccggcucucgaaacuacaccaugaaucucgccucccuaaacuggaacaacuacgauccuacagaagaaaucccagcaccucucgguacaccagacuucgucggaaaaauacaaggcguccucacccaaaccacaaaaggcgacggcucuacacgaggccacaaggcaaccgucuacacaggcagcgcaccauucacccccaaacucgguuccguccaauucuccacagacacagaaaacgacuucgaaacacaccaaaacaccaaauuuaccccaguuggcgucauucaagacggcucaaccacccaccgaaaugaaccccaacaauggguacucccuucauacuccggccgaaacguccacaacguccaccuagcccccgccgucgcaccaacauuccccggagaacaacuucucuucuuccgaaguaccaugccuggcugcucaggcuacccuaacauggaucucgauugcuuacuaccccaagaauggguacaacacuucuaccaagaggcagccccugcccaauccgacguagcccuucuccgcuucguuaacccagacaccggccgcguauuauuugaaugcaaacuccauaaaucaggcuacguaaccgucgcccacaccgggcaacacgaccucgucaucccacccaacggcuacuuccgauucgacuccuggguaaaccaauucuacacccucgcccccaugggcaacggaaccggaagacgacgcgcgcuauaa

SEQ ID NO: 36486 - RNA, 1623 nt, Artificial Sequence
  derived and/or modified sequence opt11 from VP1__Norovirus__BAJ13996
augaaaauggccuccaacgacgccaaccccucagauggauccgcagccaaucucguccccgaaguaaacaaugaagucauggcccucgaacccguagucggcgccgcuaucgccgcucccguagccggacaacaaaacguuauagaucccuggauacgaaauaacuucguucaagcccccgguggcgaguucacgguaagcccccgcaacgcccccggagaaauccucuggagcgcuccccuaggacccgaccucaaccccuaccucucccacuuagcccguauguacaacggcuacgcaggaggcuucgaaguccaagucauccucgcaggcaacgcauucacagcggguaaaauaauauucgcugcagucccacccaacuuucccacagaaggccuaagccccucacaaguaaccauguucccucacauuaucgucgacguccgacaacuagaacccguacucauaccccuacccgacguacggaacaacuucuaccacuacaaccaaagcaacgacuccaccauaaagcucaucgcgaugcuuuauacaccccuccgcgccaacaacgcaggagaagacgucuucaccgucuccugccgcguccucacccgacccuccccagacuucgacuucauauuccucguuccgcccaccgucgaauccagaaccaaaccauucacuguacccauccuaacugucgaagaaaugacuaacucccgcuuccccaucccccuagaaaaacuuuuuacaggacccucaagcgcuuucgucguacaaccccaaaacggccgaugcaccaccgacggagucuugcucggaaccacccaacugagucccgucaauaucugcaccuuccgcggcgacguaacccacauagccggcucccgcaacuacacaaugaaccucgccagccuuaacuggaacaauuacgaccccacagaagaaauccccgccccgcuaggcacacccgacuucgucggcaaaauccaagggguccucacccaaacaaccaaaggcgacggcuccacacgcggucacaaagccacuguuuacaccggauccgcaccauucaccccuaaacucggcuccguacaauucuccacugacacagaaaacgacuucgaaacccaccaaaacacaaaauucacccccguaggcgucauacaagacggcggcacaacacaccgaaacgagccccaacaauggguacucccguccuacagcggccggaacguccagaauguacaccucgccccugccguagcacccaccuucccaggcgaacaacuccucuucuuccguuccaccaugcccggcugcucaggcuacccaaacauggaccucgacugccugcucccccaggaauggguccaacacuucuaccaagaagccgccccugcacaaucagaugucgcucuauuaagauucgucaaccccgacaccggacgaguccucuucgaaugcaaacuucacaaauccggcuacguaacugucgcccacacuggccaacacgaucuagucaucccucccaacggcuacuuccgcuucgacuccugggucaaccaguucuacacccucgcacccaugggcaacgguaccggacgacgccgcgcacucuaa

SEQ ID NO: 36487 - RNA, 1623 nt, Artificial Sequence
  derived and/or modified sequence opt11 from VP1__Norovirus__BAJ13999
augaaaauggcauccucagacgccaaccccucagacggcuccgcagccaaccucguacccgaaguaaacaacgaagucauggcauuagaaccagucgucggagcagccauagcagcaccugucgccggccaacaaaacgucaucgaccccuggauccguaacaacuucguucaagccccgggaggugaguucacagucucaccccgcaacgcccccggcgaaauccuauggucagcaccccucggaccagaccucaacccuuaccucucccaccucgcccguauguacaacggcuacgccggcggcuucgaaguacaagucauccuagcaggcaacgccuucaccgcaggaaaaaucauauuugcagcaguacccccaaacuuccccacagaaggccuaucccccucacaagucacaauguucccccacaucaucgucgacguacgccaacucgaaccaguccuuauaccacuaccagacgucagaaacaacuucuaccacuauaaccaauccaacgauucaaccaucaaacucaucgccaugcucuacaccccgcuucgagccaacaacgccggcgaggacgucuucaccguguccugccgcguccuaacccgccccucccccgauuucgacuuuaucuuccuagucccucccaccgucgaaucccgcaccaaacccuucacgguccccauccuaaccgucgaagaaaugacaaacucccgauuccccaucccccucgaaaaacuauucacuggucccucaggcgcuuucguaguccagccacaaaacggcagaugcacaaccgacggcguauuacucggcaccacccaacucucucccguuaacaucugcaccuuccgcggcgacgucacccacaucgccgguucacgcaacuacaccaugaaccucgccucccucaacuggaacaacuacgaucccaccgaagaaauccccgccccucuaggcacuccagacuucgucggaaaaauacaaggaaugcuaacacaaacuaccaaaggcgacggauccacucgcggucacaaagcaacagucuacacaggcagcgcccccuucacccccaaacuaggcuccguucaauucagcaccgacaccgaaaacgacuucgaaacccaucaaaacacuaaauucacacccgugggagucauacaagacgguuccacaacucaccgaaacgaaccccaacaauggguccuacccucauacucaggccgcgacguccacaacguccaccucgcccccgccguagcccccaccuuccccggagaacaacuacucuucuuccgauccaccaugccggguugcuccggcuaccccaacauggaccuagacugccuucuaccccaagaauggguccaacauuucuaucaagaggccgcuccagcccaauccgacguagcccuccuccgcuucguaaaccccgacaccggccgaguacuuuucgaaugcaaacuccacaaauccggcuacguaaccguagcccacaccggacaacacgaccucguaauaccacccaacggcuacuucagauucgacuccuggguuaaccaauucuacacccucgccccaaugggaaauggaaccggccgucgccgcgcacuauaa

SEQ ID NO: 36488 - RNA, 1623 nt, Artificial Sequence
  derived and/or modified sequence opt11 from VP1__Norovirus__BAJ14002
augaaaauggccuccaaugacgccaaccccucagacggauccgccgcaaaccucguccccgaaguaaacaacgaaguaauggcccuagaacccgucgucggcgccgccaucgcugccccagucgcaggccaacaaaacgucaucgaccccuggauacgcaacaauuucguccaagcaccaggcggcgaguucaccguauccccacgcaacgccccaggagaaauccucuggucagcgccccucggcccagaccucaacccauaccuaucucaccucgcccgcauguacaacgguuacgccggaggcuucgaaguccaagucauccuggccggcaacgccuucaccgcaggcaaaaucauuuucgccgccguacccccgaacuuccccacagaaggacuaucacccagccaaguuacaauguucccccacaucauaguugacguccgccaacuagaacccguccucauuccacucccagacguacgaaacaacuucuaccacuacaaccaaagcaacgacaguaccaucaaacuaauagccaugcucuacacaccccuucgagcaaacaaugcaggcgaagacgucuuuaccguaucaugccgcguacucacccgacccagucccgacuuugacuucaucuuucuaguaccucccaccguagaaucacgcacaaaacccuucacaguccccauccucacagucgaagaaaugaccaacucccgguuccccauuccccucgaaaaacucuucaccggaccaucaucagcauucguaguccaaccacaaaacggccgcugcaccaccgacggcguccuccuuggcacaacccaacuaucucccgucaacaucugcaccuuucgcggcgacgucacccacaucgccggcuccagaaacuacacuaugaaccucgccuccuuaaacuggaacaauuacgaccccaccgaagaaauccccgccccacucggcacacccgacuucguaggcaagauucaaggcguccucacacagaccacaaaaggagacgguucuacccgcggccauaaagccaccgucuacaccggcuccgcccccuucacccccaaacucggcuccguucaauucuccaccgauaccgaaaacgauuucgaaacccaccaaaacacaaaauucacaccagucgguguaauccaagacggcggcaccacccaccgcaacgaaccccaacaaugggucuuaccuucauacuccggaagaaacguccaaaacguccaccucgcccccgccguagccccuacauuccccggcgaacagcuccucuuuuuccgcucuaccaugcccggcugcucaggcuaccccaacauggaccucgacugccuacucccgcaagaauggguacaacacuuuuaucaagaagcugcaccagcccaguccgacguugcccuucuuagauucguaaaccccgacacaggacgcguccucuucgaaugcaaacuccacaaauccggcuacgucacagucgcacacacaggccaacacgaccuagucaucccacccaacggauacuuccgcuuugacuccugggucaaccaauuuuacacacuagcccccaugggcaacggaaccggccggcgacgcgcccuuuaa

SEQ ID NO: 36489 - RNA, 1623 nt, Artificial Sequence
  derived and/or modified sequence opt11 from VP1__Norovirus__BAJ14005
augaaaauggccuccaacgacgcaaacccauccgacggauccgcagccaaccuagucccagaaguaaacaaugaaguaauggcucucgaacccgucgucggcgcagccaucgcagcccccguagcaggccaacaaaacguaauagacccauggauccgcaacaacuucguccaagcccccggcggugaguucaccguaagcccccguaacgcgccaggagaaauccucugguccgcuccccugggcccugaccugaaccccuaccucucccaccuagcccguauguacaacggcuacgccggaggcuucgaaguccaaguuauccuagccggcaacgccuucacagcaggaaaaaucaucuucgcugccgucccacccaacuuccccacagaaggccuaucccccucccaaguuacaauguucccccacauuaucguugacguucgccaacucgaacccguacuuauuccccuacccgacguacgaaacaacuucuaccacuauaaccaauccaacgacuccaccauaaagcuaaucgccaugcucuacaccccacuccgcgcaaacaacgccggcgaagacgucuucaccgucagcugccgcguacucacccgacccucccccgacuucgacuucaucuucuuagucccacccaccgucgaaucacgaaccaaacccuucaccguacuaauccucaccgucgaagaaaugacaaauucccgauuccccaucccccucgaaaaacucuucaccggcccuuccuccgccuucgucguucaaccacaaaacggccgauguacaaccgacggcguccuacucggaacaacacaacuuuccccaguuaacaucugcaccuuccgcggcgacgucacccacaucgcaggcucccgcaacuauaccaugaaccuagccucucucaauuggaacaacuacgacccuaccgaagaaaucccagcaccccuuggaacacccgacuucguggguaagauccaagguguccuuacccaaaccaccaaaggagacggcuccaccagaggccauaaagcgacagucuacaccggcucagccccauucacacccaagcucggcuccguccaauuuucaaccgacacugaaaacgacuucgaaauccaccaaaacacaaaauucacccccgucggcgucauacaagacggcucaaccacccaccgcaacgaaccccaacaauggguacuacccuccuacuccggccgcaacguccacaacguucaccuagccccagcagucgcccccaccuucccaggcgaacaacuucucuucuuccgcucuaccaugcccggaugcucaggcuaccccaacauggaccuagacugucuccugccccaagaauggguccaacacuucuaccaagaagcugcccccgcacaauccgacguggcgcuccuccgauucgucaaccccgacacaggccgcguacuauucgaaugcaagcuacacaaauccggcuacgucaccgucgccuacaccggccaacacgaccucguaauaccacccaacggauacuuccgcuucgacuccugggucaaccaauucuauaccuuagcccccaugggcaaugguaccggucgccgccgcgcccuauaa

SEQ ID NO: 36490 - RNA, 1623 nt, Artificial Sequence
  derived and/or modified sequence opt11 from VP1__Norovirus__BAJ14008
augaaaauggccuccaacgacgccaaccccuccgacggaucagccgccaaccuugucccagaagucaacaacgaagucauggcccuugagccggucgucggagccgcaaucgccgcaccaguagcaggacaaaccaacgucaucgacccauggauccgaaacaacuucgugcaagccccaggaggcgaguucaccgucuccccacggaacgcccccggagaaaucuuauggucagcaccccuaggccccgaccucaacccauaccucucacaccuagcccgaauguacaacggcuacgcaggaggauucgaaguccaagucauccuagcaggaaaugccuucacagccggcaaaaucaucuucgccgccgucccacccaacuuccccacagaaggucuaucccccucccaagucaccauguuuccccacauaaucguagacguccgccagcucgaaccaguucucauaccccuccccgauguccgcaacaacuucuaccacuacaaccaauccaacgacuccaccaucaaacuuaucgccaugcucuacacuccacuccgcgcaaacaacgccggcgaagacguauuuaccgucucuugucgcgugcucacacgacccucacccgauuucgacuucauauuccucguaccacccaccgucgaaucccgcaccaaacccuucacaguccccguccuaacaguagaagaaaugaccaacucacgauuccccauaccccuagaaaaacucuucaccggacccuccggagccuucguaguccaaccacaaaacggcagaugcaccaccgacggcguccuacuaggcacaacccaacuuucccccgucaacaucugcacuuuuagaggcgacgucacacacaucgcaggcucuagaaacuacaccaugaaccucgccucucuaaacuggaauaacuacgaccccaccgaagaaaucccagcuccacuaggcacacccgacuucguaggcaaaauccaaggcguccucacacaaacaaccaaaggcgacggaucaacccgcggccacaaagccacagucuacaccggauccgcacccuucacccccaaacuaggcucaguacaauucucaaccgacaccgaaaacgauuucgaaacccaccaaaacaccaaauucacacccguaggcgucauccaagacggcuccaccacccaccgcaacgaaccccaacaauggguccuccccucauacucaggccguaauguccauaacguacaccucgcaccagcaguugcccccaccuuccccggcgagcaacuacucuucuuccgaucaaccaugcccgggugcucaggcuaccccaacauggaccucgacuguuuacucccccaagaguggguccagcacuucuaucaagaggcugcccccgcacaaucagaagucgcacuacuccguuucguaaaccccgacacuggcagaguacucuucgaaugcaaacugcacaaauccggcuaugucacugucgcgcacacaggacaacacgaccuagucaucccucccaacggcuauuuccgauucgacuccugggucaaccaguucuauacccuugcccccaugggcaacggcaccggucgccgccgcgcucuauag

SEQ ID NO: 36491 - RNA, 1623 nt, Artificial Sequence
  derived and/or modified sequence opt11 from VP1__Norovirus__BAJ14011
augaaaauggccuccaacgacgcaaaccccucagacgguuccgccgccaaccucguccccgaagucaacaacgaaguuauggcccucgaacccguaguaggcgccgccaucgcagcucccgucgcuggccaacaaaaugucauagaccccuggauccgaaacaacuucguccaagcucccggcggcgaguucaccgucucuccccgaaacgcccccggcgaaauccucuggucugcaccccuaggcccagaccucaaccccuaccucucucacuuagcccggauguacaauggcuacgcaggcggcuucgaaguccaaguaauccuugcuggaaacgccuuuaccgcaggcaaaaucaucuucgcagccguucccccaaacuucccaacagaaggacucuccccaucgcaagucaccauguucccccacaucaucgucgacguacgccagcuugaaccaguccuaaucccccuccccgacguccgcaacaacuuuuaccacuacaaccaaucaaacgacucaaccaucaaacuaauagccaugcucuacacaccccuccgcgcaaacaacgcaggagaagacgucuucaccguauccugucgcguucuaacacgcccaucccccgacuucgacuucauauuccuaguacccccaacagucgaaagccgcaccaaaccauucaccguccccauucucaccgucgaggaaaugaccaacucacgcuuccccaucccccuagaaaaacucuuuacaggccccucuuccgcauucguaguccaaccacaaaacggccgcugcaccaccgacgggguccuccucggcaccacucaacucucaccuguaaacaucugcacauuccgcggcgacgucacucacaucgccggaucccgaaacuacacaaugaaccuagccucccuaaauuggaacaacuacgacccaacugaagagaucccagcaccccucggcacccccgacuucgucggaaaaauccaaggcguccuaacccaaacaaccaagggcgacggcucaacccguggccacaaagccaccguauacaccggaagcgcccccuucaccccaaaacuaggcucaguccaguucucaacagacacagaaaacgacuucgaaauacaccaaaacacaaaauucaccccaguaggcgucauucaagacggcuccacaacccaccgcaacgaaccacaacaguggguacucccaucauacucuggccgaaacguccacaacguccaccuagccccagccgucgcccccacuuuccccggagaacaacuacuuuucuuccgauccaccaugcccggcugcucgggauaccccaacauggaccuagacugccuacucccccaagaauggguccagcacuucuaccaagaggcagccccagcccaaucugacguagcccuccuccgauucgucaaccccgacaccggacgcguccucuucgagugcaaacuacacaaaucuggauacguaacugucgccuacaccggacaacaugaccucgucaucccucccaacggcuacuuccgcuucgacuccugggucaaccaauucuacacacuagcacccaugggaaacggaacaggucgcagacgcgcccuauaa

SEQ ID NO: 36492 - RNA, 1623 nt, Artificial Sequence
  derived and/or modified sequence opt11 from VP1__Norovirus__BAJ14014
augaaaauggccuccaacgaugccaaccccuccgacggcuccgccgccaaccuuguuccugaagucaacaacgaagucauggcccuagaaccagucgucggcgcggccaucgccgcacccguagcuggacaaaccaacguaauugacccuuggauccgaaauaauuucguccaagcaccaggcggcgaauuuaccguuuccccacgcaacgcacccggagaaauccucuggagcgcaccccuaggccccgaccuuaaccccuaucucagccaucucgcccgcauguacaacggauaugcaggcggcuucgaaguucaagucauacucgcaggcaacgcauucaccgccggaaaaaucaucuucgccgccguacccccaaacuucccaacggaaggacucucccccucccaagucaccauguucccacacaucauaguggacguccgccaacucgaaccaguccuuauaccccuccccgacguacgcaacaacuucuaccacuacaaccaauccaacgauuccaccaucaaacucaucgcaaugcucuacacuccccuacgagccaacaaugcuggcgaagacgucuucaccgucucaugccguguccucacccgacccucacccgauuucgacuucaucuuccuagucccucccaccguugaaucccgaaccaagcccuucaccguccccauacuuaccgucgaagaaaugaccaauucacgcuuccccaucccccuagaaaaacuauucaccggcccuucaggcgccuucgucguccaaccccaaaacggccgcuguaccacagacggaguccuccucggaacaacccaacuaucaccaguaaacauaugcacauuucggggcgacgucacccacaucgcuggcucccgaaauuacacaaugaaccucgccucucuaaacuggaacaacuacgauccuaccgaagaaaucccagcaccccucggcacacccgacuucgucggcaaaauccaaggcguacucacacaaacaacaaaaggcgacggcagcacucgaggccacaaagccacaguauacaccggauccgccccauucacccccaaacuaggcucaguccaauucucgacugacacagaaaacgacuuugaaacccaccaaaacaccaaauucacccccgucggagucauccaagacggcuccaccacccaucgaaacgaaccacaacaauggguccuacccucauacucaggccgcaacguacacaacguccaccucgcccccgcagucgcaccaacauuccccggagaacaacuacuauucuuccgaagcaccaugcccggcugcucaggcuaucccaacauggaccucgacugccuacuaccccaagaauggguacaacacuucuaccaagaagcagcaccagcucaaucugacgucgcacuucuccgcuucgucaaccccgacacaggcagaguccuuuucgaaugcaaacuucacaaauccggcuacgucaccgucgcccacacuggccagcacgaccucgucauaccgcccaacggcuacuuccgguucgacuccugggucaaccaauucuauacacucgcacccaugggcaacggcaccggccgccgccgcgcccucuaa

SEQ ID NO: 36493 - RNA, 1623 nt, Artificial Sequence
  derived and/or modified sequence opt11 from VP1__Norovirus__BAK43269
auggccuccaacgacgcagccccaucaacagacggagccgcaggccuaguuccagaauccaacaacgaaguaauggcucucgagcccguagccggcgccgcacucgccgcccccgucaccggccaaaccaacaucauagacccauggauccgagccaacuucguccaagcaccaaacggagaguucaccgucuccccucgaaacgccccuggcgaaguccuacuaaaccuagaauuaggcccagaacuaaaccccuaucucgcacaccuugcccgccucuacaacggcuacgcaggcggcauggaaguccaaguaaugcuugccggcaacgccuucaccgcaggaaaauuagucuuccccgccguuccuccccacuuccccaucgaaaauuuaucgccccaacaaaucacaauguucccacaugucaucauagacgucagaacccucgaaccuguccuccuaccccuaccugacguccgaaacaacuucuuccacuacaaucaaaaagacgaccccaaaaugcgcauagucgccaugcucuacacaccccuucgcuccaacggcuccggcgacgacguauucaccgucuccugccgaguacuaacccggcccucccccgacuucgacuuuacauaccuuguacccccaaccgucgaauccaaaaccaaacccuucacacuaccuauccucacccuaggagaacucuccaacucccgcuucccagucuccaucgaccaaauguacacaagccccaacgaagucaucucuguccaaugccagaacggacgcugcacacucgacggcgaacuccaaggcacaacccaacuacaaguaucaggcauaugcgcauucaaaggcgaaguaaccgcccaccuccaugacaacgaccaccuuuacaacauaaccaucaccaaccucaacgggucgcccuuugaccccuccgaagacauccccgcaccccugggcgucccagacuuccagggucguguauucggaauaauaucccaacgcgacaaacauaacuccccaggccacaaugaacccgccaaccgcggccacgacgccguaguucccaccuacaccgcccaauacacaccaaaacucggccaaauccaaauaggaaccuggcaaaccgacgaccuaacagucucacaacccgucaaauucacacccgucggccuuaaugacaucgaacacuucaaccaaugggucguaccacgauacgcuggagcacucaaccuaaacaccaaccucgcccccuccguagccccggucuuccccggagaacgucuccucuucuuccgcuccuacaucccccucaaaggcggcuacggcaacccagccauugacugccuccucccacaagaguggguacaacacuucuaccaagaagccgcccccaguauguccgaagucgcacucguccgcuacaucaaccccgauaccggccgcgcccucuucgaagccaaacuccaccgagccggcuucaugaccgucuccucuaacacauccgccccagucguaguacccgccaacggauacuuccgauucgacuccugggucaaucaauucuacucccuggcccccaugggcaccggcaacggccgaagacgaguccaauaa

SEQ ID NO: 36494 - RNA, 1623 nt, Artificial Sequence
  derived and/or modified sequence opt11 from VP1__Norovirus__BAK43272
augaaaauggccuccaacgacgccaacccauccgacggcuccgccgccaaccuaguccccgaagucaauaacgaaguaauggcccuagaacccgucgucggggccgccaucgcagcccccgucgccggucaacaaaacguaauagaccccuggauccgaaacaacuucguccaagccccaggcggcgaguucaccgucucccccaggaaugcccccggcgaaauacucugguccgcaccccucggccccgaccuaaacccauaccucucacaccuagcccgaauguacaauggcuaugccgguggcuucgaaguacaagucauccuagcaggcaacgcauuuacagccggaaaaaucaucuucgcagccgucccgcccaacuuucccaccgaaggacucucccccucccaaguaaccauguucccccacaucaucguagacguacgccaacucgaacccguccuaauaccccuacccgacguaagaaacaacuucuaccacuacaaucaaucuaacgacucaacuaucaagcucauagccaugcucuacacaccccuacgagccaacaacgccggagaagacgucuucaccgucucaugucgaguccuaacacgcccaucaccagacuucgauuucaucuuccucgucccacccaccgucgaaucccgcacaaaacccuuuacgguacccauacuaaccgucgaagaaaugacgaacucccgauuccccaucccccuagaaaaacucuucaccggccccuccucagcuuucgucguccaaccccaaaauggccgcugcaccacagacggcguccuacucggcaccacccaacucagccccgucaacauuugcaccuuccgaggcgacguuacccacaucgccggcucacgaaacuacaccaugaacuuagcaucacucaacuggaacaacuacgauccaacugaagaaauuccagcaccccuaggaacaccagacuuugucgggaaaauccaaggaguacuuacacaaaccaccaaaggcgacggcucaacccgcggacacaaagccacagucuacaccggaucagcccccuucacacccaaacuaggcaguguacaauucagcaccgacacucaaaacgacuucgaaacccaccaaaacaccaaauucacacccgucggagucauccaggacggcggcacaacccaccgaaacgaaccccaacaauggguccuccccuccuacucaggccgcaacguccccaacguacaccuagcacccgccgucgcccccaccuuccccggugaacagcuacucuucuuccgcagcaccaugccaggaugcuccggcuaccccaauauggaucuagacugccuccucccccaagaauggguccaacacuucuaccaggaagccgcccccgcccaaucagacgucgcucuacuucgcuucguaaacccagacacaggaagaguccucuucgaaugcaaacugcacaaaucccgcuacgucacgguagcccacaccggacaacacgaccucguaauuccucccaacggcuacuuccgcuucgacuccugggucaaccaauuuuacacacucgcaccaaugggcaacggcacgggacgacgccgagcacuauaa

SEQ ID NO: 36495 - RNA, 1647 nt, Artificial Sequence
  derived and/or modified sequence opt11 from VP1__Norovirus__BAK43275
augaaaauggccuccaacgacgcagccccauccaacgacggcgcagcuggacucgucccagagaucaacaacgaagccauggcucucgagcccgucgccggcgccgcgauagccgcaccccuuaccggccaacaaaacauaauagaccccuggauuaugaacaauuucguccaagcccccggcggcgaguucaccgucagcccccgcaacuccccaggagaaguccugcucaaccucgaacucggaccugaaauaaauccuuaccuagcccaccuagccagaauguacaacggcuacgccggaggauucgaaguccaagucguccucgcaggaaacgcauucaccgccggcaaaauuauuuucgcagcuauaccacccaauuuccccaucgacaaccuuuccgccgcacaaaucaccauguguccccacgucaucgucgacguccgccaacucgaaccuguaaaccucccaaugccugacguacgcaacaacuucuuccacuauaaucaaggaucugacucccgccuccgccuaguagccaugcuauacacaccccuacgcgccaacaacucaggcgacgacgucuucaccgucuccugccgaguccuuacccgccccucucccgacuucuccuucaacuuccucguuccacccaccguagagucaaaaaccaaacccuucacucuucccauacuaaccaucuccgaaaugucaaauucccgguuuccaguccccauagacucacuccacaccagccccacagaaaacauagucguacaaugccaaaacggccgaguaacacucgacggagaacuaaugggcaccacacaacuccuccccucacaaaucugcgccuuccgcggcguccucacccgcuccaccuccagggccucagaccaagccgacacagccacaccccgucuuuucaacuacuauuggcacauucagcuagccaaccuaaacggcacccccuacgacccugcagaagacauccccggccccuuaggcacucccgacuuccgcgguaaaguauuuggagucgccugccaacgcaaccccgacugcaccacccgagcacacgaagccaaagucgacacaaccgccggccgcuucacaccaaaacucggcucccucgaaauauccacagaauccggcgacuucgaccaaaaccaacccacacgauucacccccgucggcauaggagucgaccacgaagccgacuuccaacaauggucacuacccgacuacuccggacaauucacccacaacaugaaccucgcccccgccguagccccaaauuuccccggagaacaauuacuauucuuccgcucacaauugccuucaucagguggccgcuccaauggcauccuagacugccuagucccacaagaauggguccaacacuucuaucaagaaucagcucccgcccaaacccaaguagcccucguacguuaugucaaccccgacaccggccgcguccuauucgaagccaaacuucacaagcucggcuuuaugaccauagccaaaaacggcgacucccccaucaccguaccucccaacggauacuuccgcuucgaaucaugggucaacccauucuauacccucgccccaaugggcaccggaaacggacgacgccgaauacaauaa

SEQ ID NO: 36496 - RNA, 1623 nt, Artificial Sequence
  derived and/or modified sequence opt11 from VP1__Norovirus__BAK43278
augaaaauggccuccucagacgccaacccaucagacggcucaaccgccaaccuaguccccgaagucaacaacgaagucauggcacucgaaccaguuguaggagccgccaucgcagcucccgucgcuggccagcaaaacgucauagaccccuggauccgcaacaacuucguacaagcccccggaggagaguucacugucucaccccgcaacgccccaggcgaaauccucugguccgcaccccucggcccagaucucaacccauaccuaucccaucucgcccgaauguacaacggauaugccggcggcuucgaaguccaagucauccuagccggcaacgcauucaccgccggcaaaaucaucuucgccgcagugcccccuaacuuuccaaccgaaggacuaucccccucacaagucacuauguucccacacaucaucgucgacguccgucaacucgaacccguccucaucccccuacccgacguccgcaacaacuuuuaccacuacaaccagucaaacgacccaacaauuaaacuaaucgcaaugcucuacaccccacugcgcgcaaacaacgccggcgacgacgucuucaccgucuccugccgcguucucacccgacccucacccgacuucgacuucaucuuccucguaccacccaccguugaaucccguaccaaacccuucagcguccccguucucacaguagaagaaaugacaaauucccgcuucccaaucccacuggaaaaacucuucaccgguccaucuucagcauucgucguccaaccgcaaaacggccgaugcacuacagacggaguucuccuaggcaccacacaacugucacccgucaacaucugcacuuuccgcggcgauguaacccauauaucaggcucacgcaacuacacaaugaaucuugcaucacaaaacuggaacuccuacgacccuaccgaagaaauacccgcaccccucggcacacccgauuucgucggaaaaauacaaggcguccucacacaaacaacacgaaccaacggcucuacaagaggucacaaagccacagucuacaccggcucagccgacuucagccccaaauuaggccgcguccaauucgcaaccgacaccgacaaugacuucgaaaccaaccaaaauaccaaauucacacccgucggcguaauacaagacgguagcacaaccccacgcaacgaaccccaacaauggguacucccaucguacuccggccgcaacacacacaacguccaccucgcacccgccguagccccaaccuucccuggcgaacaacuccucuucuuucgcuccaccaugcccggcugcucuggcuaccccaacauggaccucgacugccuccucccacaagaauggguacaauacuucuaccaagaagcugcccccgcccaauccgacguggcucuuuuacgcuucguuaaccccgacaccggcagaguacuauucgaaugcaaacuccacaaauccuccuacgucaccguagcacauaccggccagcacgaucuagugauacccccaaacggcuacuuucgcuucgacuccugggucaaucaauucuacacacuugcacccaugggaaacggcaccggacgucgacacgcucuauga

SEQ ID NO: 36497 - RNA, 1623 nt, Artificial Sequence
  derived and/or modified sequence opt11 from VP1__Norovirus__BAK43284
auggcaucaaacgacgccgccccauccacugacggggcagcaggacucguccccgaaucaaacaacgaagucauggcacucgaaccuguugccggcgcagcacucgcagccccagucaccggucaaaccaacaucaucgaccccuggauacgggcaaacuucguccaagcaccaaacggcgaguucaccguauccccacgcaacgcccccggggaaguccuccuaucccucgaacuaggccccgaacucaaccccuaucucgcacaccucgcccgcauguacaauggcuacgcaggcggcauggaaguccaaguaaugcuagcaggaaacgccuucaccgccggaaaacucgucuucgccgccgucccgccccacuuccccgucgaaaaccucagcccccaacaaauaaccauguucccccacguuaucauugacguacgcacccuagaaccaguacuacucccacuccccgacguccgcaacaacuucuuccacuacaaucaaaaagacgacccaaaaaugcgaaucguagcaaugcuauacacaccccuacgcuccaacggauccggagacgacgucuucaccguaucaugcagaguccucacccgaccuucaccugacuucgacuuuaccuaccucgucccacccaccgucgaaucgaaaaccaaacccuuuacccuccccauucuaacucucggcgaacucagcaacucccgcuuuaccgucucaaucgaucaaauguacaccucccuaaacgaagucaucuccguucaaugccaaaacggccgcugcacccuugacggcgaacuccgaggcacaacccaacuacaagucuccggcauuugugcauucaaaggagaagucacugcacacguccacgacaacgaccaucucuacaacguaaccaucacaaaccugaacggauccccguucgacccaucugaagauguacccgcuccccuagguguccccgauuuccaaggccgcgucuucgggaucaucucacaaagagacaaacacaacucaccaggccacaacgaacccgccaaccgcggccacgacgcagucguuccaacauacacagcccaauauacccccaaacucggucaaauucaaaucggcaccuggcagacagacgaccucacagucaaccaacccguaaaauucacuccaguaggccucaacgacaccgaacacuucaaccaauggguugucccgagauacgcaggcgcgcucaacuuaaacaccaaccucgccccuagcgucgcuccggucuuccccggagaacgccuacuauucuuccgauccuacgucccccucaaaggcggcuacggaaauccggccaucgacugccuucucccccaagaguggguacaacacuucuaccaggaagcagccccguccauguccgaggucgcacucguccgauacaucaacccagacaccggccgcgcacucuucgaagccaaacuccaucgagcuggauucaugaccguauccucaaacaccuccgcccccguggucguccccgccaacggcuacuuccguuucgauuccugggucaaccaauucuacucacuggcccccaugggcacagguaacggccgacgacguguacaauaa

SEQ ID NO: 36498 - RNA, 1644 nt, Artificial Sequence
  derived and/or modified sequence opt11 from VP1__Norovirus__BAL14785
augaaaauggcuagcaacgacgccgcccccuccaacgacggcgccgccaaucucguccccgaagcaaacaacgaagucauggcucucgaacccguugucggcgccuccaucgcagcucccgucgucggccaacaaaacauuauagaucccuggauccgcgaaaacuucguccaggcaccccaaggagaauuuaccgucucaccacgcaacucucccggcgaaaugcuccuaaaucucgaacucggacccgaacucaacccauaccucucgcaccucucccgcauguacaacgguuacgccggcggaaugcaagugcaagucguacuugccggcaacgccuucaccgcuggcaaaauaaucuucgcagccgucccaccacacuucccagucgaaaacaucuccgccgcacagauaacaaugugcccccacguaaucgucgacguccgccaacuagaacccgugcuccuaccccuaccugacauccgcaaccgcuucuuccacuacaaccaagaaaacaccccucgcaugcgacucgucgcaaugcucuacacgccccuacgcgccaacuccggcgaagacgucuucacagucuccugccgcguccucacucgucccgcccccgacuucgaauuuaccuuccucgucccacccaccgucgaauccaaaaccaaacccuucacccuccccauccucacucucggcgaacuuucuaacucucgcuuccccgcacccauagacaugcuauacacagaccccaacgaaggcauagucguacagccccaaaacggccgcugcacacuugacggcacccuacaaggaaccacacaacucguccccacccaaaucugcgccuuccgcggcacacuaauuggccaaaccagccgaucuuccgacucaacugacuccgccccacgccgacgcgaccauccacuacacguccagcucaaaaaccucgacggcacccaauacgacccuacagacgaaguacccgccguccucggcgccauagacuucaaaggcacugucuucggcguagccucacaacgcgacgucuccggccaacaagucggagcaacacgagcccacgaaguccacaucuccaccacugacccccgcuacacaccaaaacucgggagcauccugaugcguuccgaaucagacgacuucguaaccggacaaccaguaagauucacgcccauaggcaugggagauaacgacuggcaccaaugggaacuccccgacuacuccggccaccuaacccucaacaugaaccuagcccccgcaguagcacccgccuuccccggugaacgcauccuauucuucagaucaaugguaccauccgcaggaggguauggcuccggacaaauugauugucuaaucccccaagaauggguacaacacuucuaucaagaagccgccccuucacaauccgcugucgcccuaauccgcuacguaaacccagacacuggacgaaauaucuucgaagcaaaauuacaccgcgaaggauucaucaccgucgcuaacucaggaaacaaccccaucguaguaccacccaacgguuacuuccgauucgaagccugggucaaccaauucuacacccucacccccaugggaaccggccaaggccgccgacgcaaccaauaa

SEQ ID NO: 36499 - RNA, 1749 nt, Artificial Sequence
  derived and/or modified sequence opt11 from VP1__Norovirus__BAR88157
augaaaauggcauccucagacgcagccucuccgucauccgacggagccgccaaccuaguccccgaaaucaauaacgaagucauggcccuagaaccaguagccggagcacaacuagccgcccccgucgccgaccaauucaacgccauagaccccuggauccggcaaaacuucguacaagcccccgaaggggaguucacagucucaccccgcaacgccccuggugaaauccuacucaaccucgaacuaggcccccaucucaaccccuuccuccaacaccuagcccaaauguacaacgccuacgccggcggcauggaaguccaagucguacucgcaggaaacgccuucaccgcaggcaaaaucaucuucgcagccauacccccacacuuucccccagaaagauuauccgccgcucaagccacccaauuuccccacgucaucauugacguccgccagcuagaaccuauaguccucccccucccugacguacgacacaaccuuuuccacuucaaccaacaaaacgacgaacguaugcgccucgucgccuuccuauacaccccacucagagcuaacuccggauccggagacgacgucuucaccguauccugucgaguccuuacacgucccucaccagacuucgaguucauguuccuagucccacccaccguagaaagaaaaaccguagcuuucucccuaccacaacucacagucggcgaaaugucgaacuccagauggccggcccgaaucaccaccaugauagccgacccccaccucccgcaaguccuccgcauacaaaacggcagaugcacucuggacggcacacucaugggcaccacccaacuaaacccuaacgacaucugccgcguaagaggcuacuucuccaacucccgcccucaagucaugugcgaaggcgaagacgacgcucucgaccaagccucacucggagcagaacccauccgcgaccaagcccccggccucagaacccaagcacgcucuaccgaacgaugguucgcaguuaccgaacuaaacggccaagccuaugacccauuuggcgaccaacccgccccacucggcgucccagacuucgaagcgcggaucgucggcgcccucguacgucucccaggcacuaacccaacauccaacucccgcuucgaagacgcuuggauagacaccaacaaccaaaccaccuacgcccccgcagcaggcauggucgcaauaacaaccuccgacgacuccagcuccaacuacgccaacgaccaaguuugcgaguuccuccccuuaggagucgacauaaccaacagcacccccuacaacgaguucgaucuaccaucauacggcggaagcgccucauccggaaaccgcaaccuugcccccaccguagccccuaccuuccccggagaaaucguacuccuauucggcucuaacaugcccguccagaaccguagcgcaggcaccagcaauaaggaaauccguugccuacuaccuaacgaauacauacaacaccucuacgacacucaagcccccucacugucagacguagcccucgucagauacaucaacccagacaccggacgcguccucuucgaagccaaacuccaccgcgacggcuucaugaccguuaacgccucagccacaaccguccuaccaguugacggccacuucagauucgauucguggguuaaccaauucuacgcacuguccccaguaggcaacgccuccggccgccgaggccgcaaccgaagagucgacuga

SEQ ID NO: 36500 - RNA, 1623 nt, Artificial Sequence
  derived and/or modified sequence opt11 from VP1__Norovirus__BAS29993
augaaaauggcauccaacgacgcaaaccccucagacggauccgcagcaaaucucguccccgaagucaacaacgaagucauggcccucgaaccagucgucggcgccgccaucgccgcgccagucgccggccaacaaaacgucauugacccauggauuagaaacaauuuuguccaagcaccaggaggagaguucacagucucuccccgcaacgcuccaggagaaauacucugguccgcaccccuaggucccgaccucaaccccuaucuaucacaccucgccagaauguacaacggcuacgccggcggauucgaaguacaagucauacucgccggcaacgccuucaccgccggcaaaauuaucuucgccgccguaccaccaaauuucccaaccgaaggccuaagccccucccaaguaaccauguucccccacaucaucguagaugucagacaacucgaacccguucuaaucccucuccccgacguccgaaacaacuucuaccacuacaaccaaagcaacgacucaaccauuaaacuaaucgccaugcuguacacaccccugcgcgccaacaacgcaggagaagacgucuucaccguuucuugucgcguccuaacccgacccucccccgacuuugacuucaucuuucucgucccgccaaccgucgaaagccgcacaaaacccuucacagugcccauacucaccgucgaagaaaugacaaacucgcgcuuccccauaccccuugaaaaacuauucacaggacccucaucugccuuugucgugcaaccccaaaacggccgaugcaccaccgacggcguccuacucggaaccacccaacucucccccguaaacaucugcaccuuccgcggagacgucacacacaucgccgguagccgcaacuacaccaugaaccucgccucgcucaacuggaacaacuaugacccaaccgaagaaaucccagccccacucggcacccccgacuucgucggcaaaauccaagggguccucacccaaacaaccaaaggcgacggauccacccguggacauaaagccacagucuauacaggcucagcccccuucacaccaaaacugggcuccguccaauucuccaccgacaccgaaaacgauuucgaaacccaccaaaacaccaaauucaccccagucggcgucauacaagacggcggcaccacccaccgaaacgaaccacaacaauggguccuucccucauacucaggacgaaacguacccaacguccaccuagcccccgcggucgccccaaccuucccuggagaacaauuacucuucuucagaucaaccaugcccggcugcuccggauaccccaacauggaccuagacugucuccuaccccaagaauggguccaacacuuuuaccaagaagcagccccagcccaauccgauguagcccuacuccgcuuuguaaaccccgacaccggccgcguccucuucgaaugcaaacugcacaaauccggcuacguaaccgucgcccacacaggacaacacgaccuagucaucccacccaacggcuacuuucgcuucgauuccugggucaaucaauucuacacacuugcccccaugggcaacggcaccggccgcagacgcgcacucuag

SEQ ID NO: 36501 - RNA, 1623 nt, Artificial Sequence
  derived and/or modified sequence opt11 from VP1__Norovirus__BAS29996
augaaaauggccucaaacgacgccacccccuccgauggcucagccgcaaaccucguccccgaaguaaacaaugaagucauggcacucgaacccgucguaggagcagccaucgccgcccccgucgcuggucagcaaaacgucaucgaccccuggauccgaaacaacuucguccaagcgcccgguggagaauuuaccguaucuccacgaaacgcccccggcgaaauacucuggucagccccucucggccccgaccucaaccccuaccuaagccaucucgcccgcauguacaacggguacgccggcggauucgaaguccaagucauccuggccggcaacgcauucaccgcuggcaaaaucaucuucgccgcaguacccccaaacuucccaacagaaggccucucccccucucaagucacaauguucccccacaucauagucgacguucgccaacucgaaccaguccuaaucccacucccagacguccgcaacaacuucuaccacuacaaccaauccaaugacuccaccaucaaacucaucgccaugcucuacaccccacuccgcgccaacaacgccggcgaagacguauucaccgucuccugccgaguccucacacgccccuccccugacuucgacuucaucuuccuagucccacccaccgucgaaucucgcaccaaacccuucaccguccccauacugaccguugaagaaaugacuaacucacgcuuccccaucccccucgaaaaacucuucaccggaccaucguccgccuucgucguccaaccccagaacggccguugcaccacugacggcguacugcuaggaaccacacaacuaagccccgucaacaucugcacuuuccgcggcgacguuacccacaucgcaggcagccgaaacuacacuaugaaccuagccucccucaacuggaacaacuacgaccccaccgaagaaauccccgcaccccuaggaacccccgauuucgucggaaaaauccaaggaguccuaacccaaacaaccaaaggcgacggaucaacgcgcggacauaaagccacagucuacaccggcuccgcuccauucacccccaagcucggcucaguucaauucucaaccgacaccgaaaacgacuucgaaacccaucaaaacaccaaauucacacccgucggcgucauacaagacggcggcacaacccaucgcaacgaaccacaacaauggguccuuccauccuacuccggccgcaacguccccaacguccaucuagcacccgccguugcccccaccuuucccggcgaacaacuacucuucuuccguucaacaaugcccggcuguucaggcuaccccaacauggaccucgacugccugcuaccccaagaauggguacaacauuuuuaccaagaagccgccccagcccaaucagaugucgcccuccuccgauucgucaaccccgacaccggccgaguacuauucgaaugcaaacuacacaaaagcggcuacgucaccgucgcccacaccggccaacacgaucucgucaucccacccaacggcuacuuccgcuucgacuccugggucaaccaauucuacacccucgcccccaugggcaacggcaccggucgucgccgagcacuuuaa

SEQ ID NO: 36502 - RNA, 1623 nt, Artificial Sequence
  derived and/or modified sequence opt11 from VP1__Norovirus__BAS29999
augaaaauggcuagcaacgaugccaaccccagcgacggcuccgccgccaaccuaguccccgaagucaacaacgaagucauggcacucgaacccgucgucggcgccgccauagccgcccccgucgccggccaacaaaacguaaucgacccauggauaagaaacaacuucguccaagcaccagggggcgaguucaccguuucaccccgaaacgcccccggcgaaauccucugguccgcaccacuuggcccagaccuaaacccuuaccucucccaccuagccagaauguacaacggcuacgcaggcggcuucgaaguacaagucauccucgcuggcaacgccuucacagccggcaaaaucauauuugcugccguacccccuaacuucccuacggaaggacuaucacccucccaagucaccauguucccucacaucauagucgaugucagacaacucgaaccaguccucauaccacuaccagacguacgcaauaacuucuaccauuacaaccaaucaaacgacagcaccaucaaacucaucgcaaugcucuacacaccccucagagcuaacaacgcaggcgaagacgucuucaccguauccugucgcguccucacccgccccuccccagauuucgacuucaucuuccuagucccaccgacggucgaauccagaacaaaacccuucaccguccccauccuaacagucgaagaaaugacaaacucucgauuccccauaccccucgaaaaacucuucacaggucccucaagcgcuuucgucguccaaccccaaaacgggcgcugcaccaccgacggcguccuccucggaaccacccaacucucacccguaaacauauguaccuuucgcggcgacgucacucauaucgcaggcucccgcgacuacacaaugaaccuggccagccucaacuggaacaauuacgaccccaccgaagaaauacccgccccacucggcacaccugacuucgucgguaaaauccaaggcguccuaacacaaaccaccaaaggagacggauccacacgcggccacaaagcaacuguauacaccggauccgccccauucacccccaaacucggcucaguacaauucuccacagacaccgaaaacgacuucgagacacaccaaaacacaaaauucacacccgucggaguaauccaggacggcggcaccacccaccguaacgaaccccaacaauggguuuuacccucauacuccggccgcaacguccccaacguacaccuagcucccgccguagccccuaccuucccaggcgaacaacuccucuucuuccgcuccacgaugcccggauguucaggcuaccccaacauggaccucgacugcuuacuaccccaagaauggguccaacacuucuaccaagaagccgccccagcacaaucagaaguagcccuacuccgcuucgucaaccccgacaccggccgcguccuauucgaaugcaaacuccacaaauccggauacgucaccguagcccacacaggccagcacgaccucguaaucccacccaauggauacuuccgcuucgauucaugggucaaccaauucuacacccucgcacccaugggaaacggaacaggcagacgccgcgcccucuag

SEQ ID NO: 36503 - RNA, 1623 nt, Artificial Sequence
  derived and/or modified sequence opt11 from VP1__Norovirus__BAS30005
augaaaauggccagcaacgacgcaaaucccuccgacgguucagccgccaaccucguccccgaaguaucuaacgaagucauggcacucgaacccgucgucggcgcugcuaucgccgcccccgucgcgggucaacaaaacguaauugacccauggauccguaacaauuucguccaagcccccgguggagaguucaccgucuccccucgaaacgcuccuggagaaauucuauggucagcaccccucggccccgaccucaaucccuaccucucccaccucgcccgcauguacaacggcuacgcugguggcuucgaaguucaagucauccucgcagguaacgccuucacugcaggcaagaucaucuucgccgccgucccacccaauuuccccacagaagggcuaucacccagccaaguaacaauguucccccacaucaucgucgacguccgccaacuagaacccguacuaaucccccuccccgacgucagaaacaacuuuuaccacuauaaucaaucaaacgacuccaccaucaaacugaucgccaugcuauacaccccucuacgcgcuaacaaugccggagaagacgucuucacaguauccugcagaguucuaacccgucccuccccagacuuugacuucaucuuccucgucccacccaccgucgaaagccgaaccaaacccuucacuguuccaauccucaccguagaagaaaugacaaacucacgcuuccccaucccccucgaaaaacucuucaccggaccaucuggcgccuucgucguccaaccccaaaacggccgcugcaccaccgacggaguacuccucggcaccacccaacucucaccagucaacaucugcacauuucgaggagacgucacacacauagccggcucccgcaacuacaccaugaaccuagccucacucaacuggaacaacuaugaccccacugaagagaucccagcaccccuaggcaccccagacuucgucggaaaaauacaaggcguccucacccaaacaaccaaaggagacggauccacacgcggccacaaagccaccguguacacaggaucugccccauucaccccuaaacucggcuccguccaauucucaacagacacagaaaacgacuucgaaacacaccaaaacaccaaauucacgcccguuggcguuauacaagacggcuccacgacacaccgcaacgaaccacaacaauggguccuccccuccuacucuggacgcgacguccacaacguccaccuugccccagcagucgcccccaccuuccccggagaacaacuccuauucuuccgcuccacgaugccugguugcucaggcuaccccaacauggaccucgacugccuccucccacaagaguggguacaacacuucuaucaagaagccgcacccgcccaaucugacgucgcauugcuacgcuucgucaaccccgauaccggccgcguccucuucgaaugcaaacuccacaaauccggcuacgucaccgucgcccacaccggccaacacgaccuaguaaucccacccaacggcuacuuccgauuugacuccuggguaaaccaauucuacacacucgcacccaugggcaauggcaccggacgccgccgagcccucuag

SEQ ID NO: 36504 - RNA, 1623 nt, Artificial Sequence
  derived and/or modified sequence opt11 from VP1__Norovirus__BAS30008
augaaaauggccagcaacgacgcaaaccccuccgacggcucagccgcuaaccuaguaccagaagucaacaacgaaguuauggcacucgaacccguagucggugccgcuaucgccgccccagucgccggccaaacuaacgucaucgacccuuggauccgcaacaacuucguccaagccccgggaggcgaguucaccgucucuccccgcaacgccccaggcgaaauccuaugguccgccccacucgguccagaccucaaccccuaccuaucccaccucgcccgcauguacaacggauacgccggcggauucgaaguccaagugauacuagcaggcaaugcauucaccgcaggcaaaaucaucuucgcagcagucccacccaacuuccccaccgaaggacucucucccucccaaguaaccauguucccccacauaauagucgacgugcgccaacucgaacccguucucauaccccuacccgacguccguaacaacuucuaucacuacaaccaauccaacgacucaacaaucaaacuaauagccaugcucuacacaccccuccgcgcaaauaacgccggugaagacguauucaccgucucuugccgcguacucacccgacccucccccgacuucgacuucaucuuuuuagucccacccacaguggagucccgcacuaaaccuuucacaguccccauucuuaccguagaagaaaugaccaacucccgcuuuccaauuccccuagaaaaacuuuucaccggccccuccggcgccuucgucguccaaccccaaaauggucgaugcaccacugacgguguccuccucggcacaacacaacuuucccccgucaacaucugcaccuuccgaggcgacgucacccacaucgccggcucccgaaacuacaccaugaaccuagcuucccucaacuggaacaacuacgaccccacagaggaaaucccugcuccccucgguacuccagacuucguagguaaaauccaaggaguacuaacccagacuaccaaaggcgauggcucaaccagagggcacaaagccacagucuacacuggauccgcccccuuuaccccaaaacucgguuccguacaauucucaacagacacagaaaacgauuucgaagcccaccaaaacacuaaauuuacccccgucggcgucauccaagacggcuccaccacacaccgcaacgaaccgcaacaauggguccuucccuccuacagcggcggaaacguacaaaacguccaccucgcccccgcugucgcccccaccuuccccggcgaacaacuacucuucuuccgcuccaccaugccaggcugcucaggcuaccccaacauggaccucgacugcuugcucccccaagaauggguacaacacuucuaccaagaagcagcccccgcccaauccgacgucgcccuccuccgcuucgucaaccccgacaccggccgaguccucuucgaaugcaaacuccacaaaucaggauacguaaccguagcccacacuggacaacaugaccucgugauacccccaaacggcuacuucagauucgacuccugggucaaccaauucuacacacuagccccaaugggcaacggcaccggcagaagacgagcccucuga

SEQ ID NO: 36505 - RNA, 1623 nt, Artificial Sequence
  derived and/or modified sequence opt11 from VP1__Norovirus__BAS30011
augaaaauggcauccaaugaugccaacccuuccgacggcuccgccgcaaaccucguccccgaagucaacaacgaggucauggcccucgaaccagucguaggcgcagcaaucgccgccccagucgcaggccaaacaaacgucauagaccccuggauacgcaacaacuucguccaagccccuggcggcgaguucacagucucuccccgcaacgcacccggggaaauucuaugguccgccccacucggacccgaccucaaccccuaccuaucacaccucgcccgcauguacaacggcuacgcaggcgguuucgagguacaagucauccucgccggaaacgcauucaccgccgggaaaaucaucuuugccgcagucccaccaaacuucccaacagaaggccucucaccaucccaaguuaccauguucccccacaucauugucgacguacgccaacucgaacccguccucauaccccuccccgacguacgcaauaacuucuaccacuacaaucaaagcaacgacuccaccaucaaacuaauagcaaugcucuacacuccccuccgcgccaacaacgcuggcgaagacgucuucacagucuccugucgcgugcucacccgcccaucccccgacuucgacuucaucuuccucgucccacccacuguagaaucccguaccaaacccuucaccguccccauccuaacagucgaagaaaugacaaauucccgauuccccauuccccucgaaaaacucuucaccggccccucaggcgccuucguuguccaaccccaaaacggacgaugcacaaccgacggaguccuccuuggcacaacccagcucucccccgucaacaucugcaccuuccgcggagacgucacccacaucgccggcucacgcaacuauaccaugaaccuugcgucacuaaacuggaacaacuacgaccccaccgaagaaaucccagccccacucggaacccccgacuucgucggaaaaauccaagguguacuaacccagacuacaaaaggcgacgguuccacccggggccacaaagcuacuguauacacaggcucagcccccuucacacccaaacuaggcucaguacaauucuccaccgacaccgaaaacgacuucgaagcccaccaaaacacaaaauucacccccguuggcgucauacaagacgggucaacgacucaccgaaacgaaccucaacaauggguccucccauccuacuccggccgcaacguucaaaauguccaccuagcgccagccguagccccaacauuuccaggagaacaacuccucuucuuccgcucaacaaugcccggcugcuccgguuaccccaacauggaccuagacugccuccuuccccaagaauggguccaacacuucuaccaagaagccgccccagcgcaauccgauguggcacuacuacgauucguaaacccagacaccggucgcguccuuuucgaaugcaaacuccacaaaucuggauacguuaccguagcacacacaggccaacacgaucucgucauacccccaaacggauacuuccgcuucgacuccugggucaaccaauuuuacacccucgcccccaugggaaacggcaccggccgccgucgcgcccuauaa

SEQ ID NO: 36506 - RNA, 1623 nt, Artificial Sequence
  derived and/or modified sequence opt11 from VP1__Norovirus__BAS30014
augaagauggcauccaacgacgcaaaccccuccgauggaucagcagcuaaccuggucccagaaguuaacaacgaagucauggcucuagagcccgucgucggagcggcaaucgcggcccccguugcuggacaacaaaacguaaucgaccccuggauacgaaacaacuucguccaagccccgggcggcgaauuuaccgucucaccccggaacgcccccggagaaauccuaugguccgcaccccuaggcccagaccuaaaccccuaccuaucccaccuagcccgcauguacaacggauaugccggaggauucgaaguccaaguaauccuagcuggcaacgcauucacagcuggcaaaauaauauucgccgccgucccacccaacuuuccaacagaaggacucucccccagccaaguaaccauguuuccccacaucaucguugacguacgacaacucgaaccagugcuaaucccccuccccgacguccgaaauaauuucuaccacuacaaucaauccaacgacuccacaaucaagcucaucgcgaugcucuacacgccccucagagcaaauaacgccggcgaagacgucuucaccgucuccugccgcguacuaacccgacccuccccugacuucgacuucaucuuccucguacccccaaccgucgaaucccgcacaaaaccauucaccguccccauacuuacagucgaagaaaugaccaacucacgcuucccuaucccucuagaaaaacuauucacaggccccuccuccgcauucgucguccaaccccaaaacggccgcugcaccacagacggcguccuccucggcaccacccaacucucacccgucaacaucugcaccuuucgaggagacgucacacacaucgccggcucccgcaacuacacaaugaaccuagccucccucaauuggaacaacuaugaccccacagaagaaauaccagcaccacuuggcacucccgacuucguggguaaaauucaaggaguccucacucaaaccacuaaaggagacgguuccacccgaggccacaaggccaccgucuauaccggcuccgcacccuucacacccaaacucggcuccguccaauucuccaccgacaccgaaaacgacuucgaaacccaccaaaacaccaaauucacacccgucggaguaauccaagacggcggcaccacacaccggaacgaaccgcaacaauggguccuccccagcuacagcggaagaaacguccccaacguccaccucgcacccgccguugcaccaaucuuccccggcgaacaacuccucuucuuccgcuccaccaugcccggaugcuccggcuaucccaauauggaccuugacugccuccuaccccaagaauggguccaacacuucuaccaggaagccgcccccgcccaaucagacgucgcccuacuucgcuucgucaaccccgacacuggccgagucuuauucgaaugcaaacugcacaaauccggcuacguuacugucgcccacacgggccaacacgaccuagucaucccucccaacggcuacuuccguuuugauuccugggucaaccaauuuuacacccuagccccaaugggaaacggcaccggccgccgccgagccuuauaa

SEQ ID NO: 36507 - RNA, 1623 nt, Artificial Sequence
  derived and/or modified sequence opt11 from VP1__Norovirus__BAS30017
augaaaauggccuccaacgacgccaaccccuccgacggcucagcugccaaccuaguacccgaagucaacaacgaaguuauggcccuugaaccagucguaggcgccgccaucgcagcuccuguggcaggccaacaaaacgucaucgaccccuggauccgaaacaacuucguccaagcaccaggcggagaauuuaccguuagcccccgcaacgcccccggcgaaauccuauggucggcaccuuuaggacccgaccucaauccuuaccucagccaccucgcccgaauguacaacggcuacgcaggaggcuucgaaguucaagucauccucgcaggaaacgcauucaccgccggaaaaaucaucuucgcugccgucccuccaaacuucccaaccgaaggccuaucacccucccaagucaccauguucccccacaucauaguugacguucgacaacucgaacccguccuaaucccacucccggacguucgaaacaacuucuaccacuacaaccagucaaacgacucaaccauuaaacuaaucgccaugcucuacacgccccuccgagccaacaacgccggagaagacguauucaccgucagcugccgcguccuaacccgcccaucuccagacuucgacuuuaucuuccucguaccacccaccgucgaaucccgcacuaaacccuucacaguccccauccugaccgucgaagaaaugaccaauucccgauuccccauuccgcucgaaaaacucuucaccggcccgucuagcacauucgucguccaaccucaaaacggacgcugcacaaccgacggcguccuccuaggcaccacccaacuaucccccgucaacauuugcaccuuucgcggagacgucacccacaucgcaggaucccgaaacuacacaaugaaccucgcaucucuaaacuggaacaacuacgacccaaccgaagaaauaccagcaccccuaggaacaccagacuucgucggaaagauccaaggcguauuaacccaaaccaccaaaggggacggcucaacgcgcggccacaaagccaccgucuacacaggaagcgccccauucaccccuaaacucgguucgguacaauucggaaccgacacagaaaaugacuucgaaacccaccaaaauaccaaauucacccccgucggagucauccaagacggaggcaccacccaccgcaacgaaccacaacaauggguccuccccucauauuccggacguaacguaccaaacguccaccucgcccccgccgucgcccccacauuccccggcgaacaacuucucuucuuccgcucaaccaugcccggauguucaggcuaucccaacauggaccuugacugccuccucccacaagaauggguacaacacuucuaccaagaagccgccccagcccaaucagaugucgcgcuacuccguuucguaaaccccgacaccggccgaguacucuucgaaugcaaacuacauaaaucaggauacgucaccgucgcccacaccggacaacacgaccucgucauacccccaaacggauacuuccguuucgacucaugggucaaccaauucuacacacucgcccccaugggcaacggcaccggccgacggagagcccuuuag

SEQ ID NO: 36508 - RNA, 1623 nt, Artificial Sequence
  derived and/or modified sequence opt11 from VP1__Norovirus__BAS30023
augaaaauggcauccaacgacgcgaaccccucugacggcuccgccgccaaccucguacccgaagucaacaacgaagucauggcccucgaaccagucguaggcgccgcaaucgcagccccuguagcagggcaacaaaacguaaucgaccccuggauucgcaauaacuucguccaagcucccggcggagaauuuaccgucucuccccgcaacgcccccggcgaaauacuaugguccgccccauuagggccagaccucaaccccuaccucucccaccuagcccgaauguacaacggcuacgccggcggcuucgaaguacaagucauccucgccggcaacgccuucaccgccgggaaaaucaucuucgccgcagucccacccaacuuccccauagaaggccucucccccucccaagucaccauguucccccauauaaucgucgacguaagacagcucgaaccaguacucauaccccucccugacguucgaaacaacuucuaccacuacaaccaaucgaacgacucaacaauaaaacuaaucgcaaugcucuacacaccccuacgcgccaauaacgcuggagaagacgucuucaccgucucaugccgcguucucacacgcccuucacccgacuucgacuucauauuccuugugccacccaccguagaaucucgcaccaaacccuuuaccgucccgauccucaccgucgaagaaaugaccaacucacgcuucccuauaccccucgaaaaacuauucaccggcccaucauccgccuucguaguccaaccccaaaacggacgcugcaccaccgacggaguacuccucggaacuacccaacuaucacccguaaacaucugcacguuccgcggcgacgucacacauaucgcaggcucccgaaacuacaccaugaaccuagccucccuaaacuggaacaacuacgaccccaccgaagaaauccccgccccacucgggacacccgacuucgucggaaaaauccaaggcguccucacccaaaccaccaaaggagacggcucgacucgaggccacaaagcaaccguuuauacaggcuccgcaccauucaccccuaaacuaggcuccguacaauucucuaccgacacagaaaacgacuucgaaacacaccagaauaccaaauucacacccgugggagucauccaagacggcggcaccacccaucguaacgaaccccaacaauggguucugccaagcuacuccggccgcaacguccccaauguccaccucgcccccgcaguagcacccaccuuucccggcgaacaacucuuauucuuccgcuccaccaugcccggcugcuccggcuaccccaauauggacuuagacugccuacucccccaagaauggguccaacauuucuaccaagaagcagcgcccgcacaaucagacgucgcacuccuccguuuuguuaacccagacaccggccguguccucuucgaaugcaaacuccacaaaucaggcuacgucaccgucgcccacacaggccaacacgaccucgucaucccacccaacggcuacuuccgcuucgacucaugggucaaucaauucuacacccucgcccccaugggcaacggcacgggacgucgacgagcccucuaa

SEQ ID NO: 36509 - RNA, 1623 nt, Artificial Sequence
  derived and/or modified sequence opt11 from VP1__Norovirus__BAS30026
augaaaauggcaucgaacgacgccaacccaucagacggaucagcagccaaccuaguacccgaaguaaacaaugaagucauggcgcucgaacccgucgucggagccgccaucgccgcacccgucgccggccaacagaacgucaucgaccccuggauacgcaacaauuucguccaagcccccggaggcgaauuuaccguguccccgcgcaaugcccccggagaaauccucuggagcgcaccccucggacccgaccucaaucccuaccucucccaccuagcccgcauguacaacggcuacgcaggaggcuucgaaguccaagucauccucgccggaaacgccuucaccgcuggaaaaaucauauucgccgcaguaccacccaacuuccccacagaaggccucucacccucacaagucaccauguuuccccacaucauagucgacgucagacaacuagaacccguucuaauaccccuacccgacguccgcaacaacuucuaccacuauaaccaauccaacgacagcaccauaaaacugaucgcaaugcucuacacaccccuacgcgccaacaacgccggcgacgacgucuucaccguauccugccguguccucacucgcccaucaccagacuucgacuucaucuuucuuguacccccaacagucgaauccagaaccaagccauuuaccguaccaauacucaccgucgaggaaaugaccaacagccgcuuccccauaccacucgaaaaacucuuuacaggcccauccucagcauucguaguccaaccccaaaacggacgaugcacgacagauggcguacuacuaggcaccacacaauuaagccccguuaacauaugcacauuccgcggcgacgucacccacaucgccggcucccgaaacuacaccaugaaccuagccucccuaaacuggaacaauuacgaccccaccgaagaaauccccgcaccccucggcaccccagacuuugucggcaagauccaaggcguccuaacccagaccacaaaaggcgauggcucgacccgcggacacaaagccacggucuacacaggcagcgccgauuucacccccaaacuaggcuccguacaauucggaacagacaccgaaaacgacuucgaaacccaucaaaacacaaaauucacccccgucggagucauacaagauggaucgacaacccaccgaaacgaaccccagcaguggguucuaccguccuacuccggccgcaacguccacaacguccaccuggccccagccguagccccaaacuuccccggcgaacaacuccucuucuuccgcucuaccaugccagguugcagcggauacccaaacauggaccuugacugccuccucccacaagaauggguacaacacuuuuaccaagaagcagcccccgcccagucagacgucgcccuacuacgcuucgucaacccagacaccggccggguacucuucgaaugcaaacuacacaaauccggauacgucacugucgcacacaccggccaacacgaccuugucaucccacccaacggauacuuccgauucgacucauggguaaaucaauucuacacacuagcccccaugggcaacggcaccggccgccgccgcgcacucuaa

SEQ ID NO: 36510 - RNA, 1623 nt, Artificial Sequence
  derived and/or modified sequence opt11 from VP1__Norovirus__BAS30029
augaaaauggcauccaacgacgccuccccaucagacggauccgccgccaaccucguccccgaagucaacaacgaagucauggcccuggaaccuguagucggagccgccaucgcagcccccguagccggccaacaaaacgucauagacccauggauccgcaacaacuucguccaagccccaggcggcgaguucacagucuccccacgcaacgccccaggcgaaauacucugguccgcaccccuaggccccgaccuuaaccccuaccuaagccaccucgcacgcauguacaacggcuaugccgguggcuuugaaguccaaguaauacuugcaggcaacgcuuucaccgccggcaaaauaauauucgccgcuguaccacccaacuuccccacugaaggacucuccccuucccaggucacaauguucccccacauaauugucgacguacgccaacucgaacccguucucauuccccucccagacguccgcaacaacuucuaccacuacaaccaauccaaugacuccaccauaaaacucaucgcuaugcuauacacuccacucagagcaaauaacgccggcgaagacguuuuuaccgucuccugcagaguccucacacgccccucccccgacuucgacuucaucuuucucgucccacccaccguagaaucacgaacaaaacccuucacuguccccauacuuacagucgaagaaaugacaaacucaagauucccuauaccccuagaaaaacuguucaccggccccuccuccgccuucguaguacaaccccaaaacggacgcugcaccacagacggcguccuacucggaaccacccaacucagccccgucaacaucugcacauuccgaggcgacguaacccauaucgccggcucacgcaacuacacaaugaaccuggccucccucaacuggaauaacuacgacccuacggaagaaauacccgccccacuaggcacaccagacuucgucggcaaaauccaaggaguccuaacccagaccacuaaaggagacgguagcacucgcggucacaaagccaccgucuauacaggcagcgcccccuucacccccaaacuaggauccguccaauucuccaccgauacagaaaacgacuucgaaacacaccaaaacacaaaauucaccccagucggcguaauucaagacgguggcaccacacaccgaaacgaaccccaacaaugggugcuucccucauacucaggccgcaacguccauaacguccaccuagcacccgcaguagccccaaccuuccccggagaacaacuacuauucuuccgcucaacaaugccaggcugcucuggcuaccccaacauggaccucgacugccuccuaccccaagaauggguacaacacuucuaccaagaggcagcacccgcccaauccgacguagcacuccuucgauucguaaaccccgacaccggccgaguccucuucgaaugcaaacuucacaaauccgguuacgucacaguagcucacacaggacaacacgaccuagucauacccccaaacggauacuuccgcuucgauucaugggucaaccaauucuacacucuagcccccaugggcaacggcaccggacgccgacgcgccuuauaa

SEQ ID NO: 36511 - RNA, 1623 nt, Artificial Sequence
  derived and/or modified sequence opt11 from VP1__Norovirus__BAS30035
augaaaauggccagcaacgacgccaaccccagcgacggaucugcagccaaccucgucccagaagucaacaacgaagucauggcucuagaaccggucguaggagcagccauagcggcaccagucgccggacaacaaaacgucauugaccccuggauacgcaacaacuucguccaagccccaggaggcgaguucaccgucucaccccgcaacgcccccggagaaauccucugguccgcaccccuugguccagaccucaaccccuauuugucccaccuugcccgaauguacaacggcuacgccggcggcuucgaaguacaagucauacuagccggcaaugccuucacagcuggaaaaauuaucuucgccgccgucccucccaacuuccccaccgaaggccucucccccagccaagucaccauguucccucacaucaucgucgacguccgccaacucgaacccguacuaaucccccuuccagauguccgaaacaacuucuaccacuacaaccaauccaacgacuccacaaucaaacucauugccaugcucuacacuccccuccgagccaacaacgccggcgaagacgucuucaccguauccugccgcguccucacacgccccucucccgacuucgacuucaucuuccuaguaccacccacagucgaaagccgcaccaaacccuucaccguccccauucucaccgucgaagaaaugaccaacucccgcuucccaauccccuuagaaaaacucuucaccggccccucauccgccuucgugguucaaccccaaaauggccgauguacaaccgacggcguccuacuaggcaccacacaacuuucacccgucaacaucugcaccuuccguggcgacguaacccacauagcagguucaagaaacuacaccaugaaccucgcaucgcucaacuggaacaacuacgaccccacagaagaaaucccagcuccccuaggcaccccagacuucgucggaaaaauccaaggcguacucacacaaacaacaaaaggcgacggcucaacacgaggccacaaagccaccguguacaccggcuccgcccccuucacacccaaacuaggcucaguccaauucggaaccgacaccgaaaacgacuucgaaacacaccaaaacaccaaguucacucccgucggagucauacaagacggaggcaccacccaccgaaacgaaccucaacaauggguccucccguccuacuccggccgcaacguaccaaacguccaccuagcacccgcggucgcacccacauuccccggcgaacaacuucucuucuuccgauccacaaugcccggcugcucagguuaccccaacauggaucucgacugccuucucccacaagaauggguacagcacuucuaccaagaagcugccccagcccaauccgacguagcacuccuacguuucgucaaccccgacaccggacgcguccuauucgaaugcaaacuccacaaaucaggcuacguaacaguagcacacaccggccaacacgaccuugucauaccacccaacgguuacuucagauucgacagcugggucaaccaauucuauacccucgcccccaugggcaacggcaccggccgccgccgggcacucuaa

SEQ ID NO: 36512 - RNA, 1623 nt, Artificial Sequence
  derived and/or modified sequence opt11 from VP1__Norovirus__BAS30038
augaaaauggccucaaacgacgccaacccuucugacggcuccgcagccaaucuagucccugaagucaacaacgaagucauggcccucgaacccguugucggagcugccaucgccgcacccgucgccggacaacaaaacgucaucgacccauggauccgcaacaacuucguccaagcaccaggcggagaguucaccguaucccccagaaacgcacccggcgaaauccuauggucagcaccacucgguccggaccucaaccccuaccucucacaccuugcucgcauguacaacggauacgccggcggauucgaaguacaaguaauccucgccggcaacgccuucaccgccggcaaaaucauauucgccgcaguacccccuaacuuccccaccgaaggccuuucccccucacaagucaccauguucccucacaucauagucgacguccgacaacuagaaccuguauuaaucccccuccccgacguacgaaacaacuucuaccacuacaaccagucuaacgacucaaccauaaaacuuaucgccaugcucuacacuccccuccgcgcaaacaacgcaggagaagacgucuucaccgucucaugccgcguccugacccgcccaucacccgauuucgacuucaucuuccucgucccacccaccgucgaaucacguacuaagcccuucaccguccccauccucacuguagaagaaaugaccaacuccagauuccccauaccauuagaaaaacuguucacaggacccuccuccgccuucgucguacaaccacaaaacggacgcugcaccacagacggcguccuacucggaaccacccaacuaucaccagucaacauaugcaccuuucgaggcgacguaacccacauagccggcucccgcaacuacaccaugaaccucgcuucacuaaacuggaacaacuacgaccccacagaagaaauuccagcaccucucggcacccccgacuucgugggcaaaauacaaggcguccuaacucaaaccacaaaaggagacggcuccacccgaggccacaaagccaccguuuacaccggcagcgcacccuucacccccaaacuaggcucaguacaauucggaaccgacaccgaaaacgacuuugaaacacaucaaaacaccaaauucacaccaguaggcgucauccaagacggcggcaccacccaucgcaacgagccccaacaauggguccucccauccuacuccggacguaacguccccaacguacacuuagcccccgcagucgcccccaccuuccccggcgaacaacuccuauucuuccgauccaccaugcccggcugcuccggauacccaaacauggaccucgacugccuccuaccccaagaauggguacagcacuuuuaccaagaagccgcacccgcccaauccgacgucgcccuacuccgcuucgucaaccccgacaccggcagaguccucuucgaaugcaaacuccauaaauccgguuacgucaccgucgcgcacaccggacaacacgaccucgucauacccccaaacggcuacuucagguuugacucaugggucaaucaauuuuacacacucgcgcccaugggcaacggcaccggccgccgcagagcgcucuaa

SEQ ID NO: 36513 - RNA, 1623 nt, Artificial Sequence
  derived and/or modified sequence opt11 from VP1__Norovirus__BAS30041
augaaaauggcauccaacgacgccaaccccucagacggcucagcagccaaccucguccccgaagucaacaacgaagucauggccuuagaaccugucgucggcgccgccauagccgcccccguagcaggccaacaaaacguaauagaucccuggauccguaauaacuucguccaagcaccaggcggagaauuuacaguaucaccucgaaaugcccccggcgaaauccucugguccgcaccccuaggccccgaccucaacccauaccuaucccaccucgcccgaauguacaacgguuacgccggaggcuucgaaguccaaguaauacuugccggcaacgccuucaccgccgguaaaaucauauucgcagcagucccacccaacuuccccauagaaggccucagccccucacaaguaaccauguucccccacauaaucgucgacguaagacaauuggaacccguucucaucccccuccccgacgucagaaacaacuucuaccacuacaaccaauccaacgacagcaccaucaaacuaaucgccaugcucuacacgccccuccgcgcaaacaacgccggcgaagacguauucacaguauccugccgcguccucacccgccccucccccgauuucgacuucaucuuccuugucccacccacagucgaaucucgaaccaagcccuucaccguccccaucuuaaccgucgaagaaaugaccaacucacgauuccccaucccccuagaaaaacucuucaccggccccucauccgcguucgucguccaaccccaaaacggacgcugcaccaccgacggcguccucuuaggcaccacccaacucucucccgucaacaucugcacuuuccgaggcgacguuacacacaucgcugguucacgaaacuacaccaugaaccucgccucccuaaacuggaacaauuacgacccuaccgaagaaauccccgccccucucggcacacccgacuucguaggcaaaauccaagggguccuaacccaaaccaccaaaggugacggcuccacacgaggccacaaagccaccgucuacacaggaucagcccccuuuaccccaaaacucggcagcguccaauucuccaccgacacugaaaacgacuuugaaacacaccagaacaccaaauucacccccguuggugucauccaagacgguggcacaacccaccgcaaugaaccccaacaauggguacuccccucauacuccggccgcaacguaccaaacguccaccuagcccccgccguugcacccacuuuccccggcgaacaacuccuauuuuuccgcagcacgaugcccggcugcucaggcuaccccaacauggaccucgauugccuacuaccacaagaauggguccaacacuuuuaccaagaagccgcccccgcacaauccgacguagcccuacuccgcuucguuaacccugacaccggccgcguccuauucgaaugcaaacuccacaaauccggcuacgucacagucgcccacacaggccaacacgaccucguaauaccacccaacggauacuuccgauucgacuccugggucaaucaguucuacacccucgcacccaugggcaacggcaccggacgccgacgagcacuauaa

SEQ ID NO: 36514 - RNA, 1623 nt, Artificial Sequence
  derived and/or modified sequence opt11 from VP1__Norovirus__BAS30044
augaaaauggccuccaacgacgcaaauccaucagacggauccgccgccaacuuagucccagaaguuaauaacgaagucauggcucucgaacccgucgucggcgccgcaauagccgcaccuguugcgggccagcaaaacgucaucgaccccuggauacgaaacaacuucguccaggcacccggcggugaguucacagugucuccccgcaacgcaccgggcgaaauacuauggucagaacccuuaggcccagaccucaaucccuaucucucccaccuagcccgaauguacaauggcuacgcuggcggcuucgaaguccaagucauacucgcaggcaacgccuuuaccgcaggcaaaaucauauucgccgcaguaccacccaauuuccccacugaaggacuuucccccucccaagucaccauguucccccacaucaucguggacguacggcaacucgaacccguacuaauaccccuccccgacguacgcaacaacuucuaccacuacaaccaaucaaacgauuccaccaucaagcucaucgccaugcucuacacaccccuccgcgccaacaaugccggcgaagaugucuuuaccguuucaugccgcguccucacccgacccagcccggacuucgauuucaucuuccucguaccuccaaccgucgaaucaagaacaaaaccuuucacaguccccauccuuacuguagaagaaaugacaaacucccgcuuccccauaccccucgaaaagcucuuuacuggccccucauccgccuucgucguccaaccccaaaacggaagaugcacaaccgacggcguucuccucggcaccacacaacucuccccagucaacauaugcacuuuccguggcgacguaacacacaucgcaggcucccgaaauuacaccaugaaucuugccucccuuaacuggaacaacuacgaccccacugaagaaauccccgcaccccuuggcacacccgacuuuguuggaaaaauccaaggcguucugacccaaaccacaaagggugacgguuccacccgcggccacaaagccaccgucuacacuggcucagccccuuucacccccaaacucggcuccguccaauucucuaccgacacugaaaaugacuucgaaacccaccaaaacaccaaauucacccccguaggcgucauucaagacggaggcaccacccaccguaacgaaccucaacaauggguccuccccuccuacagcggucgcaacguacccaacguacaccucgcacccgccgucgccccaaccuuuccaggcgaacagcuacucuucuuccgaucaaccaugcccggaugcucgggcuauccaaacauggaccuagacugccuccucccacaagaguggguccaacacuucuaccaagaagccgcccccgcccaauccgacgucgcccuccucagguuuguaaaccccgacacaggacgcguccucuucgagugcaaacuccacaaauccggauacgucaccgucgcccacacaggacaacacgaccucguaauuccacccaacggauacuuccgauucgacuccuggguaaaccaauucuacacacucgccccaauggguaacggaacaggccgccgccgcgcccuauaa

SEQ ID NO: 36515 - RNA, 1623 nt, Artificial Sequence
  derived and/or modified sequence opt11 from VP1__Norovirus__BAS30047
augaaaauggccucuaacgacgcaaaccccuccgacggaucagcagccaaccucguacccgaagucaacaacgaagucauggcccuagaacccgucguaggagcagccaucgccgcuccagucgcaggccaacaaaaugucaucgaccccuggauacgaaauaacuucguccaagccccuggaggagaguucacggucucaccccguaacgcaccaggagaaauccucuggucggcaccccuaggacccgaccuaaaccccuacuuaucgcaccuagcccguauguauaacggcuacgccggcggcuucgaaguacaagucauccuggccggcaacgccuuuaccgccggcaaaaucauauucgcagccgucccucccaacuuucccaccgaaggccucucuccuucacaagucacaauguucccccacaucaucgucgacguacgacaacuugaacccguacucaucccccuccccgacguacgcaacaacuucuaccacuauaaccaauccaacgacucaaccauuaaauuaaucgccaugcuauauaccccacuccgagccaacaacgccggcgaagacgucuucacagucuccugccgcgugcuaacccgcccuucaccagacuucgacuucaucuuccucguaccucccacagucgaaucccgaaccaaacccuucacaguccccauccuaaccgucgaagaaaugaccaacucacgauuccccaucccccuagaaaaacucuucaccggacccucauccgccuuugucguacaaccccaaaacggacgcugcaccaccgacggcgugcuacuugguaccacacaacucagcccagucaacaucugcacauuccgaggcgacgucacacauaucgccggcucccgcaacuacacaaugaaccuagccucccucaacuggaacaauuacgaccccaccgaagagauccccgcaccacucggaacccccgacuucguaggaaaaauccagggcguacucacccaaacaaccaaaggcgacggaagcacccgcggccacaaagcuacuguauacaccggauccgcccccuucacaccuaaacuaggcuccguacaauucucgaccgacaccgaaaacgacuucgaaacccaccaaaauaccaaauucacccccgucggcgucauccaggacggaggcaccacacaccgcaacgaaccccaacaauggguccuccccagcuacuccggccgcaacguacccaauguccaccucgcccccgccguagcucccaucuucccuggggaacaacuucuauucuuccgcuccaccaugcccggcugcagcggauacccaaauauggaccuugacugucucuuaccucaagaauggguccaacacuucuaccaagaggcagccccugcccaauccgacgucgcccuccuacgauucguaaaucccgacaccggccgcguccucuucgaaugcaaacuacacaaauccggauacgucacaguagcccacaccggccaacacgaccuaguaauaccucccaacggcuacuuccgguucgacucaugggucaaccaauucuacacacucgcacccaugggcaauggcacuggucgacgccgugcccucuaa

SEQ ID NO: 36516 - RNA, 1623 nt, Artificial Sequence
  derived and/or modified sequence opt11 from VP1__Norovirus__BAS30050
augaaaauggcuuccaacgacgccaacccauccgacggcucagccgcuaaccucguaccggaagucaacaacgaaguuauggcccuggaaccaguggucggcgcugccaucgcagcacccgucgccggacaacaaaacgucaucgaccccuggauacggaacaacuucguacaagcccccggaggcgaguucacaguuuccccacgaaacgcccccggcgaaauacucugguccgccccacucggacccgaccucaaccccuaccucucccaccuagcccgcauguacaacggcuacgcaggaggcuucgaaguccaagucauccucgcuggaaacgccuucaccgccggcaaaauaaucuucgcugccgucccacccaacuuccccaccgaaggucuaucccccucgcaagucacuauguucccacacauaaucguugacguccgccagcuagaaccaguccuaauacccuuacccgauguaagaaacaacuucuaccacuacaaccaauccaacgacucaaccauaaaacuuauagccaugcucuacaccccucuccgagccaacaacgcaggcgaagauguauucaccguauccugccgcguacucacccgcccaucccccgacuucgacuucaucuuucucguacccccaacaguugaaucccgaacaaaaccuuucacaguccccauucuaaccguagaagaaaugaccaacucacgcuuccccaucccccuggaaaaacuuuucaccggaccauccuccgccuuugucguccaaccacaaaacggccgcuguaccacagauggcguacuacuaggcaccacccaacucagcccagucaacaucugcaccuuccgcggagacgucacccacauagcagguucgcgcaacuacaccaugaaccuagcaucccucaauuggaacaacuacgacccaaccgaagaaauacccgcaccccuuggcacaccugacuucguaggcaaaauccaagggguacucacacagaccaccaaaggugacggaucaacccgaggccacaaagccacagucuacaccggguccgcuccuuucacacccaaacuuggcucagugcaauucucgaccgacaccgaaaaugacuucgagacccaccaaaacaccaaguucacaccagucggcgucauacaagacggaggaaccacccaccgaaacgaaccccaacaauggguacuccccagcuacuccggccggaacgucccuaacguacaucuugcacccgccgucgcccccaccuuccccggagaacagcuacucuucuuccgguccaccaugcccggcugcuccgguuaccccaacauggaccucgauugucuacucccucaggaauggguucaacauuucuaccaagaggccgcacccgcccaaucugacgucgcccuacuuagauucgugaaccccgacaccggccgaguccucuucgaaugcaaacuccacaaauccggauacguaaccgucgcacacaccggccaacacgaccucgugaucccucccaacggcuacuuccguuucgacucaugggucaaccaauucuacacccucgccccuaugggcaacggaaccggacgccgacgcgcccucuaa

SEQ ID NO: 36517 - RNA, 1623 nt, Artificial Sequence
  derived and/or modified sequence opt11 from VP1__Norovirus__BAS30053
augaaaauggccuccaacgacgcaacuccaucagauggcucagccgccaaccugguccccgagguaaacaacgaagucauggcacuugaacccgucgucggagccgcaaucgcugcccccguugccgggcaacaaaacguuaucgacccuuggauucgcaacaacuucguacaagccccaggcggugaguucaccgucucaccacgcaacgcccccggcgaaauccuauggucagcaccccuaggccccgaccuuaaccccuaccuaucccaccuagcccgcauguauaacggcuacgccggcggcuucgaaguccaagucauacuagccggcaacgcauucaccgccggaaaaaucaucuucgcagccguacccccaaacuuccccacagaaggucucucccccucccaagucacaauguucccacacauaauagucgacguccgccaacuugagcccguacucauaccccucccugacguccgcaacaauuucuaucacuauaaccaaucgaacgacucaaccauaaaacuaaucgcaaugcuguauacccccuuacgugcaaacaacgcaggcgaggacgucuucaccgucuccugccgcguacucacucgacccucaccagacuucgauuucaucuuccucgucccaccuacaguagaaucaagaacaaaacccuucaccgucccgauccuaaccguggaagaaaugaccaacuccagauucccaaucccccucgaaaaacuauucacuggccccuccucugcguucgucguccaaccccaaaacggccgaugcaccaccgacggcguucuccucggaaccacccaacucucacccgucaacaucugcaccuuccgaggugacgucacucacaucgccggcagccgcaacuauaccaugaaccucgccucccucaacuggaacaacuacgaucccaccgaagaaaucccagccccacucggcaccccugacuucguaggcaaaauccaaggaguccucacccaaaccacuaaaggagacggcucuacccgaggacacaaagccaccgucuauaccggauccgcgccauucacgcccaaacucggcuccguccaauucaauacagacaccgaaaacgauuucgaaacucaccaaaacaccaaauucaccccaguaggcguaauccaagacggaucaacaacccaccguaaugaaccccaacaguggguccuccccucuuacuccggacgcaacgucccaaauguccaucuagcccccgcggucgcccccacguuccccggagaacaacuccucuucuuccgcuccaccaugccaggaugcucaggauaccccaacauggaccucgauugccuacuuccccaagaauggguccaacacuucuaccaagaagcggcccccgcccaauccgacgucgcacuacuccgcuucguuaaccccgacaccggacggguacuauucgaaugcaaacuccacaaaucaggcuacgucaccguagcacacacgggccaacacgaccucgucauucccccaaacgguuacuuccgcuucgacucauggguaaaccaauucuacacccucgcccccaugggcaauggcaccgguagacgccgcgcccuauag

SEQ ID NO: 36518 - RNA, 1623 nt, Artificial Sequence
  derived and/or modified sequence opt11 from VP1__Norovirus__BAS30056
augaaaauggcauccaacgacgccaacccgucagauggcuccgccgcaaaccuuguacccgaagucaacaacgaaguuauggcacuugaaccagucgucggagccgccaucgccgcacccgucgccggccaacaaaacgucaucgaccccuggauccgcaacaauuucguacaagcuccaggcggagaguucaccgucagcccccgaaacgccccuggcgaaauccucugguccgcaccccuagguccagaccucaaccccuaccucucccaccucgcccgaauguacaacggcuacgccggaggcuucgaaguccaagucauacucgcaggcaacgccuucaccgccggaaaaaucauauucgccgcgguaccacccaacuuccccauagaaggccuaucccccucccaagucaccauguucccccacaucaucgucgacguccgccagcucgaaccaguccuaauaccccuucccgacguccgcaacaacuucuaucacuacaaccaguccaacgacucaacaaucaaacuuaucgccaugcucuauacgccacuccgcgcaaacaaugccggcgaagacgucuucaccguuucaugccgcguccucaccagacccagccccgacuucgacuucauauuccucguacccccaaccgucgaaucucggacuaaacccuucaccguccccauccuuaccguagaagaaaugacuaacucccgguuuccaaucccccucgaaaaacucuucacaggcccauccuccgcauucguuguacaaccccaaaacggccgaugcaccaccgacggcguccuccucggaaccacccaacucucccccgucaacauaugcaccuuccgaggcgacgugacacauaucgccggaucccguaacuacacgaugaaccuagccucccuaaacuggaauaauuacgaccccaccgaagaaauaccugccccacuaggcacccccgacuucguaggcaagauccaaggcguacucacccaaaccaccaaaggugacggcucaacccgaggacacaaagcuaccguuuauacugguuccgcccccuucacccccaaacucggcuccguccaauucuccacagacacugaaaacgacuucgaaacccaucaaaacacaaaauucacaccaguaggagucauacaagacggaggcacaacccaccgaaaugaaccccaacaguggguacuccccagcuacuccggccgaaaugucccaaacguccaccuugcacccgccgucgcacccacguucccgggcgaacaacuccucuucuuccgcucaacgaugcccggcugcuccgguuacccuaacauggaccucgacugccuccucccccaagaauggguccaacacuucuaccaagaagcagcacccgcccaauccgacguagcccuacuccgauucguuaaccccgacaccggccgcguccucuuugagugcaaacuccauaaauccggcuacgucaccgucgcccacaccggccaacacgaccuaguuaucccaccaaacggcuauuuccgauucgacucauggguuaaccaauucuacacccucgcaccaaugggcaacggcaccggccgccgcagagcccucuaa

SEQ ID NO: 36519 - RNA, 1623 nt, Artificial Sequence
  derived and/or modified sequence opt11 from VP1__Norovirus__BAS30059
augaagauggccuccaacgacgccaaucccucagaugguuccgcagccaaccuagucccagaagucaacaacgaagucauggcacucgaacccgucguaggagccgccaucgccgccccagucgccggccaacaaaacgucaucgacccuuggaucagaaacaacuucguccaagcccccgggggcgaguucacaguuucgccccgcaaugcccccggcgaaauccucuggucggcaccccucggaccagaccucaacccuuaccuaucccaccuagcccgcauguacaacggauacgccggcggcuucgaaguacaaguaauccuagccggcaacgccuucacagcaggaaaaaucaucuucgccgcuguacccccaaacuuccccacugaaggccucucccccucucaagucacaauguucccccacaucaucgucgacgucagacaacuugaacccguccuuaucccccucccagacguacgcaacaauuucuaccacuacaaccaaucuaacgacucuaccauaaaacucaucgcaaugcucuacacuccccuaagagcaaacaacgcaggcgaagacgucuucaccguauccugccgcguccucacccgcccuucuccugacuucgacuucaucuuccuaguuccacccaccgucgaaucaagaaccaaacccuucaccguccccauccuaacagucgaagaaaugaccaacagccgcuuucccaucccccuagaaaaacuguucaccggaccauccuccgcguucgucguccaaccucaaaacggucgcugcaccacagacggcguucucuuaggcaccacacaacuuucacccgucaauauuugcacuuucagaggagacgucacccauaucgcugguucucgcaacuacacaaugaaucucgcuucccucaacuggaacaacuacgaccccaccgaagaaauccccgcgccccucggcacucccgacuucgucggcaaaauucaagguguccucacccaaaccacaaaaggcgacggcuccacccgaggccacaaagccaccguauacacgggcucagcccccuucaccccaaaacucggcuccguucaauucucaacggacaccgaaaacgacuucgagacccaccaagacaccaaauuuacacccgucggcgucauccaagacggcggaaccacccaccguaacgaaccccaacaauggguacuacccuccuacuccggcagaaauguccccaacguccacuuagcccccgcagucgcaccuaccuuccccggcgaacaacuccucuucuuccgcuccaccaugccaggcugcucgggcuacccaaacauggaccuugacugccuacucccacaggaauggguccaacacuucuaccaagaggccgcuccagcccaauccgacguagcacuccuacgcuucgugaaccccgacacaggccgcguccucuucgaaugcaaacuucacaaauccggcuacgucaccgucgcacacacaggccaacacgaccucguaauucccccaaacggcuacuuccgcuucgacagcugggucaaccaauucuacacacucgccccuaugggcaacggcacuggccgccgccgcgcacuuuaa

SEQ ID NO: 36520 - RNA, 1623 nt, Artificial Sequence
  derived and/or modified sequence opt11 from VP1__Norovirus__BAS30062
augaaaauggccagcaaugacgccaacccaucagacggcuccgccgccaaucucguacccgaagucaacaacgaaguaauggcccuagaacccgucgucggcgccgccaucgccgcccccguagccggucaacaaaacgucauagaccccuggauccgcaauaacuucguccaagcaccaggaggcgaguucaccgucuccccacgcaacgcccccggcgaaaucuuauggucagcaccccucggaccagaccucaaucccuaccuuucucaccucgcccgcauguacaacggauacgcaggcgguuucgaaguccaagucauacuagccggcaacgccuuuacagcaggcaaaaucaucuucgccgccguaccacccaacuucccaaccgaaggacucucccccucccaagucaccauguucccccacaucauagucgacguccgucagcuagaacccguccucaucccacuccccgacguccgcaacaacuuuuaccacuacaaccaaucaaacgacucaaccaucaaacuuaucgccaugcucuacacaccacuccgugcaaacaacgcaggcgaggacgucuucacagucucaugccgcguauuaacacgccccagcccggacuucgacuuuauauuccucgucccacccaccgucgaaucacgcaccaagcccuucaccguccccauucucaccguagaagaaaugaccaacucucguuuccccauccccuuagaaaaacuauucaccggacccucgucugccuucgucguucaaccccaaaacggccgcugcaccaccgacgguguccuacucggcacaacucaacuuucaccaguaaacauuugcacauuccgaggcgacguaacgcacauugccggcucccgaaacuacacgaugaaccucgccucacuaaacuggaacaacuacgacccuacagaagaaauccccgcaccccucgguaccccagacuucguaggcaaaauacaaggcguccucacccaaaccaccaaaggugacggcuccacccgaggccacaaagccacagucuacaccggcuccgccccuuucacccccaaacucggcucuguucaauucucaacagacaccgaaaacgacuucgaaacccaccaaaacaccaaauucacaccagucggcguaauacaagacggcggcaccacacaccgcaacgaaccccaacaauggguacuccccuccuacucaggcagaaacguccaaaauguccaccucgcccccgccgucgcccccaccuuccccggagaacaacuccuuuucuuucgguccacuaugccaggcugcucaggcuacccaaacauggaccuagauugccuauuaccccaagaauggguacaacacuucuaucaagaagccgccccagcccagucagacgucgcccuacuccgauuuguuaacccagacacaggacgaguccucuucgaaugcaaacuccacaaauccggcuacgucaccguagcccacaccgggcaacacgaccucgucauaccgcccaacggauacuuccgauucgacuccugggucaaucaauucuacacccucgcaccaaugggcaacggcaccggaagacgacgcgcccuauga

SEQ ID NO: 36521 - RNA, 1623 nt, Artificial Sequence
  derived and/or modified sequence opt11 from VP1__Norovirus__BAS30065
augaaaauggccuccaacgacgccaaccccuccgauggauccgcugcaaaucuaguaccagaaguaaacaacgaagucauggcacucgaacccgucguuggcgcugccauagccgccccagucgcaggacaacaaaacgucaucgaccccuggauccgcaacaacuucguccaagcccccggaggagaauuuacagucuccccaagaaacgcccccggcgaaauacucuggucagcaccccucggccccgaccuaaaccccuaccucucccaccucgcccggauguacaauggcuacgccggaggcuucgaaguacaagucauccuagccggcaacgccuucacggucgucaaaaccacacucuccgcgguaccacccaacuuccccaccgaaggccuuucuccaucucaaguuacaauguucccacacauaaucgucgauguaagacaacuggaaccgguccucauaccccucccugacguccgcaacaacuucuaccacuacaaccaaaguaaugacucgaccauuaaacuaauagccaugcuauacacaccccuucgggcaaacaacgccggagaagacgucuucaccgucuccugccgcgucuuaacccgacccucacccgacuucgacuucaucuuccuagucccaccuacaguagaaagccggacuaaacccuucaccgucccaauccuaaccgucgaagaaaugacaaacucccgcuuccccaucccacucgaaaaacuauucaccggccccuccucagccuucguaguacaaccacagaacggacgcugcaccacugacggcguacuccuagguaccacccaacuuucacccgucaacauaugcacauuccgaggcgacgucacccacaucgccggcucacgcaacuacaccaugaaccucgccucccuaaacuggaacaacuacgaccccacugaagaaaucccagcaccccuaggaacccccgacuucguaggcaaaauccaaggcguacucacccaaaccaccaaaggcgacggaucgacccgaggccacaaggccacagucuacacaggcuccgcaccauucacccccaaacucggcucaguccaauucucaacugacacagaaaacgacuucgaaacgcaccaaaacaccaaauucacccccgucggagucauccaagacggcggcaccacccaucgaaacgaaccccagcaauggguccuccccagcuacuccggcagaaacguccccaacguccaccuugcccccgccguugcccccaccuuccccggugaacaacuacucuucuuccgauccacuaugcccggaugcuccggauaccccaacauggaccucgacugucuacucccacaagaauggguucaacacuucuaccaagaagcagcccccgcccaauccgacgucgcccuccuucgcuucgucaaccccgauaccggccgcguccuauucgaaugcaaacuccacaaauccggauacgucacaguugcccauaccggccaacacgaccucgucaucccacccaacggcuacuuccgcuuugacuccugggucaaccaauucuacacacuagcccccaugggaaacggaaccggacgaagacgagcccuauaa

SEQ ID NO: 36522 - RNA, 1623 nt, Artificial Sequence
  derived and/or modified sequence opt11 from VP1__Norovirus__BAS30068
augaaaauggccuccaacgaugccaccgccuccgauggaucagcagccaaccuaguccccgaagucaauaacgaaguaauggcccuugaacccgucgucggagccgcaaucgccgcccccguggccggccaacaaaacguaaucgacccauggauuagaaacaacuucguccaagcaccgggaggcgaauuuaccgucagcccccgcaacgcaccuggcgaaauccucugguccgcaccccucggccccgaccucaaccccuaccuaucacaccuggcccgcauguacaacggauacgccggcggcuucgaaguccaaguuauacuggcaggcaacgccuucaccgccggaaaaaucaucuucgccgccguaccacccaacuuccccaucgaaggacuaucccccucccaaguuaccauguuuccccacaucaucgucgacgugcgucaacuagaacccguccuaaucccgcucccagacguccgcaacaacuucuaccacuacaaccaauccaacgacucaaccaucaaacuaaucgccaugcuguacacuccccuccgggccaacaacgccggagaagacguuuucaccguauccugccgcguccucacacgacccuccccagacuucgacuucaucuuccugguaccacccacggucgaaucccgcaccaaacccuucaccguccccauacucaccgucgaagaaaugaccaacucccgauuccccauaccucucgaaaaacucuucacaggcccaucuucugcuuucgucguacaaccccaaaacggccgcugcaccaccgacggaguccuacucggcacaacccaacucagccccgucaacaucugcaccuuccgaggcgacguaacccacauagccggaucccgcaacuacaccaugaaccucgcuagccucaauuggaacaacuacgacccuaccgaggaaauccccgccccucuaggcacccccgauuucgucggaaaaauucaaggcguacucacucaaaccacaaaaggcgacggcuccacucgcggccacaaggcaaccguguacacaggaucagcccccuuuacccccaagcuagguucaguacaauucagcacugacaccgaaaacgacuucgaaacacaccaaaacacuaaauuuacucccgucggagucauccaagacggcggcaccacacaccgaaacgaaccccaacaauggguacuacccucauacuccggccgcaacgucccaaacguacaccuagcacccgccgucgcacccacauuucccggagaacaacucuuauucuuucgcagcacaaugccaggcugcucaggcuacccaaacauggaccucgacugccuccucccccaagaauggguccaacacuucuaccaagaagcugccccagcccaauccgacguagcccuacuucgcuuuguaaaccccgacacaggccgcguccucuucgaaugcaaacuacacaaaagcggcuacguaaccgucgcccacaccggccaacacgaucuaguaauacccccaaacggauacuuccgcuucgacucauggguaaaucaauucuacacucucgccccaaugggaaauggaaccggaagacgacgcgcccuauaa

SEQ ID NO: 36523 - RNA, 1623 nt, Artificial Sequence
  derived and/or modified sequence opt11 from VP1__Norovirus__BAS30071
augaaaauggccuccaacgacgcaaaccccucagacggcucagccgccaaccucguccccgaagucaacaacgaagucauggcccuagaacccgucgucggcgccgcgaucgcggcccccgucgcaggacaacaaaacgucaucgaccccuggauccgaaacaacuucguccaagcaccaggaggagaguucaccgucucaccacgcaacgcccccggagaaauacucugguccgcgccccucggccccgaucucaacccauaccuaucccaccuagcccgcauguacaacggcuacgccggcggcuucgaaguacaaguaauacuagccggcaaugcuuucaccgcaggaaagaucauauucgccgcaguacccccaaacuuccccaucgaaggccucucccccucccaagucacaauguucccccacaucaucgucgacguccgccaacucgagccagucuuaaucccacuuccagacguccgcaauaacuucuaccauuacaaccaauccaacgauucaaccaucaaacuuauagcaaugcucuacacuccccuccgagcaaauaacgccggcgaagaugucuucaccgucagcugucgcguccucaccaggccaucccccgacuucgacuucaucuuccuagucccucccacagucgaaucacgaaccaaacccuucaccgucccaauccucaccguagaagaaaugacuaauucccgcuucccaaucccccuagaaaaacuauucacaggacccuccuccgcauucguaguccaaccccaaaauggccgaugcacaacagacgguguccuacuaggcacuacccagcucucccccguaaacauauguacauuccgaggugauguaacccacaucgcaggcucccgcaacuacacaaugaaccucgcaucccugaacuggaacaacuacgaccccacagaagaaauccccgcaccccuaggcacucccgauuuugucggcaaaauccaaggaguccuuacccaaacaacaaagggagacggcucaacccgaggacacaaagccacaguauacaccggcuccgcccccuuuacccccaaacucgguucaguccaauucuccacagacaccgaaaacgacuuugaaacacaccaaaacaccaaauucacccccgucggcgucauccaagacggcggcaccacccacagaaacgaaccccagcaguggguccuucccucuuacucaggccgaaacguccccaacguccaccuugccccagccgucgcccccaccuuccccggcgaacaacuccucuucuuccgcuccaccaugccaggcugcuccggcuaucccaacauggaccucgacugucuccucccccaagaauggguccaacauuucuaucaagaagccgcccccgcacaaucggacguugccuuacucagauucgucaaccccgacaccggacgcguacucuucgaaugcaaacuacacaaauccggcuacguaaccgucgcccauacuggucaacacgaccuagucaucccacccaacggcuacuuucgauucgacuccugggucaaccaauuuuacacccucgcacccaugggcaacggcacaggccgacgacgcgcacuuuaa

SEQ ID NO: 36524 - RNA, 1623 nt, Artificial Sequence
  derived and/or modified sequence opt11 from VP1__Norovirus__BAS30074
augaaaauggccagcaacgacgccaacccuuccgacggauccgcagccaaccucgucccagaagucaacaaugaaguaauggcucuagaacccgucgucggcgcagcuaucgccgccccagucgccggacaacaaaacgucauagaccccuggauccgcaacaauuucguccaagcccccggcggcgaguucaccgucuccccacgcaaugcaccaggcgaaauccucuggucagcaccccucggaccagaccucaaccccuaccucagccaccucgccagaauguauaauggauacgccggcggcuucgaaguccaagucauacucgccggcaacgccuucacagccggcaagaucauauucgcagccguaccacccaacuuccccauagaaggccuauccccaucccaagucaccauguucccccacaucaucgucgacguccgccaacuagagcccguacucaucccccuccccgacguccgaaacaauuucuaucacuacaaccagucuaacgacuccaccaucaagcucaucgccaugcucuacacgccacucagagccaacaacgccggcgaagacgucuucacaguuuccugccgcguccucacacgcccaucgcccgacuucgacuuuaucuuccucguaccaccuaccguagaaucccgcacgaaaccauucaccguacccauacucacaguagaagagaugaccaacucucgauuccccauaccacuagaaaaacuauucaccggccccuccuccgccuucguaguccaaccccaaaacggccguuguacuacagauggaguacuccucggcaccacacaacuaucuccagugaauauaugcaccuuccgcggcgacgucacacacaucgccggcucccgcaauuacaccaugaaccucgcaucccuuaacuggaacaacuacgaccccacagaggagauccccgccccucuaggcacaccagacuucgucggcaaaauucaaggaguucucacccagaccaccaaaggcgacggaucaacccgcggccacaaggccaccgucuauaccggcucugcccccuuuacacccaagcugggaucuguacaauucuccaccgacaccgagaacgacuucgaaacccaccaaaacaccaaauucacucccgucggcguaauccaagacggaggcaccacacaucgcaacgaaccacaacaauggguccucccaucuuacucaggacgcaacguaccaaacguccaccuagcccccgcaguagcacccaccuucccaggcgaacaacuacuauucuuucgcuccacgaugcccggcugcagcggauaccccaacauggaucucgacugccuccucccacaagagugggugcaacacuucuaccaagaagccgcccccgcccaauccgacguugcccuacuccgcuucguaaacccagacaccggccgcguccuauucgaaugcaaacuccauaaauccggcuacgucacagucgcccacacaggccaacacgaucuggucauaccgcccaauggcuacuuccgcuucgacagcugggucaaccaauucuauacucucgcccccauggguaacggcaccggacgucguagagcccucuaa

SEQ ID NO: 36525 - RNA, 1623 nt, Artificial Sequence
  derived and/or modified sequence opt11 from VP1__Norovirus__BAS30077
augaaaauggccuccaacgacgcaaauccaagcgacggcuccgccgcaaaccucguaccugaaguaaacaacgaaguaauggcucucgaacccguagucggagccgcaauugccgcgcccgucgccggccaacaaaacgucaucgacccauggauccgcaauaacuucguccaagcccccggcggagaguucaccgucucaccccgcaacgcccccggcgaaauccucugguccgcgccccuaggacccgaccucaacccauaccuuucccaccucgccagaauguacaacggcuacgccggcggcuucgaaguacaagucauacuagcaggaaacgccuucaccgcaggaaaaaucauauuugcagccgucccacccaacuuccccaccgaaggccucucccccucccaaguaaccauguucccacauaucaucguagacguccggcaacucgaaccuguccucaucccauuacccgacguccgaaacaacuucuaccacuacaaccaaucuaacgacucuaccauaaaacucauagccaugcucuacacuccccuccgcgcaaacaacgcuggcgaagacgucuucaccgucucaugccgaguacucacccgccccagccccgacuucgacuucaucuuccucgucccacccaccgucgaaucgcgaacaaaacccuucaccguacccauacucaccgucgaagaaaugaccaacucccgauucccuaucccccuagaaaaacuauucaccggaccauccuccgcauucgucguacagccacaaaacggacgcugcaccaccgacggcguccuacucggcaccacacaacuuuccccagucaacauaugcaccuuccgaggugacgucacacacaucgccggaucacacaacuacaccaugaaccuugcgucccucaacuggaacaauuacgacccaaccgaagagauacccgccccacuagguacaccagauuuuguaggaaaaauccaaggcguccucacccagaccacaaaaggcgacggcagcacccgcggacacaaggcaaccgucuauacaggcuccgccccauucacucccaaacucggaagcguccaauucuccaccgacaccgaaaacgacuucgaaacccaucaaaacacaaaauucacacccgucggcguaauccaagacggcggcaccgcccacagaaacgaaccccaacaauggguacuaccaucuuacucaggccgcaacguacaaaacguccaccucgccccugccgucgcccccaccuucccaggagaacagcuccuuuucuuccguuccacaaugccaggcugcucaggauaccccaacauggaccucgacugccuccuuccacaagaauggguacaacacuucuaccaagaggccgccccggcacaauccgacgucgcucuccugcgcuucguaaaccccgacaccggcagaguacuguucgaaugcaaacuccacaaguccggcuacgucaccguagcacacaccggccaacacgaccucgucauaccacccaacggauauuuccgcuucgacucaugggucaaccaauucuacacacucgcaccaaugggcaacggcaccggaagaagacgcgcacuauaa

SEQ ID NO: 36526 - RNA, 1623 nt, Artificial Sequence
  derived and/or modified sequence opt11 from VP1__Norovirus__BAS30080
augaagauggcauccaaugacgcaaaccccuccgacggauccgcagcaaacuuaguacccgaagucaacaacgaaguaauggcucuagagcccgucgucggugccgccauagccgcacccguagccggccaacaaaacguaaucgaccccuggauccgcaacaacuuuguccaagcaccuggaggagaguucacaguuuccccgcgcaacgcacccggcgaaauccucuggucugcaccccucggccccgaucuaaaccccuaccucucccaccucgcccgcauguacaacggauaugccggcggcuuugaaguccaggucauacucgccggcaacgcguucaccgcuggacaaaucaucuucgccgccgucccacccaacuuccccacggaaggccucucccccagccaagucacgauguucccccacauuauugucgacgucagacaacucgaacccguccucauuccacuccccgacguccguaacaacuucuaccacuacaaccaaagcaacgacuccaccaucaaacuaaucgccaugcucuacacaccccuacgcgccaacaacgccggagaagacgucuucaccgucucgugccgcguccucaccagaccaucaccagacuucgacuucauauuccucguucccccaaccguagaaucccggaccaaacccuucaccgucccaauccucacaguugaagaaaugaccaacucacgauuccccaucccacucgaaaaacucuucaccggacccuccuccgcuuucguuguucaaccacaaaacggccgcugcaccaccgacggaguacuucuaggcacuacacaacucucccccgucaacaucugcaccuuccgcggagacgucacacacauagcaggaagccgaaacuacacuaugaaccucgcaucccuaaacuggaauaacuacgauccaaccgaagaaaucccugcuccccucggaacacccgacuucgucggaaaaauccaaggcguccuaacccaaaccaccaaaggcgacggcuccacccgaggacacaaagccaccguauacaccggcucagccccuuucacccccaaauuaggcucaguucaauucuccacagacaccgaaaacgacuucgaaacacaucaaaacaccaaauucacccccgucggagucauccaagauggcggcaccacccaccgcaacgaaccccaacaauggguacuacccuccuacucgggcagaaacguccccaacguccaccuugcccccgccgucgcccccacauuccccggcgaacaacuccuuuucuuucgaucaacuaugccuggcuguuccggauaucccaacauggaccuagacugucuccuaccacaagaauggguccaacacuucuaucaagaagccgccccagcccaauccgacgucgcacuccuacgcuuugucaaccccgacacaggacguguccucuucgaaugcaaacuccacaaauccggcuacgucaccguagcacacacaggccaacacgaccucgucaucccuccuaacggauauuuccgcuucgacuccugggucaaccaauucuacacccucgccccaaugggaaauggcacuggccgacgccgcgcccuauaa

SEQ ID NO: 36527 - RNA, 1623 nt, Artificial Sequence
  derived and/or modified sequence opt11 from VP1__Norovirus__BAS30083
augaaaauggcaagcaacgacgcgaacccauccgacggcucagccgccaaccucgucccugaagucaacaacgaagucauggcccucgaaccaguagucggcgcggcuaucgccgcacccguagccggacaacaaaacgucauagacccuuggauccggaacaacuucguacaagcccccggcggcgaguucaccgucucaccccgcaacgcuccaggugaaauccuaugguccgcuccccucggccccgaccucaaccccuaccucucccaccucgcccgaauguacaacggauacgcaggcgguuucgaaguccaagucauccucgcuggcaaugcuuucaccgcaggaaaaauaauuuucgcagcgguacccccaaacuuccccacagaaggacugagcccaucccaagucacaauguucccccacaucaucgucgacguacgccaauuagaaccaguacucaucccacugcccgacguccgcaacaacuucuaccacuacaaccaaucgaaugacucaaccaucaaacugauagccaugcuuuacacuccccuucgcgcuaauaacgccggcgaagacgucuucaccgucuccugcagagugcucacccgccccagucccgacuucgacuucaucuuccucgucccgccaaccguagaaucgcgaaccaaacccuuuaccguaccuauucucaccgucgaagaaaugaccaacucccgcuuccccaucccccucgaaaaacuauucaccggccccucauccgccuucgucgugcagccccaaaacggccgcugcacaacagacggaguucugcucggcaccacacaacucucccccguaaacauaugcacauuccgaggcgacguaacccacaucgccggcucucgcaauuacaccaugaaccucgccucacucaacuggaacaauuaugaccccacagaagaaaucccugccccacucggcacccccgacuuugucggcaaaauccaagguguccucacccaaaccaccaaaggagacggcuccacccgaggacacaaagccaccgucuacaccggcuccgcucccuucacccccaaacucggaucaguccaauuuuccaccgacaccgaaaacgauuucgaaacccaccaaaacacaaaguucacccccgucgguguuauccaagacggcggcaccacccaccgaaacgaaccccagcaguggguccuccccuccuacucaggccgcaacgucccaaacguucaccucgcccccgccgucgcaccaaccuuucccggcgaacaacuacucuucuuccgcuccaccaugccagggugcuccggauaccccaacauggaccucgacugccuccucccccaagaauggguccaacacuucuaccaagaagccgcaccagcacaaucugacgucgcccuacuccgcuucgucaaccccgacaccggccguguccuuuucgaaugcaaacuccacaaauccggauacguaaccgucgcgcacaccggccaacacgaccucgucaucccaccaaacggcuacuucagauucgacuccugggucaaccaauucuacacccuugcaccaaugggaaauggcaccggccgacgucgcgcccuuuaa

SEQ ID NO: 36528 - RNA, 1623 nt, Artificial Sequence
  derived and/or modified sequence opt11 from VP1__Norovirus__BAS30086
augaaaauggccuccaacgacgcaaaccccuccgacggaucagccgccaaccucguuccagaaguaaacaacgaagucauggcccucgaacccguaguaggcgcagccaucgcugcacccgucgccggccaacagaacgucaucgaccccuggauccgaaacaauuucgugcaagcccccggcggcgaguucaccguaucucccagaaacgcucccggcgaaaucuuaugguccgcaccucucggccccgaccucaacccauaucuaucccaccuugcccgcauguauaacggcuacgccggagguuucgaaguccaggucauccuagccgggaacgccuucaccgccggaaaaaucauauucgccgcagucccacccaacuuccccacagaaggacuaucccccucccaaguaacaauguucccccacauaaucgucgacguccgucaacucgaacccguccucaucccccuacccgacguaagaaacaacuucuaccacuacaaccaaucuaacgacagcacuaucaaacuaauagcaaugcucuacacaccccuccgcgccaacaacgccggcgaagaugucuuuaccgucuccugcagaguccugacccgaccaagcccagacuucgacuucaucuuccuuguacccccaaccguagaaucacgcaccaaacccuucacuguaccuguccuaacugucgaagaaaugacaaacagccgauucccuaucccccucgaaaaacucuucaccggacccuccucagccuucgucguccaaccccaaaauggccgcugcacaacagacggcguccuccuaggcaccacccaacucucccccguuaacauaugcaccuuccgcggagaugucacccacaucgcgaacucccacaauuacaccaugaaccucgcaucacucaacuggaacaacuaugaccccaccgaagaaauccccgcaccccuuggcacccccgacuucguuggaaaaauucaaggcguccucacccaaaccacaaaaggagacggcuccacccgcggccacaaagccaccguuuacaccggcuccgccccauucacaccaaaacuaggaucaguccaauucucaacagacaccgaaaaugacuucgaaacccaccaaaacacgaaauucacucccguaggcgucauccaagacggcggaaccacccaccgcaacgaaccacaacaauggguccuacccuccuacucuggacggaacguacaaaauguccaccuagcccccgccgucgcaccuaccuucccuggagaacaacuccucuucuuccgauccacaaugcccggauguuccggcuaccccaacauggaccucgacugccuacucccccaagaauggguccaacacuucuaccaagaagcagcccccgcucaauccgacguagcccuccuaagauucgucaaccccgauacagguagaguccucuucgaaugcaagcuacacaaguccggcuacgucacagucgcccacaccggccaacacgaccucgucauacccccgaacggcuacuuccgcuucgacucuugggucaaccaauucuacacacucgcaccuaugggcaacgguaccggccgccgccgagcccucuaa

SEQ ID NO: 36529 - RNA, 1623 nt, Artificial Sequence
  derived and/or modified sequence opt11 from VP1__Norovirus__BAS30089
augaaaauggccuccaacgacgcuaacccaagcgacggaucugcugccaaucuaguacccgaaguuaauaacgaagucauggcccucgagccggucgucggcgccgcaauagcggccccagucgccggacaacaaaaugucaucgaucccuggauacgcaacaacuucguccaagcacccggcggcgaguucacugucucaccccgaaacgcccccggcgaaauccuauggucagcaccccucggccccgaccuaaaccccuaccuuucacaccuggcccgcauguacaacggauacgccggcggcuucgaaguccaagucauccucgccggcaacgccuuuaccgccggcaaaauuaucuucgcugccgucccucccaacuuccccacagaaggccucucccccucacaaguaaccauguucccccauaucaucgucgauguccgccaacuagaacccguucucauccccuuacccgacguacgcaacaacuucuaccauuacaaucaaucaaaugacuccaccauaaaacucauagccaugcucuacacaccccuacgagcaaacaacgcaggagacgacgucuucaccgucucaugccgaguccucacccgccccucacccgacuucgacuucaucuuucucgucccaccaacaguagaaucccgcacuaaaccauucaccguccccauccucacagucgaagaaaugaccaauucccgcuucccuaucccccuagaaaaacucuucacaggccccucguccgccuucgucguccaaccccaaaacggccgcugcaccacagacggcguccuucucgggacuacacaacucucaccaguaucaaucugcaccuuucgcggagacgucacacacauugccggcagccgagauuacacaaugaaccucgcuucacuuaacuggaacaauuacgaccccaccgaagaaaucccugcaccccuugguacccccgacuucguugggaaaauccaaggaguccuaacccaaacaacaaaaggcgacggcucaacacgcggccacaaagccaccguuuauaccggauccgccccauucaccccaaaacucggaucaguacaauucuccaccgacacagaaaacgacuucgaaacacaccaaaacacaaaauucacccccgucggggucauacaagacggcucuaccgcccaccgcaacgaaccgcagcaauggguccuccccuccuacucaggccgcaacguacaaaauguccaccuagcccccgccguagcccccaccuucccaggagagcaacuccucuucuuccgaucaacaaugcccggauguuccggcuaccccaacauggaccucgacugccuccucccccaagaauggguccaacacuucuaccaagaagccgcaccagcucaaucagacgucgcacuccuccgcuucgucaacccagacaccggccgcguccuauucgaaugcaaacuacacaaauccggcuacgucaccgucgcccacacaggccaacaugaccuuguaauuccucccaacggcuacuuccgauucgacagcugggucaaccaauucuauacacucgccccaauggggaacggcaccggacgcagacgagcccucuaa

SEQ ID NO: 36530 - RNA, 1623 nt, Artificial Sequence
  derived and/or modified sequence opt11 from VP1__Norovirus__BAS30092
augaaaauggcauccaacgacgcuaaccccuccgacggcucagcggcuaaucuaguccccgaagucaacaacgaggucauggcacucgaacccgucgucggcgccgccaucgccgcccccgucgcuggccaacaaaacgucauugaccccuggauucgaaacaacuucguccaagcccccggcggcgaguucacagucucuccccguaacgcccccggcgaaauacucugguccgcaccacucggccccgaccuaaaccccuaccucucccaccuugccagaauguauaacggcuacgccggugguuucgaaguccaagucaucuuagcaggcaacgcauucaccgcaggcaaaaucauuuucgcagccgucccucccaacuuccccaucgaaggccuaagccccucccaaguaaccauguuuccccacauaauaguagacguacgacaacucgaaccaguccuuaucccccuaccagauguccgaaacaacuuuuaccacuacaaccaauccaacgacucaaccauuaaacuaauagcgaugcucuacacaccacuccgcgccaacaacgccggcgaagacgucuuuacagucuccugccgcguccucacccgccccucccccgacuucgacuucaucuuccucgucccuccaaccgucgaauccagaaccaaacccuucaccguccccaucuuaacaguagaagaaaugaccaacucacgguucccuauuccacucgaaaaacuauuuacaggacccagcucagcauucguaguccaaccccaaaacggccguuguacaacagacggcguccuucucggcaccacccaacucucucccguaaacaucugcacuuuucgcggagaugucacacacauagccuccuccaggaacuacaccaugaaccuugcuucccuaaauuggaauaacuacgaccccaccgaagaaauccccgccccacuaggcacccccgacuucgucgguaaaauccaagggguccucacccaaaccaccaaaggcgacggcuccacccguggccacaaagccaccguauacacagguuccgcccccuucacccccaaacucggcucaguacaauucuccaccgacaccgagaacgacuucgaaacccaccaaaacaccaaauucacccccgucggcguaauccaagacggcggcaccacccacagaaaugaaccccaacaguggguccuaccaucuuacuccggccgaaacgucccaaauguccaccuagccccagccgucgcccccaccuucccaggcgaacaacuccuuuucuuccgcuccaccaugccaggaugcuccggauaccccaacauggaccucgacugccuccuaccacaagaguggguacaacauuucuaccaagaggcagcccccgcacaaucagacguagcccugcuccgcuucgucaaucccgacaccggacgaguacuauucgaaugcaaacuacacaaauccggcuacgucaccgucgcccacaccggccaacacgaccucgucauaccacccaacggcuacuuccgguucgacucaugggucaaucaauucuacacccuagcacccauggguaauggcaccggucgccgccgcgcucucuaa

SEQ ID NO: 36531 - RNA, 1623 nt, Artificial Sequence
  derived and/or modified sequence opt11 from VP1__Norovirus__BAS30095
augaaaauggcauccaacgacgccaaccccuucgacggcucagccgcuaaucucguaccagaagucaacaacgaagucauggcccucgaaccagucgucggcgccgccauagccgcccccguagcaggccagcaaaacgucauugacccauggauccgcaacaacuucguccaagcccccggcggcgaguucaccgucucaccccgaaacgccccuggcgaaauccucuggucagcaccccuaggucccgaccucaacccuuaucucucucaccucgccagaauguacaacggcuacgccggcggcuucgaaguccaggucauccucgccggcaacgccuucaccgcaggcaaaauaauauucgcugccguaccaccaaauuucccagcugaaggccucucccccucacaaguuaccauguucccccacauaaucgucgacgugcgccaacucgaacccguccucaucccccuccccgauguccgaaauaauuucuaccacuacaaccaauccaacgacucaaccaucaaacuaaucgcaaugcucuacacaccccuccgcgccaacaacgccggcgaagacgucuucaccgucuccugccguguccuaacacgaccuucccccgacuucgacuucauauuucucguucccccaaccgucgaauccagaacuaaacccuucaccguccccauccuaacagucgaagaaaugacaaacucacgcuuuccaaucccccuagaaaaacuauucaccggccccuccagcgccuucgucguccagccccaaaacggccgcuguaccaccgacggaguccuccuaggcacaacccaacucuccccaguaaacaucugcaccuuucgcggcgacgugacccacaucgccggcucccgcaacuacaccaugaaccuagcaucccucaacuggaacaacuacgaccccaccgaagaaauccccgcaccccucggcacaccagauuucgucggcaaaauccaaggaguccucacacaaaccacaaagggcgacggcagcacacguggacacaaagccaccgucuacaccggauccgcccccuuuacuccaaaacuuggcucaguccaauucuccaccgacacagaaaacgacuucgaaacacaccaaaacacaaaguucacucccgucggcgucauccaagacggcgguaccacccaccgcaacgaaccacaacaguggguccuucccuccuacucuggccgcaacguccccaacguucaccuagcccccgccgucgcccccacuuuccccggugaacaacuccucuucuuucgaucaacaaugcccggcugcagcggauaucccaauauggaucuagacugccuccuaccccaagaauggguccaacacuucuaccaagaagcagcccccgcacaauccgacguagcccuacucagauucgucaaccccgacacaggccgaguccucuucgaauguaagcuccacaaaucuggcuacgucacugucgcacacacaggacaacacgaccucgucauaccacccaauggauacuuccguuucgacuccuggguuaaccaauucuacacccucgcccccaugggaaacggcaccggccgaagacgagcccucuaa

SEQ ID NO: 36532 - RNA, 1623 nt, Artificial Sequence
  derived and/or modified sequence opt11 from VP1__Norovirus__BAS30098
augaaaauggccucaaacgacgccaaccccucagacggcucagcagccaaccuaguaccagaaguaaauaacgaaguuauggcccucgaacccgucgucggcgcagcgaucgccgcuccagucgcuggacagcaaaacgucaucgacccauggaucagaaacaacuucguccaagccccuggcggagaguucaccgucucaccccgcaacgcacccggcgaaauacuaugguccgcgccccucggccccgaccucaaccccuaccucucccaccucgcccgaauguacaacggauacgccggaggauucgaaguccaagucauccuagccggcaacgccuuuacagccggaaaaaucauauucgcugccguaccacccaacuuccccacagaaggccuaucacccucccaaguaaccauguuuccacacaucauagucgauguucgacaacucgaaccaguccucaucccacuaccagacguccgcaacaacuucuaccacuacaaccaauccaacgacucaaccaucaagcucaucgccaugcuuuacacaccacuacgagcaaacaacgcgggagaagacguauucacagucucuugccgaguucucacccgccccucuccagacuucgacuucaucuuccuaguaccacccaccgucgaaucacgcaccaaacccuucaccguacccauucuaaccgucgaagaaaugacaaacucccgguuccccaucccccuugaaaaacucuucacaggacccagcuccgccuucaucguccaaccccaaaacggccgcugcaccaccgacggcguucuacuaggcaccacucaacucagcccagucaacaucugcacauuucgaggagacgucacacacaucgccggcucacgcaacuacaccaugaaccuugcaucccucaacuggaacaacuacgaccccacagaagaaauccccgccccacucggcacuccugacuucgucggaaaaauccaaggcguacucacccaaaccaccaaaggcgacggaucuacucgcggccauaaagccaccgucuacaccggcagcgcccccuuuaccccaaaacuaggcagcguccaauucuccaccgacaccgaaaacgacuucgaaacccaccaaaacacaaaauucacccccgucggcgucauccaagacggcggcacaacccacagaaacgaaccccagcaauggguucuuccauccuacucaggucgcaacguccccaauguccaccuagcacccgcagucgcccccacauuccccggcgaacaacuccuguucuuccgcuccacaaugcccggauguucaggcuaccccaacauggaucuagacugccuucuaccccaagaauggguccagcacuucuaccaagaagcugcccccgcacaauccgacgucgcccuccuaagauucguuaaccccgauaccggacgcguccucuucgaaugcaaacuccacaaauccggauacguuaccgucgcucauaccggacaacacgaucucguaauacccccaaacggcuacuuccgauucgacagcugggucaaccaauucuacacacuagccccuaugggcaacggcaccggccgacgccgcgcacucuaa

SEQ ID NO: 36533 - RNA, 1623 nt, Artificial Sequence
  derived and/or modified sequence opt11 from VP1__Norovirus__BAS30101
augaaaauggcuuccaacgacgccaaccccuccgacgguuccgccgccaaccuaguccccgaaguaaacaacgaggucauggccuuagaacccgucgucggcgccgccauugccgccccagucgccggccaacaaaacgucauagaccccuggauccgcaacaacuucguccaagcuccgggaggagaguucacagucuccccucgcaacgcccccggcgaaauccucuggagcgcaccccucggcccagaccuuaaccccuaccuuucccaccucgcccgcauguacaacgguuacgcaggcggcuucgaaguacaagucauccucgccggcaacgccuucaccgcgggaaaaaucaucuucgccgcaguacccccuaacuuccccacugaaggccucucccccucccaagucacuauguucccgcacaucauagucgacguucgacaguuagaacccguacuuaucccucugcccgacguccgaaacaacuuuuaccauuacaaccaguccaacgacuccaccaucaaacuaauugcaaugcuauacaccccacuccgagccaacaacgccggcgaagacgucuucaccgucuccugccgcguccucacccgaccaucuccagacuucgacuucaucuuccucgucccacccaccgucgaaucucgaaccaaacccuuuaccguaccaauacuaacaguagaggaaaugaccaauagccgauuccccaucccacuagaaaaacucuucaccggcccaucauccgcauucgucguccaaccccaaaacgggcgcugcaccaccgacggcguccuacucggcaccacccaacucucccccguaaacauaugcaccuuccggggcgaugucacacacauagccggcucccgcaacuacaccaugaaccucgcaucccuaaacuggaacaacuacgaccccaccgaagaaauccccgcaccccucggaacccccgacuucgucgguaaaauccaaggcguacucacucaaacuacaaaaggcgacggcuccacacgaggccacaaagccaccgucuauacaggauccgcccccuucacacccaaacuaggcucuguccaauucuccacagacaccgaaaacgacuuugaaacacaucaaaacacaaaauucacccccgucggcgucauccaagacggcucgacagcccaccgcaacgaaccccaacaauggguccucccauccuacucaggccggaacguacaaaacguccaccucgccccagccgucgcccccacguucccaggcgaacaacuccuauucuucagaucaaccaugcccggaugcuccggcuacccaaacauggaucucgacugucugcuuccacaagaauggguucaacacuucuaccaagaagccgcccccgcccaaagcgacgucgcacuacucagauucgucaaccccgauacaggccgcguacucuucgaauguaaacuucacaaaucuggcuauguuaccgucgcccacaccggccaacacgaccucguaaucccuccaaauggguacuuccgcuucgacucauggguaaaccaauucuacacacucgcacccaugggcaacggcaccggccgacgacgagcucuauaa

SEQ ID NO: 36534 - RNA, 1623 nt, Artificial Sequence
  derived and/or modified sequence opt11 from VP1__Norovirus__BAS30104
augaaaauggccuccaacgacgccaaccccuccgacggcuccgcagccaaccuagucccagagguuaacaacgaagucauggcccuggaaccugucguaggagcagccaucgccgcccccgucgcgggacagcagaacgucaucgaucccuggauacggaacaacuucguacaagccccaggcggcgaauuuaccguuucccccagaaacgcucccggcgaaauacucuggucagcaccccucgggcccgaccucaaccccuaccuaucucaccuagcccgaauguacaacggcuacgccggcggcuucgaaguacaagucauacucgccggaaacgccuucacagccggcaaaaucaucuucgccgccguacccccaaacuuccccaccgaaggacuuucccccucccaaguaaccauguucccacacaucaucguagacguccgccagcucgaaccaguccucauaccccuucccgacgucagaaacaacuucuaccacuacaaccaaucaaacgacucgacuauaaaacucauagcaaugcuauacacuccacuccgagcuaacaacgccggagaagacgucuucaccguaagcugccgaguauuaacccgccccuccccagacuuugacuucauauuccucgucccacccaccgucgaaucaagaaccaaacccuucaccguacccauccuaaccgucgaagaaaugaccaauucacgauucccaaucccccucgaaaaacucuucaccggacccucaagcgcauucgugguacaaccccaaaacggccgaugcacuaccgacggcguacuccucggcaccacccaauuauccccaguuaacauaugcaccuuccgcggcgacgucacacauaucgcaggcucccgcgacuacaccaugaaccuagcaucccucaacuggaacaacuacgacccaaccgaagaaauccccgcaccacuaggcacccccgacuucguaggaaaaauucaaggcguccucacucaaacaaccaaaggcgacggcucaacccgaggccacaaagccaccgucuacaccggcuccgcccccuucacccccaaacugggcuccguccaauucuccaccgacaccgaaaacgacuucgaaacccaccaaaacgccaaauucacacccguaggugucauucaagacgguuccaccacacaccgcaacgagccucagcaauggguacuccccucauacucagggagaaacgucccuaacguccaccucgcuccagcugucgccccaaccuuccccggcgaacaacuccuauucuuuaggucuaccaugccaggcugcucaggcuaccccaauauggaccuagauugccuacuaccccaggaauggguacagcacuucuaccaggaagcagcucccgcccaauccgacgucgcccugcuccgcuucgucaaccccgacaccggccgaguacuuuuugaaugcaaacuccauaaaagcggcuacgucaccgucgcccacacaggccagcacgaccucguaauucccccaaacggcuauuucagguucgacagcuggguaaaccaauucuacacacucgcccccaugggcaacggcaccggacgccgccgagcacucuaa

SEQ ID NO: 36535 - RNA, 1623 nt, Artificial Sequence
  derived and/or modified sequence opt11 from VP1__Norovirus__BAS30107
augaaaauggccucaaacgacgcaaauccaagcgacggcucaacagcaaaccucguccccgaaguuaacaacgaagucauggcgcucgaacccgucguaggcgccgcaaucgccgcccccgucgcuggccaacaaaacgucaucgaccccuggauccgcaacaacuucguccaagccccaggcggcgaguucaccguaagcccacgcaacgcccccggcgaaauccucugguccgccccgcucggccccgaccucaacccauaucucucccaucucgcccgcauguacaacggcuacgcaggcggcuucgaaguccaagucauccucgccggaaacgccuucaccgccggcaaaauaauauucgcagccgucccaccuaacuuccccacugaaggccucucaccaucccaagucaccauguucccccacauaaucgucgacguacgacagcuagaaccuguacucaucccucuuccugauguacgaaacaacuucuaccauuacaaccaguccaacgacuccaccaucaaacucaucgcaaugcuauacacaccccuucgagccaacaacgccggcgaagacguauuuaccguaucuugccgcguacuuacccgccccucaccagacuucgacuucaucuuccucgucccaccuaccgucgaaucacgcaccaaaccuuucacuguccccauccucaccgucgaagaaaugaccaacucccgcuuucccauaccacuugaaaaacuauucacaggcccuuccuccgcauucguaguacaaccccaaaacggccgcugcacaaccgacggaguccuccuaggcaccacucaacucucccccguaaacauaugcaccuuccgaggcgacguaacacacaucgccggcucgcacaacuacacuaugaaccucgccucacuaaacuggaacaacuacgaucccacugaagaaauccccgcaccacuaggcacccccgacuucgucggcaaaauccaagggguccucacccaaacaacaaaaggagacgguuccacacgagggcacaaagcuacagucuauacagguuccgcaccauucaccccaaaacuaggcuccguccaauucuccacugacacagaaaacgacuucgaaacccaccagaacaccaaauucaccccaguaggcguaauacaagacggcggcaccacccaccgaaaugaaccccaacaauggguccuccccuccuauagcggcagaaacguccagaacguccaccucgcucccgccgucgccccaaccuucccaggagaacaacuccucuucuuucgcucaaccaugccaggcugcuccggcuaucccaacauggaccucgacugccuccuaccccaagaauggguccaacacuucuaccaagaagccgcccccgcccaaucagacguugcccuacuccguuucgucaauccagacaccggcagaguccuauucgaaugcaaacuacacaaaucaggauacguuaccgucgcacacaccggccagcacgaccucgucaucccaccaaacggcuacuuccgcuucgacucguggguaaaccaauucuacacacucgcacccaugggcaacggcaccggccgccgccgcgcccuauga

SEQ ID NO: 36536 - RNA, 1623 nt, Artificial Sequence
  derived and/or modified sequence opt11 from VP1__Norovirus__BAS30110
augaaaauggccuccaacgacgcuaaccccuccgacggaucagccgccaaccuaguccccgaaguuaacaacgaagucauggcccucgaacccguaguuggugcagcuauagccgccccagucgcgggccaacaaaacgucaucgaccccuggauccgcaacaacuucguacaagcccccggcggcgaguucacuguaucaccccgcaacgcccccggcgaaauccucugguccgcaccccucggccccgaccuaaacccauaccucucccaucuagcccguauguauaacggauacgccggcgguuucgaaguacaagucauccuugccgguaacgccuucacagccggcaaaaucaucuucgccgcaguucccccaaauuuccccauagaaggccucucuccaucccaagucaccauguucccccacaucaucgucgacgugcgacaacucgaacccguucuaauaccucuaccagauguucgaaacaacuucuaucacuacaaccaauccaacgacuccacuaucaaacucauagccaugcucuacacaccccuacgcgccaauaacgccggcgaagacgucuuuaccgucuccugccgcguccucacacgacccuccccagacuucgauuucaucuuccucgucccacccacgguugagucccguaccaaacccuucaccguccccauucucacugucgaagaaaugacuaacucccgcuucccaaucccacuugaaaaacucuucacaggccccuccucagcauuuguaguccaaccccaaaacggccgcugcaccacagacggaguccuacucggaacaacccaacuaucaccaguaaacaucugcaccuuccgcggcgacgugacccacauugccggcucccgaaacuacaccaugaaccucgcgucccucaacuggaacaacuacgauccuaccgaagagauacccgcaccccucggcaccccagacuucgucgguaaaauucaaggcguccucacccaaaccacuaagggagacggcucaacccgcggccacaaagccacuguguacacaggaucagcgcccuucacacccaaacucggcucaguccaauucuccaccgacaccgaaaacgacuucgaaacccaccaaaacaccaaauucacaccaguaggagucauccaagacggcggcaccacccaccgcaacgaaccccaacaauggguccuuccuagcuacucaggacgcaacguccccaacguacaccucgcacccgccgucgcaccaacauuccccggcgaacaacuucuuuucuuccgcaguaccaugcccggaugcucuggauauccaaacauggaccuagacugccuacucccacaagaauggguccaacacuucuaccaagaagcagcucccgcccaaucugacgucgcccuccuccguuucgucaaccccgauaccggccgaguccucuucgaaugcaaacuucacaaauccggcuacgucaccguagcucacacaggccaacacgaccucgucauucccccaaauggcuacuuccgauucgauagcuggguuaaccaauuuuacacccuagcacccaugggcaacggaaccggccgaagacgagcccucuaa

SEQ ID NO: 36537 - RNA, 1623 nt, Artificial Sequence
  derived and/or modified sequence opt11 from VP1__Norovirus__BAS30113
augaaaauggcaucgaaugacgccaaccccucggacggcuccgcagcaaaccucguacccgaagucaacaacgaagucauggcacuagaaccagucgucggagcagcaaucgccgcccccguagcgggacaacaaaaugucauagaccccuggauacgaaacaacuucguccaagcccccggaggcgaguucaccgucucuccccgcaacgccccuggcgaaauccucugguccgccccacugggcccagaccuaaaccccuaucucucacaccucgcacgcauguacaauggcuaugccggcggauucgaaguccaagucauccuagccggaaacgccuucaccgccggaaaaaucaucuucgcagccgucccaccaaacuuccccacagaaggacucucacccucccaaguaacaauguucccccacaucaucgucgacguucgccaacuagaaccugugcucauaccucucccagacgugagaaacaauuucuaccacuacaaccaauccaacgacagcaccauaaaacuaaucgcaauguuauacacaccccuccgcgccaauaacgcaggagaagacguauucaccguuucuugccgcguacuaacccgucccuccccggacuucgacuucaucuuucugguuccacccaccgucgaaucccgcaccaaaccauucaccgucccuauccuaaccgucgaagagaugacaaacucaagauucccaauuccccucgaaaaacucuuuacuggacccucauccgccuucguaguccaaccccaaaacggacgaugcaccaccgacggaguccuccucggcacaacccaacucucccccguaaacaucugcaccuuccgaggcgacgucacccacaucgcaggcucgcgaaacuacaccaugaaccucgcaagccuaaacuggaacaacuacgauccuaccgaagaaauccccgcaccacuaggcacaccagacuucguaggcaaaauccaaggcguacucacccaaacaaccaaaggcgacgguucaacccgcggacacaaagccacugucuauaccggcuccgccccuuucacccccaaacucggcuccguccaauucuccacagacacagaaaaugacuucgaaacccaccaaaacaccaaauucaccccaguaggcgucauucaagacggcggcaccacacaccgcaacgaaccccaacaauggguccuccccucauacucaggacgcaacguccccaacguccaccuagcccccgccgucgcccccaccuuccccggcgaacaacuccuauucuuccgcuccacaaugcccggaugcagcggcuaccccaacauggaccuagacugcuuacuaccacaagaauggguccaacacuucuaccaagaagcagccccagcccaauccgacgucgcccuccuccguuucgucaacccugacacaggccgcguccucuucgaaugcaaacuccacaaauccggcuacguaaccguugcacacaccggccaacaugaccucgucaucccacccaacggcuacuuccgguucgacucgugggucaaccaauucuacacgcuagcacccaugggcaacggaaccggaagacgacgcgcccuauaa

SEQ ID NO: 36538 - RNA, 1623 nt, Artificial Sequence
  derived and/or modified sequence opt11 from VP1__Norovirus__BAS30116
augaaaauggcauccaacgacgcaaaccccagugacggauccgcagcaaaccuuguccccgaagucaacaacgaaguuauggcccuagaacccguugucggcgccgcaauagccgcccccguagcaggucaacagaacgucaucgaccccuggauaagaaacaacuuuguccaagcacccggaggcgaauuuacaguaagcccucgaaaugcccccggugaaauacuaugguccgcaccacucggccccgaccuuaaccccuauuuaucccaccuagccagaauguacaacggcuacgcaggcggcuuugaaguacaaguaauccuggccggcaacgccuucaccgccggaaaaaucaucuucgcagccgucccacccaacuuccccacagaaggacucucccccucccaagucaccauguucccucacaucaucgucgacguucgccaacucgaacccguccuuaucccccucccagacguccgcaacaacuucuaucacuacaaccaauccaacgauucaaccauaaaacucaucgccaugcucuacacaccccuacgcgcuaacaacgccggcgaagacguuuucacagucucaugccgcguucucacccgaccuucaccagacuuugacuucauuuuccucgucccucccaccgucgaauccagaaccaagcccuucaccguccccauccucaccguagaagagaugaccaacucucgcuuccccaucccccuagaaaagcuauucacaggacccucaucagccuucguuguccaaccccaaaacggcagaugcaccacagacggcguacuccuaggaacaacccaacucucacccgucaacaucugcaccuuccgcggagacgucacccacaucgccggcagccgcgauuacaccaugaacuuagcaucacucaacuggaacaacuacgacccaacugaagaaauaccggcgccccuaggcacccccgacuucgucggaaaaauccaaggcaugcucacccaaacaaccaaaggcgacggcuccacacgaggacacaaagccaccguuuacacaggcuccgccccauucacccccaaacuaggaucaguccgcuucucaacagauacagagaacgacuucgaaauacaccagaacaccaaauucacccccgucgggguaauccaagacgguucaaccacccaccgcaaugaaccccaacaauggguacuucccucauacuccggccgcgacgcccacaacguccaccuagccccagccgucgccccuaccuuccccggggaacaacuccuguucuuccgcagcacuaugcccggcugcuccggauacccaaauauggaccuagacugucuacucccucaagaauggguccaacacuucuaccaagaagccgcccccgcucaauccgacguagcccuucuccgcuucguaaaccccgacaccggccgcguccuuuucgagugcaaacuccauaagucaggcuacguuacagucgcccacacaggccaacacgaucucguaauaccaccaaacggcuacuuccgcuucgacucaugggucaaccaauucuacacacuugcccccaugggcaacggaacuggccgccgccgcgcccucuaa

SEQ ID NO: 36539 - RNA, 1623 nt, Artificial Sequence
  derived and/or modified sequence opt11 from VP1__Norovirus__BAS30119
augaaaauggccaguaacgaugcaaacccauccgacggcuccgccgcuaaccucguccccgaaguuaacaacgaaguaauggcacucgaaccagucgucggcgcagccauagccgcucccgucgccggccaacaaaacgucauugacccuuggauccgcaacaacuuuguacaagcacccggaggcgaguucaccguuucaccccgcaaugccccuggcgaaauccuaugguccgcccccuuaggccccgaccucaaccccuaccucucccaccuagccagaauguacaacgguuacgccggcggcuuugaaguccaagucauccucgcuggcaacgccuucacagccggcaaaaucaucuucgccgccguaccacccaauuuccccaucgaaggccuuucccccucccaagucaccauguucccccacaucauaguagacguccgccaauuagaacccguacuaaucccccuacccgacguccgaaacaacuucuaccacuauaaccaaagcaacgauucaacaaucaaacuuaucgccauguuauacacgccccuccgcgcuaacaacgccggcgaagacgucuucaccguauccugccgaguccuaacacgcccaucuccugacuucgacuucaucuuucucgucccacccaccguagaaucacgcaccaaacccuucacuguccccauacuaaccgucgaagaaaugaccaacucccgcuuccccaucccccucgaaaaacucuucacaggccccuccuccgccuucguaguccaaccccaaaacggacguugcaccacagacggaguccuccuuggaacaacccaacucucccccgucaauauuuguacauuccgcggcgacgucacccacauagccggaucaagaaauuacaccaugaaccuagccagccuuaacuggaauaauuacgaccccaccgaagaaaucccugccccucuaggaacccccgauuucguaggcaaaauccagggaguccucacccaaaccaccaaaggagacggcuccacgcgcggccacaaagcuaccguauacacagggagcgcgcccuucaccccuaaacuuggcuccguccaguucucaacagacaccgaaaacgacuucgaaacccaccaaaacacaaaguucacucccguuggcgucauccaagacggaggcacaacccaccgaaacgaaccccaacaauggguccuccccagcuacagcggcagaaacgucccaaacguccaccucgcccccgcagucgccccaaccuuccccggcgaacagcuccuuuucuuccgcuccacaaugccaggaugcucuggcuauccaaauauggaucuggacugucuauuaccccaagaauggguccaacacuucuaccaagaagccgcccccgcacaaucagacgucgcccuccuccgcuucgucaaccccgacaccggccgaguccucuucgaaugcaaacuccacaaaucaggcuacgucaccguagcccacaccggucaacacgaccucguaaucccacccaacggauauuuccgcuucgacuccugggucaaccaauucuacaccuuggcccccaugggcaacggcaccggacgccgccgagccuuauaa

SEQ ID NO: 36540 - RNA, 1623 nt, Artificial Sequence
  derived and/or modified sequence opt11 from VP1__Norovirus__BAS30125
augaaaauggccuccaacgacgcaaacccaucugacggaagcgccgccaaccucguaccagaagucaacaacgaagucauggcucuagaaccaguagucggcgccgccaucgcagcccccgucgccggacaacaaaacguaauagacccuuggauaagaaacaacuucguccaggcacccggcggcgaguucaccgucucaccacgaaacgcacccggagaaauacucugguccgcaccccucggacccgaccuuaaccccuaccucagccaccucgcccgcauguacaacggcuacgccggugguuucgaaguacaaguuauccucgcuggcaacgcauucacagcaggcaaaaucaucuucgcagccgucccacccaacuuucccaccgaaggucucucccccucccaaguaacuauguuuccacauaucaucgucgacguccgacaacucgaaccaguccuaauaccccuccccgacguccguaacaacuucuaccacuauaaccagagcaacgacuccaccauuaaacucauagcaaugcuauacacaccccuacgcgccaacaacgccggugaagacguauucacagucuccugccgcguacuaacacgccccucccccgacuucgacuucauauuccuaguuccacccaccguugaaucucgcacaaagcccuucaccguccccauccuuaccguagaagaaaugaccaacucccgcuuccccaucccccucgaaaaacucuucaccggucccuccuccgccuucgucguccaaccacagaacggacgcugcaccaccgacggcguccuccucggaacaacccaacucucaccugucaacaucugcaccuuccgcggcgacgugacccacaucgcaggcucccgcgacuacaccaugaaccucgcaucucuaaacuggaacaacuacgaccccaccgaagaaauaccugccccucucggcacccccgacuuugucgguaagauccaaggaaugcuuacccaaaccaccaagggcgacggcagcaccagaggucacaaggccaccgucuacaccggauccgcccccuucaccccaaagcucggcuccguccgauucucaacagacaccgaaaacgauuucgaaauccaccaaaacacaaaauucacaccagucggcgucauccaggacggcucuacaacccaucgaaaugaaccccaacaauggguuuugcccuccuacucagggcgagaugcacacaacguacaccucgccccagcaguugccccuacauuccccggagaacaacuccucuucuuccguuccaccaugcccggcugcuccggauaccccaacauggaccucgacugccuccucccccaagaauggguucaacacuucuaucaagaagccgcucccgcccaaucugacgucgcccuccuacgcuucgucaaccccgacaccggccgaguacucuucgaaugcaaacuccacaaauccggauacguaaccguagcccacaccggacaacacgaucucgucaucccucccaacggcuacuuccgcuucgacucuugggucaaccaauucuacacccucgcaccaaugggaaacggcaccggcagaagacgcguacuuuaa

SEQ ID NO: 36541 - RNA, 1623 nt, Artificial Sequence
  derived and/or modified sequence opt11 from VP1__Norovirus__BAS30128
augaaaauggccagcaacgaugccaacccauccgacggcuccgccgcaaaccucguccccgagguaaacaacgaaguuauggcccucgaacccguuguaggugcagcaauugcagcccccgucgccggccagcaaaacgucauugaucccuggauccgcaacaacuucguccaagccccagguggcgaguucacagucucucccagaaacgccccaggcgaaauccuuugguccgcaccccucggccccgaccuuaaccccuaccucucacaccucgcccggauguacaacggcuacgccgggggauucgaaguccaagucauacucgcuggcaacgcauucaccgccggaaaaaucaucuucgccgcaguaccaccaaacuucccuacagaaggacuaucaccaucacaagucaccauguucccccacaucauagucgacguccgccaacucgaacccguucucauaccguuacccgauguccgaaacaacuucuaccacuacaaucaauccaaugacuccaccaucaaacucauagccaugcucuacacaccccuccgcgccaacaacgcaggcgaagacgucuucaccguauccugccguguccucacccgccccucccccgacuucgacuucaucuuccuugucccacccacugucgaaucccgcaccaaacccuuuacaguccccauccucaccgucgaagaaaugacaaacucgcgcuuucccaucccacuugaaaaacucuucacaggcccauccucagccuucguaguacaaccccagaacggccgcugcaccacggacggaguucuccuaggcaccacccaacucagcccaguuaacaucugcaccuuucgcggcgaugucacccacaucgccggcucccgaaacuacaccaugaaccucgcaucccucaacuggaacaacuacgaccccacagaagaaauccccgccccacucggcacacccgacuucgucgguaaaauacaaggcgucuuaacccaaacuaccaaaggcgacggcuccacccgcggccacaaagcuacgguauacacaggcagcgcccccuucacacccaagcucggcuccguacaauucucaaccgauacagaaaacgacuucgaaacccaccaaaacaccaaauucacaccagucggcguuauacaggacggaggcacaacccaucgcaaugaaccccaacaauggguauuaccaagcuacuccggacgaaacguccccaacguccacuuagcccccgccgucgcccccacuuuccccggcgagcaacuacucuuuuucagaucuaccaugccaggcugcucuggcuaccccaacauggaccuagacugccuccuaccccaagaauggguccaacacuucuaccaagaagccgccccugcccaaucagacguagcccugcuccgcuucgucaaucccgacacuggcagaguccuauucgaaugcaaacuccacaaaucaggauacgucacagucgcccacacuggccaacacgaucucgucaucccaccgaacggcuacuuccgcuucgacuccuggguaaaccaauucuacacacuagcccccaugggaaacggcaccggaagacgccgagcucuauaa

SEQ ID NO: 36542 - RNA, 1623 nt, Artificial Sequence
  derived and/or modified sequence opt11 from VP1__Norovirus__BAS30134
augaaaauggccuccaacgaugccaaccccuccgacggcuccgccgcaaaccucguaccagaagucaacaacgaaguaauggcacuggaacccguggucggcgccgcgaucgccgccccugucgccggccaacaaaacgucaucgacccuuggauacgaaacaauuuuguccaagccccuggcggcgaguucaccguaucaccccgaaaugcccccggcgaaauccucugguccgccccucucggcccagaccucaacccauaccuaucacaccucgcucgaauguauaacggcuaugccggcgguuucgaaguccaaguaauucucgccggcaacgccuucaccgcgggaaaaaucaucuucgccgccgucccacccaauuuccccaccgaaggacuaucccccucccaaguaacaauguucccccacauaaucguggacgucagacaacuagaacccguacuaauaccccuuccagauguccgcaacaacuucuaccacuacaaccagucaaacgacuccaccaucaaacucaucgccaugcucuacaccccacuacgagcaaacaacgccggugaagacguauucacaguuuccugccgcguccucacccgccccucacccgacuucgacuucauauuucucguaccaccuaccgucgaaucccgaacaaaacccuucaccguucccauccuuacaguugaagaaaugaccaacagccgauuccccauuccacuggaaaaacuguucaccggccccaguucagccuucgucguacaaccccaaaacggccgaugcaccacagacggaguccuacuaggcacuacacaacucuccccugucaacaucugcaccuuccgcggcgacgucacccauaucgccggcucacgcaacuacacaaugaaucuugccucccucaacuggaacaacuacgaccccacggaagaaaucccagcaccccucggcaccccugauuucguuggaaaaauccaaggaaugcuuacccaaaccaccaaaggagacggauccacccgaggacacaaagcaacugucuauaccggcagcgcacccuucacccccaaacucggcucaguccaguucaguaccgacaccgaaaacgacuucgaaacccaucaaaacacuaaauucacacccgucggcguaauccaagacggcuccacuacacaccgcaacgaaccccagcaauggguccucccuagcuauuccggccgcgauguccccaacguccaccuagcccccgccguagcccccacuuucccuggcgaacaacuauuauucuuccgauccaccaugccaggaugcuccggauaccccaacauggaccuagacugccuccucccccaagaauggguccaacacuucuaccaagaggccgccccagcccaaucagacguugcacuacuacgcuucgucaaccccgacacaggccgcguacuauucgaaugcaaacuacacaagucaggauacguaacaguagcacacaccggccaacacgaccuaguaaucccacccaacggauauuuccgauucgacuccuggguuaaccaauucuacacacucgccccuaugggcaauggcaccggacgacgccgagcccucuaa

SEQ ID NO: 36543 - RNA, 1623 nt, Artificial Sequence
  derived and/or modified sequence opt11 from VP1__Norovirus__BAS30137
augaaaauggcauccaacgacgcuaaccccucggacgguucugccgccaaccucguccccgaaguaaacaacgaagucauggcccucgagcccgucgucggcgccgcaaucgccgcacccgucgccggccaacaaaacguaaucgaccccuggauacgcaacaacuucguccaagccccuggcggcgaguucacagucucaccuagaaaugcccccggugaaauucuauggucggcaccccucggcccagaucucaaccccuaccucucacaccucgcccgcauguacaacggcuacgccggcggcuucgaaguccaagucauacucgcaggcaacgcauuuaccgccggaaaaauaaucuucgccgcuguucccccaaacuucccaacagaaggacucuccccaucacaagucacaauguucccccacaucaucguggacguccgacagcucgaacccguccuuaucccucuccccgauguccgcaacaacuucuaccauuacaaccaauccaaugacucaaccaucaaacucauagccaugcuauacacaccccuccgcgcuaacaacgcuggcgaagacgucuucaccgucucaugccgagugcuuaccagaccgucucccgacuucgacuucauauucuuagucccucccacagucgaaucacguaccaaacccuucaccguacccauucucaccguugaagaaaugacaaacucgcgauuccccaucccgcuagaaaaacucuuuaccggaccaucauccgccuucgucguucaaccccaaaacggacgaugcaccaccgacggcguccuccucggcaccacccaacuaucccccguuaacauaugcacauucagaggcgacgucacccacauugccggcucccgcaacuacaccaugaaccuagccucccuaaauuggaacaacuacgaccccacagaagagauccccgcaccccucggaacccccgacuucgucggcaaaauccaaggcguccucacccaaaccaccaagggcgacggcagcacccgcggacacaaagccaccgucuacaccggcagcgcccccuucaccccaaaacuaggaagcguacaauucuccaccgacaccgaaaaugacuucgaaacccaccaaaacaccaaauucaccccugucggcgucauacaagacggcggcaccacccaccgaaaugaaccacaacaguggguccucccauccuacuccggccgaaacguacccaacguccaucucgcccccgccgucgcacccaccuuccccggcgaacaacuccuauucuuucgcuccaccaugcccggcugcagcggcuaccccaacauggaccuagacugucuccucccacaagaaugggugcaacacuucuaccaagaagcagccccggcacaaucagacgucgccuuacuccgauucgucaaccccgacaccggccgcguacucuucgaaugcaagcuccacaaauccggcuacgucaccgucgcccacaccggacaacacgaccuaguaauaccucccaauggcuacuuccguuucgacuccugggugaaccaauuuuacacacuugcacccaugggcaacggcaccggucgccgacgugcacuauag

SEQ ID NO: 36544 - RNA, 1623 nt, Artificial Sequence
  derived and/or modified sequence opt11 from VP1__Norovirus__BAS30140
augaaaauggcauccaacgacgccaaccccuccgauggcuccgccgccaaccuaguccccgaagucaacaacgaagucauggcccucgaacccgucgucggcgcugccaucgcagcccccgucgccggccaacaaaacguaaucgaccccuggauucgcaacaacuucguacaagcccccggcggcgaguucacagucagcccccggaaugcucccggcgaaauccucuggucagccccucuaggaccugaccugaaccccuaccucucucaccucgcacgaauguacaacgguuacgccggaggcuucgaaguucaagucauauuagccggaaacgccuucaccgccggaaaaaucaucuucgccgccgucccacccaacuuccccaccgaaggacucucccccucccaagucaccauguucccccacaucaucguagacguccgccaacucgaacccguucucauaccauuacccgacguccgcaacaacuucuaccacuacaaucaaucuaacgacucaacaaucaaacuaauagccaugcuuuacacaccccuccgcgccaacaacgcaggcgaagacgucuucacaguauccugcagaguccuaacacgaccaucacccgacuucgacuucauauuccucgucccacccacagucgaaucccgcaccaagcccuucacggucccaauccuaacuguagaagaaaugaccaacucaagauuccccauaccacuagaaaaacuauucaccgguccaucaucagccuuuguaguccaaccgcaaaauggccgaugcaccacagacggcguucuccucgguaccacccaacucagcccagucaacauuugcaccuuuagaggcgacguaacccacaucgcuggcucacgaaacuauacaaugaaccucgcaucccucaacuggaacaacuacgaccccaccgaagaaauccccgcaccccucggcaccccugacuucgucggaaaaauccaaggaguccuaacccagaccaccaaaggcgacggcuccacucgcggucacaaagcaaccguauacacaggaucagccccguucacacccaaacucggcuccguccaauucagcaccgacaccgaaaaugacuucgaaacccaccaaaacaccaaauucacucccguuggcgucauacaagacggcggaacuacacaccgcaaugaaccacaacaauggguccuccccuccuacucaggccgcaauguacccaacguucaccucgccccugccgucgccccuacauucccaggagagcagcuccucuucuucagaucgaccaugcccggcugcagcggcuaccccaacauggaucucgacugccuacuuccccaggaauggguacaacacuucuaccaagaagccgcccccgcccaaucagacguagcacuccuaagauucgucaaccccgacaccggccgaguccuuuucgaaugcaagcuccacaaaucuggcuacguuaccgucgcacauacuggacaacacgaccucgucaucccacccaauggauacuuucgcuucgauuccugggucaaccaauucuacacucuugcccccaugggcaacggcaccggccgccgccgcgcacucuga

SEQ ID NO: 36545 - RNA, 1623 nt, Artificial Sequence
  derived and/or modified sequence opt11 from VP1__Norovirus__BAS30146
augaaaauggcauccaacgacgccaaccccucugacggauccgccgcgaaccuaguccccgaaguaaacaacgaagucauggcccucgaacccgucgucggcgccgccaucgccgcccccgucgccggccaacaaaaugucauagaccccuggauccgcaacaacuucguccaagcccccggcggcgaguucaccgucucaccccguaacgcccccggcgaaauccuaugguccgcaccccuuggacccgaccuuaaccccuaccuaucacaccucgcccgcauguacaacggcuacgccggcggcuucgaaguucaagucaucuuagccgguaacgcauucaccgccggcaagaucauauucgccgccguaccacccaacuuccccaucgaaggacuaagccccucucaagucacaauguucccccacaucaucgucgacguccgacaacuugaacccguccuaaucccccuccccgacguccgaaacaacuuuuaccacuacaaucaauccaacgacucgaccauaaaacuuaucgcuaugcuuuacacaccccuccgagccaacaaugccggcgaagacguuuucacugucuccugccgcguccucacccgccccucccccgacuucgacuucaucuuccuugucccacccaccgucgaaucccgcaccaaacccuucacuguccccauacucaccgucgaagagaugaccaacucacguuuccccaucccccucgaaaaacuguucaccggucccucaucugccuucguaguccaaccacaaaacggccgcugcaccacagacggaguacuccucggcaccacccaacuauccccuguaaauaucugcacauuccgcggagacguaacccacaucgcuggaucgcacaacuacaccaugucucucgcaucacucaacuggaauaacuacgacccaacagaggaaaucccagcaccccucggcaccccagacuucgucggcaaaauacaagguguacuaacccaaaccacaaaaggcgacggcucaacccgcggccacaaagccaccguauacaccggcuccgcucccuucacacccaaacuaggcucgguccaauuuuccacagacacagaaaacgacuucgaaacccaccaaaacaccaaauucacacccguaggcguuauccaagacggcggcaccacccaccgcaacgaaccccaacaauggguccucccgucauacuccggcagaaacgucccaaacguacaccuagccccagccgucgcucccacuuucccaggcgaacaacuacucuucuucagauccaccaugcccggcugcucuggauacccaaacauggaccucgacugucuacuaccccaagaauggguccaacacuucuaccaagaagccgccccugcccaguccgacguagcacuccuacgcuucgucaaccccgacaccggucgcgucuuauucgaaugcaaacuccacaaaucaggcuacgucaccgucgcccacaccggacaacacgaccucguaauaccacccaauggcuacuuccguuucgacuccugggucaaccaauucuacacccucgcacccaugggcaacggaaccggacgccgacgagcacucuaa

SEQ ID NO: 36546 - RNA, 1623 nt, Artificial Sequence
  derived and/or modified sequence opt11 from VP1__Norovirus__BAS30149
augaaaauggccucuaacgacgccaauccauccgauggcuccgccgccaaccuaguacccgaagucaacaacgaagucauggcccucgaaccaguagucggagccgccauagcagcaccagucgccggccaacaaaacguaaucgacccauggaucagaaacaacuuuguccaagcccccggcggcgaguucacagucucgccccgcaaugccccaggcgaaauccuuugguccgcaccccuuggcccugaucucaacccauaccucucccaccucgccagaauguacaacggcuacgcaggcggauucgaaguccaagucauucuagcaggcaaugccuucaccgccggaaagaucaucuucgcggccguaccacccaacuuccccaccgaaggccucucgcccucccaagucacaauguucccccauauaaucgucgacguccgucaacuggaacccguucucauccccuuaccugauguacgcaacaacuucuaccacuacaaccaauccaacgacagcaccaucaaacucauagcuaugcuguacacuccauuaagagccaacaacgccggagaagacgucuucacaguaagcugccgcguacuaacccgcccaucucccgacuucgauuucaucuuccucguacccccaaccgucgaaucccgaacaaaacccuucaccguccccauccucacagucgaagaaaugacuaacucccgcuucccuaucccccuagaaaaacucuucacagguccauccucagccuucgucguccaaccccaaaauggccgauguaccacagacgguguccuacucggaaccacacaacucucccccgucaacauaugcaccuuccgcggagacgucacccacaucgccgggucucgaaacuacaccaugaaccucgcgucccuaaacuggaacaacuacgaccccaccgaagaaauccccgcaccucucggcaccccagacuucguagggaaaauccaagguguacuaacccaaaccacaaaaggugacggauccacccgcggccacaaagcaaccgucuacaccggaagcgcccccuucacaccaaagcucggauccguccaguuuuccacagacaccgaaaacgacuucgaaacacaccaaaacaccaaauucacaccaguaggaguaauccaagauggcuccaccacccaccgcaacgaaccccaacaauggguacuccccucguacucaggccgcaacguccccaacguccaccuagcccccgccgucgccccaaccuuccccggagaacagcuauuauucuuccgcucgaccaugccgggcugcucaggcuacccuaacauggaccuugacugccuacuaccccaagaauggguacaacacuucuaccaagaagccgcccccgcacaauccgauguagcucuccuccgcuucgucaaccccgacacaggccgcguccuauucgaaugcaaacuucacaaaucuggcuacgucaccguagcacacacuggacaacacgacuuaguaauacccccaaacggcuacuuccgcuucgacucauggguaaaccaguuuuacacccucgcccccaugggaaacggcacaggacgcagacgcgcccucuga

SEQ ID NO: 36547 - RNA, 1623 nt, Artificial Sequence
  derived and/or modified sequence opt11 from VP1__Norovirus__BAS30152
augaaaauggccuccaacgacgcaaacccuuccgacggcuccgccgcaaaccucgucccggaagucaacaacgaaguaauggcccucgagcccgucguaggcgccgccaucgccgccccuguagccggacagcaaaacgucaucgaccccuggauccgcaacaacuucguacaagcaccaggcggcgaguucacaguaucuccacgcaacgcacccggcgaaauccucugguccgcaccccucggcccugaccucaacccauaccucucccaccucgcccgcauguacaacggcuacgccggcggcuucgaaguacaagucauccucgccggaaaugccuucacagcaggaaaaaucaucuucgccgcagucccacccaacuuuccuaccgaaggccucagccccagccaagucacuauguuuccccacaucaucguugacguacgacaacucgaaccuguacucaucccccucccagacguccgaaacaacuucuaccacuacaaccaauccaacgacuccaccaucaaacuuaucgccaugcuauacacaccccuccgcgcuaacaacgcaggcgaagacguuuucacagucuccugucgcguccuaacccgacccucccccgacuucgacuucaucuuccucguaccaccuaccgucgaaucacguacaaaacccuucaccguucccauccuaaccgucgaagaaaugaccaacagccgcuucccaaucccccucgaaaaacucuucacaggccccucauccgcauucguaguacaaccacagaacggacguugcaccacggacggcguacuccucgguaccacucaacucuccccaguaaacaucugcaccuuccgcggugacguaacacacauagcaggcucccgaaacuacaccaugaaccucgccucacucaacuggaacaacuacgacccaacagaagaaauccccgcaccccucggcacccccgacuucgucggaaaaauccaaggcguccucacccaaacuaccaaaggagacggguccaccagaggccauaaagccaccgucuacaccggauccgcgcccuucacaccaaaacuaggcucuguccaauucuccaccgacaccgaaaacgacuucgaaacacaccaaaacacgaaauucacccccgucggcguaauucaagacggcggcacaacacaccgcaaugaaccacaacaauggguucuaccaucauacuccggacgaaacguccccaauguccaccucgcccccgccgucgcccccaccuuccccggagagcaacuccucuucuuccgaucuaccaugccaggcugcucaggauaccccaacauggaccucgacuguuuacuuccacaagaauggguacaacacuucuaccaggaagccgcccccgcccaauccgacgucgcucuccuccgcuucgucaaccccgacaccggacgaguccucuucgaaugcaaacuucacaaauccggguacgucacaguugcccacacuggucaacacgaccucgucaucccacccaacggcuacuuccgauucgacagcugggucaaccaauucuacacccucgcccccaugggaaauggcaccggacgacgccgagcccuauag

SEQ ID NO: 36548 - RNA, 1623 nt, Artificial Sequence
  derived and/or modified sequence opt11 from VP1__Norovirus__BAS30155
augaaaauggcauccaacgacgcaaaccccagcgauggcuccgccgcuaaccucgucccggaagucaacaacgaagucauggcccuugaaccagucgucggugcggccaucgcagcuccagucgcuggccagcaaaacgucaucgacccauggauccgcaacaacuucguccaagcacccggcggagaguucacagucucacccagaaacgccccuggcgaaauccuaugguccgcuccccuaggccccgaucuaaacccauaccucagccaccuagcccgaauguacaacggcuaugcaggcggcuucgaaguccaagucauacuagcaggcaacgccuucacugccggcaaaauaaucuucgccgccguucccccaaacuuucccacugaaggacuaucccccagccaagucaccauguucccucacaucaucguagacguccgccagcucgaaccaguccucauaccccuacccgacguccguaacaauuucuaccauuacaaccaaagcaacgacucuacaaucaaacuaaucgccaugcuguacaccccacuacgggcaaacaacgccggagaagauguauucaccguaucuugccgcguccuuacccgacccucccccgauuucgacuucauauuccuagucccacccaccguagaaucccgcacaaaacccuucacuguccccauauuaaccgucgaagaaaugaccaacucccgcuuccccaucccccucgaaaaacucuucaccggccccuccggcgcauucguaguacaaccucaaaacggaagaugcacaaccgacggcguucuacucggcaccacccaauuaucccccgucaacauaugcacauucaaaggagacguaacccacaucgcaggaucccgaaacuacacaaugaaccuagccucccuaaauuggaacaacuacgaccccacugaagaaauacccgcaccccucggcacccccgacuuugucggcaaaauccaaggaguacucacacagaccaccaaaggagauggcuccacccgcggccacaaagcaacaguauacaccggcuccgcaccuuucacuccaaaacucggcuccguacaauucuccaccgacaccgaaaacgacuucgagacccaccaaaacacuaaauucacccccguaggcgucauccaggacggcggcaccacacaccagaacgaaccccaacaauggguccuccccuccuacuccggacgagacguaccaaacguccaccuugccccagccguagcacccaccuuucccggcgaacaacuccucuucuuccgcucaaccaugccuggcugcuccggauaccccaacaugaaccucgacugccuucucccacaagaauggguccaacacuucuaccaagaggcagccccugcccaauccgacgucgccuuacuccgauucguaaacccugacaccggacgcguccuuuucgaaugcaagcuacacaaauccggauacguaacggucgcccacaccggccaacacgaccuagucauacccccaaacggcuacuuucgauucgacuccuggguaaaucaauucuacacccucgcccccaugggaaacggcaccggaagacgacgcgcacucuaa

SEQ ID NO: 36549 - RNA, 1623 nt, Artificial Sequence
  derived and/or modified sequence opt11 from VP1__Norovirus__BAS30158
augaaaauggccucuaacgacgccaacccgucagacggcuccgccgccaaccuaguccccgaaguaaacaacgaagucauggcccucgaacccgucguaggcgcugccaucgccgcccccguagcaggccaacaaaacgucaucgacccuuggauacgaaacaacuucguacaagccccaggaggagaauuuaccguaucaccaagaaaugcaccaggcgaaauccucuggucagcaccccuaggccccgaccucaacccauaccuaucacaucucgcccgcauguacaacggcuacgccggcgguuucgaaguccaagucauacucgcaggcaacgccuucaccgcaggaaaaaucauuuucgccgcaguaccacccaacuuccccaucgaaggccucucacccucccaaguaaccauguucccucacaucauaguugacguacgccaacuagaacccguccucauaccacucccagacguacgaaacaacuuuuaucacuacaaccagcucaaugauucuaccaucaaacucaucgccaugcucuacaccccucuccgcgcaaacaacgcaggcgaagacgucuucaccgucuccugccgcguccuaacccggcccucccccgacuucgacuucaucuuccuugucccuccuaccgucgaaagccgaaccaagccauucaccguacccauccucaccguagaagaaaugacaaacucgcgauuucccauaccccuagaaaaacucuucaccggacccuccuccgcauucguaguccaaccacaaaacggccgcugcaccaccgacggaguccuauuaggcaccacccaacuaucacccgucaacaucugcaccuuccgaggcgacgucacccacaucgcuggcucccgcaauuauacaaugucccucgcaucacucaacuggaacaacuacgaccccaccgaagaaauaccggcaccccuaggcacccccgacuuuguagguaaaauacaaggaguacuaacacaaaccacaaaaggcgacggaucaacacgaggucacaaagccacugucuacacaggcagcgcccccuucacccccaaacuagguuccguacaguucucaaccgacacagaaaacgacuucgaaacccaccaaaacacaaaauucacccccguaggagucauccaagacggaggaaccacacaccgaaaugaaccccaacaauggguccuaccauccuacucaggacgcaacguacccaacguucaucuagccccggccguugccccaacuuuccccggcgaacaacuccucuucuucagauccaccaugcccggcugcagcggauaccccaacauggaccuagauugccuccucccccaagaauggguccaacacuucuaccaagaagcagccccagcacaaucagacguagcccuccuccgcuuugucaacccggacaccggccgcguccuuuucgaauguaagcuccacaaaucaggcuaugucacagucgcucacaccggacaacacgaccuagugaucccaccgaacggcuacuuccgcuucgacucaugggucaaccaauucuacacccuagcacccaugggaaacggaacuggccgccgccgcgcccucuag

SEQ ID NO: 36550 - RNA, 1623 nt, Artificial Sequence
  derived and/or modified sequence opt11 from VP1__Norovirus__BAS30164
augaaaauggccuccaacgacgccaacccguccgacggcuccgccgccaaccucguccccgaagucaacaaugaagucauggcacuagaacccgucguuggcgccgccaucgccgcacccguugccggccaacaaaaugucaucgaccccuggaucagaaacaacuucguccaagcuccuggcggcgaguucaccguuucaccacguaacgcccccggcgaaauccucuggucagcacccuugggacccgaucuaaaccccuaccuuucccaccucgcccgcauguacaacggauacgcaggcggcuuugaaguccaagucauacucgcuggaaacgccuucaccgcaggcaagaucaucuucgcagcaguaccucccaacuuccccauagaaggucucucccccucccaaguaaccauguucccccauaucaucgucgacguccgccaacuugaaccgguccuaauaccccuacccgacguccgcaacaacuucuaccacuauaaccaauccaacgacuccacaaucaaauuaauagccaugcucuacacaccccucagagccaacaacgcuggcgaagacgucuucacagucuccugucgaguacuaacgcgcccaucucccgacuucgacuuuaucuuccucgucccacccaccguugaaucccguaccaaaccauucacggucccaauccucacagucgaagaaaugacuaacucucgcuucccaaucccccucgaaaaacuuuucacaggcccuuccuccgcauucgucguacaaccacaaaacggccgcugcacaaccgacggaguccuccucggcaccacucaacucucccccgucaacauaugcaccuuccgcggagacgucacacacaucgccggcucgcgcaauuacaccaugucgcucgcaucccuuaacuggaacaacuacgaccccaccgaagaaauccccgcaccccucggcaccccagauuucgucggaaaaauccaaggcguccuaacucaaaccaccaaaggcgacggcucaacccgcggccacaaagccacugucuacacaggcuccgccccauuuacacccaaacucggauccguccaauucuccaccgacaccgaaaacgauuucgaaacccaccagaauaccaaauuuacccccguaggaguuauccaagacggcggaaccacccaccgcaacgaaccacaacaauggguccucccaucauauuccggccgcaacguccccaacguccaccucgccccagccgucgcccccacguuccccggcgaacagcuccuauucuuccgauccacaaugcccggcugcuccgguuacccaaacauggaccuugauugccuccuaccccaagaauggguccaacacuucuaccaagaagccgcacccgcacaaucggauguagcccuacuacgcuucguaaacccugacaccggccguguacuauucgagugcaaacuccacaaaagcggauaugucaccguagcacacacuggccaacacgaccuagucaucccacccaacggcuauuuccgauucgacagcugggucaaucaauucuacacccuagcccccaugggcaacggcaccggccgacgucgugcccuauga

SEQ ID NO: 36551 - RNA, 1623 nt, Artificial Sequence
  derived and/or modified sequence opt11 from VP1__Norovirus__BAS30167
augaaaauggccucaaaugacgcuaaucccuccgacggauccgccgccaaccucguccccgaagucaacaacgaaguaauggcccucgaacccguagucggcgccgcaauagcagccccuguagccggccaacaaaacguaauagacccauggauccguaacaacuucguccaagccccaggaggugaguucaccgucagcccccgaaacgcccccggcgaaauccucugguccgccccacuaggaccagaucucaaucccuaccucagccaccuugcacgcauguacaacggguacgccgguggcuucgaaguacaagucauacucgccggcaaugccuucaccgccggaaaaaucauauucgcagcaguaccaccaaacuuccccaccgaaggccucucccccucucaaguuacaauguucccucacauaauaguagacgucagacaacucgaacccguucucauaccccuccccgacguccgaaacaacuucuaccacuacaaccaaucgaacgacagcaccaucaaacucaucgccaugcucuacacaccccuuagagcaaacaacgccggagaagacgucuuuaccguuuccugccgcguccucacccgucccucccccgacuucgacuucaucuuccucgucccuccaaccgucgaaucccgcaccaaaccauucaccgucccuauccuaaccgucgaagaaaugaccaacucacgcuuccccauaccacucgaaaaacuauucaccggccccuccucagccuucgucguccaaccccaaaacggccgcugcaccaccgacggaguacuucuugguaccacacaacucucccccguaaacaucugcaccuuccgcggcgauguaacccauaucgccggaagccgaaacuacacgaugaaccuugccucacucaacuggaacaacuacgaccccaccgaagaaauacccgcaccccuaggcacaccagacuucgucggcaaaauccaaggcguccuuacacaaacaacuaaaggcgacggcucaacacgcggccacaaagcaaccguauacaccgguuccgcccccuucacuccaaaacucggauccguccaauucucaacagacaccgaaaacgauuuugaaacacaccaaaauaccaaauucacacccgucggcguuauucaagacggaagcaccacccaccgaaaugaaccccaacaauggguccuccccucauauuccggccgcaacguucccaacguccaccuugcacccgcugucgccccaaccuuccccggagaacaacuccuauucuuccgaucaaccaugcccggcuguuccggcuauccaaacauggaccuugacugccuccucccccaagaauggguucaacacuucuaucaagaagccgccccugcacaaucagacguugcccuacuccgcuucgugaaccccgacacuggccgaguccucuucgaaugcaaacuccacaaauccggcuacguaacagucgcacauaccggccaacacgaccucgucaucccacccaacggcuacuuccgcuucgacuccuggguaaaccaauucuacacccucgcccccauggggaacgguacuggucgacgacgugcccucuaa

SEQ ID NO: 36552 - RNA, 1623 nt, Artificial Sequence
  derived and/or modified sequence opt11 from VP1__Norovirus__BAS30170
augaaaauggcauccaacgacgcaaaccccuccgacggcuccgccgcuaaccucguucccgaggucaacaacgaaguaauggcccucgaacccgucguaggcgcagcuaucgcagcccccgucgcaggccaacaaaacguuauagaccccuggauccgaaacaacuucguucaagcccccggaggcgaguucaccgucucuccacgcaacgcuccaggagaaauccuauggagcgccccacuaggcccagaccucaacccuuaccuaucacaccuagcacgcauguacaacggcuacgccggcggauucgaaguccaaguuauacuagccggaaacgccuucaccgccggcaaaaucaucuucgcagccgucccacccaacuucccaacagaaggacuaucucccucacaaguaacaauguucccccauauaauagucgacguccgccaacuagaacccguccucaucccccuccccgacguacgaaacaacuucuaccacuacaaccaaucaaacgacuccacaauaaaacucaucgcaauguuauacacaccucuccgagcaaauaacgcaggcgaggacguauucaccgucuccugcagaguacucacccgccccuccccagacuucgacuucauuuuccucguacccccgaccgucgaaucucgcaccaaaccuuucaccguacccauacucacuguagaagaaaugacaaacucccgauucccuauuccccucgaaaaacuauucacaggccccucauccgccuucgucguacaaccacaaaauggccgaugcacgacagacggaguacuccucgggaccacccagcucucccccgucaauaucugcaccuuccgcggugacgucacccacauagccggcucccgcaacuacacaaugaaucuagccucccugaacuggaacaacuaugaccccaccgaagaaaucccagcaccccuaggcacacccgacuuugucggcaaaauucaagggguccucacacagaccacgaaaggcgacggcuccacccgcggacacaaagcuacagucuacaccggcuccgcacccuucacccccaaacucggaucaguacaauucucuaccgacaccgagaacgacuucgaaacccaccagaacaccaaauucacgccagucggcgucauccaagacggcggcaccacccaccgaaacgaaccccaacaauggguacuaccaucauacucuggacgcaacguccccaacguacacuuagcccccgcagucgcacccacauuccccggcgaacagcuccuauucuuccgcuccacaaugcccggcugcuccggauaccccaacauggaccucgacugucuucuaccccaagaauggguucaacacuucuaccaagaagccgcccccgcccaaagcgacgucgcccuccuccgcuucguaaacccugacaccgggcgaguacucuucgaaugcaaacuccacaaaucaggcuacguaacuguagcacacacuggccaacaugaucucguaaucccacccaauggcuacuucagauucgacuccugggucaaccaguucuacacgcuagcacccauggguaauggcaccgggcgacgacgagcucucuaa

SEQ ID NO: 36553 - RNA, 1623 nt, Artificial Sequence
  derived and/or modified sequence opt11 from VP1__Norovirus__BAS30173
augaaaauggccuccaacgacgccaaccccuccgacggcuccgcagcaaaccucguccccgaagucaacaacgaaguaauggccuuagaacccguaguaggugccgccaucgccgcccccgucgccggacaacaaaacgucaucgacccauggauccgcaacaacuucguccaagcccccggcggagaauuuaccguaucgccccgcaacgcacccggcgaaauccuaugguccgcaccccuaggcccugacuuaaaccccuaccuaucccaccucgcccgcauguacaacggauacgcaggcgguuucgaaguccaagucauacucgcaggcaaugcauucaccgcaggcaaaaucaucuucgcagcaguaccaccaaacuuccccacagaaggccuaucuccaucccaagucaccauguucccccacaucaucgucgacguccgccaacuagaaccuguccucaucccacuaccagacguacgcaacaacuucuaccacuauaaccaauccaacgacuccacaaucaaacuaaucgcaaugcuauacacuccacugcgcgccaacaacgccggcgaagacguuuuuaccgucagcugccgcgugcucacucgcccauccccugacuucgacuuuauauuccuagucccacccaccguugaaucacgcaccaaacccuucaccguacccauccucaccgucgaagaaaugacaaacucacgauuccccaucccccucgaaaaacucuuuaccggccccagcuccgcguucguaguacaaccccaaaacggccgcugcaccaccgacggcguacuccucggcaccacccaacucagccccgucaacaucuguaccuuccgaggugacgucacacacauagccggaucaagaaacuacaccaugaaccucgccagucuaaauuggaacaacuacgaccccacagaagaaauccccgcuccccucggcacccccgacuucguaggcaaaauccaaggcguauuaacacaaacuacaaaaggcgacggauccacccgaggacacaaagccacggucuacaccggcuccgccccauucaccccaaaacucggcucuguccaguucuccaccgacacagaaaacgacuucgaaacccaccaaaauacaaaauucacacccgucggcguaauucaagacggcggcacuacccacagaaacgaaccucaacaauggguacuccccucauacucaggccgcaacguccccaacguacaccucgcacccgccgucgccccuacauuccccggagaacaacuacucuucuuucgaucaacuaugcccggaugcucaggcuaccccaacauggacuuagauugccuacucccccaagaguggguucaacauuucuaucaagaagcagcccccgcacagucagacgucgcccuccuccgauucgucaaucccgacaccggucgcguccucuuugaaugcaaacuacacaaaagcggcuacguaaccgucgcccacacuggacaauacgaccucguaaucccaccaaacggcuacuuccgcuucgacucgugggucaaucaauucuacacccuagccccaaugggcaacggcaccggccgccgacgcgcccuuuaa

SEQ ID NO: 36554 - RNA, 1623 nt, Artificial Sequence
  derived and/or modified sequence opt11 from VP1__Norovirus__BAS30176
augaaaauggcaucuaacgacgcaaacccauccgacggcucugccgccaaccuaguaccugaagucaacaacgaaguaauggcccucgaaccagucgucggagccgccaucgccgcaccagucgccggacaacaaaacgucaucgaccccuggauacgaaacaacuucguacaagcaccaggcggugaguucacugucucaccacgaaacgcuccaggagaaacccucuggucagccccucucggcccggaccuaaacccauaccucucucaccuagcccgcauguacaacggauaugccgggggcuuugaaguccaagucauacuagccggcaacgcauucacugcgggaaaaauaaucuuugccgcaguacccccaaacuucccaaccgaaggucuauccccgucccaagucacaauguucccccacaucauugucgacguccgucaacucgaacccguccucauaccacucccagacguccgcaauaacuucuaccauuacaaccaauccaacgacuccaccauuaaacuaaucgccaugcuauacaccccacuuagagcaaacaaugcgggcgaagacgucuucacaguuuccugccgaguccuaacccgccccucaccagacuucgacuucaucuuccuaguacccccuacagucgaaagccgaacaaagcccuucaccguccccauacuaacaguggaagaaaugacaaacucccgcuuccccaucccccuugaaaaacuauucacgggccccuccuccgccuucguaguacaaccacaaaacggacgaugcacuaccgacggcguacuccuaggcacaacccaacuaucacccgugaacauaugcaccuuccggggcgacgugacccacauagcaggcucccgcaacuacaccaugaaccucgccucccucaacuggaacaacuacgacccuaccgaagagauccccgcaccccuaggcaccccugacuucgucggcaaaauccaaggcaugcucacgcaaaccaccaaaggcgacggcuccacacgcggccauaaagccaccgucuacacuggauccgcccccuucacucccaaacucgguuccguccaauucuccaccgacaccgaaaacgauuucgaaacacaccaaaacacaaaauucaccccaguuggaguuauccaagacggcuccacaacccaccgcaacgagccacaacaauggguccuacccuccuacuccggccgcaacgucccaaauguccaccucgccccagccgucgcccccacauuccccggcgaacaacuccucuuuuuccguagcaccaugcccggaugcagcggcuacccgaacauggaucucgacugccuccucccacaagaguggguccagcacuucuaccaagaagcagcucccgcccaauccgauguagcccuacugcguuucgucaaccccgacacaggacgcguccucuucgaaugcaaacuacacaaaucuggcuacgugacugucgcacacaccggccagcacgaccucguaauaccacccaacggcuacuuccgcuucgacuccugggucaaccaauucuacacccuagcccccaugggcaacggcaccggcagacgccgcgcacucuaa

SEQ ID NO: 36555 - RNA, 1623 nt, Artificial Sequence
  derived and/or modified sequence opt11 from VP1__Norovirus__BAS30179
augaaaauggccucaaacgacgcuaaucccagcgacggcuccgccgcaaaccuaguaccagaaguaaacaacgaagucauggcgcuggaacccgucguuggcgcggcaauagccgcaccgguagccggccagcagaacgucauagaccccuggauacgcaacaacuucguccaagcccccggaggagaauuuaccguauccccacgaaacgcccccggcgaaauccuaugguccgcaccccucggcccagaucuuaaccccuaccucucacaccucgcccgaauguacaacggcuacgccggcggcuucgaaguccaagucauacucgccggcaacgccuucaccgccggcaaaaucaucuucgcagcaguaccacccaacuuccccaccgaaggacucucucccucgcaaguaacuauguucccccacaucaucguagacguacgacaacuagagcccguccucaucccccuccccgacguccgcaacaacuucuaccacuacaaccaaucaaacgacucaacaauuaaacugauagccaugcucuacacaccacucagagcaaauaacgcaggcgaagauguauucaccgucuccugucguguccucacacgccccagcccugacuucgacuucaucuuccucguucccccaaccgucgaaucccgcacuaaaccuuucacaguacccaucuugacugucgaagaaaugacuaacucacgauuccccauaccacucgaaaaacucuucacugguccuucuuccgccuucguaguacaaccacagaacggacgcugcacaacagacggacugcuacucggcaccacccaacucucccccgucaauauaugcacauuccgcggcgacgucacucauauagccggaucccggaacuacaccaugaaccuugcuucccuuaacuggaacaacuacgaccccacagaagaaauccccgcgccccuaggcacaccagacuucguuggaaaaauacaaggcaugcuuacucaaacaaccaagggagacggcuccacacgcggacacaaagccacagucuacacaggauccgcaccauucacacccaaacucggcucuguccaauucuccaccgauaccgaaaacgacuucgaaacacaccaaaacaccaaauucacucccgucggcgucauacaagacggcucgacaacccacagaaacgaaccccaacaauggguccuacccucauacuccggacgaaacguccccaacguucaccuagccccugccgucgcaccaaccuuccccggcgaacaacuacuauucuuccgcuccacaaugccugguugcuccggcuaccccaacauggaccucgacugccuccucccccaagaguggguacagcacuucuaccaagaagccgcccccgcucaaucugacgucgcccuccuccgauucgucaaccccgauaccggccgcguacucuucgaaugcaaacuccacaaauccggauacgucacagucgcccacaccggccaacacgaccucguaaucccacccaacggauacuuccguuucgacucgugggucaaccaauucuacacacuagcacccaugggcaacggcacaggccgccgacgugcccucuaa

SEQ ID NO: 36556 - RNA, 1623 nt, Artificial Sequence
  derived and/or modified sequence opt11 from VP1__Norovirus__BAS30182
augaaaauggccuccuccgaugccaaccccuccgacggcucugccgccaaccuagucccagaagucaacaacgaagucauggcccucgaaccagucguaggcgccgccauagcagcccccgucgccggacaacaaaacgucaucgaccccuggauccgcaacaauuucguccaagcccccgguggcgaguucaccgucagcccccgaaacgcccccggcgaaauccuaugguccgcaccccucggacccgaccucaaucccuaccucucacaccucgcccgcauguacaacggcuaugccggcggcuucgaaguacaaguaauccucgcaggaaacgcauucaccgccggaaaaaucauuuucgcagccgucccacccaacuuccccaccgaaggccuuucaccuucgcaagucacuauguucccccacaucauugucgacguccgacagcucgaacccguacucauaccccuccccgacguacguaacaacuucuaccauuacaaccaauccaacgacaguaccaucaaacucaucgcaaugcuuuacacaccacuacgcgccaacaacgccggcgaagacgucuucaccgucuccugccgcguccuaacacgacccucccccgacuuugacuucauauuucucgugccucccacagucgaaucacgcacaaaacccuucaccguccccauacucaccgucgaagaaaugaccaacucccgauuccccauaccccucgaaaaacuauucaccggccccucuucagcauucgucguccaaccccaaaacggccgaugcaccaccgacggcguccuccuuggcaccacacaacucagucccguuaacauaugcaccuuccgcggcgacgucacccacauagcaggcucccgagacuacacaaugaaccuagccucccuaaacuggaacaacuaugacccuaccgaggaaauccccgcccccuuaggcacccccgacuuuguuggcaaaauacaaggcaugcuaacccaaaccaccaaaggugacggauccacccguggccauaaagccaccgucuacaccgguucagcuccuuucacccccaaacucggguccguacaauuuucuaccgacaccgaaaacgacuucgaaacccaccaaaacaccaaauucacucccguuggcgucauccaagacggcuccaccacucaccgcaaugaaccccaacaauggguccuacccuccuacucaggccgcaacguaccuaacguccaucucgcccccgccgucgcccccaccuucccaggcgaacaacuccuauucuuccgcuccacuaugcccggcugcuccggcuaucccaacauggaccuagauugccuacucccucaagaauggguacaacacuucuaccaagaagcagcaccagcccaaucagacguugcccuccuccgcuucgucaaucccgacaccggccguguacuauucgaguguaaacuccacaaaucagguuauguaaccgucgcacacacuggccaacacgaucuugucauuccgcccaauggcuauuuccgauucgacucuugggucaaccaauucuacacccuagcccccaugggaaacggcaccggccgccgccgcgcccuguaa

SEQ ID NO: 36557 - RNA, 1623 nt, Artificial Sequence
  derived and/or modified sequence opt11 from VP1__Norovirus__BAS30185
augaaaauggccucauccgacgcaaacccuuccgacggcucggccgccaaccuugugccagaagucaacaacgaagucauggcccucgaacccgucguaggagcagccaucgccgccccaguagcuggacaacaaaacguaaucgaccccuggaucagaaacaacuucguacaagcccccggcggcgaguucacagucucaccccgcaacgcaccuggugaaauccucugguccgccccucucggccccgaucucaaccccuaccucucccaccuugcccgaauguacaacgguuacgccggcggcuuugaaguccaaguaauccuagccggcaacgcguuuaccgcuggaaagaucauauucgcagccguaccgcccaacuucccaacugaaggccucucccccucccaagucaccauguucccccacaucaucgucgacguccgacaacucgaaccuguccuaaucccccucccagacguccguaacaacuucuaccacuacaaccaauccaacgacucaacaaucaaacuaaucgcuaugcuauacacaccccuccgcgccaacaacgccggagaagacgucuucaccguauccugccgaguccucacccgcccaucccccgauuuugacuucaucuuccucguuccacccaccgucgaaucccgcaccaaacccuucaccguccccauccucaccgucgaagaaaugaccaacucccgcuuccccaucccauuagaaaaacuauuuaccggcccguccuccgcuuucguaguucagccccaaaacggccgcugcaccaccgacggcguauuacucggcaccacucaacuaucccccguaaacaucugcaccuuccgaggcgacgucacccacaucgccggcucccgaaacuacacaaugaaccuagcgucccuaaacuggaacaacuacgaccccaccgaagaaaucccagcuccccuuggcacgcccgacuucgucggcaaaauacaaggcaugcucacccaaaccaccaaaggcgauggaucaaccagaggccacaaagccaccguauacaccggcucagcccccuucaccccaaaacucggcucaguccaauucuccaccgacacagaaaacgacuucgaaacccaccaaaacacaaaauucacccccguaggaguuauccaagacggaucgaccacacaccgcaacgaaccacaacaauggguccucccuuccuauagcggucgcaacguacccaauguacacuuagccccagccguagcccccacauuccccggcgaacaacuacuuuucuuccgcucaacaaugcccggaugcucaggcuaccccaacauggaccucgacugccuccucccucaagaauggguccaacacuucuaccaagaggcagccccggcccaauccgacguagcccugcuaagauuugucaacccagacacaggccgaguccuguucgaaugcaaauuacacaaaucuggcuaugucacaguagcacacacuggccaacacgaccuagucaucccaccuaacggcuacuuccgcuucgacuccugggucaaccaauucuacacacuugccccaaugggcaacggaaccggccgccgucgagcccucuaa

SEQ ID NO: 36558 - RNA, 1623 nt, Artificial Sequence
  derived and/or modified sequence opt11 from VP1__Norovirus__BAS30188
augaaaauggccucauccgaugccaacccuuccgacggcuccgcagcaaaccucguccccgaagucaauaaugaaguuauggcccucgaacccgucguaggcgcagccaucgcugcuccuguagcuggccaacaaaacgucaucgaccccuggauccgcaacaacuucguacaagccccuggcggcgaauuuaccgucaguccccguaacgccccaggugaaauucuaugguccgcaccccuaggccccgaccuaaaucccuaccuaucacaccuugcccgaauguacaacggcuacgcuggcggcuucgaaguacaagucauccuggccggcaacgccuucaccgcuggaaaaauuaucuucgccgcaguaccaccaaacuucccaacagaaggccucuccccaucccaagucaccauguucccacacaucaucgucgacguccgccaacucgaacccguccuaaucccacuccccgacguacgaaacaacuucuaccacuacaaccaauccaaugacuccaccauaaaacucaucgccaugcuuuacacaccccuccgggccaacaacgccggcgaagaugucuucaccgucucuugccgcguccucacccgccccucccccgacuucgacuucauauuucucgucccucccacagucgaaucucgcaccaaacccuucaccguccccauccuaacaguagaagaaaugaccaacucacgcuucccaauuccauuagaaaaauuauucaccggaccgucauccgcauucgucguucaaccccaaaauggaagaugcacaacagacggcguccuacucggcaccacccaauuaucaccaguaaacaucugcaccuuccgaggcgacgucacgcacaucgccggcagccgcaacuacaccaugaaccucgccucccucaacuggaacaacuacgaccccaccgaagaaauccccgcuccccuaggcacaccagacuucguuggcaaaauccaaggcaugcucacccaaacaacuaaaggugacggcuccacccgaggccauaaagccaccguauacaccgguucagcuccauuuacccccaaacucggcucaguccaguucucaaccgauaccgaaaacgacuucgaaacacaucaaaacaccaaauucacacccgucgguguuauacacgacggcucgaccacccaccgcaacgaaccccaacaauggguccuacccucauacuccggacgaaacguccccaauguccaccucgcgcccgcagucgcacccaccuuccccggcgaacaacuccucuucuuccgaagcacaaugcccggcugcuccggcuaccccaauauggaccuagacugccuacucccccaagaauggguacaacauuuuuaccaggaagccgcccccgcccaauccgacgucgcccuacuccgcuucguuaacccagacaccggucgcguacuauucgaaugcaaacuucacaagucuggcuacgucaccgucgcucacaccggacaacacgaccucguaauaccucccaacggcuacuuccgcuucgacagcugggugaaccaauucuauacccuugcacccaugggcaacggaaccggccgccgccgcgcacucuaa

SEQ ID NO: 36559 - RNA, 1623 nt, Artificial Sequence
  derived and/or modified sequence opt11 from VP1__Norovirus__BAS30191
augaaaauggccuccaacgacgccaacccuuccgacgguucagcugcaaaccucguacccgaaguaaacaacgaagucauggcccuagaacccgucgucggcgccgccaucgccgcaccagucgcaggccaacaaaacgucaucgaccccuggauccggaacaacuucguccaggcacccggcggagaguucaccguaucaccccgcaacgcaccaggagaaauccuauggucagcuccccuaggcccagaccucaaccccuaccuuucccaucuugcccgaauguacaacggcuacgccggcggcuuugaaguacaagucauccuagccggaaacgccuucacagccggcaaaauaaucuucgccgcuguacccccaaacuucccaaccgaaggccucucccccucccagguaacaauguucccacacaucaucgucgacguccgccaacuagaaccgguccuaauaccacugccagacguacgcaacaacuucuaccacuacaaccaauccaacgauuccacaaucaagcucaucgccaugcucuacacuccccuucgcgcaaacaacgccggcgaagacgucuuuacugucuccugccguguacuaacacgcccaucccccgacuucgacuucaucuuccucguuccucccacagucgaaagucgaaccaaacccuucaccguucccauccucaccgucgaagaaaugaccaacucccgauuccccaucccccuagaaaaacucuucacagguccaaguuccgccuucguuguccaaccacagaacggucgaugcaccaccgacggaguccuccucggcaccacccaacuaucccccgucaacaucugcaccuuccgcggcgacgucacccacauagcagguagccgcaacuacaccaugaaccucgcuagccuaaacuggaacaacuacgaccccaccgaagaaauccccgccccacuaggaacacccgacuuugucggcaaaauccaaggcguacucacccaaaccacaaaaggcgauggaagcacacguggccacaaagccaccgucuacaccggauccgcaccuuucaccccaaaauuaggcaguguccaauucggaaccgacacugaaaacgauuucgaaacacaucaaaacacuaaauuuacucccguaggcguuauccaagauggcggaacaacacaccgcaacgaaccucaacaaugggugcuccccuccuacagcggucgcaacgucccaaacguccaccucgcccccgcugucgcccccaccuucccaggagaacaacuccucuucuuccgcucaaccaugccuggaugcuccggcuaccccaacauggaccuagacugccuccucccccaagaauggguucaacacuucuaccaagaagcagccccagcccaauccgacgucgcccuccuccgauucgugaaccccgauacaggacgcguccuauucgaaugcaaacuacacaaaucaggcuacguaacagucgcucacacaggccaacacgaccucguaaucccacccaacggguacuucagauucgacuccugggucaaccaauucuacacuuuagcccccaugggcaacggcaccggacgacgccgagcccucuaa

SEQ ID NO: 36560 - RNA, 1623 nt, Artificial Sequence
  derived and/or modified sequence opt11 from VP1__Norovirus__BAS30194
augaaaauggccuccaaugacgccaaccccucugacggguccgccgcaaaccucguacccgaaguuaacaacgaagucauggcccuugaaccggucgucggcgcagcaaucgccgccccagucgccggccaacaaaacguaaucgaccccuggauucgaaacaauuucguccaagcacccggaggcgaguuuacagucucaccccgcaacgcccccggcgaaauacucugguccgcaccccucggccccgacuuaaauccauaccuuucacaucuagcccgcauguacaacggcuacgcaggcggauucgaaguccaagucauacuagccgguaacgccuucaccgccgguaaaaucauuuuugcagcggucccacccaacuucccgaccgaaggccuaucacccagccaagucaccauguucccccacaucaucguagacguccgccaacuagaacccgucuuaauaccccuccccgacguacgcaacaacuucuaccacuacaaccaaucaaacgacucaaccaucaaacuaaucgcaaugcucuacacaccccuccgagcaaacaacgcaggagaagacgucuucaccgucuccugcagaguccuaacacgccccucaccagacuucgacuucaucuuccuaguaccaccaacugucgaaagcagaacaaaaccauucaccgucccaauccucaccguugaagaaaugaccaauagccgcuuccccaucccccuggaaaaacucuucacuggccccuccuccgccuucgugguccaaccccaaaacggccgaugcaccaccgacggggucuuacucggcaccacccaacucuccccaguaaacauaugcaccuuccgaggugauguaacacacaucgcaggaagccgcaacuacaccaugaaccucgcuucacuaaacuggaacaacuacgaccccacagaagaaauccccgcaccacuuggcaccccagacuucgucggaaaaauacaaggcgucuuaacccaaacuacaaaaggcgacggcuccacacgcggccacaaagcgaccgucuacacaggcuccgcacccuucacacccaaacucggcagcguacaauucggaacagacacagaaaacgacuuugaaacccaucaaaacaccaaauucacccccgucggcgucauccaagacggcggcacaacacaccggaacgaaccccaacaauggguccucccguccuauuccggacgaaacguccccaacguacaccucgccccagcagucgcacccaccuuccccggcgagcaacuccuauucuuucgcucaacaaugcccggcugcagcggauaccccaauauggaccuagacugccuacuaccccaagaauggguccaacacuucuaccaagaagcggcacccgcccaauccgacgucgcccuccuacgauucgucaaccccgacaccggccgcguccuauucgaaugcaaacuucacaaauccggauacguuaccgucgcccacaccggacaacacgaccuggucaucccaccuaauggauacuuccgauucgauuccugggucaaccaauucuacacacucgcccccaugggaaacggcacaggccgucggcgcgcucucuga

SEQ ID NO: 36561 - RNA, 1623 nt, Artificial Sequence
  derived and/or modified sequence opt11 from VP1__Norovirus__BAS30197
augaaaauggccuccaacgacgccaaccccuccgacggcucugcugccaaccucguaccagaagucaacaacgaaguuauggcgcuagaacccgucgucggcgcagcuaucgcugccccagucgccggccaacaaaacguuauagacccauggaucagaaacaauuucgugcaagcaccuggcggcgaguucacagucuccccacgcaacgcacccggcgaaauccucugguccgcuccccucggacccgaccucaaucccuaccucucccaccucgcccgcauguacaacggcuacgcuggcggauucgaaguccaagucauccuagccggaaaugccuucaccgccggcaaaaucaucuucgccgcaguacccccaaacuuccccaccgagggccucucccccucucaagucaccauguucccacacauuauagucgacguccgccaacucgaacccguccucaucccccuacccgacguccgcaacaacuucuaccacuacaaccaaagcaacgacucaaccauuaaacucaucgcaaugcucuacacaccccuccgagcaaacaacgccggcgaagacgucuucaccguaagcugccggguccucacccgccccuccccugauuucgacuucauauuccucgucccaccuaccgucgaaucccguaccaaaccauucaccguaccgauccuuacaguagaagaaaugaccaacucccgauucccaauccccuuggaaaaacucuucaccggacccuccucagcauucguaguccaaccccaaaacggccguugcacaaccgacgguguccuccucgguaccacccaguuaucccccguuaacauaugcacauuccgcggagacgucacccacaucgcaggcucccguaacuacaccaugaaucucgcuagccucaacuggaacaacuacgauccaacagaagaaauccccgcaccccuuggaacccccgacuucguaggcaaaauacaaggaguucucacccaaacaaccaaaggcgacggcuccacccgcggucacaaagccacagucuauaccggcucagcuccauucacccccaagcucggguccguccaauucggaacugacaccgaaaacgacuucgaaacucaccaaaacaccaaauucaccccuguaggcgucauccaagacggcggcacaacccaucgaaacgaaccccaacaauggguccucccauccuacuccgggagaaacguccccaacguccaccuagcccccgccguagcccccacauucccaggagaacagcuccuguucuuccgcuccaccaugccgggaugcuccggcuaucccaacauggaccucgacugccuacuaccccaagaauggguccaacacuucuaccaggaggcagcuccagcccaaucagacguagcccuccuucgcuucgucaacccagacaccggacguguucucuucgaaugcaagcuccauaaauccggcuacguaaccguagcacacacaggccaacacgaccucguaaucccacccaacggauauuuccgauucgacuccuggguaaaccaauucuacacucucgcacccaugggcaacgguacaggacgucgccgugcacuguga

SEQ ID NO: 36562 - RNA, 1623 nt, Artificial Sequence
  derived and/or modified sequence opt11 from VP1__Norovirus__BAS30200
augaagauggccucaaacgacgccaaccccucagacggcuccgccgccaaccucguccccgaggucaacaacgaagucauggcccuagaacccgucgucggagccgccaucgcugcucccgucgcaggccaacaaaacguaaucgaccccuggauccgcaacaacuucguccaagcccccggcggcgaguucaccguauccccacgaaacgccccuggugaaauccucugguccgccccacucggacccgaucucaaucccuaccucagccaccuagcccgcauguacaacgguuacgccggcggcuuugaaguccaagucauacuagccggcaacgcauucaccgccggcaaaauaauuuucgcugccgucccgccaaacuuccccaccgaaggucuaucccccucccaagucacgauguucccccauauaaucgucgacgucagacaacucgaacccguccucauaccccuaccagacguacgcaacaacuucuaccacuacaaucaauccaacgacuccaccauaaaacucauagcaaugcuauacacaccccucagagccaacaacgccggcgaagacgucuucacaguauccugccgcgugcucacccgacccucacccgacuucgacuucauauucuuaguaccacccaccgucgaauccagaacaaaacccuucacaguacccauccuaaccguagaagaaaugaccaauucaagauucccuauaccacucgaaaaacuauucaccggacccuccuccgccuucguaguucaaccccaaaacggccgcugcaccaccgacgggguccuacuaggcaccacccaacuauccccagucaauaucugcacauuccgcggcgacgugacacacaucgcaggaucccguaauuacacaaugaaccucgcaucacucaacuggaacaacuacgaccccacagaagaaauccccgccccacuaggcacccccgacuucguaggcaaaauacaaggaguccuaacccaaaccaccaaaggcgacggcuccacccgaggccacaaagcuacagucuacacaggcuccgcccccuucacccccaaacucgguuccgugcaauucggcaccgacaccgaaaacgauuucgaaacgcaccaaaacaccaaauucacccccgucggcguuauacaagacggaggcacaacucaccgcaaugaaccccaacaauggguacuccccucauauuccggccguaaugucccaaacguccaccucgcaccagccguagcccccaccuuccccggagaacaacuccucuucuuccgcuccaccaugccaggcugcuccggauaccccaacauggaccuagacugccuacucccccaagaauggguucagcacuucuaccaagaagcugcaccagcucaauccgacgucgccuuacuccgcuucgucaaccccgacacuggucgcguccuauucgaaugcaaacuccauaaaucaggauacgucaccguagcgcacacaggccaacaugaccucgucauaccacccaacggauacuucagauucgacuccuggguaaaccaauucuacacccucgcacccaugggcaacggaaccggacgacgcagagcccuauga

SEQ ID NO: 36563 - RNA, 1623 nt, Artificial Sequence
  derived and/or modified sequence opt11 from VP1__Norovirus__BAS30203
augaaaauggcaucaaacgacgcuaacccaagcgauggcucagccgccaaccucguccccgaagucaacaacgaggucauggcccucgaacccgucguaggagcagcuaucgcugccccaguagccggccaacaaaacgucaucgaccccuggauccgcaacaacuucguccaggcccccggcggugaguucaccgucuccccacgcaacgccccaggcgaaauacucugguccgcaccccuugggcccgaccuuaaccccuaccucucccaccuagcccgaauguacaacggcuacgccggcggauucgaaguccaaguaauccucgccggcaacgcauucaccgcaggaaagaucauauucgccgccgucccucccaauuucccaaccgaaggcuuaucacccucccaaguuaccauguuuccccacaucauaguugacguacgucaacuagaacccguccucauaccccuacccgacguacguaacaauuucuaucacuacaaccaauccaacgacuccaccaucaaacuaaucgcaaugcucuacacaccccucagagccaacaacgccggggaagacguauuuaccgucaguugccguguccucacccgaccauccccugacuucgacuucaucuuccuugucccucccacagucgaaucacgcacuaaacccuucaccguccccaucuuaaccguagaagaaaugacaaacucacguuuccccaucccacuggaaaaacuuuucacaggccccucauccgccuuugucguacaaccccaaaacggacgcugcaccaccgacgguguccuucucggcacaacacaauuauccccagucaacauaugcaccuuccgcggagacgucacccacaucgccggcucccgaaacuacacgaugaaucuagccucccuaaacuggaacaacuaugacccaaccgaagaaauaccagccccucucggaaccccagacuucguaggcaaaauccaaggcguacuaacccaaaccaccaaaggcgacgguuccacccgcggccacaaagcaacuguauacaccggcucagcacccuucacuccaaaacuaggcuccguccaauucgggaccgacaccgaaaacgacuucgaaacccaccaaaacaccaaguuuacccccgucggcguuauccaagacggcgguaccacccaucgcaacgaaccacaacaauggguccuaccaucauacuccggccgaaauguccccaacguccaccuagcucccgccgucgcucccaccuucccaggagaacaacuccuauucuuccgcucaacaaugccaggaugcucuggcuaccccaacauggaccuugacugccuacuaccccaagaauggguucaacauuucuaccaggaagcggcccccgcccaauccgacguagcacuccuacguuucgucaacccagacaccggccggguccucuucgaaugcaaacuccacaagucuggauaugucacagucgcacacaccggccaacacgaucuuguaauacccccaaacggauauuucagauucgacucaugggucaaccaauucuacacccucgcucccaugggcaacggcacgggccgcagacgcgcccuauaa

SEQ ID NO: 36564 - RNA, 1623 nt, Artificial Sequence
  derived and/or modified sequence opt11 from VP1__Norovirus__BAS30206
augaaaauggcaucaaacgaugccaacccauccgacggcucagccgccaaccuaguccccgaagucaacaacgaaguaauggcacucgaacccguaguuggagccgcuaucgccgcaccagucgcuggacaacaaaacguaaucgaccccuggauccgcaacaacuucguccaggcccccgguggcgaauuuaccguaucuccacgcaacgccccaggagaaauccucugguccgcaccccuaggccccgaccuuaaccccuaccuaucccaccucgcccgcauguacaauggcuacgcuggaggcuucgaaguacaaguaauccucgcaggcaaugccuucaccgcaggcaaaaucaucuucgcagccguaccacccaacuuccccacagaaggccucucacccucccaagucacaauguucccccacaucaucguagacguaagacaacuugaacccguccucauaccccuacccgacguccgcaacaacuucuaccacuacaaccaaucaaaugacagcacaaucaaacucaucgcaaugcuuuauacgccccuacgcgccaacaacgccggagaagaugucuucaccgucuccugcagaguuuuaacccgaccaucacccgacuucgacuucauauucuuggucccuccuacagucgaaucacgaaccaaacccuuuaccgugcccauacucaccguagaagaaaugaccaauucccgauuccccaucccacuggaaaaacucuucacaggcccauccuccgccuucgucguccaaccacaaaacggccgcugcacaacagacggcguacuacucggcaccacccagcucucccccgucaacaucugcacauucagaggagaugucacccauaucgcaggcagccgcaacuacacuaugaaccucgccucucucaacuggaacaacuacgaccccaccgaagaaauccccgcaccccucggcacaccagacuuugucggaaaaauacaaggaguccucacacaaacaacaaaaggcgacggaucaacccgcgggcacaaggcgaccgucuacaccggcagcgccccauucacaccaaaacucggcaguguacaguucggcaccgacacagaaaacgacuucgaaacccaccaaaacaccaaauucaccccugucggcgucauacaagaugguggcacaacccaccguaacgaaccccaacaauggguccuucccuccuacuccggccgcaacguaccaaacguccaucucgcacccgccguugcccccacauucccaggagaacagcuacucuucuuccgcucaaccaugcccggaugcagcggauaccccaacauggaccucgacugccuccucccccaagaauggguccaacacuucuaucaagaagcagcacccgcccaauccgacgucgcccuauuacgcuucgucaaccccgacaccggccgaguccucuucgaaugcaaacuucacaaaagcggauacguaacaguagcacacaccggacaacacgaccucguuauucccccaaauggcuacuuccgauucgacuccuggguuaaccaauucuacacgcucgcccccauggguaacggcaccggccgccgccgagcccuuuag

SEQ ID NO: 36565 - RNA, 1623 nt, Artificial Sequence
  derived and/or modified sequence opt11 from VP1__Norovirus__BAS30209
augaaaauggcguccaacgaugcuaauccauccgacggaucugcagccaaccucgucccagaaguaaacaacgaaguuauggcacucgaaccuguagucggcgccgccauagcagcacccgucgccggccaacaaaacgucaucgaccccuggauacgaaacaacuuuguacaagcaccaggcggagaguucaccgucuccccacgcaacgccccaggagaaauacuaugguccgcaccccucggucccgaccuuaacccuuaccucucccaccuagcacgcauguacaacggcuacgcaggcggcuucgaaguccaagucauccuugccgguaacgcauucaccgcaggaaagaucaucuucgcagcagucccucccaacuuccccaccgaaggacucucacccucccaaguaacaauguucccccacaucaucgucgacguccgccaacuagaacccguacuaauacccuuacccgacgucagaaacaacuucuaucacuacaaucaaucaaacgacucaacaaucaagcuaaucgcaaugcucuacacuccccuaagagcaaacaacgccggcgaagacgucuucaccgucuccugccgcguacucacccgccccucaccagacuucgacuucauuuuccucguucccccaaccgucgaaagccgcaccaaacccuucacaguccccauccuaacagucgaagaaaugaccaacucccguuucccgauaccacucgaaaaacucuucacaggcccaucauccgccuucguaguacaaccucaaaacggucgcugcacgaccgacgggguccuccuaggcacaacacaacucuccccagucaacauaugcaccuuucgcggagaugucacccauaucgcaggaucccgaaauuacaccaugaaccucgcaucacucaauuggaacaacuacgaccccaccgaagaaguaccugcuccccuaggaacccccgacuucgucgguaaaauacaaggaguccucacccaaacaaccaaaggcgacggcucuacacgaggacacaaagccaccgucuacaccggauccgccccauuuaccccaaaacucggcucgguccaauucuccaccgacaccgaaaacgacuucgaaacccaccaaaauaccaaauucaccccaguaggagucauacaagacggcuccaccacacaccgaaacgaaccccaacaauggguccuccccagcuacuccggaagagacguacccaacguccaccucgccccugcagucgccccaacauucccaggagaacaacuccucuucuuccgauccaccaugcccggaugcuccggauaccccaacauggaccucgacugccuucuaccccaagaauggguccaacacuucuaccaagaagccgcuccagcacaauccgacgucgcccuccuccguuucgucaaccccgacaccggccgcguacuauucgaaugcaaacuacacaaauccggauacgucacagucgcccacaccggccaacacgaccuagucauacccccaaacggauacuuccgcuucgauuccugggucaaccaauucuacacccucgcccccaugggcaacggcaccggccgaagacgagcccuauag

SEQ ID NO: 36566 - RNA, 1623 nt, Artificial Sequence
  derived and/or modified sequence opt11 from VP1__Norovirus__BAS30212
augaaaauggcaucuaaugacgccaaccccuccgacggauccgccgccaaccucguccccgaaguuaacaacgaagucauggcccucgagcccgucguuggcgccgccaucgccgcucccgucgccggccaacaaaacguaaucgacccauggauccgcaacaacuucguccaagcuccaggcggagaguucacuguuucaccccgcaacgcccccggcgaaauccucugguccgcgccacucggccccgaccucaacccauaucucucacaccucgcccgaauguacaacggcuacgccggcggauucgaaguccaaguaauccuagccggcaacgccuuuaccgcggguaaaaucaucuuugcagcagucccacccaacuuucccaccgaaggacuaucacccucccaagucacaauguuuccccacaucaucgucgacguacgccaacucgaacccguccucaucccccuccccgacguucgaaacaacuucuaccacuacaaccaaaguaacgacuccaccaucaaacuaaucgcaaugcucuacacaccccuccgcgcuaacaacgcaggcgaagacgucuucaccgucucaugccgcguucuaacucgcccuucccccgacuucgacuucaucuucuuggucccacccaccgucgaaucucgaacuaaacccuucacaguccccauucucaccguagaagaaaugacaaacucucgauucccuaucccucucgaaaaacucuucaccggcccuuccucagcauucgucguucaaccacaaaacggccgcugcaccaccgacggcguacuccuagguaccacccaacucuccccaguaaacaucugcaccuuccgcggugacgucacccauaucgcuggcucacguaacuacacaaugaaucucgccucucucaacuggaacaacuacgacccaaccgaggaaauccccgcaccccucggaaccccugacuucguaggcaagauucaaggcguacuaacccaaacaacuaaaggagacgguagcacacgcggccacaaggccaccguauacaccggcucugccccauuuacgcccaaacuugggucgguacaauucuccacugacaccgaaaacgacuucgaaacccaccaaaacaccaaauucacgcccguaggagucauccaagacggagguaccacccaccgaaacgaaccucaacaauggguccucccuuccuacuccggacgcgaugucccaaacguccaccuugccccugccgucgccccaaccuuccccggagaacaacuccucuucuuccgcuccaccaugcccggcugcucgggcuaccccaacauggaccucgacugccuccucccccaagaauggguacaacauuucuaucaagaagccgcacccgcccaaucagauguagcccuccuacgcuucgucaacccagacacaggucgcguccuuuucgaaugcaagcuccauaaaucuggcuacgucacugucgcccacaccggccaacaugaccuugucaucccucccaacggauacuuccgcuuugacuccugggucaaccaauucuacacccucgcacccaugggcaacgggaccggccgccgcagagcacuauaa

SEQ ID NO: 36567 - RNA, 1623 nt, Artificial Sequence
  derived and/or modified sequence opt11 from VP1__Norovirus__BAS30215
augaagauggccuccaaugacgcaaaccccuccgauggcuccgcugccaaucucguccccgaagucaacaacgaagucauggcacucgaacccgucgucggcgccgcuaucgccgcaccagucgcaggacaacaaaacgucaucgauccauggauacgaaacaacuucguacaagccccaggcggagaguucaccgucucaccccguaacgccccuggagaaauccucugguccgcaccacuaggaccagaccuaaaccccuaccuuucccaccuagcacgaauguacaacgguuacgccggcggauucgaaguccaagucauccuugcuggcaacgccuucaccgccggcaaaauaaucuucgccgccguucccccaaacuuccccaccgaaggacucucaccaucccaagucaccauguuuccccacaucaucgucgacguccgccagcuagaaccaguacuaauuccccucccugauguccgcaacaacuucuaccauuacaaccaaucaaacgacuccaccauaaagcuaaucgccaugcucuacacaccccuccgagccaauaacgcaggcgaagacgucuucacagucuccugccguguccuaacucgccccucccccgacuucgacuucaucuuucucguucccccaacagucgaaagcagaaccaaaccauucacgguacccauacuaaccgucgaagaaaugacaaacucucgauuccccauaccacucgagaaacuuuucacuggcccaucauccgccuucguuguccaaccacaaaacggccgcugcaccaccgacggcguccuacugggaaccacccaacucucucccguaaacauaugcaccuuccguggagacguaacucacauugcaggaucccgcaauuacaccaugaaccuagccucccucaacuggaacaacuacgacccaaccgaagaaauccccgccccacuuggcacacccgacuucgucggcaaaauccagggcaugcucacacaaaccacaaaaggcgacggcuccacacguggccacaaagcaacagucuacacaggcuccgcccccuucaccccaaaacucgggucgguccaauucagcaccgacaccgaaaacgacuucgaaacccaccaaaacaccaaauucacucccgucggcgucauccaagauggaagcacuacccaucgcaacgaaccacaacaauggguccuccccuccuacagcggccgcaacguuccaaacguacaccuugcccccgcagucgcccccaccuuccccggagaacaacuccuauucuuccgcuccaccaugcccggcugcuccggcuaccccaacauggaccucgacugccuccucccccaagaauggguacaacacuucuaccaggaagccgccccugcccaauccgacgucgcccuacuacgcuucgucaaccccgacaccggccgaguccucuucgaaugcaaacuacacaaauccggcuacgucaccguagcacacaccggccaacacgaccucgucaucccacccaacggauacuuccgauucgacuccuggguaaaccaauucuacacucucgcgcccaugggaaacggcaccggcagacgccgagcccuauga

SEQ ID NO: 36568 - RNA, 1623 nt, Artificial Sequence
  derived and/or modified sequence opt11 from VP1__Norovirus__BAS30218
augaagauggcaucaaacgaugcuaacccaucagacggcuccgccgccaaccucgucccugaaguuaacaacgaagucauggcccuggaacccguaguuggagccgcgauagcagcccccguagccggccaacaaaacgucaucgaccccuggauccgcaacaacuucguccaagcucccggaggagaguucacggucagcccacgaaacgcuccuggcgaaauccuaugguccgcuccccugggccccgaucucaaccccuaccuaucccaccucgcaagaauguacaacggcuacgcuggcggauucgaaguacaaguaauccuagccggaaacgcauucaccgccgguaaaaucaucuucgccgccgucccacccaacuuccccacagaaggauuaagccccucacaagucaccauguucccccacauaaucgucgacguacgccaacucgaaccaguccucauaccccuacccgacguacgcaacaacuucuaucacuacaaccaauccaacgacucaaccauaaaacucauagccaugcuauacaccccauuacgcgcaaacaacgccggcgaggacguuuucacagucuccugccgaguacuuaccagaccgucccccgacuucgacuucaucuuccucgucccgcccacaguugaaagccgcacaaaacccuucaccguccccauacuuaccgucgaagaaaugaccaacucccgcuuccccaucccacucgaaaaacuauucacaggccccucaucagccuuugucguucaaccccaaaauggccguugcaccacagacggcguccuacucggcacgacccaacuaucacccguuaacaucugcacauuccgcggcgacguaacacacaucgccggcucaagaaacuacaccaugaaccuagccucacucaacuggaacaacuacgacccaacagaagaaauacccgcuccacucgguacaccagacuuugucgguaaaauacaaggaaugcuaacccaaaccaccaaaggcgacgguucaacgcgcggccacaaagccaccguguacacaggauccgcucccuucacacccaaacucggcagcguccaguucuccaccgacaccgaaaacgacuucgaaacccaccaaaacaccaaauucacacccguaggcguaauccaagacggguccaccacucaccgcaacgaaccccaacaauggguacugcccucauauuccggacgcaauguccccaacguucaccucgcccccgccguagcccccaccuuccccggugaacaacuccucuucuuucguucaaccaugcccggcugcuccggcuaccccaacauggaucucgauugccucuuaccacaagaaugggugcaacauuucuaccaagaagccgcucccgcacaaucugacguagcccuccuccgauuuguaaauccagacacagggcgcguacucuucgaaugcaaacuucacaaauccggcuacgucacaguagcccacaccggccaacacgaccucgucaucccacccaacggcuacuuccgcuucgacuccuggguaaaccaauucuacacgcuagcccccaugggcaacggcaccggccgccgccgagcacuauag

SEQ ID NO: 36569 - RNA, 1623 nt, Artificial Sequence
  derived and/or modified sequence opt11 from VP1__Norovirus__BAS30221
augaaaauggcauccuccgacgccaaccccuccgacggcuccgccgcuaaccucguccccgaaguaaacaacgaaguaauggcacucgaaccaguaguaggcgccgccaucgcagcccccgucgcaggccaacaaaacguaauagaccccuggauccgcaacaacuucguccaagcccccggcggagaauuuaccguaagcccccgaaacgcccccggcgaaauacuaugguccgcgccccucggacccgaccuuaaccccuaucucucccaucucgcccgcauguacaauggcuacgccggcggcuucgaaguccaaguaauauuagccggaaacgcauucaccgcaggcaaaaucauauucgcugccguaccacccaacuuccccaccgaaggccucuccccaucacaagucaccauguucccccacaucauagucgauguucgccaacuagagccaguccucaucccccuccccgauguccgaaacaacuucuaccacuacaaccaguccaacgacuccaccauuaaacuaauagcaaugcuauacaccccacuacgcgcaaacaacgccggcgaagaugucuucaccgucuccugccgaguucucacccgucccucaccagacuucgauuucauauuccuugucccacccacagucgaaucccgaaccaaacccuucaccguccccauccucacaguggaggaaaugaccaacucccgauuccccaucccacucgaaaagcuauucacaggccccuccuccgcauucgucguccagccacaaaauggccgcugcacuacggacggcguacuucucggcacuacacagcucucacccguuaacaucugcaccuuccgcggagacgucacacacaucgccggcucuagaaacuacacaaugaaccucgcaucccucaacuggaacaacuaugaccccaccgaagaaauccccgcaccccucggcaccccugacuucgucggaaaaguccaaggcguccucacccaaaccaccaaaggagacggcuccacccgaggccacaaagccaccgucuacaccggcucugccccauucacccccaaacucggcuccguacaauucuccaccgacaccgaaaacgauuucgaaacacaccagaacacaaaauucaccccagucggcgucauccaagacggauccacaacucaucgcaacgaaccacaacaauggguucucccaucuuauuccggccgcaacguccccaacguccaccucgcccccgccgucgcccccaccuucccaggagaacaauuacuauucuuccgcagcacaaugcccggaugcucgggcuaccccaauauggaccuugacugccuacucccccaagaauggguccaacacuucuaccaagaagccgcccccgcccaauccgacguagcccuccuccgauucgucaacccugacaccggcagaguccuauucgaaugcaaacuacauaaguccggauacguuacagucgcacacaccggccaacacgaccucgucauaccacccaacggcuacuuccgcuucgacucgugggucaaccaauucuacacucucgcccccaugggcaacgguacaggccgacgccgcgcccucuga

SEQ ID NO: 36570 - RNA, 1623 nt, Artificial Sequence
  derived and/or modified sequence opt11 from VP1__Norovirus__BAS30224
augaaaauggcuagcaaugacgccaaccccuccgacggcucagcagccaaucucguaccagaagucaacaacgaagucauggcacucgaacccgucgucggcgccgcaaucgccgcccccguggccggccaacaaaaugugaucgaccccuggauccgaaacaacuucguccaagcacccggaggcgaguucaccguaucacccagaaacgccccaggagagauccucugguccgcaccauuaggaccugaccuaaaccccuaucucucucaccuagcccgaauguacaaugguuacgccggcggauucgaaguacaagucauacucgccggcaaugccuuuaccgccggaaaaaucaucuucgcagccguuccacccaacuuccccaccgaaggccuuucccccucccaaguaaccauguucccccacauuaucguagacguccgccaacucgaacccguccucaucccccuaccagacguccgaaacaacuucuaccauuacaaccaauccaacgacuccacuaucaaacuaaucgcaaugcucuacacaccacuacgagcaaacaacgccggcgaagacgucuucacagucagcugccgcguccugacccgcccaucacccgacuucgacuucaucuuccugguaccucccaccguugaaucucgaaccaaacccuucacaguacccguccuaaccgucgaagaaaugaccaauucucgcuucccaaucccccucgaaaaauuauucaccggacccuccuccgccuucgucguccaaccccaaaacggacgaugcaccacggacggcguccuccuuggcacuacccagcuaucccccgucaacauaugcaccuuccgcggcgacguuacccacauagccggcucccgaaacuacacaaugaaccuagccucccuaaacuggaacaacuacgaccccaccgaagaaauaccagcaccacucgguacaccagacuuugucggcaaaauccaaggaaugcucacacaaaccacaaaaggcgacggcucaacccgcggacacaaagccaccguauacaccggcuccgcaccguucacccccaaauuaggcuccguccaauucuccacagacacugaaaacgacuucgaaacccaccaaaacaccaaauucaccccagucggcguaauccaagacggaucaaccacccaccgcaacgaaccacaacaauggguccucccauccuauuccggcagaaacguccccaacguacaccuagccccagcuguugcccccacauuccccggcgaacaacuccuauucuuccgcucaaccaugcccggcugcuccggcuaccccaacauggaccuagacugccuccucccacaagaauggguccaacacuucuaccaagaggcagccccagcccaaucagacguagcccuccuccgcuucguaaaccccgacacaggcaggguccuauuugaaugcaaacuccacaaaucagguuacguaaccgucgcucacacaggccaacacgaccucgucaucccucccaacggcuacuuccgcuucgacucuuggguaaaccaguucuacacccuugcucccaugggcaacggaaccggccgucgacgcgcacuauaa

SEQ ID NO: 36571 - RNA, 1623 nt, Artificial Sequence
  derived and/or modified sequence opt11 from VP1__Norovirus__BAS30227
augaaaauggcuuccucagaugcaaaccccucagacggcucagccgccaaccugguccccgaaguuaacaacgaaguuauggcccucgaacccguagucggcgccgccaucgccgcccccguagccggacaacaaaacguuaucgacccauggauacgaaacaacuucguacaggcacccggcggugaauuuaccgucuccccacguaacgccccaggagaaauacuaugguccgcaccacuaggccccgaccuaaacccauacuuaucucaucuagcacgcauguacaacggauacgcgggcggauucgaaguccaagucauacucgcgggcaacgccuucaccgccggcaaaaucauuuucgcagccgugccaccaaacuuccccacagaagggcucucuccaucccaagucaccauguuuccacacaucaucguagacguacgacaacucgagcccguucucaucccucuacccgacguccguaacaacuucuaccacuacaaccaauccaacgacuccaccaucaaacuaauagccaugcuguacacaccccuccgcgcaaacaaugccggcgaggacgucuucaccguaucaugcagaguucucacacgccccucccccgacuucgacuucaucuuucucguuccacccaccguagaaucgcgagccaaaccauucaccguccccauacucaccgucgaagaaaugaccaacucacguuuccccaucccccucgaaaaacucuucaccggacccuccuccgcuuuugucguccaaccacaaaacggacgcugcaccacagacggcguucuccuaggaacaacccaacucucgcccguuaacaucugcacauuccgcggcgacgucacccacaucgcaggcucccguaacuacaccaugaaccucgcuagcccuaacuggaacaacuacgaccccaccgaagaaaucccagcaccccuagguacccccgacuucgucggaaaaauccaaggaaugcucacucaaaccacuaaaggcgacggcuccaccagaggccacaaagccacaguauacaccggcuccgccccauucacucccaaacuuggcuccguccaauucuccaccgacaccgaaaaugacuuugaaacacaucaaaacaccaaauucaccccagucggagucauacaggacggcucgacaacacaccgaaacgaaccacaacaauggguccuccccuccuacucagguagaaacgucccuaacguccaccucgccccagccgucgccccaaccuuccccggugaacaacuccucuucuuccgcuccaccaugcccggcugcuccggcuaccccaacauggaccucgacugccuacucccccaagaauggguccaacacuucuaucaagaggccgcccccgcccaauccgacgucgcacuacuccgcuucgucaaccccgacaccggacgaguucucuucgaaugcaaacuccacaaaagcggauacgugacuguagcucacacuggccaacacgaccuaguaauaccaccaaacggauacuuccgcuucgauuccuggguaaaccaauucuacacccuagccccaaugggcaacggaacaggccgccgacgcgcccucuaa

SEQ ID NO: 36572 - RNA, 1623 nt, Artificial Sequence
  derived and/or modified sequence opt11 from VP1__Norovirus__BAS30230
augaaaauggccucaaacgacgccaaccccuccgacggcucagccgcaaaccuaguaccugaagucaacaacgaagucauggcccuugaacccgucguaggcgcagccaucgcagcuccuguugccggucaacagaacguaaucgaccccuggauccgcaacaacuuuguacaagcccccggcggcgaguucaccgucucuccccgaaacgcccccggcgaaauacucugguccgcaccccuagggccagaccuaaaccccuacuuaucccaccuagccagaauguacaacuccuacgccggaggcuucgaaguccaagucauacucgccggcaacgccuucaccgcaggcaaaaucaucuucgccgccgucccaccuaacuucccaacagaaggacucucacccucgcaggucacuauguucccccacaucauugucgacguacgccaacucgaaccaguccucaucccccuccccgacguccguaacaacuucuaccacuacaaccaauccaacgacuccaccaucaaacucaucgccaugcucuauacgccccuacgugccaacaacgccggcgaagacgucuucaccgucuccugccgcguccucacccgcccaucccccgacuucgacuucaucuuccucgucccacccaccgucgaaucccgaaccaaacccuucacaguucccauccucaccgucgaagaaaugaccaacagcagauucccaaucccacuagaaaaacucuucaccggacccuccucugcuuucguaguccaaccccaaaacggccgcugcacuaccgacggcguacuccucggcaccacacaacucucuccagucaacaucugcaccuuccgcggagaugucacucacaucgccuccucccgaaacuacacaaugaaucuugcaagccucaacuggaacaacuacgaccccaccgaagaaauacccgccccacucggaacccccgacuucgucgguaagauccaaggcaugcuaacacaaacaacuaaaggagauggcuccacaagaggccacaaagccacagucuacacuggcucagcacccuucacacccaaacuuggauccguccaauucagcacugacaccgaaaacgacuucgaaacacaucaaaacaccaaauucacccccguagguguaauccaagacgguagcacaacccaccgcaacgaaccccaacaguggguacuaccaagcuacuccggacgcaaugucccuaacguacaccucgcccccgccguagccccagcauuccccggugaacaacuccuauucuuucggucaaccaugccaggcugcuccggguaccccaacauggaccucgacugccuccucccccaagaauggguccaacacuucuaucaagaagcugcacccgcucaaucugacgucgccuuacuacgcuuuguaaaccccgacacgggacgaguccuauuugaaugcaaacuccacaaauccggauacguaaccguugcccacaccggccagcacgaccuugucauaccucccaauggcuacuuucgauucgauucaugggucaaccaauucuacacacucgcacccaugggaaacggcaccggccgccgccgcgcccuauaa

SEQ ID NO: 36573 - RNA, 1623 nt, Artificial Sequence
  derived and/or modified sequence opt11 from VP1__Norovirus__BAS30233
augaaaauggcauccaaugacgccaacccauccgacgguucagccgcaaaucuagucccagaagucaacaacgaaguaauggcccucgaacccgucguaggcgccgccaucgcugcaccagucgcaggccaacagaacgucaucgaccccuggauccgcaacaacuucguacaagcccccggaggcgaguucacaguaucuccccgaaacgcccccggcgaaauacucugguccgcgccccucggaccugacuuaaaccccuaccucucccaccuagcccgcauguacaacggcuacgcaggaggcuuugaaguacaaguaauacucgccggcaacgccuucaccgcaggcaaaaucauauucgccgcaguacccccuaacuucccuacugaaggccuaucccccucccaagucaccauguucccacacaucaucguagacguacgccaacucgaaccgguacuaauccccuuacccgauguacgcaacaacuucuaccacuacaaccaaucaaacgacucaaccaucaaacucauagccaugcucuacacaccccuccgcgcaaacaacgccggcgaagauguauucacagucaguugccgcguacucacccgacccucccccgauuucgacuucaucuuccuaguaccucccaccgucgaaucucgcacaaagcccuucaccguccccauacuaaccgucgaagaaaugaccaacagccgauuccccaucccccucgaaaaacucuucaccggcccuuccuccgccuucguaguccagccacagaacggccgcugcaccaccgacggcguacuacuagguaccacccaacucucacccgucaacaucugcaccuuccgcggcgacguuacucacaucgccggaucccgaaacuacaccaugaaccuagccuccuuaaacuggaacaacuacgaccccacagaagaaauaccagccccucucggaacaccugacuucguaggcaaaauacaaggaguccucacccaaaccacaaaaggcgacgguucgacacgcggccacaaggcuaccguauacaccggcucagccccguucaccccuaagcucggcuccguccaauucucgacagacacagagaacgacuucgaaacgcaccaaaacacaaaauucacacccguaggcgucauccaggacggcggcaccacccaucgcaacgaaccacaacaauggguacucccauccuacucuggccgcaacgucccuaacguacaccucgccccagcagucgccccgaccuuccccggcgaacaacuacucuucuuccgaagcaccaugcccggcugcuccggcuacccaaacauggaccuagacugccuccucccccaagaauggguccaacacuucuaccaagaggcagcccccgcccaauccgacgucgcccucuuacgcuucguaaacccagacaccggccgcguccuauucgaaugcaaacuccacaaaucaggcuacguaaccgucgcacacacaggccaacacgaccucguaauucccccuaacggauacuucagauucgacucaugggucaaccaauucuacacacuagccccaaugggaaacggcaccggccgcagacgcgcccucuaa

SEQ ID NO: 36574 - RNA, 1623 nt, Artificial Sequence
  derived and/or modified sequence opt11 from VP1__Norovirus__BAS30236
augaaaauggccuccaacgacgccaaccccucagacggaucggcagcaaaucucguacccgaagucaacaacgaaguuauggcauuggaacccguugucggcgccgcuauagcugcaccagucgccggccagcaaaacgucauagacccauggauccgaaacaauuuuguacaagcaccagguggcgaguucaccgucagcccccgcaacgcacccggcgaaauccuaugguccgcuccccucggccccgaccucaaccccuaccucucccaccuugcccgcauguacaacggcuacgccggagguuucgaaguacaaguaauccuagccggcaacgccuucaccgccggcaaaaucaucuucgcugcagucccacccaacuuccccacagaaggacucucccccucgcaggucaccauguucccccacaucaucgucgacguccgccagcucgaacccguucucaucccacucccagacguccgcaacaacuucuaccacuacaaucaauccaacgacuccaccauaaaacucauagccaugcucuacaccccacuccgcgcaaacaaugccggcgaagacguuuucaccguaucuugcagaguacucacccgcccauccccagacuucgacuucauauuucuugucccacccacagucgaaucucgcacaaaacccuucaccgucccaauacuuaccguagaagaaaugaccaauucucgcuucccaaucccccucgaaaaacucuucaccggccccucuuccgccuucguaguacaaccccaaaacggacgaugcaccaccgacggcguacuccucggcacuacacaacuuagcccuguuaacaucugcaccuuccgaggagacgucacacacauagccggcucccgcaauuacaccaugaaccucgcaucccucaacuggaacaacuacgaccccacagaagaaaucccugccccacuuggaaccccugauuucgucggaaaaauccaaggcaugcucacacagacaacaaaaggcgacggaucaacccgagggcauaaagccacaguuuacacaggcucagcacccuucacccccaaacucggauccguacaauucucaacugacacagaaaacgacuucgagacccaccaaaacacaaaauucacuccagucggagucauccaagacggcagcacaacccaucgcaacgaaccacaacaauggguccucccuucauauuccggccgcaaugugccgaacguacaccucgcaccagccgucgcucccaccuucccaggcgaacaacuccuauucuucagauccaccaugcccggcugcuccggcuacccaaauauggaccucgacugccuacucccucaagaauggguccaacacuucuaucaagaagcugcccccgcacaaucagacgucgcacuacuccgcuucguaaacccagacacaggccgcguccucuucgaaugcaaacuacacaaaucaggcuauguaaccgucgcccacaccggacaacacgaucuaguuaucccaccaaacggcuacuuccgauucgacuccuggguaaaccaauucuacacccuagcacccaugggcaacggcaccggccgucgccgcgcacucuga

SEQ ID NO: 36575 - RNA, 1623 nt, Artificial Sequence
  derived and/or modified sequence opt11 from VP1__Norovirus__BAS30239
augaaaauggccucuaacgacgccaaccccucagacggcucugcagcaaaccucgucccagaagucaacaacgaagucauggcccucgaacccgucguaggagccgcaaucgccgcccccgucgcaggccaacaaaauguaaucgacccauggauucgaaacaacuucguacaagcccccggcggagaauuuaccgucagcccccgcaacgccccuggcgaaauccucugguccgcgccccuaggccccgaccucaauccguaccucucccaccuagcccgcauguauaaugguuacgccggcggcuucgaaguccaagucauacucgccggcaacgccuucacugccggaaaaaucaucuucgccgccgucccucccaacuucccaacagaaggccucucacccucccaagucaccauguucccccacaucauugucgauguaagacagcuagaaccaguccucauaccccuaccagacgucagaaacaacuucuaccacuacaaucaaucaaacgacuccacaaucaaacucaucgcuaugcuuuacacaccccuccgagcaaacaacgcaggcgaagaugucuucaccgucuccugccgcguacucacccgccccuccccugacuucgacuucaucuuccucguacccccaaccgucgaaucacgcaccaagccauucaccguccccauccucaccgucgaagaaaugaccaacucaagauucccuauaccccucgaaaaacucuucacaggcccauccuccgcuuucgucguccaaccacaaaacggccgaugcaccacagauggcguccuccucgguaccacacaacucuccccaguaaacaucugcaccuuccgcggcgacgucacccacauagcaggcucucgcaacuacacaaugaaccuugcgucccuaaacuggaauaacuacgaccccaccgaagaaaucccagcaccccucggcacuccagacuuugucggcaaaauucaaggaaugcuaacgcaaacaacgaaaggagauggcucaacucgcggccacaaggccacagucuacacaggcuccgcuccuuucacuccaaaacucggaucaguccaauucuccaccgauaccgaaaacgacuucgaaacccaccaaaacacaaaauucacaccagucggcguuauccaagacggcuccaccacacaccgcaacgaaccucaacaauggguccuccccuccuacuccggccgaaauguuccaaacguccacuuagcaccagccguagcaccaaccuucccaggcgaacaauuacuauucuuccgcuccacaaugcccggcugcuccggcuaccccaacauggaccucgacugccuccuaccacaagaauggguccaacauuucuaccaggaagccgcccccgcacaaucagacgucgcccuccuccgcuucgugaacccagacaccggacgcguucuauucgaaugcaaacuacauaaauccggcuacgucaccgucgcacacacaggccaacacgaccuggucauacccccaaacggcuacuucagauucgacuccugggucaaucaauucuacaccuuagcccccaugggcaacggcaccggccgccgacgugcccuauaa

SEQ ID NO: 36576 - RNA, 1623 nt, Artificial Sequence
  derived and/or modified sequence opt11 from VP1__Norovirus__BAS30242
augaaaauggccagcaacgaugcaaacccauccgacggcucagccgccaaccucgucccugaagucaacaacgaagucauggcacuagaaccagucgucggugccgccaucgcugcacccgucgccggacaacaaaacguaaucgacccauggauucgcaacaacuucguccaagccccaggcggugaguucaccgucucccccagaaacgcacccggcgaaauccuaugguccgcaccccucggccccgaccucaaccccuaccucucacaccuagcccgaauguacaacggauacgccggcgguuucgaaguccaagucauucucgccggcaacgccuucacugccggaaagauaaucuucgccgccgucccacccaacuuccccaccgaaggccuaucucccucucaaguaaccauguucccccauauaaucguagacguccgacaacuagaaccaguccucauaccacucccugacguacgcaacaacuucuaccacuauaaccaauccaacgacuccacaauuaagcucaucgccaugcuuuacacaccacuccgcgccaacaacgccggagaagacguuuucaccguaucuugccgcguccucacccgccccucccccgacuucgacuucaucuuccucgucccucccaccguagaaucacgaaccaaacccuucacaguccccauacuuacaguggaagaaaugaccaacucccgauuccccaucccacuagaaaaacucuucaccggaccauccuccgccuucguaguacaaccacaaaacggcagaugcaccaccgacggaguccuacucggcacaacccaacucucccccgucaacauaugcaccuuccgaggcgacgugacccacauagcaggcucacgaaacuauacaaugaauuuagcuucccucaacuggaacaauuacgacccuacagaagaaguacccgccccucuaggcacgcccgacuucgucggcaaaauacaaggcguccuuacacaaaccacaaaaggcgacggaucaacccgaggacacaaagccacagucuauaccgguuccgcacccuucacaccaaaacuuggcucuguacaguucuccaccgacaccgaaaacgacuucgaaacccaccaaaacacaaaguucacccccguaggcgucauccaagacggcggcaccacccaccgaaacgaaccucaacaauggguacuccccuccuauuccggccgcgacguccccaacguccaccuagcacccgccguugcccccacuuuuccaggcgagcaacuauuauucuuccgcuccaccaugcccggauguuccggcuaccccaauauggaucucgacugccuacuaccacaagaauggguccagcacuucuaccaagaagccgccccagcccaauccgacguugcacuacucagauucgucaaccccgacacaggucgcguacucuucgaaugcaaacuccacaaaucaggcuaugucacuguugcccacaccggccaacacgaucuuguaauaccucccaacggcuacuuccgauucgacuccugggucaaccaauucuacacccucgccccaaugggcaacggaaccggccgacgacgcgcucuguga

SEQ ID NO: 36577 - RNA, 1620 nt, Artificial Sequence
  derived and/or modified sequence opt11 from VP1__Norovirus__BAS30245
augaaaauggcaucaaacgacgccaaccccuccgacggauccgcagcgaaccuugucccugaaguaaacaacgaaguuauggcccucgaacccguuguaggcgcagccauugcugccccagucgccggccaacaaaacgucauugaccccuggauccgcaacaacuucguccaagccccaggcggcgaauuuacaguaucaccccgcaacgccccaggcgaaauccucuggucagccccacuaggccccgacuuaaacccuuaccucucccaccucgcccgcauguacaacggauacgccgggggauucgaaguccaaguaauucucgcaggcaacgccuucacugccggcaaaaucaucuucgccgccauaccacccaacuucccaaccgaaggccucuccccgucucaagucaccauguucccccacaucgucgucgacguccgucaauuagaaccaguccucauaccacucccugacguccgcaacaacuucuaccacuacaaccaaacaaaagaauccaccaucaagcuagucgccaugcucuauaccccacuccgcgcuaacaacgcuggcgacgacgucuucaccguaucuugucguguccuaacccgccccucccccgacuucgauuucaucuuccucgugccucccucagucgaaucccgaacaaaacccuucaccguacccauacuuacgguagaagaaaugacuaacucccgcuuccccauaccccuagaacguuuauucaccggacccucauccgcuuucgucguucaaccacaaaacggccguugcacuaccgacggcguccuccuuggaacaacccaacuaucucccguuaacauaugcaccuuccgcggagacgucacacgcgucuccaccacccaugucuacgaaaugaaucuugccucccaaaacuggaacaacuacgacccaacagaagaaguccccgcaccccucggcacucccgacuucgucggcaaaauccaaggcguacuuacucaaaccacaagaaccgacggaucaacucgcgcccacaaagccaccguaucaacuggcgcagccgacuucaccccaaaacucggcuccaucagauuugaaaccaccacaaaccgcgaccucgaaacccaccaaaacaccaaauucacacccgucggcgucauccaagacggcgacaaccaucaaaacgaaccacaacaauggagacuacccggcuacgcaggacgcgacgcccacaacguccaccucgcccccgcaguagcucccaccuucccaggcgaacaacuccucuucuuccgauccacaaugcccggcugcucaggauaccccaauaugaaccuggacugccuccuaccucaagaauggguccaacacuucuaccaagaagccgcccccgcacaaucugacgucgcccuacucagauucgucaauccagacacuggcagaguccuauucgaaugcaaacuccacaaauccggcuacuuaacagucgcccacaccgguccauacgaccucguaauaccaccuaacggcuacuuucgcuucgacagcugggugaaccaauucuacacacucgcccccaugggcaacggcaccggccgccgccgagcccucuaa

SEQ ID NO: 36578 - RNA, 1623 nt, Artificial Sequence
  derived and/or modified sequence opt11 from VP1__Norovirus__BAS30248
augaaaauggccucaucagacgcaaacccauccgauggcuccaccgccaaccuaguacccgaagucaacaacgaagucauggcacucgaacccguagucggcgccgcaaucgcagcccccgucgcaggccagcaaaacgucaucgaccccuggauacgcaacaacuucguucaagcccccggcggugaguucacuguauccccacgcaacgcgcccggagaaauccucuggucggcaccauuaggcccagaucucaaccccuaccucucacaccucgcccgcauguacaacggcuacgccggcggauucgaaguacaagucauccucgccggaaacgccuuuaccgcaggcaaaaucauauucgcagccgucccuccaaacuuccccaccgaaggucuaucacccucucaaguaacaauguucccacacaucaucgucgacguacgccaacucgaacccguccucauuccacuccccgacguccgaaacaacuucuaccacuacaaccaaucaaacgacccgaccauuaaacucauagcaaugcuauacaccccucucagagcaaacaacgccggcgaugacgucuucaccgucuccugccgcguccuaacccgccccagccccgacuucgauuucauauuccucgugccacccacagucgaaucccgaacaaaacccuucuccgucccaauccucacugucgaagaaaugacaaacucucgauuccccaucccacuagaaaaacuauucaccgggcccucauccgccuucgucguccaaccccaaaacgguaggugcacuacagacggcguccuccuaggcacaacucaacuauccccagucaacauaugcaccuuccgcggugacguaacccacauaacaggcucacguaacuacaccaugaaccuugccacccaaaacuggaacucauaugacccuaccgaagaaauacccgcaccccuaggaaccccagacuucguuggaaaaauccaaggcgucuuaacacaaaccacgcgcgccgacggcuccacucgcggccacaaagccaucgucuacacaggcagcgccgauuuugccccaaaacuaggcagaguccaauucgcaaccgacaccgacaacgacuucggcgccaaccaaaacaccaaauucacacccgucggcguaauccaagauggcgacacggcccaccgcaaugaaccgcaacaauggguacucccauccuacucgggacgcaacagccacaacguacaccucgcaccagcagucgcuccaaccuucccuggcgaacaacuccucuucuuccgauccaccaugcccggaugcucuggcuaccccaacauggaccuugacugccuccucccucaagaauggguacaauacuucuaccaagaggccgcgccagcacaauccgacgucgcucuccucagauucgucaaccccgacacaggccgaguccucuucgaaugcaaacuccacaagucaggauacgucaccgucgcccauaccggccaacaugaucucguaauacccccaaacgguuacuuccgguucgacucaugggucaaccaauucuacacccucgcccccaugggcaacggaacagggcgccguagagcccucuaa

SEQ ID NO: 36579 - RNA, 1623 nt, Artificial Sequence
  derived and/or modified sequence opt11 from VP1__Norovirus__BAS30251
augaaaauggccuccuccgacgccaacccauccgacggcucaacagccaacuuaguacccgaggucaauaacgaagucauggcccuugaaccagucguaggcgcagccaucgccgcacccguagccggccaacaaaacgucaucgaccccuggauccgcaacaacuucguccaagcccccggcggcgaguucaccgucucacccagaaacgcucccggagaaauccucugguccgcaccccuuggacccgaccucaaccccuaccuuucccaccucgcucgaauguauaacggcuacgccggcggcuuugaaguccaagucauccuagcuggaaaugcuuucaccgccggcaaaaucaucuucgccgccgucccacccaacuuccccacugaaggacucuccccaucccaagucaccauguucccccacaucaucgucgauguccgccaacuagaaccuguccuuaucccccucccagacguacgcaacaacuucuaccacuacaaccaauccaacgacccaacaaucaaacucaucgccaugcucuacacaccccuucgagcuaacaacgcaggcgacgacgucuucaccguaucaugccgaguacucacccgccccucccccgacuuugacuucaucuuccuaguaccacccaccguagaaucucgaacaaaacccuucucaguacccauacuaacagucgaagagaugaccaauucccgcuuccccaucccccucgaaaaacucuucaccggcccaagcuccgccuucgucguacaaccccaaaacggccgcugcacaaccgacggcguccuacucggcaccacucaacucucaccagucaacauuugcacauuccgcggcgacguaacccacaucaccggaucacgcaacuacaccaugaaccuagccacccaaaacuggaacuccuacgaccccaccgaagagaucccagcuccccucggcaccccagacuucgucgguaaaauccaaggcguccucacccagacuacaagggcugauggcucaacccgcggccacaaagcaaccguuuacaccggaucugccgacuucgccccuaaacuuggccguguccaauucgcaaccgacaccgauaacgacuucgacgccaaccaaaacaccaaauucacccccgucggcgucauccaggacggugacaccgcccaccgcaacgaaccccaacaauggguacuucccuccuacucaggccgcaacucccacaacguccaccucgccccagcagucgcacccaccuuccccggcgaacaacugcuauucuuccgaagcaccaugcccggcugcucuggcuaccccaacauggaucuggacugccuacucccccaagaauggguccaauacuucuaucaagaagccgccccagcacaaucagacgucgcccuacuaagauucguaaaccccgacacuggccgcguccucuucgaaugcaaacuccacaaaucuggauacgucacagucgcccacacuggccaacacgaccuaguaauacccccaaacggcuacuuucgauucgacuccugggucaaccaauucuacacccuagccccaaugggcaacggcacaggacgccgcagagcccucuaa

SEQ ID NO: 36580 - RNA, 1626 nt, Artificial Sequence
  derived and/or modified sequence opt11 from VP1__Norovirus__BAS30254
augaaaauggccuccuccgacgccaauccaagcgacggauccacugccaaccucguccccgaaguaaacaacgaagucauggcccuggagcccguagucggcgcugccauugcugcacccgucgcaggccaacaaaacgucaucgacccauggauccgcaacaacuucguccaagcaccagguggcgaguucacugucucaccccgaaaugcaccaggcgaaauccucugguccgcuccccucggcccagaccucaaccccuauuuaucucaccucgcccgaauguauaacggauacgccggaggcuucgagguacaaguaauccuagccggaaacgcauuuacagcaggcaaaaucauauucgcagccguaccacccaacuuccccaccgaaggccucucccccucccaagucaccauguucccccacaucauagucgacguacgccaacucgaacccgugcuaauaccccuccccgacguccguaacaauuucuaccacuacaaccaaucaaacgaccccaccaucaaacucauugcaaugcucuacaccccacuacgcgccaacaaugcuggagacgacguuuuuacagucaguugccgcguacuaacgcgcccaucaccugacuucgacuucaucuuccucgucccacccacaguagaaucccgcaccaaacccuuuucaguaccaguacucaccgucgaagaaaugaccaacucgaaagucucccccaucccccuaaagaaacucuucacaggaccauccagcgccuucgucguacaaccccaaaacggccgcugcacaacagacggcguacuucuuggaaccacccagcuauccccugucaacaucugcaccuuccgcggagacguaacccacauccccggaucccgaaacuacaccaugaaccucgccagccaaaacuggaacuccuacgaccccaccgaagaaaucccugcaccccucgguaccccagacuucguaggaaaaauccaaggaguccuaacucaaacaacacgcacuaacggauccacccguggccacaaagccaccgucuacaccggcuccgccgacuucucaccaaaacucggccgaguccaauucgccaccgacaccgauaacgacuucgaaacaaaccaaaacacaaaauuuaccccagucggcgucauccaagacggcuccaccacaccccgcaacgaaccacaacaauggguacuaccaucauacuccggccgcaacauccacaacguccaccuagccccugcaguagcacccaccuuccccggcgaacaacuccuauucuuccgauccacaaugcccggcugcucuggauauccuaauauggaucuugauugccuccuaccccaagaguggguccaauacuuuuaccaagaagccgcccccgcccaauccgacgucgcacuccuacgcuucgucaaccccgacaccggccgcguacucuucgaaugcaaacuucacaaauccggcuacgucaccguagcacacaccggccaacacgaccucgucauaccaccaaacggauacuuccgauucgacuccugggugaaccaguucuacacccuagcccccaugggcaauggcaccggccgccgucgcgcacucuaa

SEQ ID NO: 36581 - RNA, 1623 nt, Artificial Sequence
  derived and/or modified sequence opt11 from VP1__Norovirus__BAS30257
augaaaauggcuucuuccgacgccaaccccuccgacggaucuacugcaaaccucguccccgaaguaaacaacgaagucauggcccucgaaccuguagucggcgcagccauugccgcaccaguugcaggccaacaaaacgucaucgaccccuggauccgcaacaacuucguacaggcacccggcggcgaguucacagucucaccccgcaacgcccccggcgaaauacucuggucugcaccccucggaccagauuuaaaccccuaccucagccaccuagcccgcauguacaacggcuacgccggaggcuucgaaguccaaguaauccuagcaggcaacgccuucaccgcaggcaaaaucaucuucgcugcagucccacccaacuucccaaccgaaggccucucacccucacaagugaccauguucccucauaucaucguagauguccgccaacucgaaccaguccucauaccccuaccagacguucgcaacaacuuuuaccacuacaaccaaucuaacgacagcaccaucaaacuaaucgccaugcuauauacaccucuccgcgccaacaaugccggcgacgacgucuuuaccgucuccugccgcguccucacccggcccucucccgacuuugacuucaucuuccuagucccacccacagucgaaucccgcaccaaacccuucuccguucccguccucaccguugaagaaaugaccaacagccgcuuucccaucccacuugaaaaacucuucacaggccccucauccgcguucguaguacaaccacaaaacggccgcugcaccacagacggcguccuccucggcacaacacagcuaucccccguaaauaucugcaccuuccgcggcgacgucacccacauuucgggaucccguaacuacacaaugaaccucgccucccaaaacuggaacagcuacgacccaaccgaggaaaucccagccccacuuggcacacccgacuucgucggcaaaauccaaggcguccuaacacaaacaacccgcacaaacggcucaacacgcggccacaaggccaccgucuacaccggauccgccgacuucucacccaaacucggccgaguacaauucgccacagacaccgacaacgacuucgaaaccaaccaaaacaccaaauucacuccaguaggcgucauccaagacggauccaccacaccccgcaacgagccccaacaauggguccucccauccuacucaggccgaaacauucacaacguccaccucgcacccgccgucgcacccaccuuucccggcgaacaacuccucuucuuccgcagcaccaugccaggcugcucaggcuaucccaacauggaccucgacugucuucucccacaggaauggguacaguacuucuaccaagaagccgccccagcccaaucugacguagcacuacuacguuucguaaaccccgacaccggacgcguacuauucgaauguaaacuacauaaauccggcuacguaacaguagcacacacaggacaacacgaccuaguaauaccgcccaacggcuacuuccgcuucgacuccugggucaaccaauucuacacccucgcacccaugggcaauggcaccggccgccggagagcccucuaa

SEQ ID NO: 36582 - RNA, 1623 nt, Artificial Sequence
  derived and/or modified sequence opt11 from VP1__Norovirus__BAS30260
augaaaauggccucauccgacgccaaccccucagacggcuccaccgccaaccuaguccccgaagucaacaacgaagucauggcucucgagccagucgucggugccgccauagccgcccccgucgccggccaacaaaacgucaucgaucccuggauccgcaacaacuuuguacaagcucccggaggagaguucaccgucucaccccgcaacgcccccggcgaaauccuuugguccgcaccccucggccccgaccuuaacccauaccuuucccaccucgcacgcauguacaacggcuacgccggaggauucgaaguccaggucauacuugcuggcaacgccuucaccgccggaaaaaucaucuucgccgcaguacccccaaacuucccaaccgaaggccuuagccccucacaagucacuauguucccacacaucaucgucgacguacgccaacuagaaccaguccuaaucccacuucccgacguacgaaacaacuucuaucacuacaaccaauccaacgaccccaccaucaaacuaauagcuaugcucuauacaccccuccgagcuaacaaugccggcgacgacgucuucaccgucucuugccguguccuaacccgucccucacccgacuucgacuucauuuuucuaguacccccaaccgucgaaucacgaaccaagcccuucucagucccaguccugaccgucgaagaaaugaccaacuccagauuccccauaccccuugagaaacucuucaccggccccucuucagccuucgucguccaaccacaaaacggccgcugcaccacagacggcguccuccucggcacaacacaacucagccccgucaacaucugcacauuccgaggcgacguaacccacauacccggcucccgaaacuacacaaugaaccuagccucccaaaacuggaacuccuacgaccccaccgaagaaauacccgcaccacuaggcacccccgacuucgucgguaagauccaagguguacuuacucaaaccacucgcacaaacggcucaacucgaggccacaaggcaacugucuacaccggcucggccgacuucucccccaaacuaggcagaguccaauucgccacugacaccgacaacgacuuugaaaccaaccaaaacacaaaauucaccccuguaggaguuauccaagacggcucaaccacaccccgaaacgaaccccaacaguggguccuccccagcuacucaggucgcaacauacacaacguacaccuagcccccgcagucgcuccuaccuuccccggagaacagcuacuauucuucagauccaccaugcccggcugcucaggauacccaaauauggacuuagacugccuacucccccaagaauggguccaauacuucuaccaagaagccgcccccgcacaaucagacgucgcucuccuccgcuucgucaacccggauacaggccgaguccuuuucgaaugcaaacuccacaaaucaggcuacguaacagucgcccacaccggccaacacgaccuagucauaccacccaacggauacuuucgguucgacagcugggucaaucaauucuauacccucgcccccaugggcaacgggaccggccgccgcagagcccuauaa

SEQ ID NO: 36583 - RNA, 1623 nt, Artificial Sequence
  derived and/or modified sequence opt11 from VP1__Norovirus__BAS30263
augaaaauggccuccucggacgcuaaucccucagauggcucuacagccaaccucguccccgaaguaaacaacgaaguaauggcucucgaaccagucgucggcgcagcaaucgccgcccccgucgccggucaacaaaacgucaucgacccuuggauccgcaacaacuucguacaagcccccggcggcgaguucaccguauccccacgcaacgcccccggcgaaauccuuuggucugccccacuaggccccgaccucaaccccuaccucucccaccucgcacgcauguacaacggcuaugcaggcggauucgaaguccaagucauacucgcaggcaacgcauucacagcaggcaaaaucaucuucgccgcagucccacccaacuucccaaccgaaggacucucccccucacaagucaccauguucccacacauuauagucgacguccgccaacucgaacccguucucaucccucuccccgacguacgaaauaacuucuaccacuacaaccaaagcaacgacucaacuaucaaacucaucgccaugcuauacacaccacuucgcgcaaacaacgccggagacgaugucuuuaccguuucaugucgaguacuaacccgucccucccccgacuucgacuuuauuuuccuagucccuccaaccgucgaaagcgaaaccaaaccuuucuucuuccccguccuuacagucgaagaaaugacaaacagccgcuuccccaucccccucgaaaaauuauucaccggccccuccuccgccuucguaguccaaccacaaaacggccgcugcaccacugacggcguccuacucggaaccacacagcucucucccgucaacauuugcaccuuucgcggcgacgucacccacauccccggcucucgaaacuacaccaugaaccucgccagucaaaacuggaacucauacgaccccacugaagaaauccccgcaccccuaggcacccccgauuuuguaggcaaaauccaaggcguccucacacaaaccacccgcacaaacggcagcacacgcggccacaaagccacaguuuacaccggauccgccgauuucucaccaaaacuuggccgcguccaauucgccaccgacaccgacaacgacuucgaaaccaaccaaaauaccaaauucacccccgucggcguaauacaagacggcucaacaacaccacggaacgaaccucaacaaugggugcucccuuccuacuccggccgcaacauucacaacguccaccuagcacccgccgucgccccaacauucccaggcgaacaacuacucuucuuucgcuccacaaugcccggcugcucaggcuacccaaacauggaccucgacugcuuacuaccacaagaauggguacaauacuucuaccaggaggcugcucccgcccaaucagaugucgcacuccuccgcuucgucaacccugacaccggccgcguucucuucgaaugcaaacuccacaaaucaggauauguaaccgucgcccacaccggacaacacgaccuagucauaccacccaacggcuacuuccgcuucgacucauggguaaaccaauucuacacacucgcccccaugggcaauggcaccggcagacgacgagcccucuaa

SEQ ID NO: 36584 - RNA, 1623 nt, Artificial Sequence
  derived and/or modified sequence opt11 from VP1__Norovirus__BAS30266
augaaaauggcaucauccgacgcaaaccccuccgacggcagcaccgccaaccuaguccccgaagucaacaacgaagucauggcucucgaaccagucguuggcgcagcaaucgccgcccccguagccggccaacaaaacguaauagacccauggauucgaaacaacuucguccaagcccccggcggcgaguucacaguaucaccccgaaacgcacccggagaaauccucugguccgccccacucggccccgaccuaaaccccuaucucucccaccucgcaagaauguacaacggauacgccggcgguuucgaaguccaaguaauccuagccggcaacgcguucacagccggcaaaauaaucuuugcagccguacccccaaacuucccaaccgaaggucucuccccaucacaagucaccauguucccucacaucaucguagacguaagacaacuagaacccguacucaucccccuccccgauguccguaacaacuucuaccacuacaaccaauccaacgacuccaccaucaaacuuaucgccaugcucuacaccccgcuuagagcaaacaacgcaggcgacgacgucuucacagucucauguagaguacuaacccgacccucccccgacuucgacuucaucuucuuaguucccccaacaguagaaucacgcaccaaaccuuucucugucccgguccucaccguugaagaaaugaccaauucacgcuucccaaucccccuagaaaaacuauucacaggcccauccucagcauucguuguccaaccccaaaauggccgaugcacaaccgacggcguccuccucggcacaacccagcucucccccgucaacauaugcaccuuccgcggcgacgucacacacauaucgggcucccgcaauuacacaaugaaccuagcuagccaaaacuggaacucauacgauccaacugaagaaauacccgcaccccuaggcaccccagacuucgucggaaaaauccaaggcguccugacccaaaccacccgaaccaacggcucaacccgcggacacaaagcaaccguauacacaggcuccgccgacuucucccccaaacuaggaagagugcaauucgccacagacacagacaacgacuucgaaaccaaccaaaauaccaaauucacccccgucggcgucauccaagacggaagcacaacgccccgcaaugaaccccaacaauggguccugcccuccuacucgggacgcaacauccacaacguacaccucgcccccgcaguagcacccaccuucccaggcgaacaacucuuauucuuucgcucaaccaugcccggcugcagcggauaccccaacauggaccucgacugccuccugccacaggaauggguccaauacuuuuaccaagaagcagccccugcacaauccgacgucgcucuccuucgcuucgucaaccccgacaccgggcgcguauuauucgaaugcaaacuccacaaauccggauacgucaccgucgcccauacgggacagcaugaccuaguaauaccacccaacggauauuucagauucgacucaugggucaaccaauuuuacacucuugcccccaugggcaacggaacaggcagaagacgagcccuauaa

SEQ ID NO: 36585 - RNA, 1623 nt, Artificial Sequence
  derived and/or modified sequence opt11 from VP1__Norovirus__BAS30269
augaaaauggcuuccuccgacgccaaucccuccgacgguucaaccgccaaccucguccccgaagucaacaacgaaguaauggcucucgaacccgucgucggagcagcaaucgccgccccagucgccggccaacaaaacguuaucgacccauggauccgcaacaacuucguacaagcacccgguggugaguucaccguuucuccccgaaacgcccccggcgaaauccuaugguccgcacccuuagggcccgaccuaaaucccuaccucucccaccuagcccgcauguacaacggauacgcuggaggcuucgaaguccaagucauccucgcaggcaacgccuucaccgccggaaagaucauuuucgcagccguaccaccaaacuucccaacagaaggccucucccccucccaggucaccauguucccacacaucauagucgacguccgccaacucgaacccguacucauuccacuccccgacguccgcaacaacuucuaccacuacaaccaauccaacgacuccaccaucaaacucauagcaaugcucuacacaccccuccgcgcaaacaacgccggcgacgacgucuuuaccguaagcugucgcguccucacgcgaccgagccccgacuuugacuucaucuuccugguacccccuacagucgaaucaagaaccaaaccauucuccguccccguccuaaccgucgaagaaaugaccaacucccgcuuccccauaccccucgaaaaacuauucaccggccccagcuccgccuucguaguccaaccacaaaacggucguugcaccaccgacggaguccuccuaggcaccacccaacucucaccagucaacaucugcaccuuucgcggagacguuacccacaucucaggaucacgcaacuacaccaugaaccuagccucacaaaacuggaacucuuacgaccccaccgaagagauacccgcuccccuaggcaccccagauuucguaggaaaaauccaaggcguccucacccaaaccacccgcaccaacgguuccacccgaggacacaaagccacagucuacaccggcucagccgacuucucccccaaacucggucgaguccaauucgccaccgacacggacaacgacuucgaaacuaaccaaaacacaaaauucacucccgucggggucauccaagacggcucaacaacaccccgcaacgaaccucaacaauggguucuuccgucguacuccggacgcaacauacacaacguccaccuugcacccgccguugcaccaaccuuccccggagaacaacuccuauuuuuccgcucaaccaugccaggaugcucuggcuaccccaacauggaccuagacugccuccucccccaagaauggguccaauacuucuaucaagaagccgcacccgcacaguccgacgucgcacuccuccgcuucgucaaccccgacaccggccgcguacucuucgaaugcaaacuccacaaauccggcuacguaaccguagcucacaccggacaacacgaccuugucaucccacccaauggcuacuuccgauucgacuccuggguaaaccaauucuacacccucgcccccaugggcaacggcacgggacgacgccgcgcccucuaa

SEQ ID NO: 36586 - RNA, 1623 nt, Artificial Sequence
  derived and/or modified sequence opt11 from VP1__Norovirus__BAS30272
augaaaauggccucauccgacgccaaucccuccgacggcuccaccgccaaccugguacccgaaguaaacaacgaggucauggcccucgaaccaguagucggcgccgcaauagccgccccaguagccggccaacaaaacgucaucgaccccuggaucagaaacaacuuuguccaagcccccggaggagaguucaccgucagcccccguaacgcccccggggaaauccucugguccgcuccauugggccccgaccuaaacccauaccucucacaucucgcccgcauguauaacggauacgcaggcggcuucgaaguccaagucauccucgccggaaaugccuuuacagccggcaaaaucaucuucgcagcaguaccacccaacuuccccaccgaaggccucucccccucacaggucaccauguucccucacaucauagucgacguccgccaacucgaacccguccuaaucccccuccccgacguucgcaacaacuucuaccacuacaaccaaucuaacgacucaaccaucaaacuaaucgcaaugcuuuacacaccccuucgcgccaacaacgcaggagaugacgucuucaccgucucaugccguguucuaacccgacccagcccagacuucgacuucauauuccuaguucccccaaccgucgaaucacgaaccaaacccuucuccguccccguccucaccguggaggaaaugaccaacucccgauucccuauaccccucgaaaaacucuucaccggcccuuccagugcauucgucguccaaccccaaaacggcagaugcaccacagacgguguacuauuaggaaccacccaacucucccccgucaacaucugcacauuccgcggagacgucacccacauuucagguucccgcaacuacacaaugaaccucgccucccaaaacuggaacucauacgaccccaccgaagaaauccccgccccucucggaacacccgauuucgucggcaaaauacaaggcguccucacacaaaccacaagaacaaacggauccacccgaggccacaaagccacgguguacacuggcucagccgauuucagccccaaacuaggccgcguucaauucgccaccgacaccgacaacgacuucgaaaccaaccaaaacaccaaauucacccccguaggcgucauccaagacggcuccacaacaccacgcaacgaaccccaacaauggguacuuccaucuuacucaggccgcaacauacacaacguacaccuagcccccgccguggccccaaccuuccccggcgaacaacuacucuucuuccgcucaacaaugcccggcugcucuggcuaccccaauauggaccuugacugccuccucccacaagaauggguucaauacuucuaccaagaagccgcccccgcccaaucagacgucgcccugcuccgauuugucaaccccgacacaggccgaguccucuucgaaugcaaacuccacaaguccggcuacgucacugucgcccacacaggccaacacgaccuaguaaucccacccaacggauauuuucgcuucgauucaugggucaaccaauucuacacccucgcacccaugggaaacggcaccggccgcagacgcgcccucuga

SEQ ID NO: 36587 - RNA, 1623 nt, Artificial Sequence
  derived and/or modified sequence opt11 from VP1__Norovirus__BAS30275
augaaaauggcgucaaaugaugccaaccccucugacgguucuacagccaaccucguacccgaaguaaacaacgaagucauggcccucgaaccagucguaggcgcugccauugccgcccccgucgccggacaacaaaacgucauagacccauggauccgaaauaacuucguucaagccccuggaggugaguucaccguaucccccagaaacgccccaggugaaauccucugguccgcuccccucggacccgaccucaacccauaccucuucccccucgcccgaaaagucaaagguuacgccggcggauucgaaguucaagucauccuagcaggcaaagcauuuccagcaggaaaaaucaucuucgcagccuccccacccaacuuccccaccgaaggacuaucaccaucccaagucacaauguuuccacacaucaucgucgacguacgccaacucgaaccgguucuaauuccccucccugacguccgcaacaacuucuaccacuacaaccaaagcaacgacuccaccauuaaacuaaucgcaaugcuauacaccccacuccgagcaaacaacgccggcgaagacguauucacaguaucuugccgcguccuuacccgcccauccccagacuucgacuucaucuuccucguucccccaaccgucgaaucccgaacaaaacccuucucaguccccauacucaccgucgaagaaaugaccaacucccgcuucccaauaccucuggaaaaacucuucaccggccccuccuccaccuucgucguccaaccccaaaacggacgcugcaccacagacggcguccuccucggcaccacccaacucuccccagucaauauaugcacauuccgcggcgacgucacacacauagcaggcucccgcaacuacaccaugaaccucgccucgcaaaacuggaacuccuacgaccccacagaggaaauacccgcaccccuggggacacccgacuucguaggcaaaauccaaggcguccucacccaaaccacacgcagagacggcucuacacgcggccacaaagcaaccguauacaccggaagcgcagacuucucccccaaacucggacgaguccaauucgcaacagacacagauaacgacuucgauacacaccaaaacaccaaauucaccccagugggagucauccaagacggcggcacggcccaccgaaacgaaccccaacaauggguccuccccagcuacuccggacguaacacccacaauguccaccuugccccagccguagcccccacauucccuggcgagcaacuacuauucuuccgaucuaccaugcccggcugcucaggauacccaaacauggaccucgacugccucuugccacaagaaugggugcaguacuucuaccaagaagccgcacccgcucaauccgacguugcacuacuacgauucgucaaccccgacacaggccgcguacucuucgaaugcaaacuccacaaauccggcuacguaaccgucgcccauaccggccaacacgaccucguaaucccaccuaacggcuacuuccgauucgacuccugggucaaccaauucuauacccucgccccaaugggcaacggcaccggccgccgacgcgcacucuaa

SEQ ID NO: 36588 - RNA, 1623 nt, Artificial Sequence
  derived and/or modified sequence opt11 from VP1__Norovirus__BAS30278
augaaaauggccuccucggacgccaaccccagcgacggcucaacagcuaaccuaguccccgaagucaauaacgaagucauggcccucgaacccgucgucggcgccgccauagcugcucccgucgccggccaacaaaacguaauagaccccuggauacgcaacaacuucgugcaagcccccggcggcgaauuuaccgucucuccccgcaacgcccccggcgaaauacuaugguccgcgccccucggcccugaccucaaccccuaccuaucccaccuagcccgaauguacaacggcuacgccggcgguuucgaaguacaaguaauccuagccggcaacgccuucaccgccggcaaaauaauuuucgccgccgucccacccaacuucccaaccgaaggccucuccccaucccaaguuaccauguucccccacaucaucguagacgugcgacaacuagaacccguacugauaccccuacccgacguucgcaacaacuucuaccacuacaaccaauccaacgacuccacaauaaaacucauagccaugcucuacacuccccugcgcgccaauaacgccggggacgaugucuucacagucuccugccgcguccuaacacgucccagccccgacuucgacuucaucuuccucguacccccgaccgucgaaucgcgcaccaaacccuucucggucccaguccuaacagucgaagaaaugacaaacuccagauucccaauaccccucgaaaaacuauuuaccggccccucaagcgccuucguaguacagccacaaaauggccgcugcacuacagacggcguccuacuagggaccacccaacuaucccccguaaacaucugcacauuccgcggcgacgucacccacaucuccggcagucguaacuacaccaugaaccuugcaucccaaaacuggaacucuuacgaccccaccgaagaaauaccagccccucucggaacccccgacuucgucggcaaaauacaaggaguccuaacccaaaccacacgcaccaacggaagcacaagaggccacaaagccacaguuuacacuggaucagccgacuucucccccaaacucggccgaguccaauucgccaccgacacggacaacgacuucgaaaccaaccagaacaccaaauucaccccagucggugucauccaagacggcuccaccacaccccgcaacgaaccacaacaauggguacuccccuccuacuccggccgcaacauacacaacguccaucuugccccugccgucgccccuaccuuucccggcgaacaacuccucuuuuucagaucaaccaugccagguuguucaggcuaucccaacauggaccucgacugccugcucccccaagaauggguacaauacuucuaccaagaagccgcacccgcccaaucagacguagcccuccuccgcuucgucaaccccgacaccggccgcguccuauucgaaugcaaacuucacaaaucaggauacguuaccgucgcacacaccggccaacacgaccucguaaucccacccaacggcuacuuccgauuugacuccuggguaaaccaguucuacacccucgcccccaugggcaauggcaccggucgccggagagcacucuaa

SEQ ID NO: 36589 - RNA, 1623 nt, Artificial Sequence
  derived and/or modified sequence opt11 from VP1__Norovirus__BAS30284
augaaaauggccagcuccgacgcuaaccccagcgacggcuccacagccaaccuaguccccgaagucaacaacgaagucauggcacucgaacccgucgucggcgcagccaucgccgccccaguagcuggccaacagaacgucaucgaucccuggauacguaauaacuucguccaagccccaggcggcgaguucaccgugagcccccgaaacgcccccggcgaaauccuaugguccgcaccucucggcccagaccucaacccauaccucucgcaccucgcacgcauguacaacggguacgcgggcggauucgaaguucaagucauccucgccggaaaugcuuucaccgccggcaaaaucauauucgccgcaguaccacccaacuucccaaccgaaggccucucccccucacaagucaccauguucccacacaucaucguagacguccgccaacuagaaccaguccucaucccacuacccgacguccgcaacaacuucuaucauuacaaccaaucaaaugaccccacaaucaaacucauagcuaugcucuacacaccccuacgagcaaacaaugccggcgacgacguauucaccgucuccugucgcguacucacccgacccucaccagacuucgacuucaucuuccuaguaccacccaccguagaaucccgcaccaagccuuuuuccguaccaguccuaaccgucgaagaaaugacuaacucccgcuuuccaaucccccucgaaaaacucuuuaccggcccaucauccgcauucguaguccaaccccaaaacggccgcuguaccaccgacggcguacuacucggcaccacccaacucuccccuguaaacaucugcacuuuccgaggcgacgugacccacaucuccggcagccgcaacuacacuaugaaccucgcgucccaaaacuggaacuccuaugacccaacggaagaaauuccugcaccccuaggcacacccgacuucguagguaaaauccaaggcguccuaacccaaaccacccgaaccaacggcucaacacgaggccacaaagcaaccgucuauaccggcucggcugacuucucccccaaacucggacguguccaauucgcaacugacaccgacaacgacuucgaaaccaaccaaaacaccaaauucacacccguaggcguaauccaagauggaagcaccaccccacguaacgaaccccaacaauggguacucccgucuuacuccggccgaaauauccauaacguccaccuagcacccgccgucgcacccaccuuccccggcgaacaacuacuauucuuccguucuaccaugcccggcugcucaggauaccccaauauggaccucgauugccuccucccacaagaauggguccaauacuuuuaccaagaagccgcccccgcacaauccgacgucgcccuccuacguuucguaaaucccgacaccggcagaguccucuucgaaugcaaacuccauaaaucaggcuacgucacaguggcacacaccggucaacacgaccucgucaucccaccaaacggcuacuuccgcuucgacuccugggucaaccaauucuacacccucgcccccaugggcaaugguacaggccgccgccgcgcacucuga

SEQ ID NO: 36590 - RNA, 1623 nt, Artificial Sequence
  derived and/or modified sequence opt11 from VP1__Norovirus__BAS30287
augaagauggccucaucagacgccaacccauccgacggauccaccgcaaaccuaguccccgaagucaacaacgaagucauggcauuagaacccgucgucggcgcugccauugcagcccccguagcaggccaacaaaaugucaucgacccauggauacgaaauaacuucguccaagccccaggaggcgaguucacagucucaccccguaacgcccccggcgaaauacucugguccgccccacucggcccagaccugaacccauaccucucacaccucgcccgcauguacaacggcuacgccggaggcuucgaaguacaaguaauccucgcuggaaacgccuucaccgccggcaaaaucauauucgccgccgucccucccaacuucccaacugaagggcucucaccaucacaggugacuauguuuccccacaucaucgucgauguacggcaacuagaaccgguccucauccccuuacccgacguccguaacaacuucuaccacuacaaccaaagcaacgaccccaccauuaaacuuaucgccaugcucuauaccccacuacgcgcuaacaacgccggcgacgaugucuucaccguauccugccgcguccucacccgccccucaccagacuuugacuucaucuuccuagucccucccacaguagaaucccgcacaaaaccauucucaguccccguccucaccgucgaagaaaugaccaacucgcgauuccccaucccccucgaaaagcuauucacaggccccucgucagcuuuuguaguccaaccacaaaacggccgcugcaccaccgacggcguccuacucggcacaacccaacucucccccgucaacaucugcacauuccgaggagacguuacccacaucccaggcucccgcaacuacaccaugaaucucgccagccaaaacuggaacucauacgaccccacagaagaaaucccagccccacucggaacacccgauuucgucggcaaaauccaaggcguacucacucaaaccacccgaacuaacggcucuacccgaggccacaaagcuaccguauacaccggaucagcagacuucucccccaaacucggccgcguccaauuugccaccgacaccgacaacgacuucgaaacaaaccaaaauaccaaauucacccccgucggcgugauucaggacggcuccaccacaccccgaaacgaaccgcaacaauggguccuaccaucauacucuggucgcaacauccacaacguucacuuggcacccgccguagccccaaccuuccccggcgaacaacuccucuucuuccgauccaccaugcccggcugcuccggauaccccaacauggaccucgacugccuccucccccaagaauggguccaauacuucuaccaagaagcugccccagcacaauccgacgucgccuuacuccgauucgucaauccagacacaggccgcguccucuucgaauguaaacuucauaaauccggcuaugucacagucgcacacaccggacaacacgaccuagucaucccucccaacggcuacuuccgcuucgacuccuggaucaaccaauucuacacccucgcacccaugggcaacggaaccggccgacgccgcgcccucuaa

SEQ ID NO: 36591 - RNA, 1623 nt, Artificial Sequence
  derived and/or modified sequence opt11 from VP1__Norovirus__BAS30290
augaaaauggccuccucagacgccaaccccagcgacggcucuaccgccaaccuuguccccgaaguaaacaacgaagucauggcccucgaacccguagucggcgccgcuauugccgccccagucgccggacaacaaaaugucaucgaccccuggauacgcaacaacuuuguccaagccccaggcggcgaguucaccgucuccccacgaaacgcacccggcgaaauucucuggucagcuccccuaggccccgaccuaaacccauaccucucacacuuagcccggauguacaacggcuacgccggcggcuucgaaguccaagucauacucgccggcaacgcuuucaccgccggcaaaaucauauucgcagccguucccccaaacuuccccacagaaggccucucacccucacaagucaccauguucccucacaucauuguagacguacgacaacuggaacccguccuaauaccccucccagacguacgcaacaacuucuaccacuacaaccagagcaacgacuccacaaucaaacuaaucgccaugcuauacaccccauuacgugcaaacaacgcaggcgacgacgucuucaccguuuccugccguguccuuacgcgcccaucccccgacuuugauuucaucuuccuaguucccccaacagucgaaucaagaaccaaaccauucucaguaccaguacucaccgucgaagaaaugaccaacagccgcuuccccauuccacucgaaaaauuauuuaccggccccuccagcgccuucgucguccagccacaaaacggccgaugcaccacggaugguguacuucucggcaccacccaacucucucccguuaacauaugcaccuuccgcggugacguaacccacaucucuggcucccgcaacuacaccaugaaccuugccucacaaaacuggaacuccuacgaccccacagaagaaauccccgcaccccucgguacuccagacuucgucggaaaaauacaaggcguccucacccaaaccacccgaacaaacggaucaacccguggccauaaagcuacggucuauaccggauccgccgacuucucgccaaaacuaggccgaguccaauucgccacugacaccgacaacgacuucgaaacaaaccaaaacaccaaguucacccccgucggugugauccaagacggcuccaccacaccccgcaacgaaccucaacaauggguccuucccucauauuccggcagaucgauccacaacguacaccucgcccccgccguagcaccgaccuucccaggcgaacagcuacucuucuucagaucuaccaugcccgguugcucaggauacccaaauauggaucuugacugccuccucccccaagaauggguacaguacuucuaccaagaagccgcccccgcacaauccgacgucgcucuccugcgauucguaaacccugauacaggacguguacuuuucgaaugcaagcuccacaaaucaggcuacguaaccgucgcccacacuggacaacacgaccucgucaucccacccaacggcuacuuccgcuucgacagcugggucaaccaauucuacacccucgcccccaugggcaacggaaccggccgaagacgcgcacucuaa

SEQ ID NO: 36592 - RNA, 1623 nt, Artificial Sequence
  derived and/or modified sequence opt11 from VP1__Norovirus__BAS30293
augaaaauggccucuucagacgcaaaccccucagacgguagcaccgcaaacuuaguccccgaaguaaacaacgaaguaauggcccuagaacccgucgucggagccgcaauagcagccccaguagcaggucaacaaaacgucaucgaccccuggauacgaaauaacuucguacaggcccccggcggcgaauuuaccgucucaccccgaaacgcacccggcgaaauccucugguccgcgccccuaggccccgaccuaaaccccuaccucucccaccuagcccgcauguacaacggcuacgccggcggcuucgaaguacaggucauacucgccggcaaugccuucaccgccggaaaaaucaucuucgccgccguaccacccaacuuccccaccgaaggacucucccccagccaagucacaauguuuccccacauaaucguugacguccgucaacucgaacccguacucauuccccugcccgacguccgaaacaacuucuaccacuacaaccaaucaaacgaccccaccaucaaacuaaucgccaugcucuacaccccucuccgcgcaaacaacgccggugacgacgucuucacaguauccugccgcguccuaacccgccccucacccgacuucgacuucaucuuccucgucccacccaccgucgaaucacgaaccaaacccuucagcguccccauacuaaccgucgaagaaaugacuaacucccgcuuccccaucccccuagaaaaacucuuuaccggacccuccuccaccuuugucguccaaccccagaacggucgaugcaccacugacgggguacuacucggcacuacacaguugucccccgucaauauaugcacauuccgcggcgacgucacccacaucgccggcagucgaaauuacacaaugaaccucgcgucccaaaacuggaacucauacgaccccaccgaagaaauucccgcuccccucggcacgcccgacuucgucggcaaaauccaaggcguccucacacaaaccacccgaaccgacggcagcacacgaggacacaaagccaccgucuacaccggauccgccgacuuuucccccaaacucggccgcguccaauucgccacagacaccgacaacgacuuugacgccaaccaaaacacaaaauucacucccguaggcgucauacaagacggaggaaccgcucaccgcaacgaaccccaacaauggguucuuccuuccuacuccggccgcaacacucacaauguccaccucgccccagcugucgcccccacauuucccggcgaacaacuacuauucuuccgcucaacuaugcccggaugcuccggguacccuaacauggaccucgauugucuucucccccaagaaugggugcaauacuucuaccaagaagccgccccagcucaauccgacgucgcccuacuccgauucgucaacccugacaccggcagaguccucuucgaaugcaaacuccacaaaucaggauacgccaccgucgcacacacuggacaacacgaccucgucauaccacccaacggcuacuuccgcuucgacuccugggucaaccaauucuacacucucgcacccauggguaacggcaccggccggcgcagagcgcuuuaa

SEQ ID NO: 36593 - RNA, 1623 nt, Artificial Sequence
  derived and/or modified sequence opt11 from VP1__Norovirus__BAS30296
augaaaauggccuccaaccacguaaaccccucugauggcucaaccgcgaacuuggucccagaagucaacaacgaagugauggcacucgaacccguugucggcgccgccauagccgccccagucgccggacaacaaaacguaaucgaccccuggauacgcaacaacuucguccaagcccccgguggagaauuuaccgucuccccucgaaacgcuccaggagaaauacucugguccgccccucuuggccccgaccuaaaccccuaucuaucgcaucuagcacgaauguacaacggcuacgccggcggcuucgaaguccaagucauccuagccggcaacgccuucaccgccggcaaaaucaucuucgccgccgucccacccaacuuccccaccgaaggccuaucccccucccaaguaaccauguucccccacaucauagucgacguacgccaacucgaacccgucuuaaucccccucccugauguccgcaacaacuucuaccacuacaaccaauccaacgacccuaccauaaaacucauagccaugcucuacaccccucuacgcgccaacaaugccggagaugacgucuucacagucuccugccgcguccuaacccgcccaucccccgacuucgacuucaucuuccuaguacccccuacaguagaaucccgcaccaaaccuuucuccguacccguccuaaccgucgaagaaaugacuaacucacguuuccccauaccccuagaaaaacucuucaccggccccuccagcgcauucgucguccaaccccaaaauggccgaugcaccaccgauggcguacuccucggcaccacacagcugucccccgucaacauaugcaccuucagaggugacgucacacauauacccggaucaagaaacuacacuaugaaccuagccucccaaaacuggaacuccuacgacccaaccgaagaaauccccgcuccccucggcaccccagacuucguaggcaaaauccaaggcguccuuacccaaaccaccagaaccaauggaucaacgcguggccacaaagccacugucuacaccggcucagcagacuucucccccaaacuuggccgcguacaauucgcaaccgacaccgacaacgacuucgaaacaaaccaaaacaccaaauucaccccagucggcguuauucaagauggcuccaccaccccucgcaacgaaccccaacaguggguacuccccagcuacucaggccgcaacauacacaauguccaucuagccccagcaguagcccccaccuuucccggcgaacaacuccucuucuuccgcucuauaaugcccggaugcucuggcuaccccaauauggacuuagauugcuuacuuccccaagaauggguccaauauuucuaccaggaagcugccccagcccaauccgacguagcccuccucagauucgucaaccccgacaccggccgcguccucuucgaaugcaaacuccacaaaucuggcuacgucaccguagcacacaccggccaacacgaccucgucaucccacccaacggauacuucagauucgacuccugggugaaccaauucuauacacucgcccccaugggaaacggcacaggccgccgccgagcccuauaa

SEQ ID NO: 36594 - RNA, 1623 nt, Artificial Sequence
  derived and/or modified sequence opt11 from VP1__Norovirus__BAS30299
augaaaauggccagcuccgacgcaaacccauccgauggauccaccgccaaccucguccccgaagucaacaacgaaguuauggcccucgaacccguagucggcgccgccauagccgcacccguggccggccaacaaaacgucaucgaccccuggauucggaacaacuucguccaagcaccaggaggcgaguucacaguaucaccccgcaacgcacccggcgaaauccucugguccgcuccccucggucccgaccucaacccauaucucucacaccuagcccgaauguacaacggcuacgccggcggcuucgaaguccaagucauccucgccggaaacgcauucaccgccggcaagaucgucuucgcagccgucccacccaacuuccccacggaaggacuaucccccucccaagugaccauguucccccacaucaucgucgacguacgccaacucgaaccuguacucauaccccucccagacgucagaaacaacuucuaucacuacaaccaauccaacgaccccaccaucaaacucaucgcaaugcuauacacuccccuccgugcaaacaacgccggcgacgauguauuuacggucuccugucgcguccucacgcgaccaucaccagacuucgacuucauauuccuuguaccacccaccguagaauccagaaccaaacccuuuucaguccccauccuaaccgucgaagaaaugaccaacucacgauuucccauaccucucgaaaaacucuucacaggacccucauccgccuucguaguccaaccacaaaacggcagaugcacaacugacggaguccuccuuggcacaacccaacucucacccguuaacaucugcacauuccgcggagacgucacucacaucgccggcagccacaacuacaccaugaaucucgcaagccagaacuggaacuccuacgaucccaccgaagaaaucccagcaccccugggcacccccgacuucgucggcaaaauccaaggcguacucacccaaaccacacgcaccgacggcagcacccgcggccacaaagccaccguauauacaggcucagcugaauuuagcccaaaacuaggccguguccaguucgcuacugacacuaacaacgacuucgacgcaaaccaaaacaccaaauucaccccagugggcgucauucaagauggaggcacaacacaucgcaacgaaccacaacaauggguacuuccauccuacucuggucgaaauacccacaacguacaccucgcacccgccgucgccccaacauuccccggcgaacaacuacuauucuuucgcucaacuaugcccggaugcuccggauaccccaacauggaccuagacugccuacucccccaagaauggguccaauacuucuaccaagaggccgcgccagcacaaucugacgucgcacuccuacgauucguuaacccagacacaggccgcguccuauucgaaugcaaacuacacaaauccggcuacgucaccgucgcucacacuggccaacacgaucuuguuaucccacccaacggcuacuuccgcuuugauucauggguaaaccaauucuacacccuagcccccaugggaaacggcacaggaagacgacgugcccucuaa

SEQ ID NO: 36595 - RNA, 1623 nt, Artificial Sequence
  derived and/or modified sequence opt11 from VP1__Norovirus__BAS30302
augaaaauggccucuucagacgccaaccccuucgacggaucaacugcaaaccucguccccgaaguuaauaacgaagucauggcccucgaaccuguaguuggcgccgccaucgccgccccagucgcaggccaacaaaacgucaucgacccuuggauucgcaacaacuucguacaagccccaggaggcgaguucaccgucuccccacgcaacgcccccggugaaauccucugguccgcaccccuuggacccgaccucaaucccuaccucucccaccucucccgaauguacaacggauacgccggaggcuucgaaguccaaguaauccucgccggcaacgccuucaccgcaggcaaaauaaucuucgcagcaguacccccaaauuucccuacagaaggacucuccccaucacaggucaccauguucccccacaucaucgucgacguccgccaacucgaacccguccuuauaccacuacccgacguccgaaacaacuucuaucacuacaaccaguccaacgaccccacaaucaaacucaucgccaugcuauacacaccacuccgcgccaauaacgccggcgacgacgucuucacaguauccugccgcguacuuacacgccccucaccagacuucgacuuuaucuuccuaguucccccaacuguagaaucccgcacgaaaccauucucgguaccagugcucaccguagaagaaaugaccaacagucgcuuucccaucccacuugaaaaacuauucaccggccccucauccgcuuucgucguccaaccccaaaacggacguuguaccaccgacggcguucuccuuggcaccacucaacuaucccccguaaacaucugcacuuuucguggcgacguaacccacauccccggcucccgcaacuacacaaugaaccucgccucacaaaacuggaacuccuacgacccuacagaagaaauccccgccccgcuagggacccccgacuucguaggcaaaauccaaggcguccucacccaaaccacacgaaccaacggcucaacccgcggccacaaagccaccguauacaccggcuccgccgacuucuccccgaaacucggccgcguccaauucgcaaccgacaccgacaacgacuucgaaacaaaccaaaacaccaaauucacccccguugguguaauccaagacggcuccaccaccccaagaaacgaaccacaacaauggguucuaccaagcuauucaggucgcaacauacacaacguacaccucgcucccgcugucgccccaaccuuucccggagaacaacuccucuucuuccgcucaaccaugcccggcugcuccggcuacccaaauauggaccucgacugccuccuuccacaagaauggguccaauacuucuaccaagaagccgcacccgcucaauccgacguugcccugcuccgcuucguaaacccagacaccggccgaguccucuucgaaugcaaacuacacaaauccggcuacgucacagucgcccauaccggacaacacgaccucguaaucccacccaacggauauuuccguuucgacuccugggucaaccaauucuacacgcucgcccccauggguaacggcaccggccgccgccgcgcccuguga

SEQ ID NO: 36596 - RNA, 1623 nt, Artificial Sequence
  derived and/or modified sequence opt11 from VP1__Norovirus__BAS30305
augaaaauggccucaucagacgcgaaccccuccgacggcagcaccgcaaacuugguuccugaaguaaacaacgaaguaauggcacucgaaccagucguaggagccgccaucgcagcacccgucgccggccaacaaaacgucaucgaccccuggauucgcaacaacuucguccaagcaccuggcggcgaauuuacagucaguccccgaaacgcccccggugaaauccucuggucaggcacccuaggcccugaccucaaucccuaccuaucccaccucgcucgcauguauaauggcuacgccgggggcuucgaaguccaagucauacucgccggcaacgcauuuaccgccggcaaaaucaucuucgccgccguacccccaaauuucccaaccgaaggccucuccccaucucaagucaccauguucccacacaucauaguagacguccgccaacuugaacccguacucaucccccuccccgacguccgcaacaacuucuaccacuacaaccaauccaacgaccccaccauaaaacuuaucgccaugcucuacacaccccuucgcgccaacaaugccggcgacgacgucuucacaguuagcugucgaguccucacgagaccaucccccgacuucgacuucauauuccucguaccacccacugucgaaucccgcacaaaacccuucuccguacccguucucaccgucgaagaaaugacaaacucccgcuuccccaucccccucgaaaaacucuucacaggccccucauccgccuucgucguccaaccacaaaacggccgcugcaccacagaugguguccuacucggcaccacccagcucucccccgucaacaucugcaccuuccgaggagacguuacccacauccccggcucucgaaacuacaccaugaaccucgccagccaaaacuggaacuccuacgaucccacagaagaaaucccagcaccccuaggaaccccugacuucguaggcaaaauccaaggaguacuaacccaaacaacccgaacaaacggcucaacacgcggccacaaagccaccguauacaccggcuccgcugacuucucacccaaacucggccgaguccaauucgccacagacacagacaacgacuucgaaaccaaccaaaacaccaaauucacccccgucggcgucauccaagacggcuccacaacaccucgcaacgaaccccaacaauggguccuccccucauauucaggccgcaacauccacaacguacaccuugcccccgccgucgccccaaccuucccaggcgaacaacuccucuuuuuccguuccaccaugccaggcuguucaggcuacccaaacauggaccucgacugccuacucccccaagaauggguccaauacuucuaccaagaagcugccccagcccaauccgacgucgcccuccuccgcuucguuaaccccgacacaggccgaguacuauucgaaugcaaacuccacaaauccggcuacgucacagucgcccacacuggccaacacgaccuagucauacccccaaacggguacuuccgcuucgacucuuggguaaaccaauucuacacccuugcaccuaugggcaacggaaccggccgacgacgcgcccuauaa

SEQ ID NO: 36597 - RNA, 1626 nt, Artificial Sequence
  derived and/or modified sequence opt11 from VP1__Norovirus__BAS30308
augaagauggccuccaacgacgucaaccccucagacggaucaaccgccaaccucguccccgaagucaauaaugaaguaauggcccucgaaccugucguaggcgccgccaucgcagcccccguagcaggccagcagaacguuaucgacccauggauccgcaauaacuucguccaagcaccuggaggugaauuuaccgucucaccccgaaaugcucccggcgaaauccucugguccgcuccccucggucccgaucucaacccauaucuaucccacuuagcccgcauguacaacggcuacgccggcggcuucgaaguacaagucauccucgcaggaaacgcauucaccgccgucguacgaaucauuuucuccgccguuccacccaacuuucccaccgaaggucucucccccucccaagucaccauguuuccccacauuaucgucgacguacgccaacucgaaccaguccucaucccucuacccgacguccgcaacaacuucuaucauuacaaccaguccaacgacuccaccaucaaacucauugccaugcuuuacacaccccugcgcgcaaacaacgccggagacgacgucuucaccguauccugccgaguacuaacccgaccuucccccgacuucgacuucaucuuccuuguacccccaaccguugaaucaagaaccaaacccuucuccguacccguccuaaccguagaagaaaugacuaacagccgcuucccaaucccucuagaaaaacucuucaccggaccauccuccgccuuugugguccagccccaaaacggccgcugcaccacugacggcguccuccucggcacaacacaacuguccccagucaacaucugcacauucagaggcgacguaacacauaucucagggucccgaaacuacacuaugaaccuagccucccaaaacuggaacucuuacgaccccaccgaggaaauccccgcaccccuaggcaccccagacuucgucgggaaaauccagggaguccuaacacaaaccacccgcacaaacggauccacccguggccacaaagccaccguauacacaggcucagccgacuuuucaccaaaacucggccgcguccaauucgccaccgacacugacaacgacuuugaaaccaaccaaaacaccaaauucacccccgucggcgucauccaagacgggagcaccacaccccgcaacgaaccccagcaauggguacuacccucuuacagcggacgcaacauccauaacguccaccucgccccagccgucgcccccaccuuccccggcgagcaacuccucuucuuccgcuccaccaugcccggcugcucuggauaccccaacauggaucuugacuguuuacucccccaagaauggguccaauacuucuaccaagaagcagcccccgcccaauccgacgucgcacuccuccgcuuugucaaccccgauacaggacgcguccucuucgagugcaaacuccacaaaucaggcuacguaaccgucgcacacacaggccaacacgaccuagucauucccccaaacggauacuuucguuucgacagcugggucaaucaauucuacacacuagcccccaugggcaacggcaccggccggcgccgcgcccuauaa

SEQ ID NO: 36598 - RNA, 1623 nt, Artificial Sequence
  derived and/or modified sequence opt11 from VP1__Norovirus__BAS30311
augaaaauggcaucaucagacgccaaccccuccgacggcuccaccgccaaucuagucccugaaguaaacaacgaaguaauggcccucgaaccagucgucggcgccgcaauugccgcccccgucgccggccagcaaaacgucaucgaccccuggauacgaaacaacuucguccaagcgcccggaggcgaguucaccgucuccccucguaaugcccccggcgaaaucuuauggucagcuccccucggccccgaccucaacccuuaucuaucucaucucgcccgcauguacaacggauacgccggagguuucgaaguacaagucauccucgccggcaacgccuuuacagccggcaaaaucaucuucgccgccgucccacccaacuuccccaccgaaggucuuucucccagccaaguaaccauguucccccauaucaucgucgauguccgccaacuagagcccguccuaaucccacuccccgacguacgcaacaacuucuaccacuacaaccaaucaaacgacucgacaaucaaacucauagccaugcucuacacuccccuccgcgccaacaacgccggagacgauguauucaccguguccugccgaguccuaacccgcccaucccccgacuucgacuucaucuuccuugucccacccaccguagaaucacgcaccaaacccuucucagucccgguccuaaccgucgaggaaaugacuaacucacgcuuccccaucccccucgaaaaacucuucaccggccccuccagcgcuuucgugguacaaccccaaaacggacgaugcaccacagacgguguucuccucggcacaacccaacucucccccgucaacaucugcacauuccgcggcgacguuacacacauacccggcucacguaacuacaccaugaaccuagccucucaaaacuggaacuccuacgaccccacagaagagauacccgcaccccuaggcacccccgacuucguaggaaaaauccaaggaguccucacccaaacaacacgaaccaacggcuccacacgcggacauaaggccaccguuuauaccggauccgcagauuucucccccaaacucggccgcguccaauucgccaccgacaccgauaacgacuucgagaccaaccagaacaccaaauucacgcccguaggcgucauccaagacgguucaaccaccccacgaaacgaaccccaacaauggguacucccuagcuacuccggucgcaacauccacaacguccaccuggcccccgcaguagcccccaccuuucccggcgaacaacucuuauucuuccgauccaccaugcccggaugcucugguuacccgaacauggaccuugacugccuccucccgcaagaauggguacaauacuucuaccaagaagccgcacccgcccaauccgacguagcccuccucagauucgucaacccagacaccggacgcguccucuucgaaugcaaacuacacaaauccggcuacgucacaguagcccacacuggacaacacgaccuagucaucccacccaacggauacuuccgcuucgacuccugggucaaccaauucuacacccucgcccccaugggaaacggcacagggcgccgccgcgcccucuaa

SEQ ID NO: 36599 - RNA, 1623 nt, Artificial Sequence
  derived and/or modified sequence opt11 from VP1__Norovirus__BAS30314
augaaaauggcauccucugacgccaaucccuccgacggcucuacugcuaaccucgucccagaaguuaacaaugaagucauggcccuagaaccaguuguuggcgccgcaauagcagcucccgucgcaggccaacaaaaugucauugaccccuggauccgcaacaacuucguccaagccccuggcggagaguucacugucuccccacgcaacgcccccggugaaauccuguggucagccccucucggaccagaccucaaccccuaccucucccaccuagcacgcauguauaacggcuacgccggcggcuucgaaguccaagucauacuagcuggaaacgccuuuaccgcaggaaaaaucauauucgcagccguaccuccaaacuuccccaccgaaggacucucccccucgcaagucaccauguucccccacaucaucgucgacguacgucaacucgaacccguccucaucccccuccccgacguccgcaacaacuucuaccacuacaaccaaucuaacgacccuaccaucaaacucaucgccaugcucuacacuccccuccgagcuaacaacgccggcgacgacgucuuuaccguauccugucgcguccucacccgucccagccccgacuuugacuucaucuuccucgugcccccuaccguugaaucacgcaccaaaccauuuuccguccccguacucaccgucgaagaaaugacaaacuccagauuccccauaccacucgagaaacucuucacaggccccuccuccgccuucgucguccaaccccaaaacggucguugcaccacagacggaguccuacuaggcaccacucaacucucccccguaaauaucugcacauucagaggcgacgucacccacauccccggcuccagaaacuacaccaugaaccucgcuucccagaauuggaacuccuacgaccccaccgaagaaaucccagccccucuaggaacccccgacuucguaggcaagauacaagguguccucacccaaaccacccgaacaaacggcuccacccgcggccacaaggcaacugucuacaccggcucagcggauuucucccccaaacucggcaggguccaauucgccaccgacaccgacaacgacuucgaaaacaaccaaaauaccaaauucaccccagucggcgucauccaagacggauccacaacaccccgaaacgaaccccaacaauggguacucccaagcuauuccggucgcaacauacauaacguacaccuggcacccgccguagcccccaccuuuccaggcgaacaacuccucuucuuccgauccaccaugcccggcuguuccggcuaccccaacauggaccucgacugccuccucccacaagaauggguacaauacuucuaucaagaagccgcccccgcacaauccgacguagcccuacuacguuuugucaaccccgacacaggacguguccucuucgaaugcaaacuccauaaaucaggauacgucacagucgcccacaccggacaacacgaccuuguaauaccacccaacggauacuuccgcuuugacucaugggucaaccaauuuuacacacucgcacccaugggcaacggcaccggacgccgcagagcccuauaa

SEQ ID NO: 36600 - RNA, 1623 nt, Artificial Sequence
  derived and/or modified sequence opt11 from VP1__Norovirus__BAS30317
augaaaauggccuccucugacgcaaaccccucagacggcucaacagcuaaccuuguaccugaagucaacaacgaagucauggcccucgaaccugucgucggcgccgccaucgccgcucccguagccggccaacaaaacgucaucgaccccuggaucagaaacaacuucguacaagcccccggcggcgaguucaccgucucaccccgaaacgcccccggcgaaauccuaugguccgcuccccuaggaccugaccuaaacccauaccucucccaucucgcacgcauguacaacggauacgcuggaggcuucgaaguacaaguaauccuagccggcaacgccuucacagccggaaagaucaucuuugccgccgucccacccaacuuccccaccgaaggccucagcccaucacaagucaccauguucccccacaucaucguugacguacgccaacucgaacccguccuaaucccccuacccgacguacgcaacaauuucuaccacuauaaccaaucuaacgaccccaccaucaaacuaaucgccaugcuuuacacaccccuccgcgccaacaacgccggcgacgacguauucaccgucuccugccguguccucacucgaccaucccccgacuucgacuucaucuuccucguuccaccuaccgucgaaucccgaacaaaacccuucagcguccccauccuaaccguagaagaaaugaccaacucccgcuuuccaauaccacuugaaaaacucuucaccggccccuccuccaccuucgucguccaaccccaaaacggccgcugcaccaccgacggcguccuacucggcaccacucaacuauccccagucaacaucugcaccuuccgcggcgacguaacccacauagcaggcagccgaaacuauaccaugaaccucgccucacaaaacuggaacuccuacgacccaacugaagaaauccccgccccacuaggaacccccgauuucguaggaaaaauccaaggcguccucacccaaaccacacgaaccgacggcagcacccgcggacacaaagccaccgucuacacaggcuccgccgauuucucuccgaaacucggcagaguccaauucgccacagauacggacaacgacuucgaugcaaaccagaacaccaaauucacacccguaggugucauccaagacggcggcacagcccaccgcaacgaaccccaacaguggguucuaccuuccuacuccggucgaaacacccacaacguacaccuagccccagcaguagccccaaccuuuccuggcgaacaacuucuauucuuucgcuccacaaugccaggcugcucaggcuacccuaacauggaccuggacugccuccuaccacaagaauggguccaguacuuuuaccaagaagccgccccagcccaaucagacgucgcacuccuccgcuucgucaaccccgacaccggccgcgucuuauucgaaugcaaacuacacaaaagcggcuacguaacagucgcccacacaggacaacacgaucucguuauacccccuaacggcuacuuccgauucgacucaugggucaaccaauucuacacacuagcacccaugggcaacggaaccggccggcgccgcgcacucuaa

SEQ ID NO: 36601 - RNA, 1623 nt, Artificial Sequence
  derived and/or modified sequence opt11 from VP1__Norovirus__BAS30320
augaaaauggcuucauccgaugccaaccccuccgacgguuccaccgcgaaccuaguccccgaagucaacaacgaagucauggcucucgaacccgucgucggcgccgcuaucgcagcccccguagccggacaacaaaacgucauagaccccuggauacgcaacaacuucguacaagccccaggcggggaauuuacagucagcccccgaaaugccccaggcgaaauccucugguccgcgccccuuggacccgaccucaacccuuaccucucccaccuagcccgaauguacaacggauacgcgggcggcuucgaaguccaagucauccucgccggcaacgccuucacugccggaaaaauaauauucgcagcgguaccucccaacuuccccacagaaggccuuuccccaucacaagucaccauguucccucacauaaucguagacguccgccaacucgaacccguccucaucccccuccccgacguccgcaauaacuuuuaucacuacaaccaaucuaaugauccaaccauaaaacucauagcgaugcucuacacccccuuacgagcaaacaacgccggcgacgacgucuucacagucucuugccguguacucacccgcccgucccccgacuucgacuucaucuucuuaguacccccuaccgucgaaagccgcacaaaacccuucagcgucccgauccucaccgucgaagaaaugacaaacucccgcuuccccaucccccucgaaaaacucuucaccggcccuuccucuaccuucguaguccaaccccaaaacggacgcugcaccaccgacgguguccuccuuggcacuacccaacuaucacccgucaacauaugcacauuccgaggggacgucacccacaucgcaggcucccgcaacuacaccaugaaccucgccucacaaaacuggaacucauacgaucccacagaagaaauaccagcgccccugggaaccccagauuucgucggcaaaauccagggcguccuuacccaaacgacccgcacugacggcuccacccgcggccacaaagccaccgucuacaccggcucagccgacuucucccccaaacucggacgaguucaauucgccacagauaccgacaacgacuucgacgcaaaccaaaacaccaaauuuacaccagucggcgucauccaggacggcggcaccgcacaccguaacgaaccacaacaauggguccugccauccuacucaggccgcaauacucauaacguccaccucgcccccgccguggcccccacauuccccggcgaacaacuccucuucuuccgauccaccaugcccggcugcucaggcuaccccaauauggaccuugacugccuccuaccccaagaauggguccaauacuucuaccaagaagcugcacccgcccaauccgacgucgcccuucuccgcuucgucaacccagauaccggccgcguccuauucgaaugcaaacuacacaaauccggcuacgucaccgucgcccacaccggccaacaugaccucguaaucccucccaauggcuauuuccgcuucgacuccugggucaaccaauucuacacccuagcacccauggggaacggcaccggacgccgucgagcccucuag

SEQ ID NO: 36602 - RNA, 1623 nt, Artificial Sequence
  derived and/or modified sequence opt11 from VP1__Norovirus__BAS30323
augaaaauggcaucuucagacgccaaucccucggacggcucuaccgccaaccuuguacccgaagucaacaacgaaguaauggcccuugaaccagucguuggcgccgccaucgccgcuccugucgcaggucaacaaaacguaaucgacccauggauccgaaauaacuucguacaagcaccaggcggcgaguucaccguaucaccccgcaacgcacccggcgaaauccucugguccgcaccccucggccccgaccucaacccauaucucucccaccucgcccgaauguacaacggcuacgcaggaggcuucgaaguacaagucauccucgccggcaacgccuucacagccggcaaaaucaucuucgccgcaguucccccaaacuuccccaccgaaggccucucccccucucaagucacaauguucccacacauaauugucgacguccgccaacucgaacccguauuaauaccccuuccagacguuagaaacaacuucuaccauuacaaccaaucaaacgaccccaccaucaaacucauagccaugcuauacaccccacuacgagccaacaacgccggagacgacgucuucacaguuucaugccggguccucacacgacccucccccgacuucgacuucaucuuccucgucccaccaaccgucgaaucccgaacuaaacccuucucagugccaguccucaccgucgaagaaaugaccaacucccgcuucccaaucccccuugaaaaacuauucacaggccccucauccgcauucgugguccaaccccaaaacggccgcugcacaaccgacggaguacuccucggcaccacacaauuauccccugucaacaucugcaccuuccgcggagaugucacucacaucuccggcucaagaaauuacacaaugaaccucgccucacaaaacuggaacucauacgaccccaccgaagagauccccgcacccuuaggcacacccgauuucgucggcaagauccaaggcguccucacacaaaccacgcgaaccaacggauccacacgaggccacaaagcaaccgucuacaccggauccgccgacuucuccccaaaacucggccgcguacaauucgccaccgacaccgauaacgauuucgaaacaaaccaaaacacuaaauucaccccugucggcgucauccaagacggcgguacaaccccacgaaacgaaccacaacaauggguacuccccagcuacuccggucgcaacauccacaacguccaccuugcccccgccguggcccccaccuuuccuggcgaacaacuucucuucuuccgcaguaccaugcccgggugcuccggcuaccccaauauggaccucgacugccugcuaccacaagaauggguucaauauuucuaucaagaagcagcuccagcccaaucugacguagcacuacuacgcuucgucaaucccgauacuggcagaguccucuucgaaugcaaacuccacaaaucuggauacgucaccgucgcccacaccgggcaacacgaccucgucaucccucccaacggcuacuuccgauucgacucauggguaaaccaauucuacacacucgcccccaugggcaacgggacaggacgccgccgagcccuauaa

SEQ ID NO: 36603 - RNA, 1623 nt, Artificial Sequence
  derived and/or modified sequence opt11 from VP1__Norovirus__BAS30326
augaaaauggccuccucggacgccaaccccucagacggauccaccgccaaucucguccccgaagucaacaacgaaguuauggcccucgaacccguugucggagccgccauagcagcacccgucgcaggccaacaaaauguaaucgaccccuggauacgcaacaacuucguccaagcccccggcggggaauuuaccgucuccccacgcaaugcccccggagaaauacuaugguccgcaccccuaggcccagaccuaaaccccuaucucucccaccucgcccgcauguacaacggcuacgccggaggcuucgaaguccaagucauacuugccggcaacgccuucaccgccggaaaaauuauauucuccgccgucccaccaaacuuccccaccgaaggcuuaucucccucccaaguuaccauguucccacacauaauugucgacgucagacagcuagaacccguccuaaucccacuccccgacguccgcaacaacuucuaucacuacaaccaauccaacgauccuaccaucaagcucaucgccaugcucuauaccccacuucgcgccaacaaugcaggagacgacgucuuuaccgucuccugccgcguacucacccgacccucccccgacuuugacuucauauuccuagucccacccaccgucgaaucacgaacaaaacccuucucuguccccauccucaccgucgaagaaaugaccaacucccgauuccccaucccacucgaaaaacucuucaccggccccuccucuaccuucguagugcaaccccaaaauggccgauguaccaccgacggcguccuccugggcaccacucaacuuucccccgucaacaucugcaccuuccguggcgacgucacccacaucaccggaucccacaacuacacaaugaaccucgccucacaaaacuggaacucauacgaucccaccgaagaaaucccagcaccccuaggaacacccgacuucgucggaaagauacaaggaguacuaacccaaaccacccgcacagacggaucaacacgaggacacaaagccaccguauauacaggaucggcagaguucucccccaaacucggccgaguacaauucgccaccgacacaaauaaugacuucgaugccaaucaaaacaccaaauucacacccgucggcgucauccaagacggaggcacaacccaccgaaacgaaccacaacaauggguauuacccucauacagcggacgaaacacacacaacguccaccucgccccagcaguagcaccuaccuuccccggcgaacaacuccuuuucuuccgcuccaccaugcccggcuguuccggauacccaaacauggaccucgacugccuucucccccaagaauggguccaacacuucuaccaagaagcagcccccgcccaauccgacguugcccuccuccgcuucgucaaccccgacaccggccgcguccuauucgaaugcaaacuccacaaaucgggcuaugucacaguugcccacaccggccaacacgaccucgucaucccacccaaugguuacuuccgauucgauuccugggucaaccaauucuauacacucgcccccaugggcaacggaacgggccgacgucgcgcucuguaa

SEQ ID NO: 36604 - RNA, 1623 nt, Artificial Sequence
  derived and/or modified sequence opt11 from VP1__Norovirus__BAS30329
augaaaauggccuccucagacgcaaaccccucagacgguucaacagccaaccucguucccgaagucaacaacgaagucauggcccucgaaccagucgucggcgcagccaucgccgccccugucgccggacaacaaaacguaaucgaccccuggauccguaauaacuucguacaagcccccggaggugaguucaccgucucuccccgaaacgcccccggggaaauccuauggucagcuccccuaggccccgaccucaaccccuaucucucccaccucgcacggauguacaacggcuacgccggcggcuucgaaguacaagucauccucgccggcaacgccuucaccgccggcaaaaucaucuuugcagccguacccccaaacuuccccaccgaaggacuaagccccucccaagucaccauguucccccacaucauagucgauguccgccaauuagaaccuguccuaaucccccuaccggacguacgaaacaacuuuuaucacuacaaccaaucaaacgacuccacaauaaaacucauagcaaugcucuacacaccccuacgagccaacaacgcaggcgaugacguauucaccgucucaugccgaguccucacccggcccuccccugacuucgacuucauauuccucguaccucccaccgucgaaucacgcacaaaacccuucagcgucccaguacucacggucgaagaaaugacaaacucucguuuccccaucccacuagaaaaacucuucaccggcccauccagcgccuucgugguccaaccacaaaacggccggugcaccaccgacggcguccuccuuggaacaacccaacucucacccguaaacaucugcaccuucagaggcgaugucacccacauaucugguuccagaaacuacaccaugaaccucgcaucccaaaacuggaacuccuacgaccccaccgaagaaauccccgcaccccugggcaccccagacuuugucggcaaaauacaagguguccucacucaaacaacgcgcaccaacggcucuacgagaggccauaaagccaccguauacaccggcuccgcagacuucucccccaaacucggccgaguccaauucgcaaccgacaccgacaacgacuucgaaaccaaccaaaauacaaaauucacccccguaggcguaauccaagacggcagcacaacacccagaaacgaaccccaacaguggguccuacccuccuacucuggccgcaacauacacaacguccaucucgcccccgccgucgccccaacauuccccggagaacaacuccuauucuuccgcuccacuaugcccggcugcuccggcuacccaaacauggaccuagacugccuccuaccccaagaauggguacaguacuucuaccaagaagccgcccccgcucaauccgacguagcccuccuccgauuugucaaccccgacacaggccgaguucucuucgaaugcaaacuacacaaaucaggcuacgucaccguagcucacacaggccaacacgaccucgucaucccacccaacggguacuuccgcuucgacucaugggucaaucaauucuacacccucgcccccaugggaaauggcaccggccgccggcgcgcccucuaa

SEQ ID NO: 36605 - RNA, 1623 nt, Artificial Sequence
  derived and/or modified sequence opt11 from VP1__Norovirus__BAS30332
augaaaauggccuccuccgacgccaacccaucagacggcuccaccgccaaccucgucccagaagucaacaacgaagucauggcccuagaacccguagucggcgccgccauagcagccccuguagccggccaacaaaacgugaucgacccauggaucagaaacaacuucguccaagcccccggcggagaguucaccgucucaccuagaaacgccccaggagaaauccuauggucagcuccccuuggcccagaccucaaccccuaccucucccaccucgccagaauguacaacggauacgccggcggcuucgaaguccaagucauccuagccggaaacgcauucaccgccggaaaaaucaucuucucagcaguuccucccaauuuccccacagaaggccucucgcccucucaagucacaauguucccacacauaauaguagacguucgccaacuagaaccuguccugaucccccuccccgacguacggaacaauuucuaccacuacaaccaauccaacgacccuacaauaaaacucaucgcuaugcucuacaccccacuccgcgcaaacaaugcaggagacgacgucuucacagucucuugccgaguccuaacccgacccucacccgacuucgacuucaucuuccucguaccacccaccgucgaaucccgcaccaaacccuucucaguccccauucucaccguagaagaaaugacgaacucccgcuuccccacgccccuagaaaaacucuucaccggccccuccucaacauucgucguccaaccccaaaacggccgcugcacaacagacggcguccuacucggcacuacacaacucuccccggucaauauaugcacuuuccgcggcgacgucacgcacaucaccggcucccacaacuacaccaugaaccuagcaucccagaauuggaacucuuacgaccccaccgaagaaaucccugcuccccucggcacacccgacuucguagguaagauccaaggaguccuaacucaaaccacccgcacagacggcuccacacguggccacaaagccacaguguacacaggauccgccgaguucucacccaaacucggccgcguccaagucgccaccgacacaaacaacgacuucgaugcuaaccaaaacacaaaauucacaccagucggcguuauccaagacggcggcaccacacaccgaaacgaaccucaacaauggguccuccccucguacucaggccgcaaugcacacaacguccaccucgcacccgcaguagcacccaccuucccaggcgaacaacuacuauucuuccgauccaccaugcccggcugcuccggauacccuaacauggaccuagacugccuccuuccccaagaauggguccaacacuucuaucaagaagccgcacccgcacaauccgaugucgcccuacuccgauuuguuaaccccgacacaggccguguacucuucgagugcaaacuccacaaauccggauacgucacggucgcccacacaggccaacacgaccucgucaucccacccaauggcuacuuccgauucgacuccugggucaaccaauucuacacccuugcccccaugggaaacggcaccggccgccgucgcgcacuauaa

SEQ ID NO: 36606 - RNA, 1623 nt, Artificial Sequence
  derived and/or modified sequence opt11 from VP1__Norovirus__BAS30335
augaaaauggccucaagcgacgcaaaccccuccgacggcuccaccgcaaaccucgucccagaagucaacaaugaaguuauggcacuagaaccaguaguaggagccgccaucgcagcaccagucgccggucaacaaaacgucauugaucccuggauacguaacaacuucguccaagcaccaggcggcgaauuuacagucagcccccgcaacgcccccggcgaaauccucugguccgcaccccuaggccccgaucucaaccccuaccuuucccacuuagcccgcauguauaacggauacgccggcggcuucgaaguucaagucauacucgccggcaacgccuucacagccggcaaaaucaucuucgcugcaguacccccaaacuuccccaccgaaggccucucccccagccaaguaaccauguucccccauauaaucgucgacguucgacaacucgaacccguccucaucccccuaccagacguccgcaacaauuucuaccacuacaaccaaucaaacgacccuaccauaaaacucauagcaaugcucuacacaccccugcgugccaacaacgccggugacgacguauucaccguaucaugccgcguucucacccgccccucgcccgacuucgacuucaucuuccucguaccgcccaccgucgaaucccgcaccaaacccuucagcguacccauccucaccguagaagaaaugacuaacucaagauuccccauaccccucgaaaaacuguucaccggacccagcuccgccuucguaguccagccccaaaacggccgcugcacaaccgacgguguacuccucggaaccacccaacucuccccugucaacaucugcacauuccgcggcgacgucacccacauagccggcucacacaacuacacaaugaaucucgccucccaaaacuggaacuccuacgaccccaccgaagaaaucccagcaccacuaggcacaccagacuucgucggcaagauacaaggcguccucacacaaacgaccagaacagacgggucgacccgcggucacaaagccaccgucuacacaggcucagcggaguucucccccaaacucggacgcguacaauuugccacagacacuaacaacgacuucgacgcaaaccaaaacacgaaauucaccccugucggcgucauacaggacggcggcacgacacaccgcaacgaaccucaacaauggguacuccccuccuacuccggaagaaauacccacaacguacaccuagcccccgcggucgcacccacauucccaggugaacaacuccuauucuuccgcuccaccaugccgggcugcucuggcuaccccaacauggaccuugacugucugcuaccacaagaauggguucaauacuucuaucaagaagccgcccccgcccaauccgacguugcccuccuccgcuucguaaauccagacaccggcagaguacucuucgaaugcaaauuacacaaaucuggcuacgucaccgucgcccacacaggacaacacgaccucguuaucccacccaacggcuacuuccgcuucgacuccugggucaaccaauucuacacuuuagcacccaugggaaacggaacaggccgccgccgugcccuauaa

SEQ ID NO: 36607 - RNA, 1623 nt, Artificial Sequence
  derived and/or modified sequence opt11 from VP1__Norovirus__BAS30338
augaaaauggcaagcucagacgcaaacccauccgacggcagcaccgccaaccuaguuccagaaguuaacaacgaaguaauggcacuagaacccgucgugggagcagccauugccgcacccguagcuggacaacaaaacgucaucgacccauggauacguaacaauuucguccaagcgcccggcggcgaguucaccguaagcccccgcaacgcccccggcgaaauacucugguccgcaccccucggcccagaccuaaacccauaccuaucccaccucgcccguauguacaacggauacgccggaggauucgaaguacaaguaauccucgccggcaacgcauucacagcagguaaaauuauuuucgccgcugucccaccaaacuuccccacagaaggacucuccccuucacaagucaccauguucccacauauaauagucgacguccgccaacucgaaccaguccucaucccccuccccgacguucgaaacaacuucuaucacuacaaccaaagcaaugaccccaccaucaaacuaaucgcaaugcucuacacaccccuccgcgccaacaacgccggcgacgacguauucaccguaucaugucgcguucucacccgcccauccccugacuucgacuucauuuuucucguacccccaacugucgaaucgcgcacuaaacccuucuccguccccauccuaacugucgaagaaaugacaaauucacgcuuccccauuccccuagaaaaacuauuuaccggacccucauccgccuucgucgugcaaccccaaaacggccgcugcaccaccgacgguguccuccucggcaccacacaacuaucacccgucaacaucugcacauuucgcggcgacgucacacacaucaccggcucucgaaacuacaccaugaaccuagcaacacaaaacuggaacucauacgacccaaccgaagaaaucccagccccacucggaacccccgacuucguuggaaaaauccaaggcguccucacccaaaccacccgugcagacggauccacccgaggucacaaggccaccgucuacaccggcucagcagauuucgcccccaaacuaggccgcguacaauucgccaccgauacagacaacgacuucgacgcaaaucaaaacacaaaauucacccccgucggagucauacaagacggggacaccgcccaccgcaacgaaccgcaacaauggguccuacccagcuacucaggaagaaacucacacaacguacaccucgccccagccguagcccccaccuuucccggcgaacaacuccuauucuuccgcuccacaaugccaggcugcuccggcuaccccaauauggaccuagacugccuacucccacaagaauggguacaauacuuuuaccaagaagccgccccagcacaaucugacguagcccuauuacgguucgucaaccccgacaccggacgaguccucuucgaaugcaaacuucacaaauccggcuacguaacagucgcccacacaggccaacacgaccuugucaucccgcccaacggcuacuucagauucgacuccugggucaaccaauucuacacccucgcacccaugggcaacggcacaggccgacggcgcgcacucuaa

SEQ ID NO: 36608 - RNA, 1623 nt, Artificial Sequence
  derived and/or modified sequence opt11 from VP1__Norovirus__BAS30341
augaaaauggccuccuccgacgccaaccccucugacggcagcaccgccaaccucguuccagaagugaacaacgaaguaauggcccuagaaccagucguaggcgcugcuaucgcagccccagucgcaggccaacaaaacgugaucgaccccuggauacguaacaacuucguacaagcgcccggcggcgaguucacaguaucaccccgcaacgccccaggagaaauccuuugguccgccccauuaggcccagaucucaacccauaccucucccaccucgcacgcauguacaacggauacgcgggcggcuucgaaguccaagucauucuagccggaaacgcuuucacagccggaaaaaucaucuucgccgccgucccaccaaacuucccaacggaaggccucuccccaucacaaguaacuauguucccccacaucaucgucgacguccgccaacucgaacccguccuaauaccccuccccgacguccgcaacaacuucuaccacuauaaucaauccaaugaccccaccauaaaguuaauagccaugcuauacacaccccuucgcgccaacaacgccggcgacgacgucuuuaccgucaguugucgaguccucacccgcccuuccccagacuucgacuucauuuuucucguaccacccaccgucgaaucacgcacaaaacccuuuucuguaccuguccucacagucgaagaaaugaccaacucccgcuuccccaucccccuagaaaaacucuucaccggacccuccuccgccuucguaguacaaccacagaacggacguugcacaaccgacggcguccuccucggcaccacccaacucagcccaguaaacaucugcaccuuccgcggcgacgucacccacauccccggaucacgcaauuacacuaugaaccuugccagccaaaacuggaacuccuacgaccccacagaagaaauacccgcaccccucggcacucccgacuucguuggcaaaauccagggcguccucacccagacuacccgcaccaauggcuccacccgcgggcacaaagccaccgucuacacgggcucugcagacuucucccccaaacucggacgaguucaauucgcuaccgacaccgacaacgacuuugaaaccaaccagaacaccaaauucacaccaguaggcguaauucaagacgguucaaccacaccccgaaacgaaccacagcaauggguccuaccauccuacagcggacgaaacauacacaacguacaccucgcacccgccguugcccccaccuuccccggcgaacaacuccucuucuuccgauccaccaugccaggcugcuccggcuaucccaacauggaccuagacugccuccuaccacaagaauggguacaauacuuuuaccaggaagccgccccagcccaaucagacguugcccuccugcgcuucguaaaccccgacaccggccgcguacuuuuugaaugcaaacuccauaaguccggcuacgucaccgucgcacacaccggacaacacgaucuaguuaucccacccaacggauacuuccgcuucgauuccugggugaaccaauucuacacccuagcccccaugggcaacggcacgggccgccgacgcgcacucuga

SEQ ID NO: 36609 - RNA, 1623 nt, Artificial Sequence
  derived and/or modified sequence opt11 from VP1__Norovirus__BAS30344
augaaaauggccucauccgacgccaaccccucagacggcuccacagccaaccucguccccgaagucaacaacgaggucauggcacucgaacccguagucggcgccgcaaucgccgcccccgucgcgggccagcaaaacguaaucgaccccuggauaagaaucaacuucguccaagccccaggaggagaguucaccgucucaccccgcaacgcacccggcgaaauccucugguccgcaccccucggccccgaccuuaaccccuaccucucacaucuugcccguauguacaacggauacgccggcgguuucgaaguucaggucauccuugcagguaacgccuucacugccggcaaaauuaucuuugcagcagucccacccaacuuucccacagaaggacucucucccucacaaguaaccauguucccccacaucauagucgacguucgccaacucgaacccguccuaauuccauuacccgacguacgcaacaacuucuaccacuacaaccaaucuaacgaccccaccaucaaacuaaucgccaugcuauacacuccccuacgcgccaacaacgcaggcgacgacguauucaccguauccugccgaguauuaacccgcccaagccccgacuucgacuucauauuccucguuccacccaccgucgaaucaaggaccaagcccuucucaguacccguccuaaccgucgaagaaaugaccaauucucgcuuccccauaccccucgaaaaacucuucaccggccccagcucagccuucguaguccagccucagaacggccgcugcacuacagauggcguccuccucggaaccacacaacucucccccgucaacaucugcacauuccgaggcgacguaacccacauccccggaucccgaaacuacacaaugaaccucgccucccaaaacuggaacucauacgacccaacugaagaaauaccagccccacuaggcacacccgacuucguaggaaaaauccaagguguucucacccaaacaacccgcacaaacggauccaccagaggccacaaagccacagucuacaccggcagcgccgacuuuucccccaaacucggccguguccaauucgcaaccgacacagacaacgacuucgaaaccaaccaaaacaccaaauucacacccgucggaguaauacaagauggaucaacuacgccccgaaacgaaccccaacaauggguccucccaucguacuccggccgcaacauucacaacguucaccucgcccccgccgucgcccccaccuucccaggcgaacaacuccuauucuuccguuccaccaugcccggcugcucaggauacccuaacauggaucucgacugccuccuaccccaagaauggguccaauacuuuuaccaagaagccgcccccgcacaauccgacgucgcucuccuccgcuucgucaacccugacaccggcagaguacucuucgaaugcaaacuucacaaauccggcuacgucaccgucgcgcacacaggccaacacgaccucguaaucccacccaacggcuacuuccgcuucgacuccugggucaaucaauucuacacucucgcacccaugggcaacggcaccggaagacgccgcgcacuauaa

SEQ ID NO: 36610 - RNA, 1623 nt, Artificial Sequence
  derived and/or modified sequence opt11 from VP1__Norovirus__BAS30347
augaaaauggccuccucagacgccaaccccucagacggcuccacagcaaaccuaguccccgaaguaaacaaugaagucauggcacucgaacccguugucggugccgccauagccgcuccaguagccggccaacaaaacguaauagacccauggaucagaaauaacuuuguccaagcccccggcggcgaauuuacagucuccccaagaaacgcccccggagaaauccuauggucagcaccgcuaggccccgaccucaacccauaccucucccaccuugcccgcauguacaauggguacgccggcggauucgaaguccaaguuauccucgccggaaaugcauucacugcaggaaaaauaaucuucgccgcagucccacccaacuuccccaccgaaggucucucccccucccaaguaacuauguucccccacauaaucguagacguacgccaacucgaacccgucuuaaucccccuccccgacguacggaacaacuucuaccacuacaaccaauccaaugaccccaccaucaaacucaucgcaauguuauacacuccccuacgagcaaacaacgcaggcgacgacgucuucaccgucuccugucgcguccuaacuagacccucacccgacuucgacuucauauuccuaguaccacccaccguggaaagcagaaccaaacccuucuccguccccguccucaccguagaagaaaugaccaacucacgcuuccccaucccccuugaaaaacucuucaccggcccauccuccgcauucgucguccaaccccaaaacggacgcugcacaaccgacggaguacuccuuggaaccacacaacuaucccccgucaacaucuguaccuuccgcggugacgucacccacauccccggaucacgaaacuacacaaugaaucuagcaucccaaaacuggaacucauacgacccuacagaagaaauacccgcaccccucggaaccccagacuucgucggcaaaauccaagguguccuaacccaaacaacccgcacaaacggcuccacacgaggccacaaagccacagucuacaccgguuccgccgacuucuccccaaaacuaggucgaguacaauucgccacagacaccgacaaugacuucgagaccaaccaaaacaccaaauucacccccgucggcguuauccaagacggcuccacaacaccccgcaacgaaccccaacaaugggugcuccccuccuacuccggccgaaauauccacaacguccaccucgccccugcgguugcccccaccuuucccggcgaacaacuccucuucuuucgaucuaccaugccaggcugcuccggcuaccccaacauggaccuugacugucugcucccgcaagaauggguacaauacuucuaccaagaagccgcccccgcacaaucagacgucgcccugcuccgguucgucaacccugacaccggccgcguccuauucgaaugcaaacuccacaaauccgguuacgucaccgucgcccacacuggacaacacgaccuaguaauaccacccaacggauacuuccgcuucgacagcugggucaaccaauuuuacacccuugcccccaugggaaacggcaccggacgccgccgggcccucuag

SEQ ID NO: 36611 - RNA, 1623 nt, Artificial Sequence
  derived and/or modified sequence opt11 from VP1__Norovirus__BAS30350
augaaaauggccucuucagacgcaaauccauccgacggcucuaccgccaaccuaguacccgaggucaacaaugaaguaauggcacucgaacccgucgucggcgccgcuaucgcagcaccagucgccggccaacaaaacguaaucgaccccuggauucgaaacaacuucguacaagcccccggaggcgaguucaccgucucccccagaaacgcccccggcgaaauccuaugguccgccccacucgggcccgaccucaacccguaccugucccaccuagcccgcauguacaacggauacgccgguggcuucgaaguccaagucauccucgccggcaacgccuucaccgccgguaaaauaauauucgcggccgucccaccuaacuuccccacagaaggcuuaaguccuucacaagucacuauguucccccacauaaucguagacguccgccaacuagaacccguccucauuccacuccccgacgucagaaacaacuucuaccacuacaaccaauccaacgaccccaccauuaaacuaauagcaauguuauacacuccccuacgagccaacaacgcaggcgacgacguauucaccguuuccugccgugugcuuacccgaccaucaccagacuucgacuucaucuuccuggucccucccaccgucgaaucacgaacaaaaccauucuccgucccuguccucaccgucgaagaaaugacgaacucccgcuuccccaucccacucgaaaaacuguuuacgggacccuccuccgccuucgucguacaaccccaaaacggacgcugcacgaccgauggaguccuccucggcacaacccaacucagccccguaaacaucugcaccuuccgaggagacgucacacacauccccggaucucguaacuacaccaugaaccucgcaucccagaacuggaacuccuaugacccaaccgaagaaaucccagccccacucggcacacccgacuucgucggcaaaauccaaggaguccucacccaaacaacccgcaccaacggauccacccgaggacacaaagccacagucuacaccggcuccgcagacuuuucacccaaacucggccggguccaauucgccaccgacacugacaacgacuucgaaacaaaccaaaacaccaaauucacccccgucggaguaauccaagacggaagcacaacaccccgaaacgaaccccaacaaugggucuuacccuccuacucaggacgcaacauacauaacguccaccucgcccccgccguagccccaaccuuccccggagaacagcuccucuucuuccgcuccaccaugcccggcugcucaggcuaccccaacauggaccucgacugccuccuaccucaagaauggguacaauacuucuaccaagaagccgcgcccgcucaguccgacgucgcacuacuacguuucgucaaccccgacaccggacgcguccucuucgagugcaaacuacacaaauccggauacgucaccgucgcacacacaggccaacacgaccuugucaucccaccaaacggauacuucagauucgacuccuggguaaaccaauucuacacacucgcaccaaugggcaacggaaccggccgccgacgcgcccucuaa

SEQ ID NO: 36612 - RNA, 1623 nt, Artificial Sequence
  derived and/or modified sequence opt11 from VP1__Norovirus__BAS30353
augaaaauggcauccucagaugccaacccauccgauggcucgaccgcaaaccucgucccagaagucaacaacgaagucauggcccuagaacccgucguaggcgccgccauugcugcccccgucgcaggacaacaaaaugucauagaccccuggauccgcaacaacuucguacaggcccccggaggagaguucaccguaucaccccguaaugccccaggcgaaauccucuggucagcaccccucggacccgaccuuaaccccuaccucucccaccucgcccgaauguacaacggcuacgccggaggcuucgaaguccaagucauucucgcaggcaacgcuuucacagccggcaaaauaaucuucgccgccgugccacccaacuuccccaccgaaggccuaucccccucccaagucacaauguucccccacaucauugucgacgugcgccaacucgaacccgucuuaaucccccuccccgacguccgaaacaacuuuuaucacuacaaucagcucaacgaccccaccauuaaacuuauagcaaugcucuacacaccccuacgcgcaaacaacgccggcgacgacgucuucaccgucucaugccgcguacuaacacgucccucccccgacuucgacuucauuuuccucgucccgcccaccgucgaauccagaaccaagcccuucuccguccccguccucaccgucgaagaaaugaccaacucccgcuuccccaucccccucgaaaagcuauucacaggacccucuuccgccuucguaguacaaccccaaaauggccgaugcaccacagacggcguacucuuaggcaccacacaacuguccccagucaacaucugcaccuuccgcggcgacguaacucacauacccggaucgagaaauuacacaaugaaccucgcgagccaaaacuggaacucauacgaccccaccgaagaaauccccgcaccccuaggaaccccugacuucgucggcaaaauccaagggguccuaacgcaaaccacacgaacaaacggcuccacccgaggucacaaagccacagucuacaccggcagcgccgacuucagccccaaacuaggccgcguccaauucgcuaccgacaccgacaacgacuucgaaaccaaccaaaacacaaaguucacuccaguuggcguaauccaagacggcucuaccacuccccgcaacgaaccacagcaauggguacuccccuccuacucuggacgaaacauacacaacguucaccuagccccagccguagcccccaccuuccccggagaacagcuucuauucuucagaucaaccaugcccggcugcuccggcuacccgaauauggaccuugauugccuccucccccaagaauggguacaauacuucuaucaagaagccgcccccgcacaaucggacguagcacuucuacgguucgucaauccagacaccggccgcgucuuauucgaaugcaaacuccauaaaucgggauacgucacaguagcccacaccggccaacacgaccucguaaucccaccaaacggguacuuccgcuuugacuccugggucaaccaauucuacacacucgcaccaauggggaacgguacuggccgacgccgggcccucuaa

SEQ ID NO: 36613 - RNA, 1623 nt, Artificial Sequence
  derived and/or modified sequence opt11 from VP1__Norovirus__BAS30356
augaaaauggccuccuccgacgccaaccccucagacggaagcaccgcuaaccuaguacccgaagucaacaacgaagucauggcccuagaacccguugucggcgcugcaauagcugcaccagucgccggacaacaaaacgucaucgaucccuggaucagaaacaacuucguacaagcacccggcggugaauuuacagucucaccccgaaacgcucccggcgaaauccuauggucagaaccccuaggccccgaccuuaacccauaucuaucccaccuagcacgcauguacaacggcuaugcaggcgguuuugaaguccaaguaauccucgccggcaacgcauucaccgcaggcaaaaucaucuuugccgccguucccccaaacuuucccaccgagggcuuaucacccucccaagucaccauguuuccccacauaauagucgacguacgccaacuagaaccaguccugauaccacucccagacguccgaaauaacuucuaccacuacaaccagagcaacgacuccaccaucaaacucaucgcaaugcucuacacaccccuccgugccaacaacgcaggagacgacgucuucacugucagcugccgcguacucacccgcccaucaccagacuucgacuucaucuuucucguaccacccacaguagaaagccgcacaaaacccuucuccguuccaguccucacuguagaagagaugaccaacucccgcuuccccaucccccucgaaaaacucuucaccggccccagcuccgccuucgucguccaaccacaaaauggcagaugcacaacugacggcguccuccuaggcacaacacaacucuccccagucaauaucugcacauucagaggcgacguaacacacauccccggcucccgaaauuacaccaugaaucucgcaucccaaaacuggaacuccuacgacccaaccgaagaaauccccgcaccccuuggcacacccgacuucguaggaaaaauccaaggcguacucacccaaaccacccgaaccaacggcuccacccguggacacaaagccaccgucuacacaggaagcgccgacuucagccccaagcucggccguguacaauucgcaacagacaccgacaacgauuucgaaaccaaucaaaauaccaaauucacccccgucggaguaauccaagacggagguaccacacaccgcaacgaaccccaacaauggguacuaccauccuacucuggcagaaacauccacaacguccaccuagccccagcugucgcccccaccuuccccggugaacaacuacucuucuuccgaucaacuaugcccggcugcucaggcuaccccaauauggaccucgacugccuacucccacaagaauggguacaauacuucuaccaagaagcagcccccgcccaauccgacguggcccuucuaagauucguuaaccccgacaccggccguguccucuucgaaugcaaacuccacaaauccggcuacgucacagucgcacacaccggccaacacgaccuaguuauaccacccaacggcuacuucagguucgacagcugggucaaccaauuuuacacacucgcucccaugggcaacggcacaggacgucggagagcccuuuga

SEQ ID NO: 36614 - RNA, 1623 nt, Artificial Sequence
  derived and/or modified sequence opt11 from VP1__Norovirus__BAS30359
augaaaauggcuagcagcgacgccaaucccucagacggcucaaccgccaaccucguccccgaaguuaacaacgaagucauggcccuagaacccguugucggcgccgccaucgccgcccccgucgccggccaacaaaacgucauagacccguggaucagaaacaacuucguccaggcccccgguggagaguucacaguauccccgcgcaacgcaccaggcgaaauccuauggucagcaccucucggccccgaccuaaaccccuaccucucccaucuugcacgcauguauaacggcuacgccggcggcuucgaaguccaaguuauccucgccggcaacgccuucaccgccggcaaaauaaucuucgcagccgucccuccaaacuucccaacggaaggucucuccccaucacaaguaaccauguucccacacaucaucguagacguccgccaacuagaaccaguccuuaucccucuccccgacguccgcaacaacuucuaccacuacaaccaauccaacgacucaaccaucaaacuaauagcaaugcuauacacaccccucagagccaacaaugcgggagacgacguauuuaccguguccugccgcguccucacccgccccucccccgacuucgacuucaucuuccuaguacccccaaccgucgaaucccguaccaaaccauucuccguccccguccuaaccgucgaagaaaugacuaacucccgcuuccccaucccccuugagaaacucuucacaggaccauccuccgccuuugucguucagccacaaaacggacgcugcaccacugacggcguacuccuaggaaccacccaacucuccccaguuaacauaugcacauucagaggugacgucacucacaucuccggcucacgcaacuacacuaugaaccucgccucacaaaacuggaacucauacgaccccaccgaagaaauccccgcuccucuaggcaccccagacuucgucggcaaaauccaagguguccuaacccaaacuacacgcacaaacggcuccacccggggacacaaagccaccguauacaccggcuccgcagacuucucaccaaaacuuggccgaguacaauucgccacagacaccgacaacgauuuugagaccaaccaaaacaccaaauucaccccuguaggcgucauccaggauggauccacaaccccacgcaacgaaccccaacaauggguccuuccauccuacuccggccgaaacauacacaacguccaccuagcacccgcaguagcacccaccuucccaggcgaacaacuacucuucuuccgcuccacaaugcccggcugcuccggcuacccaaacauggaccucgacugccuccucccucaggaauggguucaauauuucuaccaagaagccgcccccgcccaauccgacgucgcccuacuccgcuucgucaaccccgacacaggacgcguccuauucgaaugcaaacuacacaaaucaggcuacguaacaguugcccacacaggccaacacgaucucgucaucccacccaacggguacuuccgauucgauuccuggguuaaccaauuuuacacucuagcccccaugggaaacggaaccggacgccgccgagcccuauaa

SEQ ID NO: 36615 - RNA, 1623 nt, Artificial Sequence
  derived and/or modified sequence opt11 from VP1__Norovirus__BAS30362
augaaaauggcuuccuccgacgccaaccccuccgacggcucuacagccaaccucgucccugaaguaaacaacgaaguaauggcccucgaaccuguugucggagcugccaucgccgcuccagucgccggacaacaaaacgucaucgacccauggauucgaaacaacuuuguccaagcccccggaggcgaguucaccgucucuccaagaaacgccccuggagaaauccucugguccgcaccccuuggcccugaccuaaaucccuaccuaucccaccucgcccgcauguacaacggauacgccggcggauucgaaguucaagucauccucgcaggaaacgccuucaccgcaggaaaaaucauauucgccgccgucccacccaacuuccccacggaaggccucagccccucccaagucaccauguuuccccacaucaucguagacguccgccaacuugagccaguccucaucccccuccccgacgucagaaauaacuuuuaccacuacaaccaauccaacgaccccaccaucaaauuaauugcuaugcuuuacacaccccuccgagccaacaacgccggcgacgacgucuucaccguguccugucguguucucacccgccccucccccgacuucgauuucauauuccuagucccacccaccguagagucacguaccaaacccuucuccguccccguauugaccguggaagaaaugaccaacucucgcuuccccauaccccucgaaaaacucuucaccggccccuccuccgccuuuguaguccaaccccaaaacggccgcugcaccaccgacgggguccuccuuggcaccacccaacucucucccgucaacauuugcaccuuccgcggagacgucacccacaucccuggcucacgcaacuacacaaugaaucucgccucccaaaacuggaacuccuaugaccccaccgaagaaauccccgccccucucggaacaccugacuucgucggaaaaauccaaggaguacucacacaaaccacacgaaccaacggguccacaagaggacacaaagcaacagucuacacaggcagcgcagacuucucccccaaacucggacgcguccaauucgcuacagacaccgacaaugacuucgaaacaaaccaaaacaccaaauucacacccguaggcguaauacaagacggcuccaccacaccccgcaacgaaccccaacaauggguccucccuucauauucaggccgcaacauccacaacguccaccuagcaccagcaguagccccaaccuucccuggagaacaacuccucuucuuccgcuccaccaugcccggcuguucuggauacccaaacauggaccucgacugccuucucccacaagaauggguccaauacuucuaucaagaagcugcacccgcacaaucagacgucgcgcuccuacgauucgucaaccccgacaccggucgaguccucuucgaaugcaaacuccacaaauccggcuacguaaccgucgcacacacaggacagcacgaccuagucauucccccaaaugguuacuucagauucgacuccugggucaaccaauucuacacucuagcuccaaugggcaacggcaccggccgccgccgcgcacuauaa

SEQ ID NO: 36616 - RNA, 1623 nt, Artificial Sequence
  derived and/or modified sequence opt11 from VP1__Norovirus__BAS30365
augaaaauggccucauccgacgccaaccccucagacggcucgacugccaaccuagucccagaagucaacaacgaagucauggcccucgaaccagucguaggagccgccaucgccgcccccgucgccggccaacagaacgucaucgaccccuggauccgaaacaacuucguacaagcccccggcggugaauuuacaguaucccccagaaacgcccccggcgaaauccuguggucagccccucuaggcccagaucucaaucccuaccucagccaccuggcaagaauguauaacggauacgcuggcggauucgaaguccaagucauucuagccggcaacgccuucacagcuggcaaaaucaucuucgcugccguacccccaaauuucccaaccgaaggccuaucucccucacaagucaccauguucccccacauuaucguagacguccgccaacucgaaccugucuuaaucccccuccccgacgucagaaacaacuucuaccacuacaaccaauccaaugauccaacaaucaaacugaucgccaugcucuacacuccacuccgagcaaacaacgccggggacgacgucuucacagucucaugcagaguccucacacgcccauccccagacuucgacuucaucuuccuaguacccccaaccgucgaaucccgcaccaaacccuucuccgucccaguacuaaccgucgaagaaaugacaaacucccgcuuccccaucccccucgaaaaacuauucaccggaccuucauccgccuucguuguucaaccacaaaacggacgaugcaccacugacggaguccuucucggcacgacacaacuaucaccaguaaacaucugcacauuucgcggcgauguuacccauaucuccggcucacgaaacuacaccaugaaccucgcaagccaaaacuggaacagcuacgaccccacagaagaaaucccagcgccccuaggcacuccagacuucgucggcaaaauccagggcguccucacacaaaccacacguacuaacggaucaacacgaggacacaaagccaccgucuacacaggcuccgccgacuucucgccaaaacucggccguguacaauucgcgacagacaccgacaacgacuucgaaaccaaccaaaauaccaaauucacccccgucggagucauacaagacggauccaccacuccucgcaacgaaccacaacaguggguccuccccuccuauuccggucgcaacauccauaacguucacuuagcccccgccguugcaccaacauuucccggcgaacaacuccucuucuuccgcucaaccaugcccggcugcuccggauacccaaacauggaccucgacugccuucugccccaagaauggguacaauacuuuuaccaagaagcagcccccgcccaaucagacguagcccuccuacgcuucgucaacccggacaccggccgcguacuauucgaaugcaaacuccacaaauccgguuacguuacagucgcacacaccggccaacacgaccuagucaucccucccaacggcuacuuccgcuuugacucaugggucaaccaauucuacacccuugcacccaugggaaauggcaccggacgacgacgcgcauuauaa

SEQ ID NO: 36617 - RNA, 1623 nt, Artificial Sequence
  derived and/or modified sequence opt11 from VP1__Norovirus__BAS30368
augaaaauggcguccuccgacgccaaccccucagacggcuccaccgccaaccucgucccagaaguaaacaacgaagucauggcccuagaaccagucgucggcgccgcuauagcugcacccguagcaggccaacaaaacgucauugaccccuggauccgcaacaacuucguacaagcccccggaggugaguucaccgucagcccgcgcaacgccccuggagaaauccuuugguccgcuccccugggacccgaccucaacccauaccucucccaccuagcccgcauguacaacggauacgccggcggcuucgaaguccaagucauccucgcgggcaacgccuucacagccggcaaaaucaucuuugccgccgucccacccaacuuccccaccgaaggccucucccccucccaaguaaccauguucccccacauaaucgucgacguccgccaacuagaaccaguccuaauuccccucccagacguacgcaacaacuuuuaccauuacaaccaaucaaacgacccaacaaucaaacucauagcaaugcuauacaccccacuccgcgccaacaacgccggagacgacguauucaccgucucaugccgcguccucacccgcccuucacccgacuucgacuucaucuuccuagucccacccacaguagaaucucgcacaaaacccuuuucaguacccguccucaccguagaagaaaugacuaacucccgcuuccccauuccucucgaaaaacuuuucaccggacccucuuccgccuucgucguccaaccccaaaacggacgcugcacaaccgacgguguacuucugggcacaacccaacucucacccguaaacaucuguaccuuccguggcgacguaacccacauccccggcucacgcaacuacaccaugaaccucgcuucccaaaacuggaacucauacgaccccaccgaagaaauaccagccccucucggcacaccagacuucgucggaaaaauccaaggcguccucacccaaacaacucgcacaaacggcuccacccguggccacaaagccaccgucuacacaggcuccgcugacuuuagcccuaaacucggccgaguccaauucgccacagacacagacaacgacuucgaaaccaaccaaaauaccaaauucaccccagucggcguuauacaagacggcuccaccaccccucgaaacgagccucaacaauggguacucccuuccuacucuggccgcaacauucacaacguacaccucgccccugccgucgcaccaacauuccccggagaacaacuccuauucuuccgguccaccaugccaggaugcuccggcuaccccaacauggaccuagacugccuccucccgcaagaauggguucaauacuucuaccaagaggccgccccagcacaauccgaugucgcucuacucagauucguaaaccccgacaccggccguguccuguucgagugcaaacuccacaaguccggcuacgucaccguagcucacacuggacaacacgaccucguaauaccgcccaacggauacuuccgcuucgacucauggguaaaccaauucuacacccuugcacccaugggaaacggaacaggccgcagacgcgcccuauaa

SEQ ID NO: 36618 - RNA, 1623 nt, Artificial Sequence
  derived and/or modified sequence opt11 from VP1__Norovirus__BAS30371
augaaaauggcaucauccgacgccaaccccucugacggcuccacagccaaccucguuccggaaguuaacaacgaagucauggcccuagaacccgucguuggcgccgccauagcagccccaguugcuggccaacaaaaugucauagaccccuggaucagaaacaacuuuguccaagcacccggaggcgaguucaccguuuccccacgcaacgcccccggcgaaauccuauggagcgccccacuaggccccgacuuaaaccccuaccucucccaccuagcacgcauguacaacggcuaugccggcggcuucgaaguccaagucauccuagcuggcaacgccuucaccgccggcaaaaucauauucgcagccguuccacccaacuuccccacagaaggacucucccccucccaagucacaauguucccccacaucauugucgacguccgacaacucgaacccguucuaauaccacuccccgaugugcgaaacaauuucuaucacuacaaucaauccaacgaccccacuauaaaacuaauugccaugcuauacacaccccuaagagccaacaacgccggagacgacguauucaccguuuccugccgcguccuaacccgacccucccccgacuucgacuucauauuccucguaccucccaccguugaaucccgaaccaaacccuucuccguccccguccucaccguggaagaaaugaccaacucucgcuuccccaucccacucgaaaagcuauucaccggucccagcucagcauucgucguccaaccccaaaacggacgcuguaccaccgacggcguacuacucggcaccacccaacucaguccaguaaacauaugcaccuuccgcggcgaugucacccacauacccggaagccgaaacuauaccaugaaccucgccucccaaaacuggaacuccuacgaucccaccgaagaaaucccugccccauuaggaacccccgacuucgucggaaaaauccaaggaguacucacccagacuacgcgaaccaacggcuccacccgcggccacaaagcaacagucuacaccggauccgccgacuucaguccaaaacucggccgcguccaauucgccaccgacaccgacaacgacuucgaaaccaaucaaaacacaaaauucaccccgguuggagucauacaagacggcuccaccacaccccgcaaugaaccccaacaauggguacucccaucauacucaggacgaaacauccacaacguucaccucgcgccagccgucgcacccaccuuccccggcgaacaacuccucuucuucagaucgaccaugcccggcugcuccggcuacccaaacauggaccuugacugccuccucccacaagaguggguccaauacuucuaucaagaagccgcacccgcucagucggacguggcccuacuccgauucgucaacccugacaccggccguguccuuuucgagugcaaacuccacaaauccggguacgugaccgucgcccauaccggacaacacgaccuuguaaucccuccuaacggcuacuuccgcuucgacuccugggucaaccaauucuacacccuagcacccaugggaaacggcacuggccgaagacgcgcccuuuga

SEQ ID NO: 36619 - RNA, 1623 nt, Artificial Sequence
  derived and/or modified sequence opt11 from VP1__Norovirus__BAS30374
augaagauggccuccagcgacgccaaucccuccgacggcucaacggcaaaccucguccccgaaguaaacaacgaagucauggcccuagaaccaguagucggagccgcaauagccgcccccgucgccggccaacaaaacgucaucgaccccuggauacgcaauaacuucguucaagcccccggcggagaguucacagucucaccacgcaaugcaccaggagaaauacucugguccgccccucucggucccgaucuuaaccccuaccuaucccaccucgcacgcauguacaacgguuacgccggcgguuucgaaguccaagucauccucgccggcaacgccuucacagccggcaaaaucaucuucgccgcagucccucccaacuuccccaccgaaggccucucaccaucucaaguaacaauguucccucacaucaucgucgacguccgccaacuagaaccuguccuaaucccccuccccgacguccgcaacaacuucuaccacuacaaccaauccaacgaccccaccaucaaacuaaucgccaugcuauacacaccacuacgcgcuaacaacgccggagacgacguauucaccguauccugccgcguccucacacgacccagccccgacuucgauuucaucuuccucguuccaccaaccgucgaaucacgcaccaaaccauucucuguacccguccuuaccguagaagaaaugacuaacucacgcuucccaauaccccuugaaaaacucuucaccggacccuccucagccuucguuguccaaccccaaaacggcagaugcacaaccgacggaguccuccuaggcaccacccaacucucccccguaaacaucugcaccuucagaggcgacgucacacacauaaccggaagccgaaacuacaccaugaaccucgccagccaaaacuggaacagcuacgaccccacagaagaaauacccgcuccccuuggcaccccugacuucgucggcaaaauccaaggcguccuaacacaaaccacacguaccaacggguccacacgaggccacaaagccacagucuacacagguuccgccgacuuuucaccaaagcuaggccgaguccaauucgccacggacaccgacaacgauuucgaagccaaccaaaauaccaaauucacacccgucggcguaauccaagacggcagcacgacaccaagaaaugaaccacaacaauggguccucccauccuacuccggccguaacauccacaacguucaccuagcucccgcaguagcacccaccuucccuggagaacagcuacucuucuuucguucuacaaugccagguugcuccggcuacccaaacauggaccucgacugccuccucccccaagaauggguacaauacuucuaccaagaggccgccccugcucaaagcgauguagcccuacuccgcuuugucaaccccgacacaggccgaguccucuucgaaugcaaacuucacaaauccggcuacgucacaguagcccacacaggacaacacgaccucgucauaccacccaacggcuacuuccgcuucgacuccugggugaaccaauucuacacgcuagcccccaugggaaacggcaccggccgaagacgagcccucuaa

SEQ ID NO: 36620 - RNA, 1623 nt, Artificial Sequence
  derived and/or modified sequence opt11 from VP1__Norovirus__BAU16297
augaaaauggccuccaacgacgacaaccccucagacggcucagccgccaaccuaguacccgaagucaacaacgaagucauggcccucgaacccgucguuggagccgccaucgcagccccagucgcaggccagcaaaacgucaucgaccccuggauacgaaacaacuuuguccaagcccccggcggcgaauuuacaguauccccucgaaacgcaccaggugagauccucuggucugccccacucggccccgaccucaaccccuaccuaucucaccuagcccgcauguacaacggcuacgcuggcggcuucgagguacaagucauacucgcuggcaacgcauuuaccgccggcaaaguaaucuuugccgcuguaccuccaaacuuuccaaccgaaggccuaucccccucccaaguuaccauguucccccacauugucguggauguacggcaacucgaaccaguacucauaccccuccccgacguucgaaacaacuucuaccacuacaaccaauccaacgaccccaccaucaaauuaaucgcaauguuauacacaccccuccgagccaacaaugccggcgacgacguuuucacagucucaugcagaguccuuacccgaccuucacccgacuucgacuuuaucuuccucgucccgcccaccgucgaaucacgaacuaaacccuuuucagucccaguccuaaccgucgaagaaaugacuaauucacgcuuccccauaccacucgaaaaacuauucaccggcccauccuccgcauucgucguccaaccccaaaacggccgcugcaccacggacggcguucuccuaggcaccacccaacuauccccagucaacaucuguaccuuccgaggagacgucacccacauaacaggcucacgcaacuacaccaugaaucuagccucacaaaacuggaacaacuacgacccaacagaagaaauacccgcuccccuaggcacaccagacuucgucggcaaaauucaaggagucuugacacaaacaacccgcaccgacggauccacacgcggccacaaagccaccgucuacacaggcuccgccgacuucgccccuaaacuuggccguguccaauucgaaacugauacagaccacgacuucgaagcaaaucaaaacaccaaauucacaccaguaggcgucauccaagaugguggaaccacccaucgaaacgaaccccaacaauggguccucccaucauacuccggacgcgacacacacaacguccaccuggcaccagcaguagcacccacauucccaggugaacagcuacuauuuuuccgauccacaaugcccgggugcagcggcuaccccaacauggaccucgacugccuacucccccaagagugggugcaauacuucuaccaagaagccgcaccagcacaguccgacguagcccugcuccgauucgucaaccccgacaccggccgcguccucuucgaauguaaacuccacaaaucaggcuacguaaccgucgcccauacaggccaacacgaucucguaaucccgcccaacggauacuuccgcuucgacuccugggucaacaaauucuacacccucgccccaaugggcaacggcacuggccgccgcagagcagucuaa

SEQ ID NO: 36621 - RNA, 1623 nt, Artificial Sequence
  derived and/or modified sequence opt11 from VP1__Norovirus__BAU16299
augaaaauggccuccaacgacgcagcccccuccaacgacggagcagccggccucguccccgaaggcaacaacgaaacacucccacucgagcccgucgccggcgccgccaucgccgcucccguaaccggacaaaauaacaucaucgaccccuggauccgcauaaacuuuguacaagcccccaacggcgaguucacaguuucacccagaaacuccccuggcgaaauacuccucaaccucgaacuaggucccgaccucaaccccuaccuagcacaccuauccagagucuacaacggcuacgccggaggcguagaaguacaaguccuccuagccggcaacgcauucacagccggcaagauccucuucgccgcagucccacccaacuuccccgucgaguucuuaucccccgcacaaauuacaaugcuaccccaccucaucguugacguccgcacucucgaacccaucaugaucccacucccagacguccgaaacaccuucuuucacuacucgaaccagccaaacucccgaaugcgccucguggccaugcucuacacaccccuacgcucaaauggcuccggcgacgacgucuuuaccguuuccugucgaguuuuaacccgacccacccccgacuucgaauuuacauaccucguaccacccucagucgaauccaaaaccaagcccuucucucucccuauccucacccuauccgaacuuaccaacucccguuuccccgucccaaucgacucccucuucacagcccacgacaacguauggcagguacaaugccaaaacggucgcugcacacucgacggugaacuccaaggcaccacccaacuccuccccaccggaaucugcgccuuucgcggccgcgucaccgcacagaucaaccaacgcgaccgcuggcacaugcaacuacaaaaccucaauggcacaaccuacgaccccaccgacgauguacccgccccacucggcaccccagauuuuaaaggcgucgucuucggcauggucucccaacgcaacgucggcaaugacgcacccggcucaacacgcgcucaacaagccugggucucaacauacucgccccaauucguacccaaacucggcuccguuaaccuccgcaucucggauaacgacgacuuccaauuccaacccacaaaauucaccccagucggcgucaacgacgacgacgacggacacccuuuccgacaaugggaacuacccaacuacuccggcgaacuaacccucaacaugaaccucgcacccccaguugccccaaacuuccccggcgaacaacuccucuucuucagauccuuugucccuugcucaggaggcuacaaccaaggcauuaucgacugccuaaucccccaagaauggauucaacacuucuaccaagaauccgccccuucacaauccgacgucgccuuaaucagauacgucaaccccgacacuggccgcacccuuuucgaggccaaacuacaccgcuccggcuacaucacugucgcccacucuggcgauuacccccuagucguccccgccaacggacacuuccgcuucgacucuuggguaaaucaguucuacucccucgcccccauggaaaccggcaacggccgacgccgggcccaauaa

SEQ ID NO: 36622 - RNA, 1635 nt, Artificial Sequence
  derived and/or modified sequence opt11 from VP1__Norovirus__BAU16301
augaugauggcaucaaaagacgccgcucccuccgcagacggcgcaacuggugccggccaacucguacccgaagucaacaccgcagaccccauaccgaucgaccccgucgcugguuccuccacugcccuagccacagccggccaagucaaccucauugaccccuggaucauuaacaacuucguccaagccccucaaggagaguucaccauaucaccuaacaacaccccuggcgacguacucuucgaccuucaacucgguccacaccucaacccauuccucucccaucucucccaaauguacaacggauggguaggcaacaugcgcguccgcguaguacucgccgguaacgccuucaccgccggcaaaguuaucaucugcugcguacccccaggcuuccaaagccgcacccucuccaucgcccaagccacucuguuuccccacguaaucgccgacguucgcacccucgacccagucgaagucccccuagaagacguccgcaacgugcucuaccauaacaacgacacucaacccaccaugcgccuccugugcaugcucuacaccccacuccgaacagguggcgccucaggcgggacagacucuuucguagucgccgggcgcguccucaccugucccgguccagauuuuaacuuccuauuccuugucccacccaccguagaacagaaaacccgacccuuuacuguucccaauauaccccuaaaauaccuauccaacucccgcauccccaauccaauagaaggcaugucccucucccccgaccaaacccaaaacguccaauuccaaaacggccgcugcacaaucgacggccaaccucuaggaaccacaccugucuccgucucccaacucugcaaauuccgcggccgcaucacauccggccaaaaagugcuuaaccuaaccgaacucgacggcucgcccuucauggccuucgcugcucccgcccccguuggcuucccggaccuuggcucaugcgacuggcacaucgaaaugucaaaaauucccaacucaucuacacaauccaaccccaucgucgucaacuccgucaaaccuaacucacaacaauucgucccccaccucuccuccaucacccucgacgacaacgucuccuccggcggcgacuacaucggcaccauccaauggaccuccccaccauccggcuccggcggcgcaaacaccaacuucuggaaaauccccgacuacggaucaucacuagcagaagcgucccaacucgcccccgccgucuacccacccggcuucaacgaagucaucgucuacuucauggccucuauccccggucccaaccaauccggcucacccaaccucguccccugccuccucccucaagaauacaucacacauuucaucucugagcaagccccuauacaaggagaagcagcgcuccuacauuacguagaccccgacaccaaccgcaaccuuggagaguucaaacucuaccccgguggcuacuuaaccugcguccccaacucauccagcaccggcccccaacaacucccacucgacggcguauucgucuucgcauccuggguaucacgcuucuaccaacucaaaccaguugguacagcuggcccagcccgaggacgccucggaguccgccgcuaa

SEQ ID NO: 36623 - RNA, 1623 nt, Artificial Sequence
  derived and/or modified sequence opt11 from VP1__Norovirus__BAU16303
augaugauggcaucuaaagacguacccaccucccccgacggcgcaucaggcgccggacaacucguacccgaagucaacaccgccgaccaaaucuccauggaccccgucgccggcgcuucgaccgccgucgccacagccggccaagucaacaugaucgacccauggauauucaacaacuucguacaagccccacaaggcgaauuuacuaucucccccaauaacacccccggcgacauccucuucgaccuacaauuaggcccucacuuaaaucccuuccuagcccaccucucccaaauguacaacggcugggucggcaacaugagaguccgcaucuugcucgcaggaaaugccuucaccgcuggaaaaaucaucaucugcugugucccacccggcuucgacgcacgaauacucaccauagcccaagcaacccucuucccccaccucaucgcagacguccguacauuagaacccgucgaacuuccccuagaagacguccgaaacguccucuaccacaauuccucccaaccccaacccacaaugcgucuagucgccaugcucuacacaccccucagaaccggcggaggcucaggaggcaccgacgccuucgucgucgcaggccgaguucuaaccugccccgcccccgacuucucauuccuauuccucguaccacccucagucgaacagaaaacgcgcgucuucucaguccccaacauaccccucaaagaccucucaaacucgcgcgucccuacccucauccaaggcauguucguuucuccagacgucaaccaaucuguacaauuccaaaacggacgaugccaaaucgacggccaacuacaaggaaccacccccgucucccuaucccaacuuugcaaaauccgcggaaagacuucaucaaacaccagaguccucaaccuuuccgaagucgacggcacacccuucgucccacucgaaucucccgcccccgucggcuuccccgacauagguggcugcgacuggcauguagguuucaccuucgaagcccgcgaucaaggacccucccagaacguaacauucgcaaccaacgacuccuccuucgucccuuaccucggcuccaucagcccccacaacggcgacggcuuccacuccggcgauaucauaggcucccucgacuggaucuccgcccccuccgacggcuccgcccucgaugucuggagcauaccaaaauacggauccucauuaccagacgucacccaccuugccccugcaguuuucccacccggauucggcgaagugauccucuacuuccacuccaaauuccccggcuccggucccaccgacaaacuacgcguccccugccucaugccccaagaauuuaucacacacuucugugacgaacaagcacccauagcuggagaagccgcucuacuccacuacguagaccccgacgcaggacgaaacuuaggugaauuuaaacucuacccagacggcuucaugaccugcguaccuaacuccaucucauccgguccccaaacacuucccauuaacggcguuuucgucuucguuuccuggguuucccguuucuaccaacuaaaaccagucggcaccgccucuauggcccgccgccuaggccuucgucgcaucuaa

SEQ ID NO: 36624 - RNA, 1647 nt, Artificial Sequence
  derived and/or modified sequence opt11 from VP1__Norovirus__BAU16305
augaaaauggcauccaaugacgcaacccccucaaacgacggagccgccggccucguacccgaaaucaacaacgaagcuauggcccucgacccugucgccggcgccgccauugccgcaccccucacaggccaacaaaacauaaucgacccuuggauuaugaacaacuucguccaagcacccggcggugaguucaccgucucuccccgaaauucccccggcgaaguuuuacucaaccuagaacuaggaccagaaauaaaccccuaccuggcacaccucgcccgcauguacaauggauacgcuggcggcuucgaaguccaagucguccucgcaggcaacgccuucaccgcaggcaaaaucauauucgcggccauaccucccaacuuuuccacagacaauuuauccgccgcccaaauaaccaugugcccccacgugaucgucgacguccgacaacucgaacccguaaaccuccccaugcccgacgucagaaacaacuucuuccacuacaaucaaggcuccgauucccgacuccgccucaucgccaugcuauacacaccauuacgcgccaacaacucaggugacgacgucuuuacaguauccugccguguucuaacccgacccucccccgacuucagcuuuaacuuccucgucccucccaccguagaaucaaaaacgaaacccuuuacccuacccauccucaccauaucagaaaugucuaacucacgcuuccccguccccaucgacucccuacacaccucucccaccgaaaacgucgugguccaaugccaaaauggacgcguaacccucgacggcgaacucaugggaaccacccaacuccuacccucucaaaucugugccuuccgcggcguccucacccgcucuaccucccgugccagcgaccaagcagauaccgccgcaccccgccucuucaauuacuacuggcacauccaacucgacaaccucaacgggacucccuacgaccccgccgaagacauccccggcccccucggaacacccgacuuccgcggaaaaguauuuggugucgccucccaacgcaauccugacagcaccacccgagcacacgaagcaaaaguagacaccaccgcaggacgauucaccccaaaacucggcucccuagaaauaagcaccgaauccgacgacuucgaccaaaaccaaccaacccgcuucacccccguaggcauaggcguagaccaugaagccgacuuccaacaauggucacuccccgacuacuccggucaauucacacacaacaugaaccucgcccccgccguagcaccaaacuucccaggagaacaacuccuguucuuucgcucccaacuacccucaucaggcggacgaucaaauggcauccuugacugucucguaccacaagaauggguacaacacuucuaccaagaauccgcacccgcccaaacccaagucgcccuuguacguuacguaaaucccgacacaggccgaguccuauucgaagccaaacuccacaaacuaggauucaugaccaucgccaaaaacggagacucacccauuaucgucccacccgauggcuacuuccgcuucgaauccuggguaaaccccuuuuacacccucgcacccaugggaaucggaaacggacgccgccgcauacaauaa

SEQ ID NO: 36625 - RNA, 1671 nt, Artificial Sequence
  derived and/or modified sequence opt11 from VP1__Norovirus__BAU16306
augaaaauggcaaguuccgacgccgccccguccgcagauggcgcuggcaaccuaguacccgaaagccaacaagaaguccuaccccucgcacccgucgcaggcgccgcccucgccgccccugucgucggccaaaccaacauuaucgaccccuggaucaaagaaaacuucguccaagcaccccaaggcgaguucacagucucccccaaaaacucacccggcgaaauucucguuaaccuagaacucggccccaaacucaaccccuaccucgaccaccucagccgaauguacaacuccuacgccggcggcaucgaugucauggucguccuagccggaaacgcauucacagccggcaaaguacucauagcagccauaccacccaacuuccccgucgaaggcguaucagcaucccaagccacucaauucccacacgucaucauagacguacgaacccucgacccuguccgacucccacucccugacguccgcucgacuuucuuccacuacaccaacgacaccgaacccaaaaugcgccucgucaucuggcucuauaccccacuccgaacaaacggcuccggcgacgacucuuucacaguaucaggcagaauacucacacggccaucccaagacuucgaguucgccuuccuaaucccacccacugucgaaaccaaaaccacccccuucuccguacccggauucuccguccaagaaauguccaacucacgcuggcccgcugccaucucagcuauggugguccgaggaaacgaaccccaaguuguucaauuccaaaacggccgcgcacaccuagacggaaugcuccuugguacuacccccguaucccccaauuacauugccagcuaccguggcaucuccacaggaaacucacgauccgccagccccgaagccgacgaacgcgcagucggcuccuucgacgucuggauccgccuacaagaacccgacggccagccauacgauauauucggcaaacaaccagccccgauuggcaccccagacuucaaagcuguaauaguaggcuucgccgcucgaccacuaaccuccggauccuacgccaacgaagccuacgucaacacgacagccagcgacuacgcaccagcgacugguaauaugcgcuucaccguccgaaacggaggcuccggccacauaagugcgaacaaauacugggaguucaaauccuucggcguagaaggcgaacgacacacagacauucaauaccaagaauacgaacucccagauuacuccggucaggucgccaguaaccacaaccuugccccucccgucgcaccccgaaugcccggcgaaagccuccuccucuuccaaagcaacaugcccgucugggaugacggccacggcgaauccacccccaagaaaauccacugccuccucccacaagaauuuaucggccacuucuucgacaaacaagccccaagccucggagacgccgcacuguuaagauacgucaaucaagaaacaaaccgcguccucuucgaauguaaacuauaccgagacggcuacaucaccgucgccgcaagcucaggacuccucgacuucccccucgacggcuucuuccgauucgacuccugggucucgucauucuacauucucucacccguaggauccggucaaggacgacgcggacgcguacgauuccaauag

SEQ ID NO: 36626 - RNA, 1626 nt, Artificial Sequence
  derived and/or modified sequence opt11 from VP1__Norovirus__BAU16307
augaugauggccuccaaagacgccacccccuccgcugauggcgccaacggagcaggccagcuaguccccgaagugaacaacgccgaaccccuaccccuagacccuguugccggcgccaguaccgcucuagccaccgccgggcaaguaaacaugauugaccccuggaucuucaacaacuucguccaagccccacaaggagaauuuaccaucucucccaacaacaccccaggggacauccucuucgaccuccaacucggaccccaccucaaccccuuccucgcacaccuaucacaaauguacaacggcugggucggaaacaugcgaguacgcguuauccuagccggcaacgccuucaccgccggcaaagucaucaucugcugcguacccccaggcuuccaauccagaacccuuagcaucgcccaagccacacucuucccccacgucaucgccgauguccgcacguuagaaccacucgaaaucccacucgaagacguccgaaauacccucuaccauaacaacgacucccaacccacaaugcgccuucucugcaugcucuauacgccccuccgcaccggaggcggcuccggagguaccgacgccuucgucgucgccggacguguccucacaugcccauccccagacuucaacuuccucuuccuuguacccccaacaguugaacagaaaaccagacccuucucagucccaaacaucccacuacaaaaucucucgaacucccgcguccccucacuaauccaaucaaugguccucucaucagaccacgcacaaacaguccaauuccaaaacgggcguugcacuaccgacggacaccuccucggcaccacgcccguaagcucgggacaacucaugaaauuucgcggaaaaguaaccccaggcucaaaaguucucaaccucacagaacuagacggcuccccauuccuggcauucgaaccacccgcccccgcaggauucccggaucucgguaaaugcgacuggcacauugaaaugucccuguaccaaguaaacaaccaagacaacccuauaguccugcgagccauagaacccaauucaucguccuuugucccccaccucggcucggucucauucaaccaaaacgucgacgcagccggcgacuacguaugcacaauacaauacaccagcccacccucgaacucacacgacgccgacgucgacuucuggucaauccccgacuacggcucaaaccucgcugaagccucccagcucgcccccgucgucuacccacccggcuucggcgaagcaaucgucuacuucaugucccgaguucccggcuggaaucgcaccaaccgccucaaccuaguccccugccuacuuccgcaagaauuuaucggccacuucgucuccgaacaagcccccgccauaggcgaagcagcccuccuccauuacgucgaccccgacacaaaccguaaucuaggcgaauuuaaacucuaccccgaaggauucauaaccugcguccccaacggaaccggcccccaacagcucccauugaacggcgucuucgucuucuccuccugggucucccgcuucuaccaacucaaacccguuggcaccgcaucgagcgcacgcggacgacuaggcaucagacgcuaa

SEQ ID NO: 36627 - RNA, 1623 nt, Artificial Sequence
  derived and/or modified sequence opt11 from VP1__Norovirus__BAU24831
augaaaauggcaucaucagacgcaaaccccucugacggcagcgccgccaaccucguuccagaaguaaauaacgaagucauggcccucgaacccgucgucggcgccgcgauagcugcgccaguugcaggccaacaaaacgucaucgacccauggauccgcaacaacuucguccaagcccccggcggcgaguucaccgucucgccacgcaacgcacccggcgaaauccucugguccgcuccacuaggaccugaccucaaccccuaccuaucucaccuugcacgcauguacaacggauacgccgguggauucgaaguccaagucauccucgccggcaacgccuucacagccggcaaagucaucuucgccgccgucccacccaacuuccccaccgaaggacucucacccagccaagucacaauguucccccauaucgucguagacguccgccaauuagaacccguccuaauaccccuccccgacguccgcaacaacuucuaccacuacaaucaauccaacgaccccaccaucaagcucauagcaaugcuauacacuccccuccgcgccaacaacgccggugacgacgucuucaccgucucgugucgcguacuuacccgacccuccccagacuuugauuucauauuccuaguacccccaaccgucgaaucccgcaccaagcccuucagcguccccguccuuaccgucgaagaaaugaccaacucacgauucccaaucccccucgaaaaacuauucacaggaccaucauccgcauucgucguacaaccacaaaacggucgcugcacaacugacggcguucuccucggcaccacucaacuaagccccguaaacaucuguaccuuccguggcgacguaacacacaucacaggaucacguaacuacaccaugaaccuagccucccaaaauuggucuaacuacgacccuaccgaagaaauccccgcaccccucggaacccccgacuucguuggcaaaauacagggaguacucacccaaaccacccgcacagacggcucaacccgaggccacaaagccaccgucuacacaggcuccgccgacuucgcuccaaagcuaggccguguucaauucgaaacagacacagaccacgacuucgaagcaaaccagaacaccaaguucaccccggucggcgucauacaagacgguuccaccacccaccgaaacgaaccacaacaauggguacucccaucauacucaggccgcaauacacccaacgugcaccucgcccccgcagucgccccaacauuccccggcgaacagcuucucuucuuccgcuccaccaugcccggcugcagcggcuacccaaacauggaccucgacugccuccucccccaagaauggguccaauacuuuuaccaagaagccgccccugcacaauccgacgucgcccuccuacgcuucgucaacccugacacaggccgcgugcuauucgaaugcaaacuucacaaaucaggauacgucacagucgcccacaccggccaacacgaccucgucaucccacccaacggcuacuuucguuucgacuccugggucaaccaauucuacacacucgcccccaugggcaacgguaccggacgccgacgagcccucuaa

SEQ ID NO: 36628 - RNA, 1623 nt, Artificial Sequence
  derived and/or modified sequence opt11 from VP1__Norovirus__BAU24834
augaaaauggccucaucugacgcaaaccccuccgacggcucagcagcuaacuuaguccccgaaguuaacaacgaagucauggcacucgaacccgucgucggcgccgcaaucgccgcccccguagcuggccaacagaacgucauagaccccuggauucgaaacaacuucguccaagcccccggcggagaguucaccgucucuccccguaacgcccccggcgaaauccugugguccgcaccacuuggaccagaccucaacccauaucucucccaccuagcucgcauguacaacggauacgcaggcggcuucgaaguccaagucauccucgccggcaacgccuucacagccggaaaaguaaucuuugcagccguucccccaaacuucccaacagaaggacucuccccaucacaagucaccauguucccccacaucgucgucgauguacgucaacuagaacccguacuaauaccacuccccgacguccgaaacaacuucuaccacuacaaccagucuaacgacccaacaaucaaacucaucgcaaugcucuacacaccacuacgcgccaacaacgccggcgaugacgucuucacagucucuugccgcguacucacacgucccuccccagacuucgacuucauauuccuaguaccuccaacagucgaaucgaggacaaaacccuucucaguccccguccucaccguagaagaaaugacaaacucacgcuuccccaucccacucgaaaaacucuuuacuggucccuccuccgccuucgucguccaaccucaaaacggccgaugcaccacagacgguguccuucucggaacaacccaacuaucccccgucaacauuugcaccuuccgcggcgacguaacucauaucacuggcucacgaaacuacaccaugaaucuagccucccagaacugguccaacuacgaccccaccgaagaaauccccgccccacucggaacacccgacuucgucggcaaaauacaaggcguccucacacaaaccacccgaaccgacggcagcacccgcggacacaaagccaccguauacaccggcuccgcagacuucgcacccaaacucggccgaguccaauucgaaacagacaccgaccgcgacuucgaagcaaaccaaaacaccaaguucacccccgucggcguuauacaagacggcagcacuacccaccgaaacgaaccacaacaauggguccuaccaucauacuccggacgaaacacccccaacguccaccucgccccugccgucgcccccaccuucccaggcgaacaacuccucuucuuccguuccacaaugcccggaugcuccggcuaccccaauauggaccucgacugccuacucccccaagaauggguccaauacuucuaccaagaggccgcccccgcacaaucagacguugcacuccuccgauucguaaaccccgacaccggccgcguacucuucgaaugcaaacuacacaaaucgggcuacgucaccguugcccauaccggccaacacgaccuaguaaucccacccaauggcuacuucagauuugacuccugggucaaccaauucuacacccucgcacccaugggcaacggcaccgggcgacgcagagcccucuaa

SEQ ID NO: 36629 - RNA, 1623 nt, Artificial Sequence
  derived and/or modified sequence opt11 from VP1__Norovirus__BAU24837
augaagauggccuccuccgacgcaaacccaucagacgguucagccgccaaccuggucccagaaguaaacaacgaagucauggcgcuagaaccuguagucggcgccgccaucgccgcuccaguagccggccaacaaaacguaaucgaccccuggaucagaaacaacuucguucaagccccaggcggugaguucaccgucagcccccgcaacgcaccaggagaaauccucuggucugcaccccuaggccccgaccuaaacccauaccucucacaucuugcccgaauguauaacggcuacgccggaggcuucgaaguacaaguaauacuugccggcaacgccuucaccgcuggcaagguaauauucgccgcgguuccacccaacuuccccaccgaaggacucucaccgucacaaguaaccauguucccccacaucguagucgacguacgacaacuagaacccguacucaucccacuucccgacguucgcaacaacuucuaccacuacaaucaauccaacgacuccaccauaaaauuaaucgccaugcuauauaccccacuucgcgccaacaacgcaggagacgaugucuucacagucucaugccgaguccucacucggccaucccccgacuucgacuucaucuuccucgucccacccaccgucgaaucccgaaccaaacccuucuccguccccguccucaccguagaagaaaugaccaacucacgcuuccccaucccacucgaaaaacucuucaccggacccuccuccgccuucgucguccaaccccaaaacggccgcuguaccaccgacggcguccuacucggaaccacccaacuaucccccgucaacaucugcaccuuccgaggugaugucacccacaucaccggaucacgcaacuacaccaugaaccuugcgucacaaaacugguccaacuacgaccccaccgaagaaauaccugccccucucgguacaccagacuucguaggcaaaauccaagggguucucacucagaccacccguacagauggcagcacacgaggucacaaagccaccguuuacaccggaucagcggauuucguuccaaaacuaggccgaguccaauuugaaaccgacaccgacagagacuucgaagcgaaccaaaacacaaaguucacacccgucggagucauccaagacggcuccaccacacaccggaacgaaccacaacaauggguccuacccuccuauucaggucgaaacaccccaaauguacaccucgcccccgccguagcccccaccuuccccggcgaacaacuacucuucuuccgauccacaaugcccggcugcuccggcuacccuaacauggaccuagacugccuccuaccucaagaauggguacaauacuucuaccaagaagccgcccccgcucaaucugacgucgcccuccugcguuucgucaaucccgacacaggacgaguacuuuucgaaugcaaacuccacaaauccggcuacguaaccgucgcccacacaggacaacacgaccuggucaucccaccaaacgguuauuuccgcuucgacagcugggucaaccaauucuacacccucgcaccaaugggcaauggcacgggccgcaggcgcgcccuauaa

SEQ ID NO: 36630 - RNA, 1623 nt, Artificial Sequence
  derived and/or modified sequence opt11 from VP1__Norovirus__BAU24840
augaaaauggccagcuccgacgcaaacccuucagacggcuccgccgcgaaccuaguccccgaagucaacaacgaaguaauggccuuagaacccguaguuggagcagcaaucgccgcccccgucgccggccaacaaaacguaaucgaccccuggauccgcaacaauuucguacaagcccccggaggugaguucaccgucucaccccgcaacgcccccggcgaaauccuuugguccgcaccccuaggcccagaccucaaucccuaccucucccaucuugcccgcauguauaacgguuacgccggcggauucgaaguacaaguaauccuagccggcaacgccuucacagccgguaaaguaauauucgcugccgucccacccaacuuccccacagaaggacucucacccucccaaguaaccauguuuccacauauuguaguagacguccgccaacucgaaccaguacuaaucccccuccccgacguacggaacaacuucuaccacuacaaccaauccaacgaccccaccaucaaauuaaucgccaugcucuacaccccacuaagagccaacaacgcaggcgacgacgucuucacagucuccugccgaguccugacccggccuucccccgacuucgacuucaucuuccuagucccacccacagucgaauccagaaccaaacccuucucuguccccguucuaaccgucgaagaaaugaccaacuccagauuccccaucccccuagaaaaacucuuuaccggccccucauccgcauucgucguccaaccccaaaacggacgcugcaccaccgacggcguccuccuaggaaccacucaacuuaguccagucaacaucugcacccuccgcggcgacgucacccacaucaccggaucucggaacuacacuaugaaccucgcaucacaaaacuggucaaacuacgaccccaccgaagaaauccccgcaccccucggaacucccgacuucgucggcaaaauccaaggcguccucacccaaacaacccgcaccgacggcucuacccgaggccacaaagccaccgucuacacuggcuccgccgacuucgcaccgaagcuaggccgcguacaauucgagaccgacaccgaccgcgacuucgaagccaaccaaaacaccaaauucacaccaguaggcgucauacaagacggaucaaccacccaccgcaaugaaccucaacaauggguacucccauccuacuccggccguaacacccccaacguucaccucgcccccgcaguagccccaaccuuucccggcgaacaacucuuauucuuucgcucaacaaugccaggcugcuccggcuaccccaacauggaccucgacugccuccucccacaagaaugggugcaauacuucuaccaagaggcagccccugcgcaaagcgacgucgcccuccuacguuucguaaacccagacaccggacgcguccucuucgaaugcaaacuacacaaaucaggauacguaaccgucgcccacacaggccaacacgaccuagucauacccccaaacggcuacuuccgauucgacagcuggguuaaccaauucuacacacucgcacccaugggcaacggaacaggccgacggcgcgcccucuaa

SEQ ID NO: 36631 - RNA, 1623 nt, Artificial Sequence
  derived and/or modified sequence opt11 from VP1__Norovirus__BAU24843
augaaaauggccuccagugacgccaacccaucugacggaucugcagcaaaccucgucccugaagucaacaacgaagucauggcccucgaacccgucguaggcgccgcaauagcagcccccguagccggccaacaaaacgucaucgaccccuggauccgcaacaacuucguccaagccccuggcggcgaguucacaguaucaccucgaaacgcucccggcgaaauccuauggucagccccacucggacccgaccuaaaccccuaccucagccaccucgcucguauguacaacgguuacgccggcggauucgaaguacaaguuauccucgccggcaacgcauucaccgccggcaaagucauauucgccgcagucccacccaacuuccccaccgaaggacuuucccccucccaaguaaccauguucccccacaucguaguagacguccgacaacuagaacccguccuuaucccccuacccgacguccgaaacaacuucuaccacuauaaccaauccaacgaccccaccaucaaacuuaucgcaaugcucuacacuccccuccgcgcuaacaacgcaggagacgacgucuucaccgucuccugcagaguccuaacacgcccaagccccgacuuugacuucaucuuccucgucccaccuacaguagaaucccgcacaaaaccauucuccgucccaguccucacagucgaagaaaugacaaacucuagauuccccaucccacucgaaaaacucuucaccggcccuuccuccgcauucgucguccaaccacagaacggccgcugcaccaccgacggcguacuccucggcacuacacaacucuccccagucaacaucugcacauuucgcggcgacgucacccacauaaccggcagccguaacuacaccaugaaccucgcaucccaaaacuggucuaacuacgaccccaccgaagaaauccccgcaccccucggcacacccgacuucgucgguaaaauacaaggcgugcucacacaaacaacccgcaccgauggauccacacgcggccacaaagccacuguuuacacagggucggccgacuucgcccccaaacucggacgcguccaauucgaaaccgacacagaccgugauuucgaagcuaaccaaaauaccaaauucacacccgucggcguaauacaagauggcuccacuacccacagaaacgaaccccaacaauggguccuccccuccuacuccggacgcaacaccccaaacguccaccucgccccagccgucgccccuaccuuucccggcgaacaacuccucuucuuccguucuacuaugcccggcugcuccggcuaccccaacauggaucucgacugccuucuaccccaagaauggguucaauacuucuaccaggaagcagcccccgcccaauccgacguagcccuacuccgcuucgucaacccagacaccggacgaguccucuucgaaugcaaacuacacaaauccggcuacguaaccguugcccacaccggacaacacgaccuuguaaucccaccuaacgguuacuuccgcuucgacuccugggucaaccaauucuacacccuagcacccaugggcaacggaaccggucgccgccgagcccucuaa

SEQ ID NO: 36632 - RNA, 1623 nt, Artificial Sequence
  derived and/or modified sequence opt11 from VP1__Norovirus__BAU24846
augaaaauggcaucaaacgacgccaaccccuccgacggcuccgccgcaaaccucguacccgaagucaacaacgaagucauggcccuagaacccgucgucggcgccgcaaucgccgcccccgucgccggccaacaaaacgucaucgaccccuggauacgcaacaacuucguacaggcccccggaggcgaguucacugucucaccccgcaacgccccgggcgaaauccucuggucagccccacuuggccccgaccucaaucccuaccucucccaccucgcccgcauguacaacggcuacgcuggagguuucgaaguccaaguaauccucgccggaaacgccuucacagcaggcaaaaucaucuucgccgccguuccacccaacuuccccaccgaaggccucucacccucccagguaaccauguuuccccacaucaucguagacguacgccaacucgaacccguccucaucccccuacccgauguucgcaacaacuucuaccacuacaaccagucaaacgauucaaccaucaaacucaucgccaugcucuacacuccacuacgcgcaaacaacgccggcgaagauguauucacaguauccugcagaguccucacccgcccaagcccagacuucgacuucauauuccucguacccccuacuguagaaucaagaacuaaacccuucacaguccccauacuuacuguagaagaaaugacaaauucccgcuucccgauccccuuagaaaaauuauuuaccggaccaucuucagccuucguaguccaaccccagaauggacgaugcaccaccgauggcguccuccucggaaccacacaacuuucgcccgucaacauaugcaccuuccgcggagacgucacacauaucgcugguucacgcaacuacacuaugaaccucgccucacucaacuggaacaacuacgaccccaccgaagaaauccccgcaccccuuggcaccccagacuucguaggaaaaauccaaggcauguuaacccaaacaaccaaaggcgacggcucaacaagaggacacaaagccacaguauacaccggcuccgcccccuucacacccaaacuaggcagcguccaauucgaaaccgacacagaaaacgacuucgaaacacaccaaaacaccaaauucacccccgucggcgucauucaagacggaggcaccacccaucguaacgaaccccaacaauggguccuaccaagcuauucagggagaaacgucccaaacguccaccucgccccagccgucgccccaacauuccccggagagcaacuccuauucuucagauccauaaugccuggcuguucaggcuaccccaacauggaccucgacugccuccucccccaagaauggguccaacacuucuaucaagaagcggcgcccgcccaauccgacgucgcccuccuacgcuucguaaaccccgacacuggacgcguucuuuucgaaugcaaacuucacaaaucuggauaugucacuguugcacacacuggucaacacgaccucguaauaccacccaacggcuacuuucgcuucgacuccuggguuaaccaauucuacacccucgcacccauggggaacggcaccggccgacgcagagcccuauaa

SEQ ID NO: 36633 - RNA, 1623 nt, Artificial Sequence
  derived and/or modified sequence opt11 from VP1__Norovirus__BAU24849
augaaaauggcaagcagcgacgccaaccccuccgacggcucugccgccaaccucgucccagaaguaaacaaugaaguaauggcacuugagccaguaguaggagcugcaaucgccgcccccgucgcuggacaacaaaacguuauagaccccuggauccgcaacaacuucguacaagcacccggaggagaguucaccgucuccccacgaaacgccccaggcgaaauccuauggucagcaccacucggaccagaccuaaaccccuacuugucacaccucgcacgcauguacaacggcuacgccggaggcuucgaaguccaagucauauuagccggaaacgccuucaccgccggcaaagucaucuucgcagccguaccacccaacuuccccaccgaaggccucuccccaagccaagucaccauguucccccauaucgucguagacguccgacaacucgaaccaguccucaucccacuacccgauguucgcaacaauuucuaccacuacaaccaaagcaaugaccccaccaucaaacucaucgccaugcuauacacgccccuacgcgcgaacaacgccggcgacgacgucuucaccguaagcugucgcguacucacccgccccucacccgacuucgacuucaucuuccucguuccacccaccguagaaucacgaaccaaaccauucuccguccccgucuuaacaguagaagaaaugacaaacagcagauuccccauuccccuagaaaaacuauuuacaggccccuccuccgccuucgucguacaaccacaaaacggcagauguaccaccgacggcguccuccuaggaacaacccaacuauccccagucaacaucugcacauucagaggcgacguuacccacaucaccggcucacgaaauuacaccaugaaucuugccucacaaaauugguccaauuacgaccccacagaagaaauaccagcuccccuaggcacccccgacuucgucggcaaaauccaaggcgucuuaacacaaacaacccgaacugacgguuccacccgcggacacaaagccaccguauacaccggcuccgccgacuucgccccaaaacucggccgcguccaauucgaaacagauaccgaccgcgacuuugaagccaaccaaaacaccaaauuuacccccguugguguaauacaagacggcagcaccacccauagaaacgaaccccaacaauggguucuccccucauacuccgggcgcaacacccccaacguacaccuagcucccgcuguagcaccaaccuucccaggcgaacaacuccucuucuuccgcucaaccaugcccggcugcuccggcuaccccaacauggaccuagacugccuacuaccacaagaauggguacaauacuucuaccaagaagcagcccccgcccaaucagacguagcccuucuccgcuucguaaaccccgacaccggacgaguccucuucgagugcaaacuccacaaaucaggcuacgucaccgucgcccacaccggacaacacgaccuaguuaucccacccaacggcuauuuccguuucgacuccuggguuaaccaguucuacacccuagcccccaugggcaacggcaccggucgccgccgcgcccucuaa

SEQ ID NO: 36634 - RNA, 1623 nt, Artificial Sequence
  derived and/or modified sequence opt11 from VP1__Norovirus__BAU24852
augaaaauggccuccuccgacgccaaccccagugacggcuccgccgcaaaccuuguacccgaagucaacaacgaaguaauggcccuagaaccaguggucggagccgcuaucgccgcgcccgucgccggucaacaaaacgucaucgaccccuggauucgcaauaacuucguacaagcaccagguggcgaguucaccguauccccucgaaacgcccccggagaaaucuuaugguccgcaccccucggacccgaccugaaccccuaccucucacaucucgccagaauguauaacgguuaugccggcggcuucgaaguccaagucauccucgccggcaacgcauucaccgccggcaaaguaaucuucgccgcuguuccacccaacuuccccaccgaaggccuaucccccucccaaguaaccauguucccccacaucgucgucgacguccgccaacucgaaccaguccuaauaccccuacccgacguucgcaacaacuucuaccacuacaaucaauccaacgaccccaccaucaaacuaaucgccaugcucuacacaccccuacgcgccaacaacgccggcgacgauguauucaccguuuccugccgaguccuaacacggcccucccccgacuucgacuucaucuuccucgucccacccaccguagaaucccgcaccaaacccuucagcguacccguacucacagucgaagaaaugaccaacucccgauuccccaucccccucgaaaaacucuucaccggaccaucauccgccuucgucguccaaccccaaaacggccggugcaccacugacggcguccuacuuggcacaacccaacucucacccguaaauaucugcaccuuuagaggcgacguuacccacaucaccggcucucgcaacuacaccaugaaccucgccucacaaaacuggaauaauuacgaccccaccgaagaaauaccagcaccccuggguaccccggacuucgucggcaaaauccaaggcguacuaacccagaccacccgaaccgauggauccacacgcggacacaaagccaccgucuacacaggcuccgccgacuucgccccaaaacugggacgcguccaauucgaaaccgacacagaccgagacuuugaagcaaaccaaaacaccaaauucacuccuguaggcgucauacaagacggaucaaccacccaccgcaacgaaccccaacaauggguccuccccuccuacuccggacgaaacacccacaacguccaccucgcccccgcagucgcccccacauuccccggagaacaacuccucuucuuccgcucaacuaugccaggcugcuccggauacccaaacauggaucuugauugccuacuaccccaagaauggguacaauacuucuaccaagaagccgccccagcccaauccgacguagcacugcuacgcuucgucaaccccgacaccggccgcguccuauucgaaugcaaacuccacaaaucaggcuacgucacugucgcccacacuggccaacacgacuuaguaaucccacccaacggcuacuuccgguucgacagcugggucaaccaauucuacacccuagcacccaugggcaacgggacaggacgccgccgcgcagucuaa

SEQ ID NO: 36635 - RNA, 1623 nt, Artificial Sequence
  derived and/or modified sequence opt11 from VP1__Norovirus__BAU24855
augaaaauggccuccaacgacgccaaccccucagacggcuccgcagcaaaccucguacccgaagucaacaacgaaguaauggcccucgaacccgucgucggagccgccaucgccgcccccguagccggacaacaaaacguaaucgacccauggauacgcaacaacuucguacaggcccccggcggagaguucaccguaagcccacgcaacgccccaggcgaaauccucuggucagcaccccuuggacccgaccucaacccauaccuaucacaccuugcccgcauguacaacggcuacgccggcggcuucgaaguccaagucauccuugccggcaacgccuucaccgcagguaaaaucauauucgccgcgguaccacccaacuuucccaccgaaggccucucucccagccaaguuacaauguucccccacaucaucguagacguccgucaacuagaacccguacucaucccccucccagacguacguaacaacuucuaccacuauaaccaaucaaacgacucuacaaucaaacucaucgcaaugcucuacacuccccuucgcgcuaacaacgccggcgaagacguauucaccgucucaugccgaguccucacccgaccaucccccgacuucgacuucaucuuccuaguaccacccaccguugagucucguaccaagcccuucaccguacccauacucacaguugaggaaaugaccaacucccgcuuccccauccccuuagaaaaacuuuucaccgggcccuccucagccuucgucguccaaccccaaaacggccgcugcaccacagacggcguacugcuaggcaccacccaacuauccccggucaacaucugcacauuccgcggcgacgucacccacaucgcagguucccgcaacuacaccaugaaccucgcuucauuaaacuggaacaacuacgacccaaccgaagagauccccgcaccccuaggaacaccagauuuuguuggaaaaauacaaggcauguuaacccaaacaaccaaaggcgacgguuccacgagagggcacaaggccaccgucuacacuggaucagccccauucacccccaaacuaggauccguucaauucgagaccgauacugaaaacgauuucgaaacccaucaaaacaccaaguucacccccgucggcgucauucaggacggaggcacaacccaccgaaacgaaccccaacaauggguccuaccauccuacuccggccgaaacguccccaacguccaccucgcacccgccgucgcucccacuuuucccggagaacaacuccucuucuuccgauccaucaugccaggcugcuccggcuaccccaacauggaccuagacugccuccuaccccaagaauggguccaacauuuuuaccaagaagccgcucccgcacaauccgacguagcccuccuccgcuucguaaacccagacaccggcagaguacuuuucgaaugcaaacuccacaaaucaggauacgucacugucgcacacaccggccaacacgaccuaguaaucccacccaacggcuacuuccguuucgacuccugggucaaccaauucuacaccuuagcacccaugggaaauggcacaggccgccgccgggcccucuaa

SEQ ID NO: 36636 - RNA, 1623 nt, Artificial Sequence
  derived and/or modified sequence opt11 from VP1__Norovirus__BAU24858
augaaaauggccagcucagaugccaaccccuccgacggcucagccgcaaaccucguccccgaagucaacaacgaagucauggcccucgagcccguagucggcgccgccauugcugcccccguggccggccaacaaaacgucaucgaccccuggauaagaaacaacuucguccaagcccccggcggcgaguucaccgugucaccccgaaacgccccaggcgaaauccucugguccgcaccccucggccccgaccucaaucccuaucucagccaccucgcccgaauguauaacggcuacgccggcggcuucgaaguacaggucauccuagccggcaaugccuucaccgccggcaaagucaucuucgccgccgucccacccaacuuccccaccgaaggucuaucccccucccaagucacaauguucccccacauaguaguagacguucgccaacucgaacccguacuaauaccccuccccgacguccgaaacaacuucuaccacuacaaucaauccaaugaccccacaaucaaacuuauagcgaugcuuuacacccccuuacgcgccaauaacgccggcgacgacgucuucaccgucuccugccgcguacuaacccgcccauccccugacuucgacuucaucuuccucgucccucccaccgucgaaucacgaaccaaacccuucucagucccuguccuaaccgucgaagagaugaccaacucccgauuccccaucccccucgaaaaacucuucacaggcccaucaucagccuucguuguccaaccacaaaauggccgcuguaccaccgacgggguacuccuaggcacaacacaacuuagccccgucaacauaugcacauuccgcggugacgucacccacauaacaggaucccgaaacuacacaaugaaccucgcaagccaaaacuggucgaacuacgaucccaccgaagaaauccccgcaccccuaggcacaccugacuucguaggcaaaauccaaggcguccucacccagaccacacgcaccgacggaucaacgcgcggacacaaagccacaguauacaccggcuccgccgacuucgccccaaaacucggccgaguacaauucgaaaccgacacagaccacgacuucgaggccaaucaaaacacaaaauucaccccaguuggcgucauccaagacggcuccaccacccaccgcaacgaaccccaacaauggguacuacccuccuacuccggccguaacacuccaaacgugcacuuagcccccgcaguagccccaaccuuucccggcgaacaacuccuauucuuccgcucaaccaugcccggcugcucagguuaccccaacauggaccucgacugccuacuaccacaggaauggguccaauacuucuaucaagaagccgccccagcacaaucagacgucgcccuccuccgcuucgucaacccagacacaggccguguccucuucgaauguaaacuucauaaguccggauacgucacugucgcccacacaggccaacacgaccuaguuaucccucccaacggauauuuccgcuucgacucauggguaaaucaauucuacacacucgcccccaugggcaauggaaccggccgucgccgagcauuauga

SEQ ID NO: 36637 - RNA, 1623 nt, Artificial Sequence
  derived and/or modified sequence opt11 from VP1__Norovirus__BAU24861
augaaaauggccuccaacgacgcaaacccaagcgacggcuccgccgcaaaccucgucccggaaguuaacaacgaagucauggcccucgaacccguagucggcgccgccaucgccgccccagucgccggccagcaaaacgucaucgaccccuggauccgcaacaacuucguccaggcccccggcggcgaguucacuguuuccccucggaaugcccccggcgaaauacucuggucugccccgcucggacccgaccucaaccccuaccuaucacaccucgcaagaauguacaauggcuacgcaggcggcuucgaaguccaagucauccucgcaggcaacgccuucacagcgggcaaaauuaucuucgccgccgucccacccaacuuccccacugaaggccucucacccucacaagugaccauguucccccauauaaucgucgacguccgccaacucgaacccguccuuaucccccuccccgacgucaggaacaacuucuaccacuauaaccaauccaacgacucaaccaucaaauuaaucgccaugcucuacacaccccuccgcgcaaacaacgcuggcgaagauguauuuaccguaucauguagaguccuaacccgaccaucccccgacuuugacuucaucuuccucgucccacccaccguagaaucacgaacaaaacccuuuaccguuccuauccuaacuguagaagaaaugacaaacucccgcuuccccaucccauuagaaaaacucuucacaggucccagcuccgccuucguaguacaaccacaaaacggccgcugcaccaccgacgguguccuccuuggaacaacccaacuuucuccagucaacauaugcacuuucagaggcgacgucacccacaucgccggcagccgcaacuacaccaugaaccuagcaucccucaacuggaacaacuacgacccaacagaagaaauccccgcaccacucggcaccccugacuucgucggaaaaauacaaggcaugcuaacccaaaccaccaaaggcgacggcagcacccggggacacaaagcaaccguguacacaggauccgcccccuuuacccccaaacucgguagcguacaguucgaaaccgacacagaaaacgauuucgaaacacaucaaaacacaaaauucacuccugucggcgucauccaagacggaggaaccacccaccgcaacgaaccacaacaauggguccuacccuccuacucaggccgcaacguucccaacgugcaccuagcucccgcaguugcaccaacauucccaggcgaacaacuccuauucuuccgaucuaccaugccuggaugcucagguuaccccaacauggaccuggacugccuacucccccaagaaugggugcaacacuucuaccaagaagccgcccccgcccaauccgacgucgccuuacuucgcuucgucaacccggacaccggccggguccucuuugaaugcaaacuccacaaaucagguuacgucaccgucgcacacacuggccaacacgaccuuguaauacccccaaacggcuacuuccguuucgacucauggguaaaccaauucuacacacucgcccccaugggcaacggaacaggccgacgacgagcccuguaa

SEQ ID NO: 36638 - RNA, 1623 nt, Artificial Sequence
  derived and/or modified sequence opt11 from VP1__Norovirus__BAU24864
augaaaauggccuccuccgacgccaacccauccgacggaucagccgcaaaccucguccccgaagucaacaacgaagucauggcacucgaacccguagucggcgccgccaucgccgccccugucgccggccaacaaaacgucaucgacccauggauacgcaacaacuucguacaagcccccggcggagaguucaccgucuccccucgaaacgcacccggcgaaauacuaugguccgccccacucggucccgaccuaaacccauaccucucucaccuagcccggauguacaacggcuacgcaggcggcuucgaaguacaaguaauccuagccgggaacgccuucaccgccggaaaagucauauuugccgccguaccaccuaacuuucccacagaaggauuaucaccuucacaagugaccauguuuccacacauagucgucgacguacgucaacucgaaccaguccuaauaccccuccccgacguacgcaacaacuucuaccacuacaaccaaagcaacgacccaacaauaaaacuaauagccaugcuauacacaccccuacgagccaacaacgccggcgacgaugucuucaccgucucaugccgcguacucacacgcccuucccccgacuucgacuucaucuuccuaguaccucccacugucgaaagucgaacaaagcccuucuccguccccguccucaccguagaagaaaugacuaacucccgauucccaauaccccucgaaaaacuauucacuggccccucauccgcauucgucguccaaccccaaaauggccgauguacaacagauggcguccugcucggcaccacccaacucuccccuguaaauauaugcacauuccgaggcgacgucacccacauaacaggaucccgcaacuacaccaugaaccucgccucccaaaauuggucaaacuaugaccccacagaagaaaucccagcaccccuggggacaccagacuucgucggaaagauccaaggaguauuaacccaaacaacccgcacagacggcuccacccgcggccacaaagccaccguauauacaggaagcgcagacuucgcacccaaacucggcagaguacaguucgaaacagacacagaccgcgacuucgaagcaaaccagaacacaaaauucacccccguuggcgucauccaagacggcuccacgacucaccgcaacgaaccccaacaauggguacuccccuccuacagcggccgcaacacaccaaacguccaccuagcccccgcugucgcccccaccuuccccggcgaacaacuacucuucuucagaucaacaaugcccggaugcuccggcuaccccaacauggaccucgauugccuccuaccacaagaauggguccaauacuucuaccaagaagccgcgccagcccaaucagacgucgcccuccucagauucguaaaccccgacaccggacgaguccucuucgaaugcaagcuacacaagucaggauaugucaccguagcucacaccggccaacacgaccuagucauacccccaaacggcuacuuccgguucgauucaugggucaaccaauucuacacucucgcccccaugggcaacggcacaggcagacgccgagcccucuaa

SEQ ID NO: 36639 - RNA, 1623 nt, Artificial Sequence
  derived and/or modified sequence opt11 from VP1__Norovirus__BAU24867
augaagauggcaucaucagacgcuaaccccaccgacggcuccgccgcaaaccuaguccccgaagucaacaacgaagucauggcacucgaacccguagucggcgcagccauagccgcacccgucgccggccaacaaaacgucaucgaccccuggauccgaaacaacuucguacaagcccccggcggcgaauuuaccgucucaccccguaacgcccccggcgaaauccucugguccgcaccccucggucccgaccucaacccauaccucucccaccucgcacgcauguacaacggauacgcaggcggauucgaaguacaagucauccuagccggcaacgcauucaccgcuggcaaagucaucuucgccgcagucccacccaacuuccccaccgaaggccuauccccaucccaagucacuauguucccacauaucgucgucgacgucagacaacuagaacccguacucaucccacuacccgacguaagaaacaacuucuaccacuacaaccaauccaacgacccaaccauaaaacucaucgccaugcuauacacccccuuacgagcaaauaacgccggcgacgacgucuucaccgucuccugccgcguucucacccgccccucaccggauuucgacuucauauuucuaguacccccuaccgucgaaucccgcacuaaacccuucucaguaccaguccuaaccguugaagaaaugaccaacuccagauuccccaucccacuagagaaacuauucacaggcccauccucggcauucgugguccaaccccagaacggccgaugcaccaccgacggcguccuacucggcacaacacaacucucccccgucaacaucugcaccuucagaggagacgucacccauaucaccggaucccgaaacuacaccaugaaccuugccucccaaaacugguccaacuacgaccccacagaagaaaucccagcaccccuaggcacacccgacuucgucggaaaaauccaaggaguccucacccaaacgacccgcacugauggcuccacccgcggacacaaagccaccgucuacaccggauccgccgauuucgcccccaaacucggccgcguccaauuugaaacagacaccgaccacgacuuugaagccaaccaaaacaccaaauucacuccagucggcguaauacaagacggcuccacaacccaccgcaacgaaccccaacaauggguccuacccuccuacuccggccgcaacacccccaacguucaccuagcccccgccgucgcccccacuuuuccaggagaacaacuacucuucuuucgaucaacaaugcccggcugcuccggauaccccaacauggaccuagauugccuccuaccucaagaauggguccaauacuucuaccaagaagccgccccugcucaaucagacgucgcccuacuucgcuucgucaaccccgacacaggccgaguccucuucgaguguaaacuacacaaaagcggcuacguaaccguagcucacacaggacaacacgaccucgugaucccaccaaacggcuacuuccgcuucgacuccugggucaaucaauucuacacccuugcacccaugggcaacggcacuggccgccgcagagcccucuga

SEQ ID NO: 36640 - RNA, 1623 nt, Artificial Sequence
  derived and/or modified sequence opt11 from VP1__Norovirus__BAU24870
augaaaauggccucauccgacgccaacccaucagacggaagcgccgcaaaccuaguccccgaagucaacaacgaaguuauggcccucgagcccguggucggcgccgccaucgcagcccccgucgccggccaacaaaaugucaucgacccguggauccgcaacaacuucguacaagcaccaggcggagaguucaccgucucaccccgaaacgcccccggcgaaauacuauggagugcaccccuaggacccgaccucaaccccuaccucagucaucuggcuagaauguacaacggauacgccgguggcuucgaaguucaagucauccucgcaggcaacgcauucaccgccggcaaagucaucuucgccgccgucccaccuaauuuccccaccgaaggccucucaccaucccaaguaaccauguucccccacaucgucguagacguccgccaacucgaacccguauuaauaccccuuccggacguacgaaacaauuucuaccacuacaaccaauccaacgaccccacaauaaaacuaaucgcuaugcuauacacaccccuccgcgccaacaacgcuggagacgaugucuucaccgucucaugccgcguccuaacgcgccccucgcccgacuucgacuucaucuuccuaguuccucccaccgucgaaucccgcacuaaacccuucucuguccccguccuaaccgucgaagaaaugacaaacucaagauuccccaucccccucgaaaaacucuucacaggccccuccuccgccuucgucguccaaccccaaaacggacgcugcaccaccgacggaguacuacugggaaccacccaacucucucccguaaacaucugcaccuuccgcggagacgucacacacaucaccgggucacgcaacuacaccaugaaccuagccucacagaacuggagcaacuacgauccaaccgaagaaauacccgcaccccuaggaaccccugacuucgucggcaaaauccaaggcguccuaacccaaaccacccgcaccgacggauccacacgcggccacaaagccaccguauacacaggcucagccgacuucgcccccaaacucggccgaguccaauucgaaacggacacugaccaugacuucgaagccaaccaaaacacaaaauucacccccgucggcgucauucaagacggcucuaccacacaccgcaacgaaccccaacaauggguccucccaucauacuccggaagaaacacccccaacguccaccuagccccagccgucgcccccaccuucccaggcgaacaacugcuuuucuuccgcagcaccaugccaggcuguuccggauauccgaacauggaccucgacugccuccuaccacaagaauggguucaauauuucuaccaagaagcugcccccgcccaauccgacgucgcacuccuacguuucgucaacccagauaccggccgcguccucuucgaaugcaaacuccacaaaucuggcuacgucaccgucgcucacaccggacaacacgaccuagucauacccccgaacggcuacuuccgauucgauuccugggucaaccaauucuacacucucgcccccaugggaaacggaaccggacgccgccgcgcccuauga

SEQ ID NO: 36641 - RNA, 1623 nt, Artificial Sequence
  derived and/or modified sequence opt11 from VP1__Norovirus__BAU24873
augaagauggcauccucagacgccaaucccucugacggcuccgcagccaaccuaguacccgaagucaacaacgaagucauggcccuagaaccagucgucggcgccgccaucgccgccccuguggccggccaacaaaacguaaucgaccccuggauacgcaacaacuucguccaagccccaggcggcgaauuuaccguuucuccccggaacgcacccggagaaauccucugguccgccccucuagggccagaucuuaacccauaccucucccaccucgcacgcauguauaacggcuacgccggcggcuucgaaguccaagucauccucgccggcaacgcauuuaccgccggaaagguaaucuucgccgcagucccucccaacuuucccacagaaggacucucccccucccaagucacuauguucccccacaucguugucgacguucgccaacucgaacccguccucaucccccuaccagacguccgcaacaacuucuaccacuacaaccaauccaacgaccccaccauuaaacuaauugccauguuauacacaccccuucgcgcaaacaacgcuggagacgacgucuucaccgucuccugccgaguccuaacccgccccucacccgacuucgacuucaucuuccuagucccucccaccguugagucaagaaccaaacccuucuccguccccguccucaccgucgaggaaaugaccaacucccguuuccccaucccacuugaaaaacucuucaccggacccuccuccgcauucgucguacaaccacaaaacggccgcugcaccacagacggcguucuccuaggaacuacacaacuuucacccguaaacauaugcaccuuccgaggcgacgucacccacauaaccggaagucgcaacuacacaaugaaccuagccucccaaaacuggagcaacuacgaccccaccgaagaaauccccgcaccccuuggaacacccgacuucgucgggaaaauacaaggcguacucacgcagaccacccgaaccgacggaagcacccgaggccacaaagccaccguauacaccggcuccgccgacuucgcccccaaacuuggacgcguucaauucgaaaccgacaccgacagagacuucgaagcuaaccaaaacaccaaauucacccccgucggaguuauccaagacggcagcacaacacaccgcaacgaaccucaacaauggguccuacccuccuacuccggcagaaacaccccuaacguccaccuugcucccgccguagcacccaccuucccuggcgaacaacuccuauucuuccgcucuaccaugcccggcugcucaggcuauccaaacauggaucuugacugccuccuaccccaagaguggguacaauacuucuaccaagaagccgcacccgcccaauccgacguugcccuccucagauucgucaaucccgacacaggacgaguccuuuucgaaugcaaacuccacaaaucagguuacgucaccgucgcacacaccggacaacacgaccuagucaucccacccaauggcuacuuccgcuucgacuccugggugaaccaauucuauacccuugcccccaugggcaacggaacaggccgacgccgagcacucuaa

SEQ ID NO: 36642 - RNA, 1623 nt, Artificial Sequence
  derived and/or modified sequence opt11 from VP1__Norovirus__BAU24876
augaaaauggccuccuccgacgcaaacccguccgacggaucagcagccaaccuuguaccagaagucaacaacgaagucauggcccucgaaccaguagucggcgccgcaaucgccgcacccgucgcuggccaacaaaacgucaucgacccuuggauacgcaacaacuucguccaagcucccggcggagaguucaccgucucuccccgcaacgccccaggcgaaauacuauggagcgcaccccuagggcccgaccucaacccuuaccucucacaccucgcaagaauguacaacggcuacgcuggcggauucgaaguccaggucauacucgccggaaacgcauucacugccggaaaaguuaucuucgccgcugucccucccaauuuccccaccgaaggccuuuccccaucacaagucaccauguucccacauaucgucguagacguccgucaacuagaacccguccucaucccucuacccgacguacgaaacaacuucuaccacuacaaucaaucuaacgaccccacaaucaaacucaucgccaugcuauacacaccccuacgagcaaacaacgccggagacgacgucuucaccgucuccugcagaguccucacccgcccaucaccggacuucgacuucaucuuccuagucccucccaccguugaaucacgcacaaagcccuucucaguccccguccucaccguggaagaaaugaccaacucacgcuuccccaucccccucgaaaaacucuucaccggcccaucauccgccuucguaguacaaccacaaaacggcagaugcaccacagacggcguccuucuaggcaccacccaacucucucccguaaacaucugcacuuuccgaggcgacguaacccacauuaccgguucaagaaacuacacuaugaaccucgccucccaaaacuggagcaauuaugaccccacagaagaaauccccgcaccccucggcacaccagacuucgucggcaaaauccaaggaguccuaacacagaccacacgcacugauggcuccaccagaggccacaaagccacaguauacaccggcuccgcagacuucgcaccaaaacuaggccgcguccaauucgaaaccgacacagaccgagacuucgaagccaaccagaacacgaaauucacgcccgucggcgucauacaagacggguccaccacccacagaaacgaaccacaacaauggguccuaccauccuacucaggccgcaacacccccaauguacaccucgcccccgccgucgcacccaccuuccccggagaacaacucuuauucuuucgauccaccaugccagguugcucaggcuaccccaacauggaccuugacugccuccuaccccaagaauggguccaauacuucuaccaagaagcagcccccgcacaauccgaugucgcacuccuucgauucgucaaccccgacacaggacgaguacucuucgaaugcaaacuacacaaaucuggcuacgucaccgucgcacacaccggccaacacgaccucgucauucccccaaacggcuacuuucgcuucgauagcugggucaaucaguuuuacacccucgcccccaugggcaacggaaccggccgccgccgcgcccucuaa

SEQ ID NO: 36643 - RNA, 1623 nt, Artificial Sequence
  derived and/or modified sequence opt11 from VP1__Norovirus__BAU24879
augaaaauggcauccuccgacgcaaacccuuccgacggcuccgccgccaaccuaguccccgaagucaacaacgaagugauggcccuagaacccguugucggcgcagcaaucgccgcccccguagccggucaacaaaacgucaucgacccauggauacgcaauaacuuuguccaagccccagguggugaguucaccguaucgccacgaaacgccccuggcgaaaucuuaugguccgcaccccucggacccgaucucaaccccuaucucucccaccucgcccgcauguacaacggauacgccggaggcuucgaaguucaaguuauucucgccggcaacgccuucacugccggcaaaguaauauucgcugccguacccccaaacuuccccacagaaggccucucccccucacaagucaccauguucccgcacaucgucgucgacgugcgacaacucgaacccguacuaaucccccuccccgacguccguaacaacuucuaccacuacaaccaaagcaacgauccaaccaucaaacucauugccaugcucuauacuccccuccgugccaacaacgcaggcgacgacgucuucaccguuuccugucgaguccuaacucgcccuucccccgacuuugacuucaucuuccucgucccacccaccguagaaucacgcaccaaacccuucuccguccccguccucaccguugaagaaaugaccaacucacgcuucccaaucccucucgaaaaacuauucacaggacccuccuccgccuucguaguucaaccccaaaacggacgauguaccaccgacggcguacuccucggaacuacccaacucucccccgucaacauuugcaccuuucgcggggacguaacacacauuaccggcucccgcaauuacacaaugaaccucgcaucacagaacugguccaacuacgacccaaccgaagaaauccccgccccauuaggcacccccgacuucguaggcaaaauccaaggaguucuuacucaaaccacccgcacagacggcucuacccgcggccacaaagccaccguauacacaggaucugcugacuucgcacccaaacucggacgaguucaauucgagacggacaccgacagggacuuugaagccaaccaaaacaccaaauucacccccguaggcgucauccaagauggcuccaccacccaccguaacgaaccccaacaguggguccuacccagcuacuccggccgcaauaccccaaacguccaccuugcacccgccgucgcaccaacauuccccggagaacaacuacucuucuuccgaucaaccaugcccggcugcuccggcuacccaaacauggaccucgacugucuccucccacaagaauggguucaauacuucuaccaagaagccgcacccgcacaauccgacguugcccuccuccgcuucguaaacccagauaccggcagaguccucuucgaaugcaaacuucacaaaucuggcuacguuaccgucgcucacaccggccaacacgaccucgucaucccucccaauggcuacuuccgcuucgacuccugggucaaucaauucuacacacucgcucccaugggcaacggcaccggucgcagacgugcccuauaa

SEQ ID NO: 36644 - RNA, 1623 nt, Artificial Sequence
  derived and/or modified sequence opt11 from VP1__Norovirus__BAU24882
augaaaauggccuccagcgacgcaaaccccucagacggcagugccgcaaaccucguucccgaagucaacaacgagguaauggcacucgaacccgucgucggcgccgcaaucgcagcgccaguggcgggccaacagaacguaauagaccccuggauccgcaacaacuucguccaagccccaggcggcgaguucaccgucucaccacgcaacgccccuggagaaauccuuugguccgcaccccuuggaccagaccuaaaccccuaccuuucgcaucucgcccgcauguacaacggauacgccggaggcuucgaaguucaaguaauucucgccggcaacgccuuuaccgccggcaaagucaucuucgccgcaguaccaccaaacuuccccacagaaggcuuauccccaucccaaguaaccauguucccacacaucguagucgacguucgucaacuagaaccuguccucaucccacucccagacguccgcaacaacuucuaccacuacaaccaauccaacgacccaaccaucaaacuuauagccaugcucuacacaccccuucgagcaaacaacgcaggcgacgacgucuucaccgucagcugccgcguccucacacgccccucacccgacuucgacuucaucuuccucguaccuccuacagucgaauccagaaccaaacccuucuccguacccguccuaaccguagaggagaugaccaacuccagauuucccaucccccuugaaaagcuauucaccggccccucaucugccuucguuguccaaccccaaaacggccgcugcaccacagacggcguuuuacuaggaacuacacaacuauccccagucaacaucugcaccuuccgcggcgacgucacccauaucaccggcucccgcaacuacaccaugaaccucgcaucacaaaacuggaacaacuaugaccccacagaagaaauccccgcaccccucggcacccccgacuuuguuggcaaaauacaaggcguccuaacacaaaccacccguaccgacggcuccacacgcggccacaaggccaccgucuacacuggaucagccgacuucgcacccaagcucggccgcguccaauucgaaacugacaccgaccacgacuucgaaacaaaccaaaauaccaaauucacaccagucggcgucauccaggacggaggcacaacucaccgaaaugaaccgcaacaauggguacuacccagcuacuccggccgaaacaccccaaacguacaccucgcccccgccgucgccccuacauucccaggcgaacaacuacucuucuucagauccacaaugccuggaugcucgggcuacccaaacauggaccucgacugccuacuuccccaagaauggguccaauacuucuaccaagaagccgccccggcccaguccgacguagcucuacuccgauucgucaaucccgacaccggcagaguacucuucgaaugcaaacuacacaaaucuggauacgucaccgucgcucacaccggccaacacgaccuuguuauaccacccaacggcuacuuucguuucgacuccugggucaaucaauucuacacccuagcccccaugggcaacggaacaggccgucgccgcgcccuauaa

SEQ ID NO: 36645 - RNA, 1623 nt, Artificial Sequence
  derived and/or modified sequence opt11 from VP1__Norovirus__BAU24885
augaaaauggccucgucagacgcaaacccaagcgacggcuccgccgccaaccucgucccggaagucaacaaugaagucauggcccuagaacccgucgucggagccgccaucgcugcacccgucgccggccaacagaacguaauugacccauggauccgaaauaauuucguccaagcccccgguggagaguucaccgucucaccacgaaacgcacccggcgaaauacuauggagcgcuccacucggccccgaccuuaacccauaccucucccacuuagcccggauguacaacggcuacgccggcggcuucgaaguacaagucauacucgcuggcaacgcauucacagccggcaaaguaaucuucgccgccgucccucccaacuuccccaccgaagggcucucacccucucaagucaccauguucccccacaucgucguugauguccgacaacucgaaccaguccuaauuccccuccccgacguccgcaacaacuucuaucacuacaaccaauccaacgaccccaccauaaaacucauagccauguuauacacaccccuccgagccaacaacgccggagaugacgucuucaccgucagcugcagaguccucacacgccccucccccgacuucgacuucauauuccucgucccacccaccgucgaaucccgaaccaaaccauucagcguacccguacucaccgucgaggaaaugacaaacucucgauucccaauccccuuagaaaaacucuucacuggcccauccuccgccuucgucgugcaaccccagaacggccgcugcacaacagacggcguccugcucgggacuacccaacuauccccagucaacaucugcacuuuccgcggcgacgucacacacaucacaggcucccgcaacuacacaaugaacuuagccucacagaacuggaacaacuacgacccaaccgaagaaauccccgccccauuagguacacccgauuucguuggcaagauccaaggcguacucacacaaaccacccggacagacggcuccacucgcggacacaaggccaccgucuacaccggaagcgccgacuucgcccccaaacuuggacguguccaauucgaaaccgacacagaucaugacuucgaagccaaccaaaauaccaaguucacacccgucggggucauacaagacggaggcacaacccaccgcaacgaaccucaacaauggguccuccccuccuacucaggacgcgauacacacaacguccaccuagccccagccguagcccccacauucccaggcgaacaacuccuauucuucagauccacaaugcccgggugcucaggcuaccccaacauggaucucgacugccuacuuccccaagaauggguacaguacuuuuaccaagaggccgccccagcccaauccgacguagcccuccugcgcuucguaaacccagacaccggacgcguacuguucgaaugcaaacugcacaaauccggcuacgucaccgucgcccacaccggccaacacgaucuugucaucccacccaacggcuacuucagauucgacuccugggucaaccaauucuauacccuagcccccaugggcaacggcaccggccgacgccgcgcagucuaa

SEQ ID NO: 36646 - RNA, 1623 nt, Artificial Sequence
  derived and/or modified sequence opt11 from VP1__Norovirus__BAU24888
augaaaauggccuccuccgacgccaacccauccgacggauccgcagccaaccuaguccccgaagucaacaacgaagucauggcccucgaaccggucguaggagcagcaaucgccgcccccgucgccggacaacaaaacgucauugacccauggauccgcaacaacuuuguccaagcccccggcggcgaguucaccgucucgccucguaacgcaccaggagaaauccucuggucagcaccccuuggccccgaccucaacccauaccuaucacaccuugcacgcauguacaacggcuacgcaggcggauucgaaguccaaguuauacuagcgggaaacgccuucaccgccggaaaagucauauucgcagcaguaccgccaaauuuccccaccgaaggccuauccccaucacaggucacuauguuuccccacaucgucgucgacguccgccagcucgaacccguccuaaucccgcuccccgauguccgaaacaacuucuaccacuacaaccaauccaacgaccccaccaucaaacucaucgccaugcucuauacaccccuaagagcaaacaacgccggcgacgacguauucacaguguccugccgaguacuuacccgacccucgcccgauuucgacuucaucuuccucguaccacccacuguagaaucccgcaccaaacccuucucagucccaguccuuaccguugaagaaaugacuaacucaagauuccccauuccccucgaaaaacucuucaccggccccagcucugccuucgucguccaaccacaaaacggccgcugcaccacagacggcguacuacuuggcaccacacaacucucccccgucaacaucugcaccuuccgcggcgacguuacacacauaaccggaucacgcaacuacaccaugaaccuagccucccaaaacugguccaacuaugacccuacugaagaaauccccgcaccacuagguacucccgacuucgucggaaaaauacaaggcguucucacccaaacaacucgcaccgacggauccacccgcggucauaaagcaacuguauacacuggcuccgccgacuucgcccccaaacucggccgcguccaauucgaaaccgacaccgaccgugacuucgaagccaaccaaaacacaaaauucacacccgucggagucauccaggauggcucaaccacccaccgcaaugaaccccaacaauggguccuucccucauacucaggcagaaacacacccaacguccaccucgccccagccgucgcacccacauucccaggcgaacaacuacucuucuuccgcuccacaaugcccggcugcucaggcuaccccaacauggaccucgauugccuacucccccaagaauggguccaauacuucuaccaagaagcagcucccgcacaaagugacguagcccuccuccgcuucguaaaccccgacacaggccgcgucuuauucgaaugcaaauuacacaaaucuggguacgucaccguagcucacaccggacaacacgacuuagucaucccacccaacggcuacuuccgauucgacuccuggguaaaccaauuuuacacccucgcccccaugggcaacgggaccggaagaagacgagcccucuaa

SEQ ID NO: 36647 - RNA, 1623 nt, Artificial Sequence
  derived and/or modified sequence opt11 from VP1__Norovirus__BAU24891
augaaaauggcauccaacgacgccaacccaagcgauggcucagcagccaaccucguacccgaagucaacaacgaaguuauggcccucgaacccgucguaggcgccgccauagccgccccagucgcaggacaacagaauguaaucgacccauggauacgaaacaacuucguacaagcacccggcggcgaguucaccguaagucccagaaacgcucccggcgaaauacucugguccgcaccccucggccccgaccuaaaccccuaccuaucccaccuagcccgcauguacaacgguuacgccggcggcuuugaaguacaagucauccuagcuggcaacgccuucaccgccggaaaaauaaucuucgccgccguaccacccaacuuccccaccgaaggccucuccccaucccaagucaccauguucccccacaucaucguugacguacgccaacucgaacccguccucaucccacuccccgacguccgcaacaacuucuaccauuacaaccaauccaacgacuccacaaucaaacucauagccaugcuguauacaccccuccgugcaaacaaugccggcgaggacgucuucaccguaagcugccgcguacuuacacgccccagccccgacuucgacuucaucuuccuaguuccacccaccgucgaaucacgaacaaaacccuucacuguccccauccuuaccgucgaggaaaugaccaacucacgcuuccccaucccccucgaaaaacucuucaccggacccuccucagccuucgucguccaaccccagaacggacgcugcacaacagauggcguccuccuuggcaccacccaacucucccccguaaacaucugcacuuuccgcggcgacguaacccacaucgcagguucccgcaacuacacaaugaaccuagcaucccucaacuggaacaacuacgaccccacagaagaaauccccgcaccccuaggcaccccagacuucgucgguaaaauccaaggcaugcuaacucaaacaaccaaaggugacggaucaacccgcggccacaaagcaaccgucuacaccgguuccgcacccuucacacccaaacucggauccguccaauucgcaacugacaccgaaaacgacuucgaaacccaccaaaacaccaaauucacacccguaggcgugauccaagacggcggcaccacccaccgcaacgaaccccaacaauggguacuuccaucauacucaggacguaacguacccaacguacacuuagcucccgccgucgcccccacauucccuggagaacagcuucuuuucuuucgcucaaccaugcccggaugcuccggcuauccuaacauggaccucgacugccugcucccccaagaauggguccaacacuucuaccaggaagccgcuccagcccaaucugacguugcccuucuacgcuucguaaacccagacacaggacgaguacucuucgaaugcaagcuccauaaauccggcuacgucacugucgcacacaccggccaacacgaucuagucaucccaccuaauggauacuuccgauucgacuccugggucaaccaauucuacacccucgcccccauggguaaugguacaggccgacgacgagcacucuga

SEQ ID NO: 36648 - RNA, 1623 nt, Artificial Sequence
  derived and/or modified sequence opt11 from VP1__Norovirus__BAU24894
augaaaauggccuccuccgacgcuaaccccuccgacggcuccgccgcaaaccuaguaccagaagugaacaacgaaguuauggcccuagaacccgucgucggcgccgcaaucgccgcaccugucgcaggccaacaaaacgucauagaccccuggauucgaaacaauuucguccaagcacccggcggcgaguucacagucagcccccgcaacgcuccaggcgaaauacuaugguccgcuccccucggacccgaucucaaccccuaccucucacaccucgcccgaauguacaacggauacgccgguggcuucgaaguccaagucauacuagccggcaacgccuucacagcuggcaaaguaauauucgccgccguuccacccaacuuccccacagaaggccucuccccaucccaagucaccauguucccacacauugucguugacguccgccaacuagaaccuguacucaucccccuccccgacguccgcaacaacuucuaccacuauaaccaaagcaacgacccaaccauaaaacuaaucgccaugcucuacacaccacuccgcgccaacaacgcaggcgacgacguauucacuguaucaugccgaguucuaacccgccccucaccugauuucgacuucaucuuccuaguaccgcccaccgucgaaucacgcaccaaacccuuuucaguccccguacucaccgucgaagaaaugacgaacucacgcuuccccaucccacuagaaaaacucuucacuggcccuucauccgcauucgucguacaaccacaaaacggccgcuguacaaccgacggcguacuccucggcaccacccaacucucaccagucaacauauguaccuuccgcggagacguaacacacaucacaggcucacgaaacuacacaaugaacuuagccucccaaaacuggucaaacuacgaccccacagaagaaaucccagcaccccugggaacccccgacuuuguaggcaaaauccaaggcguccucacccaaaccacccgcacagacggcagcacucgaggucauaaagccacugucuacaccggcuccgccgacuucgcccccaaacuaggacgcguccaguucgaaaccgauacagaccacgacuucgaagccaaccaaaauacaaaauucacacccgucggagucauccaggacggauccaccacacaccgcaacgaaccccaacaguggguccuacccucauacuccggccgcaacacgcccaacgugcaccuagcucccgcaguugccccuaccuuccccggagaacaauuacucuucuucagaucaacaaugcccggaugcuccggcuacccaaacauggaccucgacugccuccucccacaagaauggguccaauacuucuaccaagaagcagcccccgcccaauccgacguggcccuccugcgcuucgucaaccccgacacaggccgaguccuuuucgaaugcaaacuacacaaauccgguuacgucaccgucgcacacacuggccaacacgaccucgucauaccacccaacggauacuuccguuucgacucauggguaaaccaauucuacacccuagcccccaugggcaacggaacaggcagacgacgagcacucuga

SEQ ID NO: 36649 - RNA, 1623 nt, Artificial Sequence
  derived and/or modified sequence opt11 from VP1__Norovirus__BAU24897
augaaaauggccuccucagacgcaaaccccucagacggcuccgcagcuaaccuaguuccagaagucaacaaugaaguaauggcacuugaacccgucgucggagccgccauugcagccccugucgcuggccaacaaaacguaaucgaccccuggauccgcaacaacuucguacaagccccaggcggugaauuuacugucucaccccgaaacgcaccaggcgaaauacuuuggucagcccccuuaggacccgaccucaacccauaccuuucgcaccuagcacgcauguacaacggcuacgccggcggcuucgaaguacaaguuauccuagccggcaacgccuucaccgcaggaaaagucaucuucgcagccgucccacccaacuuccccaccgaaggccuuucacccucccaagucacaauguucccccacaucgucgucgacguccgccagcucgaacccguccuaauaccccuacccgacguccgaaacaauuucuaccacuacaaccaauccaacgaccccacgauuaaacucaucgccaugcuauacaccccacuccgcgccaacaacgccggcgacgacguauucacaguaucaugccgcguccucacacgccccuccccagacuucgacuucaucuuccucguaccacccaccgucgaaucucgcaccaaacccuucuccgucccaguacucaccguagaagaaaugacaaacucccgcuuccccaucccccucgaaaaacucuuuacaggacccuccucagccuucgucguccaaccacaaaacggacgaugcaccaccgacggcgucuuauuaggcaccacacaacucucacccguaaacaucugcacauuucgcggcgacgucacccacaucacaggcucacgcaacuacaccaugaaccucgcaagucaaaauugguccaacuaugauccaaccgaagaaauucccgccccacucgggacuccagacuucguaggaaaaauccaaggcguccucacccaaaccacccgaaccgacggcuccacccgcggacacaaagccaccgucuacacaggcagcgccgacuucguccccaaacuaggacgcguacaauuugaaaccgauaccgaccacgacuucgaagccaaucaaaacaccaaauucacccccgucggagucauccaagacggcuccaccacccaccgcaacgaaccccaacaauggguccuccccagcuacuccggccgcaacacuccaaacguccaccuagcacccgcagucgccccuaccuuucccggagaacaacuucucuucuuccgcucaaccaugcccgggugcuccggauacccaaacauggaucuggauugccuccucccccaagaauggguccaauacuucuaccaagaagccgcaccagcccaaagcgacgucgcccuccuccgauuugucaaccccgacaccggccguguacucuucgaaugcaaauuacacaaguccggauacgucacagucgcccacacgggccaacaugaccuaguuaucccucccaacggcuacuuccgauucgacagcuggguuaaccaauuuuacacucuggcacccaugggcaacggcacaggccgccgccgugcccucuga

SEQ ID NO: 36650 - RNA, 1623 nt, Artificial Sequence
  derived and/or modified sequence opt11 from VP1__Norovirus__BAU24900
augaaaauggccucaucagacgcaaaccccucagacggcucagccgcaaaccucguacccgaaguaaacaacgaagucauggcccuagaacccguagucggugccgcaaucgccgcccccguagccggccaacaaaacguaaucgaccccuggauccgcaacaacuucguccaagcacccggcggugaguucacagucucaccuagaaacgccccaggcgaaauccuauggucagcuccccucggccccgaccucaaccccuaccucucucaccucgcccgaauguacaacggcuaugccggcggcuucgaaguacaggucauacuagccggcaacgccuucacagccggcaaagucaucuucgccgccgucccacccaacuuccccacagaaggccuaucaccaucccaagucacaauguucccacacaucguaguugacguacgacaacucgaacccguccuaaucccccuccccgacguccguaacaacuucuaccacuacaaccaaucuaacgaccccacaaucaaacucauugccaugcuauacaccccucuacgagcaaacaacgcaggcgacgacguauucaccgucuccugccgcguacucacccgaccuuccccugacuucgacuucaucuuucucguuccucccaccguugaaucccgcaccaaacccuucuccguaccaguccuaaccguugaagaaaugaccaacucacgcuuccccaucccccucgaaaaacuuuucaccggacccuccuccgccuucguaguucaaccccaaaauggacgaugcaccaccgacggaguccuccucggcaccacacaacucuccccaguaaacauauguacauucagaggcgaugucacccacauuacuggcucucgaaacuacacaaugaaucucgccucccaaaacuggucuaacuacgaccccacugaagaaaucccugcaccccuaggcacccccgacuuuguaggcaaaauacaaggcguccucacacagaccacacgcaccgacggguccaccagaggccacaaggccacaguuuacacuggcucagcagauuucgcccccaaacuaggccgcguccaauuugaaaccgauacagaccgcgauuucgaagccaaccaaaacacaaaauucacaccagucggcgucauacaagacggaagcacaacccaccggaacgagccccaacaauggguacuacccucauacuccggccgaaacacuccaaacguccaucucgccccagccgucgcacccaccuucccaggugaacaacuccucuuuuuccguagcacuaugccaggcugcucaggcuaccccaacauggaccucgacugccuccucccucaagaauggguccaguauuucuaccaagaagcagcacccgcccaauccgacguggcccuacuccgcuucguaaaccccgacacaggccgcguacucuucgaaugcaaacuucacaaauccggauacguaacggucgcccacaccggccagcacgaccuggucaucccgcccaacggcuacuuccgcuuugacagcuggguaaaccaauucuacacccucgcucccaugggaaacggcaccggacgccgccgagcccucuag

SEQ ID NO: 36651 - RNA, 1623 nt, Artificial Sequence
  derived and/or modified sequence opt11 from VP1__Norovirus__BAU24903
augaaaauggccucaucugacgcaaaucccucagacggcucagcagccaaccucguacccgaagucaacaacgaggucauggcccucgaacccgucguaggcgccgcaaucgccgcccccgucgcuggccaacagaacgucaucgacccuuggauccgaaauaacuucguccaagcccccggaggugaauuuacagucucuccccgcaacgcccccggagaaauacucugguccgccccacucggccccgaccucaaccccuaucucucccaccuagcacgaauguacaacggauacgccggcggauuugaaguacaagucauccucgcaggcaacgccuucaccgccggcaaagucauuuucgccgccgucccaccaaacuucccaaccgaaggccuaucccccucacaagucaccauguucccacauaucguaguagacguacgccaacucgaaccuguccugaucccccuuccugacguccgcaacaacuucuaccacuacaaccaaucuaacgaccccaccauaaaacucaucgcaaugcucuacacuccccuccgagccaacaacgccggagacgacgucuucaccgucuccugccguguccucacacgcccuucacccgacuucgacuucaucuuccuuguaccaccaacagucgaaucacgaacuaaacccuucuccguacccguacucacggucgaggaaaugaccaacucacgcuuccccaucccccuagaaaaacuuuuuacaggaccuucuucagccuucguaguccaaccccaaaauggccgaugcaccacagauggaguccuccuuggcaccacccaacuauccccagucaacauaugcaccuuccgcggcgacguuacccacauaaccgguucccgaaacuacaccaugaaucuagccucccaaaacugguccaacuacgacccuacugaagaaauacccgcaccccuaggaaccccagacuucgucggcaaaauccaagggguucucacacaaaccacucgcaccgacggcucaacccgaggccacaaagccaccgucuacaccgggucagccgacuucgcacccaagcucggacgcguccaauucgaaaccgacaccgaccgcgauuucgaagccaaucaaaacaccaaauucacaccggucggcgucauccaggacggcagcaccacccaccgcaacgaaccacaacaauggguccuccccuccuacagcggacgcaacacacccaacguccaccuugccccagcaguagccccaaccuuccccggugaacaacuacucuucuuccgaucuaccaugccaggcugcucuggcuaucccaacauggaccuagacugccuccucccccaggaguggguucaauacuuuuaccaagaagcagccccugcccaaucagacguggcccuucuccgcuucgucaacccagacaccggacgcguucuauucgaaugcaaauuacacaaauccggcuacgucaccgucgcccacaccggccaacacgaccucguuaucccacccaacggguacuuucgauucgacucauggguaaaccaauucuacacacuagcacccaugggcaacggcacaggacgacgccgugcccucuaa

SEQ ID NO: 36652 - RNA, 1623 nt, Artificial Sequence
  derived and/or modified sequence opt11 from VP1__Norovirus__BAU24906
augaaaauggccucaucagacgccaacccuuccgacggauccgcagccaaccucguccccgaagucaacaacgaaguaauggcccuugaaccaguagucggcgcggccauagccgcccccgucgcaggacaacaaaacgucaucgacccuuggauccgcaacaacuucguacaagccccuggcggagaguucaccguaucaccccgcaacgcccccggcgaaauccuuugguccgcaccccucgggccagaccucaauccauaccucucucaccucgcccggauguacaacggcuacgccggcgguuucgaaguccaagucauccuugccggcaaugccuuuaccgccggaaaagucaucuucgccgccguacccccaaacuuccccaccgaaggccucucccccucccaagucaccauguucccacacaucgucgucgacguccggcagcucgaacccguccuaaucccccuccccgacguccgaaacaacuucuaccacuacaaccagucaaacgaccccacgaucaaacucaucgcaaugcucuacaccccacuccgcgccaacaacgccggcgacgacgucuucacagucucaugccgcguacuaacccgccccucgccagacuucgacuucaucuuccucgucccacccacagucgaauccagaaccaaacccuucucaguacccguccuaaccgucgaagaaaugacaaacucccguuuccccaucccccucgaaaaacucuucaccggcccaucaucagccuucguaguccaaccacagaauggacgcugcacaacagacggcguccuucuuggcacaacccaauuaucccccgucaacaucugcaccuuucgcggcgacguuauccacauaaccgguucccgaaacuauacaaugaaucucgccucacaaaacugguccaacuacgaccccacugaagaaauucccgcaccccucgggaccccagacuucgucggcaaaauacaagguguucucacacaaaccacccgcaccgacggauccacacgaggccacaaagccaccguauacaccggguccgccgacuucgccccaaaacuaggccgcguucaauucgaaacagacaccgaucaugauuucgaagccaaccaaaacacaaaguucacacccgucggcguaauccaagacggcucuaccacccaucgcaacgaaccgcaacaauggguccuuccauccuacucuggccgcaacacacccaacguacaccucgcccccgccgucgcaccaaccuuccccggugaacaacuacuguucuuccgauccaccaugcccggcugcucgggcuauccuaacauggaucucgacugccuacuaccccaagaauggguacaauacuucuaccaagaggcugcccccgcacaaucugacgucgcccuccuacgcuucgucaacccagacaccggacgcguccucuucgaaugcaaacuccauaagucaggauacguaacaguagcccacacuggucaacacgaccuagucauaccucccaacggauacuuccgcuucgacuccuggguaaaccaauucuacacacucgcccccaugggcaacggcacaggccgacgccgcgcccucuaa

SEQ ID NO: 36653 - RNA, 1623 nt, Artificial Sequence
  derived and/or modified sequence opt11 from VP1__Norovirus__BAU24909
augaaaauggccuccuccgacgccaaccccagcgacggcuccgccgcaaaccucgugcccgaaguaaacaacgaggucauggcucucgaacccguagucggagccgccauagcugcacccgucgccggacaacaaaacguaaucgaucccuggauaagaaacaacuucguucaagcaccaggaggcgaguucacaguauccccaagaaacgccccuggagaaauccucuggucugccccauuaggaccugaucuaaacccauaccuaucacaccuugcaagaauguacaacggcuacgccgguggauuugaaguccaggugauccucgccggcaacgccuucaccgccggaaaaguaaucuucgccgccguaccacccaacuuccccaccgaaggccucucacccucacagguaaccauguucccucacaucgucguagacguccgacaacucgaaccaguccucaucccccuacccgacguucgcaacaacuucuaccacuacaaccaauccaaugaccccaccauaaaacucaucgcaaugcucuacacaccccuaagagccaacaacgccggugacgacgucuucaccgucuccugccgcguguuaacccgccccucacccgacuucgacuuuaucuuucucgucccacccacagucgaaucgcgaacaaaacccuucuccguucccguacucaccgucgaagaaaugacaaacucucgcuucccaauaccccucgaaaaacuauuuacaggacccuccucggcauucgucguccaaccccaaaacgggcgaugcaccaccgacgggguccuccucggcaccacacaacuaucccccgucaauaucugcaccuucagaggcgacgucacccauaucaccggaucacgcaacuacaccaugaaccuugccucccaaaacugguccaacuacgaccccacggaagaaauccccgccccacucgguaccccagacuucgucgggaaaauacaagguguccucacucaaaccacacgcacagacggcagcacccgcggacauaaagcuaccgucuacacaggcucagccgacuucgcccccaagcugggccgcguacaauucgaaaccgauacagaccgcgacuuugaagccaaccaaaacacaaaauucacccccguuggcgucauccaagacggaucaaccacccaccguaaugaaccccaacaauggguacuacccuccuacucgggacgaaacacccccaacguacaccuagcccccgccgucgcccccacauucccaggcgaacaacuacuauucuuccgcuccacuaugcccggaugcuccggcuaccccaacauggaccucgacugccuccucccacaagaauggguacaauauuucuaccaagaggccgcaccagcucaaucagacguagcccuccuacgcuucguaaaccccgacaccggccgcguacucuuugaaugcaaacuucacaagucaggcuacgucacagucgcucacaccggccaacacgaccuaguaaucccucccaacggauauuuuagauucgacucuugggucaaccaauucuacacacucgcacccaugggaaacggcaccggccgacgacgggccuuauaa

SEQ ID NO: 36654 - RNA, 1623 nt, Artificial Sequence
  derived and/or modified sequence opt11 from VP1__Norovirus__BAU24912
augaaaauggccagcucagacgccaaccccuccgauggcucggccgcaaaccucguccccgaagucaacaacgaaguuauggcccucgaacccguggucggcgccgccaucgcggcacccgucgcaggacaacaaaacguaauugacccauggauacgcaacaacuucguccaagcacccggaggcgaguucaccguaucaccccgcaacgccccaggagaaauccuuugguccgcgccacucggccccgaccucaacccuuaccucucccaccuugcccgcauguacaacggcuacgcaggcggcuuugaaguccaggucauccucgccggcaacgccuucaccgccggcaaggucauauucgcagcagucccacccaacuuccccaccgaaggccuaucaccuucacaagucacaauguucccccacauaguugucgacguccgccaacuagaacccgugcucaucccccuaccagacguccgaaacaacuucuaucacuacaaccaaaguaacgacccaacaaucaaacuuauagcuaugcuauacacaccacuccgcgccaacaacgccggcgacgacguauucaccgucucuugcagaguacuaaccagacccucuccagacuucgacuucaucuuccuugucccacccaccgucgaaucccgcaccaaacccuucucagucccaguccugaccguggaagaaaugacuaacucccgcuuccccaucccacucgaaaaacucuucaccggccccuccuccgcauucgucguucaaccccaaaacggacgcugcaccaccgacggcguccuccucggaacaacccaacucucacccgucaacaucugcaccuuucgcggugacguuacccacaucacagggucucgcaacuacacaaugaaucuugccucccaaaacuggucuaacuacgaccccacagaagagaucccagcaccccuaggcacccccgacuucgucggcaaaauucaaggcguacucacccaaaccacccgcacagacggcagcacccgaggccauaaagccaccgucuauaccggcucagccgacuuugcccccaaacucggcagaguucaauucgaaacugacaccgaccacgacuucgaagcuaaccagaacaccaaauucacaccuguaggcgucauccaagacggcuccaccacccaccgcaaugaaccccaacaauggguacuacccuccuacucuggacgcaacaccccaaacguacacuuagcuccugcugucgccccuaccuucccaggcgaacaacuccuuuucuucagaagcaccaugccaggaugcuccggcuaccccaacauggaccucgacugccuacuaccccaagaauggguacaauacuucuaccaagaagccgcuccagcacaauccgacguagcgcuccucagauucguuaacccagacacaggucgaguccucuucgaaugcaaacugcauaaguccggcuacgucacuguagcacauaccggacagcacgaccuaguaaucccacccaacggauacuuccguuucgacucaugggucaaccaauucuacacacuagcccccaugggcaacggaaccggccgacgccgagcccucuaa

SEQ ID NO: 36655 - RNA, 1623 nt, Artificial Sequence
  derived and/or modified sequence opt11 from VP1__Norovirus__BAU24915
augaaaauggccucaucagacgcaaaccccuccgacggaucugcagcuaaccucgucccagaaguuaacaacgaagucauggcuuuagaaccaguaguaggcgccgccaucgccgcccccgucgcugggcaacaaaacgucaucgaccccuggauccgcuccaacuucguccaagccccaggcggcgaauuuaccguuucaccccgcaacgcccccggcgaaauccucugguccgcgccccuaggccccgaccuaaauccauaucucucccaccucgcccgcauguacaacggauacgccggaggcuucgaaguccaagucauacuugccggcaacgcuuucaccgccggcaaagucaucuucgcagccguuccaccuaacuuccccaccgaaggccucuccccaucccaggucacaauguucccccauauugucgucgauguccgccagcucgaacccguccucauaccacucccagacguccgaaacaauuucuaccacuacaaccaauccaacgacccuacgauaaaacucaucgccaugcucuacaccccacuccgugccaauaacgccggagacgacgucuucacaguauccugccgaguucucaccagacccucccccgacuucgacuuuaucuuccuugucccacccaccgucgaaucaagaaccaaacccuucucaguacccguucuaacaguugaagaaaugaccaacucacgcuucccuaucccauuagaaaaacuauucacgggcccauccuccgccuucgucguccaaccacaaaacggccgaugcacgaccgacggcgugcuacugggcacaacccaacucucgccagucaacaucugcaccuuccgcggagacgucacccacaucaccggaucacguaacuacacuaugaacuuggcaucgcaaaacuggucaaacuacgaccccacagaagaaauaccagccccuuuaggcaccccagacuucgucggcaaaauacaaggagugcucacccaaaccacccgcaccgacggcuccacacgaggacacaaagccaccgucuauaccggauccgcaaauuucgcccccaaacucggacguguccaauucgaaaccgacaccgaccacgacuucgaagccaaccaaaauaccaaauucacccccguaggcgucauccaagacggcagcacgacacaccgcaacgaaccccaacaauggguacuccccuccuacuccgggagaaacacacccaacguucaccucgccccagccguagcccccaccuuccccggugaacaacuccucuucuucagaucaacaaugcccggauguagcggcuaccccaacauggaccuagacugccuccucccccaagaauggguccaauacuucuaccaggaagccgcacccgcccaaucugacgucgcccuacuccgcuuugucaacccagacaccggacgaguacucuucgaaugcaaacuacacaaauccggcuacguaaccgucgcccacaccggacaacacgaccuagucauucccccaaacggcuacuuccguuucgacagcuggguaaaccaauucuacacccuagcccccaugggcaacggcaccggccgcagacgcgcccuauaa

SEQ ID NO: 36656 - RNA, 1623 nt, Artificial Sequence
  derived and/or modified sequence opt11 from VP1__Norovirus__BAU24918
augaaaauggccuccagcgaugcaaaccccuccgacggcagcgccgcaaaccuugucccugaaguuaacaacgagguuauggcccuagaaccagucgucggcgccgccaucgccgcccccgucgccggccaacaaaacgucaucgaccccuggauaagaaauaacuucguacaagcccccggcggcgaauuuaccguguccccaagaaaugccccgggcgaaauccucuggucagccccucucggccccgaccuaaaccccuaccucucccaccuagccagaauguacaacggcuacgccggcggcuucgaaguccagguaauacucgccggcaaugccuuuacagcuggcaaaguaaucuuugcugcagucccucccaacuuccccacagaaggccugucccccucccaagucaccauguucccccacaucguaguagacguucgccaacucgaaccaguccucaucccccuccccgacguccgaaacaacuucuaccauuacaaccaaucgaacgaccccaccauuaaacucauugcaaugcucuacaccccacuccgcgccaacaacgcaggcgacgacguauuuaccguauccugccgaguucuaacacgccccucacccgacuuugacuucaucuuccucguuccucccaccguugaaucaagaaccaaacccuucagcguucccguucuuacagucgaagaaaugaccaauucccgguuccccauuccacuagaaaaacucuucaccggccccucuuccgccuucgucguucagccccaaaacgguagaugcacaaccgacggcguccuccuuggaacaacgcaacucucucccgucaacaucugcacauuccgcggcgacgucacacacaucaccggaucccgcaacuacaccaugaaccucgccucgcaaaauugguccaacuacgaccccacagaagaaaucccagcaccacucggaacuccagacuucgucgguaaaauccaaggcguccucacgcaaacaacucgcacagacgguuccacccguggacacaaagcaaccguuuauaccggcuccgccgacuucgcccccaaacuaggucgcguccaauucgaaaccgacacagaccgugacuuugaagccaaccaaaacaccaaauucacccccguaggagucauucaagacggauccacaacccaccgcaacgaaccccaacaauggguccuccccuccuacucuggccgaaacaccccaaacguucaccucgcccccgccguagcacccaccuucccaggcgaacaacuccuauucuuucgauccacaaugcccggcugcucuggauacccaaacauggaccucgauugcuuauuaccccaagaauggguccaauauuucuaccaagaagcugccccugcacaaucugacgucgcccuccuccgcuucgucaacccagacaccggacgaguccucuucgaauguaagcuccacaaauccggauacguaacagucgcacauaccggccaacacgaccucgucauacccccaaacggauacuuccgauuugacucauggguaaaccaauucuauacacucgcccccaugggcaacggcaccggacgacgacgagcccucuaa

SEQ ID NO: 36657 - RNA, 1623 nt, Artificial Sequence
  derived and/or modified sequence opt11 from VP1__Norovirus__BAU24921
augaaaauggccucaucugacgcaaaccccuccgacggcucggcugccaaccucguccccgaagucaacaacgaagucauggcacucgaaccgguaguaggagccgccaucgcagccccuguagccggccaacaaaaugucaucgacccuuggaucagaaacaacuucguccaggcccccggcggcgaguucacuguaucaccucgcaaugcccccggcgaaauccuauggucagcuccccucggcccagaccucaacccauaccucucacaccuagcaagaauguacaaugguuacgcuggcggcuucgaaguccaaguaauccucgccggaaacgcauucacugcaggcaaaguaaucuucgccgcaguucccccaaacuuucccacagaaggacucuccccaucccaagucaccauguucccccacaucgucguggacguccgccaacuagaacccguccucauaccccuacccgacguccguaacaacuucuaccacuacaaccaaucaaacgacccaaccaucaagcuaaucgccaugcuauacacaccccuacgagccaacaacgccggagacgacguauuuacuguauccugucgcguccucacgcgcccaucccccgacuucgacuucaucuuccucgucccgcccaccguagaaucccgcacaaaacccuucucuguacccguacucacagucgaagaaaugacuaacucucgauuccccaucccacuugaaaaacucuucacaggaccuuccagcgcguucguaguccaaccacagaacggccgaugcaccaccgacggcguccuucucggcaccacccaacuaucaccugucaacauuuguaccuuccgcggggacgucacacacauaaccggcucccgcaacuacaccaugaaccucgccagccaaaacugguccaacuacgaccccacugaagaaauccccgcacccuuaggcaccccugacuucgucggcaaaauccaaggcguccucacccaaaccacccgcaccgacggauccacccgcggacacaaagcaaccguauauaccggcucagccgacuucgcacccaaacucggucgaguccaauucgaaaccgacacagacagagauuucgaagcaaaccaaaacaccaaauucacaccagucggcguaauccaagacggcucaacaacccaccgcaaugaaccccaacaauggguacucccauccuacagcggccgcaacacccccaacguccaccucgccccagccguagcacccaccuuccccggcgagcaacuacuguucuuccgcuccaccaugcccggcugcucaggcuaccccaacauggaccucgacugccuacucccacaagaauggguucaauacuucuaccaagaagccgcaccagcccaaucagacgucgcccuacuccgcuucgucaaccccgacaccggccgaguacucuucgaaugcaagcuacacaaauccggcuaugucaccgucgcccacaccggacaacaugaucucgucauacccccuaacggcuacuuccguuucgacuccuggguuaaccaauucuacacacucgccccaaugggcaauggcaccggcagaagacgcgcucucuaa

SEQ ID NO: 36658 - RNA, 1623 nt, Artificial Sequence
  derived and/or modified sequence opt11 from VP1__Norovirus__BAU24924
augaaaauggccagcuccgacgcaaacccaucagacggcagugcugccaaccuagucccagaaguaaacaacgaaguuauggcccucgagcccgucgucggagcagccauagccgcacccgucgccggccaacaaaacgucauugaccccuggauucgcaacaacuucguucaagcccccggaggcgaguucaccguaucgccacgcaacgcccccggagaaauccuuuggagcgccccucuugguccagaccuaaaccccuaccucucucaccuugcccgcauguauaacggauaugccggcggcuucgaaguacagguaauccucgcaggaaaugccuucaccgccggcaaagucaucuucgccgccgucccacccaacuuccccaccgaaggccuauccccgucucaaguuacaauguucccccacaucguaguagacguccgccaacucgaacccguacuuauccccuuaccugauguccguaacaacuucuaccacuacaaccaauccaacgacccaacaaucaaacucauagccaugcucuauacaccacucagagccaacaacgccggcgacgacgucuuuacagucucuugccgcguucucacccgaccaucucccgacuucgacuucaucuuccucgucccacccaccgucgaaucgcgcacgaaaccauucuccguaccaguccucaccguagaagaaaugaccaacuccagauucccaaucccccuugaaaaacuauucaccggcccuucaucagccuucgucguccaaccccaaaacggccgcugcaccacagacggaguccucuuaggaacaacccaacucucccccguuaacaucugcaccuuccgaggcgacgucacccacauaaccggcucacgcaacuauacaaugaaccuugccucccagaacugguccaacuacgacccaaccgaagagauccccgcaccccuaggaaccccagacuuuguaggcaaaauccagggaguccuuacacaaacaacgcgaacagacggcucaacccgcggccacaaagccaccguauacacaggaucagccgauuucgcccccaaauuaggucgaguccaauucgaaaccgauaccgaccgugacuuugaagccaaccaaaauaccaaauucacccccgucggaguaauacaagacggcuccacaacccacagaaacgaaccccaacaauggguacucccaucuuacucaggccgcaacacucccaacguccaccucgccccggcuguagccccaaccuucccuggagaacaacuccucuucuuccguagcaccaugccuggcugcuccggcuaccccaacauggaccucgacugucuccucccccaagaauggguccaauacuucuaccaagaagcggcccccgcccaaucagacgucgcccuccuacguuucguaaaccccgacaccggccgcguccucuucgaaugcaagcuccacaaauccgguuacgucaccgucgcccacacaggccaacacgaccugguaauaccacccaacggauacuuccguuuugacuccuggguaaaccaguucuacacccucgcccccaugggcaacggaaccggacgacgacgcgcacucuga

SEQ ID NO: 36659 - RNA, 1623 nt, Artificial Sequence
  derived and/or modified sequence opt11 from VP1__Norovirus__BAU24927
augaaaauggcaucuagcgacgccaaccccagcgacggaucagccgccaaccuaguccccgaagucaacaacgaaguuauggcacucgaaccugucgucggugccgcaaucgcugcccccgucgccggccaacaaaacgucaucgaccccuggauccguaacaacuucguccaagcacccggcggugaguucacaguaucaccacgcaacgcccccggcgaaauccucuggucagcgccccuaggcccagaccuaaaccccuaccucucacaccucgcacguauguacaacggcuacgccggcggcuucgaaguacaagucauccucgccggcaacgccuucacugcaggcaaaguaaucuucgcggccguacccccuaacuuccccacugaaggccucucccccucucaagucacaauguucccccacaucgucgucgacguccgccagcuagagcccguccucaucccgcuaccagauguaagaaacaacuucuaccacuacaaucaauccaacgaccccaccauaaaacucauagcaaugcucuacaccccacuacgagcaaacaacgccggcgacgacguauucacagucucaugccgcgucuuaacccgacccucucccgacuucgacuucaucuuccucguaccacccacagucgaaucucgcaccaaacccuucuccguccccguccucaccgucgaagaaaugaccaacucccgcuuccccaucccacucgaaaaacuuuucacugguccaucauccgccuucgucguacaaccccaaaacggccgcugcaccaccgacggcguacuacucgguacuacccaacucucccccgucaacaucugcaccuuucguggagacguaacccacaucaccggauccagaaauuacaccaugaaucuugcuucacaaaacuggucaaacuacgacccuaccgaagaaauccccgcaccccucggaaccccugacuuugucggcaaaauucaagguguucuaacacaaacaacacgcaccgacggcuccaccagaggacacaaagcaacaguauacaccggcuccgccgacuucgcacccaaacucggucgcguacaauucgaaacagacaccgaccacgacuucgaagccaaccagaauaccaaauucacaccaguaggagucauccaagacggcgguaccacccaccgcaacgagccacaacaauggguccuccccucauacucaggccgcaacacacccaacguccaccuagcccccgcagucgcacccacauucccuggcgaacaacucuuguucuucagaucaaccaugcccggcugcucuggauaccccaacauggaacucgacugccuucuaccccaagaauggguccaauacuucuaucaagaagccgccccugcucaauccgacgucgcccuacuaagauucgucaaccccgacaccggccguguccuguucgaaugcaaacuccacaaauccggcuacgucacagucgcccacaccggccaacacgaccuggucauacccccaaacggcuacuuucgauucgacucaugggugaaccaauucuacacccuagcccccaugggaaacggcacuggccgcagacgcgcccucuaa

SEQ ID NO: 36660 - RNA, 1623 nt, Artificial Sequence
  derived and/or modified sequence opt11 from VP1__Norovirus__BAU24930
augaagauggccucaagcgacgcaaauccuuccgacggcucagccgcuaauuuaguccccgaagucaacaacgaagucauggcacuugaacccgucgucggagccgccaucgccgcaccagucgccggccagcaaaacgucaucgaccccuggaucagaaacaacuucguccaagcccccggaggagaauuuaccguaagcccacgaaacgccccaggcgaaauccuaugguccgccccacucggccccgaccucaaccccuaucucucccaccuggcccgcauguauaacggcuacgccggaggcuucgaaguacaagucauccucgcaggcaacgccuucaccgcaggaaaagucauauucgccgccgucccacccaacuuucccacagaaggacuaucacccucccaagugaccauguucccccacaucauagucgacguacgccaacucgaacccguccucauaccucuccccgacgucagaaacaacuucuaccacuacaaccaauccaacgacucaaccaucaaacucaucgccaugcuuuacacaccacuccgagccaacaacgccggcgacgacgucuuuacagucuccugucguguccucacccgcccaucccccgacuucgauuucauauuucucguaccacccaccguagaaucccgcaccaaacccuucucaguccccguacucacggucgaagaaaugacaaacucccgauuccccaucccacucgaaaagcuauucaccggcccauccucagccuucguaguacaaccucaaaacggccgaugcaccacagauggaguacuccucggcacaacgcaacucucucccgucaacaucugcacauuccgaggugacguaacccacaucaccggcucacgcaacuacacaaugaaccucgccagccaaaacuggaacaacuacgaccccaccgaagaaauccccgcaccccucggcacacccgacuucguaggcaaaauccaaggaaugcucacucaaacaacucgcaccgacgguuccacccgaggccacaaagccaccgucuacaccggcuccgccgacuucgcccccaaguuaggcagaguucaguuugaaaccgacaccgaccacgacuucgaagcaaaccaaaacaccaaauucacccccgucggcguuauccaagacggauccaccacccaccgaaacgaaccccaacaauggguucucccaucauacucaggacgcaacacccacaacguccaccucgcccccgcuguagcacccacauucccaggcgaacaacuucucuucuuccgauccacaaugcccggcugcuccggcuauccuaacauggaccucgacugccuacucccccaagaauggguccaauauuucuaccaagaagccgcacccgcccaauccgacgucgcccuucuucgauucgucaaccccgacacuggccgaguccucuucgaauguaaacuccacaaauccggcuacguaaccgucgcccacacaggacaacacgacuuaguaaucccacccaacggauacuuccgauucgacucaugggucaaccaauucuacacauuagcaccuaugggcaacggcaccggccgacgacgcgucgucuaa

SEQ ID NO: 36661 - RNA, 1623 nt, Artificial Sequence
  derived and/or modified sequence opt11 from VP1__Norovirus__BAU24933
augaaaauggccaguucggacgcaaaccccuccgacggauccaccgccaaccucgucccugaaguuaacaaugaagucauggcccuugagccugucguaggcgccgccauugccgcccccgucgccggccaacaaaacgucaucgaucccuggauccgcaacaacuucguccaagcccccggcggugaguucaccgucuccccacgaaacgccccaggcgaaauacucuggucagcaccccuugguccagaccucaaccccuaucuuucccaccuagcaagaauguacaacggcuacgccggaggauucgaaguccaagucauccuugcaggcaacgccuuuaccgccggaaaaaucauuuucgcagccguacccccuaacuuccccacagagggccucucacccucccaaguaaccauguucccccacaucauaguagacguacgacaacucgaaccaguccuaaucccccuccccgacguccgcaauaacuucuaccacuacaaccaauccaacgacucuacaaucaaacucaucgcaaugcucuacacaccccuacgcgccaacaaugccggugacgacgucuucaccgucuccugccgaguacuaacccgccccucccccgacuucgacuucauauuccucgucccacccaccgucgaaucacgcaccaaacccuucuccguaccgguccucaccgucgaagaaaugaccaacucccgcuuccccaucccgcuggaaaaacucuucacagguccaucauccgcauucgucgugcaaccccaaaacggccgcugcacaacugacggaguccuccuaggaaccacccaauuaucgccaguaaacaucugcaccuuccgaggcgacgucacccacaucucaggcucacgcaacuacacaaugaaccuugccucccaaaacuggaacagcuacgaccccaccgaagaaauaccagccccacuaggcacccccgacuucguaggaaaaauccaaggaguccucacacaaaccacacgcacaaacggaucaacccguggacacaaagccacagucuacaccggcucagccgacuucucccccaaacucggacgcguccaauucgccaccgacaccgacaacgacuucgaaaccaaccaaaacaccaaauucacccccguaggggucauccaagacggaagcacuacuccccgcaacgaaccccaacaauggguacucccauccuauuccgggcguaacauccacaacguucaccuagccccagcagucgccccaaccuuccccggugaacaacuauuauucuuccgauccacuaugcccggaugcucaggcuaccccaauauggaccuagacugcuuacucccucaagaauggguccaauacuucuaccaagaagccgcucccgcacagucugacgucgcccuauuacgcuuuguaaauccagauaccggccgcguccuauucgaaugcaaacuccacaaaagcggauacgucaccguagcccacacaggccagcacgaccuagucaucccacccaacggcuacuucagauucgacucgugggucaaccaauucuacacacuagcccccaugggcaacggcaccggacgacgacgcgcuuuauaa

SEQ ID NO: 36662 - RNA, 1623 nt, Artificial Sequence
  derived and/or modified sequence opt11 from VP1__Norovirus__BAU24936
augaaaauggcauccaacgacgccaaccccucagacggcucagccgccaaccuaguaccagaagucaacaacgaaguaauggcccucgaaccagucgucggagcagcaaucgcagccccugucgcaggccaacaaaacgucauagaucccuggauuagaaacaacuucguccaggccccgggcggcgaguucacggucucaccccgcaacgcacccggagaaauacucuggucagcaccccucggccccgaccucaacccuuaccuaagccaccuugcccgcauguacaacggcuacgccggcggcuuugaaguccaagucauucucgcaggcaacgccuucacugcaggcaaaauuaucuucgccgccguacccccuaacuuccccacagaaggauuaucccccucccaagucaccauguucccccacaucauagucgauguacgccaacucgaacccguucucaucccccuccccgacguacgcaacaauuucuaccacuacaaccaaagcaacgacucaacuauaaaacuaaucgcaaugcucuacacaccccuccgcgcaaacaaugccggcgaagacgucuucaccguaucuugcagaguccucacacgaccaucucccgauuucgacuucaucuuucuugucccacccaccgucgaaagucgaaccaaacccuucaccguccccauacucaccgucgaagaaaugacaaacucccgcuuccccauaccccuagaaaaacucuucaccggccccuccuccgcauucgucguccaaccccaaaacggccgcugcaccaccgacggcguucuacuaggcaccacgcaacuauccccgguuaacaucugcaccuuccgcggcgacguaacccacauagccggaucaagaaacuacaccaugaaccuagccucccucaacuggaacaauuaugacccaacugaagaaauacccgcuccccucggcaccccagacuuugucggcaaaauccaaggaguccucacccagacuaccaaaggcgacggcagcacccgcggccacaaagccaccgucuauacagguuccgcccccuuuacccccaaacuaggaucuguccaauucggcaccgauaccgaaaacgacuucgaaacccaccaaaacaccaaguucacacccguuggagucauccaagacgguggcacuacccaccgcaacgaaccacaacaauggguccuacccuccuacucaggccgaaacguucccaacguacaccuugcccccgccgucgcccccaccuucccaggcgaacaacuccucuucuuccgcucaacaaugcccggcugcuccggcuacccuaauauggaucucgacugccuccuaccccaagaauggguccaacacuuuuaccaagaagccgcccccgcacaaucagacguugcacuccuccgauucguuaaccccgauaccggccgcguccuguucgaaugcaaacuccacaaaccaggcuacgucacagucgcccacacgggccaacacgaccucgucaucccucccaacggcuauuucagguucgacucaugggucaaccaauucuacacccucgcccccaugggcaacgggaccggccgaagacgcgcacucuag

SEQ ID NO: 36663 - RNA, 1623 nt, Artificial Sequence
  derived and/or modified sequence opt11 from VP1__Norovirus__BAU24942
augaaaauggccuccucugacgcaaaccccagcgacggcucagcugcaaaucucguccccgaggucaacaacgaaguaauggcucucgaaccagucgucggcgcagcgaucgccgcacccgucgccggccaacaaaacgucauagaccccuggauacgaaauaacuucguacaagcccccggcggcgaguucaccgucuccccacgcaacgccccaggagaaauccuauggucugcaccccuuggccccgaccucaauccauaccuuucccaccuagcccgcauguacaacggauacgcaggcggcuucgaaguacaaguuauccuagcagguaacgccuuuaccgcaggcaaaguaaucuucgcagcugugccacccaacuuccccaccgaaggccucucccccucccagguaacaauguucccccacaucgucgucgauguacgacagcuagaacccguuuuaaucccccuacccgacguccguaacaacuucuaccacuacaaccaaucaaacgacccaaccaucaaacucauugccauguuauacacaccccuacgagcaaacaacgcaggagacgacguauucaccgucuccugccgcguccugacccgccccucccccgacuucgacuucaucuuucucgucccaccaaccgucgaaagccguaccaaacccuucuccguccccguucucaccgucgaagaaaugaccaacucacgauucccuaucccccuagaaaaacucuucaccggcccauccuccgccuucgucguacaaccccaaaacggccgaugcaccaccgacggaguacuccucggcacaacccaacugucccccgucaacaucugcacauuccgcggagaugucacccacauaaccggcucccgcaacuacacaaugaaccucgcaucccagaacugguccaacuacgacccaacagaagaaacacccgcaccucuaggcacccccgacuucgucggaaaaauccaaggaguccuaacccagaccacccgcacagacggauccacccgcggccacaaagccacagucuacaccggcuccgcggacuucgcccccaaauuaggccgcguccaauucgaaacugacacagaucgggauuuugaagccaaccaaaacaccaaauucacccccguaggagucauccaagacggauccacgacacaccgcaacgaaccacaacaauggguccuccccuccuacucuggacgcaacacccccaauguccacuuagcuccugccgucgccccaaccuucccaggcgaacaauuacucuucuuccggagcacaaugcccggcugcuccggcuaccccaauauggaccuugacugccuacuaccccaagaguggguucaauacuucuaccaagaagccgcuccugcccaauccgacguagcacuccuccgcuucgucaaccccgacaccggccgcguccuauucgaaugcaagcuacacaaauccggcuaugucacaguugcccacacaggccaacacgacuuagucaucccuccaaacggauacuucagauucgacagcugggucaaccaauucuacacccuagcacccaugggaaacggcacuggacgccgccgagcccucuaa

SEQ ID NO: 36664 - RNA, 1623 nt, Artificial Sequence
  derived and/or modified sequence opt11 from VP1__Norovirus__BAU24945
augaaaauggccagcuccgacgccaaccccucugacggcucugccgccaaccucgucccagaagucaacaacgaagucauggcccucgaaccagucguaggcgccgccaucgcagcacccguggcaggccagcaaaaugucauagaccccuggauccgcaacaacuucguacaagcccccggaggcgaguucaccguaucaccccgcaacgcaccgggagaaauucucugguccgcaccacuuggcccagaccuaaaccccuaucuaagccaccucgcaagaauguacaauggauacgccggcggauucgaaguccaggucauccucgccggcaacgccuucacagccggcaaagucaucuucgccgccguacccccaaacuuucccaccgaaggucuaucccccucccaaguuacaauguucccacacauagucguagacguccgccaacucgaacccguccuaaucccccugcccgacguaagaaacaacuucuaccacuacaaccaauccaacgaccccaccauaaaacugaucgcuaugcucuacacaccccucagggcgaacaacgcuggugacgacgucuucaccgucucaugccgcguccucacccgccccagccccgacuuugacuucauauuccucgucccaccgaccguagaaucccgaaccaaaccuuucagcgucccaguccuuaccgucgaagaaaugaccaacucccgcuuccccaucccacucgaaaaacucuucaccggcccaucaagcgcauucguaguccaaccacaaaacggacgaugcacaaccgauggaguacuccucggcaccacacaacucucaccagucaacaucugcacauuccgcggcgacgucacccacauaaccgguucccgcaacuacaccaugaaccucgcaucccaaaacugguccaacuacgaccccacugaagagacacccgccccacucggcacaccagacuucguaggaaaaauacaaggcguccuaacucaaacaacucgaacagacggcucaacacggggccacaaagcaacagucuacacagguucagccgacuucgcaccgaaacuuggccgcguccaauucgaaacugacacugaccacgauuucgaagccaaccaaaacacaaaauucacccccgucggcguaauccaagacggcucaaccacccauagaaacgaaccucagcaauggguacuucccuccuacuccggacgaaacacccccaacguccaccucgccccagccguggcaccaaccuuccccggcgaacaacuacucuucuuccgaucaaccaugcccggcugcagcggguaucccaacauggaccuagacugccuccucccucaagaauggguacaauacuucuaccaagaagccgcccccgcacaauccgacgucgcacuccuccgauucguaaaccccgauaccggccgaguccucuucgaaugcaaacuccacaaauccggauacguaacagucgcccacaccggacaacacgaccucguaauaccucccaacgguuacuuccgcuucgacuccugggucaaucaauucuacacccuagcaccaaugggcaacggaaccggccgaagacgcgcccucuaa

SEQ ID NO: 36665 - RNA, 1623 nt, Artificial Sequence
  derived and/or modified sequence opt11 from VP1__Norovirus__BAU24948
augaaaauggccuccuccgacgccaaucccuccgacggcucggccgccaaccucguccccgaaguaaacaaugaagucauggcacucgaacccguaguaggcgcagccaucgcagcacccguagccggccaacaaaacgucaucgaccccuggauccgaaauaacuucguccaagcccccggaggugaguucaccguauccccacggaacgcaccaggcgaaauccucugguccgcaccccucggcccugaccucaaucccuacuuaucccaccucgcucgaauguacaacggauacgccggcggcuucgaaguucaaguaauccuagcuggcaacgccuucaccgccggaaaagucauuuucgccgcagucccucccaacuuccccaccgaagggcuaucucccagccaagucaccauguucccccacaucgucguagacgugcgccaacucgaaccuguacuaaucccacuccccgacgucagaaacaacuucuaccacuauaaccaaucaaaugaccccacaaucaaacucaucgccaugcucuacacuccucuacgugccaacaacgccggcgaugacgucuucacggucuccugccgcguccucaccagaccaucacccgacuucgacuucaucuuccucgucccgcccaccguggaaucucggacaaaacccuucuccguacccguccucaccgucgaagaaaugacaaacucccgcuuccccauaccccucgaaaaacucuucaccggaccgucauccgcauucguaguccaaccacaaaacggccgaugcaccaccgacggcguauuacucggaaccacucaacucucacccgucaacauuugcacuuuccgaggcgaugucacccacaucacagggucgcgcaacuacaccaugaaccucgcaucccagaacugguccaacuacgacccaacagaagaaauucccgccccacuugguacccccgacuucguaggcaaaauccaaggcguacucacacaaacuaccagaacugacggcagcacacgaggacacaaagccaccgucuauaccggcucugcagacuucgcacccaaacugggucgaguacaauucgaaaccgacaccgaccacgacuucgaagcaaaccaaaacacuaaauucacaccugucggcguuauccaagacggcagcaccgcacacagaaacgagccccagcaauggguccuccccuccuacagcggacgaaacacccccaacguccaccuggcaccagcugucgcccccaccuuccccggcgaacaacuccucuucuucagauccaccaugcccggcugcucaggcuaccccaacauggaccucgauugccuccucccacaagaguggguccaauacuucuaccaggaagcagcacccgcccaaagcgaugucgcccuacuccgauucgucaaccccgacacaggccgcgucuuauucgaaugcaaacuccacaaauccggauacguuacagucgcccacaccggccaacacgaccucguaaucccaccaaauggcuacuuccgcuucgacucaugggucaaccaauucuacacccuagcccccaugggaaacggcaccggccgacgucgcgcccucuaa

SEQ ID NO: 36666 - RNA, 1623 nt, Artificial Sequence
  derived and/or modified sequence opt11 from VP1__Norovirus__BAU24950
augaaaauggccucauccgacgccaaucccucagacggauccacagcaaaccuuguccccgaagucaacaacgaagucauggcccucgaaccagucgucggugccgcaaucgccgcacccgucgccggccaacaaaacgucaucgaccccuggauccgcaacaacuucguccaggcccccggcggcgaguucaccgucucgccccgaaacgcaccaggagaaauccuaugguccgccccacuaggccccgaccucaaccccuaccucucccaccuagcccgaauguacaacggcuacgccggcggauucgaaguccaagucauccucgccggcaacgcauucacugccggcaaaaucaucuucgccgccguaccacccaacuuccccacagaaggccucuccccgucacaaguaacaauguucccccauaucaucguagacguacgacaacucgaaccaguacucauaccccucccagacguccgaaacaacuucuaucacuacaaccaaucaaacgacucuaccauaaaauuaaucgccaugcucuacacaccccuccgcgccaacaaugcuggagacgacgucuuuaccgucucaugccguguccuaacccgacccucucccgacuucgacuuuaucuuucucgucccaccaacaguagaaucacgcacuaaacccuuuuccguaccuguccucaccgucgaagaaaugacaaacucccguuuccccaucccccuagaaaaacucuucacaggacccucaagcgccuucgucguucaaccccaaaacggacgcugcaccaccgacggaguucuucuaggcaccacccaacuuucccccguaaacaucuguaccuuccguggcgacgucacccacauccccggaucucgcaacuacacuaugaaccuagcuucccaaaacuggaacuccuacgaccccacagaagaaauacccgcaccccuaggcacccccgacuucgucggcaaaauccaaggcgucuuaacccaaaccacccgcacaaacggauccacucgcggccacaaagccaccgucuacaccggauccgccgauuucucccccaaacucggacgcguucaauucgcaacagacacagauaaugauuucgaaaccaaccaaaacaccaaauucacaccagucggagucauccaagacggcucuacaacaccacgcaacgaaccccaacaaugggugcucccauccuacuccggacgaaacauacacaacguucaccuagcucccgccgucgcaccaacuuuccccggcgaacagcuacucuucuucagauccacaaugcccggcugcuccggauacccuaacauggaccuagacugccuccucccucaagaauggguccaauacuucuaccaagaagccgcccccgcacaguccgacguggcccuacuccgauucgucaacccugacaccggccgaguucuauucgaaugcaaacuacacaaaucuggcuacguaaccguagcccacacaggccagcacgacuuagucauucccccaaacgguuacuuccgcuucgacuccuggguaaaccaauucuauacccuugcaccaaugggaaacggcacuggccgccgacgcgcccucuaa

SEQ ID NO: 36667 - RNA, 1623 nt, Artificial Sequence
  derived and/or modified sequence opt11 from VP1__Norovirus__BAU24952
augaaaauggccuccucagacgccaaucccuccgacgguuccgccgccaaccuagucccagaagucaacaaugaagucauggccuuagaacccgucguaggagcagccauagccgccccaguugcaggacaacaaaacgucaucgaccccuggauccgcaacaacuuuguccaagccccaggcggcgaauuuacuguaucaccccgcaacgcccccggagaaauacuaugguccgcuccccucggccccgaccucaacccauacuuaucccaccucgcccgaauguacaacggauacgcuggcgguuucgaaguacaaguaauccucgccggcaacgccuucacagcaggcaaagucauauucgcagccguaccacccaacuuccccaccgaaggccucucccccucccaagucaccauguucccccacauagucguugacguccgccaacuagaaccgguacucaucccucuacccgacguucgcaacaacuucuaccacuacaaccaauccaacgacccaaccaucaaacucaucgccaugcuauacacaccacucagagccaacaacgcgggcgacgacgucuucacaguauccugcagaguacucacccgacccagccccgacuucgacuuuauauuccucgucccacccaccgucgaaucgcgaaccaaacccuuuuccguccccguucucacaguugaagaaaugaccaacucccgcuuccccaucccacucgaaaaacuauuuaccggccccucuucagcauucgucguccaaccgcaaaacggccgcugcaccacagacggaguccuacucggaaccacacaacucucacccguaaacaucugcaccuuuaggggagacguaacccauauaacaggcuccagaaacuacaccaugaaccuugcaagucaaaacuggaacaacuacgaccccaccgaagaaauccccgccccacucgguacccccgacuucgucggcaaaauccaaggcguacucacccagaccaccagaaccgauggcuccacucgcggccacaaagcaaccgucuauaccggauccgccgacuucgccccaaaacuaggccgcguccaauucgaaaccgacaccgaccacgacuucgaagccaaucaaaacaccaaauuuacaccagucggaguaauccaggacggcuccaccacccacagaaacgaaccccaacaauggguucucccaucauacucaggccguaacacucccaacguucaccuagcaccagcugucgcacccaccuucccaggcgaacaacuccuauuuuuccgcuccaccaugccaggcugcucuggcuacccaaacauggaccuagacugccuccucccccaagaauggguacaauacuucuaccaagaagccgcccccgcccaguccgacgucgcacugcuaagauucgucaaccccgacacaggacgcguccucuucgaaugcaaacuucacaaauccggcuacgucaccgucgcccacaccggccaacaugaccuaguuaucccacccaacgguuacuuccgcuucgacucaugggucaaucaauucuauacccucgcccccaugggaaacggcacaggccgacgccgcgcacucuaa

SEQ ID NO: 36668 - RNA, 1623 nt, Artificial Sequence
  derived and/or modified sequence opt11 from VP1__Norovirus__BAU24954
augaaaauggccucuagugacgccaaccccuccgacggcuccgcagccaaccuaguccccgaagucaacaacgaagucauggcccuagaacccgucguaggcgccgccaucgccgcccccgucgccggacaacagaaugucaucgacccguggauccgcaacaauuucguccaagcacccggcggcgaguucaccgucucaccccgcaacgcacccggcgaaauacuaugguccgcaccccuaggccccgaccuuaaccccuaccucucccaccuugcccgcauguauaacggauacgccggcggcuucgaaguccaaguaauccucgccggcaaugccuucaccgccggaaaaguaaucuucgccgccgucccacccaacuuccccacagaaggucucucccccucccaagucacaauguucccccacaucguaguagacguacgacaacucgaacccgugcuuauaccacuaccagacguccgcaacaacuucuaccacuacaaccaauccaacgaccccacaaucaaacuaaucgcuaugcucuacacuccccuacgcgcaaacaacgcuggagacgacgucuucaccgucuccugccgcguccucacccgcccaucccccgacuucgacuucaucuuccuaguacccccuaccguagaaucccgcaccaaacccuucuccgucccaguccucaccguagaagaaaugaccaacucacgcuuccccauaccccucgaaaaacuauucaccggaccuagcuccgcauucguuguccaaccacaaaauggcagaugcaccacagacggaguccuccuaggcaccacccaacuaucccccguuaacaucugcaccuuccgcggagacguuacccacaucaccggcucccgcaacuacaccaugaaccuugccucccaaaacuggaacaacuacgacccuacagaagaaauccccgcaccccuaggagccccagacuucgucggcaaaauccaagggaugcucacccaaaccacccgcgccgacggcagcacacgcggucacaaagccaccguuuacaccggcuccgcagacuucgcccccaaacuuggacgcguccaauucgaaaccgacacagaccacgacuucgaagccaaccaaaacacaaaauucaccccagucggagucauacaagacggcucaaccacccaccgcaacgaaccacaacaauggguacuuccuuccuacaguggccgaaauacccacaacguccaccuagcccccgccguagccccaacguuucccggagaacaacuccucuucuuccgguccaccaugcccggcugcuccggcuaccccaauauggaccuugacugccuccucccccaagaauggguccaauauuuuuaccaagaagccgcaccagcacaauccgacguagcccuacucagauuugucaaccccgacaccggccguguccucuucgaaugcaaacuacacaaaucuggcuacgucacaguagcacacaccggccagcacgaccuagucaucccacccaacggcuacuuccgauucgacagcugggucaaccaauucuauacauuagcuccaaugggcaacggcgccggcagacgccgagucgucuga

SEQ ID NO: 36669 - RNA, 1623 nt, Artificial Sequence
  derived and/or modified sequence opt11 from VP1__Norovirus__BAU24958
augaaaauggccuccucugacgccaaccccucagacggcuccgccgccaaccucguuccagaaguuaacaacgaagucauggcacuagaacccgucgucggcgccgcaauagcagccccaguagccggacaacaaaaugucauugaccccuggauacguaacaacuucguccaggcccccggaggagaauuuaccguaucccccagaaacgcccccggcgaaauccuaugguccgccccacuugguccagaucucaaccccuaccucucucaccucgcccgcauguacaacggauacgcaggcggcuucgaaguccaagucauccuagccggaaaugccuucaccgccggcaaagucaucuucgccgccgucccacccaacuuccccaccgaaggccuaucaccaucucaaguaacaauguucccccacaucgucguagacguacgucaacucgaaccaguccucauaccucuccccgacguacgaaauaacuucuaccacuacaaccaauccaacgaccccacaaucaaacucaucgcuaugcucuacaccccacuccgcgcaaacaacgccggugacgacgucuucacagucuccugcagaguccucacaagaccuucuccggacuucgauuucauauuuuuagucccacccaccguagaauccagaaccaagccauucuccgucccaguccucacugucgaagaaaugacaaacucucgcuuccccauaccacucgaaaaacuguucaccggaccguccagcgccuucgucguccaaccacaaaacggccgaugcaccaccgacggcguccuccuaggcaccacccaacuauccccaguaaacaucugcacauucagaggcgacguaacccacaucaccggaucaagaaacuacaccaugaaccuagccucacaaaacugguccaacuacgacccgaccgaagagauacccgccccacucggcacccccgacuucguaggcaagauccagggcguucuaacucaaaccacccgcaccgacggcuccacccgcggacacaaagccaccguauauaccggaucagcagacuucgcacccaaacucggccgaguacaauucgaaaccgacaccgaccgagacuucgaagccaaccaaaacaccaaauucacacccgucggagucauccaagacggaucaaccacccaucgcaaugaaccccaacaauggguucuccccuccuacucuggccgcaacacccccaacguccaccucgccccugccguagcccccacuuuucccggcgagcaacuccucuucuuccguaguaccaugcccggaugcuccggcuacccuaacauggaccucgacugccuccuuccccaagaauggguccaauacuucuaccaagaagccgcucccgcccaauccgacgucgcacuccugcgcuucguaaaccccgacaccggccgcguacucuucgaauguaaacuccacaaauccggauacguaaccguagcccacaccggccaacacgaccuugucauaccaccaaacggcuacuuccgcuucgacuccugggucaaccaauucuauacccucgcccccaugggaaacggcacaggacgacgacgagcacuuuaa

SEQ ID NO: 36670 - RNA, 1623 nt, Artificial Sequence
  derived and/or modified sequence opt11 from VP1__Norovirus__BAU24960
augaagauggccagcaacgacgccaaucccucagacggcccagcagccaaccucguaccagaagucaacaacgaagucauggcccuagaaccagucgucggagccgcgaucgcagcacccgucgccggccaacaaaacguaaucgacccuuggauccgaaacaacuucguucaagcccccggcggcgaguucacaguuuccccucgcaacgcccccggcgaaauccucuggucagcaccccucggccccgaccucaacccauaccuaucacaucuagcccgaauguacaacggauacgccggcggcuucgaaguccaaguaauccucgccggcaacgccuuuaccgcaggcaaaaucaucuucgccgccgucccucccaauuuccccacagaaggacuauccccaucucaagugaccauguucccccacauaaucgucgacguccgccaacucgaacccguucuuaucccccuccccgacgucaggaacaacuucuaccauuacaaccaauccaacgacuccaccauaaagcuaaucgccaugcuauacaccccacuccgcgccaacaacgccggcgaagacguauucaccguauccugccgcguacuuacgcgucccucucccgauuucgacuucaucuuccucguaccucccaccgucgaaucccguacuaaacccuucaccgucccaauccuaaccgucgaagaaaugaccaacucccgcuuccccauaccauuagaaaaacucuucaccggccccaguucagccuucgucguccaaccacaaaacggccgcuguaccacagacggcguacuccucgggacuacccaacuuucacccguaaauaucugcaccuuccgaggcgacguaacccacaucgcuggcucccgcaacuacacgaugaaccuagccucccucaacuggaacaacuaugaucccacagaagaaauccccgcaccccucggcaccccagacuucgucggaaaaauccaaggcaugcucacccaaacuacaaaaggugacggcagcacccgcggccauaaggccaccguauacaccggaucagccccauucacacccaaacucggaucuguccaauucgaaacagacaccgaaaacgacuucgagacccaucaaaacacaaaauucacacccgucggcguaauccaagacggcggcacaacacaccgcaacgaaccccaacaauggguccucccauccuacuccggccgcaacgugccaaacguccaccuagccccagccguagccccgaccuuccccggagaacaacuccuauucuuuagauccauaaugcccggaugcuccggcuaccccaacauggaccuagacugccuccucccacaagaauggguacaacacuucuaccaagaagccgcacccgcccaauccgauguagcccuucuacgcuucguaaaccccgacacaggccgcguccuauucgagugcaagcuacacaaaucaggcuaugucaccguggcacacacuggccaacacgaccucguaaucccaccaaacgguuacuuccgauucgacuccuggguaaaccaauucuacacacucgccccaaugggcaacggaaccggaagacgccgagcucuauaa

SEQ ID NO: 36671 - RNA, 1623 nt, Artificial Sequence
  derived and/or modified sequence opt11 from VP1__Norovirus__BAU24962
augaaaauggccucgucagacgcaaaccccucggacggcagcgccgcaaaccuugucccugaagucaacaacgaagucauggcacuagaacccgucguaggagccgcaaucgccgcaccugucgccggccaacaaaauguuauagaccccuggauaagaaacaacuucguccaagccccaggcggcgaguucaccgucucccccagaaaugcccccggcgaaauccuauggucagcaccccuaggacccgaccucaaccccuaccuaucccaccuagcccgaauguacaacggcuacgccggcggcuucgaaguccaagucauccuagccggcaacgccuucaccgcaggcaagguuauuuucgccgccgugccucccaacuuccccaccgaaggccuaagccccucccaagucaccauguucccccacaucguagucgacguccgccaacuagaacccguccuaaucccccuccccgauguccgcaacaacuucuaccauuacaaccaaucaaacgaccccaccauaaaacucauagccaugcucuacacaccccuacgcgcaaacaacgcaggcgacgacgucuucacaguuuccugccgaguccucacccgaccuucccccgacuuugacuucaucuuucucguacccccuaccguagaaucccguaccaaacccuucuccguccccguccucacaguagaggagaugaccaauuccagauucccaaucccccucgaaaaacucuucaccggcccauccucugcauucgucguccaaccccaaaauggacguugcaccaccgacggaguccuacucggcacaacccaacuuucacccgucaacaucugcaccuuccgaggcgacgucacccacauaacaggcucccgaaacuacaccaugaaccuagccucacaaaacuggucaaacuacgaccccacggaagaaauccccgcaccccuuggcacacccgacuucguggguaaaauacaaggaguccucacacaaaccacacgcaccgacggcuccacucggggccacaaagccacagucuacacaggcuccgccgacuucgccccgaaacuaggccgaguccaauucgaaaccgauaccgaucacgacuucgaagcaaaccaaaacacaaaauucacacccgucggcgucauucaagacggauccacaacccaucgcaacgaaccccaacaguggguucuaccaagcuacuccggccgcaacacccccaacguccaucuagccccugccguagccccuaccuuccccggcgaacaacuccucuucuucagaucaacaaugccaggcugcuccggcuacccaaacauggaccuagacugccuccuaccacaagaguggguccaauacuucuaucaagaagccgcccccgcccaauccgacgucgcccugcuccgcuucgucaacccagacaccggccggguccuauucgaaugcaaacuccacaaaucgggcuacguaaccguagcgcacacaggacaacacgaucuugucauucccccaaacggcuacuuccgauucgacucuugggucaaccaauucuacacacucgcccccaugggaaacggcaccgguagacgccgagcccucuaa

SEQ ID NO: 36672 - RNA, 1623 nt, Artificial Sequence
  derived and/or modified sequence opt11 from VP1__Norovirus__BAU24964
augaaaauggcauccaacgacgcuaaccccuccgaugguagcgcagcuaaccucgucccagaaguaaacaacgaaguaauggcacuagaacccgucguuggagccgccaucgcagcacccgucgccggccaacaaaacgucaucgacccauggauacgcaacaauuucguccaagcccccggcggcgaguucacaguaucgccacgaaaugcacccggcgaaauccucuggucugccccacucggacccgaccucaaccccuaccuaucccaucuugcacgcauguauaacggcuacgccggcggauucgaaguccaggucauacucgcaggaaacgccuucaccgcugggaaaaucauauucgccgccguacccccgaacuucccaaccgaaggacucagccccucacaagucaccauguucccccacaucauaguagacguccgacaacucgaacccgucuuaauaccacuccccgauguaagaaacaacuucuaccauuauaaccaauccaaugacucuaccaucaaacuaaucgccaugcucuacaccccacuacgcgccaacaacgccggcgaagacgucuucacaguauccugcagaguacuuacccgccccucccccgacuucgacuucauauuccuaguuccacccacaguagagucaagaacaaaacccuucacugucccaauacucacagucgaagaaaugacuaacucccgcuuccccauaccccucgaaaaacucuuuacaggacccuccuccgcauuugucguacaaccccaaaauggcagaugcaccaccgacggcguccuccucggaaccacacaauuaagucccgucaacaucugcaccuuccgcggagaugucacccacaucgccggcucaagaaacuacaccaugaaccucgccucccuaaacuggaacaacuacgaccccaccgaagaaaucccagcaccccucggcaccccugacuucguaggaaaaauccaaggaaugcuaacccaaaccaccaaaggagacggaucaacccggggacauaaagccacggucuacacaggauccgcccccuucacccccaaacucggcuccguccaauuugaaacagacaccgaaaacgacuucgaaacccaccaaaacaccaaauucacccccgucggaguaauccaagacggaggcaccacccaucgcaacgaaccccaacaauggguccucccuagcuacucaggacguaacguacccaacguccaccuagcccccgccguagcccccaccuuccccggagaacaacuccucuucuuccgaucaauaaugcccggaugcuccggcuaucccaauauggaccucgacugccuccucccccaagaauggguccaacacuucuaccaggaagccgcacccgcacaauccgacgucgcccuccuccgcuucgucaaccccgacacaggccgaguccuauucgaaugcaagcuacacaaauccggcuacgucacuguagcccacaccggacagcacgaccuugucaucccacccaacggcuauuuccgcuucgauagcuggguuaaccaauucuacacacucgcacccaugggaaacggaacaggccgucgacgcgccuuguaa

SEQ ID NO: 36673 - RNA, 1623 nt, Artificial Sequence
  derived and/or modified sequence opt11 from VP1__Norovirus__BAU24966
augaagauggccucuaacgacgcuaaucccucugacggcuccgccgccaacuuaguccccgaagucaacaacgaagucauggcccucgaaccaguagucggcgccgccauagccgcccccgucgcaggacaacaaaacguaaucgaccccuggauccgcaauaacuucguccaagcccccggaggcgaguucacugucucaccccguaacgcacccggcgaaauccuuugguccgcaccccucggccccgaccucaacccauaccucucccaccuagcccgcauguacaacggcuaugcaggcggauucgaaguccaagucauccuugcaggaaacgccuuuaccgccgguaaaaucaucuucgccgcagucccacccaacuuccccaccgaaggacucucccccucccaaguaaccauguucccccauaucauuguagacguccgccagcucgaacccguccucaucccccuccccgauguccgcaacaacuucuaccacuacaaucaauccaacgauuccacaauaaaacuaauagccaugcucuacacuccccuucgagccaacaacgccggugaagacguauucaccgucuccugccgcguccucaccagacccucccccgauuucgauuucaucuuccucguacccccaaccgucgaaucccgcaccaaaccuuucacagucccaauacucaccgucgaagaaaugacaaacuccagauucccaauaccacucgaaaaauuauucaccggaccauccuccgccuucguaguccaaccccaaaacggucgcugcaccaccgacggaguccuacuaggaaccacacaacucucacccguaaacauaugcaccuuccgaggagacguaacccacauagccggaucccgcaacuacacuaugaaccucgccucucuaaacuggaacaacuacgaccccaccgaagaaaucccagccccacuaggcacacccgacuuuguaggcaaaauccagggcaugcucacacaaaccaccaaaggagacggauccacgcgcggccacaaagccaccgucuacaccggauccgcucccuucacaccaaagcucggauccguacaauucgaaaccgauaccgaaaacgacuucgaaacccaccaaaacacuaaauucacccccgucgguguaauacaagacggcggcacuacccacagaaacgaaccacaacaauggguccuccccucauauuccggccguaacguacccaacguccaccucgccccagcagucgccccgacuuuccccggagaacagcuccuauucuuccgaucaaucaugcccggaugcuccggauaccccaacauggaucucgacugccuccucccacaagaaugggugcaacacuucuaccaagaagccgcccccgcccaauccgacgucgcccuucuccgauuuguaaacccggacacaggacgcguacucuucgaaugcaaacuucacaaauccggcuaugucaccgucgcgcacacuggccaacacgaccucgucauaccaccuaacggauacuuuagauucgacucuuggguaaaccaauucuauacacuagcacccaugggcaacgggaccggccgacgccgcgcccucuaa

SEQ ID NO: 36674 - RNA, 1623 nt, Artificial Sequence
  derived and/or modified sequence opt11 from VP1__Norovirus__BAU24968
augaaaauggccuccuccgacgccaacccaucagauggauccaccgccaaccucgugcccgaaguuaacaacgaagucauggcacuagaacccgucaucggcgcagccaucgccgcccccgucgccggccaacaaaacgucaucgaccccuggauccgcaacaacuucguccaagccccuggaggagaguucaccguaagcccccguaacgcccccggugaaauccuguggucagcaccccucggcccagaccucaaucccuaccucucccaccuauccagaauguacaacggcuacgccggcgguuucgaaguccagguaauccuagccggcaacgccuucacagcgggcaaaaucauauucgccgcagucccacccaauuuccccacggaaggucuuucgcccucucaaguaaccauguucccccacaugauuguagacguccgccaacucgaacccguccucaucccccuccccgauguucgaaacaacuucuaccacuauaaccaauccaacgacucaaccauaaaacucaucgcaaugcuauacacuccccugcgcgcaaacaacgccggagacgacguauucaccgucuccugccguguccuaacccgccccuccccugacuucgacuucauauuccucguaccucccacagucgaaucccgaaccaaacccuucuccguccccguccuaaccgucgaagaaaugacuaacucaagauucccaauaccccuagaaaaacuauucacaggccccuccuccgcauucgugguacaaccccaaaacggcagaugcaccacagacgguguacuccucgguacaacucaacuaucacccguaaacauaugcaccuuccgcggcgacgucacccacauccccggcucccgcaacuacaccaugaaccuagcaucccaaaacuggaacucuuacgacccaaccgaagaaaucccagcaccccucggcacccccgauuuugucggaaaaauccaaggaguccuaacccaaaccacacgcaccaacggcagcacccgcggccauaaagccaccgucuauaccggcucagccgauuucucccccaaacuaggccgaguccaauucgcuaccgauaccgacaacgacuucgaaacaaaccaaaacaccaaauucacacccguaggcgucauucaagacgguuccaccacaccccgcaaugaaccucaacaauggguccuccccaguuacuccggacgaaauauccacaacguccaccuagcucccgcaguagcuccaaccuuccccggcgaacaacuccucuucuuccgaucaaccaugcccgguugcuccggcuauccaaacauggaccuagacugccuacucccccaagaauggguucaauacuucuaccaagaagccgcacccgcacaaagcgacgucgcccuucuccgcuucgucaaucccgacacaggacgcgucuuauucgaaugcaaacuccauaaaucaggcuacgucacaguagcacauaccggccaacacgaccucguaauacccccuaacggcuacuuccgcuucgacuccuggguaaaccaauucuacacucucgcccccaugggcaacggcacgggcagacgacgggcccuauaa

SEQ ID NO: 36675 - RNA, 1623 nt, Artificial Sequence
  derived and/or modified sequence opt11 from VP1__Norovirus__BAU24972
augaaaauggccuccuccgacgccaaccccagcgauggcuccgcagcaaaccucguacccgaagucaacaacgaagucauggcccucgaacccguaguaggcgccgccauagccgcaccgguugccggacaacaaaacgucauagaccccuggauccgaaacaacuucguccaagcacccggaggcgaguucaccgucucaccccgcaacgccccaggagaaauccuuugguccgcaccccucggccccgaccucaaccccuaccucucccaccucgcccgaauguacaacggcuacgccggcggcuucgaaguucaagugauccucgcuggcaacgccuucaccgccggcaagguaaucuucgcagcagucccacccaacuuccccaccgaaggccucucacccucccagguuacaauguucccccacaucgucgucgacguccgucagcuggaacccguauuaauaccccuacccgacguacgaaacaacuucuaccacuacaaccaaucaaacgaccccacaaucaaacucaucgccaugcuguauacaccccucagagcaaacaacgcuggcgacgacgucuucacagucagcugccgagucuuaacacgccccucacccgacuuugacuuuaucuuccucguacccccaaccgucgaaucucgcaccaagcccuucuccguccccguccuaacagucgaagaaaugaccaauucucgcuuuccaauaccccuugaaaaacucuucaccggcccauccuccgcauucgucguccaaccacaaaacggucgcugcaccaccgacgggguccuccuuggcacaacucaacucucacccgucaacaucugcaccuuccguggcgauauaacacauaucacgggcucccgcaacuacaccaugaaccuagccucccaaaacuggucuaacuacgaucccaccgaagaaauacccgcaccacuaggcaccccagacuucguaggcaagauccaaggcguccucacccaaacaacucgcaccgacggcucuacacguggacacaaagcaacagucuacaccggcuccgcagacuuugccccaaaacucggccgcguccaauucgaaacagacacagaucacgacuucgaagccaaccaaaacacaaaauuuacccccgucggcguaauacaagauggcucuacgacccaccgcaacgaaccacaacaauggguccuccccucauacucaggccgcaacacccccaacguccaccucgccccagccgucgcccccaccuuuccaggagaacaacuccucuucuuucgauccacgaugccaggcugcucaggauaucccaacauggaccucgacugccuccucccccaagaauggguccaacacuucuaccaagaagcugcaccagcacaaucagacgucgcccuacuccgcuucguaaaccccgacacuggccgcguccucuucgaaugcaaacuccacaaauccggauaugucacugucgcacauaccggccaacacgacuuaguaaucccacccaacggcuacuuccguuucgacuccugggucaaccaauucuacacacucgcccccauggguaauggcaccggucgccgccgcgcacuauga

SEQ ID NO: 36676 - RNA, 1623 nt, Artificial Sequence
  derived and/or modified sequence opt11 from VP1__Norovirus__BAU24974
augaaaauggccucaucagacgccaaucccuccgacggcucggcagccaaccuaguucccgaaguaaacaacgaagucauggcgcuugaaccaguagucggcgccgcaaucgccgccccugucgccggacagcaaaacgucauugaccccuggauuagaaacaacuucguccaagcccccggcggugaguucaccguaucaccacgcaacgcccccggugaaauccuaugguccgcaccccucggaccugaccucaaccccuaccuaucccaccucgcccguauguacaacggauacgccggcggauucgaaguucaaguaauccucgccggcaacgccuucaccgccggaaaagucauauucgcagccguacccccaaacuuccccaccgaaggacucucacccucccaagugaccauguucccacacaucguagucgacguccgacagcucgaacccguccuaauuccccucccagauguccgcaacaauuucuaccauuacaaccagucaaacgacccaaccaucaaacucaucgccaugcucuacacuccacuacgcgcgaacaacgccggcgacgacgucuucacagucuccugccgaguccucacccgccccucacccgacuuugacuuuaucuuccuaguacccccaacagucgaaucaagaacaaaaccauucucaguccccguucuaaccguagaagaaaugacaaauucaagauuucccaucccccuagaaaaacucuucaccggucccucauccgccuucguaguccagccccaaaacggucgaugcaccaccgacggaguccuccucggcacaacccaacuuucccccguuaacauaugcaccuuccgcggcgacgugacccacaucacagguucccgaaauuacaccaugaaccuagccagucaaaacuggucuaacuacgaucccacagaagaaauuccagccccacuagguacccccgacuucgucggaaaaauucaaggcguccucacccaaaccacacgaaccgacgguuccacccgcggccacaaagccaccguauacaccggcagcgcugacuucgccccgaagcucggccguguacaauucgaaaccgauaccgaucgagacuucgaagccaaccaaaacacaaaauucacccccguaggcgugauccaagacggauccaccacccaccgcaacgaaccccaacaaugggugcucccaucuuacucaggccgaaccacaccaaacguccaccucgcaccagcugucgcccccaccuuccccggcgaacaacuccuauucuuccgcucaaccaugccaggcugcucgggcuacccaaacauggaccuggacugcuuacucccacaagaauggguccaauacuucuaccaagaagcagcccccgcccaaucagauguagccuuacuccgcuucgucaaccccgacaccggccgcguccucuuugaaugcaaacuccacaaauccggauacgucaccgucgcacacacgggacaacacgaccucgucauacccccaaacggcuacuuccgcuucgacucauggguaaaccaauucuacacacucgcccccaugggcaacggcacaggccgacgucgagcacucuga

SEQ ID NO: 36677 - RNA, 1623 nt, Artificial Sequence
  derived and/or modified sequence opt11 from VP1__Norovirus__BAU24976
augaaaauggccucuucagacgccaaccccuccgacggcuccgcggcaaaccuaguucccgaaguaaacaaugaaguaauggcccucgaacccguagucggagcagccaucgcugccccugucgccggacaacaaaacguaauagaucccuggauucgaaauaacuucguacaagcccccggaggcgaguucaccgucucuccccgcaacgcacccggugaaauccuaugguccgccccacuuggacccgaucucaacccauaucucucccaccucgcacgcauguacaacggcuacgccggcggcuucgaaguccaagucauucucgccggcaacgccuucaccgccggcaaagucaucuucgcugccgucccacccaacuuccccacagaaggccucuccccaucccaaguuacaauguucccacacaucgucgucgacguccgccaacuagaaccaguccuaaucccccuccccgacguccgcaacaacuucuaccacuacaaccaauccaaugaccccaccauaaaacuaaucgccaugcuauacacaccucucagagccaacaacgccggugacgacgucuucaccguauccugcagaguccucacacgccccucccccgacuucgacuucauauuccuagucccacccaccgucgaaucccgcacaaaacccuucuccguuccaguccuaaccguagaagaaaugacuaacagccgcuuccccauaccccucgaaaaacuauucaccggccccuccuccgccuucgucguucaaccccaaaacggacgaugcacaaccgauggcguacuccucggcaccacacaauuaucccccgucaacaucugcaccuuccgcggcgacgucacacacaucaccggcucccgcaacuacacaaugaaccucgccucccaaaacuggaacaacuacgacccaaccgaagaaauacccgcaccccucggaaccccagacuucgucggcaaaauccaaggcguccucacccaaaccacucgcaccgauggcuccacccggggccauaaagccaccgucuacacaggcucagccgacuucgcccccaaacucggcagaguccaauucgagaccgacaccgaccaugauuucgaagccaaucaaaacaccaaauucacacccgucggcgucauacaggauggaggcaccacccaucgaaaugaaccccaacaauggguacuccccuccuacucuggcagaaacacccccaacguccaccuagcccccgccgucgcccccaccuuccccggcgaacaacuccuuuucuuccgcagcaccaugcccggaugcuccggcuacccuaacauggaccucgacugccuucucccccaagagugggugcaauacuucuaccaagaagccgcccccgcccaaucagacgucgcccuccuccgauuuguaaaccccgacacaggccgcguccuguucgaaugcaaauuacauaaauccggcuacguaacaguagcacacaccggccaacacgaccuagucauacccccaaacggauacuuucgcuucgacuccuggguaaaccaguucuacacccucgccccaaugggcaacgggaccggccgccgacgcgcccucuaa

SEQ ID NO: 36678 - RNA, 1623 nt, Artificial Sequence
  derived and/or modified sequence opt11 from VP1__Norovirus__BAU24978
augaaaauggccagcucugaugcuaacccauccgacggcuccgccgccaaccuagucccagaagucaauaacgaaguaauggcacuugaacccguagucggcgccgcaauugcugccccaguugcaggucaacaaaacguaaucgacccguggauacgaaacaacuucguccaagcacccggcggagaguucacugucagcccccgcaacgcacccggcgaaauccucugguccgcuccacucggcccagaccucaaccccuaccuaucccaccucgcccgaauguacaacggauacgccggcggauucgaaguccaaguaauccuagccggcaacgccuucacagccgggaagguaaucuucgcugcaguaccacccaacuuccccaccgaaggccuaucacccucacaaguaaccauguucccacauauagucguugacguccgacaacuggaacccguccucauaccgcuucccgacguacggaauaacuucuaccacuacaaccaauccaacgaccccaccaucaaacuaaucgcaaugcuauacacaccccuacgcgccaacaacgccggagacgacguauucacagucagcugccgaguccucacgagacccagcccagacuucgauuucaucuuccucguucccccaaccgucgaaucaagaaccaaacccuucuccguacccguccucaccguugaagaaaugaccaacucgcgcuuccccaucccgcuugagaaacucuucaccggcccauccuccgcguucguaguccaaccucaaaacggacgcugcaccacagauggcguccuacucggcaccacacaacuaagccccguaaacaucugcaccuuccgaggcgacguaacccacaucaccggcucccgcaacuacacaaugaaccucgcaucacagaacuggucaaacuacgaccccacugaagaaauaccagcaccccucggcacaccagacuucguaggcaaaauccaaggaguacucacccaaacaacccgaaccgacggcucuacccgcggacacaaggcaaccgucuauaccggauccgccgauuucgccccaaaacucggcaggguccaauucgaaaccgacaccgaccacgauuucgaagccaaucaaaacaccaaauucacacccgucggcgucauccaagacggcuccacaacccaccgcaacgaaccccaacaauggguacuccccuccuacagcggacgcaacacaccaaacguacaucucgcccccgccgucgcaccaaccuucccaggagaacaacuacucuucuuucgcuccaccaugcccggaugcuccggcuauccaaacauggaccucgacuguuuacuaccacaagaauggguccaguacuuuuaccaagaagcagcacccgcccaaagcgacgucgcccuccuccguuucgucaaccccgacaccggccgaguccuauucgaaugcaaacuccacaaaucuggcuacgucaccgucgcgcacaccggccaacacgaccucguuauaccacccaacggauacuuccgauucgacuccugggucaaccaauucuacacccucgcccccaugggcaacggcaccggccgacgccgagccuuauaa

SEQ ID NO: 36679 - RNA, 1623 nt, Artificial Sequence
  derived and/or modified sequence opt11 from VP1__Norovirus__BAU24980
augaaaauggcaucaucugacgcuaaucccucagacggcuccgccgccaaccucguacccgaaguaaacaacgaagucauggcccuugaacccgucgucggcgccgccauagcagcacccgucgcgggacaacaaaacguaauagaccccuggauccgaaacaacuucguccaagcaccaggaggcgaguucaccguuucgccacgcaacgcucccggagaaauccucugguccgcaccccuuggucccgaccuaaaccccuaccuuucgcaccucgccagaauguacaacggcuacgcaggcggcuucgaaguccaaguaauccucgccggaaacgccuucaccgccggaaaagucauauucgcagcaguaccacccaacuucccaacugaaggacucucccccucccaaguaaccauguucccacacauagucgucgacguacgccaacucgaacccguccucauaccacuccccgacguccgaaacaacuuuuaccacuacaaccaaucaaacgaccccaccauuaaacucaucgccaugcuauacacaccccuucgagccaacaacgcaggcgacgacguauucaccguuuccugccgcguacucacccgccccuccccagacuucgacuucaucuuccucguaccuccaacugucgagucccgcaccaagccauucucaguccccguccucacaguagaagaaaugaccaacucccgauuccccauuccccucgaaaaacuauucaccggacccuccucugcauucguaguacaaccccaaaauggacgcugcacuaccgacggcguccuccucggcaccacccagcuaucccccguaaauaucugcaccuuccgaggagaugucacacacauaaccggcucacgcaacuacaccaugaaccucgcaucacagaacugguccaacuacgaccccaccgaagaaauccccgcaccccuagggaccccagacuuuguuggcaaaauccaaggcguacucacccagaccacccguaccgacggauccacccgaggucacaaagccaccguauacaccggcuccgccgacuucgcccccaagcucggcagaguacaauucgaaaccgacaccgaccacgacuucgaagccaaccaaaacaccaaauucacccccguaggagucauccaggacgguuccaccacccaccgaaacgaaccccaacaauggguccucccuagcuacuccggacgcaacaccccaaauguacaccuugcaccagcagucgcccccacauuccccggcgaacagcuccuguucuuccgcucaaccaugccuggcugcuccggcuacccaaacauggaucucgacugccuccuaccccaagaauggguucaauacuucuaccaagaagccgcacccgcacaauccgacgucgcccuccuacgcuucgucaacccugacacgggccgcguccuauucgaaugcaaacugcacaaauccggcuacgucaccguagcccacaccggacaacacgaccucguaaucccucccaacggauacuuccgcuucgacuccugggucaaccaauuuuacacacuagcccccaugggaaacggcacagggcgccgacgggcacuauga

SEQ ID NO: 36680 - RNA, 1623 nt, Artificial Sequence
  derived and/or modified sequence opt11 from VP1__Norovirus__BAU24982
augaaaauggccuccuccgacgccaacccauccgacggauccgccgccaaccuaguccccgaagucaacaacgaagucauggcccucgaacccgucguaggugccgcgauugcagcacccgucgccggacaacaaaacgucaucgacccuuggauccgcaacaacuucguacaagcccccggcggagaguucaccguaagcccaaggaaugccccaggcgaaauccucugguccgccccacuaggacccgaccucaaccccuaccuaucgcaccuggcccgcauguacaacggcuacgcuggcggguuugaaguccaaguuauucucgccggcaacgccuucaccgccggcaaaguaauauuugccgcaguaccaccaaacuucccuacagaaggccuuucacccucccaagucaccauguucccccauaucguaguugacgugcgccaacucgagcccguccuaauaccacuccccgacguccggaacaacuucuaucacuauaaccaaagcaacgaccccaccaucaaacucauagccaugcucuacaccccacuccgugccaacaacgccggagacgacguauuuaccguauccugccgaguccucacacgaccauccccugacuuugacuucaucuuccucguaccacccaccgucgaaucccgcacaaaacccuucuccguccccguccuaaccgucgaagaaaugacaaauuccagauuccccauaccccucgaaaaacucuucaccggccccucuuccgccuucgugguccaaccacaaaacggcagaugcaccaccgacggcguucugcuuggcaccacacaacuauccccagucaacauaugcaccuuccgaggagacgucacccacaucaccgguucccgcaacuacacaaugaaucuagcuucccaaaacugguccaauuacgaccccaccgaagaaaucccagccccacuaggcacacccgauuucgucggaaaaauacaaggcguccucacacaaacaacacgcaccgacggcucaacccggggccacaaagccaccguuuacacaggaagugcaaacuucgcacccaaacugggccgaauacaauucgaaaccgacaccgaccacgacuucgaagcaaaccaaaacaccaaauucacacccgucggcgucauccaagacggaagcacuacacaccguaacgaaccccaacaguggguccuccccucauacucaggacgcaacaccccaaacguucaccuugcccccgcagucgcccccaccuuccccggcgaacaacuccucuucuuccgcucaaccaugcccgguugcuccggauaucccaacauggaccucgacugccuccucccccaagaguggguccaauacuucuaccaagaagccgcccccgcccaaucagacguagcccuacuccgcuucgucaaccccgacacaggacgaguacuauucgaaugcaaacuccacaaauccggcuacguaaccgucgcccacacaggacaacacgaccucgucauaccacccaacggcuacuuccgcuucgauucgugggucaaccaauucuacacccucgcccccaugggcaacggcacaggccgccgccgcgcacuguaa

SEQ ID NO: 36681 - RNA, 1623 nt, Artificial Sequence
  derived and/or modified sequence opt11 from VP1__Norovirus__BAU24984
augaaaauggccucaucugacgcaaaccccuccgacggcuccgcagccaaccucguacccgaggucaacaacgaagucauggcacuagaacccguagucggagccgcaaucgccgcuccugucgccggccaacaaaacguuaucgaccccuggaucagaaacaacuucguccaagccccuggaggugaauuuaccgucuccccacgcaacgcccccggcgaaauccucuggucagcaccacucggacccgaccucaaccccuaccuaucccaccuagcccguauguacaacggauacgccggcggcuucgaaguccaaguaauccuagcaggcaacgccuuuaccgccggcaaagucauauucgccgccgucccacccaacuuccccacugaaggucuaucuccaucccaaguaacuauguucccccacaucgucguagacguccgccaauuagaaccaguauuaaucccacuccccgacgucagaaacaacuucuaccacuacaaccaauccaacgaccccaccaucaaacucaucgcaaugcucuauaccccacuccgagccaacaacgccggcgacgacgucuucacaguuucaugccgaguucucacucgucccucccccgacuucgacuucauauuccucgucccucccacaguugaauccagaaccaaacccuucucaguucccguccucaccgucgaagaaaugaccaacucccgcuuccccauaccacuagaaaaacucuucaccggcccaucaucugccuucguaguacaaccucaaaacggccgaugcaccacagacgggguacuccucgguaccacucaacuaucacccgucaacauaugcaccuuucguggcgacgucacccacaucaccggaucacgaaacuacaccaugaaucucgccucccaaaacuggucuaacuaugaccccaccgaagaaaucccagcaccccucggcacccccgacuucgucggcaaaauucaaggaguccugacacaaaccacccgcaccgacggaucaacccgaggacacaaagcaaccgucuacaccggcagcgccgacuucgcccccaaacucggcagaguccaguuugaaaccgacaccgaccacgacuucgaagccaaucaaaacaccaaauuuacuccagucggagucauucaggacggcuccacaacccaccgaaacgaaccccaacaauggguccuacccuccuacagcggucgaaacacccccaacguccaccucgccccugccgucgcacccacuuuccccggcgaacaacuccucuucuuccgcuccacaaugccaggcugcuccggcuacccaaacauggaccuagacugccuucucccccaagaauggguccaauacuucuaucaggaagccgcccccgcccaaucagacgucgcccuacuacgauucgucaaucccgacaccggcagaguccucuucgaaugcaaacuccauaaauccggauacgucacagucgcacacacuggacagcacgaccucguaaucccgcccaacggcuauuuccgcuucgacuccuggguaaaucaauucuacacccuagcucccaugggcaacggcaccggacgccgcagagcccucuag

SEQ ID NO: 36682 - RNA, 1623 nt, Artificial Sequence
  derived and/or modified sequence opt11 from VP1__Norovirus__BAU24986
augaaaauggccuccuccgacgcaaaccccagcgacggcucugcagccaacuuagucccugaagucaacaacgaaguaauggcccuggaacccguagucggcgccgccaucgccgccccagucgcaggccaacaaaacguaaucgaccccuggauacgcaacaacuucguccaagccccaggcggcgaguucacaguuucaccccgcaacgcccccggagaaauacucugguccgcaccccucggccccgaucucaaccccuaccucucucaccuagcccgaauguacaauggcuacgcaggcgguuucgaaguccaaguuauccucgccggaaacgccuucaccgcaggaaaagucaucuucgcugcagucccucccaacuucccaaccgaaggccucuccccuucccaagucaccauguucccccacauagucgucgacguccgccaacuagaaccaguacuuaucccacuacccgacguccgaaacaacuucuaccacuacaaccaauccaacgacccaacuaucaaacuuaucgccaugcucuacacuccacuaagagccaacaacgcaggagaugacgucuucacaguaucaugccgcguacucacacgucccucccccgacuuugacuucauauuccuagucccacccaccgucgaaagccgcacaaaacccuucuccguccccguccucaccgucgaagaaaugaccaacucccgauucccaauacccuuagaaaaacuauucacuggaccauccuccgcauuugucguccaaccccaaaacggacgcugcaccaccgacggaguccuacuaggaaccacccaacucagccccgucaacauaugcacuuuucgcggcgacguaacucacaucaccggaucacgaaacuacaccaugaaccuagccucacaaaacugguccaacuacgacccuacggaagaaaucccugcaccccuaggaacccccgacuucgucgguaaaauccaaggaguccucacacaaaccacccgcacagacggcucuacaagaggccacaaagccacuguauacaccggauccgccgauuuugcacccaaacucggccgcguacaauucgaaacagacacagaccgcgacuucgaagcaaaccaaaacacaaaauucacccccgucggcguaauucaagacggaucgaccacacaccgaaacgaaccacaacaauggguccuccccuccuacuccggacgcaacacacccaauguccaccucgccccagccgucgcucccacauucccgggagagcaacuccuuuucuuccgaucaaccaugcccggcuguuccggcuaccccaacauggaucuagacugccuccucccccaagaauggguucaauauuucuaccaagaagcagcccccgcucaaagcgacguagcucuccuccgauucgucaaccccgacacaggacgaguccucuucgaaugcaaacuacauaaauccggcuacgucacaguagcacacaccggccaacacgaccuaguaaucccgcccaauggcuacuucagauucgacuccuggguaaaccaauucuauacucuagcccccaugggcaacggcacuggccgccgccgcgcacucuaa

SEQ ID NO: 36683 - RNA, 1623 nt, Artificial Sequence
  derived and/or modified sequence opt11 from VP1__Norovirus__BAU24988
augaaaauggccuccaacgacgccaaucccucagacggcucagcugccaacuuaguacccgaagugaacaacgaaguaauggcccucgaacccgucgucggcgcagccauagccgcucccgucgcaggacagcaaaacgucaucgaccccuggauccgcaacaacuucguccaagcccccggcggugaguucaccgucucgccccgaaacgccccaggagaaauccuaugguccgcuccacuuggccccgaccuuaacccauaccuuucccaccucgcacgcauguacaacggcuacgccggaggauucgaaguccaagucauccuugccggcaacgcuuuuacagccggaaaaaucauauucgcagccgucccacccaacuuccccaccgaaggacucucccccucccaagucaccauguuuccccacaucaucgucgacguacgacaacuagaacccguacuaauuccacuccccgacguccgcaacaacuucuaccacuacaaccaaucaaacgauuccacgaucaaacucauagcaaugcucuacacaccucuccgcgccaacaacgccggcgaagaugucuucaccgucuccugcagaguccuuacacgcccaucucccgacuucgacuucaucuuccuaguaccacccaccgucgaaagccguaccaaacccuucaccguccccauccucacagucgaagaaaugaccaacucacgauuccccaucccccucgaaaaacucuucaccgguccaucuuccgccuucgucguacaaccucaaaacggacgcugcaccacugacggaguacuccucggcaccacacaacuuucccccguaaacaucugcaccuuccgcggagacguaacccauaucgccggcucccgaaacuacaccaugaaccucgccucccucaauuggaacaacuaugaccccaccgaagaaaucccagcaccccucggcacccccgacuucguuggaaaaauacaaggcaugcucacccaaaccaccaaaggcgacggcuccacccgcggccacaaagccaccguauacaccggcucagcuccauucaccccaaaacuaggcucuguacaauucgaaacagauaccgaaaacgacuucgaaacucaccaaaauacaaaauucacccccgucggcguaauccaagacggcggcaccacacaccgcaacgaaccucaacaauggguccucccauccuacuccggcagaaacgucccuaacgugcaccucgcacccgccguagcccccaccuuuccaggcgaacaacuucucuuuuuccgaucaacagugcccggcugcuccggcuaccccaacauggaccucgacugccugcuuccacaagaauggguccaacacuuuuaccaagaagccgcacccgcccaauccgacgucgcccuacuaagauucgucaaccccgacacaggacgaguccucuucgaauguaaauuacacaaaucgggauauguaaccgucgcucacacaggacaacacgaccucgucaucccaccaaacggauacuuccgcuucgacaguugggucaaccaauucuacacccucgccccaauggguaacgggaccggucgacgccgagcccuauaa

SEQ ID NO: 36684 - RNA, 1623 nt, Artificial Sequence
  derived and/or modified sequence opt11 from VP1__Norovirus__BAU24990
augaaaauggccuccagcgacgcaaaccccagcgacggcuccgcagccaacuuaguccccgaagucaauaacgaagucauggcccucgaacccgucguaggagccgccaucgccgcaccaguagcaggacaacaaaacgucaucgaccccuggauccgaaacaacuucguccaggcacccggcggcgaguucacuguuucaccacgcaacgcaccaggagaaauccucugguccgcaccccucggacccgaccuaaacccauaccucucccaccuugcccgaauguacaacggcuacgccggaggauucgaaguacaagucauccuagccggcaaugccuucaccgccggcaaaguaaucuucgcggccguaccacccaacuuccccacagagggccucuccccaucccaagucaccauguucccccacaucgucgucgacguccgccagcucgaacccguacuuaucccccuuccagacguaagaaacaacuucuaucacuacaaccaauccaacgaccccaccaucaaacucaucgcaaugcuuuacacaccccucagagcuaacaacgccggagacgacgucuucacugucagcugccggguccuaacacgccccucaccagacuucgacuucauauuccuaguacccccaaccgucgaaucccgcacgaaacccuucagcguccccguccuaacagucgaagagaugacuaacuccagauuccccaucccccucgaaaaacuauucaccggcccaucauccgccuucguaguccagccccaaaacggacgcugcacaaccgacggcguccuacucggaacaacacaacucucccccguaaacaucugcaccuuccgcggagauguaacacacaucaccggaucccacaacuacacaaugaaccuagccucacaaaacuggaacaacuacgaucccaccgaagaaauacccgccccacuaggcacaccagacuuugucggcaaaauucaaggcguccucacccaaaccacccgaaccgacgguucaaccagaggccacaaagccaccgucuacaccggaagcgcagacuucgcccccaaacuaggccgaguccaauucgaaacagacacagaccacgacuucgaagccaaccagaacaccaaauucacccccguaggaguuauacaagacggcggcacaacacauagaaacgaaccacaacaauggguccuccccucuuacagcggccgcaacacacacaacguccaccuagccccagccgucgcacccaccuuccccggcgaacaacuccucuucuuccgauccacaaugcccggaugcuccggcuaccccaacauggaccucgacugccuacucccacaagaauggguccaauacuucuaccaagaagccgcccccgcccaauccgacguugcacuccuucgcuucguuaacccugacacaggacgcguccuuuuugaaugcaaacuacacaaaagcgguuauguaacagucgcccacaccggacaacacgaccucgucauacccccuaacggcuacuuccgcuucgacuccuggguaaaccaauucuacacccucgcacccauggguaacggcaccggccgccgacgagccgucuaa

SEQ ID NO: 36685 - RNA, 1623 nt, Artificial Sequence
  derived and/or modified sequence opt11 from VP1__Norovirus__BAU24992
augaaaauggccagcucagacgcaaaccccucagacggaucagccgcuaaccuuguccccgaagucaacaacgaaguaauggcccucgaacccgugguaggagccgcaaucgcagcccccgucgcuggacaacaaaacguaaucgaccccuggauccguaacaauuuuguacaagcaccgggcggagaguucaccgucucaccccgcaacgccccaggcgaaauccucugguccgccccacucggccccgaccucaaccccuaucucagccaccucgcccgcauguauaacggcuacgcuggaggcuucgaaguccaagucauacuagccggcaacgcauucacagcuggcaaagucaucuucgccgcaguaccacccaacuucccaaccgaaggccucucccccucucaggucacaauguucccccacaucguagucgauguacgucagcucgagcccguacuaaucccccuccccgauguucgcaacaacuuuuaccacuacaaccaaucaaacgaccccaccaucaaacuaaucgcaaugcucuacaccccacuccgugccaacaacgccggcgacgacgucuucacaguuuccugccgaguccucacccgacccucccccgacuucgacuucaucuuccuaguaccacccacaguagaaucucgcacgaaaccuuuuuccgucccaguauuaaccgucgaagaaaugacuaacucucgcuuccccauuccccucgaaaaacucuuuacaggccccucaucagccuucgucguacaaccucaaaacggucgcugcaccaccgacggaguccuucuuggcaccacccagcucuccccagucaacaucugcacuuuccgcggggacguaacacacauaacaggaagccgaaacuacaccaugaaccuagcaagccaaaauuggagcaacuaugaccccaccgaagaaaucccagcaccccugggaaccccagacuucguuggaaaaauccaaggcguccuaacccagaccacccgaacugacggcuccacacgcggccacaaggccacaguauacacuggauccgccgacuuugcacccaaacucggacgcguccaauucgaaacugacaccgaccgcgacuucgaagcaaaccaaaacaccaaauucacccccgucggggucauacaagacggcuccaccacacaccgcaacgaaccacaacaauggguuuuacccuccuacuccgggcgauacaccccaaacguccaccucgcccccgccguagccccgacauuccccggcgaacaacuauuauuuuuccgcagcacaaugccaggcugcucuggcuaucccaauauggaccuagauugccuacucccgcaagaauggguccaauacuucuaccaagaagccgcccccgcccaguccgacgucgcccuauuaagauucgucaacccagacaccggacgaguccuauucgaaugcaagcuacacaaauccggcuacguaacaguugcccacaccggccaacacgaccuaguaauaccacccaacggcuacuuccgauucgacucuugggucaaccaauucuauacacuagcccccaugggcaacggcacaggccgcagacgagcccucuag

SEQ ID NO: 36686 - RNA, 1623 nt, Artificial Sequence
  derived and/or modified sequence opt11 from VP1__Norovirus__BAU24994
augaaaauggccucauccgacgcaaaccccuccgacggaagcgcugccaaccuaguacccgaaguuaauaaugagguaauggcccuagaaccaguagucggcgccgcaauagcagccccagucgccggccaacaaaacguaaucgaccccuggauccguaacaacuucguacaagccccagguggagaguucacugucucaccccgaaacgccccaggcgaaauacucugguccgcaccccucggccccgaccuaaacccuuaccuuucccaccucgcacgaauguacaaugguuacgcaggagguuucgaagugcaagucauacucgccggaaacgccuucaccgccggcaaaguaaucuucgcagccgucccacccaacuuccccaccgaaggccucucccccucccaagucacaauguuuccccacauagucguagacguacgccaacucgaaccaguccucaucccccucccagacguacgcaacaacuucuaccacuacaaccaaucaaacgaccccacgaucaaacucaucgcgaugcucuacacaccccuacgcgcaaacaacgccggcgacgacguauucaccguuuccugccgcguccuaacccgcccaucacccgacuucgacuucaucuuucuagucccacccaccgucgaaucccggaccaaacccuucuccguacccguucuaaccgucgaagaaaugaccaacucacgauuccccaucccccucgaaaaacucuucaccggcccaucaagcgccuucgucguccaaccccaaaacggcagaugcaccacagacggcguccuccucggcaccacacaacucucaccaguaaauaucugcaccuuccgcggagacgucacacauaucacugguagccgcaacuacacuaugaaucucgccucacaaaacuggaacaacuacgaccccacagaagaaauacccgccccacucggcacacccgacuucgucggaaagauucaaggcguccucacacaaacaacacgaacagacggcucaacccgcggucacaaagcgaccguauauaccggcuccgccgacuucgccccuaaacucggacgcguccaauucgaaacagacaccgaccacgauuucgaagcaaaccaaaacaccaaauucaccccagucggagucauccaagauggcggcacuacacaccgaaacgaaccccaacaauggguccuccccuccuacucaggccgaaauacucacaacguccaccucgccccagcagucgcccccacuuuccccggcgaacaacuccucuucuuucgauccaccaugcccggcugcuccggcuaccccaauauggaccucgacugccuacucccacaagaguggguccaauacuucuaccaagaagccgcucccgcccaaucagacgucgcuuuacuccgcuucgucaacccagauaccggacgcguccucuucgaaugcaaacuacacaaaucaggauacgucacagucgcccacacaggccaacacgaccucgucauaccacccaacggauacuuccgauucgacucaugggucaaucaauucuacacacuagccccaaugggcaacggcaccggccgacgccgcgcggucuaa

SEQ ID NO: 36687 - RNA, 1623 nt, Artificial Sequence
  derived and/or modified sequence opt11 from VP1__Norovirus__BAU24996
augaaaauggccuccuccgaugccaaccccuccgacggaucagccgcaaaccucgucccagaagucucuaacgagguaauggcucucgaacccguuguaggagcagcaauugcagcccccgucgcaggacaacaaaacgucaucgaccccuggauccgaaacaacuucguccaagcccccggcggcgaguucaccguaucgccccgcaacgccccaggcgaaauccuuuggucagcaccccucggaccagaccucaaccccuaccuaagccaccucgcccgcauguauaacggcuacgccggcggcuucgaaguccaagucauacuagccggaaacgcauucacagccggaaaaguuauuuucgcggccguacccccaaacuucccaaccgaaggauuaucacccucacaagucaccauguucccccacauugucgucgacguccgccaauuagaacccguccucaucccacuccccgauguccgaaauaacuucuaccacuacaaccaauccaacgaccccacaauuaaacucaucgccaugcucuacacuccacuccgcgcaaacaacgcaggagacgacgucuucaccguauccugcagaguacuuacccgccccucacccgacuucgacuucauuuuccuagucccacccaccgucgaaucucgaaccaaacccuuuuccguacccguacucacugucgaagaaaugacgaacuccagauuccccaucccccucgaaaaacucuucacaggacccucuucugccuucgucguccagccucaaaacggccgaugcaccaccgacggaguccuacuuggcacuacacaacucucaccagucaacaucugcaccuuccgcggagacguaacucauaucacaggauccagaaacuacaccaugaaccucgccucccaaaacugguccaacuacgaccccaccgaagaaaucccagcgccccucggcaccccagauuucgucggcaaaauccaaggaguacuaacccaaacgacacgaaccgacggcuccacccggggccacaaagccaccguauacaccggcucagccgacuucgcccccaaacuaggccgcguccaauucgaaacugacaccgaccgcgacuucgaagccaaccaaaacacgaaauucacccccguuggcguaauccaagacggcuccaccacucaucgaaacgaaccccaacaguggguccuucccucauauuccggccgcaacacucccaacguccaucucgcccccgccgucgcucccaccuucccaggcgaacagcuccucuuuuuccgcucaaccaugccaggaugcuccggauaccccaacauggaccucgacugccuucuaccacaagaauggguacaauacuuuuaccaagaagcagcuccagcccaaucagaugucgcccuacuccgguucgucaacccagacaccggacgaguccucuucgaauguaaacuccacaaauccggauacguaacagucgcccacaccggccaacacgaccucgucauaccaccuaacggauacuucagauucgacuccugggucaaccaauucuacacccucgcccccaugggaaauggcacaggacgacgccgggccuuauaa

SEQ ID NO: 36688 - RNA, 1623 nt, Artificial Sequence
  derived and/or modified sequence opt11 from VP1__Norovirus__BAU24998
augaaaauggcuagcuccgacgcaaaucccagcgacggaucagccgcaaaccucgucccagaagucaacaaugaaguaauggcacucgaacccgucgucggcgcggcaaucgccgcccccgucgccggccaacaaaacguaaucgaccccuggauaagaaacaacuucguccaagcccccggcggagaauuuacaguauccccgcgaaacgcccccggggaaauucuaugguccgcaccacugggccccgaccucaaccccuaccuaagccaccuagcccgcauguauaacggcuacgcaggcggauucgaaguccaaguaauccuugcaggcaacgccuucaccgccggcaaagucaucuuugccgccguuccucccaacuuccccacagaaggccucucacccucccaagucaccauguucccccacaucguagucgacguacgccaacucgaacccguccucauaccacugcccgacguacgcaacaacuucuaccacuacaaccaaucaaacgaccccaccaucaaacuaaucgccaugcucuacacuccucuucgcgccaacaacgcuggcgacgacgucuucacagucucgugccgcguacuuaccagacccuccccagacuucgauuucaucuuccuaguacccccaacagucgaaucccgcacaaaacccuucagcguccccguacucaccguagaggaaaugaccaauucucgcuucccaaucccccucgaaaaacuauucacaggcccuuccuccgccuucgucguacaaccccaaaacggacgauguacaaccgacggcguucuccucgggaccacccaacuauccccaguuaacauaugcacauuccgcggcgacguaacccacaucacaggcucccgcaacuacaccaugaaccucgccucacaaaauuggucaaacuacgacccaacggaagaaauaccagcaccccucggcacacccgacuucguugguaaaauccaaggcguacuaacccaaaccacacgcaccgacggcuccacacgcggccacaaagccaccgucuacacaggcagcgccgacuucgcaccgaaacucggccgaguccaauucgaaaccgacacagaccacgacuucgaagccaaccaaaacacaaaauucaccccuguaggcgucauccaggauggcuccaccacgcaccgcaaugaaccacaacaauggguauuaccauccuacucaggucgcaacacccccaauguccaccuagccccagcagucgccccaacauuccccggagaacaacuccucuucuuucgcucuaccaugcccggcugcucaggauaccccaacauggaccucgacugucuccuaccucaagaauggguccaauacuucuaccaagaagccgccccagcacaaucggacguagcccuccuccgcuucguaaaccccgacaccggcagaguacucuucgagugcaaacuccacaaaucaggauacguaacaguagcccacaccggccagcaugaccuaguuauaccucccaacggcuacuuccgcuucgacuccuggguuaaccaauucuacacccuugccccaaugggaaacggcacuggccgccgcagagcccuauaa

SEQ ID NO: 36689 - RNA, 1623 nt, Artificial Sequence
  derived and/or modified sequence opt11 from VP1__Norovirus__BAU25002
augaaaauggcauccuccgacgcaaaccccuccgacggcucggcugcaaaccucguucccgaaguaaacaacgaagucauggcacuugaaccuguaguaggagccgccaucgcagccccugucgcaggccaacaaaacgucaucgaccccuggauccgcaacaacuucguacaagcaccaggaggcgaguucacaguaucaccccgcaacgcccccggcgaaauccuaugguccgcaccccuaggacccgaccucaaccccuaucucucccaccucgcccgcauguacaacggcuacgccggaggauucgagguacagguaauccucgccggcaacgccuucaccgcaggcaaagucauauucgccgcaguaccacccaacuuccccacugaaggucucucacccucccaagucaccauguucccacauauagucgucgacguccgccaacuugaacccguacucaucccccuaccagacguuagaaacaacuucuaccacuacaaccaaagcaacgacuccaccauaaaacucaucgcgaugcuauauacaccccugcgagccaacaacgcaggcgacgacgucuucaccguauccugccgcguccucacucgccccagccccgacuucgacuuuauuuucuuaguucccccaaccgucgaaucccgcacaaagccauucuccgucccaguccucacaguagaagagaugacaaacucacgcuuccccauaccacuagaaaaacucuucacgggacccuccuccgccuucgucguacaaccccaaaacggccgcugcacaacagauggcguccuacucggaaccacccaacucucacccguaaacaucugcaccuuccgcggagauguuacccacaucaccggcucccguaacuacaccaugaaucucgcuucccaaaacugguccaacuacgacccuaccgaagaaauccccgccccacucggaacccccgacuuuguagguaaaauacaagguguccucacccaaacaacccgcaccgacggcucuacccgcggccacaaggccaccguuuacaccggcuccgccgacuucgcccccaaacucggccgcguccaauucgaaaccgacaccgaccacgacuucgaagcaaaccaaaauaccaaauucaccccagucggcgucauccaagacggcuccaccacacaccguaacgaaccacaacaauggguccuccccuccuacagcggccgaaacaccccuaacguccaccucgccccugcugucgcaccaacuuuccccggcgaacaacuccuguuuuuccggucaacuaugcccgguugcuccggauacccaaauauggaccuugacugucuccucccacaagaauggguccaauacuucuaccaagaagccgccccagcccaauccgacgucgcccuccuccgcuucgucaaccccgacaccggccgcguccucuucgaaugcaaacuccacaaauccggauacguaaccgucgcccacacaggccaacacgaccuuguaauacccccaaacggcuauuuccguuucgacuccuggguaaaucaauucuacacccucgccccaaugggaaacggcacaggccgccgucgagcccuauaa

SEQ ID NO: 36690 - RNA, 1623 nt, Artificial Sequence
  derived and/or modified sequence opt11 from VP1__Norovirus__BAU25004
augaaaauggccucaucugacgccaaccccuccgacggauccgcagcaaaccugguccccgaaguaaacaacgaagucauggcccuagaaccagucgucggcgccgccaucgccgcacccgucgccggccaacaaaacguaaucgaccccuggauccgaaacaauuuuguccaagcccccggcggagaauuuaccgucucaccccgaaacgccccaggcgaaauccucugguccgcaccccuaggccccgaccucaacccuuaccuaucccaccucgcccgcauguacaacggcuacgccggcggauucgaaguccaagucauccucgccggaaacgcauucacugcuggaaaagucaucuucgcagccgucccacccaacuuucccacagaaggccucucccccucccaagucaccauguucccccauaucgucguagacguacgucaacuugaacccguacuaauaccccuccccgacguccgaaacaacuucuaccacuacaaccagucaaacgaccccacaaucaaacucaucgcuaugcucuacaccccucuccgagcaaacaacgccggcgacgacgucuucaccgucuccugccgaguccucacacgcccauccccagacuucgacuuuaucuuucuaguaccaccaacagucgaaucacgcacaaagcccuucuccguacccguccuaaccgucgaagaaaugaccaauucccgauuccccaucccccuugaaaaacucuucacaggacccuccagcgccuucguaguacaaccccaaaauggccgcugcacaacagacggcguccuucucggcacgacccaacucucgcccgucaauauaugcaccuuccgcggcgacgucacccauaucacaggcucccgcaacuacaccaugaaccucgcgucucaaaacuggucaaacuacgaccccaccgaagagauccccgcaccccucggcacccccgacuucgucggcaaaauacaagguguccucacccaaacaacccgaacagacggcucaacucgaggacauaaagccaccgucuacaccggcucagccgauuucgcccccaaauuaggccgaguucaauucgaaaccgacaccgaccgggacuucgaggcaaaccaaaacacaaaauucacucccgucggcgucauucaagacggcucaaccacccaccgaaacgaaccccagcaauggguauuaccauccuacuccggccgaaacaccccaaacguccaccucgcccccgccgucgccccuaccuuccccggagaacaacuccucuucuuccgguccacaaugccaggcugcucgggcuacccaaacauggaccucgacugccuccuuccgcaagaauggguccaauacuucuaccaggaggcagcccccgcccaaucugacgucgcccuccuccgcuuugucaaccccgacaccggccguguauuguucgaaugcaaacuccauaaaucaggauacgucaccgucgcccauaccggacagcacgaucucgucauacccccaaacggcuacuuccgguucgacuccugggucaaccaauucuacacccuugcccccaugggaaacggcaccggccgcagacgcgcacuauaa

SEQ ID NO: 36691 - RNA, 1644 nt, Artificial Sequence
  derived and/or modified sequence opt11 from VP1_protein__Norovirus__ADN84676
augaagauggccuccucagacgcugccccaagcacagacggcagcgcaggccuaguaccugaaguaaauaacgaaaccauggcacucgaacccguaguaggugcaccccucgccgccccagucgccggccaacauaacaucauagacccauggaucaaaaugaacuucguccaagcccccaauggcgaauuuaccguaucaccccgaaacgcccccggagaaauacuccucgaccuagaacucggacccgaccucaacccauaccuaucccaccucgcacgcauguacaacggauaugcaggcggaauggaaguccaagucguccucgcaggaaacgccuucaccgccggcaaaaucaucuucgccgccguuccucccaacuuccccgcagaaaaucugucagccgcccaaguuaccaugugcccccacguaaucgucgacguucgccaacucgaacccgucaugcuaccuaugccagacaucagaaacaaacuauuccacuacaaccaagucgacgacccaaaacuccgacuccucgcauaccuauacacuccccuacgugccaacaacgccggagacgacgucuucaccgucagcugcagaguccuaacacgcccaacccccgacuucgaguucauguuccucgucccaccaacaguagaguccaaaaccaaaccauucucccucccaaaccugacccucgacgaacuguccaacucacgcuuucccgcccccauaguacaacuauauaccaacccacacgacaaccucgugguccagccccaaaacggccgcugcaccaucgacggccugcuccaaggaacaacccagcuagucuccugcaacgucugcuccuuccgcggaacaaugggcgaaggccaacccgccagccacuccgaagaugaaaucaugcccauggcaaucaacguccaacgcgaaauaaugcucgaaaaccuagacggaucaccauacgacccaaccgacgauauccccgccguacucggaucccccgacuuccaaggagucauguucggcauccuuucccaaagaaacaccgacggccaaacccgcgcacacgaagcaaaaguagacaccagagccgcccgauucgccccaaaacugggcuucgucgucgccacaguugaguccaccgacuuccacgccaaccaaccaucacgcuucaccccagucggccucggcggagacgccaaccgagacuucaaccaauggcaacuccccgcuuacggcggagcacuaacaaacaacaccaaucuugcaccacccgucaugcccguauaccccggagaacaacuauuauucuucagaucacaacuacccuccuccggcggggucguagcaggcuggcucgacugccuccucccacaagaauggguccaacacuucuuccaagaaucggcaaccucacaaucaaacgucgcccucguccgauacgucaaccccaccaccggccgcguccuauucgaggccaagcuacacaaacaaggauuccucacaguagccgcauccggcuccuacccccuaguuguaccugccgauggcuacuuccgcuucgagucaugggucaacgaauuuuacacccucgcaccaauggggaaugggucaggacgacgccgcgcccgauaa

SEQ ID NO: 36692 - RNA, 1623 nt, Artificial Sequence
  derived and/or modified sequence opt11 from VP1_protein__Norovirus__BAK68870
augaaaauggccagcaaugaugccucuccauccgacggcucagccgccaaccucguacccgaagucaacaacgaggucauggcccucgaaccagucgucggcgccgccaucgcagccccaguagccggccagcaaaacgucaucgaccccuggaucagaaacaauuuuguccaagcccccgguggcgaguucacuguauccccacgcaacgcuccuggcgaaauccucuggagcgccccgcuaggcccagaccucaaccccuaccuuucccaccuagcccgcauguacaacggcuacgccggaggcuucgaaguacaaguaauacucgccggaaacgccuucaccgccggcaaaauaauauucgccgccgucccacccaauuuccccaccgaaggacucagccccucccaaguaacaauguucccucacaucauugucgacgucaggcaacuagaaccaguccucauaccccucccagacgucaggaacaacuucuaccacuacaaccaauccaaugacucaaccauaaaacuaauagccaugcucuacacuccccuacgcgcuaacaacgccggcgaagacgucuuuaccguuuccugucgcguucuaaccagaccaucacccgacuucgacuucauuuuccuaguaccgcccaccgucgaaucccgcaccaaacccuuuaccguaccaauccuaaccgucgaagaaaugacuaacucccgauucccgauacccuuagaaaaacucuucacugggccaucuucagccuucgucguacaaccccaaaacggccgcugcaccaccgacggcguauuacucggcaccacacaacucuccccugucaacaucugcacauuccgcggcgacguaacgcacaucgccggcucacgcaacuacaccaugaaccucgcaucccucaacuggaacaacuacgacccaacagaagaaauccccgcaccacucggcacaccugacuucgucggcaaaauacaaggaguccuaacccaaacuaccaaaggcgacggcucaacccgcggacauaaagccaccgucuacaccggcuccgccccuuucacacccaaacucggcuccguccaauuuucgacagacaccgaaaacgauuucgaaacccaccagaacaccaaauucacccccgucggcgugauccaagacggcagcacgacccaccgaaacgaaccacaacaauggguccuccccucauacucuggacgcaacguccauaacguccaccucgcccccgcagucgcuccaaccuuccccggagaacaacuccucuucuuccgauccaccaugccaggcugcucaggcuaccccaacauggaccuagacugccuacucccccaagaauggguacaacacuucuaccaggaagccgccccagcccaauccgacguagcccuucuccgcuucgucaaccccgacaccggacgcguucucuucgaaugcaaacuccacaagucaggcuacgucaccgucgcacacaccggccaacacgaccucguaauacccccuaauggcuacuuccgauucgauucauggguaaaccaguuuuacacccuugcaccaauggguaacggaaccggacgucgacgcgcccuauga

SEQ ID NO: 36693 - RNA, 1620 nt, Artificial Sequence
  derived and/or modified sequence opt11 from capsid__Norovirus__AAC54893
augaaaauggccucuuccgacgccaacccuuccgacggcuccgccgccaaccucguccccgaagucaacaacgaaguaauggcccucgaacccgucgucggcgccgccaucgcagcccccgucgcgggacaacaaaauaucaucgacccguggauccgcaauaauuuuguacaagcccccggcggugaguucaccgucucaccccgaaacgcuccaggagaaauucucugguccgcuccccucggccccgaccucaaccccuaccucucccaccucagccgaauguacaacggcuacgccggagguuuugaaguccaaguuauccuagccggaaacgcuuuuacagccggaaaagucauuuucgccgccguaccucccaacuuccccaccgaaggccucucuccuucccaagucacaauguucccccacaucaucguugacguacgccaacucgaacccguccucaucccacuuccagacguccgcaacaacuucuaccacuacaaccaaucccacgacuccacacuaaaauuaaucgccaugcucuacaccccacuccgagcuaacaacgcuggugacgaugucuucaccgucuccugucgcguucucacccgcccaucacccgacuucgacuucaucuuccuagucccacccaccgucgaaucccguacaaaacccuuuacaguacccauacucacuguagaagaaauguccaacucacgcuuccccauuccccuagaaaaacucuacacgggcccauccuccgccuucgucguccaaccccaaaacggacgcugcaccaccgacggcguacuccucggcaccacccaacucuccgcagucaacaucugcaacuuccguggcgaugucacccacauagucggcucacacgacuacacuaugaaccucgccucccaaaacugguccaacuacgaucccacagaagaaauccccgcaccccuaggcacccccgacuuugucggcaaaauccaaggccugcucacccagaccacacgcgccgauggauccacccgagcccauaaagccacaguuucaaccggaucaguccacuucaccccaaaauuaggauccguccaauucaccaccgacacaaauaaugacuuccaaaccggccaaaacaccaaauucacaccugucggcgucauccaagacggcgaccaccaccaaaacgaaccacaacaauggguccuuccuaacuacucagguagaaccggccacaacguacaccuagcgcccgcagucgcccccacauuucccggcgaacaacuacucuucuuccggagcaccaugccuggaugcucaggcuacccaaacaugaaccucgacugccuacuaccccaagaauggguacuccacuucuaucaagaagcagcccccgcacaguccgacguagcccuacuacgauucgucaacccagacacuggccgcguccucuucgaauguaaacuucacaaauccgguuacaucacaguagcccacaccggacccuucgaccucgucaucccacccaacggcuacuuccgcuucgacuccugggugaaccaauucuacacccucgcacccaugggcaacggcacaggucgccgucgagcacucuaa

SEQ ID NO: 36694 - RNA, 1647 nt, Artificial Sequence
  derived and/or modified sequence opt11 from capsid__Norovirus__AAW30195
augaaaauggccuccaacgacgcaacaccaucaaacgacggcgcagccggcuuaguccccgaaauaaacaacgaagcaauggcccuagacccaguagccggcgccgccauugccgcuccccucacaggacaacaaaacaucaucgaccccuggaucaugaacaacuucguccaagcacccggcggcgaacucaccguaagcccccgaaacuccccaggcgaaguacuccucaaccuagagcucggcccagaaaucaaccccuaccuagcccaucuagcccgaauguacaacggcuacgccgguggauucgaaguucaaguaguccuugcaggcaacgccuucacggccggaaaaaucaucuucgcagcaaucccucccaacuucccaaucgacaaccucuccgcagcccaaaucaccaugugcccccacgucaucgucgacguccgucaacuugaacccgucaacuuaccuaugcccgacguccguaacaacuucuuucacuacaaccaaggcuccgacacccgucuacgucuaaucgcuaugcucuacacaccccuccgugccaacuccuccggagacgacgucuucaccguauccugccguguccuaacccgacccagccccgacuuuucguucaacuuccucgucccacccaccgucgaaucaaaaaccaaacccuucacccuccccauccucacuaucucagaaaugagcaacucacgcuuccccguaccaauagacucccuccacaccagccccaccgaaaacaucgucguccaaugccaaaauggccgagucacgcucgacggugaacuaaugggaaccacccagcuccucccaucucaaaucugcgccuuccgcggcaugcucacccgcucuacaucacgagcuucagaccaagcugacacggcagcaccccgucucuucaauuaccacuggcacauccaacucgacaaucuaaacggaacccccuacgaccccgccgaagacauacccggcccccuaggcacacccgacuuccgcggaaaagucuucggcgucgcuucacaacgaaaccccgacucaaccacccgcgcacacgaagcaaaagucgauacuaccgcaggacgcuucacccccaaacucggcucucucgaaauaucgaccgaauccggcgaccucgaccagaaccagccuaccaaauucacacccgucggcaucggcguagaccacgaagaagauuuccaacaauggucacucccugacuauucuggacaauucacccacaacaugaaccuugcccccgcuguagcccccaacuucccuggcgaacaacuccucuucuuccgcucccaacuccccuccuccggcggucgcuccaacggaauccucgauugccuagucccucaagaauggguacaacacuucuaccaagaaagugcccccgcacaaacacaagucgcccuuguccgauacgucaacccugacaccggccgaguccuauuugaggcaaaacuccauaagcuaggcuucaugacaaucgccaaaaacggcgacucccccauaacagucccaccaaacggcuacuucggcuuugaauccugggucaaccccuucuacacacuugccccgaugggaaccggcaacggccgccgccgcauccaauaa

SEQ ID NO: 36695 - RNA, 1647 nt, Artificial Sequence
  derived and/or modified sequence opt11 from capsid__Norovirus__ABD36491
augaaaauggccucgaacgacgcagcccccuccaacgacggcgcugccggacucgucccagaaaucaacaacgaagccauggcacucgaacccgucgccggcgccgccaucgcagcaccucucaccggacaacaaaacauuaucgaccccuggaucaugaacaacuucguccaagcccccggcggggaguucacagucucaccccgaaacuccccaggagaaguucuccuaaaccucgaauuagguccagaaaucaacccauaccucgcacaccucgcccgaauguacaacggauacgcaggcggcuucgaaguccaagucguccucgccggaaaugccuucaccgccggcaaagucaucuucgccgccaucccacccaauuuccccauagacaaccucucagccgcccaaaucacaaugugcccccaugucaucgucgacgucagacaacuugaacccaucaaccuuccaaugcccgacguucgcaauaacuucuuccacuauaaccaaggcagcgacucccgccuucgccucauagccaugcuguacacaccccuacgggccaacaacuccggcgacgacguauucaccguauccugccgcguacucacacgccccucccccgacuucuccuucaacuuccuggugccacccacaguugaauccaaaaccaaacccuucacgcucccaauccucaccauuuccgaaauguccaacucccgguuccccguccccaucgacucccuccacacaucacccaccgaaaacauagucguccaaugccagaacggccgcgucacccuagacggagaacucaugggaaccacacaacuacucccgucccaaaucugcgccuuccgcggaacccucacacgcucaaccucccgcgcgucagaccaagccgacaccgccacaccacgccucuucaacuacuacuggcacauccaacucgacaaccucaacggcaccccauacgaucccgcagaagacauacccgccccucugggcacaccagacuuccgaggcaaaguuuucggcgucgccucccaacguaauccagacuccaccacccgcgcacaugaagccaaaguagauaccaccuccggucgcuuugccccaaaacucggaucacuugaaaucucaacugaauccucugacuucgacucaaaucaacccacccgauucacccccguaggcauaggcgucgacaacgaagcagauuuccaacaauggucacuccccgacuacucaggacaauucacccacaacaugaaccucgccccagccgucgccccaaacuuccccggcgaacagcuccucuucuuccgcucccaacuccccucaucaggaggccgcucuaauggcauauuagacugccuagucccucaagaauggguacagcacuucuaccaagaauccgccccagcacaaacccaagucgcccuagucagauauguuaacccagacacaggacgaguacucuucgaagcuaaacuccacaaacuaggcuucaugaccauagccaaaaacggugacucccccauaacagugccucccaauggcuacuuucgcuucgaauccugggugaaccccuucuauacccuagcacccaugggcacaggcaacggccggcgucgcauucaauaa

SEQ ID NO: 36696 - RNA, 1629 nt, Artificial Sequence
  derived and/or modified sequence opt11 from capsid__Norovirus__ABD36494
augaaaauggccuccaacgacgccgcaccuagcaacgacggagcagcaucccugguaccagaaggcaucaacgaaaccaugccccucgaacccgucgcaggcgccagcaucgccgcccccguagccggccagaccaacaucaucgacccuuggaucagaacaaacuucguacaagccccaaacggcgaauuuaccgucucaccccgcaacucccccggcgagauccuacuuaaccucgaacucggccccgaucucaacccauaccucgcacaccuaucccgaauguacaacggauacgccggcggagucgaaguccaaguccuacucgccggcaacgccuucacagcaggcaaaauccucuucgccgcaauucccccuaacuuccccguggacaugaucucccccgcccaaaucaccaugcuaccccaucuaaucgucgacguccgaacacuagaacccauaaugaucccccuccccgacguccgaaacgucuucuaccacuucaacaaccaaccccaaccucgcaugcgucuugucgcuaugcucuacacaccccuccgaucaaacggcagcggcgacgauguauuuaccguaucuugccgaguccucacccgaccaacaccugacuucgaguucauauaccuaguaccacccucaguagaaucaaaaaccaaacccuucacccuccccauccugaccaucuccgaacucacuaacucucgauuccccauccccauugaacaacucuacacugcacccaacgaaaacaaugucguccaaugucaaaacggccguugcacccuagacggcgaacuacaaggcacaacacaacuccucucauccgccauaugcuccuaccguggccgcacuguagccaacaacggcgacaacugggaccaaaaccuacuacaacucaccuacccuaacggcgccuccuaugaucccacggacgaaguccccgcaccccuaggcacacaagacuucuccggcaugcucuacggcguccucacacaagacaacaccaacgucuccgccggcgaagcuaaaaacgcaaaaggcaucuacaucuccaccaccuccggaaaauucaccccaaaaaucggauccaucggccuucacuccaucaccgaacacguauaccccaaccaacaaucacgauucacucccguaggcgucgccguuaaugaaaacacucccuuucaacaauggguccucccccacuacgcugggucacucgccuuaaacaccaaccucgccccagcagucgcaccuacauuccccggcgaacaacuacucuucuuccgcucccgagucccaugcguccaaggccaacaaggccaagacgucuucauagacugccuucucccccaagaauggguuaaucacuuuuaccaagaggcagcccccucccaagccgacgucgcccucauccguuacguaaaccccgacacuggccgaacccucuucgaagccaaacuacacagauccggcuucauuacagucucccacacaggcgccuacccccucgucguaccacccaacggccacuuucgauucgacuccuggguaaaccaauucuacucccuagcccccaugggaacgggcaauggccgccgucgcauccaauaa

SEQ ID NO: 36697 - RNA, 1614 nt, Artificial Sequence
  derived and/or modified sequence opt11 from capsid__Norovirus__ABD36497
augaagauggcauccaacgacgcugcacccuccuccgauggcgcagccggacuuguacccgaaauuaaccacgaaguaauggccaucgaacccguagcaggcgcaucaaucgccgcaccagucguaggccaacaaaacaucaucgaccccuggauacgcaacaacuucguacaagcccccgccggagaauuuaccgucagcccacguaaugcacccggagaauuucuacucgaccucgaacucggacccgaccucaaccccuaccuagcacaucucgcccguauguacaacggacaugcuggcggcauggaaguccaaaucguccucgccggcaacgcauucacugccgguaaaauccucuucgcagucaucccuccgggauuccccuaugaaaaccucucccccgcacaacuuaccaugugcccccaugucgucgucgacguccgccaacuagaacccgucaugcuacccaugccagacauccgaaacaccuucuuccacuacaaccaagacggaggaccccgacuccgccucaucgccaugcuauacaccccucuccgugccaacaacagcggcgacgacguauucaccgucuccugccgcguccucacccgcccagcgccagacuucgaguucaccuuccugguacccccauccgucgaaucaaaaaccaaagccuucaccaucccgguacucaagaucucagaaaugacaaacucaagauuccccguacccguugaucagauguacacaucccgaucggaaggaaucguuguccaaccccaaaacggccgcgccaccauagacggcgaacuacuagguacaacccucguaucaccugucuccgucugcaacuucaaaggcaacuuacaaaccgaaguccccggccaacaccaacaauaccaacuccaacucaccaaucucgacggcuccccgauagaccccaccgacgacaccccaggacccuuaggcugcccagauuucaucggacuucucuacggcgucgccucccagcgcggccccggcgacgccacccgcgcccacgaagcccgcaucgacaccggaucagacaccuacgcccccaaaauaggccaaguccgcuucuacuccacuuccaacaauuucgaaaccaaucaacccacccacuucacaccaguugguguauacaucgaaggcuccuccagcgacuucaaccaauggcaacucccccgauacggcggacaccucgccaacaacaaucaccuggcccccgcuguaucuccccuauucccaggagaacaaauccucuucuucagauccuucauccccggagcuuccggccacaccaacggcgaaauggacugccuccuaccccaagaguucguucaacacuucuaccaagaagccgccaccgcucaaagcgaaguagcccuacucagauucguaaaccccgacaccggacgugucuuauucgaaucaaaacuccauaaacaaggcuucaugaccauagcaucauccggcgaccaccccauaaucaugcccacaaacggcuacuuccgcuucgaagccugggucaaccaauucuacucacucgcacccgucggcaccgguuccggccgccggcgaauccaauaa

SEQ ID NO: 36698 - RNA, 1623 nt, Artificial Sequence
  derived and/or modified sequence opt11 from capsid__Norovirus__ABL74387
augaaaauggccuccaacgaugcaacccccucagacggcuccacugccaaccuaguuccagaagucaacaacgaaguaauggcccuagaacccguaguaggcgcggcaaucgccgcccccguagccggacaacaaaacguuauagaccccuggauccgcaacaacuucguccaagcacccggcggcgaguucacagucagcccccggaacgcccccggagaaauccucuggucggcuccccucggacccgaccucaaccccuaccuaucccaccuagcccgaauguacaauggauacgccggcggcuucgaaguccaaguuauacucgcaggcaacgcauucacagccggcaaaaucaucuucgccgccgugccacccaacuucccaacugaaggacucucaccaucccaaguaacaauguucccccacaucaucgucgacguccgccaacuagaaccgguccucaucccccuaccagacguccgaaacaacuucuaccacuacaaccaaucaaacgaccccaccaucaaacuaauagcaaugcuauauacaccccuccgcgccaauaacgccggcgacgacgucuucaccguauccugcagaguccucacaagacccucccccgacuucgauuucaucuuccuagucccaccaacagucgaaucgcgaaccaaacccuucuccguccccauccucaccgucgaggaaaugaccaacuccagauuuccaauaccccucgaaaaacucuucacaggacccuccuccgccuuugucguacaaccacagaacggucgcuguacaaccgacggagucuuacugggcaccacacaacuuucccccgucaacaucugcacauuccgcggugacgucacccacaucgccggcacucaaaacuacaccaugaaccuugcgucccaaaacuggaacaacuaugauccaaccgaagaaauccccgcaccacuaggcaccccugacuucguaggcaaaauccaaggcguccucacccaaacaacccgacgagacggcuccacccgaggccacaaagccacaguaucaacuggcucaguacacuucacacccaaacucgguucuguccaauucucaaccgacacaucaaacgacuucgaagccgggcaaaacacacgauucacgcccguaggaguuguccaagacgguagcaccacccaccaaaacgaaccucaacaauggguccuacccgacuacuccggccgcgacucccacaacguccaccucgcuccagccguggcccccacauuccccggcgaacaacugcuuuucuuccgcucaaccaugcccggcugcucaggauacccuaacaugaaucucgacugccuccuaccacaagaauggguccaacacuucuaccaagaauccgcccccgcacaaucagacgucgcccuccuacgcuucgucaacccagacacuggaagaguccucuucgaaugcaaacuccacaaauccggauacguaaccguagcauacaccggacaacacgaccuagucauacccccaaacggcuauuuccgauucgacuccugggucaaccaauucuacacccuggcccccaugggaaacggcgcaggaagacgccgcgcccucuaa

SEQ ID NO: 36699 - RNA, 1623 nt, Artificial Sequence
  derived and/or modified sequence opt11 from capsid__Norovirus__ABL74389
augaaaauggccucaaacgacgccaccccaucugacggcagcaccgccaaccuagucccagaaguaaacaacgaaguaauggcccuagaaccagucgucggcgccgccaucgcugcacccguagccggccaacaaaacguaaucgaccccuggauccgcaacaacuucguccaagcucccggcggcgaguucaccgucagcccacguaacgcacccggagaaauccucuggucagccccacuaggaccagaccucaaccccuaccucucccaccuagccagaauguacaaugguuacgccggaggguucgaaguccaagucauccuagccggcaacgccuucacagccggaaaaaucaucuucgccgccgucccaccaaacuuuccgaccgaagggcucucacccagccaagucacaauguucccccacaucaucguagacguccgacaacucgaacccguccucauccccuuacccgacguccgcaacaacuuuuaccacuacaaccaaucaaacgaccccacaauacgccuaaucgcaaugcucuacacaccccuccgcgcaaacaacgccggggacgacgucuucaccgucuccugccgcguccucacacgccccucaccugacuucgacuuuaucuuccucguacccccaacagucgaaagccgaacaaaacccuucagcguccccauacuuaccgucgaagaaaugaccaauucccgauuccccauaccccuagaaaaacuuuucaccggaccaucuuccgcauucgucguccaaccccagaacggcagaugcaccaccgacggcguccuccucgguaccacacaacucagcccaguuaacaucugcacuuucagaggcgacguaacccacaucgccggaacccaaaacuacaccaugaaccuggcuucccaaaacuggaauaauuacgaccccacugaagaagucccagcuccccuugguacaccagacuucguaggaaaaauccaaggaguccuaacccaaacaacccguggagauggcuccacacgaggacacaaagccaccgucucuaccggauccguccacuucacuccaaaacucggcuccguccaauucuccacagacacaucaaacgacuucgaaaccggacagaacacccguuuuaccccagucggcguaguccaagacggaagcaccacccaccaaaacgaaccucaacaauggguccuccccgacuauuccgggcgcgauaaccacaacguacaccucgcccccgccgucgccccaaccuuccccggcgaacaauuacucuucuuccgauccacuaugccaggcugcucaggcuaccccaacaugaaccuagacugccuacucccgcaggaauggguccaacacuucuaccaagaaucagccccagcccaauccgacgucgcacuucuucgcuuugucaacccagacacgggucgaguccucuucgaaugcaaacuccacaaauccggcuacgucaccgucgcccacaccggacaacacgaccucguaauacccccaaacggcuacuuccgcuucgacuccugggucaaccaauucuacacccuagcccccaugggcaacggagccggacgacgccgcgcccuauaa

SEQ ID NO: 36700 - RNA, 1623 nt, Artificial Sequence
  derived and/or modified sequence opt11 from capsid__Norovirus__ABL74397
augaaaauggccuccaacgacgcaaacccauccgacggauccgccgccaaccuaguccccgaagucaauaacgaagucauggcccuugaaccaguagucggcgcagcaauagcagcucccgucgccggccaacaaaaugucaucgacccuuggauccgcaacaacuucguacaagcuccuggcggcgaguucaccgucucuccccguaacgcgcccggcgaaauccucuggucagcuccccucggacccgaccugaaccccuacuuaucccaccucgcccgcauguacaacggcuacgcaggcggcuuugaaguccaagucauccucgcaggcaacgccuucaccgccggcaaaaucaucuucgcagccguaccacccaacuuccccaccgaaggccuaucccccucacaagucaccauguucccacauauaaucguagauguacgccagcuagaaccaguccucaucccccuucccgacgucagaaacaacuucuaccacuacaaccaauccaacgacucuaccaucaaacucaucgccauguuauacacuccccuccgugccaacaacgcaggcgaagaugucuucaccgucagcugucgcguccuuacccgacccuccccagacuucgacuucaucuuucuagucccacccaccgucgaaucacgcaccaaacccuucaccguccccauccucaccgucgaagaaaugacuaacucccgcuuucccaucccccuagaaaaacucuucaccgggccaucuggcgccuucguuguccagccacagaacggacgaugcacaaccgacggaguccuacuaggcacaacccaacucucaccggucaacauaugcaccuuccgcggcgacgucacacacaucgcaggaucccgaaacuacaccaugaaccuagccucccuaaauuggaacaacuacgacccaaccgaagaaauacccgcgccccuuggcacccccgacuucgucggaaaaauucaaggcguacuuacccaaaccaccaaaggcgacggauccacacguggccacaaagccaccgucuacaccggaagcgccccauucaccccuaaauuaggcagcguccaauucucaaccgacaccgaaaacgacuucgaaacccaccaaaacaccaaauucacaccaguuggcgucauccaagacggcuccacuacucaccgcaacgaaccacaacaauggguucucccauccuacucaggacgcaacguccacaacguucacuuagcccccgccgucgcccccaccuuccccggcgaacaauuacucuucuuccgaucaaccaugccaggcugcucuggauaucccaacauggaccucgacugccuccuaccccaagaguggguccagcacuucuaccaagaagccgcccccgcccaaagcgacgucgcccuccuacgauucgucaaccccgacacaggccgugucuuauucgaaugcaaacuacacaaauccggcuacguaacagucgcccacaccggccaacacgaccuuguuaucccacccaauggcuacuuccgauucgauuccuggguaaaccaauucuacacccucgccccaaugggaaacggaaccggccggcggagagcccuauaa

SEQ ID NO: 36701 - RNA, 1593 nt, Artificial Sequence
  derived and/or modified sequence opt11 from capsid__Norovirus__ABQ44562
augaugauggcauccaaagacgccaccagcuccgucgacggagccuccggcgccggccagcuaguccccgaagucaacgcaucagacccacucgccauggaccccgucgccggaagcucaacugccguugcaaccgccggccaagucaacccuaucgacccauggaucauaaacaacuucguucaagccccacaaggugaauuuaccauauccccuaacaacacucccggugacguccucuucgaccuuucacuaggaccccaccucaaccccuuucuccuccaucucucccaaauguacaacgguugggucggcaacaugcgcguccgaaucaugcucgccggcaacgcuuucacagcgggaaaaauuauaguauccugcauaccacccggcuucggcucccacaaccuaaccaucgcacaagccacacucuucccccacguaauugcagacgugcgcacccucgaccccauagaaguuccccucgaagacguccgaaacguccucuuccacaacaacgaccgaaaucaacaaaccaugcgccucgucugcauguuauacacaccccuccgcacaggaggaggcaccggagauaguuucgucgucgccggccgagucaugacuugcccauccccagacuucaacuuucucuucuuaguaccaccgaccguagaacagaaaacgcgccccuucacccucccaaaccuuccccucagcagccucucaaacucacgcgcuccccuaccaauauccggaaugggcauaucccccgacaacguccaaucaguccaauuccaaaacggucgcugcacacucgacggcagacucguuggcacuacccccgucagccucucccacgucgccaaaauuagaggcacauccaacggcaccgucauaaaccucacugaacuagacggcaccccguuccaccccuucgaaggacccgcccccaucggcuucccagaccucgguggaugcgacuggcacaucaacaugacccaguucggccacuccucccaaacccaauacgacguagacacaacccccgauaccuucguaccccaccuaggcuccauucaagccaacggcgucucauccggaaauuauaucggcguccucuccuggguuagcccgcccucacacccaucuggaucccaagucgaccucuggaagauucccaacuacggaaguucgaucaccgaagcaacccacuuagcacccagcgucuacccgcccggcuucggcgaaguccucgucuucuucaugagcaaaauaccaggccccggcgccuauucacuccccugccuucucccgcaagaauacaucucccaucuagccagcgaacaagcacccaccgucggcgaagccgcccuacuccacuacguagacccagacacaggcagaaaccucggcgaguucaaagccuacccagauggcuuucuuacaugcgucccaaacggcgccagcucaggcccacaacaacucccuaucaacggcgucuucgucuucgucagcugggucucacgcuucuaccaacuuaaaccagucggaacagccuccacagcccgaggacgucucggccuacgccguuag

SEQ ID NO: 36702 - RNA, 1638 nt, Artificial Sequence
  derived and/or modified sequence opt11 from capsid__Norovirus__ABQ44563
augaugauggcaucaaaaggcgcccccaccaacauggacggcaccucaggcgcuggucaguuaguuccagaagccaauacagcagaacccaucagcauggaacccguagccggugccgccaccgccgccgcaaccgccggccaaguaaacaugaucgaccccuggauaaugaacaacuacguacaagcaccccagggcgaauuuaccaucucccccaauaacacaccuggagacauacucuucgaccuacaacuaggcccccaccuuaaccccuuccucucacaccuagcccaaauguacaacggaugggucgggaacaugaaagucaaaguacuucuagccggcaacgccuuuacggcaggaaaaauaaucaucuccugcauacccccaggcuucgucgcccaaaacaucuccaucgcacaagccacgauguucccccacguuaucgccgacgucagaguccucgaaccaaucgaaguaccacuagaagacguucguaacguccucuuccauaacaacgacaauacucccaccaugcgccuagucuguaugcuauacacaccccuaagagccuccggcuccuccagcggcaccgaccccuucgucaucgccggccgcguucucacgugccccucacccgacuucuccuuccucuuccuaguacccccaaacgucgaacagaaaacuaaaccuuucucaguccccaaccuaccccucaacacacuauccaauucacgcguccccucacuuaucaaauccaugaugguaucccgcgaccacggacaaaugguccaauuccaaaacggccguguaacccucgacggccaacugcaaggaaccacccccaccuccgccucccagcucugcaaaaucagaggauccgucuuccacgccaacggcggcaacggauacaaccucacagaacucgacggcucacccuaccacgccuuugaaucgcccgccccaaucggauuccccgaccucggcgaaugcgacuggcacauggaagccucccccacgacucaauuuaacacaggcgacguaaucaagcagaucaacguaaaacaagaaucggcauucgccccacaccucggaaccauccaggccgacggacucucugacguauccguuaacaccaacaugauagccaaacucgaaugggucucccccgucuccgacggccacaaaggagacgucgacccauggguaauaccccgcuacggaucaacccucaccgaagccgcacaacucgccccacccaucuaucccccaggcuucggcgaagcaauagucuucuucauguccgacuucccaauagcacacggcacaaacggccuauccgucccgugcacaauaccccaagaauuugucacccacuucgucaacgaacaagcccccacccgcggcgaagccgcgcuguuacacuaccucgaccccgacacacaccgcaaccugggcgaguucaaacucuacccagacggcuucaugacuugcguaccuaacucaucaggcacaggaccacaaacccuccccaucaacggagucuucgucuucgucucaugggugucacgcuucuaccaacucaaacccgucggcacagccggcccagcccgaagacucggaauccgccgauccuaa

SEQ ID NO: 36703 - RNA, 1635 nt, Artificial Sequence
  derived and/or modified sequence opt11 from capsid__Norovirus__ABQ44564
augaugauggccuccaaggacgcaacccccucugccgacggagccaccggcgccggacaacucguacccgaagucaauaccgcugaucccauccccaucgaccccguagcaggcuccucaacagcacuagccaccgcaggccaaguuaaccucauugaccccuggauaauuaacaauuucguccaagcuccccaaggagaauuuaccaucucaccaaacaacacucccggcgauguccucuucgaucuacaauuaggaccccaccucaaucccuuccucucgcaccucucucaaauguacaacggcuggguuggcaacaugcgcguacgcguaguccuagccggaaacgccuucaccgccggcaaagucaucaucugcuguguuccuccuggauuccaaucccgaacccucucaaucgcccaagcaacccucuucccacaugucaucgccgacguccguacccuagauccagucgaaguaccccucgaagacguccgcaacguccucuaccacaacaacgacacccaaccaaccaugcgccuccuaugcaugcucuacacaccccuccgaacaggaggagccuccggcggaacagacuccuucgucguugccggccguguccucacuugccccggccccgauuucaacuuccuauuccucguaccacccaccgucgaacagaaaacccgucccuucaccguucccaacaucccucucaaauaccuauccaacucccgcauacccaaccccaucgaaggaaugucccucuccccagaccaaacccaaaacguucaauuccaaaacggacgcugcaccauugacggccaacccuuggggaccacccccgucucagucucacaacucugcaaauuccgcggccgcauaacuuccggccaaaagguccuaaaucuuaccgaacuagacggaucccccuucauggccuucgcagccccugcacccgccggcuuccccgaccuuggcuccugugacuggcacaucgaagucucaaaaaucccaaacucauccacccaauccaaccccaucguagucaacuccgucaaacccaacucacaacaauucgucccccaccuaucauccaucacccuagacgacaacgucuccagcggaggcgacuacaucggaaccauccaauggaccagcccucccucugacagcggcggugccaacaccaacuucuggaaaauacccgacuacggauccucccucgcagaagccucacaacucgcccccgcaguuuacccacccggcuucaacgaaguaaucgucuacuucauggccucaauccccggcccaaaccaaucaggcucacccaaccuaguacccugccuacucccccaagaauacaucacccacuucaucagcgaacaagccccaauccaaggggaagccgcauuacuacacuacguagacccagacaccaaccguaaccuuggcgaguucaaacucuacccaggcgguuaccugaccugcguccccaacuccuccucaacaggcccccaacaacucccgcuagacggcguauucgucuucgcuuccugggucuccagauucuaccaacugaaacccgucggaacagcaggccccgcccgcggccgccuuggcguccgacgcuaa

SEQ ID NO: 36704 - RNA, 1623 nt, Artificial Sequence
  derived and/or modified sequence opt11 from capsid__Norovirus__ABQ44565
augaugauggcaucaaaagacgcucccaccucaccagacggagcuuccggcgcaggccaacucguccccgaagccaacaccgccgagcaaaucucaauggacccaguagcuggcgcuucuacggcagucgccaccgcaggccaagucaacaugauagaccccuggaucuucaauaacuucguccaagcaccccaaggagaauuuacuaucagccccaacaacacccccggugacauccuuuucgaccuccaacucgggccucaccucaacccuuuccucgcccacuuaucccaaauguacaauggcuggguaggcaacaugcgcguacguauacuacucgccggcaacgccuucaccgccggcaagauaaucaucugcugcguaccaccuggcuucgacgcaagaauacucaccaucgcccaagcuacccucuucccucaccucaucgcagacguacgcacccuagaaccugucgaacucccccucgaagacguccgaaacguacucuuccacaacuccucccagccccaaccuaccaugcgacucgucgccaugcucuacacaccccuccgcaccggcggcggcuccggcgggacagacgccuucgucgucgccggacgcguacuaaccugccccgcccccgauuucuccuuccucuuccuugucccacccucuguugaacagaaaacccgcgucuucuccguccccaacgucccacugaaagaucuuucaaacucccgcgucccaguccccauccaagguauguucaugucccccgacgucaaccaauccguccaauuccaaaacggccgaugucaaaucgauggccaacuccaagguaccaccccugucucucuaucacaacucugcaaaauccgaggcaaaaccuccucaaacgcccgcguccucaaccucucagaaguagacggcucaccauucaucccacuggaaucccccgcccccgucggcuucccagaccucggcggaugcgacuggcacgucaacuucaccuuucaagcacaggaccaagacccaucccaaucagugaccuucgccaccaaugacgccuccuucguuccuuaccucggcucaaucucaccccacaacggcggcgacuuccauuccggcgacaucaucggaucccuaggcuggauuuccgcccccucugauuccucccaacuuaacgucuggaccauccccaaauacggcuccucccuccccgacgucacccaccucgccccagccgucuuuccacccggcuucggcgaagucauccucuacuucuauuccaccuuccccggcuccggccaacccggccaacuucaaguccccugccuccucccccaagaauuuauaacacacuucugcaacgaacaagcccccauagccggcgaagccgcccuacuccacuacgucgacccagacacaggccgcaaccucggcgaguucaagcucuaccccgacggcuucaugacuugcguacccaauucagucucuuccggcccccaaacacuacccauuaacggagucuucgucuuugucaguuggguaucccgcuucuaccaacucaaaccuguaggaacagccucaguugcccgacgccucggccuacgccguaucuaa

SEQ ID NO: 36705 - RNA, 1635 nt, Artificial Sequence
  derived and/or modified sequence opt11 from capsid__Norovirus__ABQ44566
augaugauggcuagcaaagacgccccgacaaacauggacggcaccuccggcgccggacaacuuguccccgaagcaaacaccgcagaaccaaucuccauggaccccguagcaggcgcagccaccgccgucgcaaccgcaggccagaucaacaugaucgaccccuggaucaugagcaacuucguccaagcuccccaaggcgaguucaccgugucccccaauaauacuccaggcgacgucuuauucgaccugcaacucggcccacagcucaaccccuuccucgcacaccuugcccaaauguacaacggauggguuggcaacaugcgaguaaaaguucuccuugcaggcaacgcauucaccgcagguaaaaucaucaucucauguaucccaccaggcuucaccucccaaaacaucucaauagcacaaaugaccauguucccgcacgucauagccgacguccgcguacuggaaccuauugaaguuccccucgaagacguccgaaacguccucuuccacacaaacgacaaccggccaacaaugcgccuagucugcaugcuuuacacaccccuaagagcaaacggcuccucauccgguaccgacccguucgucaucgcaggccgcguacuaaccugccccgauucaaacuucuccuuccucuuccucguaccacccaacguagagcagaaaaccagacccuucucaguaccaaauaucccccucaacacccucuccaacucccgagugccaucucuaauaaaauccaugaccaucuccagagaccaaaaccaaauaauucaauuccaaaacggccgaguuacccucgacggccaacuccaaggcaccaccccaaccuccguaucccaacucugcaaaauccgcggcaccacauaccacgccaccggcggcaacggcaucaaccuuaccgaacucaacggcgaacccuaccacgccuucgaauccccagcccccaucggauuccccgaccugggcggaugugacuggcaccucaccgcuacccccacccaagccuucaaugacggcgccaaaguaguacgacuuucaguaacccaaggagcagccuucgcaccccaccuagguacaauccacuacacaaccaccgacacagacuacucccccaacaccucgaucaucugcacacuagacuggcucucacaaaccaccggccaaucgaacgucgaccccuggcaaaucccaaccuacggcucaacucucacagaagccgcccaacucgccccacccauauuucccccaggcuucggcgaaacacucguauucuuccucuccgauuuccccaucagcaauggcaaaaacggccuauccguccccugcacacucccccaagaauuugucacccacuucguuaacgaacaagcgccaaucagaggcgaagccgccuuacuacacuacguagaccccgacacacacagaaaccucggugaguucaaacuuuacccagaaggcuucaugaccugcgucccuaacaccucaggcggcggaccccaaacacuccccaucaacggcgucuucguauucguaucauggguaucaagauucuaccaacuaaagccugucggcaccgccggggccgcccgccgacucgguauccgccguucauaa

SEQ ID NO: 36706 - RNA, 1608 nt, Artificial Sequence
  derived and/or modified sequence opt11 from capsid__Norovirus__ABQ44567
augaaaauggcuuccaacgacgcagcucccucuaacgacggcgccgccggccuaguacccgaagucaacaacgaaaccauggcccucgaacccgucgccggugcguccaucgccgccccgcuaaccggccaaaacaacguuaucgacccauggauacgcaugaauuucguccaagcccccaacggcgaguucaccgucucgccucgaaacucccccggcgaaauccuucuuaaccucgaacuaggccccgaacugaacccauuccucgcacaccuaucccguauguacaacggcuaugcaggcgguguagaaguccaaguccuccucgcaggcaacgcuuucaccgcaggcaaacucgucuucgccgccaucccuccacacuuccccaucgaaaaccuauccccaggccaaaucaccauguucccccacgucauaaucgacguucgcacccuugaaccaguacuucucccccuacccgacguccgaaacaacuucuuccacuacaaccaagaacccgaaccccguaugagacuuguagcaaugcucuacacaccccuccguuccaacggauccggagacgacguauucaccgucagcugccgcguacucacccgaccuucucccgacuucgauuucaacuaccuagucccacccaccgucgaguccaaaaccaaacccuucacacuacccauccucacaauaggagaacuauccaauucacgcuuccccgccccaaucgaugaacuauacacaucucccaacgaaggccucgucguccaaccccaaaacggccgcagcacucucgacggugaacuccugggcaccacucaacucgucccuucaaacaucugcucccuccguggccgaaucaacgcacaccuccccgacaaucaacacagauggaacaugcaaguaaccaacgccaacggcacccccuucgaccccaccgaagacguccccgcuccccucggcacccccgacuuucuugccaacaucuacggcguaaccucccaacgcaaccccgacaacacaugccgagcccacgauggcauccucgccaccugguccccuaaauucacccccaaacuuggcuccgucguccuaggcaccugggaggaccgagacuucgacauaaaucaaccaacccgauucacccccgucggccucuaugacaccgaucacuucaaucaaugggcccuccccaacuauucaggugcacuaacccuaaacaugaaccucgcaccaucagucgcuccacucuuccccggggaacaacuccucuuuuuccgcucacacaucccccucaaagguggaaccuccuccggcgcaaucgacugccuucucccccaagaauggguccaacauuucuaccaagaaucagccccuucauccacagacguggcccuaauucgcuacacuaaccccgacacaggacgaguccucuucgaagccaaauuacaccgccaaggcuucaucacaguugccaacuccggcucgcgcccuaucguagucccucccaacggauacuuucgcuucgacucaugggucaaucaauucuacucucuagcccccaugggaacaggcaacggccgccgccgcguccaauaa

SEQ ID NO: 36707 - RNA, 1629 nt, Artificial Sequence
  derived and/or modified sequence opt11 from capsid__Norovirus__ABQ44568
augaacauggccuccaacgacgccgcacccuccaccgacggcgccgccggacucguuccagaaagcaacaacgaagucauggcccucgaaccagucgccggcgccgcccuagccgcacccguaacaggacaaacaaacauuaucgaccccuggaucagagcaaacuucguccaagcaccaaacggagaauuuaccguaucaccacgcaacgcccccggcgaaguacuccuaaaccucgaacuaggccccgaacucaacccauaccuugcccaccucgccagaauguacaacggcuaugccggcggaauggaaguccaagucaugcucgccggaaacgccuucaccgcaggcaaacucgucuucgccgccgucccaccccacuuccccgucgaaaaccuaucuccccaacaaaucacaauguucccccacgucauaaucgacguacgaacacuggaacccguccuacucccccucccagacguucgaaacaacuucuuucacuacaaccaaaaagacgaccccaaaaugcgcaucguagcaaugcucuacacaccacuuagaucuaacgguuccggagacgacgucuucaccgucucgugccgaguccuaaccaggcccucccccgacuuugacuucaccuaccuuguaccacccaccgucgaauccaaaacaaaacccuucacccugcccauacuaacccucggagaacucuccaauucuagauuccccguauccauagaucaaauguauaccucacccaacgaaguaaucagcguccaaugccaaaacggucgaugcacccuugacggcgaacuacaaggcaccacacaacuucaagucuccggaaucugugcauucaaaggcgaagucacugcccaccuccacgauaaugaccaccuuuauaacguaacaaucaccaaccuaaacggcucccccuucgaccccucagaagauauacccgccccacugggcguccccgacuuccaaggccgcguauucggagucauaucacaaagagacaaacaaaacgccgccggccacaacgaaccagccaaccgaggccacgacgcagucguccccaccuacacggcccaguacacacccaaacuaggccaaauccaaauaggcacuuggcaaaccgacgaccuaaccgucaaccaaccagucaaauucaccccagucggccuaaacgacaccgaacacuucaaccaauggguaguuccccgguacgcuggcgcccucaaccucaacacaaaccuagccccaucugucgcaccagucuuccccggcgaaagacuacucuuuuuccgauccuacaucccacucaagggcggauacggcaacccagccauagacugccuccucccccaggaauggguccaacacuuuuaccaagaagccgccccuuccaugagcgaagucgcccuaguacguuacauaaaccccgacaccggccgcgcacuauuugaagcaaagcuacaccgcgcuggcuuuaugaccgucagcuccaacaccuccgcacccgucguaguccccgcaaacgguuacuuccgcuucgacuccugggucaaccaauucuauucucuagcaccuaugggaacaggcaacggacgccgccgcgugcaauaa

SEQ ID NO: 36708 - RNA, 1647 nt, Artificial Sequence
  derived and/or modified sequence opt11 from capsid__Norovirus__ABQ44569
augaaaauggccucaaacgacgccgcccccuccaacgacggugccgccggacucguccccgaaaucaacaacgaagccauggcucucgacccagucgcuggagcugccauagcagccccucucaccggucaacaaaacaucauagacccauggaucaugaacaauuucguccaagccccaggcggcgaauuuaccgucucaccucgaaacucccccggagaaguccuccuaaaccuagaacucggccccgaaauaaacccauaccuagcacaccuagcccgcauguacaacggauacgccgguggcuucgaaguccaaguagucuuagcaggaaaugcauucaccgcagguaaaaucaucuucgcagcaaucccgcccaacuuucccaucgacaaccucuccgccgcccaaaucaccauguguccccacgucauagucgauguacgucaacuagaacccguuaaccuccccaugcccgacguaagaaauaacuuuuuccacuacaaccaaggaucggacucccgccuccgccucauagcaaugcuauacacgccccuccgugccaacaacucuggcgacgacguauucacagucucaugucgcguacucacccgacccucccccgacuucuccuucaauuuccucgucccacccacagucgaaagcaaaacaaaacccuucacacuacccauccuaaccaucucugaaauguccaacucacgauucccaguccccaucgacuccuugcauaccucuccaacagaaaacaucgucguccaaugccaaaauggccgagucacucucgacggcgagcucaugggcaccacccagcuacuccccucccaaaucugcgccuuccgcggcguccucacacgaucaacaucccgcgccucagaccaagccgacaccgccacgccacgucucuucaacuacuacuggcacauccaacucgacaaccuaaacggcacucccuacgacccagccgaagacaucccuggcccccucggaacccccgacuuccguggcaaggucuuuggcgucgccucacagcguaaccccgacuccacaacccgcgcacacgaagcaaaagucgacaccacugcaggcagauucacaccaaaacucggcucucuugaaaucuccaccgaaucugaugacuucgaccagaaccaacccacccgauucaccccaguaggcaucggggucgaccacgaggcagauuuccaacaauggucccuccccgacuacagcggacaauucacacacaacaugaaccucgcgcccgcagucgcacccaacuuccccggcgaacaacuccucuucuuccgcucacagcuacccuccucaggcggccgcuccaacgggauccucgacugccuggucccacaagaguggguccaacacuucuaccaagaaucugcccccgcccaaacccaagucgcccucgucagauaugucaacccggacaccggccgcguccuauucgaagccaaacuccacaaacucggcuucaugaccauagcuaagaacggugacucgccaauaacaguacccccuaacggcuacuuccgauucgaauccugggucaacccauuuuacacacucgcaccuaugggcaccggaaacggccgacgccgaauccaauag

SEQ ID NO: 36709 - RNA, 1623 nt, Artificial Sequence
  derived and/or modified sequence opt11 from capsid__Norovirus__ABQ44570
augaaaauggccuccaacgacgcagcgccauccaacgacggcgccgccggccuaguacccgaauccaacaacgaagcuauggcacuagaacccguuaugggcgccucacuagccgccccagucaccggccaaaccaacaucaucgaccccuggaucagaaccaacuucgugcaagcaccaaacggcgaauuuacagucucaccccgcaacuccccaggagaaauccuugucaaccucgaacuuggccccgaacucaaccccuaccucgcccaccucgcccgaauguacaacggauacgccggcggcauggaaguccaagucaugcuugccggcaacgcauucacagccggcaaaauaaucuucgccgcaguacccccauacuucccaguugaaaaccucucccccucacaaaucacgauguucccacacgucaucauagacguacgcacucucgaacccguucuccucccuaugccagacguccgcucaacacuguuccacuucaaccaaaaagacgaacccaaaaugcgccuaguugcaaugcuauacacaccacuccgcagcaacggcucaggcgacgacguauuuaccguauccugccgcauacuuacacgcccaucccccgaauuugacuucaccuaccucgucccaccaaccgucgaauccaaaaccaaaccuuucacacuaccaguccucacacucggcgaacuuagcaauucacgauucccucucuccauugacgaaauggucacauccccgaacgaaagcauagucguucaaccacagaacggucgcgucacccuugauggagaacuucucggaaccacucaacuacaagccugcaauaucugcaguauccgaggaaaagucaccggccaagucccaaacgaacaacacauguggaaccucgaagucaccaaccuaaacggaacccaauucgaccccacagaugacguccccgcaccccuaggcguccccgauuucgccggcgaagucuucggaguccucagccaacgaaacagaggagaauccaaccccgccaaccgagcccacgacgccguagucgccaccuauucagacaaguacaccccaaaacucggacucguccaaaucgguaccuggaacaccaacgacguagaaaaccaaccgaccaaauucacuccuauaggccuaaacgaaguagccaauggucaccgcuucgaacaauggacccucccccgcuacucuggcgcccucacccucaacaugaaccuagcccccgccgucgcuccccuauuccccggcgaacgccuccucuuuuuccgcaguuacauaccccucaaagggggcuuuggcaaccccgccaucgacugccucgucccccaggaauggguccaacacuucuaccaagaaagcgcccccucucuaggcgacgucgcccuaguccgauacguaaacccagacacaggaagaguccucuucgaagccaaacuccacaaaggcggauucuuaaccguauccuccacaucaaccggcccagucguaguccccgccaacggcuacuuccgcuuugacuccugggucaaccaauucuacucauuagcacccaugggcaccggcaacggacgccgaagauuucaauaa

SEQ ID NO: 36710 - RNA, 1653 nt, Artificial Sequence
  derived and/or modified sequence opt11 from capsid__Norovirus__ABQ44571
augaaaauggccuccaacgacgccgcccccucaaacgacggugccgcaaaccucguuccugaagccaacaacgaagucauggcucucgaacccguaguaggcgccucuaucgccgcacccgucgucggccaacaaaacaucaucgaccccuggauccgcgaaaacuucguacaagcaccccaaggcgaauuuaccguuagcccacgcaacucuccaggagaaaugcuccucaaccucgaacucggccccgaacucaacccauaccucucucaccuaucccgcauguacaacggcuacgccggcggaaugcagguccaaguaguccucgcaggcaaugcauucacagcuggcaaaaucaucuucgccgccgucccaccccacuuccccguagacaacauuuccgcugcacaaaucacaaugugcccccacgucaucgucgacguccgacaacucgaacccguacuccuaccccugcccgacauccgcaaccgcuucuuucacuacaaccaagaaaacacaccccgcaugcgccuagucgcuaugcucuacacgccccuccgagccaacucaggcgaagacgucuucacagucucaugccgcguccuuacccgcccugcccccgacuucgaguucaccuuccucguucccccuaccgucgaaagcaaaacaaaacccuucacacuccccauccucacacuaggcgaacuauccaacagccgcuuccccgcagcaauagacaugcuauacacagacccaaacgaaucaaucgucguccaaccccaaaacggccgcugcacccucgacggcacccuucaaggcaccacccaacucguacccacucaaaucugcgcguucagaggcacccucaucucccaaaccgcacgcgccgccgacuccaccgacucaccacagcgggcccgcgaccacccacuccacguccaagucaaaaaccucgacggaacccaauacgaccccaccgacgacauccccgccguccuaggcgcaauagauuucaaaggaaccgucuucgguguagcaucccaacgcgacguauccggaccccaagaacaaggucacuacgcaacccgcgcccacgaagcccacaucgauacaacagaucccaaauacgcccccaaacucggcaccauccucaucaaguccgaaagcaacgacuucauaaccaaccaaccaauccgcuucaccccagucggcaugggcgacaacaauuggcgccaaugggagcuacccgacuauuccggcagacucacccuaaacaugaaucuagccccugcagucucacccucauucccuggagagcgcauacuauucuuccguuccaucguaccuuccgccggcggcuacggcucaggauacauugacugccucaucccccaagaauggguacaacacuucuaucaagaggccgcccccucccaauccgcuguagcccuaguccgauauguuaaccccgacacaggccguaacaucuucgaagccaaacuccaucgagaaggcuuccucacggucgcaaacagcggcaacaaccccaucgucgucccacccaauggauacuuccgcuucgaagcauggguaaaccaauucuauacacucgcccccaugggcuccggccaaggaagacgccgagcccaauaa

SEQ ID NO: 36711 - RNA, 1623 nt, Artificial Sequence
  derived and/or modified sequence opt11 from capsid__Norovirus__ABQ44572
augaagauggccuccaacgacgccgccccgagcucugacggcgccgccggccucguacccgaaaucaacaacgaaguaaugccacuagaucccgucgcaggcgccagccucgcaaccccagucgucggacaacagaacauaauagaccccuggauccgaaacaacuuuguccaagccccagcaggcgaguucaccgucucaccccgaaacucccccggcgaaauucuccucgacuuagaacucggccccgaacucaaucccuaucucgcccaccucgcccgcauguacaacggucacgcaggaggcauggaaguacaaaucguacucgccggcaacgccuucaccgcaggaaaaaucaucuucgccgccauaccacccgguuuccccuacgaaaaccuaucucccucccaaauuaccaugugcccccacgucauaauagacguacgacaacucgaacccguauuacuccccaugcccgacauccgcaacaacuucuuccacuacaaccaaggaaacgaccccaaacuccgccucguagccauguuauacaccccacucagagccaacaacuccggcgacgacgucuucaccguuucaugccgcguacuaaccaaaccaucccccgacuucgaguucacauuccuaguacccccaacagucgaauccaaaaccaaacaauucacgcuaccaauacucaaaaucucagaaaugaccaacucccgcuucccuguccccgucgacguaauguacaccgcacgcaacgaaaaccaaguaguccaaccacaaaacggccgcguaacacucgacggcgaacuccuaggcaccacaccccuacucgccguuaauaucugcaaauucaaaggcgaagucauagccaaaaacggcgacguacgcucauaccgcauggacauggaaauaaccaauaccgacggcacaccuauagacccaaccgaagacaccccuggccccaucggcucccccgacuuccaaggaauccucuucggaguagccucccaacgaaacaaaaacgaacaaaaccccgcaacccgugcccacgaagccaauaucaacaccggcggagaucaauacgcccccaaacucgcccaagucaaauucuucuccgaaucccaagacuucgaaguccaccaacccaccacauucacccccguaggcgucgcgggagacaacucccaucccuuccgacaauggacacucccccgcuacggaggccaccucacuaauaacacacaccuagccccagccguugcuccccucuuccccggagaacaacuucucuucuuucgcucccaaaucccaucauccgguggacacgaguccggauacauggacugccucgucccccaagaauggguacaacacuuuuaccaagaagccgccaccgcccagucggaggucgcccuaauccgcuucaucaaccccgacacaggcagaguucuauucgaagccaaacuacacaaacagggcuucauaacugucgcucacaccggcgacaacccaaucgucaugccacccaacggcuacuuccgcuucgaagccugggucaaccaauuuuacucacuugcaccuguuggcacaggaaacggccgacgccgaguccaauaa

SEQ ID NO: 36712 - RNA, 1608 nt, Artificial Sequence
  derived and/or modified sequence opt11 from capsid__Norovirus__ABQ44573
augaaaauggccucuaacgacgccgcacccuccaacgacggagcagccggccuuguacccgaagcaaacaacgaaaccauggcccucgaacccguugccggcgccuccauagccgcuccccuaaccggccaaaacaacaucaucgaccccuggauacgucuaaacuucguccaggccccaaacggcgaauuuaccguaucaccccgcaacucgcccggcgaaguacuccuaaaccucgaacucggacccgaacucaacccauaccucgcccaccucucccgcauguacaacggcuacgccgguggcgucgaaguucaaguccuacucgccggcaacgccuucacagccggcaaauugguauucgccgcuguacccccacacuucccacuugaaaacaucucacccggccaaaucaccauguucccacacgucaucauagacguccguacacucgaaccaguccuccucccccuccccgacguucgcaacaacuucuuccacuacaaccaacaaaacgaaccccgcaugcgccucgucgcaaugcuauacacuccccuacgcucgaacggaucaggcgacgacguauucaccguguccugccguguccuaacccgcccuucaccagacuuugacuucaacuaccuagucccgcccaccguagaaucaaaaaccaaacccuucacccuacccauccuaaccaucggagagcucacaaacucccgauuccccguccccaucgacgaacuuuauaccucccccaacgaaagccuagucguccaaccacaaaacggacgcugcgcccuagacggcgaacuccaaggcaccacccaacuucucccuaccgccaucugcucauuccgcggccgaaucaaccaaaaagucuccggagaaaaccacguauggaacaugcaagucacuaacauuaacggcacacccuucgacccaacugaagacguccccgucccccucgguaccccagacuucuccggcaaacucuucggcguccuuucccaacgcgaccacgacaacgcgugcagaucccacgacgccgucaucgccacaaacucagccaaauucaccccaaaacuaggcgccauacaaauaggcaccugggaggaaaacgauguucacauaaaccaaccaacaaaauucacucccguaggauuauucgaagacgaaggcuuuaaccaauggacccuucccaacuacucaggugcacuuacacuaaacgucggccuugcaccucccguagcaccgacuuuucccggcgaacaaauucucuucuuccgcucacacaucccacuuaaaggaggcgucgccgaccccgucauagacugccuccucccacaggaauggauucaacaccucuaccaagaauccgcaccaucccaauccgaugucgcccucauacgauuuacaaaccccgacacaggccgcguacuauucgaagcaaaacuccaccgcuccggcuauaucacaguagccaacaccggcucccguccaaucgucguacccgcaaacggcuacuuccgguucgacucaugggucaaccaauucuacucccucgcuccuaugggcacagguaacggccgacgacgaguccaauaa

SEQ ID NO: 36713 - RNA, 1614 nt, Artificial Sequence
  derived and/or modified sequence opt11 from capsid__Norovirus__ABQ44574
augaaaauggcauccaacgacgccacacccagcgacgauggugcagccggccucgucccugaaaucaacaacgaaguaauggcccucgaaccagucgccggugcaucaaucgccgcacccgucgucggacaacaaaacaucauugaccccuggauacgaaauaacuucguccaagcccccgccggcgaguucaccgucucccccagaaacucccccggcgaacuccuccuagaccucgaacucgggcccgaacucaaccccuaccucgcccaccucgcccgaauguacaauggucaugccggaggcauggaaguccaaauuguccucgccggcaacgcuuucaccgccggcaaaauccucuuugccgccauaccacccuccuucccguaugaaaaccucucacccgcccaacucaccaugugcccacacgucaucguugacguccgacaacuugaacccguccuccuaccaaugcccgacaucaggaacgucuucuaccacuacaaccaaaacaacucucccaaacugcgccuagucgccaugcuauauacaccccuccgagccaacaauuccggcgacgacgucuucaccguaagcugcagaguccucacacgccccucacccgacuuccaauuuaccuuucuagucccacccacaguggaaucaaaaaccaaaaacuucacccuccccguacuccgcgucucggaaaugacgaacucgcgcgugcccagaugcuuuggcacaaaaugcauacaagcacgaaacgaaaacaucaucguccagccccaaaacggccgauguaccacugacggagaacuccuaggaacaacaacccuccaauccgucucaaucugcaacuuccgcggcaccaugcaagcaaaacuaaacgaacaaccucgauaccaacuacagcucacaaaucucgauggcucccccaucgacccaaccgacgacaugcccgccccgcuagguacccccgacuuccaagccaugcuauacggcgucgccucccaaagauccucccgcgacaacgccacacgugcacacgacgcccaaaucgauaccgcaggagacaccuucgcacccaaaauaggccaaguccgcuucaaauccuccuccggcgacuucgaccuccacgacccaaccaaauuuacccccaucggugucaacgucgacgaccaacaccccuuccgccaauggucccugcccaacuacgggggacaccuagcacucaacaaccaccucgcccccgccgucaccccacuauuccccggagaacaaauccucuucuucagaucccacaucccaucugccggcggccacaccgacggagcaauggacugccuccuuccccaagaauggaucgaacacuucuaucaagaggcagcccccagccaauccgacaucgcccuaguccgcuucauaaaccccgacacuggccgcguccuccuagaagcgaaacuacacaaacaaggguuccuuacagucgcagccuccggagaccaccccauaguuaugcccaccaacggcuauuuucgauucgaggcuugggucaaccccuucuacacccuagcuccaguuggcacuggaucuggccgacgacgcauccaauaa

SEQ ID NO: 36714 - RNA, 1641 nt, Artificial Sequence
  derived and/or modified sequence opt11 from capsid__Norovirus__ABQ44575
augaaaauggcaucaaacgacgccgccccaucuaacgacggcgccgccagccucguccccgaaggaaucaacgaaaccaugccccucgaaccugucgccggcgcauccaucgccgcccccguugcgggccaaaccaacaucaucgauccauggauucgcaccaacuuuguccaagcacccaacggcgaguucacuguaucaccccgcaacucccccggcgaaauccuacucaaucuagaacucggcccugaccuuaacccauaccuagcucaccucuccagaauguacaacggauacgcuggcggcguagaaguccaaguccuccuugcaggcaacgccuucaccgcuggcaagauccuauucgccgcaaucccucccaauuuccccgucgacaugauaucccccgcccaaaucaccaugcucccccaccucaucgucgacguacguacgcucgaacccauaaugaucccauuaccagacguacguaaugucuucuaccauuucaacaaccaaccacaaccccgcaugcgacucguagcaaugcucuacacgccccuacgcuccaacggcuccggcgacgacgucuucaccgucuccugccgcguacuaacccgcccaacaccagacuucgaguucaucuaccuggucccacccuccgucgaauccaaaaccaaacccuucacccuacccauacuaaccauuucugaacucaccaacucccgcuuccccauccccauagaacaacuuuacaccgcaccuaacgaaacaaacgucguccaaugccaaaacggccgauguacucucgacggcgaacuacaagguacaacccaacuccucuccuccgccguaugcuccuaccguggccgaaccguggccaacaacggcgauaacugggaccaaaaccuacuacaacucaccuauccaaauggagccucauacgaccccacagacgaaguaccagcaccccucggcacccaagacuucucaggaaugcucuacggcguccucacccaagauaacgucaacguaucuaccggcgaagccaaaaacgcuaaaggcaucuacauauccacaaccuccggcaaauucacaccaaagaucggcucuauuggccuccacucaaucaccgaacacguucacccaaaccagcaaucccgcuucacacccguuggcgucgccgucaacgaaaacacaccauuccaacaauggguccuuccacacuacgcaggcucccucgcacuaaacaccaaccucgccccagcagucgcucccaccuuccccggugaacaacuacucuuuuuccgcucucgcguccccugcguccaaggccuacaaggacaggacgccuucaucgacugccuacucccccaagaauggguaaaccacuucuaccaagaggccgcccccgcuccagcacccucacaagccgacgucgcucucauccgcuacgucaaccccgacaccggccgaacccuauucgaggccaaacuccaccgcucaggcuuuauaaccgucucccacaccggagccuacccccuaguuguacccccaaacggacacuuccgcuucgacucaugggucaaccaguucuauucacucgcccccaugggcaccggcaacggccgccguagaauccaguaa

SEQ ID NO: 36715 - RNA, 1623 nt, Artificial Sequence
  derived and/or modified sequence opt11 from capsid__Norovirus__ABQ44576
augaaaauggccagcaacgacgccgcccccuccaacgacggcgcggcuggccucgucccagaaguaaacaacgaaacacuagcucucgagcccgucgccggagcgagcauagccgccccacuuaccggccaaaacaacgucaucgaccccuggauucgccuaaauuucguccaagcgccuaacggcgaguucaccguaucccccagaaacucucccggagaaauccuacuaaaccucgaacuuggcccagaacuuaaccccuaccuagcccaccuagcccggauguacaacgguuacgccggaggagucgaaguccagguacuacucgcaggaaacgcuuucacugccggaaagcucguauucgccgcaauaccaccccacuuccccgucgacaaccucucacccggacaaaucaccauguuuccccacgucauaaucgacguccgaacacucgaaccaguccuccugccccuccccgacguacgcaacucauucuuccacuacaaccaacaaagcgaccaacgcaugcgccucauagcaaugcuauacacaccccugcguuccaacggcagcggcgacgacguuuuuaccgucuccugccgcguccucacccgcccgucccccgacuucgacuucaacuaucucguuccaccaacaguagaauccaaaaccaaacccuucuccgucccagugcuaacacuaaaugaacucaccaacuccagauuccccguccccaucgacgcuauguacacaucccccaacgacuccaucguaguacaaccacaaaacggccgcgccaccauagacggugaacuacuaggcaccacacaacucauacccucaggcaucugcuccuuucgaggcaaaaucacaacccaccucuccgaugaccgccaccucuggaacauacaaguaaccaaucuaaacggcaccccauuugacccaaccgacgacguacccgcaccucugggcaugcccgacuucucuggacaaaucuucggcgucgucucccaaagagacaccggaaccaacccagcaaaccgcgcccaugacgccguccucgccacuuacuccgccaaauacacccccaaacuaggaucaguccaaaucggcaccugggauacagaagaccuccuagaacgacaacccguaaaauucacaccaguaggccuuaacgaaauuggccaagacaaacacuucgaccaauggguccuacccaacuacuccggagcucucggacucaacaugcaccucgcccccgcagucuccccacuauucccaggugaacgauuacucuucuuccgcucuuacauaccucucaaaggaggccauggagaucccuucaucgacugccucgucccacaggaguggauccaacacuucuaccaagaauccgccccagcccaguccuccguagccuuacuccgauacguaaaccccgacaccggccggacccuguucgaagcuaaacuucacaaagaaggcuucaucaccguauccuccaccgagaaccgcccagucguaguacccccuaacggcuacuuccgauucgacagcugggucaaccaauucuacucgcuagcaccaaugggcaccgguaacggccgucgccgcaugcaauaa

SEQ ID NO: 36716 - RNA, 1569 nt, Artificial Sequence
  derived and/or modified sequence opt11 from capsid__Norovirus__ACJ04900
augaaaaugaccgaccgugacaccaucgauuccgccccugcacucggccaaguacuucccccugaaguagaagccuccguccccguugaaccaaccgccggagcacccgucgccgcccccacagcaggccaaguaaacccaaucgauccauggauauucgcaaacuucguccaagcuccccaaggcgaguucaccaucuccccuaacaauaaucccggcgaaauccucuuugaacucgaacuaggacccgaccucaaccccuaccuagcccaccuccgacgcauguacaacgguuggaccgguucaaugagaguccgcguccuccucgccggcaacgcuuucucagccggaaaagucguugucuucugugucccuccaggauucgacaccucuuaccuaacccccucccaagcuacucaauucccccacguccuaaucgacguccgcgcccccgaaccaguggaaaugccccucgaagacguccgaaacauccuauuccaccaaggaccggacucgcgaaugcgccucaugggcaugcuuuacacaccacuccgagccaacuccggcgccgaccccuucgucguaacaggacgcguccucacuugcccuucaccaaacuucucauucuucuuucuagucccacccaccguagaagaacgcgaaacccccuucacacuacccaaccuccccgucaacucacuaucccacucccgagccauggaaccaaucgcccaaaugaugucuucacgcaauuuccccgccucaguccaauuccaaaacggucgcugcacccucuccggcgaccuccuuggcacaacccccuccagcccagcugacgucggaacauucguaggucucaucgccgaacccgguucccacgucguagaacucucccaacccaaccaagaagacuuccacgccggcuccgccccagccccauucggcuucccagacuucuccgauugcagccucacuuuugucgucgccucagccucuaccgucggcgaacgcaccgucaacacacgcucaccccaaaacuucaccccugcccuuggucacaucaccuucgaugaagaagcccccgcugaccucuuccgcgcacaucuucgcaaccucugggaccccaccgaacacuccuucuggcgcauacccgacuaccgcgccgacguccuuggcggugaguucgccccauccguaucagcacccggcgucggagaaacccuccucuuuuucauguguaacgucccccgcuccaacggggcaaaccccaaccccugcccaugccuccucccacaagaauggauaacccacuucgucuccgaacgcgccgcacuccaauccgaugucgcacuccuaaacuacauaaaccccaacaccgggcgcguccuauuugaaugcaaacucuacgcaaacgguuucuugaccgucaaccucggcgcauccgaccaagccacccuaccuguagacggcauauucaaauucguaagcugggucuccuucuacuaccaacuacgcccaguuggcaacauaggcgucggacgccgccuaccccgacucgacggcuucuag

SEQ ID NO: 36717 - RNA, 1569 nt, Artificial Sequence
  derived and/or modified sequence opt11 from capsid__Norovirus__ACJ04903
augaaaaugacagaucgagacacaaucgacucugcacccgcucuaggccaagugcuacccccugaagucgaagccucaguccccgucgaacccacagcaggagcccccguagcagcuccaacagccggccaagucaaccccaucgacccauggaucuuugcaaacuucguccaagcaccccaaggcgaauuuaccauaucacccaacaauaaccccggagaaauacucuucgaacucgaacuaggccccgaccuuaacccuuaucucgcccaccuccgccgcauguacaacggauggacaggcuccaugcgcguccgcguucuccucgccgguaacgccuucuccgccggcaaaguugucgucuucugcguucccccaggcuucgacaccuccuaccuaacccccagucaagccacccaauucccacacguccuaaucgacguccgugccccagaaccggucgaaaugccccuagaagacguacgcaacauacucuuccaccaaggcccagacucccgaaugcgccucaugggcaugcuauacacuccccuccgcgcaaacucaggugccgacccauucguuguuaccggaagaguuuuaaccugccccucccccaacuucucauuuuucuuccucguaccucccaccguugaagaacgggaaacccccuucacccugcccaaccuacccgucaacagccuaucccacucccgagucauggaacccauagcccaaaugaugucaucucgaaacuuccccgccuccguacaauuccaaaacggucgaugcacccuauccggagaccuccucggcaccacccccucaagccccgccgaccuugguacuuucguaggccucauagccgaacccggcucccacgucgccgaacuuucacaacccaaccaagaagauuuucaugccggcuccgcaccagcccccuucggcuucccagauuucuccgaauguucccucaccuucgucguggccuccgcaucaacaguuggcgaacgcacaguuaacacacgcucacuccaaaacuucacccccgcccucggccacaucaccuucgacgaagaagcccccgccgaucucuuccgcgcccaccuccgcaaucucugggacccaacagagcacucuuucuggcgcauccccgacuaccgcgcagacguccucggcggcgaauuugccccaucaguaucagcacccggcguuggcgaaacacuacuuuucuuuaugugcaacguacccagacuaaauggugcaaacccaaauccaugccccugccuucuuccccaagaauggaucacccacuucguguccgaacgcgccgcccuccaguccgacgucgcccuacuaaacuacaucaacccaaacacaggccgcguccucuucgaaugcaaacucuacgucaacggcuuccuaacuguaaaccucggcgccuccgaccaagccacacuccccguugacggcaucuucaaauucguauccuggguaucuuucuacuaccaacucaggcccgucggcaacaucggcgucggccgccgccuaccacgacuagacggauucuaa

SEQ ID NO: 36718 - RNA, 1569 nt, Artificial Sequence
  derived and/or modified sequence opt11 from capsid__Norovirus__ACJ04906
augaaaaugacagaccgcgaugucaccgacuccgccccagcccuuggccagguccuaccacccgaaguugaagccuccguccccgucgaaccaaccgcgggcgcaccagucgccgcccccaccgccggacaagucaauccuaucgaccccuggauauucgccaacuuuguccaagcuccccaaggagaauuuaccaucucuccuaacaacaaccccggcgaaauccuuuucgaacuugaacucggccccgaccucaaccccuaccucgcccaccuacgccgaauguacaauggcuggaccggcuccaugcgcguccgcguccuccuagcaggaaacgccuucuccgccggaaaaguagugguauucugcgucccacccggcuucgacaccagcuaccucacacccucacaagccacccaguucccccacguucucaucgacguccgagcaccagaacccgucgaaaugccacuggaagacgucagaaacauccuuuuccaccagggccccgacucucguaugcgccuuaugggcaugcuuuacacaccacuccgcgcuaacuccggcgcagaccccuucgucgucacaggucgcguccucacuugcccuuccccuaacuucuccuuuuucuuccucguacccccaaccgucgaagaaagagaaccacccuucacccuaccuaaccuccccguaaacaaucucucccauagccgaguuauggaaccaauagcacaaaugaugucaucccguaacuucccagcaagcguccaauuccaaaacggccgcugcacccuguccggugaccuucucggcaccacccccucaucccccuccgaccuuggcgccuucgucggacucaucgcagaacccggcucccgugucgucgaacuaucacaacccaaccaagaagacuuccacgcaggcuccgcccccgcacccuucggauuccccgacuucucagacugcucccuaaccuucguaguugcuagcgccaccaccgucggagagcgcaccgucaacgcccgcucaccccaaaacuucacacccgcccuaggccacauaaccuucgaugaagaagcccccgccgaccucuuccgugcccaucuucgcaaccucugggacccaaccgaacacuccuuuuggcgcauccccgacuaccgagccgacguccucggcuccgaguucgcaccauccgucuccgcccccggcgucggagaaacacuacuauucuucaugugcaacguaccccgacucaacggagccaaucccaauccaugccccugucuccugccccaagaauggaucacccacuucgucuccgaacgcgccgcccuucaauccgacgucgcccuccucaacuacgucaaucccaacaccggccgcguacucuucgaagcuaaacucuacgcgaacggcuuccucaccgucaaccucggcgccuccgaccaagcaacccucccugucgacgguauauucaaguuuguaucaugggucucauucuacuaccaacuccgccccgucggcaacgccuccgucggccgucgccucccacgccucgacggauucuaa

SEQ ID NO: 36719 - RNA, 1623 nt, Artificial Sequence
  derived and/or modified sequence opt11 from capsid__Norovirus__ACY00565
augaaaauggcuuccaacgacgcaaaccccucagacggcuccgcugcaaaccuugucccagaagucaacaacgaaguaauggcgcucgagccagucguuggagccgccaucgccgccccugucgccggccaacaaaacguaaucgaccccuggauacgaaacaacuucguccaggcuccuggcggagaguucaccgucuccccaagaaacgcccccggcgaaauccucuggucagcaccacuaggaccugaccucaaccccuaccucucccaccucgcucgaauguacaacggcuacgccggaggcuucgaaguccaaguaauccuggccgguaacgccuucacagccgguaaaauaaucuucgccgccgucccacccaacuuccccaccgaaggccuaucccccucacaagucaccauguucccccacauuauaguagacguacgccaacucgaacccguccucaucccacuccccgacguccgcaacaacuucuaccacuacaaccaauccaacgauucgaccauaaaacuaauagcgaugcuuuacacaccccuccgcgcuaacaacgccggcgaagacgucuucaccgucucgugccgcguacucacccgccccuccccagacuucgauuucauauuccucgucccaccaaccguagaaucccgcacuaaacccuuuacugucccuauccuuaccgucgaagaaaugacuaacucccgauuccccauuccccuagaaaaacucuuuaccgguccauccucagccuucguaguacaaccccaauccggacgauguacaacugacggcguccugcuaggcacuacccaacucucaccagucaacauauguaccuuccgcggcgacgucacgcacaucgccggcucacgcaacuacaccaugaaccucgccagccucaacuggaacaacuacgaccccacugaagaaauccccgcaccgcucggaaccccagacuucgucgguaaaauacaaggaguacuaacucaaaccaccaaaggcgacggcuccacacguggacacaaagccacaguuuacacuggcuccgcccccuucacccccaaacucggcaguguccaauucaguacugacacagaaaacgacuucgaaacccaccaaaacacuaaauucacccccgucggcgucauccaagacggaggcacuacccaccgcaacgaaccacaacaauggguccuaccaagcuacuccggacgcaacguccccaacguccaccuggcccccgcagucgcacccaccuuucccggcgaacaacuccuguucuuccgcuccaccaugcccggcugcuccggcuacccaaauguagaccuagacugccuccucccacaagaauggguccaacacuucuaccaagaggccgcaccagcccaauccgacgucgcccuacuccgauucgucaacccagacacaggccgcguccucuucgaaugcaaacuccacaaaucaggauacguaacugucgcccacacgggccaacacgaccuagucaucccucccaauggcuacuuccgcuucgacuccuggguaaaccaguuuuacacccuugcaccaaugggcaacggcaccgguagacgccgugcccucuga

SEQ ID NO: 36720 - RNA, 1623 nt, Artificial Sequence
  derived and/or modified sequence opt11 from capsid__Norovirus__ACY00568
augaaaauggcauccaacgaugccaaccccuccgacgguucugcagccaaccucguaccggaagucaacaacgaagucauggcccucgaacccguagucggcgccgccaucgccgcccccgucgcuggccaacaaaacgucaucgaccccuggauccgcaacaacuucguacaagcaccaggcggcgaguucacuguuucccccagaaacgcccccggcgaaauucucuggucugccccacucggccccgaccuaaaucccuaccucucccaccucgcccguauguacaacggcuaugccggcggcuucgaaguccaaguuaucuuagccggcaacgccuucaccgcuggcaaaauuaucuucgccgccgucccacccaacuuccccaccgaaggacucagccccucacaagucacaauguuuccccacauaaucgucgacguccgccaacuagaacccgucuuaaucccccucccugacguucgcaacaacuucuaccacuacaaccaaucaaacgacucuaccaucaaacucaucgcaaugcuguacacgccccuccgcgccaacaacgccggcgaagacgucuucaccgucuccugucguguauuaacccgccccaguccagacuucgacuucaucuuccuagucccuccaaccgucgaaucccguaccaaacccuucaccguaccaauccucacagucgaagaaaugaccaauucacgcuuccccauaccacuagaaaaacucuucaccggccccuccagcgccuucguaguccaaccacaaaauggacgcugcaccaccgacggcguacuacuaggaaccacgcaacuaucacccgucaacauaugcacauuccgcggagauguaacacacaucgccgguucccguaacuacaccaugaaccuagccucucuuaacuggaacaacuacgaucccaccgaggaaauacccgcaccccucggcaccccagacuucgucggaaaaauccaaggaguacuuacccaaaccaccaaaggugacggcucaacccgaggacacaaagcuacgguauacaccggcuccgcccccuucacccccaaacucggcuccguccaauucuccaccgacaccgaaaacgacuucgaaacucaccaaaacaccaaauucacccccgucggcgucauacaagacggcucaacuacccaccgaaacgaaccccaacaauggguccucccuucguacucuggccgcaauguccccaacgugcaccucgccccagcuguagcccccacauuucccggcgaacaacuacuuuucuuucgauccaccaugccuggcugcuccggcuaccccaacauggaccuugacugucuccucccacaggaauggguacaacacuucuaccaagaggccgcccccgcacaaucagaugucgcccuccuccgauuugucaaccccgacaccggacgcguacuauucgaaugcaaacuacauaaauccggcuacgucacagucgcccacaccggucaacacgaccuagucaucccacccaacggcuacuucagauucgacucauggguaaaccaauucuauacccucgcccccaugggcaacggaacuggucgacgccgcgcccucuag

SEQ ID NO: 36721 - RNA, 1623 nt, Artificial Sequence
  derived and/or modified sequence opt11 from capsid__Norovirus__ACY00571
augaaaauggccuccaacgacgccaacccuuccgacggaucagccgcgaaccucgucccagaaguaaauaacgaaguaauggcacucgaacccgucgucggcgccgcuauagcagcacccguagccggccagcaaaacgucaucgacccauggauaagaaacaacuucguucaagcccccggcggugaguucaccgucucaccccgcaaugccccaggagaaauccuauggucagccccgcuaggacccgaccuaaaccccaacuuaucccaccucgcccgcauguacaacggauacgccggcggcuuugaaguucaagucauccuagccggcaacgccuucacagccggcaaaaucaucuucgcagccgugcccccaaacuuccccaccgaaggucuaagcccaagccaagucacaauguuuccccacaucaucgucgacguccgccaacucgaacccguccugauuccccuucccgacguccgcaacaacuucuaccacuacaaccagucaaacgacuccaccauuaaacucaucgcaaugcucuacacuccccuacgagcaaauaacgccggcgaagacgucuucaccgucuccugcagaguacucacccgcccaucucccgacuucgacuuuaucuuccucguacccccuaccgucgaaucucgcaccaaacccuucaccguccccauccuuacagucgaggaaaugaccaacucaagauucccaauaccacucgaaaaacucuucacaggaccaucuucagcuuucguaguccaaccucaaaacggccgcuguaccaccgacggcguccuccucggcacaacucaacucucaccggucaacaucugcaccuucagaggugacgucacccauaucgccggcucccgaaacuacaccaugaaccuagccucacuaaacuggaacaacuacgacccaaccgaagaaaucccagcuccccuuggcacucccgacuucgucggcaaaauccaaggcguccucacacaaaccacaaaaggcgacggauccacccgaggccacaaagcaacagucuauaccggcucagccccauucaccccuaagcucggcuccguccaauucuccacagacaccgaaaacgacuucgaaacccaccaaaacacaaaauucacccccgucggcgucauccaagacggcggcaccacacaccgcaacgaaccccaacaauggguccuaccaagcuacuccggccguaacguccaaaacguccaccucgcccccgccgucgcccccacauuuccaggugaacaacuacuauucuuccgcagcaccaugcccggcugcucaggcuacccaaacauggaucucgacugccugcuaccacaagaauggguacaacauuucuaccaagaagcagcaccagcccaaucugacguggcuuuacucagauucgucaaccccgacaccggacgaguccucuucgaaugcaaacuccauaaaucuggauacguaacagucgcccacaccggccaacacgaccucgucauaccacccaacggauacuuccguuucgacuccugggucaaccaauucuauacccucgcacccaugggcaacggaacuggucgcagacgugcccucuaa

SEQ ID NO: 36722 - RNA, 1623 nt, Artificial Sequence
  derived and/or modified sequence opt11 from capsid__Norovirus__ACY00573
augaaaauggccuccaacgacgccaaccccuccgauggcucagccgcaaaccuaguccccgaagucaacaacgaaguaauggcccucgaacccguagucggagcagcaaucgccgcaccagucgccggacaacaaaacguuauagaccccuggauaagaaauaacuuuguucaagcccccggcggagaguucacuguauccccacgcaacgcccccggcgaaauacucugguccgcuccucucggucccgaccuaaacccauaccucucccaccuagcccgcauguacaacggcuacgcaggcggcuucgagguccaagucauccucgcaggcaacgcuuucacagccggcaaaaucaucuuugcagccguuccaccuaauuuccccacagaaggccuaucccccucccaagucacaauguucccccacaucaucgucgauguccgccaacuagagcccguccucauaccccuccccgacguacgcaacaauuuuuaccacuacaaccaaucaaacgacucaaccauaaaacuaaucgccaugcuauacacaccccuccgagccaacaacgccggcgaagacgucuucaccguaucaugcagaguccuuacccgccccucacccgacuucgacuuuauauuucucgucccucccaccgucgaaucacgcaccaaacccuucacagucccaauacucaccgucgaagagaugaccaacucucgauucccaauaccccucgaaaaacucuucacaggccccucuggcgccuuugucguccaaccacaaaacggcagauguaccacagacggcguacuccucggcacaacacagcugucacccgucaacaucugcacauuccguggcgacguaacccacaucgcaggcucccgcaacuacaccaugaaccuagcaucucucaacuggaacaauuacgaccccaccgaagaaaucccagccccucucggcaccccugacuucguaggcaagauacaaggcguacuaacccaaaccaccaagggcgacggaagcacucguggccacaaagccacaguauacacaggauccgcccccuuuacuccaaaacucggauccguccaauucuccacugacaccgaaaacgacuucgaaacccaccaaaacacuaaauucacccccgugggcgucauccaagacggauccaccacccaccgaaacgaaccacaacaauggguccucccuuccuacucuggccgugacguccacaacgugcaccuagcacccgccgucgcaccuaccuuccccggcgaacaacuccucuucuuccgcagcaccaugcccggcugcuccggcuaccccaacauggaccuagacugccuccucccccaagaauggguacaacauuucuaccaagaagcagcccccgcccaaucugacgucgcacuccugcgauucguaaaccccgacaccggccgcguauuauucgaaugcaagcuccacaaauccggcuacgucaccgucgcccacacaggucaacacgaccuagucaucccucccaacggauacuuccgcuuugauuccuggguaaaccaauucuacaccuuagcacccaugggcaacggcacaggacgccgccgagccuuauaa

SEQ ID NO: 36723 - RNA, 1623 nt, Artificial Sequence
  derived and/or modified sequence opt11 from capsid__Norovirus__ACY00576
augaaaauggccagcaacgacgccaacccaagcgacggcuccgccgcgaaucucguccccgaagucaacaacgaaguaauggcccucgaaccggucguuggagccgccaucgccgccccagucgccggccaacaaaacgucaucgacccauggauccguaacaacuucguacaagccccaggaggagaauuuaccguaagcccucgcaacgccccaggcgaaauccucugguccgccccacucgguccugaccucaacccauaccuaucucaucucgcccguauguacaacggcuacgcugguggguucgagguacaagucauccuggccggcaacgccuucacugcaggaaagaucauauucgccgccguaccacccaacuuccccacagaaggucuaucccccucccaagucaccauguucccccacaucauaguagacguccgccaacuagaaccaguucugauaccccuccccgacguccgcaacaacuucuaccacuacaaucaaucaaacgacuccaccaucaaacucaucgccaugcucuacacaccacuucgcgccaauaacgcaggcgaagacgucuucacugucuccugucgaguccucacucgccccucaccagacuucgacuuuaucuuccuuguucccccaaccgucgaaagccgcaccaaacccuucacaguccccauacuaaccgucgaagaaaugaccaacucccgcuucccaaucccucuagaaaaacucuucacaggccccuccuccgcguucgugguacaaccacaaaauggccgaugcaccaccgacggcgucuuacucggcacaacacaacucucaccaguaaacaucugcacauuuagaggagacguaacccauaucgccggcacccacaacuacaccaugaaccucgccucacucaacuggaacaacuacgaucccaccgaagaaauccccgccccacucggcaccccagacuucgucggaaaaauccaaggcguccugacccaaaccacaaaaggcgacggaucaacacgcggacacaaagccacagucuacaccggauccgccccauucacacccaaacuaggauccguccaauucuccacagacaccgaaaacgacuucgaaacacaucaaaacacaaaauucacaccaguaggaguuauccaagacggcaguacaacacaccgcaacgagccacaacaauggguccuacccucauacuccggaggaaacguccaaaacguccaccucgcaccagccgucgcaccaaccuucccaggcgaacaacuccucuucuuccgcucaaccaugcccggcugcuccggcuaucccaacauggaccuagacugccuacucccccaagaauggguccaacauuucuaucaagaagccgcuccagcacaguccgacgucgcccuccuccgauuuguaaaucccgacaccggccggguccuuuucgaaugcaaacuacacaaaucaggauacgucacuguagcacacaccggccaacacgaccuaguaauucccccuaacggcuacucaagauucgaccccuggguaaaucaauucuacacccuagcaccuaugggaaacggcacaggccgccgccgagcacucuaa

SEQ ID NO: 36724 - RNA, 1623 nt, Artificial Sequence
  derived and/or modified sequence opt11 from capsid__Norovirus__ACY00579
augaaaauggccuccaacgacgccaaccccucugacggaagcgcagccaaccucguccccgaagucaacaacgaaguaauggcccuugaacccguagucggcgccgccaucgcugccccagucgccggacaacaaaacgucaucgaccccuggauacgcaacaacuucguccaagcccccggaggcgaauuuaccgucucgccccgcaaugcuccuggagaaauccucugguccgccccacuaggccccgacuuaaaccccuaccucucccaccuagcccgcauguacaacggcuacgcaggcggcuucgaaguccaagucauacuagccggcaacgcauccacagccggcaaaaucaucuucgccgccgucccaccuaacuucccaacggaaggccuauccccuucccaaguaaccauguucccacacauaaucguagacguaagacaacucgaaccuguccuaauaccccuaccugacguccgaaacaauuucuaccacuauaaccagagcaacgacucaaccauaaaacuaaucgccaugcuuuauaccccacuccgcgcaaauaacgccggcgaggacguauucacaguaagcugccgcgugcucacccgccccuccccagacuucgacuuuaucuuccucguuccaccuaccguagaaucucgaaccaaaccauucacaguaccaauccucaccguagaagaaaugaccaacucccgauucccaaucccgcucgaaaaauuauuuaccggucccucauccgcguuuguaguacaaccacaaaacggccgaugcaccaccgacggcguccuucucggcaccacccaacucucaccaguuaacaucugcaccuuccgcggcgacgucacccauaucgccggcacacacaacuacacgaugaaucuagccucucuaaacuggaacaacuacgacccuacagaagaaauccccgcaccccucggcaccccagacuucgucggcaaaauccaaggaguacucacacaaaccaccaaaggagacggcuccacucgcggccacaaagccacgguauacaccggauccgcccccuucacacccaaacugggcuccguccaauucucaaccgacacagaaaacgacuucgaaacccaccaaaauaccaaauucaccccagucggcguaauccaagacggcuccaccacccaccgcaacgaaccccaacaauggguccuacccuccuacuccggcggaaacguccaaaacguacaccucgcccccgccgucgcacccaccuuccccggcgaacaacuacuuuucuuccgauccacuaugcccgguugcucaggcuaccccaacauggaccuagacugccuucucccacaagaauggguccaacacuucuaccaagaagcagcccccgcacaauccgacgucgcccuacuccguuucguuaaccccgacaccggccgugucuuauucgaauguaagcuccacaaauccggcuaugugaccgucgcgcauaccggccaacacgaccuugucauaccaccaaacggauacuuccgcuuugacucaugggucaaccaauucuacacacucgcacccaugggcaacggcacaggacgccgccgcgcccucuaa

SEQ ID NO: 36725 - RNA, 1623 nt, Artificial Sequence
  derived and/or modified sequence opt11 from capsid__Norovirus__ACY00582
augaaaauggccagcaacgacgccaaccccuccgacggaucuguagcuaaccucguuccagaaguaaacaaugaagucauggcccuugaacccguagucggugccgccaucgcagccccagucgcaggacaacaaaacgucaucgacccauggauacgcaacaacuucguucaagcccccggcggagaguucaccgucuccccaagaaacgcaccaggugaaauccucuggucugccccacuaggacccgaucuaaacccauaccucagccaccucgcccgcauguacaacggcuacgccggcggcuucgaaguacaagucauacucgccggcaacgcauucacagccggcaaaauaaucuucgcagcaguucccccgaauuucccuacagaaggucucucccccucacaaguaaccauguucccccacaugauaguagacguacgucaauuagaacccguccucauaccccucccagacguccgaaacaacuuuuaccacuacaaccaauccaacgacuccacaaucaaacucaucgccaugcuauacacaccccugcgcgccgacaacgccggcgaagacgucuucaccguuucaugcagaguccucacacgaccaagcccagauuucgacuucauauuccuaguacccccuaccgucgaauccaaaaccaaaccauucaccguccccauccuaaccgucgaagaaaugaccaacucccgauuccccaucccccuagaaaaacuauucacagguccaucauccaccuucguuguccaaccacaaaacggcagaugcacaaccgacggcguccuccucggaaccacccaacucucacccguaaacaucugcaccuuucgcggugacguaacacacaucgccggcucacguaauuacacaaugaaucucgcaucccuaaacuggaacaacuacgaccccaccgaagaaauacccgcaccccucggcacaccugacuucgucggcaaaauucaaggcguacugacccaaacuacaaaaggagacggauccacucgcggccacaaagccacaguauacaccggcuccgccccauucaccccaaaacucggaucaguucaauucucaaccgauaccgaaaacgacuucgaaacccaccaaaacaccaaauucaccccagucggagucauacaagacgguagcaccacacaccgcaacgaaccacaacaauggguacuacccuccuauucuggacgcaacguccacaacguucaccuagcacccgccgucgccccaacguucccaggcgaacaacuccuguucuuccgcuccaccaugccaggcugcuccggauaucccaacauggaccucgacugccuccucccgcaagaauggguccaacacuucuaccaagaagccgcccccgcucaaucagacgucgcccuacucagauuugucaaccccgacacaggucgcguacuuuucgaaugcaaacuacacaaauccggcuacguaaccguagcacacacaggccaacacgaccucguaaucccgcccaacgguuacucccgcuucgacuccugggucaaccaauucuacacacuagcccccaugggcaacggcaccggccgacgccgcgcccucuaa

SEQ ID NO: 36726 - RNA, 1623 nt, Artificial Sequence
  derived and/or modified sequence opt11 from capsid__Norovirus__ACY00588
augaaaauggccucuaacgacgcaaacccuucugacggcucggcugccaaccuuguaccagaaguaaacaacgaaguaauggcucuagaacccguagucggagcagccauugccgcccccguagccggccagcaaaacgucauagaccccuggauacgcaacaacuucguacaagcccccggcggagaguucaccgucuccccucguaaugcacccggcgaaauucuuugguccgcuccacuaggacccgaccucaaccccuaccuaagccaccucgcccgcauguacaacggcuacgccggaggguucgaaguccaagccauccuugccggcaacgcauucaccgccggcaaaaucaucuucgccgccgucccgcccaacuuccccaccgaaggacuaagccccucccaaguaacuauguucccccacaucauaguagacguccgccaacuagaaccaguucuuaucccucuccccgaugucagaaacaacuucuaccacuacaaccaauccaacgacagcaccaucaaacuuaucgcuaugcuauacacaccccuacgcgccaacaacgccggcgaagacgucuucacggucucuugccgcguacucacucgccccucaccagauuuugacuucaucuuccucguacccccaacggucgaaucacgaaccaaacccuuuaccguccccauccuaaccguggaagaaaugaccaacucacgcuucccaaucccacucgaaaaacucuucaccggacccucaucagccuucguaguacaaccccaaaacggcagaugcaccaccgacgggguccuccucggcacaacccaacuauccccugucaacaucugcaccuuccgaggagacguaacccacaucgccggaucccgcaacuacacaaugaaccuagccagccucaacuggaacaacuacgaccccacugaagaaauacccgcaccccugggaacaccugacuucgucggcaaaauccaaggcguacuuacccagaccaccaaaggagacggaucaacccgcggucacaaagccaccgucuacacuggcuccgcccccuucacccccaaauuaggcucgcuacaauucucgacagacaccgaaaacgacuucgaaacacaucaaaacacaaaauucacccccguuggagugauccaagacggcggcaccacccaccgaaacgaaccccaacaauggguccuccccuccuacuccggccgcaacguaccuaacguucaccuugcccccgccguugcccccaccuuccccggggaacaacuacuauucuuccgcucaaccaugcccggcugcucuggcuaccccaacauggaccucgacugccuccucccccaagaauggguacaacacuucuaccaagaagccgcuccagcccaauccgacgucgcccuccuccgcuucgucaaccccgacacgggccgcguccucuucgaaugcaaacuccacaaaucaggcuacgucaccgucgcucacaccggccaacacgaccucgucaucccacccaacgguuauuucagauucgacuccugggucaaccaauucuacacacuggcccccaugggcaacggcaccggccgccgccgagcccuauag

SEQ ID NO: 36727 - RNA, 1623 nt, Artificial Sequence
  derived and/or modified sequence opt11 from capsid__Norovirus__ACY00594
augaaaauggcaucaaacgacgccaaccccuccgacggauccgcugccaaccuuguaccagaagucaacaacgaagucauggcccuagaaccaguuguuggcgcagccauagccgccccagucgcaggccaacagaaugucaucgacccuuggauacgaaacaacuuuguacaagccccuggcggcgaauuuacagucucaccucgaaaugcacccggcgaaauacucugguccgccccacucggccccgaccuaaaccccuaucucucccaccucgcccgcauguacaacggcuacgccggcggcuucgaaguccaagucauccucgccggaaacgccuucaccgccggcaaaauaaucuucgccgcaguacccccaaacuucccaaccgaaggccuaucacccucacaagucaccauguucccccacauuaucgucgacguccgccaacuugaacccguacucaucccacuuccggacguccgcaacaacuucuaccacuacaaucaacccaacgacuccaccauaaaacucauagcaaugcucuacacaccccuccgcgcaaacaacgcaggcgaagacguuuucacggucuccugccgcguccucacccgcccaucgccugacuucgacuucaucuuccucguaccacccaccgucgaaucccggacaaaacccuucaccguccccauacuuaccgucgaagaaaugacaaacucccgauuccccaucccccucgaaaaacuauucaccggacccucuuccgccuucguaguacagccccaaaacggccgcugcaccaccgacggcgucuuacuaggaaccacacaacuuucccccgucaauaucugcacauucagaggcgacguaacccacauagccgggucccgcaauuacaccaugaaucucgccucccucaacuggaacaacuacgaccccaccgaagaaaucccagcaccacuaggcacccccgacuucguuggcaaaauacaaggcguccucacccaaaccaccaaaggcgacggcaguacccacggccacaaagcuaccgucuacaccggcuccgcccccuuuacccccaaacuuggauccguacaauucucaaccgacaccgaaaacgauuucgaaacacaccaaaacacgaaauucacccccgucggcguaauccaagacggauccaccacacaccgaaacgaaccccaacaauggguacugcccucuuacuccggccgcaauguacaaaacguacaccuugcacccgccguagcacccaccuuccccggugaacagcuccuauucuuccgaagcaccaugcccggcugcucaggcuaccccaacauggaccucgacugccuccucccucaagaauggguccaacacuucuaucaagaagccgcccccgcccaaucugacgucgcacuccuccguuucguaaaccccgacaccggccgcguccuuuucgaaugcaaguuacauaaauccggcuacgucacggucgcacacaccggccaacacgaccucguaauacccccaaauggcuacuuccgcuucgacucauggguaaaccaauucuacacccuagcucccaugggaaacggaacaggccgcagacgagcccucuaa

SEQ ID NO: 36728 - RNA, 1623 nt, Artificial Sequence
  derived and/or modified sequence opt11 from capsid__Norovirus__ACY00597
augaaaauggccagcaacgacgcaaacccuagcgacggcuccgccgcaaaccuaguccccgaagucaacaacgaaguaauggcccuugaacccgucgucggcgccgcuauagccgcccccgucgcgggacaacaaaacguaauagacccauggauccgcaacaacuuuguccaagccccaggcggagaguucacagucucaccccgcaacgcccccggagaaauauugugguccgccccacuuggaccugaucuaaacccuuaccuaucccacuuagcacgcauguacaacggauacgcaggcggauucgaaguacaaguaauacucgccggcaacgccuucacggccggcaaaauaaucuucgccgcagucccucccaacuuccccaccgaaggccuaucccccucacaagucacaauguucccccacaucaucgucggcguccgacaacuagaacccguccucauaccacucccugacguccggaacaacuucuaccacuacaaccaauccaacgacucaaccauaaaacuuaucgccaugcucuacaccccacuacgagcgaacaacgccggugaagacgucuucaccguuuccugccgcgucuuaacucgccccucccccgauuucgacuucaucuuccugguuccucccaccguagaaucccguaccaagcccuucacuguccccauccucacaguagaagaaaugaccaacucacgcuucccaauaccccucgaaaaacucuucacaggcccauccagcgcauucgucguacaaccccaaaacggcagauguaccacagauggcguccuacucgguacuacacaacucuccccagucaacaucugcaccuucaaaggagacguuacccacaucgccggcucccguaacuacaccaugaaccucgcaagccucaacuggaacaauuacgacccaaccgaagaaauaccagcaccucucggcacucccgacuucgucggcaaaauacaaggaguacuuacucaaaccaccaagggcgacggcucaacacguggucacaaagccaccguauacaccggcuccgcacccuucacccccaaacuagguuccguccaauucuccacagauacagaaaacgacuucgaaacccaccaaaacacaaaguucacgcccguuggcgucauacaagacggcgguacaacccauagaaacgagccccaacaauggguacuuccauccuacagcggaagaaacguacaaaacguacaccucgcccccgccgucgcccccacauuccccggagaacaacuccucuucuuccgauccaccaugccuggcugcucuggauaccccaacauggaccucgacugccuacucccacaagaauggguccaacacuucuaccaagaagccgccccagcacaaucagacgucgcacuccuccguuucgucaaccccgacacaggccgaguccuuuuugaaugcaaacuccacaaaucaggcuaugucacugucgcacacaccggccaacacgaccucgucaucccacccaacggauacuuccguuucgacuccugggucaaccaauucuacacccuagcaccuaugggcaacggcaccggccgucgacgagcccucuaa

SEQ ID NO: 36729 - RNA, 1623 nt, Artificial Sequence
  derived and/or modified sequence opt11 from capsid__Norovirus__ACY00600
augaaaauggccuccaacgacgccaacccuuccgacggucccgcugccaaccucguacccgagguaaauaacgaagucauggcccucgaacccgucguuggcgcugccaucgccgccccuguagccggccaacaaaacguaaucgaccccuggauccgaaacaacuucguccaagcucccggcggugaguuuaccguuucaccccgcaacgcacccggcgaaauccucugguccgcaccccuuggaccugaccucaacccauaccucucccaccucgcacgaauguacaauggcuacgccggcggauucgaaguacaaguaauccucgccggcaacgccuucacagcuggcaaaaucaucuucgccgccguaccucccaacuucccuacugaaggacucucccccucucaaguuacaauguucccccacauaauagucgacguacgccaacucgaacccguucuaaucccccuaccagacguccgcaacaacuucuaccacuacaaccaauccaacgacucgaccauaaaauuaaucgccaugcucuacacuccccuaagagccaacaaugccggcgaagacgucuucaccgucuccugccgcguccuaacccgccccagccccgacuucgacuucaucuuucuaguaccucccaccgucgaauccagaaccaaacccuucaccgucccaauacuaaccgucgaagaaaugaccaacucccgcuuccccaucccacucgaaaaacucuucaccggucccuccuccgccuucgucguacaaccccaaaacggccgcugcacaacagacgguguacuacucggcacaacccaacuauccccagucaauaucugcacauuccgcggcgacguuacacauaucgcuggcucauccaacuacacaaugaaccuugcaucgcucaauuggaacaacuacgaucccacagaagaaauccccgccccacucggcaccccugacuucgucggcaaaauacaaggcguccucacccaaaccacaaaaggagacggauccacacgcggacacaaggcaaccgucuacacaggaucggccccuuucacaccaaaacuaggcagcguccaauucuccaccgacacccaaaacgacuucgaaacccaccaaaacaccaaauucacacccguuggcguuauccaagacggcggaaccacccaucgcaacgaaccucaacaauggguccuccccucuuauucuggaagaaacguacagaacguccaccuagccccagccgucgcaccaaccuuuccaggcgaacaacuccucuucuuccgcuccaccaugcccggcugcuccggcuacccaaacauggaccucgacugccuccuaccacaagaauggguccaacacuucuaccaagaagccgcacccgcccaauccgacguggcacuccuacgcuucgucaaccccgacaccggacgcguccuuuucgaaugcaaacuacacaaaucacgauacgucacugucgcccacacuggccaacacgaccucguuauuccaccuaacggcuacuuccguuucgacuccuggguaaaccaauucuauacacuagcuccaaugggcaacggcaccggccgucgacgcgcccuauaa

SEQ ID NO: 36730 - RNA, 1623 nt, Artificial Sequence
  derived and/or modified sequence opt11 from capsid__Norovirus__ACY00603
augaaaauggccucgaaugacgccaacccuucagacggcuccgccgccaaccuaguccccgaagucaacaacgaaguaauggcccucgaacccgucguaggugcagccauugcagcacccgucgccggccaacaaaacgucaucgaccccuggauacguaacaacuucguacaagcucccgguggagaauuuacagucucaccuagaaacgccccuggagaaauccuaugguccgcaccccuagggcccgaccucaacccauaccuaucacaccucgcccgcauguauaacggcuaugccggcggguucgaaguccaaguaauccuagccggcaacgcccucacagcuggcaagauaaucuucgccgccgucccacccaacuuccccaccgaaggacuuucccccucacaagucacgauguucccccacaucaucgucgacguccgccaacucgaacccguacucaucccgcuaccugacguucgcaacaacuucuaccacuacaaccaaucaaacgacuccacaaucaaacucauagccaugcuuuacacaccuuuacgcgcuaacaacgccggagaagacgucuucaccgucucaugccgaguccuaacacguccaucccccgacuucgacuucaucuuccucguaccucccacaguagaaucccgcacuaaaccauucacuguacccauccuaaccguagaagaaaugacaaacucacgcuuccccaucccccucgaaaaacuauucaccggccccuccuccgcuuucgucguacaaccacaaaacggacgcugcaccaccgacggcguccuccucggcacaacccaacucucacccgucaacauaugcacguuccgcggagacguaacacacaucgccggaucacgcaacuacacaaugaacuuagcuuccuuaaacuggaacaacuacgaccccacugaagaaauaccagcaccccucggcacucccgacuucguagguaaaauccaaggcgucccaacccaaaccacuaaaggagacggauccacacgcggucacaaagccaccgucuacacuggcuccgccccauucacccccaaacucggcucuguccaauucagcacagacaccgaaaacgacuucgaagcccaucaaaacacaaaauucacccccgucggcgucauccaagacggaggcaccacccaccgaaacgaaccacaacaauggguccuacccucuuacuccggacgcaauguccccaacguacaccuggccccagcagucgcccccacauuccccggcgaacaacuccuauucuuccgcucaaccaugcccggcugcucaggauaccccaacauggaccucgacugccuacucccccaggaauggguccaacacuuuuaccaagaagcagcccccgcacaauccgacgucgcccuccuccgcuucguaaaccccgacacaggccgcguccucuucgaaugcaaacuucacaaaucuggauacguaacaguagcucacaccggccaacacgaccuaguuaucccaccaaacggcuacuuccgauucgacuccugggucaaccaauucuacacccucgcacccaugggaaacggcacugggcgacgacgcgcacuauag

SEQ ID NO: 36731 - RNA, 1623 nt, Artificial Sequence
  derived and/or modified sequence opt11 from capsid__Norovirus__ACY00606
augaaaauggcuuccaacgacgccaaccccuccgacggcucagcagcaaaccuaguaccagaggucaacaacgaaguaauggcccucgaacccguaguaggagccgccaucgcggcucccgucgccggccaacaaaacguaaucgaccccuggauccgaaacaacuucguccaagccccaggcggagaguucaccgucuccccacgaaacgcccccggcgaaauccucugguccgccccacuaggacccgaccuuaaccccuaccucucacaccucgcccgaauguacaacggcuacgccggcggcuucgaaguccaaaugauccucgcgggcaacgccuucacagcaggcaaaaucaucuucgccgccgucccaccaaauuucccuacagagggccucucacccucacagguaaccauguuuccccacaucauaguagacguccgacaacuagagccaguccuaaucccccuccccgacguccgaaacaacuuuuaccacuacaaccaauccaacgacucgaccaucaaacucaucgccaugcucuacacaccccuccgagcgaacaacgcaggagaagacguauuuaccgucuccugcagaguucucacccgcccuucacccgacuucgacuucaucuuccucguaccaccaaccgucgaaucccgcaccaagcccuucaccguaccaauccuuaccguagaagaaaugaccaacuccagauuccccaucccccuagaaaaacuauucaccggccccuccagugcuuucgucguccaaccacaaaacggccgcugcaccaccgacggcguacuccuuggcaccacccaacuaucaccaguuaacauaugcacauucagaggcgacgucacacacaucgcaggcucacgaaacuacaccaugaaccuagccucgcucaacuggaacaacuaugacccaaccgaagaaaucccagcgccacuaggcacacccgacuucgucggcaaaauccaaggcguccuaacccagacaaccaaaggagacggcuccacacgcggccacaaagccacaguauacaccggcuccgcccccuucacgcccaaacucggcuccguccaauucuccaccgacacagaaaacgacuuugagacccaccaaaacacaaaauucacccccguuggcgugauacaagacggcggcaccacccaccgcaacgaaccacaacaauggguacuaccuucguacuccggcagaaacgucccaaacguacaucuagcccccgccgucgcccccaccuucccaggcgaacaacuccuauucuucagauccaccaugcccgguugcucuggcuaccccaacauggaccuagacugccuacucccccaagaauggguucaacacuucuaucaggaggccgcacccgcccaaagcgacgucgcccuacuccgcuucgucaacccagauaccggacgcguccuauuugaaugcaaacuacacaaaagcggcuacgucacgguagcccauaccggacaacacggacucgucauacccccgaacgguuacuuccgcuucgacuccugggucaaucaauuuuacacccucgcccccaugggcaacggcacaggccgccgacgcgcccuauaa

SEQ ID NO: 36732 - RNA, 1623 nt, Artificial Sequence
  derived and/or modified sequence opt11 from capsid__Norovirus__ACY00609
augaaaauggcauccaacgaugccaaccccucagacggcucagcagccaaccuagucccagaagucaacaacgaagucauggcucucgaacccgucgucggcgccgcuauagccgcaccaguagccggacaacaaaacguaaucgaccccuggauccgaaacaacuucguccaagccccagggggcgaauuuaccguauccccacguaacgcccccggcgaaauacuaugguccgcaccccucggucccgaccucaaccccuaccucucacaccuugcacgcauguacaacggcuacgccggugguuucgaaguacaagucauacucgccggcaacgcauucaccgccggcaaaaucauauucgccgccgucccacccaacuuccccaccgaaggccucucccccucccaagucaccauguucccccauaucauugucgacguccgacaacucgaacccguccuaauccccuuacccgacguccgaaacaacuucuaucacuacaaccaauccaacgauuccaccaucaaacuaaucgccaugcucuacacaccccuccgcgcaaacaacgcgggcgaagaugucuucaccguuucaugccgcguacucacgagacccucacccgacuucgacuuuaucuuccucguuccucccaccguagaauccagaaccaaacccuucacuguacccauccucacggucgaagaaaugaccaacucucgcuuccccaucccccucgaaaaacuauucaccgaucccuccuccgccuucguuguacaaccacaaaacggacgaugcaccaccgacggcguucuccucggaacaacccaacucucccccgucaacauauguaccuuccgcggcgacgugacucacaucgccggaucccgcaacuauaccaugaaccuagccucacuaaacuggaacaacuacgaccccaccgaagaaauacccgcuccccucggcacaccagacuucgucgguaaaauacaaggaguauugacccaaacaaccaaaggcgacggcuccacacgaggccacaaagccacagucuacaccggaucugcccccuucacccccaaacuuggaucuguccaauucuccacugacaccgaaaacgacuucgaaacccaccaaaacaccaaguuuacccccguaggcgucauacaagacgguggcacgacccaccguaacgaaccccagcaauggguccuccccucuuacucaggacgcaacguccccaacguccaccuugcaccagcaguugcccccacauuccccggagaacaacuccucuuuuuccgaucuaccaugccaggaugcuccggcuaccccaacauggaccuagacugcccucucccccaagaauggguccaacacuucuaccaagaagccgccccagcacaauccgacguggcacuccuacgcuucgucaaccccgacacuggccgaguccuauucgaaugcaaacuacacaaaucaggcuacgucacagucgcccacacgggccaacacgaccucguaauaccaccuaaugguuacuuccgcuucgacucaugggucaaucaauucuacacucuugccccaaugggcaacggcaccggccgucgcagagcacucuaa

SEQ ID NO: 36733 - RNA, 1623 nt, Artificial Sequence
  derived and/or modified sequence opt11 from capsid__Norovirus__ACY00612
augaaaauggccuccaacgacgcaaaccccuccgacggaucagcagcuaaccugguccccgaagucaacaacgaaguuauggcccucgaacccgucgucggcgcagcuaucgccgcaccagucgccggccaacaaaacgucaucgaccccuggauccgcaacaauuucguccaagcccccggaggagaauuuacaguaucgccccgcaacgcccccggcgaaauccuaugguccgcaccccuaggccccgaccucaaccccuaccucucccaccucgccagaauguacaacggcuacgccggcgguuucgaaguccaaguuauccuagccggcaacgccuucacagccggaaaaaucauauucgcagccguaccuccuaacuucccuaccgaaggacucuccccuucccaaguuaccauguucccccacaucaucguagacguccgccaacucgaaccgguccuuaucccccuccccgacguccgcaacaacuucuaccacuacaaccaaucaaacgacucaaccauaaagcuaaucgcaaugcuguacacaccccuucgcgccaacaacgccggugaagacguauucaccgucuccugccgcgucuuaacccggcccuccccugacuucgacuuuaucuuccuggucccaccaaccgucgaaucacgaaccaaacccuucaccguaccaauccucaccgucgaagaaaugacaaacucacgcuuccccaucccccucgaaaaacucuucaccggacccuccuccgccuucgucguccaaccacaaaacggccgaugcacaacugacggaguccuccuaggcacaacccaacucucgcccguaaacauuuguaccuuccgcggagacgucacccacaucgccggcucccgcaacuacacgaugaaccucgccucacuaaacuggaacaacuacgaccccacagaagaaaucccagcgccccuuggaaccccagacuucaugggcaagauccaaggcguccucacccaaaccaccaaaggcgacggcucuaccagaggacacaaagccacugucuacaccggcagcgcccccuucacccccaaacucggcucaguccaauucuccaccgacaccgaaaacgacuucgaaacacaccaaaacaccaaauucacacccgucggcgugauccaagacggcggcaccacucaccgcaacgaaccgcaacaauggguccuccccucauacuccggacgaaacguacccaauguacaucuagccccagcaguagccccaaccuuccccggagaacaacuccucuucuuccgcucuacaaugccaggcugcucaggauauccaaacauggaccuagauugccuccucccccaagaauggguccaacacuucuaccaagaagcagcccccgcacagucagacgucgcccuucugcgcuucguuaauccugacacuggacgcguucuauucgaaugcaaauuacacaaauccggauacguaacugucgcacacaccggacaacacgaccucgucaucccacccaacggauacuuccgcuucgacuccugggucaaccaauucuacacucucgcccccaugggcaacggaaccggccgccgacgcgcccucuaa

SEQ ID NO: 36734 - RNA, 1632 nt, Artificial Sequence
  derived and/or modified sequence opt11 from capsid__Norovirus__ACY00615
augaugauggcaucuaaggacgcccccacaaacauggacgggacaagcggagcaggccaacucguucccgaagcaaacaccgcagaaccccuacccauaaaacccguugcgggcgcagcgacagccguagccaccgccggccaaguaaacaugaucgaccccuggaucaugaacaacuuuguccaggccccacaaggugaauucacaauuucgcccaacaacacaccaggggacauccucuucgaccuacaacuaggaccacaccucaacccguuccucgcccaccucucccgcauguacaacggauggguaggaaacaugcaaguccgcauaaugcuugcaggcaacgccuucuccgcuggcaaaaucaucgucugcugcauccccccaggcuucucuucacaaucaaucagcauagcacaggccacaauguucccucacgucaucgccgacguccguguccucgaacccauagacguaccccuugacgacguacgcaacguccucuuccacaacaaugacaacccccaaaccaugcgccuccucugcaugcucuacaccccccuucgcuccggaggcacauccucgggcacagacccauucgucaucgccggcagaguccugacaugcccuacacccgacuucucguuccucuuccuagucccacccgauaucgaacagcgcaccaagcccuucuccguacccaacauacccaugaaccuuaugucaaacuccagagucuccaugcuaaucgauggcaugauggucagcaacgaccaaaaccaaguaccacaauuucaaaauggccgcgucacccucgacggccaacuccaggacaccacaaccgucuccgccgccugcguugcccgcaugcgcggccgcauauucaacaacaacggaaacuacggggucaaccuaacagaauuagacggaaacccauaccacgccuucgacaguccagccccccuuggauuccccgacuucggcaacugcgaccugcauaugaccuucgucaaaaucaacccuaacgaacucucauccggcgacccaucaggcaaagucguuauccacuccuacgacgcaacuuucgcaccacaccucggcacugucaaacuagaaaacgacgacgaacucgcccgauucgucggcaaagaaguaguccucgaacucaccugggucuccaaccgagaaggagccacacucaaccucugggcagucccaaacuacggcucgucccucacacaagccagccaacuagccccaccaaucuacccccccggauucggcgaagccaucguauacuucaccucaaccuucccaaccgucuccaaccccaaaguccccugcacccuaccccaagaauucgucucacacuucgucaacgaacaagcuccaaccagaggcgacgccgcccuccuacauuacguggaccccgacacacaccguaacuuaggcgaauucaaaauguaccccgaaggauacaugacaugcgucccaaacgcaggcggaggaccacaaacacuaccaaucaacggaguauucgucuucauuucguggguaucacgcuacuaccaacucaaacccgucggcacagccggagccgcacgucgccucgguuuacgccgcagcuaa

SEQ ID NO: 36735 - RNA, 1623 nt, Artificial Sequence
  derived and/or modified sequence opt11 from capsid__Norovirus__ACY00618
augaugauggccagcaaagacgcacccaccucacccgacggcgccucaggcgccgggcaacucguacccgaagcuaacaccgccgaacagaucucaauggaccccgucgccggagcuucaacugccgucgccaccgccggccaagucaauauggucgacccuuggauauucaauaacuucguccaagcaccacaaggcgaauucacuauaucccccaauaacaccccaggcgauauucucuucgaccuacaacucgguccacaccuuaacccguuccucgcccaccucucccaaauguacaacggcugggucggcaacaugagaguccguauccuccucgccggcaaugccuucacagccggcaaaaucaucaucugcugcguucccccaggcuucgacgcacgcauccuaacaaucgcccaagccacccucuucccacaccucaucgcagacguccgcacccuagaacccgucgaacucccccucgaagacguacgaaacguccucuaccauaacagcucccaaccacaacccaccaugcgccuagucgcaaugcuuuacaccccacuccgcaccggcggcggcuccggagguacagacgccuucguagucgccggaagaguacucacaugcccugcccccgacuucuccuuccucuuccucguccccccguccguagaacaaaaaacucgagucuucucagucccuaacauuccacuuaaagaccuaucgaacucacguguaccuguacccauacaagguauguucauguccccagacgucaaccaauccguacaauuccaaaacggccgcugccaaaucgacggccaacuacaaggaaccacccccguuucccuaagccaacucugcaaaauaagaggcaaaaccuccucaaacgcucgcguacucaaccuaucagaagucgacggaaccccauucauccccuuagaaucaccagcccccgucggcuuccccgaccuaggcggaugcgacuggcacgucaacuucacauuccaaacccaagaucgcgacccaucucaauccgucaccuucgccaccaacgacgccucauucguaccauaccucggcuccgucagcccccacaacggcgaaggcuuccaagccggugacauuauaggcucccuagguuggauuuccgccccauccgacaacucccaauucaaugucugggcaauccccaaauacggcuccucccuccccgacguaacacaccuagcccccgccgucuucccaccaggauucggcgaagucauccucuacuucuauucuaccuucccaggcuccggacaaccaucccaacuccaaguccccugccugcucccccaagaauucauaacacacuucugcaaugaacaagcccccauagcuggcgaagccgcccuauuacacuacguggaccccgacaccggcagaaaccuaggagaauucaaacucuaccccgacggcuucaugaccugcguccccaacuccgucuccuccggcccacaaacacuccccaucaacggcgucuuugucuucgucagcugggucucacgcuucuaccagcuaaaacccgucggcacugcauccgccgcccgccgccucggccuccgccgcauauaa

SEQ ID NO: 36736 - RNA, 1623 nt, Artificial Sequence
  derived and/or modified sequence opt11 from capsid__Norovirus__ACY00621
augaugauggcaucaaaagacgccccaaccucccccgacggcgcuucuggcgccggccaacucgucccugaagcaaacacagcagaacaaaucucgauggaccccgucgcaggcgccuccaccgccguugcaacagcaggacaagucaacaugauagaccccuggaucuuuaacaacuucguccaagcaccacaaggagaguucaccaucucacccaauaacacccccggcgauauacucuucgaccuccaauuaggaccccaccugaaucccuuucuagcacaucuaagccaaauguacaacggcugggucggcaacaugcgcguccgaauccuacucgccggcaacgccuucacagcuggcaaaaucaucaucugcugcgucccucccggcuucgacgcucgaauccucacaaucgcccaggccacccuguucccccaucuaaucgccgacguacgcacccuugaaccuguagaacuuccccucgaagacguucgcaacguccucuaccacaauucaucacaaccacaacccaccaugcgccucgucgcgaugcucuacaccccucuacggacuggcggcggcuccggcggcaccgacgccuuugucguugccggccgcguccuaacaugcccagcccccgacuucucuuuccuauuccugguacccccauccgucgaacagaaaacccgcgucuucucuguucccaacauaccacuaaaagaucucuccaacucccgaguaccagucccaauccaaggcauguucaugagcccugauguaaaccaaucaguccaauuccagaacggacgaugccaaaucgacggccaacuccaaggcaccacccccguaucccuuucccaacucugcaaaaucagagguaaaaccuccuccaacgcccgaguucucaaccucuccgaaguugacggcacccccuucaucccccuagaaucacccgccccaguuggcuuccccgaccucggaggcugcgacuggcacgucaacuucacauuucaaacacaagaccgcgacccuucucaauccgucacauucgcaaccaacgacgccucuuucgucccauaccucggaucaguuuccccucauaacggagaaggauuucaagcaggcgauaucauuggaucccuaggcuggaucuccgcccccuccgauaacucccaauucaacgucugggccaucccuaaauacggauccucccuccccgacgucacccaccucgcucccgccgucuucccaccaggcuucggcgaagucauacuauacuucuacuccaccuucccuggcucaggccaaccaucccaacuccaaguaccaugccuacuaccccaagaguucaucacccacuucugcaacgagcaagcccccaucgccggcgaggcugcccuacuccacuacgucgacccagacaccggcagaaaucuaggcgaguucaaacucuaccccgacggcuucaugacaugcguaccuaacucaguaucaucaggaccacaaacccuccccauaaacggcgucuucguauucgucucauggguaucccgcuucuaccaacuaaaaccagucggcaccgccucagccgcccgacgacucggccuucgcagaaucuaa

SEQ ID NO: 36737 - RNA, 1611 nt, Artificial Sequence
  derived and/or modified sequence opt11 from capsid__Norovirus__ACY00623
augaaaauggcaucaaaugacgccacccccuccgacgacggagccgcaggccucgucccaggcauuaacuccgaagucauggcacucgaacccguugcaggcgccucaauugcugcccccgucgucggccaacaaaacaucaucgacccauggauucguaacaacuuuguccaagcacccgccggcgaauuuaccgucucaccccgcaacuccccaggcgaacuucuccucgaccuugaacucggccccgaauuaaaccccuaccuagcgcaccuugcucgaauguacaacggacacgccggcggcauggaaguucagaucguacucgcaggcaacgccuucaccgcaggagaaauccucuucgcagccaucccacccuccuuccccuacgaaaaccucucccccgcccaacuaacaauguguccucacgucaucguugauguccgccaacuagaacccguacuccuucccaugccagacauccgaaacguuuucuaccauuacaaccaaaacaauagccccaaacuacgccuagucgccaugcuauacacaccccuccgagcuaacaacuccggagaugauguauucacagucuccugccgagugcucacacgcccgucacccgacuuccaauucaccuuccucgucccacccaccguugagucaaaaaccaaaaacuucacucuacccguccuucgcgucuccgaaaugacaaacucccgcuuccccgucguccucgaucagauguacaccucccguaacgaaaacauuaucguccagccucaaaacggccgaugcacaaccgacggcgaacuccuuggcacuaccauccuccaauccgucuccaucugcaacuucaaaggcaccaugcaagcaaaacuaaacgaagaaccccgauaucaacuacaacucacaaaccuagacggcucacccaucgaccccaccgacgacaugcccgcgccccucggaacacccgauuuccaggccaugcucuacggcgucgcaucccaacgguccuccacagacaacgccacccgagcacacgaugcccaaauugauacagcaggcgacaccuucgcccccaaaaucggacagguccgcuucaaauccuccucuaacgacuucgaccuccaugaccccaccaaauucaccccaaucggcguuaacgucgacgaccaacaccccuuucgacaauggucccuucccaacuacggcggccaccucgcucucaacaaccaccucgcacccgccgucacuccccucuucccaggcgaacagauacuuuucuuccgcuccuauauaccuagcgcuggaggccauaccgacggcgcaauggacugccuccucccccaagaauggguagaacacuucuaccaagaggccgcgccgucucaaucagacaucgcccucguccguuucaucaacccagacaccggccgaguacuuuucgaagcaaaacuccauaaacaaggcuuccucacuaucgcugcuuccggcgaucacccaaucgucaugcccaccaacgguuacuuccgcuucgaagccugggucaaccccuucuacacccuagcccccguaggcaccggcuccggucgccgccgaauccaguaa

SEQ ID NO: 36738 - RNA, 1647 nt, Artificial Sequence
  derived and/or modified sequence opt11 from capsid__Norovirus__ACY00629
augaaaauggcauccaucgacgcagccccauccaacgacggcgccgccggacucguacccgaaaucaacaacgaagccauggcccucgacccagucgcaggcgcagccaucgcagcgccccucacaggccaacaaaauaucauagaccccuggauaaugaacaacuucguacaagcccccggaggagaguucaccgucucuccccgaaacucucccggcgaaguccuacucaaccucgaacucggucccgaaaucaaccccuaccucgcucacuuagcccguauguacaacggcuucgcgggcggcuucgaaguacaaguuguucuugccggcaacgcauucacagcaggcaaaauaauauucgccgccaucccacccaacuuccccauugacaaccuaucagcugcucaaauaaccaugugcccccacgucaucguggauguuagacaacucgaacccgucaaccuccccaugcccgacguccgcaacaacuucuuccacuacaaccaaggcuccgauuccaaacuacgccucgucgcaaugcuauacaccccucuucgcgcaaacaacucaggagacgacgucuucacugucucaugccgcguccucacacgaccuuccccagacuucucauucaauuuccucguuccaccuacugucgaaucaaaaaccaaaccauucacccucccaauccucaccaucuccgaaauguccaauucccgcuucccaguucccaucgacucacuccacacaagccccaccgaaaacauagucguacaaugccaaaacggccgcguaacucuugacggugaacucaugggcaccacgcaacuacuccccucacaaaucugcgccuuccguggcguccucacucgcuccacaagccgugccuccgaccaggccgacaccgcaacaccccggcuuuucaacuacuacuggcacauccaacuagacaaccugaacggcaccccauacgaccccgcugaagacauccccgguccccucggcacgcccgacuucagaggaaaagucuuuggcguagccucccaacgcaacccagacuccaccacccgagcacacgaagccaaagucgacacaaccgccggccgauucaccccaaaacucggcucccuggaaauauccacugaauccgacgauuucgaccaaaaccagcccacccgcuucaccccagucggcaucggcgucgaccacgaagccgacuuccaacaauggucccucccagacuacuccggccaguuuacacauaacaugaaccucgcacccgccguagccccaaacuuccccggagaacaacuacucuucuuccgcucccaacucccuucauccggcggccgauccaacggcauucucgacugccucguaccccaagaauggguccaacacuucuaucaagaaagcgcaccagcccaaacacaagucgcccucguacgcuacgucaacccagacaccggcagaguccucuucgaagccaagcuccacaaacucggcuucaugaccaucgccaaaaacggcgacuccccaaucaccguaccacccaacggauacuucagauucgaguccugggucaaccccuucuacacccuaguccccaugggaaccggcaauggccgccgccgcauccaauaa

SEQ ID NO: 36739 - RNA, 1614 nt, Artificial Sequence
  derived and/or modified sequence opt11 from capsid__Norovirus__ACY00632
auggcaucaaacgacgccgcccccuccaacgacggcgcuacaggccuaguccccgaaaucaauaccgaaacucucccccuagaacccgucgcaggagccgcaaucgcagccccaguaaccggacagaacaacauaaucgaccccuggauacgcaacaacuucguccaagcacccaacggagaguucaccgucuccccacgcaacuccccaggcgaaauccucaugaaccuugagcuuggacccgaccuaaacccauaccucgcccaccucucccgcauguacaacgguuacgccggcggcguugagguacaaguccuccucgcuggcaacgccuucacagcaggaaaaauacuguuugccgccguaccacccaacuuccccgucgacaugcuuucacccgcccaaauuaccaugcuuccucaccucauagucgauguucgaacccuugaaccaaucaugaucccccuccccgacguccggaacguauucuaucacuucaacaaccaaccagcaccacgaaugcgccucgucgcaaugcucuacaccccgcuccgauccaacggcuccggugacgacgucuucaccguauccugccgcguacucacccgcccaaccccugacuucgaguucacauaccuaguacccccaucagucgaauccaagacuaaacccuucacgcuacccauccucaccauaggcgaacuuaccaauagccgguucccugccccaaucgaccaacuauauacaucucccaaugccgacaucgucguccaaccccaaaacggucgcugcacucucgacggcgaacuccaaggcaccacacaacuccuaaccacagccaucugcuccuaccgcgggaugacuuccaaccccaccagugacuacugggaugaccaccuacuccaccucguccacccaaacggugccacauacgaccccaccgaagacguaccagcacccuucggcacccaagacuucagagguauacuguacgguaugcuuacccaaaaccccagaacaagcggagaugaagccgcaaacucccacggcaucuacaucuccuccaccucagaaaaauucaccccgaaacucggcacuaucggccuccaccaaguccaaggccgacacucccaacaccaacaauccaaauucacacccgucggcaucgccgucaacggcaacaccccauuccgucaaugggaacucccaaacuacucaggcgcacucacacuuaacaccaaccucgcccccgccguaggaccgaacuuccccggagaacaaauccuauucuuccgcucaaacguaccuucaguccaaggaggacaaccaaucgaaaucgacugccucaucccccaagaaugggucucccacuucuaccaagaauccgcccccucccaauccgacguagcacugguccgauacguaaaccccgauacaggacguacuauauucgaggcgaaacuccaccgccaaggcuucaucaccauagcugcaacaggcucaaacccggucgucguaccucccaacggcuacuucagauucgacagcugggucaaccaauucuacgcacuagcgcccaugggcaccggaaacggucgaaggaggguccaauaa

SEQ ID NO: 36740 - RNA, 1617 nt, Artificial Sequence
  derived and/or modified sequence opt11 from capsid__Norovirus__ACY00635
augaaaauggcaucaaacgacgccgcccccucaaacgacggagcagccggacucguccccgaaauuaacaacgaaguaauggcccucgaacccgucgccgguggcgccaucgccgcaccccuaacaggacaaaccaacgucaucgacccauggauccgcaccaacuucguccaagccccaaacggugaguucaccaucucccccagaaacucacccggagaaguccuccucaauauggaacucggacccgaacuuaaccccuuccucggccaccucagccgcauguacaacggcuacgcaggcggcaucgaaguccaaguccucauggccggcaacgcauucaccgccggcaaaguaaucuucgccgcagucccaccccacuuccccgucgaaaaccucagcccaccccaagucacuauguucccccacgucaucgucgacguccgaaccuuagaacccauccuauuaccccuccccgacguacgcaaccaauucuuccacuacucccaaguugacgaaccuaaaaugcgacuugucgccaugcucuacacgccccuccgcucaaacggcucugcagaagaugucuucaccgucuccugucgaguccucacccgaccuagccccgacuucgaguucaacuaccuagucccuccaacagucgaaagccgcaccaaaccauucaccgugcccauacucaccauaggcgaaaugucaaacagccgauucccugcaccgaucgaugucaucuacaccucccccaacgacaaccaaaauguccagccacaaaauggccgcugcacccucgacggagaacuucaaggaaccacacagcuaguccccucgggagucugcgccuuccggggacgcauaaccucacacgaaggcucagaacaaaaucaauggcacaugcaacucaccaaccuaaacggcaccccauucgaccccaccgaagacauacccgcaccccuugggacccccgacuucaaaggcgaaaucuucggcuuuaucucucaacgcaacgcccaaaacgaccccggccaaucccaaccugccaaccgcgcccacgacgcagucguauccacacgcgcccccaaauucacaccaaaacuuggcucagucaugauagguaccugggucaacuccgauauagaaaaccaacccucuaaauucacccccgucggacucaacucauccgaaaacuucaaacaaugggagcuaccagacuacuccggcguccuaacccuaaacaugggccucgcccccgucguccaucccacauaccccggagaacagauacucuucuuccgaucuuacaucccucucaaaggaggucacggcaaccccgccaucgacugccuacuaccccaggaauggauacaacacuucuaccaagaauccgccccaucacaaacagacguggcucuccucaacccagacaccggccgcguccuauucgaagccaagcuacaccgacaaggauacaucacaauugccaaauccggcgacggacccaucguuguaccgcccaacggauacuuccgcuucgacuccugggucaaccaauucuacucacuugcacccauggguaacggcaacggacgccgccgaguccaauaa

SEQ ID NO: 36741 - RNA, 1632 nt, Artificial Sequence
  derived and/or modified sequence opt11 from capsid__Norovirus__ACY00638
augaugauggccuccaaagacgcccccaccaacauggacggaaccuccggcgccggacaacucguucccgaagucuccacagcugaacccauauccauggaacccgucgccggcgcagcaacagccgcggccacagcaggccaaguaaauaugaucgaccccuggaucaugucaaacuacguccaagcaccccaaggugaauuuaccaucuccccaaacaacacccccggagauauccuauucgaccuccaacucggcccacaccucaaccccuuccuaucucaccuagcccaaauguacaacggauggguaggcaacaugaaaguccgcguccuacucgcaggcaacgccuucacagccggcaaaauaauaaucuccugcgucccaccuggcuucgccgcacaaaacguauccaucgcccaagccaccauguucccccacguaaucgcugacguucgaguccuugaacccauagaagucccccucgaagacguacgaaauguacuauuccacaacaacgacucaaccccaaccaugcgccuaauuugcaugcucuacaccccacuccgagcauccggcucauccuccggcaccgacccauucguaaucgcaggccgcguccuaaccugccccuccccugacuucaacuuccucuuccucgucccucccaaugucgaacagaaaacaaagcccuucuccguccccgaccucccccuaaauguccuaucuaauucacgcgucccaucccugaucaaauccaugauggugucccaagaccacggccaaaugguccaauuccaaaacggccgcgugacacuugacggacaacuacaaggcaccacccccaccuccgcaucccaacucugcaaaauccgcggcacuguauaccaugccacaggaggccaaggacucaaucuaaccgaaaucgacggcacucccuaccacgcauucgaaucacccgcacccaucggcuucccugaccuaggggaaugugacuggcacaucaacgccuccccugcaaacgccuucaccgacggcuccauaauacaccgcauagacgucguccaagacccaaccuucgccccacaccucggcaccauccacuacaccaacgcuaacuacgacgccaaugucucacucaucugcucccucgaauggcuauccccacccuccggaggcgcacucaaagcaaacccgugggccaucccaagauauggcuccacacucaccgaagcagcacaacucgcgcccccaaucuacccaccaggcuucggagaagccauagucuucuucauguccgacuuccccauagccaacggcuccgauggacucuccguuccaugcacuauaccccaagaguucguuacccacuucgucaacgaacaagcccccacccgcggcgaagcagcacuacuucacuaugucgaccccgacacacaucgcaaccugggcgaguucaaacucuaccccgaaggcuucaugacaugcguucccaacagcucgggcuccggcccucaaacucucccuaucaacggcguuuucaccuucaucuccugggucucacgauucuaccaacucaaacccgucggaacaaccggccccguacgacgccuaggaauccgcagaucauag

SEQ ID NO: 36742 - RNA, 1635 nt, Artificial Sequence
  derived and/or modified sequence opt11 from capsid__Norovirus__ACY00641
augaugauggcaagcaaagaugcccccaccaacauggacggaaccuccggagcaggacaacuggucccagaagccaacaccgcagaacccaucucuauggacccaguagccggggccgccaccgccguagccaccgcaggacaaaucaacaugaucgaccccuggaucauguccaauuucguccaagcaccccaaggcgaauuuaccgucucccccaacaacaccccaggcgauguccuauucgacuuacaacucggcccccaacucaaucccuuccucgcccaccuagcccagauguacaacggauggguuggaaacaugcgcgucaaaguacuacucgccggaaaugccuucaccgcaggcaagaucaucaucucaugcaucccaccaggcuucaccucacaaaauauuucgaucgcccaaaugacaauguucccacacguaaucgcugacguccgaguccucgaacccaucgaaaucccacuggaagacguucgaaacguacuuuuccacaccaaugacaaccgaccaaccaugcgccucgucugcaugcucuacacaccccuaagagccaacggauccucauccggcaccgacccauucguaaucgcaggccgaguacuaaccugccccgacuccaauuucucauuccucuuccuuguuccacccaacgucgaacaaaagaccagaccauucuccguacccaacaucccucuaaacacacucuccaacucacgagucccaucacuaauuaaauccaugaccaucagcagagaccaaaaccaaaucauccaauuucaaaacggccgcguaacccucgacggccaacuccaaggcacaacucccaccuccgucucacagcucugcaaaauccgaggcacuaccuaccacgccaccggaggcuccggcaucaaccucacugaacucaacggcgaaccuuaucaugccuucgaaucccccgcccccauaggauucccagaccucggcggcugcgacuggcaccugaccgcaacccccacucaagccuucaacgacggcgcaaaagucguucgccucucagucacacaaggcgccgccuucgcaccccaccuaggcaccauacacuacaccaccaccgacacagacuacaauccaaacacuagcauaauaugcaccuuagacuggcucucacaaaccaccggccaaucaaacguagaccccuggcaaauccccacauacggaucaacacugaccgaagccgcccaacuagccccaccuaucuuucccccaggcuucggcgaaacccucgucuucuuccucuccgacuuccccaucucaaacggcaaaaacggccuaucgguacccugcacccucccacaagaauuugucacccacuucgucaacgaacaagcccccaucagaggcgaagccgcccuacuccacuacgccgaccccgauacacaucgcaaccucggagaguucaaacucuaccccgaaggcuucaugacaugcguacccaacaccuccggcggagguccacaaacccuccccauaaacggcgucuucguuuucgucucaugggucucucgguucuaccaacucaagccugucggcaccgcaggcgcagcccgucgccucggcauccgucgcuccuag

SEQ ID NO: 36743 - RNA, 1635 nt, Artificial Sequence
  derived and/or modified sequence opt11 from capsid__Norovirus__ACY00645
augaugauggccuccaaagacgcaccuacaaauauggacggcacauccggcgccggccaacucguccccgaagccaauacagcagaacccaucucuauggaccccguugccggagccgccaccgccguagcaacagcuggccagaucaacaugauagacccuuggaucaugucaaacuucguccaggcaccccaaggagaauuuaccguaucccccaacaacacccccggcgacguccuauucgaucuacaacucggaccccaacucaaccccuuccucgcccaccucgcccaaauguacaacggauggguuggaaacaugcgcguaaaaguccuccuagcagggaacgcauucaccgccggaaaaauaaucauuuccugcaucccucccggcuucaccucccaaaacaucuccaucgcccaaaugaccauguucccccaugucauagccgacguccgcguacuagaacccaucgaaaucccccuagaagacguccgcaacguccucuuccacacaaacgacaaccgacccacaaugcgccuagucugcaugcuauacacgccccuucgagccaacggcucauccuccgggaccgaccccuucgucaucgccggccgcguacuaaccugcccugacuccaacuucucauuccuauuucuagucccacccaacguagaacagaaaacacgccccuucucaguccccaacaucccccucaacacccucucaaacucccgagucccaucacucaucaagagcaugaccaucucccgcgaucaaaaccaaaucauccaauuccaaaauggccgcguuacacucgacggacaacuccaaggcaccaccccaaccuccgucucccaacucuguaaaauccgcggcaccaccuaccaugcaacaggcggcuccggaauaaaccucaccgaacuuaacggcgaacccuaccacgcauucgaaagucccgccccaaucggauuccccgaccuagguggaugcgacuggcaccuuaccgccacacccacgcaagccuucaacgacggcgcaaaagugguccgacucucagucacacaaggagccgccuucgccccucaccucggcacaauccacuacaccaccaccgacacggacuauaaccccaacaccuccauaauaugcacucucgacugguuaucccaaacaacaggccaauccaacgucgacccauggcaaauccccaccuacggaucagcccuaaccgaagccgcccaacucgccccaccuauauucccucccggcuucggcgaaacccucgucuucuuccucucagacuucccuaucucaaacggcaaaaauggccucuccguucccuguacccuaccccaagaauuugucacacacuucguaaacgaacaagcacccauucgcggagaagcagcucuccuccacuacgucgaccccgacacucacagaaaccuaggcgaauuuaaacucuaccccgaaggauucaugaccugcguaccuaacaccucaggcggaggaccacaaacccuaccaaucaacggcguauucgucuucgucuccugggucagucgcuucuaccaacucaaacccguuggaacagccggugcagcccgacgacuaggaauccgcagaucauaa

SEQ ID NO: 36744 - RNA, 1635 nt, Artificial Sequence
  derived and/or modified sequence opt11 from capsid__Norovirus__ACY00647
augaugauggcauccaaagaugcccccaccaacauggacggcacauccggcgccggccaacuuguacccgaagcaaacaccgccgaaccaaucagcauggaacccgucgcgggcgcagccaccgcagccgccacagcaggccaaguaaacaugaucgacccuuggauuaugaacaacuacguccaggcaccccaaggagaguucaccauuucucccaacaauacccccggcgacauccucuucgaccuacaacucggaccucaccucaaccccuuccuaucccaccuagcccaaauguauaacggguggguuggaaacaugaaaguaaaaguacuucucgccggcaaugccuucacagcuggcaagaucaucaucucaugcauacccccuggauucgccgcacaaaacaucuccaucgcccaagcgaccauguucccccacgucauagccgacguccgcguccucgaaccaaucgaagucccucucgaagacguccgcaacguacuauuccacaacaacgacaacucgcccaccaugcgccuaguaugcaugcucuacaccccacuccgcgcauccgguucauccucuggcacggaccccuucgucaucgccggccgcguacuaaccugccccucaccagacuucucauuccucuuccucgucccacccaacgucgaacagaaaaccaaacccuucuccguccccaaucucccccuuaacacccuaucaaacagccgcguaccuucucuuaucaacgccaugaugaucucgcgcgaccacggccaaaugguccaauuccaaaacggccguguaacacucgacggacaacuccaaggcacuacaccaaccucucucagucaauuaugcaaaauccgaggaaaaguauuccacgcauccggcgguaacggccuaaaccuaaccgaacucgacggaucugccuaccacgcauucgaaucacccgcccccaucggcuucccugacaucggcgagugcgauuggcacaugaacgccacagcaaccagcaacuucaccggcuccaacgacgaauaccaaauacuugucaaacaagaauccaccuucgcaccccacuugggacacguccaagccgacucccuuucagccgacgccaacacugaucuuauggucucacuauccuggaucucacccgucuccgaccaacaccgccgagacguugaccccugggucaucccacgauacgguagcucgcucaccgaagccgcacaacucgcaccaccuaucuacccucccggcuucggagaagccauuguauucuucaugucagacuuccccgucguaagcggcguaaacggaaugcgcauccccugcacccucccacaagaauacgucgcacacuucgucaacgaacaagccccaacacgcggcgaagccgcccugcuccacuacgucgaccccgacacacaccgcaaccucggcgaguucaaaauguaccccgaaggcuuuaugaccugcguuccaaacuccuccggauccggcccucagacucuucccauaaacggcguccucacauucguaucaugggucagccgcuucuaccagcucaaaccagucggcacggccggccccgcccgccgccucggaauacgacgcucauaa

SEQ ID NO: 36745 - RNA, 1668 nt, Artificial Sequence
  derived and/or modified sequence opt11 from capsid__Norovirus__ACY00650
augcgaauggccuccuccgacgccccuguuuccgguaccgacggagcagcaggccuagucccagagucccaacaagagguccuaccccuagaacccguagccggaguccaacuagcugccccggucgccggacaauccaacaucaucgauccauggauccgcaugaacuucguccaagccccagcgggcgaguucacagucucgccacgggacgcacccggcgaaguucuaauagaccucgaacucgguccagaacugaaucccuaccuaaaccaccuagcccgcauguacaacggcuacgucggaggaauggaagucgaagucguccucgcagguaacgcuuucaccgcaggaaaaauacucuucgccgccgucccaccauccuucccaacacacggcauuucugccgcccaagccaccaugcuuccacacguaaucguugacguccgccaacucgaaccagucaggcucccucuacccgacguccgcaacgucauguuccacuucugccaagaaaacaaagaaccacgcaugcgcauagucgcuauccuuuacacuccccuccgcgccaacggagcaggcgacgacgucuucaccguaucaugccgcguacucacccgcccgagcccugacuucgacuucaucuuccucguacucccauccguugaauccaaacuuaaacaauuuacccuucccaaucuacagcccaacgaaaugaccaacucucgauucccaaccggcaucauacaauuauauaccucaccaaacacaaaccuagucguccaauuccaaaacggucgcugccuccucgacggcacccuacuaggaacaacccccguccgagccgcugacauauguuccuuccgcggcgucacauccaccgaggucgacgcaaccgauucaccccgcguugcgggcucccacagaaucaugguccaacucaaagaacccgacggagaggaguucagccccacaggccccaaccccgcccccgucggcacccccgacuuccaagccgccaucuuuggaacccucucucaacgcaacacuggcggcgccggccaaaacuccaaccgagcccgauucgccuauuucuacacccgcaaccccacuuucgcccccggcauaggaaccguaguauucucauucgacaccaccgacuuccaaaaccgccaacccaccaaauucucacccuccggagucuucgacgacgacuccagcgaacccuucaaccaauucucacuccccuacuacaacggcucccuuggcgccgucgacgcaggcaaacucgcucccccaguagcccccaacuaccccggugaacaaauccucuacuuccgcgguaacauacccuucaaaggcggauacggcgaaggagaaauugauagccuccucccccaagaauggaucacacacuucuacgccgaacaagcucccacucaaggcgacgcagcacuccucagauacuauaacccugauacaggccgcguccucuuugaaugcaaacuucaccgcgaaggcuuuauaacuaucaacuacacggguucaaacgcacuagccgucccggucaacggcguauuccgauucgaagguuggguaaacaaauucuacacccuaacaccaaugggcaacggcaacggccgccgaggccgucgacgugaacuauga

SEQ ID NO: 36746 - RNA, 1617 nt, Artificial Sequence
  derived and/or modified sequence opt11 from capsid__Norovirus__ACY00656
auggcaagcaacgacgcugccccaucuaacgacggggccgccggccucguucccgaaguuaacaacgagaccauggcccucgaacccguggcaggcgccuccaucgccgcaccccucaccggacaaaacaacguaaucgacccuuggauccgccucaacuucguccaagcccccaacggcgaguucaccguauccccucgcaacagccccggugaaauccuccucaaucucgaacucggacccgaacuuaauccuuaucuugcacaccucagccggauguacaacggauacgccggcggaguagaaguccaaguccuacuugccggcaacgccuucaccgccggcaaacucguauucgccgccaucccaccccacuuccccguagacaaccuaucacccggucaaauaaccauguucccccacgucaucaucgacguccgcacccucgaacccguacuccucccacucccagacguccgcaacaauuucuuccacuacaaccaacaaagcgaccaacgcaugcgccucguagcaaugcucuacaccccacuccgaucaaacggcuccggcgacgacguauucacagucucaugccgaguacucacucgccccucucccgacuucgacuucaacuaucucgucccaccaaccguagaaagcaaaacgaaacccuucuccguccccguccuaacucucaaugaacucacaaacucucgauuccccguuccuaucgacgcaauguacaccucccccaacgacuccaucgucguccaaccucaaaacggccgcgccacaaucgacggcgaacuccuuggcaccacccaacucaucccaucaggcauauguucauuccgcggcaagauuaccacccaccucgccgacgaccgacaccucuggaacauucaaguuuccaaccucaacggcacccccuucgacccuacagaugacguccccgcuccccucggaaugcccgacuucuccggccaaaucuucggcguagucucgcaacgcgacaccggcaccaaucccgccaaccgcgcccacgacgccguacucgccacauacuccgccaaauacacucccaaauuaggaucgguccaaauaggcaccugggacaccgaagaccuccucgaacgacaaccagucaaauucacacccguuggccucaacgaaaucggucaagacaaacacuucgaccaauggguacuccccaacuacucuggugcccucggacuaaacaugcaccuagcccccgcugucucaccccucuuccccggugaacgccuacuuuucuuccgauccuauaucccacucaaaggaggccacggcgaccccuucauagacugccucgugccucaggaauggauccaacacuucuaccaagaauccgcacccgcucagucauccgucgcccuacuacgcuacgucaaccccgacaccgggcgcacccuuuucgaagccaaacuccacaaaggcggauucaucaccguuucaucgaccgaaaaccgcccugucauaguaccacccaauggauacuuucgcuucgacucauggguuaaccaguucuacucccuugccccaaugggcaccggaaacggcagacggcgcaugcaauga

SEQ ID NO: 36747 - RNA, 1623 nt, Artificial Sequence
  derived and/or modified sequence opt11 from capsid__Norovirus__ADK47170
augaaaauggccucauccgacgcaaaccccagcgacggaucuaccgcaaaccucguccccgaagucaacaacgaagucauggcacucgaacccgucgucggcgccgcaaucgccgccccagucgcuggccaacaaaacguaaucgacccauggauacgcaacaacuucguacaagcccccggcggugaguucaccguaucuccucgcaacgcccccggcgaaauccucugguccgcaccacuaggccccgaccuaaaccccuaccucucucaccucucuagaauguacaacggcuacgccggcggcuucgaaguccaagucaucuuagccggaaacgcuuucacagcaggcaagaucauuuucgcagccgucccacccaacuuccccaccgaaggccugucccccucccaaguaaccauguucccccacaucauaguagacguacgccaacuggaaccaguccuaauaccacuacccgacguccgcaacaacuucuaccauuacaaccaauccaacgaccccacaaucaaacucaucgccaugcucuacaccccacuccgagcgaacaacgccggcgaugacgucuucacagucaguugccgcguccucacaagacccucacccgacuucgacuucaucuuccucguacccccaaccgucgaaagccgcaccaaacccuucuccguccccguccucaccguagaagaaaugacuaauucccgauuucccauaccccuugaaaaacucuucaccggcccaucaucagcuuuuguaguacaaccacaaaauggccgaugcaccaccgacggagucuuacucggaacaacccaacucucccccgucaacaucugcacauuccgcggcgacgucacccacaucccaggcucacgcaacuacaccaugaaccuagccucccaaaacuggaacuccuaugaccccacagcagaaauccccgcuccccucggcacccccgauuuugucggcaaaauccaaggaguccuaacccaaacaacucgcacuaacggcagcacccgcggccacaaagcaacuguauacacaggauccgcagacuucucucccaaauuaggccgaguccaauucgccacagauaccgacaacgacuucgaaaccaaccaaaauaccaaauucacacccguaggagucauccaagacggcagcacaacccccagaaacgaaccucaacaauggguccuccccagcuacucaggucgaaacauccacaauguccaccucgccccagccgucgccccuacauuccccggcgaacaacuccucuucuuccgcuccacaaugcccggaugcucaggcuaccccaacauggaccucgauugccuccuaccccaagaauggguccaauacuucuaccaagaagccgcccccgcccaauccgacgucgcccuacuucgauucguuaaccccgacacaggccgcguccucuuugaaugcaaacuccacaaaucaggauaugucaccgucgcccacacaggccaacaugaccucgucaucccucccaacggcuacuuccgcuucgauagcugggucaaccaauucuacacccucgcacccaugggcaacggcacuggcagacgccgagcucuguaa

SEQ ID NO: 36748 - RNA, 1644 nt, Artificial Sequence
  derived and/or modified sequence opt11 from capsid__Norovirus__ADR30514
augaaaauggccagcaacgacgccgcccccuccaacgacggcgccgccgaccucguccccgaagcaaacaacgaagugauggcucuagaacccgucguaggagccuccauagccgcccccguaguaggacaacaaaauaucauagaccccuggauacgcgaaaacuucguccaagcaccccaaggcgaguucaccguaagcccccguaacuccccaggcgaaaugcugcuaaaccuagaacucggccccgaacucaacccauaccuuucccaccucagccgcauguacaacggcuacgccggcggaaugcagguccaagucguacucgcagguaacgccuucacugccggcaaaauaaucuucgccgccguacccccucauuucccaguagaaaacaucucugccgcccaaaucaccaugugcccccacgugauaguugacguacgccaacucgaaccaguccuccucccacuccccgacauucgcaaccgcuucuuccacuacaaccaagaaaacaccccacgcaugcgccuagucgcaaugcuauacacaccccugcgcgcaaauucaggugaagacguauucaccgucucuugccgcguccucacacgcccagcgccugacuucgaguucacguuccucgucccacccacugucgaauccaaaacaaaacccuucacccuccccauacucacacucggcgaacuaucaaacucccgcuuccccgcucccaucgauaugcucuacacggacccaaaugaaggaaucguaguccaaccacagaacggcagaugcacccucgacggcacccuacaagggaccacccaacucgucccuacacaaauaugcgccuuccggggcacacucaucggccaaaccucacgaucaagcgacuccacagauucugcaccaagaagacgagaccacccccuucacguccaacucaaaaaccucgacggcacccaauacgauccaaccgaugaagucccugccguccucggcgcgauagacuucaaaggcaccguauucggaguagccucccaaagagacgucuccggccaacaaguuggagccacacgagcucacgaaguccacauaaacaccaccgacccccgcuauacucccaaacucggauccauccucaugcacucagaauccgacgauuucgucaccggacaaccgguacguuucacacccauaggcaugggcgacaacgacuggcaccaaugggaacuaccagacuauucaggccaccucacacuaaacaugucccucgcucccgcagucgccccagccuucccaggcgaacgcauacucuucuuccgaucaauaguaccauccgccggcggauacggcucaggccaaauagacugccucauaccacaagaauggguucaacacuucuaucaagaagcagcccccagccaauccgcaguagcccuuauccgcuacgucaacccagacaccggaagaaacauuuucgaagccaaacuccaccgagaaggauucaucaccgucgcaaacagcggcaacaaccccaucgucgucccacccaacggcuauuuccgcuucgaggcaugggucaaccaauucuacacccucacacccaugggaaccggccaaggccgacgccgcaaccaguaa

SEQ ID NO: 36749 - RNA, 1623 nt, Artificial Sequence
  derived and/or modified sequence opt11 from capsid__Norovirus__ADR78255
augaagauggccuccuccgacgcaaaccccagugacggcuccaccgcgaaccucguccccgaagucaacaacgaaguaauggcacucgaacccgucgucggcgcagccaucgccgcucccgucgccggacaacaaaacgugaucgaccccuggauccgcaacaacuuuguacaagcucccggaggagaauuuacaguaucaccacgcaacgcacccggagaaauccuauggucagccccacucggccccgaccucaaccccuaccuuucacaccuagcacgcauguacaacggauacgccgguggcuucgaaguacaggucauccuugccggcaacgcuuucaccgcuggaaaaaucaucuucgcagcugucccaccuaacuuccccaccgaaggccucucucccagccaaguaaccauguucccccacaucaucgucgacguccgccaacuagaaccaguucucauaccccuccccgauguccguaacaacuucuaccacuacaaccaauccaacgacccaacaauuaaacuuaucgcaaugcucuauacaccccuccgugccaacaacgccggagaugacgucuucacugucuccugccguguacuuaccagacccucccccgacuucgacuuuaucuuccucguaccaccuacagucgaaagccgcaccaaaccguucuccguccccauccuuaccgucgaagaaaugaccaacucacgcuuuccaaucccacucgaaaaacuauucacuggucccuccuccgccuucgucguccaaccacaaaacggacgauguaccaccgacggcguucuucucggcacaacucaacucagccccgucaacaucugcaccuuccgaggcgacgucacccacaucgccggcucccgcaacuacacaaugaaccuagccacccagaauuggaacuccuacgauccuaccgaagaaaucccagcuccccucggcacacccgacuucgucggcaaaauacaaggugucuuaacacagacaacucgggccgacgguucuacacgcggacacaaagccacaguuuacaccggcuccgccgacuucucucccaaacuuggccgcguccaauucgcuaccgacaccgauaacgacuucgacgcaaaccaaaacaccaaauucacccccguaggugucauccaagacggcaacaccgcccauagaaacgaaccucaacaguggguacucccaucauacucaggucgcaacucccacaacguccaccucgcccccgccguagcccccaccuuucccggcgaacaacuacuuuucuuccguuccaccaugcccggcugcucuggcuaucccaacauggaccuagacugccuccucccccaagaauggguucaauacuucuaccaagaagccgcacccgcacaauccgacgucgcccuacuccgcuucguaaaccccgacaccggccgaguucucuucgaaugcaaacuacacaaauccggcuaugucacaguagcccacacagggcagcacgaccucgucaucccacccaacggcuacuuccgcuuugacucaugggucaaucaauucuauacccucgcccccaugggcaacggcacaggccgccgccgcgcccucuga

SEQ ID NO: 36750 - RNA, 1623 nt, Artificial Sequence
  derived and/or modified sequence opt11 from capsid__Norovirus__ADR78259
augaaaauggcaucaucugacgccaaucccuccgacggcuccacagcaaaccuuguacccgaagucaacaacgaagucauggcccuagaacccguugucggcgcagccauagccgcgcccgucgccggccaacaaaacgucauagaccccuggaucagaaacaacuucguacaagccccugguggcgaguucaccgucucuccccgcaacgcccccggagaaauccuaugguccgcaccccuaggacccgaccucaaucccuaccucucccaccuaucccgcauguacaauggcuacgccggcggcuucgaaguccaaguuauacuagcaggcaacgcguucaccgccggcaaaaucaucuucgccgccguacccccaaacuucccaacagaaggucucucccccucccaagucacaauguucccccacauuauagucgacguacgucaacuagaacccguccucauaccccuccccgacguacgaaacaacuucuaccacuauaaccaaucaaacgaccccacaaucaaacucauagccaugcucuacacgccccuccgagccaauaacgccggcgacgacgucuucaccgucuccugccgcguccucacccgccccucacccgacuucgacuucauauuccuagucccacccaccgucgaaagucguaccaaacccuucuccguccccguccucaccgucgaagaaaugacaaacucgcgauuccccaucccacuugaaaaauuauucacggggcccuccuccgcuuucgucguccaaccccaaaacggccgcuguaccacagacggcguacuacucggcaccacccaacuaucccccgucaacaucugcacauuccgaggcgacgucacacacauccccggcucacguaacuauaccaugaaccuugccucucagaacuggaacuccuacgauccgacagaagaaauuccugcaccccucggcacaccagacuucguagguaaaauucaaggcguacucacccaaacaacacgcacaaacggcuccacacguggccacaaagccaccgucuauaccggcucagccgacuucucucccaagcucggccgcguacaguucgccacagacaccgacaacgacuuugaaaccaaccaaaacaccaaauucacccccgucggcguaauccaagacggcucaacaacaccccgaaacgaaccccaacaaugggucuuaccaucauacucgggucgcaauauccacaacgugcacuuagcccccgccguagccccuaccuuccccggcgaacaacuacucuucuuccgcucuaccaugcccggcugcucuggauauccaaauauggaucuagacugccuccucccccaggaauggguucaauacuucuaccaagaagcagccccugcccaauccgacgucgcccuacucagauucguuaaccccgacacaggccgcguacucuucgaaugcaaacuccauaaaucugguuacgucacuguggcccacaccggccaacacgacuuaguuauaccucccaauggcuauuuccgcuucgacuccuggguaaaccaauucuacacccucgcacccaugggaaacggaacaggccgacgccgcgcccucuaa

SEQ ID NO: 36751 - RNA, 1623 nt, Artificial Sequence
  derived and/or modified sequence opt11 from capsid__Norovirus__ADR78262
augaaaauggccuccuccgacgcaaaccccucagacggaucaacagcaaaccucguacccgaaguaaacaacgaaguuauggcccucgaacccgucgucggcgccgccauagcagcccccguugcuggccaacagaacguaaucgacccauggauacgcaauaauuucguacaagccccaggcggcgaguucacaguaucaccccgcaacgcccccggcgaaauccucugguccgcaccccucggccccgaccuaaacccauaccucucccaccucagccgcauguauaacggcuacgccggcggauucgaaguccaagucauucucgcagggaacgcauucaccgccggcaaaaucauuuucgcagcaguuccacccaacuuccccaccgaaggacucucccccucacaagucaccauguucccccacaucaucgucgacgucagacaacucgaacccgugcuaaucccgcucccagacguccgcaacaacuuuuaccauuacaaccaauccaaugacccaaccauaaaacuaaucgcaaugcuguacacaccacugcgagccaacaacgcaggcgacgacgucuucaccguuucaugccgaguacucacgcgacccuccccagacuucgacuucaucuuccucgucccacccaccguugaaucccgcacaaaacccuucuccguacccguccucaccgucgaagagaugacuaacucgcgauuccccaucccccuagaaaaacucuucaccggcccaagcuccgccuucguaguccaaccacaaaacggacgcugcaccaccgacggcguccugcucggcaccacacaacuaucccccgucaacaucugcaccuuccguggcgacgucacccacauccccgguucccgaaacuacaccaugaaccucgccagccaaaacuggaacucauacgacccaaccgaagaaaucccagcaccgcuuggcacucccgacuucgucggaaaaauccaagguguccucacacaaaccacacgcaccaacggauccacacgcggacacaaagcaaccguauacaccggaagcgccgacuucucacccaaacucggacgcguccaauucgcuacagacaccgacaacgacuucgaaacaaaccaaaauaccaaguucacacccgucggagucauccaagacgguuccacuacaccccgcaacgaaccucaacaauggguccuccccuccuacuccggccgcaacacacacaacguccaccuagcccccgcagucgcccccaccuuccccggcgaacaacuacucuucuuccgcucaaccaugcccggaugcucgggauacccaaacauggaucuugacugccuccuaccccaagaauggguccaauacuuuuaccaagaagccgcacccgcccaauccgacgucgcccuucuacgcuucguaaacccugacaccggacguguccuauucgaaugcaagcuacacaaaucuggauacguaaccgucgcccacaccggccaacacgaucucgucaucccucccaacggauacuuccgcuucgacuccugggucaaccaauucuacacccucgcucccaugggcaacggaaccggccgccgccgugcccuauga

SEQ ID NO: 36752 - RNA, 1623 nt, Artificial Sequence
  derived and/or modified sequence opt11 from capsid__Norovirus__ADR78266
augaagauggcauccuccgacgccaaccccucugacggcuccaccgcaaaucucguuccagaagucaacaacgaagucauggccuuagaacccgucgucggcgccgccaucgccgcccccguugccggccaacaaaacguuaucgaccccuggauccgcaacaacuucguccaagcccccggcggcgaguucaccguaucacccagaaacgcccccggagaaauucucuggagcgcaccccucggcccugaccucaacccauaccucucccaucuuucccguauguacaacggcuacgccggcggauuugaaguucaaguuauccucgccggcaacgccuucacagccggcaaaaucauauucgcagccguaccacccaacuuucccaccgaaggacucagcccaucccaagucaccauguucccccacaucaucguagacguccgccaacuagaacccguccucaucccacuaccagacgucagaaauaacuucuaccacuacaaccaaucaaacgacccaaccaucaaacuaaucgccaugcucuauacaccccuccgcgccaauaacgcuggcgaugacgucuucaccguauccugccgcguacucacccgccccuccccugacuucgacuucaucuuccuagucccuccaacugucgaaucacgcacaaaacccuucuccguccccguacucacaguugaagaaaugacaaauucccgcuuccccaucccccucgaaaaacuauuuacaggacccucaagcgccuucgucguccaaccacaaaacggacgcugcaccacagacggcguccuccucggcaccacccaauuauccccggucaacaucuguaccuuccguggcgacgucacacacauauccggcucgcgcaacuacaccaugaaccucgcuucccaaaacuggaacucuuacgaccccaccgaagaaauacccgcaccccucggcacccccgacuucgucggcaaaauacaaggcguccugacucaaacaacccgcacaaauggcuccacucgcggccacaaagccaccguauacaccggcucagccgauuucucaccaaagcuaggccguguccaauuugccacagacacugacaacgacuucgaaaccaaccaaaacaccaaauuuacccccguaggcgucauccaagauggguccaccacaccccgaaacgaaccccaacaauggguccuaccuucauauuccggccguaacauacacaauguccaucuagcccccgccgucgccccaaccuucccgggcgaacaauuacucuuuuucagauccaccaugcccggaugcuccggcuaccccaacauggaccucgacugccuacucccccaagaauggguccaauacuucuaccaggaagccgccccugcucaauccgacgucgcccuacuccguuucguaaaccccgacaccggucgaguccuuuucgaauguaaacuccacaaauccggcuacgucaccguugcacacaccggccaacacgaucucgucauucccccaaacggauacuuccgcuucgacuccugggucaaccaauucuacacccucgccccuaugggcaacggcacaggccgacggcgugcucucuaa

SEQ ID NO: 36753 - RNA, 1623 nt, Artificial Sequence
  derived and/or modified sequence opt11 from capsid__Norovirus__ADR78268
augaaaauggccuccuccgacgcaaacccaagcgacggcuccaccgcaaaccucgucccagaaguuaauaaugaagucauggcacuagaacccguuguuggcgccgcaaucgcugccccuguagccggccaacaaaacgucaucgacccauggauccgcaacaacuucguccaagcuccaggaggagaguucaccguaagcccccgcaacgccccaggagaaauccucuggucugccccacucggacccgaccucaaccccuaccucucucaccucucccggauguacaacggcuacgccggaggcuucgaaguacaaguuauccuugcaggcaacgccuucacagcugguaaaaucauuuucgcagcaguaccacccaacuuuccaaccgaaggccuuagccccucccaagucacuauguuuccccacaucauaguagacguccgucaacucgaacccguacucaucccccucccugacguacgcaacaacuucuaccacuacaaccaaucuaacgacccaaccaucaaacugaucgccaugcucuacacaccccuccgcgccaacaacgcaggcgacgacgucuucaccguuucaugccgcguucucacccgccccuccccagauuucgacuucaucuuccuggucccacccaccguagaaucccgcaccaaacccuucuccguccccguccucaccgucgaagaaaugacuaacucacgauuucccauaccccuagaaaaacucuucacaggccccucguccgccuucgucguccaaccacaaaacggacgcugcaccaccgauggcguccuucucggcaccacgcaacuauccccuguuaacaucugcaccuuucgcggcgacguaacccacaucccaggcucccgcaacuacaccaugaaccuggcaucccagaacuggaacuccuacgaccccaccgaggaaauccccgcaccccucggcacccccgacuucgucgguaaaauccaagggguccucacucaaaccacucgcacuaacggcucaacccguggacacaaagccaccgucuacaccggcucagccgacuucucccccaaacuaggucgcgugcaguucgccaccgacaccgacaacgacuucgaaaccaaccaaaacacaaaauucacucccgucggaguaauccaagacggaucuacaaccccacgcaacgaaccccaacaauggguccuucccuccuacuccggccgcaacauccacaacguccaccucgcccccgccgucgccccaacuuuccccggcgaacaacuccuauucuuccgauccaccaugcccggaugcucaggcuaucccaacauggacuuagauugccuccucccccaagaauggguacaauacuucuaccaagaagcagcccccgcacaguccgacgucgcccuacuccgcuucgucaaccccgacaccggccguguccuguucgaaugcaaacuccacaaauccgguuacguuaccgucgcacacaccggccagcacgaucucgucaucccacccaacggcuacuuccgcuucgacuccugggucaaccaauucuacacacucgcccccauggguaauggcacaggacgccgccgcgcccuguaa

SEQ ID NO: 36754 - RNA, 1569 nt, Artificial Sequence
  derived and/or modified sequence opt11 from capsid__Norovirus__AFQ00093
augaaaaugaccgauagagacaucgucgacucagccccagcccuaggccaaguacuacccccugaagucgaagcauccguacccgucgaacccacugccggcgcacccguagccgcauccacugcgggacgaguaaacccaaucgacccauggauauuugcuaacuucguccaagcuccccaaggcgaguucacaaucucacccaacaauaaccccggcgaaauccucuucgaacuagaacucggacccgaccucaacccuuaccucgcccaccucagacgaauguauaacgguuggaccggaucuaugcgcguacgaguacuccucgccggcaacgccuuuagcgccggcaaagucgucguuuucugcgucccacccggcuucgacaccuccuaccuaacacccucccaagcaacacaauuuccccacguccucauagacgucagagcccccgaaccagucgacaugccccucgaagacguccgaaacauccuauuccaccaaggccccgacucacgcaugcgccucaugggaaugcucuacacuccccuccgagccaacuccggcgccgaccccuucgucguuaccggacgcguucuaacaugccccucacccaauuucucauucuucuuccucguaccacccacugucgaagaacgagaaccucccuucacccuacccaaccuccccgucaacucccucucacacucacgcgucauggaacccaucgcccaaaugaugucaucccguuccuuccccgccuccguacaauuccaaaacggacgcugcacccuuucaggcgaccuccucggcacaacccccucaucacccgccgaccuuggagcuuucguaggccucaucgccgaaccuggaucuaggguuguagaacucucccaaccgaaccaagaagacuuccacgccggaagcgcacccgcccccuucggauuccccgacuucucagaaugcuccguaacauucgucgucgccucagccacaacaguaggcgaacgaaccgugaacgcacgcaacccacagaacuucacccccgcccuuggccacaucaccuucgaugaagaggcccccgcugaccucuuucgcgcacgauuccgcaaccucugggaacccacagaacacaguuucuggcgcauccccgacuaccgggcugacguccucggcucagacuucgcgcccucggucucagcaccaggcguaggagaaacacuccuguucuuuaugugcaacguaccccgccuaaauggcgccaacccaaaccccugccccugccuucucccccaagaauggaucacccacuucgucuccgaacgugccgcccuccaaucagacgucgcccuucuuaacuacgucaaccccaacaccggccgcguacucuucgaagccaaacuguacgccaacggcuuccuuaccguaaaccucggcgccucugaccaagccauacucccagucgacggaaucuucaaauucgucuccuggguauccuucuauuaccaacuacgacccgucggaaacaucuccgucgggcgccgccucccacgacucgacggcuucuaa

SEQ ID NO: 36755 - RNA, 1629 nt, Artificial Sequence
  derived and/or modified sequence opt11 from capsid__Norovirus__BAI52939
augaaaauggccucuaacgacgccgcccccucaaccgacggcgccgccgggcucguacccgaauccaacaacgaagucauggcacucgaaccagucgccggugccgcacuggcagccccugucaccggccaaaccaacauaaucgacccauggauacgcgccaacuucguccaggccccaaacggagaauuuacagucucccccagaaacgcccccggcgaaguccuacucaaccuagaacucggccccgaacucaaccccuaucuagcccacuuagcaagaauguacaacggcuacgccggcggcauggaaguccaaguaaugcucgccggaaacgcauucacagccggcaaacucguuuuugccgccguaccuccccacuuccccauagaaaaccucucaccccaacaaaucacaauguucccccauguaaucauugacguccgcacccuagagcccguucuccuaccacucccagacguccgcaacaacuucuuccacuacaaccaaaaagaugauccaaaaaugcgcaucguagcaaugcucuacaccccacuccgauccaacggcuccggagaugacgucuucaccgucuccugucgcgucuuaaccagaccaagccccgacuucgacuuuacauaccucgucccacccaccguugaaagcaaaacaaaacccuucacccuccccauccucacccucggugaacuauccaacucccgcuuccccgccuccaucgaccaaauguacacaucacccaacgaagucaucuccguccaaugccaaaacggucgaugcacgcucgacggcgaacuccaaggaaccacccaacugcagguaucaggcaucugcgccuucaaaggagaagugaccgcccaccuacacgacaacgaucaccuauacaacauaacaauaaccaaccucaacggaagccccuucgaccccuccgaagauauccccgcaccacuaggcaugcccgacuuccaaggccgcguauucggaaucaucucccaaagagaccgccacaacuccccaggccacaaugaaccagccaaccgaggccacgacgccgucguccccaccuacacugcucaauacacccccaaacuuggccaaauccaaauaggaaccuggcaaaccgacgaucucacaguaucccaacccgucaaguucacaccagucggccugaacgacacugagcacuucaaccaauggguugugccccgauacgcuggcgcccucaaccuaaacaccaacuuagcacccucaguagcaccagucuuccccggagaacgccuucuauucuuccgcuccuacauaccccucaaaggcggcuacggcaaccccgccaucgacugccuucucccccaagaauggguccaacacuucuaccaagaagcagcccccuccaugucagaaguagcccucgugcgaugcauuaacccagacaccggcagagcccucuucgaagcaaaacuccaccgggcaggauucaugaccgucuccuccaacaccucagcacccguagucguaccagcaaacggcuacuuccgcuucgacuccugggucaaccaauucuacucccuggcacccaugggcaccggcaacggccgacgccgcguccaauag

SEQ ID NO: 36756 - RNA, 1623 nt, Artificial Sequence
  derived and/or modified sequence opt11 from capsid__Norovirus__BAI52940
augaaaauggccuccaacgaugcuaacccuucagacggauccgccgccaaccuaguccccgaaguuaauaaugaagucauggcacucgaaccugucgucggugccgccaucgccgcacccguagccggacaacaaaacgucaucgacccauggauucgcaacaacuucguccaagcccccggcggcgaauuuaccgucucaccccgcaacgcaccaggagaaauacuaugguccgccccacucggcccugaccucaacccuuaccuuucccacuuagccagaauguacaacggcuacgcaggcggauuugaaguccaagucauccucgccggcaacgcauuuaccgcaggcaaaaucauauucgccgccguacccccaaacuuccccacugaaggccucggacccucacaagucaccauguucccgcacauaauaguugauguccgacaacucgaacccguccucaucccccuuccagacguucgcaacaacuucuaccacuacaaucaauccaacgacuccacaaucaaacuuaucgcaaugcucuauacuccccuccgcgccaacaacgccggcgaagacgucuucaccguaucaugccgcguccucacccgccccucccccgacuucgacuucaucuuccuugucccacccaccgucgagucgcgcaccaagcccuuuacagucccgauccucaccguagaagaaaugaccaacucccgcuuucccauuccacucgaaaaacuuuucaccggccccucgagcgccuucgucguccaaccccaaaacgggcguugcaccaccgacggcguccuacuaggcaccacccagcuaucuccagucaacauaugcaccuuccgcggagacgucacacgcauagcaggaucccgaaacuauaccaugaaccucgccucccucaacuggaacaacuacgaccccaccgaggaaauaccugcuccccucgggacccccgacuucguaggcaaaauccaaggcguccuaacccaaaccaccaaaggcgacggcucaacucgcggccauaaagccacagucuacaccggauccgccccuuuuacccccaaacuuggcuccguacaauucuccacagacaccgaaaacgacuucgagacucaccaaaauaccaaguuuacccccguaggcgucauccaagacggcggaacgacccaccgcaacgaaccccaacaauggguauuaccgagcuauuccggccgcaacguccccaacguacaccucgcccccgccguugcccccaccuuuccaggcgaacaacuccuuuucuuccgcucaaccaugccuggcugcuccggauacccaaauauggaccuugacugccuacuuccacaagaguggguacaacacuucuaccaagaagccgcccccgcccaauccgacgucgcccuucuccguuuugucaaccccgacaccggccgcguccuuuucgaaugcaaacuacauaaaucaggauacgucacagucgcgcacaccggccaacacgaccucguaaucccacccaacggcuacuuccgauucgacuccuggguaaaccaauucuauacccucgcucccaugggaaacggcaccggcagacgccgagcacuauaa

SEQ ID NO: 36757 - RNA, 1623 nt, Artificial Sequence
  derived and/or modified sequence opt11 from capsid__Norovirus__BAQ20801
augaaaauggcuagcucugacgccaaccccucagacggcuccgccgcaaaccuaguacccgaagucaacaacgaagacauggcccucgaacccguagucggcgcagccaucgccgcgcccgucgcaggccaacaaaacgucauagaccccuggauccgcaacaacuucguccaagcaccaggcggcgaguucaccgucucaccccgcaacgcuccaggugaaauccucugguccgcuccccuuggcccagaccuuaacccguaccucucccaccuagcccgaauguacaacggauacgcaggcggcuuugaaguacaagucauccucgccggcaacgcauucacagcaggcaaaguaaucuucgcugccgucccuccaaacuuccccaccgaaggccucuccccaucucaaguaacgauguucccccacauaguaguugacguacgccagcuagaaccaguucucauaccacuacccgauguccgaaacaauuucuaccacuacaaucaauccaacgacccaaccauaaagcuaauagccaugcuauauacaccccuccgagcaaacaaugcaggagacgacgucuucaccgucucuugccgcguccucacccgacccucucccgacuucgacuucauauuccucguuccacccacagucgaaucccgcaccaagcccuuuucagucccuguacucaccgucgaagaaaugaccaacucccgauucccaauaccacuagaaaaacucuucaccggucccuccuccgccuucguaguccaaccgcaaaacggcagaugcaccacagacgguguacuccucggcaccacccaacucucacccguaaacauaugcaccuuccgcggagacguaacccacaucaccggcucgcgcaacuacacuaugaaccuagccucacaaaacuggaacaacuacgaccccaccgaggaaauccccgcaccccuuggaacacccgacuucguagguaaaauacaagguguacucacccaaaccacccgcaccgacggcagcacccgcggacacaaagccacuguuuacaccgguucugcaaacuucucucccaaacuaggcagaguccaauucgaaaccgauaccgaccacgacuucgaagucaaccaaaacacaaaauucacucccguuggcguaauccaagacgguggaacaacccaccgcaacgaaccccaacaauggguacuaccauccuacucaggccgaaacacccccaauguccaccucgcacccgccgucgcccccaccuuccccggcgaacaacuccuauucuuccgcucgacaaugccaggcugcucaggcuaccccaacauggaccuugacugucuccuuccacaagaauggguccaauacuucuaccaagaagccgccccugcccaaucagacgucgcacuacuccgcuucgucaaccccgacaccgggcgaguccucuucgaaugcaaacuacacaaauccgguuaugucaccgucgcccauaccggccaacacgaccucgucaucccaccuaacggcuauuuccgcuucgauuccugggucaaccaauucuacacccucgcacccaugggaaacggaaccggcagaagacgggcacucuaa

SEQ ID NO: 36758 - RNA, 1623 nt, Artificial Sequence
  derived and/or modified sequence opt11 from capsid__Norovirus__BAQ20803
augaagauggccagcuccgacgccaaccccucagacgguucugcagccaaccucguacccgaggucaacaacgaggucauggcacuugaaccaguagucggcgccgcaaucgccgcacccgucgcgggccaacaaaacguaaucgaccccuggauacguaauaacuucguacaagcccccggcggcgaguucaccguaucuccccgaaacgcgccaggcgaaauacucugguccgcuccccucggaccggaccucaaccccuaccucagccacuuagcccgcauguacaacggcuacgccggugguuucgaaguccaagucauacuagcaggcaacgccuucacggcaggcaaagucaucuucgccgccguacccccaaauuuccccaccgagggccuaucaccaucccaggucaccauguucccacacaucgucgucgacguccgucagcucgaaccaguccuaaucccucucccugacguccgaaacaacuucuaucacuacaaccaauccaacgaccccaccaucaaacucaucgcaaugcucuacacaccccuacgagcuaacaacgcaggagacgacguauucaccgucuccuguagaguucucacccgacccucccccgacuuugacuucaucuuccucguaccacccaccguagaaucccgcaccaaacccuucuccguacccguacuaaccguagaagaaaugaccaacucacgcuuccccaucccccucgaaaaacucuucacgggccccuccuccgccuucgucguacaaccccaaaacggccgcugcaccaccgacgggguacuuuuaggaacaacccaacuauccccaguaaacauaugcacauuccgaggcgacguaacccacaucaccggcucccgcaacuacacuaugaaccucgccucccaaaacuggaacaacuacgaccccaccgaagaaauaccagcuccccuaggcacucccgacuucgucggcaaaauccaaggcguccuaacccaaaccacccguaccgacggcuccacccgcggccacaaagccaccguguacacaggauccgccaacuucuccccaaaacucggaagaguccaguucgaaacugacaccgaccacgacuucgaggucaaccaaaacaccaaguucaccccagucggcguuauccaagacggcuccaccacacaccgcaacgagccccaacaauggguccugcccucuuacucuggccgaaacacacccaacguacaucucgcacccgccguggcaccaaccuuccccggcgaacaacuacucuucuucagaucaaccaugcccggcuguuccggauaucccaacauggaccuagacugccuccucccacaagaauggguccaauauuucuaucaagaagccgcucccgcccaaucagacgucgcccuccuacgauucguaaacccagacaccggccgaguccuuuuugagugcaaacuacacaaaucaggcuacguaacugucgcucacacaggccaacacgaccucgucauuccucccaacgguuacuucagauucgauuccugggucaaucaauucuacacccucgcccccauggguaacggcacaggccgacggcgugcacuauga

SEQ ID NO: 36759 - RNA, 1623 nt, Artificial Sequence
  derived and/or modified sequence opt11 from capsid__Norovirus__BAQ20805
augaaaauggcauccucagacgcaaaccccuccgacggcuccgccgccaaccucguucccgaagucaacaacgaagucauggcacucgaacccgucgucggagcagccaucgccgccccggucgcaggccaacaaaacguaaucgaccccuggauccgcaacaacuucguacaagcacccggaggagaguucacagucuccccacgcaacgcaccuggagaaauacucugguccgcaccccuaggccccgacuuaaacccuuaccugucucaccucgcacgcauguacaacggauacgccggcggcuuugaaguccaagucauccuagccggaaacgcauuuaccgcgggaaaagucauauucgcagccgucccacccaacuuccccaccgaaggacuuucaccaucacaaguaaccauguucccccacaucgucgucgacguucgucaacucgaacccguccuuauuccccuccccgacguccgcaacaauuucuaccauuacaaccaauccaacgaccccaccaucaaacugaucgccaugcuauacacaccccuccgcgccaacaacgcaggcgacgacguauucaccgucaguugccgcguccucacccgaccuucacccgacuucgacuucaucuuccucguaccaccaacaggcgagucacgcaccaaacccuucuccgucccuguccucacugucgaagaaaugaccaacucacgauucccuauuccccuggaaaaauuauucaccggacccucuuccgccuucguaguucaaccacaaaacggccgaugcaccaccgacggaguacugcucggcaccacccaacucuccccaguuaacaucugcacauuucgcggugacgucacucacaccacaggcucccacaacuacacgaugaaccuagccucacaaaacuggaacaacuacgaccccacagaagaaauucccgcgccccucggaacacccgacuucgucggaaagauccaaggcaugcucacccaaaccacacgcaccgacgguuccacgcgcggccacaaagccacugucuauacaggcuccgccgacuucgcgcccaaacuuggacgcguacaauucggcaccgacaccgaucacgaccuagaagcaaaccaaaacaccaaauucacaccggucggcgucauccaagacggcucuacaacacaccgaaacgaaccccaacaauggguccuccccuccuacucaggacgaaacacucccaauguccaccucgcccccgccgucgcacccaccuuccccggcgaacaacuccucuucuuccgaucuaccaugcccggaugcuccgguuacccaaauauggaccucgacugccuccucccccaagaauggguccaauacuucuaccaagaagcagccccugcacaauccgacgucgcccuccuccgcuucgucaaccccgacaccggccgcguccuauucgaaugcaaacuccacaaauccggcuacgucacagucgcccacaccggacaacacgaccucguaaucccuccaaacgguuacuuucgcuucgacucaugggucaaccaauucuacacacucgcacccaugggcaacggcaccggccgcagacgcgcccucuaa

SEQ ID NO: 36760 - RNA, 1647 nt, Artificial Sequence
  derived and/or modified sequence opt11 from capsid_protein__Norovirus__AAB06271
augaagauggcaucaaaccgcgcagcaccuuccaacgacggagcagcgugccucguccccgaaaucaacaaugaagccauggcccuugaacccguagccggagcugcuaucgcagcaccccuaacaggacaacaaaacaucauugacccuuggaucaugaacaacuucguccaagcccccggcggagaauuuaccguaagcccccgcaacagcccaggcgaggucuugcucaaccucgaacucggacccgaaaucaacccuuaccucgcccaccucgcaagaauguauaacggauaugcgggcggcuuugaaguucaaguaguucucgccggcaacgcuuucaccgcugcaaaaaucauauucgcggccauuccucccaauuucccaauagacaaccuaucagccgcacaaaucaccaugugcccccacgucaucguagacguacgccaacucgaaccaauuaaucuucccaugcccgacguccgcaacaacuucuuccacuacaaucaaggcucagacucccgccuccgcuuaaucgccaugcucuacacaccccuucgugcaaauaacuccggcgacgacgucuucaccgucucaugccgcguccuaacccgcccauccccagacuuccucuucaacuuccuaguaccacccaccguagaaucaaaaaccaaaccauucacacuccccauacucaccaucucagaaaugucaaacucccgcuucccagucccaaucgacucccuccauaccucacccacagaaaacaucguuguccaaugccaaaacggccgcguaacacuugauggagagcuuauggggaccacccagcuacuaccaucccaaauaugcgccuuccgcggcacccuuaccggaagcacauccagagccagcgaccaagccgauacccccacaccccgccucuucaaccaccacuggcacauccaacuagacaaccuaaacggcaccccauacgaccccgccgaagacauucccgcaccccucggcacacccgacuuccgcgguaaagucuucggcgucgccggccagcgaaaccccgacucaaccacccgcgcccacgaagccaaagucgacaccaccuccggacgauucacccccaaacucggcucccucgaaauaaccaccgaauccgacgaccucgaucucucucaaccaaccaaauucacacccguuggcaucggcgucgauaaccgagccgaguuccaacaauggucccuccccgacuacuccggucaauucacccacaacaugaaccucgcccccgccgucgcccccaauuuucccggcgaacagcuccucuucuuccgaucccaacuaccaucuucaggcggaagauccaacggcguccuagauugccucguuccccaagaauggguacaacacuucuaccaagaauccgcccccgcacagacucaagucgcacucguccgcuacguuaaccccgacaccggucgcguacuuuucgaagccaaacuacacaaacucggcuucaugacagucgccaaaaauggcgacucccccauaaccgucccacccaacggcuacuuccgcuuugaaucaugggucaaccccuucuacacccucgcacccaugggcacaggcaacggccgccgccgaauccaauaa

SEQ ID NO: 36761 - RNA, 1620 nt, Artificial Sequence
  derived and/or modified sequence opt11 from capsid_protein__Norovirus__AAK96218
augaagauggcauccucagacgcaaaccccuccgacggcucaacagccaaccuuguacccgaaguuaacaacgaaguaauggcacucgaaccaguugucggagccgccauagccggcccgguugcaggccaacaaaacgucaucgaccccuggauccgcaacaacuucguccaagcucccgggggcgaguucaccgucuccccaacaaacgcccccggcgaaauacucuggucagcaccccucggccccgaccucaaccccuaccucucccaucucgcccguauguacaauggcuacgccggagguuucgaaguccaagucauccucgcaggcaacgccuucaccgccggcaaaaucaucuucgccgcaguaccaccaaacuucccuacagaaggacuaucacccucacaaguuaccauguucccccauaucaucgucgacguccgccaacuagaaccaguccuaaucccacuacccgacgcccgcaacaacuucuaccacuacaaccaaagcaaugacuccaccaucaaacucauagccaugcucuacaccccacuccgcgccaacaacgcuggagacgacgucuucaccgucucaugccgcguacuaacucguccaucccccgacuucgacuucauauuccucguaccacccacagucgaaucccgcaccaaaccauucacaguaccaauccuaaccgucgaagaaauguccaacucccgcuucccaaucccccucgaaaaacucuacacaggccccuccagcgucuucgucguccaaccccaaaacggccgcugcaccaccgacggcguccuccucgguacaacccaacucuccgccguaaacaucugcaccuuucgcggagaugucacccacauagccggcucccacgacuacaccaugaaccucgccucacaaaacuggaacaacuacgacccaaccgaagaaaucccagcaccccucggcacaccagacuucgucggaaaaauccaaggcaugcucacccaaaccacucgcgaggacggcucaacacgagccaccaaagccaccgucuccaccggaagcguacacuuuacacccaaacucggaagcguccaauauaccgccgauaccaacaacgauuuccaaaccggucaaaacaccaaauucacccccguaggcgucauccaagacggcucaaaccaccaaaacgaaccucagcaaugggucuuaaccaacuacucaggccgcaccggacacaauguccaucucgcucccgcagucgcucccaccuucccaggcgaacaauuacucuucuuccguucaacaaugcccggcugcucaggcuaccccaacaugaaccuagacugccuacucccacaagaauggguccaacauuucuaccaagaagcagcccccgcccaaucagacguagcccuacuuagauucguaaacccagauaccggaagaguacucuucgaaugcaaacugcacaaaucuggcuaugucaccgucgcacacaccggaccccacgaccucguaaucccacccaauggcuacuuccgcuucgaccccugggucaaccaguucuacacccuagcccccaugggaaacggggccgguagacgccgcgcccucuag

SEQ ID NO: 36762 - RNA, 1623 nt, Artificial Sequence
  derived and/or modified sequence opt11 from capsid_protein__Norovirus__AAR97648
augaaaauggccucuaacgacgcgaacccauccgacgguucaacagccaaccucguccccgaagucaacaaugaaguaauggcacuggaacccgucgucggggccgcaaucgccgcucccguugccggccaacaaaacgucaucgacccauggauccguaauaacuucguccaagccccuggaggggaguucacugucucaccccgcaacgcucccggagaaauacuauggucagcuccccucggaccagaccuaaaccccuaccucucccaccucgcacgcauguacaacggcuacgccggaggcuucgaaguccaagucauccuagcaggaaacgcuuuuaccgccggcaaaaucaucuucgcagccgucccacccaacuuccccaccgaaggccucucucccucccaagucacaauguucccccacaucaucguagacgucagacaacuagaacccguccucaucccccuccccgacguccguaacaauuucuaccacuacaaccagagcaacgaccccacaaucaaauuaaucgcaauguuauacacaccccuccgagcgaauaacgccggcgaagaugucuucaccguuuccugucgcguacucacccgacccuccccggacuucgacuucaucuuccucgucccacccaccgucgaaucccgcaccaaacccuucaccguccccaucuuaacuguugaggaaaugaccaacuccagauuccccauaccccuugaaaaacuauuuaccggcccuucaggcgccuucguaguucaaccccaaaacggacgaugcacaaccgacggcguccuacucggaaccacccaacucucccccgucaacaucugcaccuuccgcggugacgucacccauaucgcuggcacacacaacuacaccaugaaccuagccucccaaaauuggaacaacuacgaucccacagaagagauccccgcaccccuaggcacaccggacuucgucggccguauccagggaaugcucacccaaaccacccgaggugacggcucaacccgaggccacaaagccaccguaucaacaggcgacguccacuuuaccccgaaacucggguccauccaguucaacaccgacacuaacaacgacuucgaaacaggccaaaacaccaaauucacccccgucggcgucguacaggacggcaacggcacccaccaaaacgaaccccaacaauggguccuccccucuuacuccggccgcaccggccacaacguccaccucgcccccgcaguagcccccacuuucccgggagaacaacuacucuucuuccgcuccacaaugccaggcugcuccgguuaucccaacaugaaccuagacugccuacucccgcaagaauggguacaacacuucuaccaagaagccgccccagcccaauccgacguagcccuucugcgcuucgucaacccagacaccggacgcguacuauucgaaugcaagcuccacaaaucuggcuacgucaccguagcacacacaggccagcacgaccucguaaucccacccaacggauacuuccgguuugacucauggguaaaccaauucuauacccucgcccccaugggcaacgguacuggccgccgucgcgcacucuaa

SEQ ID NO: 36763 - RNA, 1623 nt, Artificial Sequence
  derived and/or modified sequence opt11 from capsid_protein__Norovirus__AAR97651
augaaaauggcuuccaacgacgccaaccccuccgacggaagcaccgccaaccucguacccgaagucaacaacgaagucauggcccucgaacccguggucggagccgcaaucgccgcccccguugcaggccaacaaaaugucaucgaccccuggauacgcaacaauuucguccaagcccccggaggagaguucacugucucaccccgcaacgcccccggcgaaauccuaugguccgcaccccuaggacccgaccuaaaccccuaccuuucacaccuagcccgcauguacaacggauacgcaggcggauucgaaguccaagucauacuugccggcaaugccuucaccgcaggaaaaaucgucuucgcugccguacccccaaacuuccccaccgaaggccucucaccaucccaagucaccauguucccacacauaauaguagacguccgccaacucgagcccguccucaucccgcuccccgacguccgcaacaacuucuaccacuacaaucaaucaaacgauccuacaauuaaacuaaucgcuaugcuauacacaccccuccgcgcuaacaacgccggggaagaugucuucaccgucuccugccgaguacuuacccgcccaucccccgacuucgacuucaucuuccuagucccaccaacaguagaaucccgaacaaaacccuucacagucccaauccuaacugucgaagaaaugaccaacagucgauuccccauaccccuagaaaagcuauucaccggaccguccuccgccuuugucguucaaccccagaacgguagauguaccaccgacggcguacuacuaggaacaacacaacuauccccagucaacauaugcacauuccguggcgacguaacccacaucgcuggaacccacaacuacaccaugaaccuagccagccagaacuggaacaacuacgacccaaccgaagagauccccgcaccacucggcacccccgacuucguaggccgcauccaaggcaugcuaacccaaaccacacgaggagacgguuccacccgaggccacaaagccaccguuuccacaggcgacguccacuucaccccuaagcucggcuccauccaauucaacacagacacaaacaacgacuucgaaaccggccaaaacaccaaauucacccccguaggcguaguccaagacggaaauggaacgcaccaaaacgaaccccaacaaugggucuuaccuuccuacucaggacgaaccggccacaacguccaccuagcgccagccgucgcaccaacauuccccggcgaacaacuacucuucuuccgcucaaccaugcccggcugcucgggcuacccuaacaugaaccuagacugccuucucccccaagaauggguccaacacuucuaccaagaggcagcuccagcccaauccgacguagcccuccuacgcuucguuaaccccgacaccggccguguccucuucgaaugcaaacuccacaaaucaggauacguaaccgucgcccacaccggacagcacgaccucguaauuccacccaacggcuacuuccgcuucgacuccugggucaaccaauucuacacccucgcccccaugggcaacggcaccggacgacgccgagcacuauaa

SEQ ID NO: 36764 - RNA, 1623 nt, Artificial Sequence
  derived and/or modified sequence opt11 from capsid_protein__Norovirus__AAR97654
augaaaauggccuccaacgacgccaaccccuccgacggcucaacggccaaccucguccccgaaguuaacaacgaaguaauggcccucgaacccguagucggagccgccaucgccgcccccgucgccggccaacaaaacgucaucgaccccuggauaagaaacaacuucguccaggcuccaggaggcgaguucacagucucaccccguaacgcccccggcgaaauccucuggucagcaccacuuggccccgaccucaacccauaccuaucccaccuagcccgaauguacaacggcuacgcaggaggcuucgaaguccaaguuauccuagcuggcaacgcauucaccgccgguaaaaucaucuucgcagccgucccgcccaacuuccccacagaaggccucucccccagccaagucacaauguucccccacaucaucgucgacguacgccaacuugaacccgugcucauccccuuacccgacguacgcaacaauuucuaccacuacaaccaauccaacgaccccaccaucaaacuaaucgccaugcucuacaccccacuacgagccaauaacgccggcgaagacguauucacaguaucaugccgaguacucacccgcccgagucccgacuucgacuucaucuuccucgucccacccaccguagaaucacgcaccaaacccuucacagucccaauacuaaccguagaagaaaugacaaacuccagauuccccauaccccuugaaaaacucuucaccggcccaagcggugcuuucgucguccaaccccaaaacggacgcugcaccaccgacggaguccuacucggcaccacccaacucagccccgucaacaucugcaccuuuagaggagacgugacacacaucgcaggaacacacaacuacacaaugaaccuagcaucacaaaacuggaacaacuacgaccccaccgaagaaauacccgcaccccuaggcacaccggauuucgucggaagaauccaaggcaugcucacacaaacaacccgcggcgacggcuccacacgcggacacaaggccacagucuccaccggcgacguccacuucacccccaaacuugggucgauccaauucaacaccgacaccaacaacgacuucgaaacuggccaaaacaccaaguuuacccccguagguguaguccaagacggaaacggaacccaccaaaacgaaccccaacaauggguacucccgagcuacuccggccgcacaggccacaacguccaccuagccccagccguagcacccaccuucccaggcgaacaacuccucuucuuccgcagcaccaugcccggcugcucugguuacccaaacaugaaccuagacugucuucucccccaagaauggguacaacacuucuaccaagaagccgcccccgcacaaucagacgucgcccuccuccgcuucgucaaccccgauaccggaagaguccucuucgaaugcaaacuacacaagucgggauacguaaccgucgcccacaccggacaacacgaccucgucaucccucccaacggcuacuuccgauucgacuccuggguaaaccaauucuacacacuagcccccaugggcaacggaaccggucgacgacgagcacucuga

SEQ ID NO: 36765 - RNA, 1623 nt, Artificial Sequence
  derived and/or modified sequence opt11 from capsid_protein__Norovirus__AAR97657
augaaaauggccucaaacgacgccaaccccuccgacggcuccacagcaaaucucgucccugaagucaacaacgaaguaauggcacucgaacccguagucggcgcagccauagccgccccagucgccggucaacaaaacgucauagaccccuggauccgcaacaacuuuguacaagcacccggcggcgaguucacagucagcccccgaaacgcacccggcgaaauccucugguccgcaccccuaggaccagaccucaaccccuaccuaucccaccuagcccgcauguauaacggauacgccggaggcuucgaaguccaagucauacucgccggaaacgccuucacugccggaaaaauuauuuucgcagccgucccacccaacuuccccaccgaaggccuauccccaucucaagucacaauguucccccacauaaucgucgacguccgacaacucgaaccugucuugaucccauuaccugacguccguaacaacuucuaccacuacaaccaaucaaacgaccccacaaucaaacuuauugccaugcuuuacacaccccuucgcgccaauaaugccggcgaagacguauucaccgucucaugccgaguccucacccgccccucgcccgacuucgacuucaucuuccucguacccccuaccgucgaaucccguacaaaacccuucaccguacccauacuaacugucgaagaaaugaccaacucccgcuucccaauaccccuagaaaaacuauucacaggcccauccggcgccuucguuguacaaccacaaaacggcagaugcaccaccgacggcguacuccuaggcaccacccaacuaagccccgucaacauaugcacauuccgcggcgacguaacccacauugccggcacccacaacuauacaaugaaccuagccucacaaaacuggaacaacuacgacccaacagaagaaauccccgccccacucggcacccccgacuuuguaggacgcauccaggggaugcucacccaaacaacccgcggcgacggauccaccagaggacacaaggccaccguuucaacaggagacguucauuucacucccaaacucgguuccauacaauucaacaccgacacaaacaacgacuucgaaaccggacaaaacacuaaauucacacccguaggcgucguacaggacggcaacggcacccaccaaaacgaaccccaacaauggguccuacccuccuacuccggccgcaccggccacaacguccaccuagccccagccgucgccccaaccuuccccggcgagcaacuccuauucuucagauccacgaugcccggaugcuccggcuaccccaacaugaaccucgacugccugcuaccucaagaguggguccaacacuuuuaccaagaagcagcccccgcccaaagcgacguagcccuucuccguuucguuaacccagacaccggccgcguacucuucgaaugcaaacuccacaaauccggcuacgucaccgucgcucacaccgggcaacacgaccuugucaucccucccaacggauacuuccgcuucgacucaugggucaaccaauucuacacccuagcacccaugggcaacggcacgggccgccgccgcgcacuuuaa

SEQ ID NO: 36766 - RNA, 1623 nt, Artificial Sequence
  derived and/or modified sequence opt11 from capsid_protein__Norovirus__AAR97660
augaaaauggccuccaacgacgccaacccauccgacggcucaaccgcuaaucucgucccagagguuaacaacgaaguaauggcccucgagcccgucgucggcgcggcaaucgccgccccaguagccggccaacaaaacgucauagacccauggauaagaaacaacuucguccaagcaccaggcggcgaauuuaccgucucaccccgcaacgccccaggcgaaauucuauggucggcaccccuaggcccagaccucaaucccuaucuuagccaccuagcccgcauguacaauggauaugccggaggauucgaaguccaagucauccucgcaggcaacgccuucaccgccggcaaaaucaucuucgccgccguucccccaaauuucccaacagaaggccuaucucccucccaaguaaccauguucccccacaucauagucgacguccgacaacuagaaccuguccucauaccauugccugacguccgaaacaacuucuaccacuacaaccaaagcaacgaucccaccauaaaacuaauagcaaugcuauacacaccccuccgcgcuaacaacgccggcgaggacguauucaccgucuccugccgcguccucacccgaccguccccagacuucgauuucaucuuccucgucccgccaaccguugaaucccgaaccaaacccuucaccguuccaauccucaccgucgaagaaaugacgaacagccgauucccuaucccacuugagaaacuuuucacuggccccucaggcgcauucgucguccagccccaaaauggacgcugcacaaccgacggcguccuacucggcaccacccaacucuccccagucaacauaugcaccuuccgcggagacguuacccacaucgcaggcacccacaacuacacaaugaaccucgcuagucaaaacuggaauaacuaugaccccaccgaagaaauaccagcaccccucggcacccccgacuuugucggccgcauacaaggaaugcucacccaaaccacacgcggcgacggauccacccgaggccacaaggccacuguaucaaccggggauguacacuucacccccaaacuaggcuccauccaauucaauacagacaccaacaacgacuucgaaacaggacaaaacaccaaauucacccccgucggaguaguccaagacggcaacggcacacaccaaaacgaaccccaacaauggguacucccaucguacuccggccgaaccggccauaacguccaccuagcccccgccgucgcccccaccuuccccggugaacaacuccuauuuuuccgcucaaccaugccaggaugcucagguuaccccaacaugaaccucgacugccuccuaccccaagaauggguccaacacuucuaccaagaagccgcacccgcacaguccgacguagcacuacuccgcuucgucaaccccgacaccggccgcguacuguucgaaugcaagcuccacaaauccggcuauguaaccgucgcccauaccggccaacacgaccucgucaucccacccaacggauacuucagguucgacucgugggucaaccaauucuacacacuagcaccaaugggcaacggcaccggacggcgccgugcacucuaa

SEQ ID NO: 36767 - RNA, 1623 nt, Artificial Sequence
  derived and/or modified sequence opt11 from capsid_protein__Norovirus__AAR97663
augaaaauggccagcaacgacgccaaccccuccgauggauccaccgcuaaccuaguaccagaaguaaacaacgaaguaauggcccucgaacccguugucggagcagccauagcugcccccgucgcaggccagcaaaacguaauugacccguggauccgcaacaacuucguccaagccccaggaggcgaguucaccguuucaccccgaaaugccccaggagaaauccuaugguccgcaccccucggacccgaccuaaaccccuaccugucccaccuugcccgcauguacaacggguacgccggaggcuucgaaguccaaguaauacucgccggcaacgcauucacagccggaaaaaucauauucgccgccgucccacccaacuucccaaccgaaggccuauccccaucccaagucacaauguucccacacaucaucguagacgucagacaauuagaacccguacucaucccccuacccgacguacgcaacaacuucuaccacuacaaccaacucaacgaccccacaaucaaacucaucgcuaugcucuacacaccccuacgcgccaacaacgccggcgaagacguuuucaccguuucguguagaguccucacccgccccucccccgacuucgacuucaucuuccuagucccacccacagucgaaucccgaaccaaacccuucaccguacccauccuaacagucgaagaaaugaccaacucacgcuuucccauuccccuagaaaaacucuucacaggccccucgggcgccuucguuguucaaccccaaaacggccgcugcaccaccgacggaguccuacuaggcacaacacaacuuucacccgucaacaucugcaccuuccguggcgacgugacccacauagccggcacccacaauuacaccaugaaccuagccucccaaaauuggaacaacuacgaccccaccgaagaaauaccugcaccccucggaacucccgacuuuguuggccgcauccaaggcaugcucacccaaacaacccgaggcgacggcagcacacgcggacacaaggcaaccgucuccacuggcgacguucacuucacacccaaacuaggauccauccaauucaacacugacaccaacaacgacuucgaaaccggccaaaacacaaaguucacacccgucggagucguccaagacggaaacggcacccaccaaaacgaaccccaacaauggguccucccaucauacucaggccgaacaggccacaacguccaccuagccccugccgucgccccaacauuccccggcgaacaacuacuuuucuuccguaguacaaugcccggaugcuccggguaucccaacaugaaccuagacugccuccucccacaagaguggguucaacacuucuaccaagaagcagcacccgcccagucagacguugcacuccuccgauucgucaacccugacaccggccgcguccucuucgaaugcaaacuccauaaauccggcuacgucaccgucgcccacaccggacaacacgaccuagucaucccacccaacggauacuuccgcuucgacuccuggguaaaccaauucuacacucuagcucccaugggcaauggcacuggacgccgacgagcccuauaa

SEQ ID NO: 36768 - RNA, 1623 nt, Artificial Sequence
  derived and/or modified sequence opt11 from capsid_protein__Norovirus__AAS86774
augaaaauggcaucaaacgacgccgccccuucuaacgacggcgcugccggccucguaccggaaguuaacaacgagaccauggcacucgaaccagucgcuggcgccucgaucgcagccccacuaacagggcaaaacaauguaauagacccauggauacgccuuaacuucguacaagcccccaacggugaauuuaccguaucaccccguaacuccccgggcgagauccuccucaaccuagagcucggacccgaacucaaccccuaccucgcccaccucgcccgcauguacaacggcuaugccggcggagucgaagugcaaguccuccuugccgggaacgcuuucaccgcaggcaagcuagucuucgccgccaucccuccccacuuccccguugacaacuuaucacccggucaaaucaccauguucccucacguaaucauagacguccgaacucucgaaccaguccuccucccccuaccagauguccgcaauaacuuuuuccacuacaaccaacaaucagaccaacggaugcgccuaguagccaugcucuauacaccccuacgcagcaacggauccggcgaugacgucuuuaccgucuccugccgcguccucacccgccccucgcccgacuucgacuucaacuaccucguaccacccacuguagaauccaaaaccaaacccuucucagucccaguacuaacucuaaacgaacucacaaacucccgauuccccguaccagucgacgccauguacaccuccccaaacgacucaaucgucguccaaccacaaaacggccgcgccaccauagacggcgagcuccucggcaccacccaacucauccccuccgguaucugcucauuccgcggaaaaauuaccacccaccucuccgaugaccgccaccucuggaacauucaaguaagcaaccucaauggaacuccuuucgacccaaccgacgacguccccgcaccacuaggcaugccagacuucucgggccaaaucuucggaguaguaucccaacgagacaccggcaccaaccccgccaaccgcgcccacgacgcaguccucgcuaccuacuccgccaaauacacacccaaacuuggcucaguccaaauuggcaccugggacacagacgaccuccucgaacgccaaccaguaaaauucacacccgucggccucaacgaaauaggacaagacaaacacuucgaccaauggguccuccccaauuacuccggcgcccucggccuuaacaugcaccucgcccccgccguaucacccuuauuccccggagaacgccuccucuucuuccgauccuacauaccacucaaaggcggccacggggaucccuucaucgauugccucgucccccaagaauggauacaacauuucuaccaagaaucagcacccgcccaauccucagucgcccuccuccgauacgucaaccccgacacuggacgaacccucuucgaagcaaaacuccacaaagaaggauucauaaccguauccuccacagaaaaccgccccgucauaguaccaccuaauggauacuuccgcuucgacucauggguaaaccaauucuacucauuagcucccaugggaacaggcaacggccgccgccgcaugcaauag

SEQ ID NO: 36769 - RNA, 1623 nt, Artificial Sequence
  derived and/or modified sequence opt11 from capsid_protein__Norovirus__AAS86777
augaaaauggcaagcaacgacgcugcccccuccaacgacggagccgcaggccucguccccgaaguaaacaacgaaacaauggcccucgaacccguagcaggcgccucaaucgcagcccccuuaacaggccaaaacaaugucauagacccauggauccgucucaacuucguacaagcacccaacggagaguucaccgucucaccccgcaacucccccggugaaguccuacuuaaccucgaacucggccccgaacuaaaccccuaccuagcccaucuugcccgaauguacaacggcuacgccggcggcgucgaaguccaaguccuccucgccggcaacgcauucaccgccggcaagcucgucuuugccgccauaccaccccacuuccccguagacaaccuaucccccggucaaaucaccauguuuccccacgucaucaucgacguacgaacccucgaacccguccuacuaccccuucccgacguccgaaacaacuucuuucacuacaaucaacaaucggaccaacgcaugcgccuaguagccaugcuauacacaccccuaagaucaaacggaucuggcgacgacgucuuuaccgucagcugccgcguccucacccgccccucacccgauuucgacuucaacuaccucgucccacccaccguagagucaaaaacaaaacccuucucaguccccguccuaacccucaacgaauuaacaaacucccgcuuccccguccccaucgacgcaauguacaccuccccgaaugacuccaucgucguccaaccccaaaacggucgcgcaaccaucgacggcgaacuacuaggcaccacccaacucaucccaucaggcaucugcucauuccgcggaaaaaucacuacccaccuauccgacgaccgccaccucuggaacauccaagucucaaaccuaaauggcacacccuucgacccuaccgacgauguacccgcaccccuaggcaugccugacuucuccggucaaaucuucggaguugucucgcaacgcgacaccggcaccaaccccgcaaauagagcccacgacgccguucucgccaccuauagcgccaaauacacccccaaacuaggaagcguucaaauagguacaugggacaccgaggaccuacuagaacgccaacccguuaaauucacccccgucggccucaacgaaaucggacaagacaagcacuucgaucaauggguccuaccaaacuacucgggcgcacucggccucaacaugcaccucgcacccgccgucucaccccucuuucccggcgaacgccuucucuucuuccgauccuacaucccccuuaaagguggcuauggagauccauucaucgacugccucgucccacaagaauggauccaacacuuuuaccaagaaucugcccccgcccaaucuagcgucgcccuacugcgauacgucaacccugacaccggccgcacacucuuugaagccaaacuucacaaagaaggcuucaucaccgucagcuccaccgaaaacagacccguaaucgucccucccaacggcuacuuccgcuucgacagcugggucaaccaauucuacucccucgcacccaugggaaccggcaacggccgccgccgaaugcaauaa

SEQ ID NO: 36770 - RNA, 1623 nt, Artificial Sequence
  derived and/or modified sequence opt11 from capsid_protein__Norovirus__AAS86780
augaugauggcgucuaaagacgcccccaccucccccgacggcgccuccggagcuggccaacucguccccgaagcuaacacagccgaacaaaucucaauggacccaguagccggcgccucaacagccgucgcaacagcuggccaagucaacaugaucgaccccuggauauucaacaacuucguucaagccccacaaggcgaguucaccaucucccccaacaacaccccaggcgauauacucuucgaccuccaacucggaccccaccucaacccauuccucgcccaccucucccaaauguacaacgguugggucggcaacaugcgcguacgcauacuccuugccggaaacgccuucaccgcaggcaaaauuaucauaugcugcgucccacccggcuuugacgcaagaauccucacuauagcccaagccacccucuucccucaccucaucgccgacguccgaacacucgaaccggucgaacucccccuugaagauguccggaacguccucuaucacaacucaucccaaccccaaccuacaaugcgacucgucgccaugcuuuacacuccccuccgcaccggaggaggcuccgguggcaccgacgccuucgucguagccggccgcgugcucacaugccccgcgccagacuucuccuuccucuuccuaguaccaccguccgucgaacagaaaacacgaguuuucuccgucccaaacauuccccucaaagaccuuuccaacucucgcguccccguccccauacaagguauguucaugucacccgacguaaaccaaucuguccaauuccaaaacgggcgaugccaaaucgacggccaacuacaaggaaccacccccguaucacuaucccaacucugcaaaauacgcggaaaaacauccucuaacgcccgaguccucaaccucuccgagguugacggcacccccuucgucccccucgaaucucccgccccagucggguucccagaucucgguggaugcgacuggcacguaaacuucaccuuucaagcgcaaaaccaagaccccucccaaucagucaccuucgccacaaaugacgcaucauucguccccuaccucggcuccaucagcccccacaaugguggcgacuuccaugccggcgacauaaucggaucacucggcuggaucuccgcacccuccgacaacacacaacucaacgucuggacaauccccaaauacggcuccucccucccagacguaacccaccuagccccagccguguucccacccggauucggcgaaguaauccucuacuuuuacuccaccuuccccggauccggccaacccucucaacuacaaguccccugccuacuuccccaagaguuuaucacccacuuuugcaacgaacaagcaccuaucgccggcgaagcagcccuccuacacuacguagacccagacaccggccgaaaccuaggcgaguucaaacucuacccagauggauucaugacaugcgucccuaacucaguaucuuccggaccacaaacccucccgauaaacggcgucuucgucuucgucuccuggguuucacgcuucuaccaacucaagccagucggcacugccucggcagcucgccgccucggcuuacgacgcauauaa

SEQ ID NO: 36771 - RNA, 1623 nt, Artificial Sequence
  derived and/or modified sequence opt11 from capsid_protein__Norovirus__AAS86783
augaugauggccuccaaagacgcgcccaccuccccagacggggccuccggcgcaggccagcuaguccccgaagcaaacaccgccgaacaaaucucaauggaccccgucgccggagccuccaccgccgucgccaccgccggucaggucaacaugauagauccauggauauucaauaacuuuguacaagcaccccaaggcgaauuuaccaucucucccaacaacacccccggcgauauacuguucgaccuccaacucggcccccaccucaaccccuuccuagcccaccucucacaaauguacaacggcuggguaggcaacaugcgaguccgaauccuacucgccggcaaugccuucaccgcaggaaagauaaucaucugcugcgugccaccaggcuucgacgcccgaauccuaaccaucgcacaggcaacccuauucccccaccuaauagccgacguacgaacccuagaacccgucgaacucccccuugaagacguccggaacgucuuauuucacaacuccucacaaccccaacccaccaugagacucguagccaugcuuuacacaccccuccgcaccggcggaggcuccggaggcaccgacgccuucguugucgccggccgcguccucacaugcccggccccagacuuuucauuccucuucuuagucccuccauccguugaacaaaagacucgcguauucuccgucccuaacgucccacuaaaagaccuuuccaacucccgcgucccuguacccauccaaggcauguuuaugucacccgacgucaaccaaucuguacaauuccaaaacggccgcugccaaaucgacggccaacugcagggcaccacccccgucucccucucacaacucugcaaaauucgcggcaaaaccucaucaaacgcccgaguacuaaaccuaucugaaguagacggauccccauucauaccacuggaaucccccgcacccgucggcuuccccgaccucggagguugcgacuggcacgugaacuucacauuccaagcacaggaccaagaccccucccaaucagucacauucgccaccaacgacgcauccuucgucccauaccugggcuccauaagcccucacaacggcggcgacuuccacuccggcgacaucauuggauccuuaggcuggauauccgcccccucagacucaucacaacuaaaugucuggaccaucccgaaauauggcuccucccuacccgacgucacccaccuugccccagcagucuucccacccggcuucggcgaagugauccuauacuucuacuccaccuuccccggcuccggucaaccuguccaacuccaaguaccaugccuacuaccccaagaauuuaucacacacuucugcaaugaacaagcccccauagccggcgaagcagcucuccuacacuacgucgaccccgacacaggccgcaauuuaggagaguucaaacucuacccagacggcuucaugaccugcgucccaaacagcgucuccucuggcccccaaacccuaccaauaaacggcguauuugucuuugucuccuggguaucccgauuuuaccaacucaaacccgucggcacagcauccgucgcacgccgccucggacuccgacgcauauga

SEQ ID NO: 36772 - RNA, 1623 nt, Artificial Sequence
  derived and/or modified sequence opt11 from capsid_protein__Norovirus__AAS86786
augaaaauggcaucaaacgacgccgcccccucaaacgacggcgccaccggccuaguccccgaaaucaacaacgaaacccucccacucgaaccaguagccggagccgcgaucgccgccccaguaacuggccagaacaacaucaucgaccccuggauccgcaccaauuuugugcaagcgcccaacggcgaauuuaccgucagcccccgcaacucccccggcgaaauccuacucaaccucgaacuuggacccgaccucaaccccuaccucgcccaccuaucccguauguacaacggauaugccgguggcgucgaaguacaaguccuccucgcaggcaacgccuucaccgcaggcaaaauccucuucgccgccgucccaccaaacuucccgguagaauuucuaucacccgcacaaaucaccaugcuaccucaccuaauagucgacgucagaacacuugaaccaaucaugaucccacuccccgacguccgcaacaccuucuuccacuauaacaaccaacccgccaaccgaaugcgauuaguagccaugcuauacacaccacuccgcuccaacgguuccggagacgacgucuucaccguaagcugucgcguccuaacacgccccacccccgacuucgaguucacauaucucguacccccauccguggaauccaaaaccaaacccuucucgcuucccauacuaacuauauccgaacuaaccaacucacgauuccccgccccuaucgauucacuauucaccgcacaaaacaacaaccuaaacguucaaugccaaaacggucguuguacuuuagacggcgaacuccaaggcacuacacaacuccucccauccggcaucugcgcauuccguggccgccuaaccgcugacguagacggcucccacgacgaccgauggcacaugcaacuaacuaaucucaauggaaccccauucgacccuaccgaagacgucccagcaccccuaggaaccccagacuucaccggccuccucuucggcgucgccucccaacgaaacgucggcucaaaccccaacaccacaagggcccacgaagccguaguuuccaccacauccucacaauucguucccaaacucggaucaguaaacuucggauccaccucgaccgacuuccagcuucaacaacccaccaaauucaccccagucggcaucaaaauagaaucaggacacgaguucgaucaaugggcauuaccacgauacuccggucacuuaacccucaacaugaaccuagccccgcccauugcacccaacuucccaggggaacaauuacucuucuuccgaucuaacguccccugcgccggcgguguaucugacggcguaaucgacugccuccuuccccaagaauggauccaacacuucuaccaagaaagcgcacccucucaaucagacgucgcccucauccgcuacguaaaccccgauacaggacgaaccuuauucgaagccaaacuccaccgaaccggcuauaucacugucgcccacuccggcgacuacccccuaguagucccaucaaacggcuacuuccgauucgacuccugggucaaccaauucuacucacuagcccccaugggaacuggaaacggccgacgacgcguccaauaa

SEQ ID NO: 36773 - RNA, 1623 nt, Artificial Sequence
  derived and/or modified sequence opt11 from capsid_protein__Norovirus__AAS86792
augaaaauggcauccaacgacgcggcacccuccaacgacggcgcugcaggccuagucccagaaguaaacaacgaaaccauggcucuugaaccggucgccggagccucgaucgccgcuccccugacaggccaaaacaacgucaucgacccuuggauccgacuaaacuucguccaagccccaaacggcgaguucaccgucucaccccgaaacucccccggagaaauccuccucaaccuagaacuuggcccagaacucaauccauaccucgcgcaucuugcccgcauguacaacggguacgccggcggaguagaaguccaaguacuccucgcaggcaacgcauuuaccgcaggcaagcuaguauucgcagccauacccccacauuuucccgucgacaaccucucccccggccaaaucaccauguucccccacgucauaauagauguccgcacacucgaacccguccuccucccccuacccgacguacgcaacaacuucuuccacuacaaccaacaauccgaccaaagaaugcgccucaucgcgaugcucuacacaccccuacgaucaaacggcuccggugacgacgucuucaccgucuccugccguguacuaacccgccccuccccagacuucgacuucaauuaccuuguuccacccacagucgaaucaaaaacuaaacccuuuuccguccccguacucacacucaacgaacuuaccaacucacgauuucccguccccaucgacgccauguacaccucacccaacgacucgaucgucguacaaccucagaacggacgcgccaccauagacggagaacuacucggcaccacacaacuaaucccauccggcaucugcagcuuccgcggcaaaauaaccacacaccucucagacgaccgccaccuguggaauguccaagucuccaaccucaacggcacccccuucgaccccacagaugacgucccggccccacuaggcaugccagacuucucaggccaaauauuuggggucgucucccaacgcgacaccggcaccaaccccgccaacagagcccacgacgccguccuagccaccuacuccgcuaaguacacacccaaauugggauccguacaaauaggcacaugggacaccgaagaccuccuagaaagacaacccgucaaauucacccccgucggacuaaacgaaaucggccaagacaaacacuucgaccaauggguucuucccaacuacuccggugcccuuggccucaacaugcaccucgcuccugccgucucaccucucuuccccggagaacgccuacucuucuucagaucauacaucccccucaaaggcggccacggcgaccccuucaucgacugccucgucccacaagaauggauccaacacuucuaccaggaauccgcaccagcacaaucauccgucgcccuacuccgcuacgucaacccugacacaggccgaacccuauucgaagccaaacuccacaaagaaggcuucaucaccgucucuuccaccgaaaaccgucccguaaucgucccaccaaacggauacuuuagauucgacucuugggucaaccaauucuacucacucgcaccaaugggcacuggcaacggacgacgacgcaugcaauaa

SEQ ID NO: 36774 - RNA, 1623 nt, Artificial Sequence
  derived and/or modified sequence opt11 from capsid_protein__Norovirus__AAS86795
augaaaauggcaucuaacgacgccgcuccuucaaacgacggagcugcuggacucguccccgaaguaaacaacgaaaccauggcccucgaaccagucgcaggagcaucaauagccgcaccccucaccggccaaaacaacgucauagauccauggauccgucuaaacuucguccaagccccuaacggcgaguucaccgucuccccacgaaacucccccggcgaaauccuccucaaccucgaacuaggaccagaacuaaacccauaccuugcccaccucgcccgcauguacaauggauacgccgguggagucgaaguacaaguccuacuugccggcaacgccuucaccgccggcaagcuagucuucgccgccauaccuccccacuuccccgucgauaaccucucaccuggacagauaacaauguucccccaugucaucauagacguacgcacccucgaacccguccuccucccacucccagacguucgcaacaacuucuuccacuacaaccaacaguccgaccaacgcaugcgccuagucgcgaugcucuacacaccccuccguucuaacggcuccggcgacgacguauucaccguauccugccgcgucuuaacccgccccucccccgacuucgacuucaauuaccuagucccacccacagucgaaucaaaaacaaaacccuucucaguacccguccucacccuaaacgaacucaccaacucucguuucccaguccccaucgacgccauguacaccucaccaaacgacuccauagucguccaaccacaaaacggccgagcaaccauagacggagaacuccucggaacaacucaacugaucccuuccggaaucugcucauuccgcggaaaaaucacuacccaccucucugacgaccgacaccucuggaacauacaagucagcaaccucaacggcaccccauucgacccuaccgacgacguacccgcuccccucggcaugccggacuucuccggacaaaucuuugguguuguaucacaacgcgacacuggaaccaacccagccaaccgggcccacgacgcaguccucgccacauacucagcaaaauauaccccaaaacuaggauccguacaaauaggaaccugggacaccgaagaccuccucgaacgacaacccgucaaauucacucccgucggucuaaacgaaauuggccaagacaaacacuuugaccaauggguccuacccaacuacucaggcgcccucggccucaauaugcaccucgcaccagccgucucaccacuauucccuggagaacgacuacuauucuuccguucauauaucccacuaaaaggcggacacggcgacccauucaucgacugccucguuccccaggaauggauccaacacuucuaccaagaguccgccccagcccaauccucagucgcauuacuccgauacgucaaccccgacaccggccgaacacuguuugaggccaaacuccacaaagaaggcuucaucacagucagcucuaccgaaaaccgacccguaaucguucccccuaacgguuauuuccgcuucgacuccugggucaaccaauucuacucacucgccccaaugggaacaggcaacggacgccgacgcaugcaauaa

SEQ ID NO: 36775 - RNA, 1623 nt, Artificial Sequence
  derived and/or modified sequence opt11 from capsid_protein__Norovirus__AAS86798
augaaaauggcauccaacgacgccgcccccuccaacgacggcgcagcaggacuuguccccgaaguaaauaacgaaaccauggcccucgaacccgucgccggagcauccauagcugcaccccucaccggccaaaacaacgucaucgacccguggauccgccucaacuucguccaagccccaaacggcgaguucaccguauccccuagaaacucccccggagaaauacuacuaaaccucgaacucggccccgaacucaacccauaccucgcccaccuugcacgcauguacaacggcuacgccggcggaguagaaguucaaguacuacucgcaggcaacgcauucaccgccggcaaacucguuuucgccgccauacccccacacuucccagucgacaaccuaucccccggccaaauaaccauguucccacacgucaucaucgacguccgcacucucgaaccuguccuucucccccugcccgacguccgaaauaacuucuuccacuacucacaacaauccgaccaacgcaugcgccucgucgccaugcucuacaccccucuuagaucuaauggauccggcgacgacgucuuuaccgucucaugccgcguccuaacccgcccguccccagacuucgacuucaacuaccuagucccaccaaccgucgaauccaaaaccaaacccuucuccguaccaguccucacccuuaacgaacuaaccaacucccguuuccccgucccaauagacgcuauguacaccucccccaacgacucaauaguaguccaaccccaaaauggacgcgccaccaucgacggcgaacuacucggaaccacacagcucaucccguccggcaucugcuccuuccgaggcaaaauuacaacacacuuaucggacgaccgccaccucuggaacauccaaguaucaaaccucaacggcaccccauuugaccccacagacgacguacccgcuccccucggcaugcccgacuucuccggccaaaucuucggagucgucucccagcgugacacaggcaccaaucccgccaaucgcgcccacgacgccguccucgccaccuacagcgccaaauacacacccaaacucggcuccguccaaaucggaaccugggacaccgaagaccuccuagaacgucaaccgguaaaauucacacccgucggacuaaacgaaaucggacaggacaaacacuucgaccaauggguacuccccaacuauuccggcgcccucggacucaacaugcaccuagccccagccgucucaccccuauuccccggagaacgccucuuauucuuccgcuccuauauuccccucaaaggcggccacggcgaccccuucaucgacugccuagucccccaagaauggauacaacacuucuaccaagaauccgcccccgcacaauccuccguagcauuacuacgcuacgucaaccccgauaccggccgaacccucuucgaagccaaacuacauaaagaagguuucauaaccguuuccucaacagagaaccgcccaguaaucguucccccgaacggauacuuccgcuuugacuccugggucaaccaauucuacucacuagcaccaaugggcaccggcaaugggcgccgucgcaugcaauaa

SEQ ID NO: 36776 - RNA, 1623 nt, Artificial Sequence
  derived and/or modified sequence opt11 from capsid_protein__Norovirus__AAS86801
augaaaauggccuccaacgaugccgccccuucaaacgauggcgccgcuggccuaguccccgaagucaacaacgaaacgauggcccucgaacccguugcaggcgccuccaucgccgcaccccucacaggacaaaacaacguaauagacccauggauacgucucaauuucguccaggccccuaacggcgaauuuacagucucgccaagaaacucacccggcgagauucuccucaaccuagaacuaggucccgaacuaaacccauaccucgcccaccucgcccgcauguacaacggcuacgccggaggagucgaagugcaaguccuacucgccggaaacgccuucaccgccggaaaacuggucuucgcagccauaccaccccacuucccagucgacaaccuaucaccuggccaaaucaccauguucccacacgucauaaucgacguccgcacauuagaacccguccuacucccccuuccugacguccgaaacaacuucuuccacuacaaccaacaauccgaccaacgaaugcgccucgucgcaaugcucuacacuccacuacgcucaaauggcuccggcgacgacguauucaccgucuccugccgcguccucacccgccccuccccagacuucgacuucaauuaccuagucccacccaccgucgaguccaaaaccaaaccuuucucugugccaguccucacccucaaugaacucaccaacucacgauuccccgucccaaucgacgccauguauaccucucccaacgacuccaucgucguacaaccccaaaacggccgcgcaaccaucgacggcgaacuccuagguaccacccagcuuauacccucgggcaucugcucauuccgcggcaaaaucaccacacaucucuccgaugaccgccaccuauggaacauucaagucuccaaccucaacggcacucccuuugaccccacagaugacgucccugcaccacuaggaaugcccgacuucucuggacaaauauuuggcgucgucucccaacgcgacacaggcacaaaccccgccaaccgagcccacgacgcaguacucgccaccuacuccgccaaauacacccccaaacuaggaagcguacaaaucggcaccugggacaccgaagaucuacucgaacgccaaccagucaaguucacucccguaggccuuaacgaaaucggucaagauaaacacuucgaccaguggguacuaccaaacuacucaggcgcccucgggcuaaacaugcaccuagccccagcggucuccccacuauucccaggagaacgacuccuauuuuuccgcucauacauaccccuaaaaggcggucacggcgaccccuucaucgacugccucguaccucaagaauggauccaacacuucuaccaagaauccgcacccgcacaaucaucaguagcccuccuacgcuacgucaacccagacaccggccgcacccuauucgaagcaaaacuucacaaagaaggcuucaucaccgucagcuccacagaaaaccgaccagucaucgucccacccaauggcuacuuccgcuucgacagcugggucaaccaauucuacucauuagcacccaugggcaccggaaacggccgccgccgaaugcaauaa

SEQ ID NO: 36777 - RNA, 1623 nt, Artificial Sequence
  derived and/or modified sequence opt11 from capsid_protein__Norovirus__AAS86804
augaaaauggccuccaacgacgccgcccccaguaacgacggcgccgccggccuaguccccgaaguaaacaacgaaaccauggcacuugaacccgucgccggcgccuccauagccgcaccccucaccggacaaaacaaugucaucgaccccuggauucgacuaaacuucguacaagcccccaacggagaguucaccguauccccucgcaacuccccaggcgaaguccuccucaacuuagaacugggccccgaacucaaccccuaccucgcacaccucucgagaauguacaacggcuacgccggagguguagaaguccagguccuucucgcaggcaacgccuucacugcaggcaaacuuguauucgcugccaucccaccacauuuccccgucgacaaccucucccccggccaaaucacaauguucccccauguuauaaucgacguaagaacccuagaacccguauuacucccccuccccgacguacgcaacaacuuuuuccacuacaaucaacaaucagaccaacgcaugcgucucauugccaugcuauacaccccacucagauccaacggaucuggcgacgacgucuucaccguauccugccgcguccucacaagacccucccccgacuucgacuucaacuaccucguaccgccaacugucgaauccaaaaccaaacccuucucaguucccguccuaacacucaacgaacucaccaacagccgcuuccccgucccuaucgacgccauguacacuagccccaacgacuccgucgucguucaaccccaaaacggacgcgccacaauagacggcgaacuccuaggcacuacccaacugaucccaagcggcaucugcuccuuccgcggaaaaaucacaacccaccucucagacgaccgccaccucuggaacauacaagucucaaaccucaacggaacucccuucgaccccacagacgacgucccagcaccccucggcaugccagacuucagcggccaaaucuucggcgucaucucucaacgagacaccgguaccaaccccgccaaccgagcccacgacgccguccucgccaccuacucagcaaaauacacucccaaacucggcagcguacaaaucgguaccugggacaccgaagaccuacuggaacgccaacccgucaaauucaccccaguaggacucaaugaaaucggccaagacaaacacuucgaccaauggguacuaccgaacuacuccggcgcacucggccucaacaugcaccucgcgcccgccgucagcccccucuuccccggggaacgacuucuauuuuuccgauccuacaucccccugaaaggaggucacggcaaccccuucaucgacugccuagucccccaagaauggauacaacacuucuaccaagaauccgcccccgcacaaagcuccgucgcccuccuacgcuacgucaacccugacaccggccgcacacuauucgaagccaaacuucacaaagaaggcuucauaaccgugagcagcaccgaaaaccgacccgucauaguacccccuaacggcuacuuccgauucgacuccugggucaaccaauucuacagccucgcaccaaugggcaccggaaacggccgacgccguaugcaauaa

SEQ ID NO: 36778 - RNA, 1593 nt, Artificial Sequence
  derived and/or modified sequence opt11 from capsid_protein__Norovirus__AAS86807
augaugauggccagcaaagacgccaccuccaacguagacggugccuccggagcaggacaacucguccccgaagccaacaccucagacccauuagcuauggaccccgucgcuggaucauccaccgccgucgcuaccgcuggucaagucaaccccaucgaccccuggaucauaaacaacuucguucaagccccacaaggcgaauuuaccaucucccccaacaacaccccaggugacguccucuucgaccuaagucucggaccccaucucaaccccuuccuacuccaccuuucacagauguacaacggcuggguaggcaacaugcgcguccgcaucaugcucgccggcaacgccuucaccgccggcaaaauaaucgucucaugcauacccccagguuucggaucccacaaccuaaccaucgcccaauccacacuuuucccacacgucaucgcagacguccgaacgcucgacccaaucgaaguuccccucgaagacgugcgcaacguacuauuccacaauaacgaccgcaaccaacaaaccaugcgccuagucugcauguuauacacuccccuccgcacaggcggcggcaccggcgacuccuucgucgucgccggccgcgucaugaccugccccucccccgacuucaacuuucucuuccugguaccacccaccgucgaacagaaaacgcgacccuucacucuccccaaccuaccccucuccucccucucaaacucccgagccccacuacccaucucaucgaugggcaucucacccgacaacguccaaucaguccaauuccaaaacggccgcugcacccuagacggacgucuagucggaacaaccccaguaucacuaucccaagucgccaaaauccgcggcaccuccaacgguaccguaauaaaccuaacugaacucgacggcacucccuuccaucccuucgaaggacccgcccccauaggcuucccagaccucggcggcugcgacuggcacguaaacaugacacaauucggccacuccucccaaacucaauucgaugucgacacuacaccagaaacuuucgucccccaccucggcucuauccaagccaacggcguugguuccggaaacuacauaggcguacuuuccuggauaagcccacccucgcacccauccggcucccaagucgaccucuggaaaaucccaaacuaugguuccucgaucaccgaagcaacccaccucgcucccagugucuucccacccggcuucggcgaaguccuagucuucuucauguccaaaauacccggccccggcgccuacaaucuacccugccuacuuccucaagaauacauaucccauuucgcaucagaacaggcccccacaguaggcgaagcagcacuccuccacuacgucgauccagacacaggccggaaccugggcgaguucaaagccuacccagacggauuccuaaccugcguuccuaacggagcauccucuggcccccaacaacuccccaucaacgguguauucguguucgucuccugggucucccgauucuaccaacucaaacccguuggcaccgccucauccgcccgcggucgccuaggcuuacgccgcuaa

SEQ ID NO: 36779 - RNA, 1623 nt, Artificial Sequence
  derived and/or modified sequence opt11 from capsid_protein__Norovirus__AAT00237
augaaaauggccuccaacgacgcaaacccauccgacggcuccacagccaaccucguaccagaaguaaacaacgaaguaauggcccucgaaccaguugucggugccgcaauagccgccccaguagccggacaacaaaacgucauagaccccuggaucagaaacaacuucguacaagcacccggcggcgaguucaccgucucuccccguaacgcccccggcgaaauccucugguccgcuccccucggaccugaucucaaccccuaccuaucccaccucgcccgaauguacaacggcuacgccggcggcuucgaagugcaaguaauccuagccggcaacgccuucacagcaggcaagaucaucuucgccgccgucccacccaacuuccccaccgaaggacuaucucccagccaagucaccauguucccccacaucaucgucgacguacgacaacucgaacccguccucaucccccuaccagacguccgaaacaacuucuaccauuacaaccaaucaaacgaccccaccaucaaacucaucgcuaugcucuacacuccgcuccgagccaacaacgcaggagaagacguuuucaccgucuccugccgaguccuaacccgcccauccccagacuucgacuucaucuuccuagucccgcccaccgucgaaucccguacaaagcccuucaccguacccauccuaacugucgaagaaaugaccaacucccgauuucccaucccacucgaaaaacucuucaccggccccucaggcgccuucgucguccaaccccaaaacggacgaugcacuaccgacggcguccucuuaggcaccacccaauuaucccccgucaacaucugcgcauuccgcggcgacguaacacacaucgccggaacucacaacuacaccaugaaccuugcaucccaaaacuggaacaacuacgaucccacugaagaaauccccgcaccccuaggcacccccgacuucgucggccguauccaagguaugcuaacacaaacaacccgcggcgacggcuccacccgcggccacaaagccacaguauccaccggagacguacacuuuaccccaaaacuaggcuccauacaguucaacaccgacaccaacaacgacuucgaaacaggacaaaacaccaaauucacccccgucggcgucguucaagauggcaacggcacucaccaaaacgaaccccagcaauggguacuccccuccuacuccggcagaacaggccacaacguacaccucgccccagcagucgcaccaaccuuccccggagaacaacuccuguucuuccgcuccaccaugccaggcugcuccgguuacccaaacaugaaucuagacugucuucuaccucaagaauggguccaacacuucuaccaagaagcagccccagcccaaucagacguugcccuacuccguuucgucaaccccgacacaggacgcguacucuuugaaugcaaacuccauaaaucaggcuacguaaccgucgcccacacaggacagcacgaccucgucauaccacccaacggauacuuccgcuucgacuccuggguaaaccaguucuauacccucgccccaaugggcaacggcacaggacgucgacgcgcccucuaa

SEQ ID NO: 36780 - RNA, 1623 nt, Artificial Sequence
  derived and/or modified sequence opt11 from capsid_protein__Norovirus__AAT00240
augaaaauggccucaaacgacgcaaaccccucagacggcuccacagccaaccucguccccgaagucaauaaugaaguaauggcccuagaaccaguggucggcgccgccaucgccgcucccgucgccggucaacaaaacgucaucgacccuuggauccgcaacaacuucguacaagcacccggcggcgaguucaccgucagcccccggaacgccccaggcgaaauccucugguccgcaccacuaggacccgaccucaaccccuaccuuagucaccucgcccgaauguacaacggauacgccggcggguucgaaguccaagucauccucgcuggcaacgcauucaccgccggcaaaauuaucuucgccgccguaccucccaacuuccccaccgaaggccucucccccucacaagucacuauguucccacacauuaucguagacguccgccaacucgaacccguacucaucccacucccagaugucagaaacaacuucuaccacuacaaccaauccaacgaccccacaauuaaacuaaucgccaugcucuacacuccccuccgcgcgaacaaugccggcgaagacgucuucaccguaucaugccgaguccucacccgcccaagcccagacuucgacuucauauuccucgucccacccaccguugaaucccgcaccaaacccuucaccguccccauccucaccguagaagaaaugaccaacucccgauuucccaucccccuagaaaaacuauucaccggcccuucaggcgcauucguaguccaaccccaaaacgggcguuguaccacagauggcguccuccucggcacaacccaacucucaccuguuaauaucugcgccuuccgaggcgacgucacacauaucgcaggcacacacaacuacaccaugaaccucgcgagccaaaacuggaauaacuacgaccccacagaagaaauccccgccccacuuggcacaccagacuuuguaggccguauacaaggcaugcuuacacagacaacccgcggcgacggcucaacccgcggccacaaagccaccguauccacuggugacguccauuucacccccaaacuaggaucaauucaauucaacacagacacaaacaacgacuucgagaccggccaaaacaccaaauucacccccgucggaguaguccaagacggaaauggcacccaccaaaacgaaccacaacaauggguccucccauccuacucaggccgaaccggacacaacguacaccuagcccccgccguugcccccacauuccccggcgaacaauuacucuuuuuccgcuccacuaugcccggcugcucaggauaccccaacaugaaccuagacugccuccuaccgcaagaauggguccaacauuuuuaccaagaagcugcaccagcccaguccgacguagcacuacuccgcuucguaaaucccgacaccggacgaguccuauucgaaugcaaacuccacaaaucaggauacgucacagucgcacacaccgggcaacacgaucucgucauaccacccaacggauacuuccgcuucgacagcugggucaaccaauucuacacacuagcacccaugggcaacggcaccggccgacgucgcgcccucuaa

SEQ ID NO: 36781 - RNA, 1623 nt, Artificial Sequence
  derived and/or modified sequence opt11 from capsid_protein__Norovirus__AAT00243
augaaaauggccucaaacgacgccaaccccuccgacggaucuaccgccaaccucguccccgaaguaaacaacgaaguaauggcacuagaaccugucgucggcgccgccauugcggccccagucgcaggccaacaaaacguaaucgacccauggauucgcaacaacuucguccaagcccccgguggggaguucaccgucuccccacgcaacgcaccaggcgaaauacucugguccgcuccacucggccccgaccucaacccuuaccucucccaccucgcccgcauguacaacggauacgccggaggcuucgaaguccaagucauccucgccggcaacgccuucaccgccggcaaaauaauauucgcagccgucccacccaacuuccccaccgaaggccuuucccccagucaaguaaccauguucccccacaucauagucgacguaagacaacuagaaccuguccuaaucccccuccccgacguccgcaacaacuucuaccacuacaaccaaucgaacgaccccacaauuaagcucauagccaugcuauacacaccccuccgcgcaaacaaugcuggcgaagacguauucacagucucaugcagaguacuaacccgccccucacccgacuucgacuucauauuccucguaccaccaaccgucgagucccgaaccaaacccuucacagucccaauccucaccgucgaagagaugacaaacuccagauuccccauuccucucgaaaaacucuucaccggacccagcggcgccuucgucguccaaccacagaacggacgcugcacaaccgacggcguacuacucggaaccacccaacuauccccaguaaacauaugcgccuuccgcggagacgucacacacauagccggcacccauaacuacaccaugaaccucgcaucacaaaacuggaacaacuacgaccccacagaagaaaucccagcaccacucggcacccccgacuucguaggacgcauccaaggcaugcucacacaaaccacacgaggcgacggcuccacccguggucauaaagccacagucuccaccggcgacguacacuucacacccaaacucggauccauccaauucaauaccgacacaaacaacgacuucgaaaccggccaaaauaccaaauucaccccaguaggagucguccaggacggcaacggcacucaucagaacgaaccccaacaauggguucucccauccuacuccggccgcaccggccacaacguccaccuagccccagccguugcccccaccuucccaggugagcaacuccucuucuuccgcucuaccaugccaggcugcuccggauaccccaacaugaaccucgacugccuccucccccaagaauggguacaacacuucuaccaagaagccgcccccgcccaaucagacgucgcccuccuucgcuucguuaaccccgacacaggucgcguccuuuucgaaugcaagcuccacaaaucaggcuacguaacaguugcccacaccggacaacacgaccucgucauaccaccaaacggauacuuccgcuucgacucaugggucaaccaguucuacacccuagcaccuaugggaaacggaaccggacgccgccgcgcauuauaa

SEQ ID NO: 36782 - RNA, 1623 nt, Artificial Sequence
  derived and/or modified sequence opt11 from capsid_protein__Norovirus__AAT00246
augaaaauggccuccaacgacgccaaccccuccgacggcuccacagcaaaccuagucccagaagucaauaacgaaguaauggcccuagaacccguagucggcgccgccauagcugcccccguugccggccaacaaaacgucaucgaccccuggauccgcaacaacuucgugcaagcccccggcggugaguucaccgucuccccacgaaacgcccccggcgaaauccucuggucagcaccccucggucccgaccuuaaccccuaccucucccaccuagccagaauguacaacggcuacgccggaggcuuugaaguccaggucauccuagcaggcaacgcuuucaccgcagguaaaauaauauucgcagccguucccccaaacuucccuaccgaaggacucucccccucccaagucaccauguucccacacaucauugucgacguccgccaacuagaacccguucucaucccccuccccgacguacgaaacaacuucuaccauuacaaccaaagcaacgaccccaccaucaaacucaucgcaaugcucuacacaccccuccgcgccaacaacgccggcgaagacgucuucaccgucucaugccgcguacucacacgcccaucccccgauuuugacuucaucuuucuaguacccccaaccguagaaucccgcaccaaaccuuucacaguccccauccucacagucgaagaaaugacaaacucccgauuccccaucccccuugaaaaacuuuucaccggccccucgggagcauucguaguccaaccacaaaacggccgaugcaccaccgacggaguacuccuaggaaccacccaacucucuccggucaacauaugcgcauuccgcggagacgucacccacaucgccggcacccacaacuacaccaugaaccuagcaucacaaaacuggaacaacuacgaccccacagaagaaauacccgcuccccucggcacacccgacuucgucggccgcauacaaggaaugcucacucaaaccacacgaggagacggcucuacccgcggccacaaagccacaguuuccaccggcgacguacacuucacaccaaaacucggcuccauccaauucaacaccgacacaaacaacgacuuugaaaccggacagaacacuaaguucacaccagucggcguaguccaagacggaaacggaacacaccagaacgaaccccaacaauggguccucccauccuacuccggccgcacaggccacaacgugcaccucgcccccgccgucgcccccaccuuccccggagaacaacuccucuuuuuccgcuccaccaugcccggaugcagcggcuacccaaacaugaaccuagacugccuccucccccaagaauggguccaacacuucuaccaagaagccgcuccagcccaaucugacgucgcccuacuaagauucguaaacccagacacagggcgcguccucuucgaaugcaaacuccacaaauccggcuacguaaccgucgcccacacuggccaacacgaccucgucaucccacccaacggcuauuuccguuucgacucauggguaaaccaauucuacacccucgcacccaugggcaacggaaccggccgcagacgagcacuauaa

SEQ ID NO: 36783 - RNA, 1623 nt, Artificial Sequence
  derived and/or modified sequence opt11 from capsid_protein__Norovirus__AAT00249
augaaaauggccuccaacgacgcuaaccccuccgacggcuccaccgccaaccucguaccagaagucaacaaugaggugauggcccuagaacccgucgucggcgcagccauagccgccccuguagcuggacaacaaaacgucaucgacccauggauccgcaacaacuucguucaagcacccggcggugaguucacagucucaccccgaaacgccccaggcgaaauccuaugguccgcgccccuaggccccgaccucaaccccuaccucagccaccuagccaggauguacaacggauaugccggcggcuucgaaguccaagucauccuagccggcaaugccuucacugcaggcaaaaucaucuuugcagccgucccacccaacuuucccacagaaggccuaucaccaucccaagucacgauguucccacacauuauagucgacguacgccaacuugaacccguccucaucccacucccugacguccgaaacaacuucuaccacuacaaccaauccaacgacccaaccaucaaacucauagccaugcuuuacaccccauuacgugccaacaacgccggcgaagacgucuucaccguaagcugucgcguacucacccgacccucccccgacuucgacuucaucuuccuggucccacccacugucgaaucccgcacaaaacccuucaccgugccuauacuuaccguugaagaaaugaccaacuccagauuccccaucccacucgaaaaacucuucaccggccccucaggagccuucgucguacaaccccaaaacggccgcugcaccaccgacggcguccuccuaggcacaacucaacucucccccguaaacauaugcgccuuccgcggcgacguaacccacaucgccggcacacacaacuacacaaugaaccuugccucacaaaacuggaacaacuaugacccaaccgaagaaauuccagcaccccucggcacucccgacuucgucggccgaauacagggaaugcucacacaaacaacacguggcgacggcucaacacgcggacacaaagccacagucucaaccggcgacguccacuucacgcccaagcucggaucuauccaauucaacacagacaccaacaacgauuucgaaacaggccaaaacacaaaguucacacccguaggagucguccaagauggaaacggcacacaccaaaacgaaccacaacaauggguccuaccuucauacucaggacgcaccggccacaacguucaucucgcacccgccguugccccaacauuccccggagaacaacuacucuucuuccgcucuacaaugcccggaugcucuggauacccaaauaugaaccucgacugccuccucccccaagaauggguccaacacuucuaccaagaagcagcccccgcacaaagcgaugucgcacuacucagauucguuaaccccgacaccggccgcguacuauucgagugcaaacuccacaaaaccggcuacgugacagucgcacacaccggacaacacgaucucgucaucccaccaaacggcuacuuccgcuucgacuccuggguaaaccaauuuuacacccuagcacccaugggcaacggaaccggccgccguagagcccucuaa

SEQ ID NO: 36784 - RNA, 1623 nt, Artificial Sequence
  derived and/or modified sequence opt11 from capsid_protein__Norovirus__AAT00255
augaaaauggccuccaacgacgcaaaccccuccgacggauccacagccaaccuugucccagaagucaacaacgaagucauggcccuagaacccgucgucggcgcugccaucgccgcccccgucgcaggccaacaaaacgucauugaccccuggauccggaacaacuucguccaagcacccgguggcgaguucaccgucucuccccgaaaugcacccggcgaaauacuaugguccgcaccacucggacccgaccucaacccauaccuuucucaccucgcacgcauguacaacgguuaugccggaggcuucgaaguacaagucauccuggccggaaaugccuuuacagcaggcaaaaucaucuucgccgccgucccacccaauuuccccaccgaaggacucucccccucacaaguaaccauguucccccacauaaucgucgacguacgccaacucgaacccgugcucauaccacuccccgacguucgcaacaacuucuaccacuacaaccaauccaacgaccccacaaucaaacuaaucgccaugcucuacacaccccuccgugcaaacaacgcaggcgaagacgucuucaccgucuccugccgcguccugacccgaccuucucccgacuucgacuuuaucuuccucgucccacccacaguugaaucucgcacuaagcccuuuaccgucccaauccucaccgucgaagaaaugaccaacucacgcuuccccaucccacucgaaaaacucuucaccgguccaaguggcgcauucguaguccaaccccaaaacggccgaugcaccaccgacggaguccuucucggaacaacccaacuaucacccgucaacaucugcaccuuucguggggacgucacccacaucgccggcacacacaacuacaccaugaaccucgccucccaaaacuggaacaacuacgaccccaccgaagaaauuccugcaccccucggaacucccgacuucguaggcagaauccaaggcaugcucacccagacaacacgcggagauggcucaacccgcggccacaaagccaccgucucaaccggcgacguccacuucaccccaaaacucggcuccauccaauucaacacggacaccaacaacgacuucgaaacaggacaaaauacccgauucacccccgucggaguaguccaagacggcaacggcacccaccaaaacgaaccccaacaauggguccuccccuccuacaguggucguacaggucacaacguccaccuagccccagccguagcacccaccuuccccggcgaacaguuacucuucuucagauccacaaugccaggcugcucaggauaccccaacaugaaccucgacugccuacuaccacaagaauggguucaacacuucuaccaagaagccgcccccgcgcaauccgacguugcacuccuccgcuucguuaaccccgacaccggacgcguacucuucgaaugcaaacuacacaaauccggauacgucaccgucgcacacaccggccaacaugaucucgucaucccaccaaacgguuauuucagauucgauucaugggucaaccaauucuacacccucgcccccaugggcaacggcaccggccgccgacgcgcacuauaa

SEQ ID NO: 36785 - RNA, 1623 nt, Artificial Sequence
  derived and/or modified sequence opt11 from capsid_protein__Norovirus__AAT00258
augaaaauggccuccaacgacgccaacccauccgauggcuccaccgccaaccucguccccgagguaaacaacgagguuauggcccucgagccaguagucggcgccgccauagccgcacccgucgcaggccaacaaaacgucaucgacccauggauccgcaacaacuucguccaagcccccggcggcgaguucaccgucucaccccgcaaugcccccggcgaaauccucugguccgcaccccucggccccgaucucaacccauaccuaucacaccuggcccguauguauaacggcuacgccggcgguuucgaaguacaagucauacucgccggaaacgccuucacagcgggaaaaaucaucuucgccgccgucccacccaacuuccccaccgaaggacuaucccccagccaagucaccauguucccacacauaaucgucgacguccgacaacucgaaccuguacucauaccccuccccgacguccgaaacaacuucuaucacuacaaccaaucaaacgaccccaccaucaagcucaucgcuaugcuuuacacaccccucagagcuaacaacgccggcgaagacguauucaccgucucaugccgaguacuuacacgaccaucccccgacuucgacuuuaucuuccucguaccacccaccguagaauccagaacaaagcccuucaccguucccauacucacagucgaagaaaugacaaacuccagauucccaauccccuuggaaaaacucuucacaggccccaguggcgccuuugucguacaaccccaaaacggucgcugcaccaccgacggcguccuucucggcaccacccaacucucacccguaaacauauguaccuuccgaggcgacguaacccacaucgccggaacccacaacuacaccaugaaccuagccucccaaaacuggaacaacuacgaccccaccgaagaaauccccgcaccacuaggaaccccagacuucgucggacgaauccaaggcaugcucacucaaacaacccgcggugacggaucuacacggggccacaaagcaaccguuagcaccggugauguacacuuuacccccaaacuaggauccauucaauucaacacagacacuaacaacgacuucgaaaccggccaaaauacccgcuucaccccaguaggagucguacaagacggcaacggcacacaccaaaaugaaccccaacaauggguucucccguccuacucaggacguacaggccacaacguccaccucgcucccgcagucgccccuaccuucccaggcgaacaacuacuauucuuccgcuccaccaugcccggaugcuccggauaccccaacaugaaccucgacugccuccuaccccaagaauggguccaacacuucuaccaagaagcagccccggcacaauccgacguagcccuacuacgauucguaaaccccgacaccggccgaguacuuuucgaaugcaaacuacacaaauccggauauguaacagucgcccacacaggccaacacgaccuaguaauacccccaaacgguuacuuccgcuucgacagcugggucaaccaauucuacacacucgcccccaugggaaacgguaccggccgcagacgagcccucuaa

SEQ ID NO: 36786 - RNA, 1623 nt, Artificial Sequence
  derived and/or modified sequence opt11 from capsid_protein__Norovirus__AAT00261
augaaaauggccagcaacgacgcaaaucccagcgacggcucaaccgcaaaccugguccccgaagucaacaacgaaguaauggcccuggaacccgucgucggcgccgcaauagccgcccccguggccggccagcaaaacgucaucgacccauggauccgcaacaacuucguccaagccccaggcggagaguucaccgucucaccccgcaacgccccaggcgaaauucuauggagcgcaccccuuggaccagaccuaaaccccuaccuuucacaucuugcccggauguacaacggauacgccggcggcuucgaaguccaagucauucucgccggaaacgccuucaccgcaggaaaaaucauauuugccgccgucccacccaacuuccccaccgaaggccugucacccucacaaguaacaauguucccccacaucauaguagacguaagacaacucgagcccguacucauaccccuccccgacguacgcaacaacuucuaccacuacaaccaauccaacgacccgaccaucaaacucaucgccaugcucuacacaccccuaagagcaaacaacgccggugaagacguauucaccgucucaugccgaguccucaccagaccaucaccggacuucgacuucaucuuccuagucccucccacaguggagucccgcacuaagcccuucacaguacccauccuaaccgucgaagaaaugacaaacucccguuuucccauuccccucgaaaaacucuucacaggcccaucaggcgccuuugucguacaaccacaaaacggccgcugcaccaccgacggcguccuccucggaaccacccaacuaucgccaguuaauaucugcacauuccgcggagaugucacccacaucgccggcacacacaauuacacaaugaaccuagcuucucaaaacuggaacaacuacgaccccacagaagaaauccccgccccucuugggacacccgacuucgucggacgaauccaaggaaugcucacccaaaccacucgcggagacggcuccacccgaggacauaaggccaccgucucgaccggcgacguacauuuuacccccaaacucggcucaauccaguucaauaccgacaccaacaacgacuucgaaaccggacaaaacacccgcuucacccccgucggcguuguacaagauggcaacggcacacaccaaaacgaaccccaacaauggguccuaccuagcuacuccggccgaaccggccacaacguccaucucgcaccggcagucgcccccaccuuccccggagaacaacuccuauucuuucgcuccaccaugcccggcugcuccggauacccaaacaugaaccucgacugccuccucccacaagaauggguucaacacuucuaccaagaagcagccccugcacaauccgacguagcccuccuccgcuuugucaacccagacaccggacgcguccuauucgaaugcaaacuccacaaaucaggauacguaaccguagcacacaccggacaacaugaccucgucauaccaccaaacggauacuuccgauucgacucuuggguuaaccaauuuuacacacuagcccccaugggaaauggaaccggacgccgccgcgcccucuaa

SEQ ID NO: 36787 - RNA, 1623 nt, Artificial Sequence
  derived and/or modified sequence opt11 from capsid_protein__Norovirus__AAT00264
augaaaauggcuucuaaugacgccaaccccuccgacggcucaaccgccaaccuagucccagaaguaaacaacgaagucauggcacuggaaccaguaguaggagccgcaauugcagccccugucgcuggacaacaaaaugucaucgacccauggauacgcaacaacuucguacaagcccccggcggagaguucaccguauccccacgcaaugcccccggcgaaauccucuggucagcccccuuaggacccgaccucaaccccuaucuaagccaccucgcccgcauguacaacggcuacgccggcggauucgaaguccaagucauucucgcaggcaacgcauucacagcaggcaaaaucaucuucgccgccguucccccaaauuuccccaccgaaggucuuuccccaagccaagucaccauguucccacacaucaucgucgacguacgccaacucgaacccguacuuauaccacucccagacguaagaaacaacuucuaccauuacaaccaauccaacgaccccacaauaaagcucaucgccaugcuauacacgccucuccgcgcaaacaacgccggcgaagacgucuucacagucuccugccgcguccuaacccgccccuccccagacuucgacuucaucuuccucgucccacccaccgucgaaucccgcaccaaacccuuuacaguccccauccucacagucgaagaaaugaccaacuccagauuccccauaccccuagaaaaacucuucaccggccccucaggcgcauucgucguacaaccccaaaacggccgcugcaccacagacggaguccuccucggcaccacccaauuaucccccguaaacauaugcaccuuccgcggcgacgucacacacaucgccggcacccacaacuacacaaugaaccucgccagucaaaacuggaacaacuacgacccuaccgaagaaauacccgcaccccucggcacccccgacuucgucggcagaauccaaggcaugcucacacaaaccacccgcggcgacggaucaacaagaggacacaaagccacagucuccacgggcgacguccacuucacacccaaacuuggauccauccaauucaauacagacacaaauaacgacuucgaaacaggacaaaacaccagauucacucccgucggagucguccaagacggaaacggaacccaccaaaaugaaccccaacaaugggucuuacccucguacuccggccgcaccggccacaacguacaccucgcacccgccgucgcccccaccuucccaggagaacaacuccuuuucuuccgcucuaccaugcccggaugcuccggcuaccccaacaugaaccuagacugccuacuaccccaagaauggguccaacacuuuuaccaagaggcagcacccgcccaauccgacgucgcacuacuacgcuucgucaacccagacacgggcagaguacucuucgaaugcaagcugcacaaaagcggauacguaacggucgcacacaccggucaacacgauuuagucaucccacccaacggcuacuuccgcuucgacagcugggucaaccaauucuacacgcucgcccccaugggaaacggcaccggccgacgacgcgcucucuaa

SEQ ID NO: 36788 - RNA, 1623 nt, Artificial Sequence
  derived and/or modified sequence opt11 from capsid_protein__Norovirus__AAT00267
augaaaauggccagcaacgacgcaaacccauccgacggaucuaccgcaaaccuggucccagaagucaacaacgaagucauggccuuagaaccagucgucggcgcagcaauagccgcccccguagccggccaacaaaaugucaucgaucccuggauccgcaacaacuucguccaggcccccggcggagaguucacaguaagcccacgcaacgcccccggagaaauccuuugguccgcaccccucgguccugaccucaacccguaccucucacaccucgcccgaauguauaacggcuacgcaggaggcuucgaaguccaggucauacuugccggcaacgccuucaccgccggcaaaaucaucuucgcagccguuccacccaacuuccccaccgaaggccuaucccccucacaaguaacaauguucccccacaucauaguugacguccgacaacuagaacccguccuaaucccccuucccgacguacgcaacaacuucuaccacuacaaccaauccaacgaccccaccaucaaacucaucgcaaugcuuuacacaccccuccgcgccaacaaugccggcgaagacgucuucaccgucucuugccgcguccuaacacgccccucaccagauuucgacuuuaucuuccuagugccaccaaccguugaaucccgcaccaaacccuucaccguccccauccuuacuguagaagaaaugacaaacucccgcuuccccauuccccuugaaaaacuuuucacaggaccuucuggcgccuucguaguccaaccacaaaacggccgaugcaccaccgacggcguacuacucggaacaacccaacuuuccccugucaacaucugcaccuuccgaggagacgucacgcacaucgccgguacccacaauuacacuaugaaccucgcaucccaaaacuggaacaacuacgaccccacagaagaaauccccgccccucucggcacccccgacuuuguaggacgcauucaaggcaugcuaacccaaaccacacgaggcgacggcuccacccgcggacacaaagcaacaguaucaacuggagacguccacuucacccccaagcuaggauccauccaauucaacacagacacaaacaacgacuucgaaaccggccaaaacacccgauucacucccgucggcguaguccaagacggcaacgggacccaccaaaacgaaccccaacaauggguucucccauccuacucagggcgcaccggccacaacguccaccucgccccagccgucgccccaaccuuccccggagaacaacuacuauuuuuccgcucaaccaugccagggugcagcggcuacccaaacaugaaccucgacugccuccucccccaagaauggguccaacacuuuuaccaagaggccgcccccgcccaaucggacguugcacuccuacgcuucguaaaccccgacaccggacgcguacuauucgaaugcaaacuccacaaaucuggauacgucaccgucgcccacacaggacaacacgaccucguaaucccaccaaacggcuacuucagauucgacuccugggucaaccaauucuacacgcucgccccuaugggcaacggaaccggccgacgccgagcccucuaa

SEQ ID NO: 36789 - RNA, 1623 nt, Artificial Sequence
  derived and/or modified sequence opt11 from capsid_protein__Norovirus__AAT00270
augaagauggcauccaacgacgcaaacccauccgacggcuccacagccaaccucguacccgaaguuaacaacgaagucauggcacucgagcccguagucggcgccgccaucgccgccccagucgcgggccagcaaaacgugaucgacccauggauacgcaacaacuucguccaagccccaggcggagaguucacaguuucaccccguaaugcccccggcgaaauccuauggucugcaccccuagggcccgaccucaaccccuaccucagccaccuggcccgaauguacaacggauacgccgguggcuucgaaguccaagucauacucgccggcaaugccuucaccgcaggcaagaucauauucgcagcaguucccccaaacuuuccaacggaaggccuaucgccaucccaaguaacaauguucccucacaucaucgucgacguccgacaacuagaacccguccuaaucccccuucccgacgucaggaacaacuucuaccacuauaaccaaucaaacgacccgacaauaaaacucauagcaaugcuuuacacaccacuccgcgccaacaacgccggcgaagacguuuucaccguauccugccgcguccuuacacgccccucccccgacuucgacuuuauauuccuagucccacccaccgucgaaucacgcaccaagcccuucacaguucccauacuaacagucgaagagaugacaaacucaagauuccccauccccuuagaaaaacucuucaccggcccuuccggagccuucguuguacaaccccagaacggccgaugcaccaccgacggaguccuacuaggaaccacccaacucagccccgucaacaucugcacauucagaggagacgucacccauaucgccggcacgcacaacuacaccaugaaccuagcaucccaaaacuggaacaacuacgaucccacagaagaaaucccugcaccccucgguaccccagauuucgucggcagaauacaaggaaugcuaacccaaacuacccgaggagacggcucaacccggggacacaaggccaccgucuccaccggcgacguccacuucacacccaaauuaggcuccauccaauucaacaccgacacaaacaaugacuucgaaaccggccaaaacacccgcuucacgcccguaggcgugguacaagacggcaacggcacccaccaaaacgaaccccaacaauggguacuccccucuuacucaggccgcaccggucacaacguacaccucgcccccgccgucgcucccacauucccaggagaacaacuccuauucuuccgcuccaccaugcccggaugcucagguuacccaaacaugaaccuagacugccuacuaccccaagaauggguacaacacuucuaccaggaagcagcgcccgcccaguccgacguggcccuccuccgcuucguaaaccccgacaccggacguguacuguucgaaugcaaacuccacaaauccggcuauguuaccgucgcccacaccggccaacacgaccuaguaaucccaccuaacgguuacuucagauucgacucaugggucaaccaauucuacacacucgccccaaugggcaacggcacuggccgacgccgggcacucuaa

SEQ ID NO: 36790 - RNA, 1623 nt, Artificial Sequence
  derived and/or modified sequence opt11 from capsid_protein__Norovirus__AAT00273
augaagauggcaucaaacgacgccaaccccuccgacggauccacagccaacuuaguaccugaagucaacaacgaagucauggcccucgaacccguuguaggagcagccaucgcugcccccguagccggccaacaaaacgucaucgaccccuggauccgaaacaauuucguccaggccccuggcggcgaguucacaguuucgccccgcaacgcaccuggcgaaauccucugguccgcaccccucgggccagaccuaaaucccuaccucucccaucuugcccgcauguacaacggcuacgccggaggauucgaaguacaagucauccucgccggaaaugcauuuaccgccggaaaaaucaucuucgccgccguacccccaaacuuccccacugaaggucucucacccucacaagucaccauguucccacacauaauaguagacguccgacaacucgaacccguacucauaccccuacccgacguccguaacaacuucuaccauuacaaucaaucaaacgacccaaccauaaaacucauagcaaugcuauauacaccccuccgagcaaacaacgccggagaagacguguucacagucucaugccgaguacucacacgccccucccccgauuucgacuucauauuccuaguacccccuacagucgaaucccgcaccaaacccuucacugucccuauccuuaccgucgaagaaaugacaaacucuagauuccccaucccacuggaaaaacuauucacaggccccucaggagccuucgucguccaaccccaaaacggccgcugcacaacagauggcguccuccuaggcacaacucaacucucucccguaaacauaugcaccuuccgcggugacgucacacacaucgcaggcacccacaacuacacaaugaaccucgcuucgcaaaacuggaacaacuacgacccaaccgaagaaauuccagcaccccuaggaacccccgacuucgucggccgaauccagggcaugcucacucaaaccacccgcggcgacggcucuacccguggucauaaagccacagucuccaccggagacguacacuucacccccaaacuaggcucuauccaauucaacaccgacaccaacaacgacuuugaaaccggucaaaacaccagauucacacccguaggcgucguccaagacggcaacggcacccaccaaaacgaaccacaacaauggguccuccccuccuauuccggucgcaccggacacaacguccaccuagccccagcagucgcccccacauucccaggagaacaacuucucuucuuucgcucaaccaugcccggcugcucaggcuacccuaacaugaaccuagacugccuccucccccaagaauggguccaacauuucuaccaagaagcagcccccgcccaauccgacgucgcccuacuccgcuucgucaacccagacacuggccgcguacuauucgagugcaaacuucauaagucaggauacguaacaguagcccacaccggccaacacgaccucgucaucccacccaacggcuacuuccgcuucgacucauggguaaaccaauucuacacccucgcccccaugggcaacggcaccggccgacgccgcgcacucuaa

SEQ ID NO: 36791 - RNA, 1623 nt, Artificial Sequence
  derived and/or modified sequence opt11 from capsid_protein__Norovirus__AAT00276
augaaaauggccuccaacgacgcaaaucccuccgauggauccaccgccaaccucguaccagaaguaaauaacgaaguaauggcacucgaaccugucguaggagcagcaauagccgcaccagucgccggccaacaaaacgucauagacccauggauacgcaacaacuucguacaagcccccggcggcgaguucaccgucuccccucgcaacgcccccggcgaaauacuauggucagcaccccucggccccgaccucaaccccuaccuuucccacuuagcccgaauguacaacggcuacgccggaggauucgaaguacaagucauccuagccggcaacgccuucaccgccggcaaaauaauauucgccgccguacccccgaacuuccccaccgaaggccuuucacccucacaagucaccauguucccccacaucaucgucgacguucgacaacuagaacccguacucaucccccuacccgacguccgaaacaacuucuaccacuacaaccaaucaaacgaccccaccaucaaauuaaucgccaugcucuacacuccccuccgcgccaauaacgccggcgaagacgucuucaccguaaguugccgcguccucacccgucccucccccgacuucgacuuuaucuuccucgucccacccaccguagaaucccgaaccaaaccauucacugucccaauacucaccgucgaagaaaugaccaacucgagauucccaaucccccucgaaaaacucuucacaggaccgucaggagccuucgucguccaaccacaaaacggccgaugcacuacagauggaguacucuuaggcaccacccaacuaagccccgugaacaucugcacauuccgaggagacguaacccacauagccggcacccacaauuacaccaugaaucucgcaagccaaaacuggaacaacuacgacccaaccgaagaaauaccagccccauuaggcaccccagacuucgucggccgcauacaaggcaugcuaacacaaacaacacgcggagacggauccacacgcggccacaaagccaccguaagcaccggcgacguccacuucacacccaagcuagguagcauccaauucaacacugacaccaacaacgacuucgaaaccggccaaaacacccgauucacccccguaggcgucguccaagacggcaacggcacccaccaaaaugaaccacaacaauggguccucccauccuacuccggccguaccggacacaacgugcaccucgcaccagcaguagccccaaccuuucccggcgaacaacuacuguucuuucgcuccaccaugcccggcugcuccggauaucccaacaugaaccucgacugccuucucccacaagaguggguccagcacuucuaccaagaagcagcacccgcccagagcgacguagcccuccuccgcuucguaaacccagacacuggccgcguccucuucgaaugcaaacuccacaaauccggauacgugacagucgcacacaccggccaacacgaccucguuaucccucccaauggcuacuuccgauucgacuccugggucaaccaauucuacacucucgcccccaugggcaacggcacaggccgccgacgcgcccucuaa

SEQ ID NO: 36792 - RNA, 1623 nt, Artificial Sequence
  derived and/or modified sequence opt11 from capsid_protein__Norovirus__AAT00279
augaaaauggccuccaacgacgccaaccccuccgacggcucaacugcuaaccucguccccgaagucaacaacgaaguaauggcccucgaaccugucguuggcgccgcaaucgccgcaccagucgccggccagcaaaacgucauagacccauggauccgcaacaauuucguacaagcccccggcggcgaguucacaguguccccacgaaacgcccccggagaaauccuuugguccgcuccccucgguccagaccucaacccauaccuuucccaccucgcccgaauguacaacggauacgccggaggcuucgaaguccaagucauccucgccggcaacgccuucaccgcaggcaaaauaauauucgccgccgucccacccaacuuccccaccgaaggacuauccccaucacaagucaccauguucccacauaucauagucgacguccgacaacuagaacccguacucauaccccuccccgauguacgaaacaacuucuaccacuacaaccaauccaacgacccaaccauaaaacuaauagccaugcuauacacaccccuccgcgccaacaacgcaggggaagacguauucaccguauccugccgcguacucacccgaccuucccccgacuucgacuucauauuucucgucccaccuaccgucgaaucccgcacgaaacccuucacuguccccauacucaccguagaagaaaugacaaauucccgauucccaaucccacuugaaaaacuauucacgggccccucaggcgccuucguaguacaaccccaaaacggccgaugcacaaccgacggcguccuauuaggaaccacccaacucucacccguaaacaucugcaccuuccguggcgacgucacucacaucgcaggcacacacaacuacacaaugaacuuagcaucucaaaacuggaauaacuacgacccaaccgaagaaauacccgcaccccucggaaccccagauuucgucggucgcauccagggaaugcuaacccaaaccaccagaggagacggauccacaagaggccacaaggccaccgucucaacaggcgauguccacuucacacccaagcucggcuccauccaauucaauaccgacaccaacaacgacuucgaaaccggccaaaacaccagauucacccccgucggaguuguacaagacggaaacggcacccaccaaaacgaaccccaacaauggguccuacccuccuacucaggacgcaccggccacaacguccaccucgcccccgccguagcccccacauuccccggcgaacaacuccuuuucuuccgcucaacaaugccaggcugcucaggcuaccccaacaugaaccuagacugccuccuuccccaagaauggguccaacacuucuaccaagaagccgcccccgcacaaucagacguugcccuccuccgauucgucaaccccgacaccggacgaguacuauuugaaugcaaacuccacaaauccggauacguuacaguugcacacacaggccaacacgaucucguaauuccacccaacgguuacuucagauucgacucaugggucaaucaguucuauacccucgcccccaugggcaacggcaccggacgccgacgagcccuauaa

SEQ ID NO: 36793 - RNA, 1623 nt, Artificial Sequence
  derived and/or modified sequence opt11 from capsid_protein__Norovirus__AAT00282
augaaaauggccagcaaugacgcuaaccccuccgacggcuccacugcaaaccuagucccagaagucaacaacgaaguaauggcccucgaacccgucguaggcgcagccaucgcugccccgguugccggccaacaaaacguuaucgacccauggauccgcaauaacuucguucaagccccagggggagaguucacagucuccccacgaaacgcacccggugaaauccucuggucagcaccccuaggcccagaccucaacccauaccucucccacuuagcccgcauguacaaugguuacgccggcggcuuugagguccaagucauacucgccggcaacgccuucaccgccggcaaaauaauuuucgcagccguuccacccaacuuccccacagaaggccuaucacccucacaaguaacaauguucccccacaucaucgucgacguacgacaacucgaacccguacucaucccacuccccgacguccgaaacaacuucuaccacuacaaccaaucuaacgaccccaccauaaagcucauagccaugcuauacacuccccuacgugccaacaacgcaggcgaagacgucuucaccgucuccugccgcguccucacccgccccucccccgacuucgacuucauauuucuagucccgcccaccgucgaaucccgcaccaaacccuuuaccguccccauccuaacagucgaagaaaugacaaacucacgauuccccaucccucucgaaaaacuauucaccggacccuccggagccuucgucguccaaccacaaaacggucgaugcacaaccgacggcguacuccucggcacaacccaacucagccccgucaacaucugcacauuccgcggggacgucacccacaucgccgguacacacaacuacacaaugaaccuagcaucccaaaauuggaacaacuacgaucccacagaagaaaucccagccccacucggcaccccggacuucgucggccgcauucaaggcauguuaacccaaaccacuagaggcgacggcagcacacgcggccauaaagcaaccguaucaacuggagacguccacuucacacccaaacuugguuccauccaauucaacaccgacaccaacaacgacuucgaaaccggacaaaauacccgcuucacacccgucggcgucguccaagacggaaacggcacacaccaaaacgaaccccaacaauggguccucccauccuacucaggcagaaccggucacaacguccacuuagcccccgccgucgcacccacuuucccaggcgaacaacuacuauucuuccgcuccaccaugccuggcugcuccggcuacccuaacaugaaccucgacugccuacuaccccaagaauggguccagcacuucuaccaagaagccgcucccgcacaaucagacguagcacuccuacgauucgucaaccccgacaccggccgcguccucuucgaaugcaaacuccacaaauccggcuauguuaccgucgcacacaccggccaacacgaccuuguaauaccacccaacggcuauuuccgcuuugacucaugggucaaccaauucuacacgcucgcccccauggguaacggcacaggccgucgacgugccuuauaa

SEQ ID NO: 36794 - RNA, 1623 nt, Artificial Sequence
  derived and/or modified sequence opt11 from capsid_protein__Norovirus__AAT00285
augaaaauggccuccaacgacgcaaaccccuccgacggcucaacagcuaaccucguccccgaaguuaacaacgaagucauggcccucgaaccaguggucggcgcagccaucgccgccccaguugcaggccaacaaaacguaauugaccccuggauccgaaacaacuuuguccaagccccaggcggcgaauuuacagucagcccccgaaacgccccaggcgaaauccucugguccgccccucucggucccgaccucaaccccuaccuuucccaccucgccagaauguauaacggauaugcuggaggauucgaaguccaaguaauccuagccggcaacgcauucacagcuggcaaaauuaucuucgcugccguacccccaaacuuccccacagagggccucucccccagccaagucaccauguucccccacaucaucgucgacguacgccaacuagaacccguacucaucccacuacccgacgucaggaacaacuucuaccacuauaaccaguccaacgacccgaccaucaaacucauagccaugcucuacacuccccuccgcgcaaacaacgccggagaagauguauucaccguaucaugccgcguccucaccagacccucccccgacuucgauuucaucuuccucgucccucccacagucgaaucacgcacgaaacccuuuacagucccaauacuaaccgucgaagaaaugacaaacucacgcuuccccaucccucucgaaaaauuauucaccggcccaucaggcgccuucgucguacaaccccaaaacggacgcugcacaaccgacgggguccuucucggaacaacccaacucagccccgucaacaucugcaccuuucguggagacgucacacacaucgccggcacccacaauuacaccaugaaucuagccucccaaaacuggaacaacuacgaccccacagaagaaauacccgcaccacucggcacuccggacuucguaggacgcauccaaggcaugcuaacacaaacaacucgaggcgacggaucaacccgaggccacaaagccaccguuuccaccggcgacguccacuucacacccaaacucggcucaauacaauucaacaccgacaccaacaaugacuucgaaaccggucagaacacccgcuucacccccguaggagucguacaagaugguaacggaacccaccagaacgagccccaacaauggguucuccccuccuacuccgggcggaccggccacaauguccaccucgcacccgccguggccccaacauuccccggcgaacaacuccucuucuuccgauccaccaugcccggcugcuccggauaucccaauaugaaccucgacugccuccuaccccaggaauggguccaacacuucuaccaagaagcagcccccgcucaauccgacguagcucuccuacguuucgucaauccugacacaggacgcguacucuucgaaugcaaacuccacaaaucaggcuauguaacaguugcccauacgggccaacacgaccuagucaucccacccaauggcuacuuccgcuucgacucaugggucaaccaauucuacacacuagcacccaugggaaacggaaccggacgccgacgcgcucucuga

SEQ ID NO: 36795 - RNA, 1623 nt, Artificial Sequence
  derived and/or modified sequence opt11 from capsid_protein__Norovirus__AAT00288
augaaaauggccucaaacgacgccaaccccucagacggcucaaccgccaaccucguucccgaagucaacaacgaagucauggcccuggaacccguaguaggcgcagccaucgcagcccccgucgccggacaacaaaacgucaucgaccccuggauccgcaacaacuucguccaggccccuggcggcgaguucacaguuuccccucgcaacgcccccggcgaaauccuaugguccgccccacucggccccgaccuuaaucccuaccucagccaccuugccagaauguauaauggcuacgccggcggcuucgaaguacaagucauacucgccggcaaugcauucaccgcaggcaaaaucaucuucgccgcagucccacccaacuuccccacagaaggccucucacccucccaagucaccauguuuccccacaucaucguagaugucagacaacucgaacccguacuaauaccccuaccugacgucagaaacaacuucuaccacuacaaccaaagcaacgaccccaccauaaagcuaaucgccaugcuauacacaccacuacgcgcuaacaacgcaggagaagacguauucaccguaagcugccgcguccuaacucgaccaucgcccgacuucgacuucauuuuccuagucccgcccaccguugaaucacgaaccaaaccuuucaccguaccaauccuaaccguugaagaaaugacaaacucccgcuuccccauaccccuagaaaaacucuucaccggccccucaggggccuucguaguacaaccccaaaacggccgcuguacaacagacggcguccuccuaggaaccacacagcucucccccguuaacaucugcacuuuccgcggcgacgucacccacauagcaggaacccacaacuacaccaugaaccucgccucacaaaacuggaacaacuacgacccaacagaagaaauccccgcaccccucggcacccccgacuucguaggacgaauccaaggcaugcucacccaaaccacucgcggagacggcuccacuagaggccauaaagccaccgucuccaccggcgacguccauuucacacccaaacucggcuccauccaauucaacacagacaccaacaacgacuucgaaaccggccaaaacacccgcuucacccccguaggcguuguccaagacggaaauggaacacaccaaaacgaaccccagcaauggguacuccccuccuacuccggacgaaccggccacaacguacaccuugcccccgcaguugccccaaccuucccuggagaacaacuucuauucuuccgauccacuaugcccgguugcucuggauaccccaacaugaaucuugacugccuucucccccaagaauggguacaacacuucuaccaagaagcagcgccagcacaaucagacgucgcccuccuucgcuucgucaaccccgacacaggaagaguccuuuucgaaugcaaacuccacaaaucaggcuauguaacggucgcacauacuggccaacacgacuuaguaauaccacccaacggcuacuuccgcuucgacuccuggguaaaccaauucuacacccucgcacccaugggcaacggcaccggacgccgccgcgcccuauaa

SEQ ID NO: 36796 - RNA, 1623 nt, Artificial Sequence
  derived and/or modified sequence opt11 from capsid_protein__Norovirus__AAT00291
augaaaauggccuccaacgacgcaaaccccagugacggauccaccgccaaccucguccccgaaguuaacaacgaaguaauggcacuagaacccguaguuggcgccgcaaucgcagcacccgucgcaggccaacaaaacgucaucgaucccuggauacgcaacaacuucguccaagcccccggcggagaguucaccgucucuccccgaaacgccccuggugaaauccucugguccgccccucucggccccgaccucaaccccuaccucucccaccucgcuagaauguacaacggcuaugcuggcggauucgaaguccaagucauccuagccggcaacgccuucacagccggcaagaucaucuucgccgccguaccgcccaacuucccuacagaaggacuaucccccucccaaguuacaauguucccccacaucaucgucgacguccgccaacuagaacccguacucauaccccuaccagacguccgcaacaacuucuaccacuauaaccaaagcaacgaccccaccauuaaacucaucgccaugcucuacaccccacuucgcgccaacaacgccggcgaagacguauucaccgucucgugccgaguccucacucgcccaucccccgacuucgacuucauauuccucgucccacccacagucgaaucacguaccaaacccuuuacuguacccauccucaccgucgaagaaaugaccaauucacgcuuccccaucccucucgaaaaacuauucaccggacccucgggcgcauucgucguucaaccccaaaacggccgcuguaccaccgacggaguucuccucggcacgacccaacucucacccgucaacaucugcaccuuccgcggcgacgucacccacaucgccggaacacacaacuacaccaugaaccucgccucacaaaacuggaacaacuacgacccuaccgaagaaauccccgcaccccuaggaaccccagacuucgucggacgcauccaagguaugcucacccaaaccacucgcggugacggcuccacacgcggccacaaggccacagugucgacaggugacguccacuucacccccaaacuuggcagcauacaauucaacacagacaccaacaacgauuucgagacaggucaaaacacccgcuucaccccagucggaguuguacaagacgggaacgggacccaccaaaaugaaccccaacaauggguacuccccucauacucgggccgcaccggacauaacguacaccucgccccugccgucgccccuacauucccuggcgaacaacuccucuucuucagauccacuaugccaggaugcuccggauaccccaacaugaaccucgacugccuccucccucaagaauggguacaacacuucuaccaagaagccgcccccgcccaauccgacgucgcccugcuaagauucgucaaccccgacaccggaagaguacuauucgaaugcaaacuccauaaauccggcuacguaaccguugcccacaccggccaacacgacuuagucauacccccuaacggcuauuuccguuucgacucauggguaaaccaauucuacacacucgcacccaugggaaacgguacuggcagacgccgagcccuuuaa

SEQ ID NO: 36797 - RNA, 1623 nt, Artificial Sequence
  derived and/or modified sequence opt11 from capsid_protein__Norovirus__AAT00294
augaaaauggcauccaacgacgccaaccccuccgacggaucaaccgcaaaucuagucccggaagucaacaacgaagucauggcacuagaaccagucgucggagcagccaucgccgcccccguagccggccaacaaaacgucaucgaccccuggauaagaaacaacuucguucaagcccccggaggagaguucaccgucucaccacgaaacgccccaggcgaaauccucuggucagcaccacuaggacccgaccuaaauccauaccuaucacaccuugcccgcauguacaacgguuaugcaggcggauuugaaguacaagucauccucgcuggaaacgccuucaccgccggcaaaauaauauucgccgccgucccacccaacuucccaaccgaaggccuaucaccaucacaaguaaccauguucccacauauuaucgucgauguacgccagcucgaacccguccucauaccccuccccgacguacgcaauaacuucuaccauuacaaccaaagcaacgaccccaccaucaagcucaucgcaaugcucuacaccccacuccgcgccaacaacgcaggcgaagacgucuucaccgucucaugccgaguacucacccgaccaucaccagacuucgacuucaucuuucucguaccacccacagucgaaucacgcaccaaacccuucacaguacccauccucaccgucgaagaaaugaccaacucccgcuucccaaucccccuugagaaacuauucaccggaccgucaggagccuucgucguccaaccccaaaacggccgaugcacaacggacgguguucuccuugggaccacccaacucucacccguaaacauuugcaccuuccgcggagacguaacacacaucgcuggcacacauaacuacaccaugaaccucgcaucacaaaacuggaacaacuacgaccccaccgaagaaauccccgccccacucggcacccccgacuucgucggccgaauccaaggcaugcuaacacaaacaacacgaggcgacggcucgacacgcggccacaaagcaacagucagcaccggggacguccacuucacaccaaaacucggauccauccaauucaauaccgauaccaacaacgacuucgaaaccggccaaaacacccgcuucacacccguaggugucguccaagacggaaauggcacccaccaaaacgaaccccaacaauggguccuucccuccuacagcggcagaaccggccacaacguccaccuagcccccgccguagcccccacuuucccaggcgaacagcuucucuucuuccgcuccacuaugcccggcugcuccgguuaucccaacaugaacuuagacugcuuacucccucaagaauggguccaacauuucuaccaagaagcagcaccagcccaauccgacgucgcccuucuacguuucgucaacccugacacaggccgcguccuuuuugaaugcaaacuccacaaauccggauacguaaccgucgcccacaccggacaacacgaccucgucauaccacccaacggcuacuuccgcuucgacuccugggucaaccaguucuacacccuagcccccaugggcaacggcaccggccgcagacgagcccuuuaa

SEQ ID NO: 36798 - RNA, 1623 nt, Artificial Sequence
  derived and/or modified sequence opt11 from capsid_protein__Norovirus__AAT00297
augaaaauggcuucaaacgacgccaaccccuccgauggcuccacagccaaccucguccccgaagucaacaacgaagucauggcuuuagaacccgucguaggagcugcaaucgcagcccccguagcaggccaacaaaacguaauagaucccuggaucagaaacaacuucguccaagcacccggcggcgaauuuaccgucagccccagaaacgcccccggcgaaauacuuugguccgcaccccucggccccgaccucaaccccuaccucucacaccucgcgcgaauguacaauggcuacgccggcggcuucgaaguccaagucauucucgccggcaacgcauuuaccgcaggcaaaaucaucuucgccgccgucccaccaaacuucccgacugaaggccucuccccaucccaggucacaauguucccccauaucaucgucgacguccgacaacuugaaccaguacucauacccuuacccgacguacgaaacaacuucuaucacuacaaccaaagcaaugaccccaccaucaaacucaucgccaugcucuacacuccccuacgcgcuaacaacgccggagaagacgucuucaccgucuccugccguguccucacccgccccucccccgacuucgacuuuauuuuccucgucccacccaccgucgaaucucgcaccaaacccuucacugucccaauccucacggucgaagaaaugacaaacucaagauucccgauaccccucgaaaaacuuuucaccggccccuccggcgccuuugucguccaaccccaaaacggccggugcacaaccgacggcguacuccuaggcaccacccaacucucccccgucaacaucugcaccuuucgcggcgacguaacacacauugccggaacccacaacuacaccaugaaucucgcaagccagaacuggaacaacuacgaccccacagaagaaauccccgccccacuaggcacaccagacuucguaggacgaauccaaggcaugcucacccaaaccacacguggagacggaucaaccagaggccacaaagcaaccguaucaacaggcgacguucacuucacacccaaacucggcaguauccaauucaacaccgacacaaacaacgacuuugaaaccggccaaaacacacgcuucacccccgucggagucguccaggacggaaacggcacccaccaaaacgaaccccaacaauggguccuacccucauauagcggccgcaccggucacaauguccacuuagcuccagccgucgccccaacauucccaggcgagcagcuccucuucuuucgcuccaccaugcccggcugcucaggauaccccaacaugaaccucgacugccuccucccccaagaauggguccaacacuucuaccaagaagcagcacccgcccaaucagacgucgcccuauuaagauucgucaacccagacaccggacgcguucucuucgagugcaaacuccacaaauccggcuacgucacugucgcccacaccggucaacacgaccuagucaucccucccaacggcuacuucagauucgacagcugggucaaccaauucuauacccucgcacccaugggcaacggcaccggacgcagacgagcccucuaa

SEQ ID NO: 36799 - RNA, 1623 nt, Artificial Sequence
  derived and/or modified sequence opt11 from capsid_protein__Norovirus__AAT00300
augaaaauggccucuaacgacgccaacccaucagacggaucaacagcuaaccuaguacccgaaguaaauaacgaagucauggcccuggaacccguagucggcgccgcaaucgccgcccccgucgcuggccaacaaaacgucaucgaccccuggauccgaaacaacuucguucaagccccuggcggagaauuuaccgucucgccccgcaacgccccaggcgaaauccuuugguccgcgccccuaggacccgaucucaaccccuaccuaucccaccuagcccgcauguacaacggcuaugccggcggcuucgaaguccaaguaaucuuagccggcaaugccuucaccgccgguaagaucaucuucgccgccguucccccaaacuucccuacugaaggccuauccccuucacaagucacaauguucccccacaucauugucgacguccgccagcuagaaccaguacuaauuccccuccccgacguccgcaacaacuucuaccacuacaaucaauccaacgaccccaccaucaaacucauagccaugcuauacacccccuuacgcgcaaacaacgccggugaagacguuuucaccguauccugccgaguccuaacacgcccuuccccagacuucgacuucaucuuucuagucccacccaccgucgaaagccgcaccaaacccuucacaguccccauccuaaccgucgaagaaaugacaaacucacgauuccccauaccccuagaaaaauuauucaccggcccauccggagccuucgucguacaaccccaaaacggccgaugcaccaccgacggcguccuacuuggcacgacccaacuuucacccgucaacaucugcaccuuccgcggugacguaacucacaucgcaggcacccacaacuacaccaugaaccuagccucacaaaauuggaacaacuacgaccccaccgaagaaauccccgccccacucggcacccccgauuucgucggccgcauccaaggaaugcucacacaaaccacccgcggcgacggaucaaccagaggccauaaagccaccguuuccacuggcgacguccauuucacccccaaacucggcucaauccaauucaacaccgauacuaacaacgauuucgaaaccggucaaaacacccgcuucacaccagucggagucguacaggacggaaacggaacccaccaaaacgaaccacaacaaugggucuuacccuccuacucaggccgaacuggucacaacguccaccuagccccugcaguagccccaaccuuccccggagaacaacuccucuucuuccgcucaaccaugcccggcugcucaggcuacccaaacaugaaccucgacugccuccuuccccaagaauggguccaacauuucuaccaagaagcagcccccgcccaaucugacgucgcccuccuacgcuucguuaacccagacacaggccgcguccucuuugaaugcaaacuccacaaauccggauacgucaccgucgcccacacaggccagcacgaccuagucauuccacccaacgguuacuuccgcuucgacuccugggucaaccaauucuacacacucgcccccaugggcaacggaacuggccgccgacgugcacucuaa

SEQ ID NO: 36800 - RNA, 1623 nt, Artificial Sequence
  derived and/or modified sequence opt11 from capsid_protein__Norovirus__AAT00303
augaaaauggcaagcaacgacgccaaccccucagacggcuccaccgccaaccuaguacccgaagucaacaacgaggucauggcccuagaaccugucgucggcgccgccaucgcagcccccgucgccggccaacaaaacgucaucgacccuuggauccgcaauaacuucguccaagccccaggcggcgaguucacagucucaccccgcaacgccccgggcgaaauccucugguccgcaccccuaggacccgaucucaaccccuaccucucacaucucgcacgcauguacaacggcuacgccggcggcuucgaaguccaaguaauccucgcaggaaacgccuucaccgcaggaaaaaucaucuucgcagccguaccucccaacuuccccaccgaaggccucucaccaucccaagucacaauguucccucacauuaucguggacguccgccagcucgaaccaguccucauaccacuccccgauguccgaaacaacuucuaccauuauaaccaaucuaacgaucccaccaucaaacuuaucgcgaugcuuuacacaccccuccgcgccaacaacgccggcgaagacguauuuaccguaucaugcagaguacucacccgccccuccccagacuucgacuucaucuuccucguacccccuaccgucgaaucuagaaccaaaccauucaccgucccuauacucaccguggaagagaugacaaacuccagauucccaauaccauuagaaaaacucuucaccggccccuccggcgccuucgucguacaaccccaaaacggccgcugcaccaccgacggcguacuccuuggcaccacccaacucagccccguaaacaucuguaccuuccgcggcgaugucacucauauagccggcacccacaacuacaccaugaaucuugcuucacaaaacuggaacaacuacgacccaacagaagaaauacccgcaccccucggcacacccgauuuuguaggccgaauccaaggcaugcuuacccaaaccacacgcggcgacggcucaacccgcggacauaaagccacggucuccaccggagacguacacuucacgcccaaacucggaucaauccaauucaacacugauaccaauaacgacuucgaaaccggacaaaacacccgauucacaccagucggagucguccaagacggcaacggcacccaccaaaaugaaccccagcaguggguacuuccguccuacuccggacgaacaggacacaacguccaccucgcccccgccgucgcccccacguucccaggcgaacaacuccuauucuuccgaucaaccaugccuggaugcuccggauaccccaacaugaaccuugacugccuccugccccaagaauggguccaacacuucuaccaggaagccgccccugcccaaucagacguagcauuacuccguuucguaaaccccgacacaggucgaguuuuauucgaaugcaaacuacacaaauccggcuacgucacaguagcccauaccggccaacacgaccucguaauacccccuaacggcuacuuccgguucgacuccugggucaaccaauucuacacccuagcccccauggggaacggcaccggacgccgccgagcacucuaa

SEQ ID NO: 36801 - RNA, 1623 nt, Artificial Sequence
  derived and/or modified sequence opt11 from capsid_protein__Norovirus__AAT00306
augaaaauggccucaaacgacgcaaaccccucagacggcucaaccgccaaccucguccccgaaguaaacaacgaaguuauggcccuagaacccguagucggcgcagccaucgccgccccugucgcuggccaacaaaacguaauagaccccuggaucagaaacaauuucguccaagcccccggaggcgaguucaccgucucuccucgaaaugcccccggggaaauacucuggucagcaccacucggacccgaccugaacccauaccucucccaccucgcccgcauguacaacggcuaugccggcggcuucgaaguccaagucauccucgccggcaacgccuucaccgccggcaaaaucaucuucgccgccgucccaccaaacuuccccacugaaggccuaagcccaucccaaguaacaauguucccccacaucaucgucgacguccgccaacucgaacccguccuaaucccacuccccgacgucaggaacaacuucuaccacuacaaccaauccaacgaccccaccauaaaacuaaucgccaugcucuauacuccccuccgagccaacaacgccggugaagacguuuucaccgucucaugcagaguccucacccgccccucacccgauuucgacuucaucuuccuaguacccccuaccguagaaagccgcaccaaacccuucaccguccccauacucacaguugaagaaaugaccaacucacgcuucccuauaccccuagaaaaacuauucacuggccccucaggggcauucgucguccaaccccaaaacggcagaugcacuacagacggaguccuacucggcaccacucaacucuccccaguaaacaucuguaccuuucgcggcgacguaacacacauagccgguacccacaacuacacaaugaaccucgcaagucaaaacuggaauaauuacgauccaacagaagaaauccccgcuccccucggcacccccgacuucgucggccgcauccaagggaugcucacccaaacaacccguggcgacggauccacacgcggccauaaagccacagucaguaccggcgacguacacuucacacccaaacucggaagcauccaauucaauaccgacaccaacaacgacuucgaaaccggccaaaacacaagguucaccccugucggcguaguccaagauggcaacggcacacaccaaaaugaaccacaacaauggguccucccauccuauucuggccgaacaggccacaacguccaccucgcccccgcagucgcucccacauuccccggagaacaacuacucuucuuccgaucuaccaugccaggcugcuccggcuaccccaacaugaaccucgacugccugcugccacaagaguggguccaacacuucuaccaagaagcugccccugcacaguccgacguagcccuccuccgauucgucaauccagacacuggacgcguccucuucgaaugcaaacuacacaaaucugguuacgucaccgucgcccacacuggccaacacgaccuuguuaucccacccaacgguuacuuccgauucgacucaugggucaaccaguucuacacccucgcucccaugggcaacggcaccggacgccgcagagcccuuuaa

SEQ ID NO: 36802 - RNA, 1623 nt, Artificial Sequence
  derived and/or modified sequence opt11 from capsid_protein__Norovirus__AAT00309
augaaaauggccucaaacgaugccaacccaucggacggcagcaccgccaaccucguccccgaagucaacaacgaaguaauggcccucgaacccguagucggcgccgccauagcagccccagucgcaggccaacaaaacguaaucgaccccuggauccguaacaacuucguccaagcaccaggcggcgaauuuacagucucaccccgaaacgcaccaggggaaauccuaugguccgcaccacucggcccagaccucaacccauaccucucccaccucgcccgcauguauaacggcuaugcaggaggcuucgaaguccaagucauccucgccggaaacgccuucaccgccggcaaaaucaucuucgccgcagucccacccaacuucccuaccgaaggccuauccccaucccaggucacuauguucccccacaucaucgucgacgucagacaacucgaaccaguccuaaucccacucccugauguccgcaacaacuucuaccauuacaaccaaagcaacgaccccaccauaaaacucaucgccaugcuauacaccccacuucgcgcaaacaacgccggugaggacgucuucacagucuccugccgaguccuaacgcgacccuccccagacuucgacuucaucuuccucgucccaccaacaguagaauccagaacuaaacccuucaccgucccuauacucacagucgaagaaaugaccaacucccgcuuucccaucccccuagaaaaacuuuuuacaggcccauccggcgccuucgucguccaaccacaaaacggcagaugcaccaccgacggcguccuacucggcacaacccaacuaucccccgucaacauaugcaccuuccguggcgacgucacccacaucgccggaacacacaacuacaccaugaaccuagccucccaaaacuggaauaacuacgacccaacagaagagauccccgccccucucggcacucccgacuucgucggacgaauacaaggcaugcuaacccaaacaacccgcggcgacggaaguacccggggacacaaagcuacagucucaaccggagacguccacuucaccccuaaacucggcuccauccaguucaacaccgacacaaacaacgacuucgaaacaggccaaaacacgcgauucacacccguaggcgucguccaagacggcaacggaacccaccagaacgaaccccagcaauggguacuccccucauacuccggucgaaccggacacaacguucaccucgcccccgccgucgcccccacauucccaggagaacaacuccucuucuuucgcuccacuaugcccgggugcuccggauaccccaacaugaaccucgacugccuacuaccccaagaauggguacaacacuucuaccaagaagcugcacccgcacaaagcgacguugcacuccuccgcuucgucaacccagacacugggcgaguccucuucgagugcaaacuucacaaaucagguuacguaaccguugcacacaccggccaacacgaucucguaaucccacccaacggauacuuccgauucgacuccugggucaaucaguucuauacccucgccccaauggguaacggcacuggacgccgacgagcccucuaa

SEQ ID NO: 36803 - RNA, 1623 nt, Artificial Sequence
  derived and/or modified sequence opt11 from capsid_protein__Norovirus__AAT00312
augaaaauggcauccaacgacgccaaccccuccgacgguuccaccgccaaccuaguacccgaagucaacaaugaggugauggcccucgagcccguagucggcgcggcgaucgccgcacccgucgcaggccaacaaaacgucaucgacccauggaucaggaacaacuucguacaagcccccggcggggaguucaccgucuccccacgaaacgcacccggcgaaaucuuauggagcgcaccccucggacccgaccucaauccauaucuaucccaccuagcacggauguacaacggcuacgccggcgguuucgaaguucaagucauccucgcaggaaacgccuuuacagcaggcaaaaucaucuucgccgcaguacccccuaacuuccccaccgaaggacuaagucccucccaagucaccauguucccccacaucaucguagacguccgccaacuugaacccgucuuaauccccuuacccgacguccgcaacaacuucuaccacuacaaccaaucaaacgacccaaccaucaaacuaaucgcaaugcucuacaccccacuacgcgcaaacaacgccggcgaagacguauucaccguauccugccgcguacuuacccggcccuccccugacuucgacuucaucuuccucgucccaccuaccgucgaaucucgcaccaaaccauucaccguccccauccucacagucgaagagaugaccaacuccagauucccaauaccccuugaaaaacucuucaccggccccuccggcgccuuugucguccaaccccaaaacggucgcugcacuaccgacggcguccuccucggcaccacccaacuaucaccggucaacaucuguaccuuccgcggcgacgucacccacaucgccggaacucacaacuacaccaugaaccucgcaucccaaaacuggaacaacuacgaccccacggaagaaauucccgcaccacucggaacacccgacuucgucggccgaauacaaggcaugcuaacccagaccacccgcggcgacggauccacccgaggccauaaagccacagucuccacaggcgacguccacuucacaccuaaacuaggaucaauccaauuuaacacagauacuaacaacgacuucgaaacaggccaaaacaccagguucacacccguaggcgucguccaagacggcaacgggacccaccagaacgaaccccaacaauggguccuccccagcuacucaggccgaaccggacacaauguccaccucgccccagccguagcaccuacauucccuggagagcaacuacuuuucuuccggucaaccaugcccggaugcucaggcuaccccaacaugaaccucgacugccuccucccccaagaauggguccaacauuucuaccaagaagccgcacccgcacaaucugacgucgcacuacuacgcuucgucaaccccgacacaggccgcguccucuucgaaugcaaacuucauaaaucaggcuacgucaccgucgcacacaccggccaacacgaccucgucauacccccaaacggcuacuuccgcuucgacuccugggucaaccaauucuacacacuggcaccaaugggcaacggcacuggucgccgucgcgcacuauaa

SEQ ID NO: 36804 - RNA, 1623 nt, Artificial Sequence
  derived and/or modified sequence opt11 from capsid_protein__Norovirus__AAT00315
augaaaauggccuccaacgacgccaacccauccgacggcucuaccgcaaaucuuguccccgaagucaacaacgaaguaauggcccuagaacccguuguaggcgccgccauagccgccccagucgccggucagcagaacguaauugaccccuggauccgcaacaacuucguccaagcaccaggaggcgaguucaccgucagcccccgcaacgcccccggcgaaauccucugguccgcaccccucggacccgacuuaaaccccuaccuaucccaccuagcccggauguacaacggcuacgcaggcggcuucgaaguacaagucauauuagccggcaacgccuucacagccggaaaaaucaucuucgcagcggucccgcccaacuucccaaccgaaggccucucccccucccaagucaccauguuuccccacauaaucguagacguucgccagcuagaacccguacuuauaccccuccccgauguccguaacaacuucuaccacuacaaccaauccaaugaccccacgauuaaacucaucgccaugcucuauacaccccuccgcgccaacaacgcaggcgaagauguauucaccgucuccugccgaguccuaacccgaccaucacccgacuucgacuucauauuccucgucccacccaccgucgaaucccgcacaaaacccuucaccguccccauccucaccguagaagaaaugaccaacuccagauuccccaucccgcuagaaaaacucuucaccggacccuccggugccuucguuguacaaccacaaaacggccguugcacuacagacggaguguuacuugguaccacccaacucucaccagucaacauuugcaccuuccgcggcgacgucacccacaucgccggcacccauaacuacacgaugaaccucgccucucaaaauuggaacaauuacgaccccaccgaagaaauccccgccccacucggaaccccagacuucguaggccgaauacaagguaugcuaacccaaaccacucgcggcgacggcuccacccgcggacauaaagccacagugucaacaggagacguccacuucaccccaaaacucggcuccauccaauucaacacagacacaaacaacgacuuugaaaccggacaaaacacucgcuucacacccgucggcguaguccaagacgguaacggcacccaucaaaaugaaccccaacaauggguccuacccuccuacagcggccgcacaggccacaacguacaccuagcucccgccguagcccccacuuuucccggagaacagcuccucuucuuccgcucaaccaugcccggcugcuccggauaucccaacaugaaucuagacugccuccucccccaagaauggguccaacacuucuaccaagaagcagccccagcccaauccgacgucgcccuucuccgcuucgucaacccagacaccggccgcguccucuucgaaugcaaacuccacaaaucaggcuacgucacuguagcccacaccggccaacacgaccuuguaauacccccaaacggcuacuuucgcuucgacucaugggucaaccaauucuacacccucgcucccaugggcaacggcacaggccgccgacgcgcacucuaa

SEQ ID NO: 36805 - RNA, 1623 nt, Artificial Sequence
  derived and/or modified sequence opt11 from capsid_protein__Norovirus__AAT00318
augaaaauggccuccaacgacgcaaaccccuccgacggaucuaccgccaaccucguacccgaagucaacaacgaagucauggcccuagaacccguagucggugcagccaucgcagcacccguugccggacaacaaaaugucauagacccauggauccgcaacaacuucguacaagcccccggcggcgaguucaccguuucaccccggaacgcccccggagaaauccucugguccgcaccccuggggccagaccuaaaccccuaucucagccaccuagcacgcauguacaacggcuacgcaggaggcuucgaaguccaagucauccucgccggaaacgccuucaccgcaggcaaaauaauuuucgcagccguuccacccaacuuccccacugaaggccuauccccuucacaagucaccauguucccccacaucaucguugacguccgccaacucgaaccagugcucaucccccuaccagacguaagaaauaacuucuaccacuacaaucaauccaacgaccccacuaucaaacuuaucgcaaugcucuacaccccacucagagcaaacaacgccggcgaagaugucuucaccgucucaugccgcguccucacccgccccucacccgauuucgacuucauauuccucgucccacccaccgucgaaucacgaacaaaacccuucaccguacccauucuuacgguugaagaaaugacaaacucccgauuccccaucccccucgaaaaacucuucacaggucccuccggagccuucgucguccaaccccagaacggccgcugcacaacggacggcguacuacucggaacuacccaauuaagccccgucaacauaugcaccuuccgcggcgacgucacacacaucgcgggaacccacaacuacaccaugaaccucgcaucccagaacuggaacaacuacgaccccaccgaggaaaucccagcaccccuuggcacuccggacuucgucggacgaauacaaggcaugcucacccaaaccacacgcggcgacgguucaacccgcggucacaaagccaccguguccacaggcgacguucacuucacccccaaacuaggcuccauccaauucaacacugacaccaacaacgacuucgaaaccggccaaaacacacgcuucacccccgucggcgucguacaagacggcaacgguacccaccaaaacgaaccacaacaauggguacuacccucauacuccggccgaaccggacacaauguacaccucgccccagcaguagcaccaaccuucccaggcgaacaacuccuuuucuuccgcuccacaaugcccggcugcuccggcuaccccaacaugaaucucgacugccuccucccccaagaauggguccaacauuucuaccaagaagccgccccagcacaauccgacgucgcccucuuacguuuugucaaccccgacaccggccgaguccuauucgaaugcaaacuacacaaaucaggcuacguuacagucgcgcacacgggccaacacgaccuaguaauuccacccaacggauacuuccgcuucgacagcugggucaaccaguuuuacacccucgcccccaugggcaacggcacaggccgccgccgcgcccucuaa

SEQ ID NO: 36806 - RNA, 1623 nt, Artificial Sequence
  derived and/or modified sequence opt11 from capsid_protein__Norovirus__AAT00321
augaaaauggcguccaaugacgcaaaccccuccgacggcuccacagccaaccuagucccagaagucaacaaugaaguuauggcccucgaaccagucgucggcgccgcuaucgcagcacccgucgccggccaacaaaacgucaucgacccauggauccgaaacaacuucguccaagccccaggcggagaguucaccgucucaccccgcaacgccccuggugaaauccuaugguccgcuccccuaggacccgaccuuaaucccuaucugucccaccuagcccgaauguacaacggauacgccggaggguucgaaguccaaguaauccuagccggaaacgccuucaccgccggaaaaaucaucuucgcagccgucccacccaacuuucccaccgaaggccuaucccccucccaagucaccauguucccccacauuaucgucgauguccgacaacucgaacccguacucaucccccuccccgacguucgaaacaacuucuaccauuacaaccaauccaacgaucccaccauuaaacuaaucgccaugcuauacacaccccuccgcgccaacaacgccggagaagacgucuucacagucucaugccgcguacucacucguccaucacccgacuucgacuucaucuuucucgucccaccgaccguagaaucccgcaccaaacccuucacagucccaauccucaccgucgaagaaaugaccaacucucgauucccuaucccacuagaaaaauuauucacaggcccauccggagccuucguaguccaaccccaaaacggccgcugcaccaccgacggcguccuccuagguacuacccagcucuccccugucaauaucugcacauuccgcggcgacgucacacacauagccggcacccacaacuacaccaugaaccucgcaucccaaaacuggaacaacuacgacccuaccgaagaaauccccgcuccacuugguacccccgacuucguaggccgaauacaaggcaugcuuacccaaaccacccgcggcgacggcuccacccgaggccacaaagccaccgucuccacaggcgacguacacuuuacucccaaacucggcuccauccaauucaacaccgacaccaauaacgacuucgaaacaggacaaaacacccgcuucacccccgucggcguaguccaagacggaaacggcacccaccaaaaugaaccccaacaauggguucuacccuccuacuccggucgaaccggacacaauguccaccucgcccccgccgucgcaccaaccuucccgggugaacaacuacucuucuuccgaucaaccaugcccggcugcucuggcuaucccaacaugaaccucgacugccuucugccccaagaauggguccaacacuucuaucaagaagcagcccccgcacaauccgacgucgcacuccuucgcuuuguuaacccugacaccggcagaguccucuucgaauguaaacuacauaaaagcggauacgucaccgucgcacacacaggucaacacgaccuagucaucccacccaacggauacuuccgauucgacucuuggguaaaccaauucuacacccuugcccccaugggcaacggcacaggccgacgccgcgcacucuaa

SEQ ID NO: 36807 - RNA, 1623 nt, Artificial Sequence
  derived and/or modified sequence opt11 from capsid_protein__Norovirus__AAT00324
augaaaauggcauccaacgacgccaacccguccgacggcuccaccgcaaacuuaguccccgaagucaacaacgagguaauggcccucgaaccuguugucggagcagcaaucgccgcccccguagcuggccaacaaaacguaaucgaccccuggauccguaacaacuucguccaagcacccggaggcgaauuuaccgucuccccacgcaacgccccgggcgaaauccucuggucggcuccucucggccccgaccucaaccccuaccucucccaccuagcccgaauguacaacggcuacgccggcgguuucgaaguccaagucauacucgcaggcaacgcauucaccgcaggaaaaauuaucuucgcagccgucccucccaacuuccccacugaaggccucuccccaucucaagucaccauguucccucacauaauaguagacguacgccaacuagaacccguccugaucccccuccccgacguccgcaacaacuucuaccauuacaaccaguccaacgaccccacaaucaaacucaucgcuaugcuuuauacaccccuccgcgccaacaacgccggcgaagacgucuucaccgucaguugcagaguccuaacccgacccucccccgacuucgacuucaucuuccucgucccacccaccgucgaaucccgcaccaaacccuucaccguccccauacucacaguagaagagaugaccaacucccgcuuccccauaccccuagaaaaacucuucaccggccccuccggagcauucgucguccaaccccaaaacggccgaugcaccaccgacggcguccuacucgguaccacccaacuuucccccgucaacaucugcgcauucagaggagacguaacccacaucgccggcacccacaauuacacaaugaaccuugccagccagaacuggaacaacuacgaccccaccgaagaaauacccgcaccccucggaacacccgacuucgucggccgcauacaaggcaugcuuacccaaacaacccgcggagacggaucaacgcgaggccacaaagccaccgucuccaccggcgauguacacuucacccccaaacuaggcucaauccaauucaauaccgacaccaacaacgacuucgaaacaggccaaaacacaaaauucacacccguaggaguaguccaagacggaaacggaacccaccagaacgaaccacaacaauggguccucccaucauacucaggcagaaccggacacaacguacauuuagccccagcugucgcccccacauucccaggcgaacaacuccucuuuuuccgauccaccaugcccggcugcaguggcuaccccaauaugaaccuagauugccuccucccccaagaauggguccaacacuucuaccaagaagccgcccccgcccaaagcgacguagcccuacuccgcuucgucaaccccgacacaggccgcguacucuucgaaugcaaacuucacaagucaggcuacguuacagucgcccauaccggccaacacgaucucguaauucccccaaacggcuauuuccgauucgacagcuggguaaaucaauucuacacccuagcucccaugggaaacgguaccggacgccgccgugcccucuaa

SEQ ID NO: 36808 - RNA, 1623 nt, Artificial Sequence
  derived and/or modified sequence opt11 from capsid_protein__Norovirus__AAT00330
augaaaauggccucaaacgacgccaaccccuccgacggauccaccgccaaccucguccccgaagucaacaacgaaguaauggcccuagaaccagucgucggcgccgcaaucgccgcccccguagccggccaacaaaacgucauagacccauggauccgcaacaacuucguccaagccccaggcggagaguucacagucucaccccgcaacgcccccggcgaaauacuauggucagcaccccucggacccgaccuaaaccccuaccucucacaccuggcccgcauguacaacggauacgcaggcgguuucgaaguccaagucauacucgccggcaacgccuucacugccggcaaaaucauuuuugccgccguacccccgaacuuccccacagaaggucuaucacccucccaagucaccauguucccacauaucaucgucgacguccgccaacuagaacccguccuaaucccccuccccgacgucagaaauaacuucuaccacuacaaccaaagcaacgacccaaccauaaaacucaucgcuaugcuuuauacaccccuaagagccaacaacgccggagaagacgucuucaccgucuccugccggguacuaacccgaccauccccagacuucgacuucauauuccucgucccaccaaccguagaaucccgaacuaaaccauucacagucccuauccuaaccguggaagaaaugacuaacucccgcuuccccauaccucucgaaaaacuauucacaggcccuucaggcgccuuugucguacaaccccaaaauggccgcugcaccacugacggcguccuccucggaaccacacaacucucacccgucaacauaugcacauuccgcggugacguaacucauaucgcaggcacacacaacuacacgaugaaccucgcaagccaaaacuggaacaacuacgaccccaccgaagaaauccccgccccucucggcaccccagacuucgucggccgcauccaaggcaugcuaacccaaaccaccagaggcgacggcucgacucgcggucacaaggccaccguauccaccggagacguccacuucaccccaaaacuuggauccauacaauucaauaccgacaccaacaacgacuucgaaaccggccaaaacacgaaauucacacccgucggcguaguccaagacggaaauggaacccaccaaaacgaaccccaacaauggguccuccccuccuacucuggucgcaccggucacaacguucaucucgcacccgcuguugcacccacuuuccccggugaacaacuccuauucuuccgcucagccaugccaggcugcucaggcuaccccaacaugaaucucgacugccugcucccccaagaauggguccaacacuucuaccaagaagcagcacccgcccagucagacgucgcacuccuaagguucguuaaccccgacaccggccguguccucuucgagugcaaacuacauaaguccggauacguaaccgucgcccacaccggacaacacgaccuaguaauaccacccaacggcuacuuccgauuugacuccugggucaaucaauuuuacacccuagcccccaugggcaacggcacaggccgccgucgagcccucuag

SEQ ID NO: 36809 - RNA, 1623 nt, Artificial Sequence
  derived and/or modified sequence opt11 from capsid_protein__Norovirus__AAT00333
augaaaauggccucaaacgacgccaaccccucagacggaucuaccgcaaaccucguucccgaaguaaacaacgaagucauggcacuggaaccagucgucggugcagcaauagcagcucccgucgccggccaacaaaacgucauagaccccuggauccgcaacaacuucguccaagcccccggaggcgaguucaccgucucuccccgcaaugcccccggcgaaauacucugguccgcuccccucggucccgacuuaaacccuuacuuaucccaccucgcccgcauguauaauggcuacgccggcggcuucgaaguccaaguuauccucgcaggcaacgccuucaccgccggcaagauuaucuucgcagccgucccacccaacuuccccacugaaggccucucccccucucaggucacuauguuuccccacauaaucguugacguccgccaacucgaacccguacucaucccucuaccagacguccgcaacaacuucuaccacuacaaccaaucaaacgaccccaccaucaaacucauagccaugcucuacacuccccuucgagcuaauaacgccggcgaagaugucuucaccguaucaugccgugucuuaacacgcccaucacccgacuucgacuucaucuuccucgucccacccaccguagaaucacgcaccaaaccuuucaccguacccauccuuaccgucgaagaaaugaccaacucacgcuuucccauaccucuggaaaaacuauucacaggucccuccggcgcauucguaguccaaccccaaaacggccgaugcaccacagacgguguucuccuaggaacaacccaacucagcccaguaaacaucugcaccuuccguggugacgucacccacaucgcagguacccacaacuacacaaugaaccuugcaucccaaaauuggaacaauuacgaccccacagaagaaaucccagcuccccuaggcaccccugacuucgucggccguauacaaggcaugcucacccaaacaacccgaggagacggcuccacccgcggccacaaagccacugucucaaccggcgacguccacuucacacccaaacucggaucuauccaauucaacacugacacaaacaacgacuucgaaacuggucaaaacacaaaauucaccccagucggugucguccaggacggcaacggcacucaccaaaacgaaccccaacaauggguacuacccaguuacuccggccgcaccggccacaacguccaccuagcccccgccguagcccccaccuuccccggagaacaacuccucuucuuccguuccgcaaugcccggaugcuccggcuaccccaacaugaaccucgacugccuacuaccccaagaauggguccaacacuucuaccaagaagccgcacccgcccaguccgacgucgcccuacuacgauucgucaacccugacaccggacgcguccucuucgagugcaaacuccacaaaucaggcuacguaaccgucgcacacaccggccagcacgaccucguaaucccacccaacggcuacuuccgauucgacuccuggguaaaucaauucuacacccucgcccccaugggcaacggaaccggccgccgacgagcccucuag

SEQ ID NO: 36810 - RNA, 1623 nt, Artificial Sequence
  derived and/or modified sequence opt11 from capsid_protein__Norovirus__AAT00336
augaaaauggcgucaaacgacgcaaaccccucagacggaagcacagcaaaccuuguccccgagguaaacaaugaggucauggcacucgaacccguugucggcgccgccaucgccgcccccgucgccggacaacaaaacguaauugacccauggauacgcaacaacuucguccaggcucccggcggcgaguucacagucuccccacgcaacgcaccaggagaaauccugugguccgcaccacucgguccagaccucaaccccuaccucucccaccucgccagaauguacaacggcuacgcugggggcuucgaaguccaaguaauccucgccggaaacgccuucaccgccggcaaaauuaucuucgccgcaguaccacccaacuuccccaccgaagggcucucccccagccaagucacaauguucccccacaucaucgucgacguccgccaacuagagcccguacuaauaccccugccagauguccgcaacaacuucuaccacuacaaccaauccaaugacccaacuauaaaacucaucgcgaugcucuacacuccccuccgcgcaaacaacgccggcgaagacgucuucaccguaucaugcagaguccucacccgccccucacccgacuucgacuucaucuuccucguaccacccaccgucgaaucacgaaccaagccauuuaccguucccauccucacagucgaagaaaugaccaacucacgauuucccaucccccucgaaaaacucuucaccggccccucaggcgccuucgucguccaaccacaaaacggacgcugcacaacagacgggguccuacucggaaccacccaacucagcccagucaacaucugcaccuuccgcggcgauguaacccacaucgccggcacccacaauuacacuaugaaucucgccucacaaaacuggaacaacuacgaccccaccgaagaaauucccgccccacucggcacccccgauuucgucggccgaauccaaggaaugcucacccaaacuacacgcggcgacggaucaacccgaggccacaaagccacugucucaaccggcgacguccacuucacaccaaaacucgguucuauacaauucaauacagacaccaacaacgacuucgaaaccggacaaaacaccaaauucacacccgucggcgucguccaagacggaaacggcacccaccaaaacgaaccccaacaauggguccuuccaucuuacagcggccgaaccggccacaacguucaccucgcaccagcugucgcucccaccuuccccggagaacagcuucucuucuuccgcuccgccaugcccggcugcuccggauaccccaacaugaaccuagacugccuccucccccaagaauggguccagcacuucuaccaagaagccgcaccagcccaaucagacguagcacuauuacgcuucguaaaccccgacaccggcagagugcuauucgaaugcaaacuacacaaaucaggauacguaaccguugcacacacaggccaacacgaccuaguaaucccacccaacggcuauuuccgcuucgacuccugggucaaccaauucuacacccuagcccccaugggcaacggcaccggucgccgccgggcccucuaa

SEQ ID NO: 36811 - RNA, 1623 nt, Artificial Sequence
  derived and/or modified sequence opt11 from capsid_protein__Norovirus__AAT00342
augaaaauggccagcaacgacgccaaucccuccgacggcucaaccgcuaaccucguccccgaagucaacaaugaagucauggcgcucgaacccgucgucggcgcagccauagccgcccccguagccggccagcaaaacguaaucgaccccuggauccgcaacaacuucguccaagcaccaggcggagaguucaccgugucccccagaaacgcacccggcgaaauccuauggucagcaccccucggacccgacuuaaaccccuaccuaucccaccuugcccgcauguacaacggauaugcaggcggcuucgaaguccaagucauccucgccggcaacgccuucacugcuggaaaaaucaucuucgccgcaguacccccaaacuucccaacagaaggacucuccccaucacaagucaccauguucccucacaucaucguagacguccgccaacucgaaccaguccucauaccacuacccgacguccgcaacaacuucuaccacuacaaccaaagcaacgaccccacaaucaaacucauagccauguuauacacucccuuacgcgccaacaacgcgggcgaagacgucuucaccguauccugccguguacugacccgccccucacccgacuucgacuucaucuuccucguaccacccaccguagaaucccgcaccaaaccauucacagucccuauacuaaccguggaagaaaugaccaacucccgcuucccuauaccacucgaaaaacuauucaccggccccuccggcgcauucgucguccaaccccaaaacggacgaugcaccaccgacgguguucuccuugguaccacccaacuuucuccagucaacauuugcaccuuccgaggagauguuacccacaucgccggcacccacaacuacacaaugaaccuagccucccaaaacuggaacaacuacgaccccacagaagaaauucccgcaccccucggcacacccgacuucgucggcagaauccaagguaugcucacccagacaacccgcggcgacgggucaacccguggacacaaagccacuguauccaccggagacguccacuucacacccaaacucggcuccguccaauucaacaccgacaccaacaaugacuuugaaaccggccaaaacaccaaauucacccccguaggagucguccaagaugguaacggugcccaccaaaacgaaccccaacaguggguacuuccuucauacuccggcagaaccggccacaacguacaccuagccccagcagucgcacccaccuuucccggcgagcaacuacucuucuuccgcuccaccaugccaggcugcucuggcuaccccaacaugaaccucgacugccuccucccacaagaguggguccaacacuucuaccaagaagccgcccccgcccaauccgacgucgcccuacuccgauucgucaaccccgacaccggacgaguccucuucgaaugcaaacuacacaaaaguggcuacgucaccguugcccacacuggccaacacgaccuuguaaucccucccaauggcuacuuccgauucgacucauggguaaaccaauucuacacacuugcccccaugggcaacggaaccggccgccgacgagcacuauaa

SEQ ID NO: 36812 - RNA, 1623 nt, Artificial Sequence
  derived and/or modified sequence opt11 from capsid_protein__Norovirus__AAT00345
augaaaauggccucaaacgacgcaaacccaucggacggcagcacggcgaaccucgucccagaagucaacaaugaaguaauggcccucgaaccagucguaggcgccgccaucgccgcacccgucgcaggacaacaaaacguaaucgaccccuggauacgaaacaacuucguccaagccccaggcggcgaguucaccguaucaccccgaaacgcccccggcgaaaucuuaugguccgccccgcucggcccggaccucaaccccuaccucucccaccuagcccgcauguacaacggcuacgcaggaggauucgaaguccaagucauccuagcaggcaacgccuucaccgccggaaaaaucauauucgcagcugucccaccuaacuuccccacagaaggccuauccccaucacaaguaacaauguucccccacaucauaguugacguacgacaacucgaacccguacuaaucccccucccagauguacgcaacaacuucuaccacuacaaccaauccaacgaccccaccaucaaacuaaucgccaugcucuacacaccucuacgcgccaacaacgcaggagaagacgucuucacagucucaugccgcguacuaacacgccccucacccgacuuugacuucauauuccucgucccaccaaccguugaaucccguacaaaaccauucacagucccaauccuaaccguugaagaaaugaccaacucccguuucccaaucccccucgaaaaacucuuuaccggccccucuggcgcuuucgucguccaaccccaaaacgggcgcugcaccaccgacggcguccuccucggaaccacacaacucuccccaguaaacauaugcaccuuccgcggugacguuacccacauagcaggcacccacaacuacaccaugaaccucgcuucacaaaacuggaacaauuacgaccccacagaagaaauccccgcaccccucggcacccccgacuucguaggaagaauccagggaauguuaacccagaccacccgcggagacggcucuacacgaggccacaaagccaccguaucuacaggcgacguacacuucacucccaaacugggcuccauacaauuuaacaccgacaccaacaacgacuucgaaaccggccaaaacaccagauucacuccuguuggcgucguccaagacgguaauggaacccaccaaaacgaaccccaacaauggguccuucccuccuacagcggccgcaccggccacaacguacaccucgccccagccguagccccaacauuccccggggaacaacuccucuucuuccgcuccacgaugccaggaugcuccggcuacccaaacaugaaccuugacugccuucucccgcaagaauggguacaacacuuuuaucaagaagccgcccccgcccaaucagacgucgcccugcuccgcuucgucaacccugacacuggccgcguccucuucgagugcaaacuacacaaauccggcuacguaaccgucgcccacaccggacaacaugaccucgucauacccccaaacggcuacuuccgauuugacucuugggucaaccaauucuacacacuagcacccaugggcaacgguacaggccgccgucgagcccuauag

SEQ ID NO: 36813 - RNA, 1623 nt, Artificial Sequence
  derived and/or modified sequence opt11 from capsid_protein__Norovirus__AAT00348
augaaaauggccucuaacgaugcaaacccaagcgacggcucuaccgcaaacuuagucccugaagucaauaacgaaguaauggcacucgaacccguagucggugcagccaucgcagcacccguugccggccaacaaaacguaaucgaucccuggauccgcaacaacuucguccaggcccccggcggcgaauuuaccguuagcccccgaaacgcccccggcgaaauccucugguccgccccacuaggaccagaucuaaacccauaccucucccaccucgcccguauguacaacggcuacgcaggaggcuucgaaguacaagucaucuuagccggaaacgccuucaccgccggaaaaaucaucuuugcugccgucccgcccaauuuccccaccgaaggcuuaucacccucacaagucaccauguuuccccacauaaucgucgacguacgacaacucgaacccguacucaucccucuucccgacguccgaaauaacuucuaccacuauaaccaaucaaacgaccccaccauaaaacucaucgcaaugcuuuacaccccgcuccgcgccaacaacgcgggcgaagacgucuucaccgucuccugcagaguccucacccgaccauccccagacuucgacuucaucuuccucguaccucccaccgucgaaucacgcaccaaaccauuuacaguccccauccucacaguagaagaaaugaccaacucucgauuucccaucccccuagaaaaacucuucaccggccccucaggcgcauucgucguccaaccccaaaacggccgaugcaccaccgacgguguccuucucggcaccacccaacucucccccgucaacauuuguaccuuccgcggcgacgucacccacauagcaggaacacacaacuacacaaugaaccuugccucacaaaacuggaacaacuacgaccccacagaagaaaucccagcaccccucggcacacccgacuuugucggccgcauccaagguaugcuaacucaaaccacccguggcgacggcuccacccguggccacaaagccacaguuuccacaggagacguccacuucaccccaaaacuaggaucuauccaauucaacaccgacaccaacaacgacuucgaaaccggacagaacacccgauucacccccguaggcgucguccaagacgguaacggcacccaccaaaacgaaccccaacaauggguccucccaucuuacuccggccgcaccggccacaacguucaucuugccccagccguugcacccaccuuuccuggagaacaacuccuauucuuccgaucaacaacccccggcugcuccggauacccaaacaugaaccucgacugccuccucccacaagaauggguucaacacuucuaccaagaagccgcccccgcccaaucugacguagcgcuccuccgcuucgucaacccugacacaggccgcguccucuucgaaugcaaacuacacaaaucaggauacguaaccgucgcucacaccggccaacacgaccucgucauacccccuaacggcuacuuucgcuucgacucaugggucaaccaauucuacacccucgcccccaugggcaacggcacaggacgccgacgcgcccuuuaa

SEQ ID NO: 36814 - RNA, 1623 nt, Artificial Sequence
  derived and/or modified sequence opt11 from capsid_protein__Norovirus__AAT00351
augaaaauggccagcaaugacgcaaacccauccgacggauccacagccaaucuagugcccgaagucaacaacgaaguaauggcccuagaacccguagucggcgcagcaaucgccgcacccgucgcaggccaacaaaauguaauagaccccuggauccgcaacaacuucguccaggcacccggcggagaguucaccgucucaccccgcaacgcccccggagaaauacuaugguccgcaccccucggccccgacuuaaacccauaccucucccaccucgcccgcauguacaacggcuacgccggcggcuucgaaguacaagucauccuagccggaaaugccuucaccgcagggaaaaucaucuucgccgcugugcccccaaacuuucccaccgaaggccuaucucccucccaagucaccauguucccacacaucaucguggacguccgccaacucgaacccguccucauaccccucccagacguacgaaacaacuucuaccacuauaaccaauccaacgaccccaccauaaagcucaucgccaugcuauauacaccccuacgagccaauaacgcaggagaagacguauucaccgucuccugucgaguccuaacccgcccaucccccgacuucgacuucauuuuucuaguacccccaaccgucgaaucccgcaccaaacccuucaccguccccauacucacugucgaagaaaugaccaacucaagauucccaauaccacuugaaaaacuuuuuaccggucccucaggagccuucguagugcaaccccaaaacggccgcugcacaaccgauggaguccuccuaggcacaacccaacucucccccgucaacaucugcaccuuccguggggaugucacacacauagccggcacccacaacuacaccaugaaccucgccucacaaaacuggaacaacuacgacccaacagaagaaauaccagccccacucgguacccccgacuuuguaggccgcauccaaggcaugcuuacacaaaccacccggggcgacggcuccacacgaggccacaaggcaaccgucuccaccggcgacguucacuucaccccaaaacucggcucaauccaauucaacaccgacacgaacaacgacuuugaaacaggccaaaacacccgauucacccccguaggcgucguccaggauggcaacggcacacaccaaaacgaaccccaacaauggguacuacccagcuacuccggaagaaccggccauaacguacaccucgcuccagcugucgccccaaccuuccccggcgaacaacuccucuucuuccgaucaaccaugcccggcugcagcggcuaucccaacaugaaccuagacugccuacuaccacaagaauggguccaacacuucuaccaagaagccgcuccugcccaguccgacguugcacuccuacgcuucgucaacccagacacaggccgaguacuauucgaaugcaaacuucacaaaucaggauacguaacaguugcccacaccggccagcacgaucucguaauacccccuaacgguuacuuccguuucgacucauggguuaaccaauucuacacgcuagcaccaaugggcaacggaacaggacgacgccgcgcucucuga

SEQ ID NO: 36815 - RNA, 1623 nt, Artificial Sequence
  derived and/or modified sequence opt11 from capsid_protein__Norovirus__AAT00354
augaaaauggccuccaacgacgcuaaccccuccgauggaucaacagcaaaccuaguaccagaaguaaacaaugaagucauggcccucgaacccguaguaggcgccgcuauagccgcacccgucgccggccaacaaaacgucauagaccccuggauacgaaacaacuucguacaagcccccggaggcgaauuuacagucucuccccgaaacgcccccggcgaaauccucugguccgcaccccugggccccgaccucaaccccuaccuaucacaccucgcccgcauguacaacggcuacgcaggaggcuucgaaguucaagucauacucgccggcaacgcuuucacagccggaaaaaucauauucgcagcagucccgcccaacuuccccaccgaaggccucucacccucccaagucacaauguucccccacaucauagucgacguacgccagcuagaacccguccucaucccccugcccgacguccgcaacaacuucuaccacuacaaucaaucgaacgaccccaccaucaaacucaucgccaugcucuacacuccucuccgcgcaaacaacgccggcgaagauguguucacaguuagcugccggguucucacucgcccaucccccgacuucgacuucaucuuccucgucccucccacaguagaaucucguaccaaacccuucacaguccccauccuaacagucgaagaaaugacaaacucucgauuccccaucccccucgaaaagcuguucaccggcccgucaggcgcuuucgucguccaaccccaaaacggccgaugcacaaccgaugggguccuccucggcaccacccaacucagcccggucaacaucugcacauuccguggcgacguuacacacaucgcaggaacacacaauuacacaaugaaccucgcaucccaaaacuggaacaauuacgaccccaccgaagaaauaccagcaccccuaggcaccccugauuucgucggacgaauccaaggcaugcuaacccaaacaacccgaggagacggcagcacccgaggacacaaagccacaguuuccaccggagacguucacuucacaccaaaacuaggauccauccaauucaacacagacaccaacaacgacuucgaaaccggccaaaacaccagauucaccccagucggcguaguccaagacggcaacggaacacaccagaacgaaccccaacaauggguccuaccaucauacuccggcagaaccggccacaacguccaccucgcccccgccgucgcacccacauuccccggagaacaacuccuauuuuucagaucaacaaugcccggcugcucuggauacccuaacaugaaccucgacugccuccucccccaggaauggguccaacacuucuaccaagaagccgcccccgcccaaucggaugucgcccucuuacgcuucgucaaccccgacaccggacgcguccuauucgaaugcaaacuccacaaauccgguuacguaaccgucgcgcacaccggacaacacgaccucgucauaccacccaauggcuacuuccgcuuugacuccugggucaaccaauucuacacccuagcacccaugggcaacggcacuggccgacgccgcgcccucuaa

SEQ ID NO: 36816 - RNA, 1623 nt, Artificial Sequence
  derived and/or modified sequence opt11 from capsid_protein__Norovirus__AAT00357
augaaaauggccucaaaugacgcaaaccccuccgacggcuccacagccaaccuaguacccgaagucaacaacgaaguuauggcacucgaacccguagucggagcagcuaucgccgcuccagucgccggucaacaaaacguaaucgacccauggauacgcaacaacuuugugcaagcuccaggcggcgaauuuaccgucucccccagaaacgccccaggcgaaauccucuggucagcuccccuuggcccagaccucaaccccuaccuaucccaccuagcccgcauguacaacggcuacgccggcggcuucgaaguccaggucauacucgccggaaacgccuuuacugccggaaaaaucaucuucgccgccgucccacccaacuuccccaccgaaggccucucaccaagccaaguaacuauguucccccacaucauaguagauguaagacaacucgaaccgguucuaauuccccuccccgacguccgcaacaacuucuaccacuacaaccaaucaaacgaccccacuauaaaacucaucgccaugcucuacacaccccuccgugccaacaacgcaggagaagacguauucaccgucucaugccgcguccuuaccagaccaucaccagacuuugacuucauauuccucgucccacccaccguagaaucucgaaccaaacccuuuaccguccccauccuaaccguagaagaaaugaccaacucacguuuccccauuccccucgaaaaacucuucacagguccauccggagcauucgucguccagccacaaaacggacgcugcaccaccgacggaguacuccucggcaccacacaacucagccccgucaacaucugcaccuuccgcggagacgucacccacauagccggaacccacaacuacacuaugaaccucgccucccaaaauuggaacaacuacgaccccaccgaagaaaucccggcuccccucggaacccccgacuucgucgggcgcauccaagguaugcuaacacaaaccacccgaggagacgguuccacccgcggccacaaagccacagucucaaccggagauguccacuucaccccaaaacucggcucuauacaauucaacaccgauaccaauaacgacuucgaaaccggacaaaacacccgcuucacccccguaggaguaguccaagacggcaacggcacccaccaaaacgaaccacaacaauggguccucccuucauacagcggucgcacaggccacaacguccaccucgcacccgccgucgcccccacauuccccggcgaacaacuccucuucuuccguuccacgaugccaggcugcagcggcuacccaaacaugaaccucgacugccuccucccucaggaaugggugcagcauuucuaccaagaagcagcccccgcccaauccgacgucgcccuucuccgcuucgucaauccugacaccggccgcguccuauucgaaugcaaacuccacaaauccgguuacgucaccgucgcccacacaggccaacacgaccucguaauaccacccaauggcuacuuccgcuucgacucaugggucaaccaauucuacacucucgcacccaugggcaauggcaccggacgcagacgagcccucuaa

SEQ ID NO: 36817 - RNA, 1623 nt, Artificial Sequence
  derived and/or modified sequence opt11 from capsid_protein__Norovirus__AAT00360
augaaaauggcauccaacgacgccaaccccucagacggcucaaccgccaaccucgugccagaaguaaacaacgaaguuauggcccuagaacccgucgucggcgccgcaauagcugcacccgucgccggccaacaaaacgucaucgacccauggauccgaaacaacuuuguccaagcccccggcggcgaguucacuguaucaccccguaacgcccccggcgaaauccucugguccgcuccccucggccccgauuuaaacccguaccuaucccaccuagcccgcauguacaacggcuacgccggcggauucgaaguccaagucauccuugccggaaaugccuucaccgccggcaaaaucaucuucgccgccguaccucccaacuuucccaccgaaggccucuccccuucccaaguuacaauguucccccacauuaucgucgacguccgccaacucgaaccaguucucaucccacuccccgauguucgcaacaacuucuaccacuacaaccaauccaacgaccccacuaucaaacuaauagccaugcuauacacaccacuccgcgccaacaacgccggcgaagacguauucacaguaagcugccgaguacuaacaagacccucucccgauuucgacuucauauuccuagucccacccacagucgaaucccgcacgaaaccauucacaguaccaauucucaccgucgaagaaaugaccaacucccgcuuccccaucccucuagaaaaacucuucacaggaccauccggugcauucguaguucagccacaaaacggccgcugcacuaccgacggcguccuccucggcacaacccaacucucaccagucaacaucuguaccuuccguggagacgucacccacauagcaggaacccacaacuauaccaugaaccucgccucccaaaacuggaacaacuacgaccccaccgaagaaauacccgcaccccucggaacuccugacuucgugggccgcauccaaggcaugcucacucaaacaacccgaggagacggaucaacccguggccacaaggccacagucuccaccggcgacguccacuucaccccaaaacuuggcagcauccaauucaauaccgacaccaacaacgacuucgaaacaggucaaaacacccgauucacaccagucggcgucguccaagacggcaacggaacccaucaaaacgaaccucaacaauggguucuccccucguacucaggccguaccggacacaacguccaccuugcucccgccgucgcccccaccuucccaggcgaacaacuacucuucuuccgcagcaccaugccaggcugcuccgguuaccccaauaugaaccucgacugccuacuuccccaagaauggguccaacacuucuaccaagaggccgccccagcccaguccgacguagcacuucuacgcuucgucaaccccgacacuggacguguccucuucgaauguaaacuacacaaguccggauaugucaccgucgcccacaccggacagcacgaccuaguaauaccacccaacggcuacuuccgcuucgacucuugggucaaccaauucuauacacucgcccccaugggaaacgguacaggccgccgccgcgcccuauaa

SEQ ID NO: 36818 - RNA, 1623 nt, Artificial Sequence
  derived and/or modified sequence opt11 from capsid_protein__Norovirus__AAT00363
augaagauggccagcaacgacgccaaccccuccgacggcucuacugcaaaccuagucccagaagucaacaacgaaguaauggcccuagagccuguagucggagccgccaucgcagccccagucgcaggccaacaaaacgucauagaccccuggauaagaaacaacuucguacaggcacccggcggagaguucacagucucgccccgcaacgccccaggagaaauccuuugguccgccccucucggcccugaccuaaacccauaccuaucccaccuagcucgcauguacaacggcuacgcaggcggcuucgaaguccaagucauccucgccggaaacgccuucaccgccggcaaaauaaucuucgccgcagucccgcccaacuuccccaccgaaggacuuucccccucccaaguuacuauguucccccacauuauuguugacguccgccaacucgaacccguccuuaucccccuccccgacguacguaacaacuucuaccacuacaaccagucaaacgaccccacaaucaaacuaaucgccaugcucuacacaccccuccgagccaacaacgccggcgaagaugucuucaccguauccugccguguccucacacgucccucccccgacuucgacuucaucuuccuaguucccccaacugucgaaucgcgcacaaaaccuuucaccguuccaauacucaccgucgaagaaaugaccaacucacgauuccccaucccccucgaaaaacuauucaccgggcccuccggcgccuucgucguacaaccacaaaacggccgaugcacaaccgacggcguacuucuuggcaccacacaacuaucacccgucaacaucugcgcauucagaggagacguaacccacauugccggcacccacaacuacaccaugaaccucgcaagccaaaacuggaauaacuacgaccccacagaagaaaucccagccccucucggcacccccgacuucgucggccgcauucaaggaaugcuuacacaaacaacucgcggcgacggcuccacccgaggucacaaagcaacuguaucaaccggcgacguccacuucacccccaaacucggcucuauacaauucaacacagacaccaacaacgacuucgaaaccggccaaaacacaaaauucacgcccguaggcguaguccaagacggcaacggaacacaccaaaacgaaccacaacaguggguccucccaagcuacagcggacgaaccggccacaacguacaccuagccccugccgucgcccccaccuucccaggagaacaacuacuauucuuccgcuccaccaugcccggcugcucaggcuauccuaauaugaaccucgacugccuccucccccaggaauggguucaacacuucuaucaagaagccgcccccgcacaauccgacgucgcccuccuacgcuucgucaaccccgacacuggccguguccucuucgaaugcaaacuccacaaaucgggcuacgucaccguagcacacacaggccaacacgaccucgucauucccccaaacggcuacuuccgcuucgacuccugggucaaccaauucuacacacuugcaccaaugggcaauggcaccggccgccgccgagcacucuaa

SEQ ID NO: 36819 - RNA, 1623 nt, Artificial Sequence
  derived and/or modified sequence opt11 from capsid_protein__Norovirus__AAT00366
augaaaauggcuagcaacgacgccaaccccuccgaugguuccacagccaaccucguaccugaagucaacaacgaaguaauggcccuagaacccgucgucggcgccgccaucgccgcccccguagcaggccaacaaaacgucaucgacccauggauccguaauaacuucguccaagccccaggaggcgaguucacaguaucuccccgcaacgcaccuggcgaaauacuaugguccgccccacuaggccccgaccuaaacccauaccuuucccacuuagcccgcauguacaacggcuacgcaggcggauucgaaguccaagucauucuugccggcaacgcauucacagcaggcaaaauaaucuucgcagcagucccaccaaacuuccccacagaaggacucuccccuucucaagucacaauguucccccacauuaucgucgacgugcgccaacuugaacccguacuaauaccccuucccgacguacgcaacaauuucuaccacuacaaccaguccaacgacccaaccauaaaauuaaucgccaugcucuacacaccccuccgugcuaacaacgccggcgaagacgucuucaccguaagcugccgcguccucacgcgacccuccccagacuucgacuuuaucuuccuagucccacccaccgucgaaucucgcaccaaacccuucaccgucccaauccucaccgucgaagagaugacaaacucucgcuucccaauaccccucgaaaaacucuucaccggcccaucuggcgccuucguaguccaaccccaaaacggcagaugcaccaccgaugguguccuccucgggaccacccaacucuccccagucaauaucugcaccuuccgcggcgacgucacccacaucgccggcacacacaauuacacuaugaaccuagcaagccagaauuggaacaacuacgacccaaccgaagaaauaccagccccacucggaacuccugacuucguaggccgcauucaaggcaugcucacacaaaccacccgaggcgacggauccacccgcggccacaaagccaccguauccaccggcgacguccacuucacccccaaacucggcuccauccaauuuaacaccgauaccaacaacgacuucgaaaccggccaaaacacccgcuuuacgcccguaggugucguccaagacggcaacggaacccaccaaaaugaaccacaacaauggguucucccauccuacuccggccgaaccggccacaauguccacuuagcccccgcagucgcacccaccuuccccggcgaacaacuccuauucuuccgcagcaccaugcccgguugcuccggcuauccaaacaugaaccuagacugccuacuuccacaagaauggguccaacacuuuuaucaagaagccgcccccgcccaaucagacgucgcucuccuccgcuucguaaaccccgacaccggccgcguacuguucgaaugcaaacuccacaaaucuggauacgucaccguagcccacaccggacaacacgaccucgucauaccacccaacggauacuuccgcuucgacuccuggguaaaccaauucuauacacucgcucccaugggaaacgggaccggccgccgccgcgcacuauaa

SEQ ID NO: 36820 - RNA, 1623 nt, Artificial Sequence
  derived and/or modified sequence opt11 from capsid_protein__Norovirus__AAT00369
augaaaauggcauccaacgaugccaaccccucugacggcucaacagccaaccuaguccccgaaguaaacaacgaaguaauggcacuugaacccgucgucggagccgccaucgccgccccggucgcaggucaacaaaacgucauagaccccuggaucagaaauaacuucguccaagcacccggaggagaauuuaccgucagcccccggaacgccccaggagaaauacucuggagcgccccacuaggccccgaccucaacccauaccucucccaccucgcucguauguacaacggcuacgccggaggcuucgaaguucaagucauucucgccggcaacgccuucaccgcuggaaagaucaucuucgccgcaguuccacccaacuuccccaccgaaggccucuccccaucccaggucacaauguucccccacaucauuguugacguacgccaacucgaacccguacucaucccccucccagacguccgaaacaacuucuaccacuauaaucaauccaacgaccccaccauaaaacuuaucgccaugcuauacacaccccuacgugccaacaacgccggugaagacgucuucaccgucuccugucgcguccuaacacgcccaucccccgacuucgacuucauuuuccucgucccucccacagucgaaucacgcaccaaacccuucacuguacccauccugacaguagaagaaaugacaaacucacgauuccccaucccccucgagaaacucuucacaggacccuccggcgcuuucgucguccaaccgcaaaacggacgcugcaccaccgacgguguucuccuaggaaccacacagcuaucacccgucaacauaugcacauuccgaggcgacguaacacacauagcaggcacccacaacuacacuaugaaccucgccucacaaaacuggaacaacuacgacccaacagaagaaauacccgcaccccucggcacacccgacuucgucggacgaauccaaggcaugcucacacagacaacucgcggcgauggaucaacucgcggacacaaggccaccgucuccaccggagacguccacuucacacccaaacucggcuccauacaauucaacaccgacacaaacaacgacuucgaaaccggacaaaacacaagguucacccccgucggagucguccaagauggaaacggcacccaccaaaacgaaccccaacaauggguccuucccucauacagcggacgcaccggucacaacguacaccucgccccagccguagcccccaccuuccccggcgaacaacuucuauucuuccgauccaccaugcccggcugcucaggcuaccccaacaugaaccucgacugccuccuuccccaagaauggguucaacacuucuaucaagaggccgccccagcgcaaagcgacgucgcccuacuccgcuucgucaaccccgacaccggccgcguccuuuucgaauguaaacuccacaaauccgguuacgucacuguagcccacaccgggcaacacgacuuaguuauaccacccaacggcuauuuccgauucgacucgugggucaaccaauucuacacccuagcccccaugggcaacggcaccggccgccgccgagcccucuaa

SEQ ID NO: 36821 - RNA, 1623 nt, Artificial Sequence
  derived and/or modified sequence opt11 from capsid_protein__Norovirus__AAT00372
augaaaauggccuccaaugacgccaaccccucagacggcuccaccgccaaccucguccccgaaguaaacaacgaagucauggcacuagaacccgucguaggcgccgcaaucgcagcacccgucgcuggucaacaaaacgucaucgaccccuggauacgcaacaauuucguccaagcccccggaggugaguucacggucucuccacgaaacgcccccggagaaauccucugguccgcaccccucggaccagaccuuaaucccuaccucucucaccuagcccgcauguauaauggcuacgcaggcggcuucgaaguccaagucauccuagccggcaacgccuucacagcaggcaaaauaauauucgccgcaguacccccaaacuucccgacagaaggacuguccccaucccaagucacaauguucccacacaucauaguagacguacgccaauuagaaccaguacuaauuccccucccagacguuagaaacaacuucuaccacuacaaccaauccaacgacccaacaaucaaacucaucgccaugcuuuacacaccccuccgcgccaacaacgccggagaagacgucuucaccgucuccugccgaguucucacccgacccucccccgacuuugacuucaucuuccuaguaccacccaccguagaaucucgaaccaaaccauucacaguccccauacucaccguugaagaaaugacaaacagccgcuucccuaucccucuagaaaaacucuucaccggacccucaggcgcauuugucguccaaccccaaaacggucgaugcaccacagacggcguccuacucggcaccacucaacuuagcccuguaaacaucugcaccuuccgaggagacgucacacauaucgccggcacccacaacuacaccaugaaccucgccucucaaaacuggaacaacuacgaucccaccgaagaaauuccagcaccccucggcacccccgacuucgucggccgcauacaaggcaugcuaacacaaaccacccgcggcgacggauccacccgaggccacaaagccacugucuccaccggcgacguacacuucacacccaaacucggaagcauccaguucaauacugacacgaacaacgacuuugaaacaggccaaaauacacgguucaccccagucggaguaguacaagacggcaacggcacacaucaaaacgaaccacaacaauggguccuccccucauacuccggccgcaccggccacaacguccaccucgcacccgccgucgcacccaccuuccccggugagcaacuccucuucuucagauccaccaugcccggcugcucaggcuaccccaacaugaaccuagacugccuccucccccaagaauggguacaacacuucuaccaagaagccgcccccgcacaauccgacgucgcccuccuccgcuucguaaaucccgacaccggacguguccucuuugaauguaaacuacacaaauccggcuacgucacugucgcacacacuggccaacacgaccucgucaucccuccaaacggguacuuccgauuugacuccugggucaaccaauucuacacccucgcccccaugggaaacggcacaggccgccgacgcgcccuauaa

SEQ ID NO: 36822 - RNA, 1623 nt, Artificial Sequence
  derived and/or modified sequence opt11 from capsid_protein__Norovirus__AAT00375
augaaaauggcauccaacgacgccaaccccuccgacggcucaacugcuaaccuaguccccgaagucaacaacgaaguaauggcgcuagaacccgucguaggcgcagccauagcugcccccgucgcaggccaacaaaacgucaucgaccccuggauccgcaacaacuucguccaagccccuggcggagaauuuaccgucucaccgcgcaacgcacccggcgaaauacuauggucagcuccccucggaccugaccucaaccccuaccucucacaccucgcccguauguauaacggauacgccggaggauucgagguccaggucauacucgccggcaaugccuucaccgcaggaaaaaucaucuucgcugcagucccaccaaacuuccccaccgaaggccucucacccucccaagucaccauguucccccacauaaucgucgacgugcgccaacucgagccuguccucauaccccuccccgacgucagaaacaacuucuaccacuacaaccaauccaacgacccaacaauuaaacucaucgccaugcucuacacaccccuacgcgccaacaacgccggagaggacgucuucaccguaaguugccguguacucacccgccccucccccgacuucgacuucaucuuccucguacccccaaccgucgaaucccgcaccaaaccauucacgguccccauccuaaccgucgaagaaaugaccaacucacguuucccaaucccccuagaaaaacucuucaccggcccaucgggcgcauucguuguccaaccccaaaacggccgaugcaccacugacggaguacuacuaggcacaacucaacucuccccagucaacaucugcaccuuccguggugacgugacacacauagccggcacucacaacuacacaaugaaccucgccucacaaaacuggaacaacuacgaccccaccgaagaaaucccugcgccccuaggcacaccagacuucgucggucgaauccaaggcaugcuuacacaaacaacacgcggcgacggguccacccgcggacacaaagccaccgucucaaccggcgacguccauuucaccccuaaacuuggcucaauacaauucaacaccgacacaaacaacgacuucgaaaccggccaaaauaccagguucacccccgucggcguaguccaagacggcaacggcacgcaccaaaacgaaccccaacaauggguacucccaucuuacuccggccggaccggacacaacguacaccuagcccccgccgucgcaccaacauuccccggcgaacaacuccuuuucuuucgaucaaccaugcccggauguuccggcuacccuaauaugaaccucgacugccuacuaccccaagaauggguccaacacuucuaccaagaagccgcacccgcccaaucagacgucgcccuacuccgauucguaaaccccgacaccggacgaguacuguucgaaugcaaacuccacaaauccggcuacguaaccguagcccacaccggccaacacgaucuaguaaucccacccaacggcuacuuccgcuuugauagcuggguuaaccaauucuacacccucgcacccaugggaaacggcaccggccgaaggcgggcacucuga

SEQ ID NO: 36823 - RNA, 1647 nt, Artificial Sequence
  derived and/or modified sequence opt11 from capsid_protein__Norovirus__AAT70110
augaaaauggcauccaaggacgcuacacccucaaaugacggcgccgccggcuuaguucccgaaaucaacaacgaagccauggcccuagaccccguagccggcgccgcaauagcagcaccccucacaggccaacaaaacauaauagacccauggaucaugaacaacuucguacaagccccuggcggcgaguucaccguaagcccccgaaacucccccggcgaaguacuacuaaaucuagaacucggucccgaaaucaaccccuaccuagcacaccucgccagaauguacaacggcuacgccgguggcuucgaaguccaagucguucucgccgguaacgccuucacagccggaaaaauaaucuucgccgcaauaccucccaacuuccccauagacaaccucucugccgcacaaauaaccaugugcccccacguaauagucgacguccgucaacucgaaccagucaaccuuccaaugccagauguccgaaacaacuucuuccacuacaaccaaggcuccgacucccgucuccgccuaaucgccaugcucuacacuccccuucgcgccaacaacuccggggacgacguauuuaccgucucaugccguguccucacccgucccuccccagacuucagcuuuaacuuccucgugcccccgaccguagaaucaaaaaccaaacccuucacccuaccaauccucacgauaucagaaaugucaaacucccgcuucccaguucccauagacucacuccacaccuccccaaccgaaaacaucgucguacaaugccaaaauggacgcgucacacucgacggcgaacucaugggcaccacacaacucuuacccucucaaauuugcgccuuccgcggcguccuuacccgcagcacaagccgagccucugaccaagccgacacagcaacaccucggcuauucaacuacuacuggcacauucaacucgauaaccucaacggaaccccuuacgaucccgcagaagacaucccugguccacucggcacccccgacuuccgcggcaaagucuuuggagucgccucccaacgcaacccagacuccaccacgagagcacacgaagcuaaagucgacacaaccgcaggacgauucacuccaaaacuaggcucacuggaaaucucaacagaauccggagacuucgaccaaaaccaacccaccagauuuacuccagugggcaucggagucgacaacgaagccgacuuccaacaauggucccuccccgacuacucaggucaguucacacacaacaugaaccucgccccggccgucgccccuaauuucccaggcgaacagcuccuauucuuccgcucucaacuucccuccucaggaggccgcuccaacggcauacucgacugccucgucccacaggaauggguccaacacuucuaccaagaauccgcgcccucccaaacccaggucgcccucguccgauacgucaaccccgacacaggccgaguccuauucgaagccaaacuacacaaacucggcuucaugaccaucgccaaaaacggcgacuccccaaucaccgugccuccaaacggauacuuccgcuucgaauccugggucaaucccuucuacacccuagcaccaaugggaaccggcaauggacgccgccgcauccaauaa

SEQ ID NO: 36824 - RNA, 1623 nt, Artificial Sequence
  derived and/or modified sequence opt11 from capsid_protein__Norovirus__AAT73592
auggccuccaaagacgccgcccccucaaccgacggcgccgccggccuaguuccagaaucaaacaacgaaguaauggcacuugaaccaguagcgggagccgcacucgccgccccugucaccggucaaaccaacaucaucgaccccuggauacgaaccaacuuuguccaagcgcccaacggcgaguucacgguaucgccccgaaacgcacccggcgaaguacuccuaaaccucgaacucggaccagaacucaauccauaccuagcccaccuagcucgaauguauaacggcuacgccggaggcauggaaguccaagucaugcuggcaggcaacgcguuuaccgccgguaagcuaguuuucgcugccgucccaccucacuuccccgucgaaaaucucucgccccaacaaaucaccauguuuccccaugucaucauagauguccgcacucucgaaccaguccuccuaccccuccccgacguccgaaacaacuucuuccacuacaaucaaaaagacgaccccaaaaugcgcauugucgccaugcucuacaccccucuccgcuccaacggauccggcgacgacguauucaccgucuccugccgcguccucacucgccccuccccagacuucgacuucaccuaccucgucccacccacgguagaaucaaaaacuaaacccuucacccuccccauccucacccuaggagaaaccuccaauucccgauuccccguccccaucgaccaaauguacacaucccccaacgaaguaaucuccguacaaugccaaaauggcagaugcacacuagacggugaacuccaaggcaccacccaacuccaagucuccggcaucugcgcauucaaaggccaagucacagcacaccuccaagacaacgaacaccucuacaacguaaccauuaccaaccucaacgguucccccuucgaccccuccgaggacauuccagcgccauuaggagucccugacuucgaaggacgaguauuuggagucaucucccaacgcgacaacuacaacagcggaggacaaaaccaacccgcuaaccgcucacacgacgcaguugucccgaccuacaccgcccaauacaccccaaaacucggacaaauccaaauaggcaccuggcaaacagacgacaucaccgucgaccaacccgcaaaauucacccccguaggacuauccgacacagaccacuucaaccaaugggucguaccccgcuacgccggcgcacucaaccuaaacaccaaccuagcacccucagucgcuccuguauuccccggagaacgacuccuauucuuccgauccuacaucccgcucaaaggcggauucggcaaccccgccaucgacugccucguuccacaagaauggauccaacacuucuaccaagaagccaccccuucccuaucagaagucgcccucguccgguacaucaauccagacaccggcagagcccuuuuugaagcaaaacuccaccgcgcaggcuucaugacagucuccucuaacacaagcgcccccgucguaguccccgccaacggcuacuuccgcuucgacuccuggguaaaccaauucuacucauuagcccccaugggcacaggaaacggccgacgacgcauacaauaa

SEQ ID NO: 36825 - RNA, 1614 nt, Artificial Sequence
  derived and/or modified sequence opt11 from capsid_protein__Norovirus__AAT78480
auggccucaaaagacgccgccccuucaaacgacggugccaccggccucguccccgaaaucaacaccgaaacucuaccccucgaacccgucgccggcgccgcuauagccgcccccgucaccggccaaaacaacauaaucgaccccuggauccgaaacaacuucguccaagcacccaacggagaguucaccguaucaccccgaaacucccccggagaaauccugaugaaccucgaacuaggcccagaccucaaccccuaccuagcccaccuaucacgcauguacaacggcuacgccggaggcgucgagguccaaguucuacucgcuggcaacgcuuucaccgccggaaaaauucuauucgccgccguacccccuaauuuccccgucgauaugcucucccccgcacaaaucacaaugcucccacaccucauagucgacgucagaacacucgaaccaauaaugaucccacuccccgacgucagaaacgucuucuaccacuucaacaaccaacccgcaccccgaaugcgucucguugccaugcuauacaccccgcuccgauccaacggcuccggugacgacguguucacggucucaugccgcguccucacuagaccaacccccgauuucgaguucaccuauuuaguaccacccuccgucgaauccaaaaccaaacccuucacccuaccaauccucacgaucggagaacucacaaacucacgcuucccagccccuaucgaccaauuguacacaucccccaacgccgacgucgucguacaaccacaaaacggccgcuguucacuggacggagaacuccaaggcaccacacaacuccuaacaacggccaucugcucuuaucgaggcaugacaagcaacccgacacgagacuacugggacggccaccuccugcaccucguccacccaaacggagccaccuacgaccccacugaagauguacccgcccccuucggaacacaagacuucagaggcauacucuacggcguacuaacacaaaacccccgcgcauccggugacgaagccgcgaacucucaaggaguauacauuucaucuacuagcgaaaaauucacacccaaacucggcacaauaggacuccaccaaguccaaggccaccacucacaacaccaacaaucaaaauucacaccucuaggcgucgcagucaacggcaacacccccuuccgucaaugggaacucccuaacuacuccggagcccuaacucuaaacaccaaccuagcaccagccgucggccccaacuuuccuggcgaacaaauccuuuucuuucgcucaaacguccccuccguccaaggugggcaaccaaucgaaaucgacugccuaauaccacaagaaugggucucccacuucuaccaagaaucagcccccucccaaucagacgucgcccuaguccgauacgucaaccccgacaccggccggaccauauuugaagccaaacuccaccgccaaggauucauaacaauagccgccaccggcucuaaccccgucgucguacccccaaacggauacuuccgcuucgauagcugggucaaccaauucuacgcucuugcaccaaugggcaccggcaacggacgccgacguauccaauaa

SEQ ID NO: 36826 - RNA, 1635 nt, Artificial Sequence
  derived and/or modified sequence opt11 from capsid_protein__Norovirus__AAT78481
auggcaagcaaagacgcaccauccaacauggacggcaccuccggcgccggccagcucguccccgaagccaacaccgccgaccccaucccccucgaacccgucguaggagccgcuacagccgccgcaaccgcagggcaggucaacaugaucgacccuuggaucaugaacaacuucguucaaucacccgaaggcgaguucacuaucucuccuaacaacacaccaggcgauauccuuuucgaccuccaacuaggaccccaccucaaucccuuccuacaacaccuaagccaaauguacaacggcuggguaggcaacaugagaguccgcauccuacuagccggcaaugcauucuccgcaggcaaaaucaucauaugcugcgucccgccaggcuucacagcacaaaacauaucaaucgcucaagccaccauguucccccacgucauagccgacguccgaguccucgaaccaaucgaaauuccccucgacgacguccgcaacguccuauuccacacuaacgaaaaccgcccaaccaugcgucuccucugcaugcucuacacaccccuacgcgcaggcggcgccuccgccggcaccgacccauucgucaucgccggccgcguccuaaccugcccaucccccgacuucaacuuccuuuuucuaguacccccauccgucgaacagaaaacccgccaacuaaccgucccuaacaucccacucaacaaccucuccaacucauccgucccagcaaugaucaauaaaauggcaaucuccucagaugccaaccaaguaguucaauuucaaaacggacgaugcacaaccgacggccaacuccucggcacgacacccauaucagcaucccaagucgcucgaauccguggcaaagucuucuccacguccucaggcaaaggccuuaaccucuccgaacucgacggaucccccuaccacgcauucgaaucaccagcccccgucggcuuccccgaucuaggacacugcgacuggcacgucuccuccuuuaaagcagaccaaaacuccuccggagaccccaucucgcgacucgauaucaagcaaggagcuucauucgcaccccaucucggaucaaucgaauacaccacaucucaaaaccccgacggcggacaacuaggcacacucacauggauuagcucaccaagcgacgauaccccuggccacggcaccaucaaccucuggaaaauaccauccuauggcuccaccguaaccgaauccguccaccucgccccacccaucuacccucccggcuucggcgaaacucuagucaaccuaauguccaacuuccccaucggccacacuaacucaaacauggcccaaguccccuguacacucccccaagaauuuguagcccauuucgucaacgaacaagcccccgucagaggcgacgccgcccuccuucacuacguagacccugauacccaccgaaaccuaggcgaguucaaacuauaccccgagggcuacaucacaugcguccccaacaccggcggcggcggcccacaaucacugcccacaaauggcgucuucaucuucucauccugggucagccgauacuaucaacuagaaccugucggcacagcaggacccgcacgccgccugggaguacgacgagucuaa

SEQ ID NO: 36827 - RNA, 1620 nt, Artificial Sequence
  derived and/or modified sequence opt11 from capsid_protein__Norovirus__AAU95776
augaaaauggccuccaacgacgcaaaccccuccgacggcucuaccgccaaccuagucccggaagucaauaacgaagucauggcacuagaaccugucgucggcgccgcaaucgccgcccccguugcaggccaacaaaacgucauagaccccuggauccguaacaauuucguccaagccccaggcggagaguucacagugucuccccgcaacgccccaggcgaaauucucugguccgcaccccuuggccccgaucuaaaccccuaccuaucccaccucgcccgcauguacaacggcuacgccgggggcuucgaaguccaagucauccuagccggcaaugccuucacugccggcaaaguaauauucgccgccguaccacccaacuuccccaccgaagggcucucacccucccaagucacaauguucccccauaucaucgucgacguccgccaacucgaacccguccuaaucccccuucccgacguccgaaacaacuuuuaccacuacaaccaauccaacgacuccacuaucaaacuaaucgccaugcucuacacaccccucaaagccaacaacgccggcgacgacgucuucaccgucuccugccgaguucucacccgcccaucacccgacuucgacuucaucuuccucgucccacccaccgucgaaucacgaaccaagcccuucaccguccccauacucaccgucgaagaaauguccaacucacgauucccaaucccccuagaaaaacucuauaccggcccguccagcgccuucgucguccagccccaaaacggccgcugcaccaccgacgguguccuccuuggcaccacccaacucuccgccguaaacaucugcacguuccgcggcgacgucacccacaucgccggaucccaugacuacacaaugaaucucgcuucccaaaacuggaacaacuacgaccccacagaagaaauccccgcaccccucggcacccccgacuucguaggcaaaauucaaggaaugcuuacccaaacaacucgcgaagacggcagcacacgagcccacaaagccacagucuccacagguuccguacacuucaccccaaaacucggcucgguacaauacaccacugauacaaacaacgacuuccaaacuggccaaaacacaaaauucacaccaguuggcgucauccaagacggaaauaaccaccaaaacgaaccacaacaauggguacuccccaacuacuccggacgaaccggucacaacguacaucuugcccccgccgucgccccuacauuccccggagaacaacuccuauuuuuccgcagcacaaugccaggaugcuccggcuaccccaacaugaaccucgacugccuacuuccccaagaauggguacaacacuucuaucaggaagccgcccccgcacaauccgacgucgcccuacuccgcuucgucaaccccgauaccggccgaguccucuucgaaugcaaacuccacaaauccggcuacguuaccgucgcccacacaggcccacacgaccuagucauaccacccaacggcuacuuccgauucgauucaugggucaaccaauucuauacacuugcccccaugggaaacggugcaggacgccgucgugcccucuaa

SEQ ID NO: 36828 - RNA, 1644 nt, Artificial Sequence
  derived and/or modified sequence opt11 from capsid_protein__Norovirus__AAX32874
augaaaauggccagcaacgacgcagccccuuccaccgacggcuccgccgggcucguaccagaagucaacaacgaaaccauggcacucgaacccguuguaggcgcuccccucgcagcacccgucgcgggccaacacaauaucauagacccguggauaaaaaugaauuucgugcaagcccccaacggagaauuuaccgucucaccccgcaacgccccaggcgaaauccugcuagaucucgaacuaggaccagaccuaaacccauaccugucccaccuggcccgaauguauaacggguacgccggcggcauggaaguccaagugguccucgccggaaacgcauucacagccggcaaaaucauuuucgccgccgucccgcccaacuuccccgccgaaaaccuaucugccgcccaagucaccaugugcccccacguaaucguagacgucagacaacuugaacccguaaugcuacccaugcccgacauccgaaauaaacucuuccauuacaaccaaguagacgaccccaaacuccgccuccucgcuuaccuuuacacaccccuacgcgcaaacaacgccggugacgacguauucaccgucucaugccgcguccucacccggcccaccccagacuucgaguucauguuccucgucccacccacagucgaaagcaaaaccaaacccuucucccuccccucccuaacccucgacgaacucucuaacucccgauuccccgcccccaucguccaacucuacaccaacccacacgacaaccucguaguccaaccucagaacggccgaugcacaaucgacggacuccuucaaggcacaacccaacucguaucaugcaacgucugcucauuccgaggcacaauaggcgacggccagcccgccagucauuccgaagaagaaaucaugccaauggccuucaacauacaaagagaaauuaugcucgaaaaucuagauggcucuccauacgaccccgccgacgauauccccgccguccuuggauccccagacuuccaaggaauaguauucggcguacuuucccaacggaacgccgacggacaaacuagagcacacgaagcuaaaguagacacacgcgcagcacgauuugcccccaaacuaggcuucgucgucgcaaccgucgaaucaaccgacuuccacgccaaucaacccucccgcuucacccccgucggccucggcggagacggcaaccaagauuucaaccaaugggcacuaccagcauacggaggcgcccuaaccaacaacaccaaucuagcacccccagucaugccagucuaccccggcgaacaaauucuauacuuccgcucccaacuuccauccuccggcggcgucgugggcggcuggcuagacugccuacugccccaagaauggguucaacacuucuuccaagaaucagcaacaucacagagcgacgucgccuuaguccgcuacaucaaccccacuacaggaagaguccucuucgaagccaaacuacacaaacagggcuuccuaaccguagcagccuccggcucauacccccucgucguacccgccgacggauacuuccgcuuugaaucuuggguuaaccaauucuacacccucgcaccaaugggcaauggaucaggccgacgccggacucgcuaa

SEQ ID NO: 36829 - RNA, 1674 nt, Artificial Sequence
  derived and/or modified sequence opt11 from capsid_protein__Norovirus__AAX32877
augaugauggcuucuaacgacgcaaccgcacccaccgacggggccgcaggccugguccccgaagucaccaacgaaaccauggcccucgaacccgucgcaggagccgcccuagccgcacccguaguaggccaacacaauguaauagacccuuggauacguggcaauuucguccaagcacccaacggagaguucacugucucuccccgcaacucucccggcgaagucuuacuaaaccucgaacucggcccugaacuaaacccauaccucgcacaccuagcucgaauguacaacggcuacgcaggcgguauggaaguccagguaguccucgcgggcaacgccuucgccgccggaaaaaucauuuuugcagccgucccacccagcuuccccgucgacgcucucuccgcccccacaauaaccaugugcccccacgucaucgucgacguccgccaacucgaacccguccuccuccccaugcccgacguccgcaacaacuucuuccacuacaaccaauccucagacccuaaacuacgccucgucgcaaugcuauacacaccacuucgagcaaacagccccacagacgacgucuucaccgucucuugccgcguacugacacgaccgagccccgacuucgaguucaccuuccuaauacccccuacagucgaauccaaauccaagccauucaccaucccccaacuuacucuuucagaacuauccaacucacgcuucccagcacccaucgacaugcucuauaccucaccaaacgacaacauuguaguacaaccccaaaacggcagaugcacccucgacggcgaacuacaaggcaccacccaacuacaaccaucccucauaugcucuuuucgcggcgucacgcucaacgaaaccagccgcaugcuagucgaccaagaagaagaagaagaaggagaaguccaacgcccacaagcaagagccuucaaccacgaauaccaccuacaacuccaaaaccucgacgguacagacuacgacccagccggcgaccucccggcaacccucggcgcccccgacuucauaggcacagucuacggcguagucagccaaagaacgaccagagacuccgccgcucgcgcgcacgaggccaaaauaacaaccuccgacccacgcuacgcccccaaacuaggcucagucgaauuuguuaccgaaucaaccgacauuguccucaacgaccaaacaaaauucacucccguuggccuugcucacaaucgcgcagucgauuacaaacaaugggaacuaccccacuacgccggcgaacuaaccgccaacaccaaccucgcaccgcccgucgcccccgucuaccccggagagcaacuccuguucuuccguuccaaucuuccacuagccggcggaaccgcagccucaguucuagacugccuacucccacaagaauggauccagcauuucuaccaagaauccuucgccccacaauccgacauagcacuccuacgcuacgucaacccagacaccggacgaguccuauucgaagccaaacuucaccgccaagguuacaucaccgucgcaggagccggaacaucccccgucgccguuccgcccaacgguuacuuccgcuucgaauccuggguaagccaauucuauacacuagcccccaugggguccggaaccggacgacgacgcaaccaauaa

SEQ ID NO: 36830 - RNA, 1674 nt, Artificial Sequence
  derived and/or modified sequence opt11 from capsid_protein__Norovirus__AAX32880
augaugauggcaucgaaugacgcgaccgcccccacagauggcgcagcaggccucguccccgaagucaccaacgaaacaauggcccucgaacccguagccggcgccgcccucgccgcacccguagucggccaacacaacguaauugacccuuggauccgcggaaacuucguucaagccccaaacggggaguucacgguauccccaaggaacucuccuggcgaaguccuucuaaaccuugaacuuggccccgaacuaaacccuuaccucgcucaucuagcccgcauguacaacgguuacgccggcggcauggaaguccaagucguccuagccggcaacgcauucgcagccggcaaaauuaucuucgccgccgucccacccucauuccccguagacgcccuauccgcccccacaaucaccaugugcccucacgucaucgucgacguacgacaacuagagcccguccuccuucccaugcccgacguacggaacaauuucuuccacuacaaccaauccucagacccuaaacuccgccucguagcuaugcuauacacaccccuccgcgcuaacuccccuaccgaugacguauuuaccgucucaugccgcguccuuacucgucccucacccgacuucgaguucaccuuccucauaccaccaaccgucgaauccaaauccaaacccuucaccaucccccagcuaacccuaagcgaacuaucuaacucucgauuccccgcccccauagacaugcuauacaccucacccaaugacaacauagucguccaaccccaaaacggccgcugcacccucggcggugaacuacagggcacaacccaacuccaacccucacucaucugcucauuccgcggcgucacccucaacgaaaccucacgcaugcugguagaucaggaagaagaagaagaaggcgaaguccaaagaccacaagcccgcgcuuucaaccacgaauaccaccuccaauuacaaaaccuugacggcacagacuacgaccccgccggcgaccuccccgccacgcuaggcgcccccgacuuuaucgggaccgucuauggcgucguaucccaaagaaccacacgugacuccgccgcccgagcccacgaagccaaaaucacuaccucagacccacgcuacgcccccaaacucggcuccgucgaguucguaaccgaaucaaccgacaucguccuaaacgaucaaaccaaauuuacaccagucggccuagcccacaaccgagcaguggacuauaaacaaugggaacuuccccacuacgccggcgaacuuacagcaaacacaaaccucgccccacccgucgcccccguguaccccggagaacaacuacuauucuuccgcucaaaccucccccucgcaggcggaaccgccgccucugucuuagacugccuccuuccccaagaauggauacaacacuuuuaccaagaaucguucgcaccccaaagcgacaucgcccuacuccgcuacgucaaucccgacaccggucgaguacuauucgaagcuaaacuacaccgccaaggcuacauuaccguagccggcgcaggcacaucacccguagccguaccacccaacggauacuuccgcuucgaaucaugggucucacaauucuacacccucgcacccaugggauccggaaccggacgacgccgcaaccaauga

SEQ ID NO: 36831 - RNA, 1647 nt, Artificial Sequence
  derived and/or modified sequence opt11 from capsid_protein__Norovirus__AAX32886
augaaaauggccagcuccgacgccgcccccuccucagacggcucagccggccucguaccagaagucaacuccgaaaccauggcccucgaacccgucgucggcgcaccccucgccgcacccgucgccggacaacacaacauuauagaccccuggaucaaacucaacuucguccaagcccccaacggcgaguucacagucagcccccgaaacgcucccggcgaaauacuacucgaccuagaacucggaccagauuuaaacccauaccuagcccaccucuccagaauguacaacgcauacgcaggcggcauggaaguccaagucauccucgccggcaacgccuucaccgccggcaaaaucauauucgcagccguuccacccaauuucccccuagaaaaucucucugcagcacaaaucacaaugugcccccacauaaucgucgauguaagacagcuagaacccgucaugcuccccaugccagacguccgaaaccgacucuuccauuacaaccaaguccgggaaccacgacuccgacuuguagccuaccucuacaccccacuccgugccaacaaugcaggcgacgacguauucaccguauccugccgaguacuaacccgccccucacaagacuucgaguucauguuccucgucccacccucuguagaaucaaaaaccaaacccuucucacuccccaaccuaacccucgccgaacuaucaaacagcagauucccccuacccaucgaacaacucuacaccaacccgcuagacaaccucgucguccaaccacaaaacggccgcuguaccaucgacggaauacuccugggcacaacccagcuaguccccucccucaucugcucaaugcgcggcacccuagaagcggaccaagccuccggucacaccgacgacgaauccguccaaagccgagccuucaaccgccaacgcuccuugaugcucgaaaaccccgacggcuccgccuucgacccauccgacgaaguaccugccguauuaggcguucccgacuuccgcggcguugucuucggaguccucucccaacguaacaacggcgacaccacccgcucccacgaagcaaaaauagauacccgacguccccgcuacgcccccaagcuaggauucgucgaaguccuaacagaaucagacgacuuccaaaacggaccacccaccaaauucacacccguaggccuaggaggagacggcaaccccgacuuccaacaaugggcacuacccgacuacggcggcgcccucaccaacaauaccaaccuugcaccuccugucgucccagucuaccccggcgaacagauacuauucuuccgcucccaacuacccagcuccggcggaaccgucgccggcuggcuagacugccuccucccccaagaauggauccaacauuucuaccaagauucagcagccgcacaauccgacgucgcacucguacgcuacaucaauccagcaaccggacgcguccucuucgaagcaaaacuacaccgccaaggcuuccucaccguauccgccgccggcccccacccagucgucgcaccagccgacgguuacuuccgcuucgaaucaugggucaaucaauucuacacccuagccccaaugggcaaugggucaggucgacgacgcgucuacuaa

SEQ ID NO: 36832 - RNA, 1623 nt, Artificial Sequence
  derived and/or modified sequence opt11 from capsid_protein__Norovirus__AAZ31376
augaaaauggcaucaaacgacgccacccccucagacggcuccacagccaaccugguccccgaagucaacaacgaagucauggcccucgaacccgucgucggcgccgccauagcagcacccgucgccggccaacaaaacgucaucgacccauggauccgaaacaacuucguacaggcccccggcggagaguucaccgucuccccuagaaacgccccaggcgaaauccuaugguccgcaccccuaggacccgaccucaaccccuaccucucccaccuagccagaauguacaacggcuacgccggcggauucgaaguccaggucauccuagccggcaacgccuuuaccgcaggcaaaaucaucuucgccgccguacccccaaacuucccaacagaaguccucucacccucccaagucaccauguucccacacaucaucgucgacguucgccaacucgaaccaguccucaucccccuccccgauguccgcaacaaccuauaucacuacaaccaguccaacgaccccacaauccgccucauagcuaugcucuacacaccccucagagcaaacaacgccggugacgacgucuuuaccguauccugccgcguccucacucgcccgucacccgacuucgacuuuauguuccuagucccaccgacagucgaaucacgcaccaaacccuucuccguaccaauacuaacugucgaagaaaugaccaauucccgcuucccuaucccgcuagaaaaacuauucaccggccccuccuccgccuucgucguccaaccccaaaacggccgcugcaccacagacggcguauuacucgggacaacucaacucuccccagucaauauuugcaccuuccgcggugacgucacccacauagccggcgcgcaaaacuauaccaugaaccuagccucccagaacuggaacaacuacgaccccaccgaagaaauccccgcgccacuagggacccccgacuucgucggaaaaauacaagggguccuuacccaaaccacacgacgcgacggcuccacccgaggucacaaagcaaccgucucaacuggauccguccacuucacacccaaacucgguuccguccaauucucaacugacacaucaaacgacuuugaaaccggccaaaacacacgcuucacaccaguaggaguaguccaagacggcuccaccacccaucaaaacgaaccacaacaauggguacuacccgacuacucaggacgcgacucccacaacguucaccucgcacccgccgucgcccccaccuucccaggagaacaacucuuauucuuccgcuccaccaugccagguugcuccggauaccccaacaugaaccucgauugccuacuuccccaagaauggguccaacacuucuaccaagaaucagcccccgcccaaucagacgucgcccuucuccgcuucguaaacccagacacaggacgcguacucuucgagugcaagcuccacaaaagcggauacgucaccgucgcccacaccggccaacacgaccucgucaucccacccaacgguuacuuccgguucgacagcuggaucaaccaauucuacacucuggcccccaugggcaacggugccggccgcagacgagcccucuaa

SEQ ID NO: 36833 - RNA, 1623 nt, Artificial Sequence
  derived and/or modified sequence opt11 from capsid_protein__Norovirus__AAZ31396
augaaaauggcauccaacgacgccacucccuccgacggcucaaccgccaaccuaguaccagagguaaacaacgaagucauggcccuugaaccuguggucggagccgcaaucgcagcccccguagcaggacaacaaaacgucaucgacccuuggauccgcaacaacuucguccaagcacccggcggagaguucacagucuccccacgaaaugccccaggcgaaauacuuuggucugccccacucggacccgaccuaaacccuuaccucucccaucucgcuagaauguacaauggauacgccggaggcuucgaaguccaggucauucucgccggcaaugccuucacugccggcaaaauaaucuucgccgccgucccacccaacuuccccaccgaaguacuaucacccucccaagucaccauguuuccccacaucauaguagauguccgacaacucgaacccgugcucaucccacuccccgauguacgcaauaaccuauaccacuacaaucaauccaacgaccccacgauccgucuuaucgccaugcucuacacuccccuccgcgcaaacaacgccggcgacgacgucuucaccguuaguugccgcgugcuaacccgccccucccccgauuucgauuucaucuuccucguaccacccaccguagaaucucgaaccaaacccuucuccguccccauacugaccgucgaagaaaugacaaacucgagauucccaauuccccucgaaaaacucuucaccggucccucaagcgccuucguaguccaaccccaaaauggccgaugcacaacagacgguguacuacucgguaccacacaauuaucccccgucaacaucugcacauucagaggcgacgucacccacaucgccggcacccaaaacuacaccaugaaucuagccucccaaaacuggaacaauuacgaccccaccgaagaaauccccgcaccccuaggaacccccgacuucgucggcagaauccaaggcguccucacacaaacuacccgccgcgacggcucaacacgcgggcacaaagcaacugucucaaccggcagcguccacuucacccccaaacucggcuccguccaauucuccaccgacacaucaaacgauuucgaaaccggccaaaacacccgauucaccccagucggcguaguccaagacggcuccaccacccaucaaaacgaaccccaacaauggguccuacccgacuacagcggccgcgacucccacaacguccaccuugcucccgccgucgccccaacauuccccggcgaacaacuccuauucuucagaucaacaaugccaggcugcucaggcuaccccaacaugaaccuugacugucuucucccccaagaauggguacaacacuucuaccaagaaucagcccccgcacaaucagacgucgcccuacuccgcuuuguuaaccccgacacaggccgcguacucuuugaaugcaaacuacacaaaagugguuacgucacagucgcccacaccggccaacacgaccuaguaauaccacccaacggcuacuuucgauucgacuccuggguaaaccaauucuacacccucgccccuaugggaaacggcgccggccgccgccgugcccucuga

SEQ ID NO: 36834 - RNA, 1623 nt, Artificial Sequence
  derived and/or modified sequence opt11 from capsid_protein__Norovirus__AAZ31402
augaaaauggccuccaacgacgcauccccuucagacggcuccaccgccaaccuuguacccgaaguuaacaacgaaguaauggcccucgaacccguagucggagccgcaaucgccgcccccgucgccggccagcaaaacgucaucgaccccuggaucagaaacaacuucguccaagcccccggcggcgaguucaccgucaguccccgaaacgcaccuggagaaauacuuuggucagcaccccucggccccgaccucaaccccuaccucucccaccucgcccgcauguacaacggcuacgccggagguuucgaaguccaagucauccucgcuggaaacgcauucaccgccggcaaaauaauauucgccgccgucccucccaacuuccccacugaaggacucggccccagccaagucacaauguucccccacaucaucgucgauguaagacaacuagaacccguacuaauaccacuccuagacguccgaaacaaccuauaccauuauaaccaauccaaugacccaaccaucaaacucaucgcaaugcucuacacuccacuucgcgccaauaaugccggcgaagucgucuucaccgucucaugucgcguacucacccgccccucaccagacuucgacuucauauuccucguuccacccaccguagaaucccgaacaaagcccuucaccguccccauccucaccgcagaagaaaugaccaacucucgauuccccacaccccuaggcaaacuauuuacaggccccucauccgcauucguaguccaaccacaaaacggccgaugcgccaccgacggcguccuccuaggaaccacccaacuaucccccguaaacauaugcaccuuccgcggcgacguaacccacaucgccgggacccacgacuacaccaugaaccuugcaucacagaauuggaacaacuacgaccccaccgaagaaauccccgccccacucggaacaccagacuuugucggcaaaauccaaggcguccuaacccaaaccacccgcggcgacgguucaacccgcggccacaaagccacuguauccacaggcuccguccacuucacaccaaaacuuggcggcguccaauucacaaccgauaccaacaaugacuucgaaaccggacaaaacacaaaguucacacccguaggagucauccaggacggcaacucuacacaccaaaacgaaccccaacaauggguccuacccaacuacuccggccguaccggccacaacguacaccucgccccagccguagccccaaccuuccccggagaacaacuccuauucuuccgauccaccaugcccggcugcucgggcuacccaaacaugaaccucgauugccuucucccucaagaauggguacaacacuucuaccaagaagccgccccggcgcaaucagacguugcccuccuccgcuucgucaacccagacgcuggacgcguccuauuugaaugcaaaccacacaaaucuggcuacgucaccgucgcucacaccggccaacacgaccucgucaucccacccaacggcuacuuccgcuucgacuccuggguuaaccaauuuugcacacuagcccccaugggcaacggcaccggccgccgccgcgcccucuaa

SEQ ID NO: 36835 - RNA, 1620 nt, Artificial Sequence
  derived and/or modified sequence opt11 from capsid_protein__Norovirus__AAZ31411
augaaaauggcauccaacgacgccaacccauccgauggauccgccgcaaaccucgucccagaggucaacaacgaagucauggcccucgaaccggucguuggcgcagcaaucgccgcccccgucgcgggccaacaaaacgucaucgaccccuggauacgaaacaacuuuguccaagccccuggcggcgaguucacagucucaccccgcaacgcccccggagaaauccucugguccgcccccuuagggcccgaccuaaacccauacccaucccaccucgcgcgcauguacaacgguuacgccggaggauucgaaguacaagucauacucgccggcaacgccuucacagccggcaaaaucaucuucgcggcuguuccacccaacuuccccaccgaaggacucucccccucccaaguaaccauguucccccacaucaucguagacguccgacaacuagacccaguccucaucccaucaccagacguccgcaacaauuucuaccauuacaaccaaagcaacgacucaaccaucaaacucaucgccauguuauacacacccuuacgagccaacaacgccggcgacgacgucuucaccguauccugucggguacucaccagaccaagcccagacuucgacuucaucuuccucguacccccaacagucgagucccguacgaaacccuucacaguacccauccuaacagucgaagaaauguccaacagccgcuuccccauaccacucgaaaaacucuacaccggcccuucaucagccuucgucguccagccacaaaauggccgcugcacaacagacggcguccuccucggaaccacgcaauuguccgccgucaacauuugcacguuccgcggcgacgucacacacauagccggcucccacgacuacaccaugaaccucgccagccaaaacuggauaaauuacgaccccaccgaggaaauccccgcuccacucgguacccccgacuucgucggcaaaauccaaggcaugcuuacacaaacaacccgcgaagacggcaguacccgcgcacacaaagccaccguauccaccggaucaguccacuucaccccaaaacucggcagcguacaauacaccacagacacaaacaacgacuuccagacaggacaagacaccaaguucacacccgucggcgucauccaagacggaaacaaccaccaaaacgaaccccaacaauggguccuacccaacuauucuggucgaaccggacauaacguccaccuagcccccgcaguugcccccaccuucccaggcgaacaacuacuuuucuuccgaucgacuaugccuggaugcucaggcuaccccaacaugaaccuagacugcuuacucccccaagaauggguccaacacuucuaccaagaagcugcccccgcucaacccgacgucgcccuccucagauucgucaaccccgacacuggccgcguccucuucgaaugcaaacuccacaaauccgguuacgucaccgucgcacacaccggaccucacgaccuagucauacccccgaacggcuacuuccgcuucgacucuugggucaaccaauucuacacccuagcacccaugggaaacggcgccggacgccgccgcgcccuauaa

SEQ ID NO: 36836 - RNA, 1647 nt, Artificial Sequence
  derived and/or modified sequence opt11 from capsid_protein__Norovirus__AAZ31423
augaaaauggccuccuccgacgcaacccccuccaacgacggcgccgcaggccuaguacccgaaaucgacaacgaagccauggcccucgaucccgucgccggcgccgcuauugcugccccacucacgggccaacaaaacaucaucgaccucuggaucaugaacaacuucguacaggcuccaggaggcgaguucacugucucaccccgcaauucccccggcgaaguccuucuaaaccucgagcuuggccccgaaaucaaccccuaccuggcucaccuggccagaaugcacaacgguuacgccggaggcuucgaaguccaagucguccuugccggcaacgcuuucaccgccggcaaaauaaucuucgcagccauaccacccaacuuccccaucgacaaccucuccgcugcacaaaucaccaugugcccccacgucaucguugacguccgccagcucgaacccguuaaccuccccaugcccgacguccggaacaacuucuuccacuacaaccaaggcuccgacucacgccuacgccucaucgccaugcucuacaccccacuccgcgccaacaacucaggugacgacgucuucacaguauccugccgcguccucacccggcccuccccagacuucuccuucaacuuccugguacccccaacagucgaauccaaaacaaaacccuucacccuccccauacuaaccauuucagaaaugucuaacucccgcuuccccguccccaucgacucacuccuuaccucgccaacagaaaauaucgucguacaaugccaaaacgggcgcgucacccucgauggcgaacucaugggcacaacucaacuacuucccucucaaaucugcgcauuccgcggcguccucacacguuccacaagcagagcaucugaccaagccgacaccgcaacaccacgccucuucaacuacuacuggcauauacaacucgacaaccucaacgggaccccauacgacccugccgaagacauaccaggcccacucggcacacccgacuuccgcgggaaaguauucggcguugccucccaacgcaaccccgacuccaccacacgcgcccacgaggccaaagucgacacaaccgcaggucguuucacaccuaaacuaggcucccuagaaaucuccaccgaaagcgacgauuucgaccaaaaccaaccaacccgcuucacucccguuggcaucggcguagaccgcgaagccgacuuccaacaauggucccuaccugacuacucuggucaauucacacacaacaugaaccuagccccugccgucgcacccaaccugcccggagaacaacuccuauucuuccgcucccaacucccuucauccggcggccgaucaaccggaauccucgauugccucguaccccaagaauggguccaacacuuuuaccaagaaucagcacccgcucaaacgcaggucgcccucguaagauacaucaaccccgacaccggcagaguccucuucgaagccaagcuacacaaacucggcuucaugaccaucgcuaaaaacggcgauuccccaaucacagucccacccaacggcuacuuccguuucgaauccuggguaaaccccuucuacacccucgcacccauggguaccggcuccggcagacgccgcauucaauaa

SEQ ID NO: 36837 - RNA, 1623 nt, Artificial Sequence
  derived and/or modified sequence opt11 from capsid_protein__Norovirus__AAZ31428
augaaaauggccuccaacgacgccgcccccuccaacgacggcgcagccggccucguaccugaaaucaacaacgaagucaugccccucgaacccgucgccggcgccucccucgccacccccgucguaggccaacaaaacauaauagaccccuggauccggaacaauuuuguccaagcgcccgccggagaauuuaccguaagcccccguaacucccccggcgaaauccuccucgaucucgaacucggcccagaacucaaccccuaccuugcacaccuugcacgaauguacaacggacaccccagcggcauggaagaacagauuguccuagccggcaacgcauucaccgcuggaaaaaucaucuucgccgccauucccccugguuucccuuacgaaaaccucucccccucccacaugaccaugugcccccacguaaucauauacguuauucaacucgaacccguccuaaugcuaaugcccgaaauccaaaacaacuucuuucacuacaaccaagggaacgaccccaaacuccgccucguagccaugcuuuacacgccccuccgcgccaacaacucuggcgaugacgucuucaccguaucuugccgaguccucaccaaacccuccccagacuucgaguucaccuuccuaguacccccaaccgucgaauccaagacaaaagaguucacccuccccauacuccguaucuccgaaaugaccaacucacgcuucccaguacccguagaaaugauguacaccgcccgaaacgaaaaccaaguaguccaaccccagaauggccgcgucacucucgacggcgaacuacucggcacuaccccacuacucgcagucaacaucugcaaauucaaaggugaagucauugccaaaaauggcgacguucgcucauaccgcauggacauggaaauaacaaacaccgacggaaccccgaucgaccccaccgaagacacacccgggccgaucggcucacccgacuuucaaggcauccuuuucggcgucgccucccaacgaaacaaaaacgaacaaaaccccgccacacgcgcucacgaagucaacaucaauaccggaggugaccaauacgcgcccaaacucgcacagguaaaauucuucuccgaaucgcaagacuucgaaguccaccaacccaccguuuucacccccgucggcgucgccggcgacaccagccaccccuuccgccagugggugcucccccgcuacggcggccaccucaccaacaauacccaccucgcccccgccguugcaccccucuuucccggcgaacaaauccuauucuuccgcucccaaauccccucuuccgguggccacgaacucggcuauauggacugucucguuccccaagaauggguccaacacuucuaccaagaagccgccaccgcucaauccgaagucgcccuuauacgguucauaaacccagacaccggacgaguccuauucgaagccaaacugcacaaacaaggcuucauuaccgucgcacacaccggcgauaaccccaucgucaugcccccaaacggauacuuccgcuucgaagccugggucaaucaauucuacucccucgcacccgucggcaccggcaacggcagacgccgcguccaauaa

SEQ ID NO: 36838 - RNA, 1626 nt, Artificial Sequence
  derived and/or modified sequence opt11 from capsid_protein__Norovirus__ABB02420
augcgcaugagcgacggcgcugcccccaaagccaauggcuccgaagccuccggacaagaccuaguacccaccgccguagaacaagccguacccauccaacccguagcaggcgccgcacucgccgcgcccgccgcaggccagaucaaccagauugacccauggauauuccagaacuucguccagugcccccucggagaauuuucaaucuccccacgaaacacccccggcgaaauccuauucgaccuagcgcuuggccccggccucaacccauauuuagcccaccucucagcaauguauaccggaugggucggcaacauggaaguacaacucguccucgcaggcaacgccuucacagcuggaaaagucgucguagcccuagucccgcccuacuuccccaaagggucccucaccacagcacaaauuaccugcuucccccacgucaugugcgacguucgcacccucgaaccuauccaacuaccccuccucgacguuagacgaguacucuggcacgccacccaagaccaagaagaauccaugcggcucgucuguaugcucuacacaccccuacgcacaaacucgccaggcgacgaauccuucgucguuucaggccgccuccuauccaaacccgccgcagacuucaacuucguauaccucaccccacccaucgaacgaacgaucuacagaauggucgaccuccccguccuccaaccccgucuaugcacacacgcuagauggcccgcccccgucuacggccuccuagucgaccccucucuccccuccaacccccaauggcagaauggccgaguccacgucgauggcacccuacucggaaccaccccaguuaguggcuccuggguauccugcuucgccgcagaagccgccuacgaguuccaaucaggcaccggacaagucgccaccuucaccaugaucgaacaagauggcagcgcauacguccccggcgaccgcgcagccccacucggcuaccccgauuauucaggccaauuagaaauagaaguccaaaccgaaacaaccaaagccggggacaaacucaaagucaccaccuuugaaaugauccuaggccccaccaccaacgucgaucaagcccccuaccaaggcagagcauacgccucacucacagcaguagccucccuggaccucguagacggacguguacgagccguaccccgauccaucuacaguuuccaagacguacuccccgaauacaacgauggacuacucgucccgcucgcaccaccacucggcccauuucucccaggcgaaguccucuugcgcuucagaacauauaugcgacaacucgacaccgccgacgcugccgcccaaccaaucgacugcgcccucccccaagaguucaucucaugguucgcuucaaacucauucacaguacaaucagacgcacuucucguacgauaccguaacacccucacaggccaacuccuauucgaagccaaacuuuacuccgaaggcuacauagccgucagcuauuccggcuccggcccccucacauucccuaccgacggcuucuucgaagucguuucuuggguaccucgccucuuccaacucgcaucaguaggaucccucgcaaccggccgcacccucaagcaauaa

SEQ ID NO: 36839 - RNA, 1626 nt, Artificial Sequence
  derived and/or modified sequence opt11 from capsid_protein__Norovirus__ABB02423
augcgaaugucagacggcgcagcacccaaagccaacgguagcgaagccuccggccaagaccuugucccaacagccguugaacaagcaguaccaauccagccugucgccggugccgcgcuagcagcccccgccgcaggacaaaucaaucaaaucgacccuuggaucuuccaaaacuucguccaaugcccacuaggugaauuuucaaucucaccccgcaacaccccaggugaaauccucuucgaccucgcccuaggcccaggauuaaaccccuaccucgcccaccuauccgccauguauacaggauggguaggaaacauggaaguucagcuagucuuagccggaaacgcauucaccgccggcaaagucgucguugcccuagucccacccuacuuccccaagggcucccucacaaccgcccaaauaaccugcuucccccacgucaugugcgacguacguacacuagaaccaauccaacugccacuacuagacguccgccgcgugcucuggcacgccacccaagaccaagaagaauccaugcgacucguaugcaugcucuacacaccccuucguaccaacuccccgggcgacgaauccuucgucguaucaggccgccuccucucuaaaccagccuccgacuuuaacuucgucuaccuaacaccacccaucgaacgcaccauauaccgcaugguugaccuuccaguccuucaaccccgccuaugcacccacgcccguuggcccgcccccguauacgggcuccucguagaccccucccuucccucaaacccccaauggcaaaacggccguguccacgucgacggcacccuacuaggcaccacccccgucucaggcuccuggguaucuugcuucgcagccgaagcagccuacgaguuccaaucaggcaccggcgaagucgccacauucacaaugaucgaacaggacggcucugccuacgucccaggcgaccgugccgccccacuaggcuacccagacuucagcggccaacuagaaaucgaaguccaaaccgaaaccaccaaaaccggagacaaacucaaagucacuaccuucgaaaugauccucggacccaccaccaauguugaccaagccccuuaucaaggucgagcuuacgccucacuaaccgcagccgccucccucgaccuagucgacggccgaguucgagccguaccccgaucaguauauucuuuccaggacgaacucccagaauauaacgacggcuuacucgugccccuagccccaccccucggccccuuccuccccggcgaaguccuacuucgauuccgcaccuacaugcgccaacucgacacagcagacgccucagcccaacccaucgacugcgcacuaccccaggaguucaucucaugguucgccuccaacaacuuuaccguccaauccgacgcccugcuaguucgcuaccgcaacacccuaaccggacaacuccucuucgaagcaaaacucuacuccgaaggguacaucgccguaucauacuccggauccgggccucuuaccuucccaaccgacgguuucuuugaaguaguaucuuggguaccccgccucuuccaacuggccucagucggcagccucgucaccggucgcacccucaaacaauaa

SEQ ID NO: 36840 - RNA, 1623 nt, Artificial Sequence
  derived and/or modified sequence opt11 from capsid_protein__Norovirus__ABC96746
augaaaauggccuccaacgacgccagcucauccgacggcucaacugccaaccuuguccccgaagucaacaacgaagucauggcccuagaacccgucgucggcgcagcaaucgcagccccagucgccggccaacaaaacguuaucgacccuuggauccgcaacaauuucguccaagcccccgguggcgaguucaccguuuccccacgcaaugcccccggcgaaauccuaugguccgcaccccucggccccgaucuaaaucccuaccucucacacuuagccagaauguauaacggcuaugccggcggcuucgaaguucaagucauccucgccggcaacgcauucaccgcuggcaaaauaauauucgcagccgucccucccaacuuccccacagaaggacuaucucccucacaagucaccauguuuccccacauuaucguagacgucagacaacucgaacccguccucaucccccuccccgacguccgaaacaacuucuaccacuacaaucaauccaacgacccuaccaucaaacuaaucgccaugcuauacacaccccuccgcgcaaacaacgccggugacgacgucuucacuguauccugccgcguccuaacccgcccauccccagacuucgauuucaucuuccucguacccccuaccguagaauccagaaccaaacccuucaccguucccaucuuaacagucgaagaaaugaccaacuccagauuccccaucccccucgaaaaacucuucaccggcccguccucagccuucgucguccaaccccagaacggccgcugcaccaccgacggcguccuccucggaacaacccaacuaucaccaguaaauaucugcaccuuccgaggagaugucacacauaucgcaggaacacacgacuacaccaugaaccucgccucccaaaacuggaacaacuacgaccccaccgaggaaauccccgccccacucgggaccccggacuucguuggaaaaauccaaggcguauuaacacaaacuacgcgaggagacggauccacucgcggucacaaagccaccgucuccaccggcucaguccacuucaccccuaaacucggcucaguccaauucacuaccgacaccaacaacgacuucgaaaccggccaaaacacgaaauucacccccgucggcgucguucaagacggcaauucaacacaccaaaacgagccccaacaauggguccuccccaacuacucuggacgcaccggacacaacguacaccucgcccccgccguagcaccuacauuccccggagaacaacuacucuucuuccguuccaccaugcccggcugcagcggcuacccaaacaugaaccuagacugccuucucccacaagaauggguccaacauuucuaucaagaggcagccccagcccaaucugacguagcccuccucagauucgucaaccccgacacaggacgaguccuauucgaaugcaaacuacacaaauccggcuacgucaccgucgcacacaccggccaacacgaccucguaauacccccaaacggcuacuuccgcuucgauuccuggguuaaccaauucuacacccucgccccaauggguaacggcgcgggacgccgccgcgcccucuga

SEQ ID NO: 36841 - RNA, 1620 nt, Artificial Sequence
  derived and/or modified sequence opt11 from capsid_protein__Norovirus__ABD77588
augaaaauggccuccaacgacgccucaccaucagacggcuccaccgcgaaccucguacccgaagucaacaaugaagucauggcccuagaacccgucgucggcgccgcuaucgccgcacccgucgccggucaacaaaacgucaucgaucccuggauacgcaacucuuccguccaagcaccgggcggagaauuuaccgucagcccccgagaugcccccggcgaaauuuuaugguccgcuccccucggccccgaccuaaaucccuaccuaucccaccuggcccgcauguacaacggcuacgccggcggcuucgaaguccaagucauacuagcaggcaacgccuucaccgccggcaaaaucaucuucgccgcugcacccccaaacuuccccaccgaaggacucucacccucacaaguaaccauguucccacacaucaucgucggcguacgccaacucgaaccaguccuaaucccacucccagacguccggaacaacuucuaccacuacaaccaaucaaacgacucaacaaucaagcucauagccaugcuauacacaccacuccgagccaauaacgccggcgacgacgucuucacagucuccugccgcguccucacacguccgucaccugacuucgacuucauauuccucguaccacccaccgucgaaucacgcaccaaacccuucacaguaccaauacucacagucgaagaaaugacgaacagcagauuccccaucccccuagaaaacugcucccgcguacccgccgucccccucuccuccaaccacaaaaugcaaugcaccaccgacggcguccucuuaggcaccacccaacucucaccaguaaacauuugcaccuuucgcggcgacgucacccacauacccggaacccgcaccuaccguaugaaccucgccucccaaaacuggaacaacuacgaccccaccgaagaaauuccagccccgcucggaacgcccgacuucgucggaaaaauccagggcaugcuaacccagacaaccaaaggcgacggcuccacccgaggucacaaagcaacagucuccaccggcucagucgacuucaccccaaaacucggaucaguccaauucgccaccgacacagacaacgacuucgaaaccggacaaaacacucgcuuuacacccgucggaguaauacaagacggcuccuccacacaccggaacgaaccgcaacaauggguccuccccgauuacagcggaagaaccguacacaacguacaccuagcccccgcaguggcccccacauuccccggcgaacaacuacucuucuuccgauccaccaugccuggcugcuccggauaccccaacauggaccuugacugucuacuuccccaagaauggguacaacacuucuaccaagaagcugcccccagccaauccgacgucgcacuacuuagauucgucaaccccgacacaggacgaguccucuucgaaugcaagcuccacaaagccggauauguaacagucgcucacaccggccaacacgaccucguaauaccaccaaacggcuacuuucguuucgacagcuggguaaaccaauucuacacccucgcccccaugggaaacggcgcagggcgacgccgcgcccucuaa

SEQ ID NO: 36842 - RNA, 1623 nt, Artificial Sequence
  derived and/or modified sequence opt11 from capsid_protein__Norovirus__ABD77589
augaaaauggccucgaacgaugcaucaccauccgacggcuccacagcaaaccuaguccccgaagucaacaaugaaguaauggcacuagagccuguuguaggcgcagccaucgccgccccagucgccggccaacaaaacgucauagaccccuggauccgcaacaacuucguccaagcccccggcggcgaguucacaguuucaccccgaaacgcccccggugaaauccucugguccgcaccccuagguccagaccucaacccauaccucucacaucucgcccgcauguacaacggcuaugccggcgguuucgaaguucaagucauacucgccggcaacgccuuuacagcaggcaaaaucauauucgccgccguaccucccaauuuccccaccgaaggauuaucacccucucaagugaccauguucccccacaucaucgucgauguacgccaacucgaacccguccucaucccacuacccgacguccgcaacaacuucuaccacuacaaccaauccaacgacucuaccauaaaacucaucgcuaugcuuuacacaccacuacgcgcaaacaacgcaggggacgacguuuucaccgucuccugccgcguacucacacgaccuuccccagacuucgacuucaucuuccucguacccccaaccgucgaaucccgaaccaaacccuucacugucccuauacucacagucgaagaaaugaccaacucccgcuuccccaucccccucgaaaaacucuucacuggacccucaucugccuucgucguucaaccccaaaacggccgaugcaccacugacggcguucuucugggaaccacccaacucuccccuguaaacaucugcacuuuccggggagacguaacccacaucccaggcacccgaacauaccgcaugaacuuagcaagccaaaacuggaacaacuacgaccccacagaagaaauacccgcaccccucggcaccccagacuucgucggcaaaauccaagguaugcucacccaaaccaccaaaggcgacggcucuacccgcggccacaaagccaccguauccaccggcucagucgacuucacccccaaauuagacuccguacaauucgccaccgauaccgacaacgacuucgaaacuggccaaaacacccgauucacccccgucggaguaauccaagacgggucuuccgcccaucgaaacgagccccaacaauggguucuccccgacuacucuggccgaacaguccacaacguucaccuagcccccgccgucgcaccaaccuuucccggcgaacaacuccuauucuuccgcuccaccaugccaggaugcuccggcuacccaaauauggacuuagacugccucuuaccccaagaauggguccaacacuucuaccaagaagcugcaccaucccaauccgacgucgcccuacuccgcuucguuaaccccgacacaggccguguccuauucgaauguaaacuacacaaagccggauacgucaccgucgcccacaccggccaacacgaccuugucauacccccaaacggcuacuuccgcuucgacuccugggucaaccaauucuacacccucgccccaaugggcaacggcgccggacgacguagagcccuauaa

SEQ ID NO: 36843 - RNA, 1647 nt, Artificial Sequence
  derived and/or modified sequence opt11 from capsid_protein__Norovirus__ABD77590
augaaaauggccuccaacgacgcaacccccuccaacgacggcgccgcugggcuaguacccgaaaucaacaacgaagccauggcacucgaccccgucgcaggcgccgccaucgccgcaccccucaccggccaacagaacauaaucgaccccuggaucaugaacaauuucguucaagcccccggcggugaguucaccgucucaccccgaaacucccccggagaaguccuccuuaaucucgaacucggcccagaaaucaaucccuaccuagcacaccuagcccgcauguacaacgguuacgcugguggcuucgaaguccaaguaguccuagcaggcaacgccuucaccgcaggcaaaaucauauucgcagccauaccacccaacuuccccaucgacaaccucuccgcagcccaaaucacaaugugcccccacguaauuguugacguccgccaacucgaaccagucaaccuaccaaugccagauguacgcaacaacuucuuccacuacaaccaaggaucagacuccaaacuacgccuagucgcaaugcucuacaccccacuccgcgccaacaacucaggagacgacgucuucaccguaucaugccgcguccuaacacgccccucuccagacuucucauucaacuuccuagucccacccacagucgaaucaaaaacaaaacccuucacccuucccauccucacuaucuccgaaaugucuaacucccguuuccccgucccaaucgacucccugcacaccuccccuaccgaaaauaucuccguccagugccaaaacggccgagucacccuugacggcgaacuaaugggcaccacacaacuucuccccucacaaauaugcgccuuccgaggcguccucaccagaucaaccucccgcgccuccgaccaagccgacaccgccacaccccgacucuuuaacuacuacuggcacauccaacucgacaaccucaacggcacccccuacgacccagcagaagauauccccggcccccucggaacaccagacuuccgaggcaaagucuucggcguggccagccaaagaaacccagacuccacaacacgcgcccacgaagccaaagucgacaccacagccggccgcuucacccccaaacuuggcagccuugaaaucuccacagaauccggcgacuucgaccaaaaccaacccacgcgcuuuaccccggucggcaucgguguagaccaugaagaaaacuuccaacaauggucccuaccggacuacucgggccaauucacacacaacaugaaccuugcccccgcugucgcccccaacuucccaggagaacaacuacuauucuuccgcucacaacuaccauccucaggaggacgcucaaacggcauccucgacugccuugucccccaagaauggguccagcacuucuaccaggaauccgccccagcucaaacccaaguagcccucguacgcuacgucaaccccgacacaggccgcguauuauuugaagccaaacuccacaagcucggcuucaugaccaucgcuaaaaacggagacuccccaaucacagucccacccaacggcuacuuccgauucgaaagcugggucaaccccuucuacacccucgcacccaugggaaccgguaauggacgccgacgcauacaauaa

SEQ ID NO: 36844 - RNA, 1626 nt, Artificial Sequence
  derived and/or modified sequence opt11 from capsid_protein__Norovirus__ABG45845
augcgcauguccgacggcgccgcccccaaagccaacggcucugaagccuccggccaagaccucguccccaccgccgucgaacaagccguccccauccaaccagucgcaggcgcaucccucgccgcccccgccgcuggccaaaucaaccagaucgaccccuggauuuuccaaaacuucguccaaugcccacuaggcgaauuuuccauaucaccccgcaacacccccggugaaauacuuuucgaccucgcucucggccccggccuaaaccccuacuuagcccaccucuccgcaauguacacaggauggguaggaaauauggaaguccagcucguccucgcaggaaacgccuucaccgcaggcaaagucguuguugcucuagucccacccuacuuccccaaaggcucccuaaccaccgcccaaauaacaugcuucccccaugucaugugcgacguacgcacucuagaaccuauccaacucccccuacuagacguccgccgcguacucuggcaugccacacaagaucaggaagaauccaugcgccucguuugcaugcuauacacaccucugcguaccaacucccccggcgacgaauccuucgucgucuccggccgccuccucucuaaaccagccgccgacuucaacuucguguaccuaaccccacccaucgaacguaccaucuaucgaaugguagaccuacccguacuucaaccccggcuaugcacccacgcccguuggcccgcaccuauuuacggccuccucguagaccccucccuacccgcaaacccacaauggcaaaacggccgcguccacguagacggaacucuccuaggcacaacccccgucuccggcuccugggucucuugcuucgcagccgaagccgcauacgaguuccaaucagguaccggcgaagucgccaccuucacacucauagaacaagacgguuccgccuacguaccgggcgaucgcgccgcuccccucggauaccccgauuucuccggccaacuagaaaucgaaguccaaacggaaacaaccaaaaccggcgacaaacuaacugucaccacuuucgaaaugauccucggaccuaccacaaaugucgaccaagcccccuuccaaggccgcgccuacgccucacuaaccgccgccgccucacucgaccucguagacggccgcguccgcgccguaccccgcuccauauacucauuccaagacgucauccccgaauacaacgacggccuccucgucccccuagcacccccaaucggccccuuucuacccggcgaaguccuacuucgcuuccguaccuacaugcgucaaaucgacagcuccgacgccgccgccgaagccaucgacugcgcucuaccccaggaguucauauccugguucgcauccaacgcauucaccgugcaauccgaagcacuacuacuuagauaccgcaacacccucacgggucaacuccucuucgaaugcaaacuauacuccgaaggcuauaucgcgcucuccuacuccgguucaggcccccucacauucccaacugacggcuuuuucgaagucgucucaugggucccccgccucuaccaacuagccuccgucggcucucucgccaccggucgcacccuuaagcaauaa

SEQ ID NO: 36845 - RNA, 1626 nt, Artificial Sequence
  derived and/or modified sequence opt11 from capsid_protein__Norovirus__ABG45847
augcgaauguccgacggcgcagcacccaaagcaaacggcucagaagcauccggucaagaccuaguacccacagcacuagagcaagccguccccauccaacccgucgccggcgccuccuuagcugcccccgccgcaggccaaauaaaccaaaucgaucccuggaucuuucaaaauuucguucaaugcccccuuggcgaguucucaauuucaccccgaaacacgccaggcgaaauccucuucgaccucgcacucggacccggccuaaacccauaccucgcccaccucuccgcgauguacaccggaugggucggcaacauggaaguacaacucguccucgccggcaacgcauucacagcuggaaaagucgucgucgcccuugucccucccuacuuccccaaaggaucucuaacaaccgcucaaaucacuuguuucccccacgucaugugcgacguccguacccuagaacccauacaacucccccuccucgacguccgacgcguucucuggcacgccacucaagaccaagaagaaucaaugcgucucguaugcaugcucuacacaccccuccgcaccaacucccccggagacgaauccuucgucgucuccggacgccuccucuccaagccagccgccgacuucaacuucgucuaucucaccccacccauugagcgcaccauauaccguauggucgaccuacccguccuccaaccccggcuaugcacacaugccagauggccagcaccuaucuacggccuccuagucgacccaucucuacccgcaaacccccaauggcaaaacggccggguccacgucgacggcacccuccuuggaaccaccccaguaucaggcuccuggguauccugcuucgccgcagaagccgcuuacgaguuccaaagcggcaccggcgaaguugccgccuucacacuuauagaacaagacggcagugccuaugucccaggggacagagccgcaccccuaggguaccccgacuucucaggacaacuagaaauagaaguccaaaccgaaacaacaaaaaccggugacaaacuaaccguaacaaccuucgaaaugauccucggccccaccaccaacguugaccaagcccccuuccaaggccgcguauacgcaucccucaccgcagccgccucacucgaccuagucgacggacgcguccgcgccguaccccgcuccauauacggcuuccaagacgucauccccgaauauaacgacggccuucucgucccccucgccccacccaucggcccauuccuccccggcgaaguucuacuuagauuccgcacauacaugcgacagaucgacucauccgacgccgccgccgaagcaauagacugugcacuaccucaagaguucauauccugguucgccuccaacgccuucaccguacaauccgaagcccuauuacucagauaccgcaacacccucacaggccaacuacuuuucgaaugcaaacuauacucggaaggcuacaucgcccuauccuacuccggcucggguccacucaccuuccccaccgauggcuucuucgaagucgucuccuggguaccccgucucuaccaacucgcaucagucggcucccuagccaccggccgcacccucaaacaauaa

SEQ ID NO: 36846 - RNA, 1626 nt, Artificial Sequence
  derived and/or modified sequence opt11 from capsid_protein__Norovirus__ABG45849
augcgcaugagcgacggcgcggcccccaaagccaacggcuccgaagcauccggccaagaccucguccccacagccgucgaacaagccguccccauucaacccguugccggcgcaucacucgcagcucccgccgcuggccaaaucaaucaaaucgaccccuggaucuuccaaaacuucguccaaugcccccuaggcgaauuuucaaucucuccccgcaacacaccuggcgaaauucuauucgaccuagcacuuggcccaggucuuaaccccuaccuagcccaccucuccgcuauguacaccggaugggucgguaacauggaaguucagcuaguacucgccggcaacgccuucacagccggcaaagucguugucgcucucgucccacccuacuucccccgaggaucccuaacuaccgcacaaauaaccugcuucccucacguaaugugcgacguucgcacccuugaacccauccaacucccccuccucgacgucagacgaguccuguggcacgcaacccaagaccaagaagaaucaaugcggcuaguauguaugcuauacaccccgcuaagaacuaacucccccggcgacgaauccuucgucgucucaggcagacuccuauccaaacccgcugcagacuucaacuucgucuaccuaaccccacccaucgaacgaacuaucuaccgcaugguagaccuccccguacuccaaccccguuuaugcacccacgcccgauggcccgcccccaucuauggacuccucgucggcccaucucucccagcaaacccccaauggcaaaacggcagaguacacgucgacgggacacuacuuggcacgacacccguaucgggauccugggucuccugcuucgccgcagaagccgccuacgaauuucaaucuggaaccggugaagucgcagccuucacucuaaucgaacaagauggcuccgcuuacguacccggggaccgcgccgcuccacucggcuaccccgacuucucaggacaacucgaaaucgaaguccaaaccgaaacaaccaagacaggcgacaaacucaccguaaccaccuucgaaaugauccuuggacccaccaccaaugucgaccaagcccccuuccaaggccgcgucuacgcuucacuaaccgccgccgccucccuagaccuagucgacggccgcguccgcgccgucccaagaucaaucuacggcuuccaagacguuauccccgaauacaacgacggccuccuugucccacucgcaccaccaaucggccccuuccuccccggagaaguccuccuccgauuccggaccuacaugcgccaaauugacuccuccgacgccgccgcagaagcaauagacugcgcccuaccccaagaauuuaucucuugguucgccucgaacgccuucacuguccaauccgaagcccuacugcuacgauaccgcaacacccucaccgaacaacuccuauucgaaugcaagcucuauucagaagguuacaucgcccucuccuacagcggcucaggcccccuuaccuuccccaccgacggcuucuucgaagccgucucgugggucccccgccuauaccaacucgccuccguaggaucacucgcaaccggccguacccucaaacaauaa

SEQ ID NO: 36847 - RNA, 1626 nt, Artificial Sequence
  derived and/or modified sequence opt11 from capsid_protein__Norovirus__ABG45851
augcguaugucagacggcgcagcccccaaagccaacgguagcgaagcauccggucaagaccuaguccccaccgccgucgaacaagcaguccccauacaacccgucgccggugccucccuagcagcccccgccgcaggccaaauuaaccaaaucgaccccuggaucuuccaaaacuucguccaaugcccccucggugaguucucaauaucacccagaaauacaccaggcgaaauccucuucgacuuagcacucgguccaggccucaaccccuaccucgcccaccugucagcuauguacacaggcugggucggcaacauggaaguccagcuaguccucgccgguaacgcauucaccgcaggaaaagucgccguugcccucguucccccuuacuuuccaaaaggcucacuaaccaccgcucaaaucacaugcuucccucacgucaugugcgacguccguacccuagagccaauccaacuaccccuccuagacguccgccgcguccucuggcacgccacacaagaccaagaagaaucaaugcgacucguuugcaugcuauacacaccccuccgcaccaacuccccaggcgacgaaucauucgucgucucuggccgccuacuauccaaacccgccgcagauuucaacuucgucuaccuuacacccccaaucgagcgcaccauauaccguauggucgaccuccccguuuuacaaccccgauuaugcacacacgcccgauggccggcacccaucuacggccuucucgucgaccccucccuacccgcaaacccacaauggcaaaacggccgaguccacguugacgguacccuccucggcacaacacccgucucaggaucacgagucuccugcuucgccgcagaagcagcauacgaguuccaauccggcaccggagaaguagccaccuucacccuaauugaacaagauggaucagcuuacgucccaggcgaccgcgccgcaccccucggcuaccccgacuuuuccggccagcuagaaauagaaguccaaaccgaaaccaccaaaacaggcgacaaacucaccguaaccaccuucgaaaugauacucggccccacaaccaacgucgaccaagcccccuuccaaggacgagcauaugccucucuuacagccgccgccagccuagaucucgucgacggacgcgucagggcagucccccgauccauauacucuuuccaagacguuauccccgaauacaacgacggccuccuagucccccuagcaccucccauaggccccuuccuaccaggcgaaguccuccuccgauuucgcacauacaugcgccaaaucgacucuuccgacgccgccgcugaagccaucgacugcgcccuuccacaagaauuuaucuccugguucgccucuaacgccuucaccguccaaucagaagcgcuccuacuacgauacagaaacacccucaccggccagcuccuauucgaauguaaacucuauucagaaggauacaucgcccucuccuacuccggcucaggaccccucacuuuccccaccgaugguuucuucgaagucgucuccugggucccccgccuuuaccaacuagccuccguaggcucucuagcaaccggccgcacucucaaacaauaa

SEQ ID NO: 36848 - RNA, 1626 nt, Artificial Sequence
  derived and/or modified sequence opt11 from capsid_protein__Norovirus__ABI95835
augcgcaugucagacggcgcagcaccuaaagccaacggcuccgaagcuagcggacaagaccuaguccccacagccgucgaacaagcuguacccauccaacccgucgcaggcgcgucccucgccgcucccgcagccggacaaaucaaccaaaucgaccccuggaucuuccaaaacuucguccaaugcccccucggagaguucucaaucucaccucgcaacacaccaggagaaauccucuucgaccucgcccuaggccccggccucaaccccuaccucgcccaccucuccgcgauguacaccggaugggucggcaacauggaaguccaacucgucuuagccgguaacgcauucacggcaggaaaagucguagucgcucucgucccacccuacuuccccaaaggaucccuaaccacagcccaaaucacaugcuucccccacguaaugugcgacguccgcacccuugaacccauccaacucccccuccuagacguacgccgaguccucuggcacgcaacccaggaccaagaagaaucaaugagacucguaugcaugcuauacacaccacuacgaacgaacagccccggagaugaaucauucguagucuccgggcgacuccuuagcaaacccgccgcagacuucaacuucguauaucucacaccgccaauugaacgcacaaucuaccgaaugguagacuuacccguacuccaaccaagacuuugcacccacgcacgauggcccgcccccaucuacggccuccuagucgaccccucacuuccagcaaauccacaauggcaaaacggucgcguccaugucgacggcacacuccucggaaccacccccgucagcggcucauggguauccuguuucgccgccgaagcagcauacgaauuucaauccggcaccggagaaguagccacauucacccucaucgagcaagacggcuccgccuacguccccggcgaccgagccgccccacuaggauaccccgacuucuccggccaacuagaaaucgaaguccaaaccgaaacgaccaaaaccggugacaaacucaccgugacuacauucgagaugauacucggacccacaacaaacgucgaccaagccccuuuccaagggcgcgccuacgcaucucuaacggcagccgccucacuagauuuagucgacggccgcguccgcgccgucccacguuccaucuacucuuuccaagaugucauccccgaauauaacgacggacuacucgugccccucgccccacccauuggccccuuccuacccggugaaguacuccugcgauuccgaacauacaugcgacaaaucgacuccucggacgcagcagccgaagccauugacugcgcccucccacaagaguucauauccugguucgccagcaacgccuuuaccguccaaucagaagcacuccugcuucgcuaccgcaacacacucaccggccaacuccucuucgaaugcaaacucuacucagagggcuacaucgcccucucauacuccggcuccggcccacucaucuucccaacugacggcuucuucgaagucgucuccuggguaccacgccucuaccaacucgcauccgucggcucucuagccacaggacgcacucucaaacaauaa

SEQ ID NO: 36849 - RNA, 1620 nt, Artificial Sequence
  derived and/or modified sequence opt11 from capsid_protein__Norovirus__ABI97981
augaaaauggccuccaacgacgcaaacccaucagacggcucaaccgccaacuuagucccagagguaaauaacgaagucauggcccuagagcccguagucggugcagcuaucgccgccccaguagcaggucaacaaaauguuauagaccccuggauccgaaacaacuucguccaagcccccggaggcgaguucaccgucucaccccgcaacgcacccggcgaaauccuaugguccgcaccccuaggcccugaccucaaccccuaccugucucaccucgcccgcaccuacaacggauacgcuggcggauucgaaguccaaguaauccucgccggaaaugccuuuaccgccgguaaaaucaucuucgccgccgucccacccaacuuccccacugaaggccucucacccucccaagucaccauguucccccacaucaucgucgauguccgccaauuagaaccaguccucaucccccuccccgauguacgcaauaacuucuaccacuacaaucaaagcaacgacuccaccaucaaacuaaucgcaaugcuauacacaccacuacgagccaacaacgccggcgacgacgucuuuacaguguccugucgaguccuuacacgccccucccccgauuucgacuucaucuuucucgucccacccaccguggaauccagaaccaaacccuucacgguccccauccuuaccgucgaagaaaugucuaacucacgcuuccccaucccccuagaaaaacuauacaccggccccuccuccgccuucgucguccaaccucaaaacggccgcugcaccaccgacggaguacuucucggcacaacacaacuauccgcagucaacaucugcaccuuccgcggagacguaacccacauagccgguucccacgacuacaccaugaaccuagccagccaaaacuggaauaacuacgaccccacugaagaaaucccagcaccccuaggcacccccgacuucgucggcaaaauccaagguaugcuuacccaaaccacccgcgaagacggcucaacacgcgcccacaaagccaccguaucuaccggaucgguccacuucacacccaaacuuggauccguccaauacacaaccgacacuaacaacgacuuccagacaggacaaaacaccaaauucacacccguaggcgucauccaagauggaaacaaccaccaaaacgaaccccaacaauggguucuccccaacuacuccggccgcacggggcacaacguacacuuagcaccagccgucgccccaaccuucccuggggaacaacuacucuucuuccgaucaacuaugcccggauguuccggauacccaaacaugaaccuagauugccuccuaccccaggaauggguccaacacuucuaccaagaagccgcacccgcccaaucagacgucgcucuccuacgcuucgucaaccccgacaccggccgcguacucuucgaaugcaaacuacacaaaucuggauacguaacagucgcccacaccggcccccacgaccucgucaucccacccaacggauacuuccgcuucgacagcuggguaaaccaauuuuacacccucgccccaaugggcaacggagccggccgccggcgcgcacucuaa

SEQ ID NO: 36850 - RNA, 1626 nt, Artificial Sequence
  derived and/or modified sequence opt11 from capsid_protein__Norovirus__ABP99038
augagaaugucugacggcgcagccccaaaagccaacggcucagaagccuccggccaagaccucguaccaaccgccguagaacaagccguaccaauccaacccgucgccggcgcaucucuggccgccccggccgccggucagaucaaccagaucgaccccuggauauuccaaaacuucguccaaugcccacuaggcgaguucagcaucagcccacgcaacacccccggcgaaauacucuucgaccucgcccuuggaccaggccucaaccccuaccucgcgcaccuauccgccauguacaccggcugggucggaaacauggaaguacagcucguacuagcuggcaacgcauucacagccggcaaaguagucgucgcccucgugccacccuacuuucccaagggcucccucaccacagcacaaauaaccugcuucccccacgucaugugcgacguuagaacccucgaacccauucaacugccccuccucgacguacgcagaguacuauggcacgccacccaagaccaagaagaauccaugcgucucguaugcaugcucuacacaccccuacgcaccaacucucccggcgacgaaucuuucgucgucuccggccgacuccucuccaagccagccgcagacuuuaacuucgucuaccuaacucccccgaucgaaagaaccauauaucgcaugguagaccuacccgcccuucaacccagacucugcacccacgcucgauggcccgcccccguauacggccucuuagucgacccaucccuacccucaucaccccaauggcaaaacggccgaguccacgucgacggaacacuacuaggcaccaccccagucuccgguuccuggguaaguugcuucgccgccgaagcugccuacgaguuccaaucaggaacaggcgaaguugcgaccucuacacuaauagaacaagacggcuccgccuacguacccggcgaacgagccgccccucuaggcuaccccgacuucuccggccaacucgaaaucgaaguccaaaccgaaacuacaaaagcgggcgacaagcuccgcgucaccacauucgaaaugauccucggacccacaaccaacgucgaccaagcccccuaccaaggccgagucuacgccucacucacagccgccgcuucccucgaccucguagacggucgcguucgcgcagucccccgcucaauauacgguuuucaagaugugauccccgaauacaacgacggccuccucgucccccucgccccacccaucggccccuuccuacccggcgaaguccugcuccgcuuucgcaccuacaugcgccaaaucgacagcuccgacgccgccgccgaagccaucgacugcgcucuaccacaagaguucaucuccugguucgcaucaaacgccuucacaguccaaucagaagcccuccuacuccgcuacagaaacacccuaaccggacaacuccucuucgaaugcaaacucuacucugaaggcuacaucgcacucuccuacuccggcuccggaccccucgcauucccaacagacggauucuucgaagucgucuccugggucccccgccucuaccaacuagcuucugucggaucacucgccacaggacguacacucaaacaauaa

SEQ ID NO: 36851 - RNA, 1626 nt, Artificial Sequence
  derived and/or modified sequence opt11 from capsid_protein__Norovirus__ABP99041
augcgcaugucagauggcgcagcuccuaaagccaacggauccgaagccuccggacaagaccucgucccaaccgcaguggaacaggccguaccaauccaaccagucgccggugcagccuuagccgccccagccgcaggccaaaucaaucaaaucgacccauggaucuuccagaacuucguccagugcccacucggagaauuuuccaucucaccacguaacacuccgggugaaauacuguucgaucucgcccuuggccccggccucaaucccuaccuugcacaccucucugcaauguacaccggcugggucggcaacauggaaguccagcuaguccucgccggaaacgccuucaccgccggcaaaguaguagucgcccuaguaccacccuacuuccccaaaggcucccucacaaccgcacaaauuaccugcuucccccacgucaugugcgacguacgcacacucgaaccaauccaacuaccacuacucgacguacgccgaguccucuggcacgcaacacaagaccaagaagaaucuaugcgacucgucugcaugcucuacacacccuuaagaacuaacucacccggcgacgaaucauucgucgucucaggccgccugcucuccaaaccugcagcggacuucaacuucgucuaucuaacaccucccaucgaacgaacaaucuaccgaauggucgaccuacccguucuacagccccgccucugcacacacgcccgcuggccagccccaguauacggccuccuagucgaccccucccucccaucuaacccccaauggcaaaacggccgaguccacgucgacggcacccuacucggcacaacucccgucuccggauccugggucucauguuucgccgcagaagccgccuacgaauuucaaucuggcaccggcgaagucgcaaccuucacuaugaucgaacaagacggcucagccuacguccccggcgaccgagccgccccacucggauaccccgacuucuccggccaacucgaaauagaaguccaaacagaaacaaccaaagccggagacaaacuuaaggucacaaccuucgacaugauauuaggccccacaaccaaugucgaccaagcccccuaucaaggccgagccuaugcgucccucaccgcugccgccuccuuagaccuggucgacggacgcguccgcgcuguaccccgcucuauauacucauuccaagacgaacucccagaauacaacgacggccuccucgucccacucgcgcccccucucggccccuuccuccccggcgaaguccuccuccgcuucagaaccuacaugcgacaacucgacaccgccgacgccuccgcccaaccaauagacugcgcccuuccccaagaguucauauccugguucgccucaaacaacuucacaguccaauccgacgcacuccuaguucgauaccgcaacacccugaccggccaacuccucuuugaagccaaacuguacucagaaggauacaucgccguauccuacuccggcuccggcccccucaccuuccccaccgacggauucuucgaagucgucagcugggucccacgccucuuccaauuagccagcgucggaucacucgccacaggcaggacacucaaacaguaa

SEQ ID NO: 36852 - RNA, 1623 nt, Artificial Sequence
  derived and/or modified sequence opt11 from capsid_protein__Norovirus__ABQ12784
augaaaauggcauccaaugacgccacccccuccgacggauccgcugccaaccucguccccgaagucaacaacgaaguaauggcccucgaaccaguggugggcgccgccaucgcagccccagucgccggacagcaaaacguuaucgacccuuggauccgcaauaacuucguccaagcccccggcggcgaauuuaccguaucaccacgcaacgccccaggagaaauccucugguccgcaccucucggacccgaccucaacccauaccuaucccaccuagcccgcauguauaacggauacgccggcggcuucgaaguacaaguaauccucgccggcaacgccuucaccgcaggcaaaauaaucuucgccgccguucccccaaacuuccccaccgaaggacuauccccaucccaaguuaccauguucccccacaucaucgucgacguccgccaacucgaaccuguacucaucccccuacccgacguacgaaacaacuucuaccacuacaaccaaucaaacgaccccacaaucaaacucauagccaugcuauacacaccccuccgcgccaacaaugcaggagacgacgucuucaccgucucaugccgaguacucacccgccccuccccagacuucgacuucaucuuccuugucccacccaccguggaaucccgaaccaaacccuucuccguucccauccuuaccguagaagaaaugaccaacucacgcuucccaaucccccucgaaaaacuauucaccggcccuagcucauccuucguaguacagccacaaaauggccgcugcacaacagacggcguacuucucggcaccacccaacuaucacccgucaacaucugcacauuccgaggcgacgucacacacauagcaggcacacaaaacuacaccaugaaccuagccucacaaaacuggaacaacuaugaccccaccgaagaaaucccagcaccucucgguaccccagacuucguaggaaaaauccaaggcguccuaacccaaaccacccgucgcgacggcucuacgcgaggccacaaagccacaguaucaacaggaucaguccauuucacccccaaacuuggauccguucaauucuccacagauaccuccaacgacuucgaaaccggccaaaacacccgcuucaccccagucggaguaguccaagacggcucuaccacaccucaaaacgaaccccaacaauggguacucccggacuacuccgguagagacucucacaacguccaccucgcccccgccgucgcgcccaccuucccaggagaacaacuccucuucuuccgcucuacaaugccaggcugcuccggcuaccccaacaugaaccuggacugccucuuaccgcaagaauggguacaacacuucuaccaggaaucagcccccgcccaaucagacguagcccuacuccgcuucgucaaccccgacaccggacgcguccuuuucgaaugcaaauuacacaaauccggauaugucaccgucgcacacaccggccaacacgaccuaguaaucccucccaacggcuacuuccgauucgauuccuggguaaaccaauucuacacacuagcccccaugggcaacggcgcuggccgcagacgcgcacucuga

SEQ ID NO: 36853 - RNA, 1737 nt, Artificial Sequence
  derived and/or modified sequence opt11 from capsid_protein__Norovirus__ABR15783
augaaaauggccuccuccgacgccacacccucaucagacggcgcagguaaccucguacccgaaucccaacaagaaguccuuccccuagccccagucgcaggcgccgcacucgccgcgccaguagucggacaacaaaacaucaucgacccuuggaucaaagaaaacuuuguucaagcaccccaaggcgaguucaccgucucccccaaaaacucccccggagaaguccucgugaaccuagaacucagcccacgccucaacccguaccuccaccaccuauccaaaauguacaacgcauacgccggaggaauggaagucgaaaucauccucgcaggcaacgccuucaccgccgguaaaguccucaucgcagcagucccacccaacuuucccauugaaaacgucucagccucccaagccucccaauucccccaugucauagucgacguuagaacccuugaaccaauccgccuaccacuaccagacguucgcacaaacuucuuccacuacacaacccaagaagaaccccgcaugcgcauaguagcauggcucuacacaccacuccgcaccaacggcuccggcgacgauuccuucaccgucuccggccgcauccucacucgccccagcccagacuucgaguucuccuuccucgucccgcccaccgucgaaaccaagacuguaaguuucucgguacccggacucguaguccaagacauguccaacagccgcuggcccgcacaaauaucaggauuaguaguccggggcaaugaagcccaaguaguacacuuccagaacggccguugcacaaccgaaggaaugcuucucggcaccaccacccucaacaucaacucuaucugcggucuccgcgguuugucaguuagccaggcuaguguccgcggcgcgcccgcccuaaccgaagaaaugccaccccucgaagaugaagucgccgacggagcagcagccaccuacacccucacccgcgccgccgacacagcccucuggcuaagaguagaagaacccgacggccgccccuacgacauauuuggcgaccagcccgcaccacucggcacccccgacuucacagcuguuauagucggaaccgccauacguccccgcacaacauccggcgcauaucuccacgaugcauacgucgacacaacuccaggcgacgcagacuucacccccuccaccggcaauacaaaaaucguccuacguggcggcggcucaggucacgucggacaaggccacuacuggcaauucaaacccaucgcuguagaaggaggaggcucccgcccccaauaccaagaauacaaccuccccgacuacgccggaccaaccgccuccaaccacgaccuagcaccaccgguagcaccccgcaugcccggugaacuacuccucuuauucgaaucagacaugcccgucugggacaacggagccggugccgcgccagcucaaaagauacacugccuccucccuaacgaguucaucacacaccucuucgaucugcaagcccccgcacucgcagaagccgcccuccuacgcuacgugcaccccgacucaggacgaacuuuauucgaaugcaaacucuaccgcgaaggauacauggucguagccgcaccagucggcagacuuaacuuccccuuagacggauacuuccgcuucgacuccugggucuccgccuuuuacguccucagcccagucgguucaggccaaggccgccgcggccgcuccaaagcugccuaa

SEQ ID NO: 36854 - RNA, 807 nt, Artificial Sequence
  derived and/or modified sequence opt11 from capsid_protein__Norovirus__ABR24136
auggcaggagccuucuucgccgggcucgcgagcgacgucuugggauccggccuaggcucgcucauaaacgccggcgcgggcgcgauaaaccaaaaggucgaguucgaaaacaaccgcaaacuccagcaagccagcuucgaguucaguucgaaccugcaacaagcaucguuccagcacgauaaagaaaugcuacaagcacaaauagaagcgaccaagaaacuacaacagggcaugaugaaggucaagcaagcaaugcuacucgagggcggguucucggaaacagacgcggccaggggcgcgaucaacgccccgaugacgaaagcacuagacuggucaggcacgagauacugggcgcccgacgcaaggaccacaaccuauaacgcgggccgguucucgacaccgcaaccaagcggggcccugcccgggcgcacgaacccacgcgcgaccguaccagcacgcgggagcccaagcacgcccuccaacacgagcacggucacgagcguguacucggaccaaaccguaagcacgcgccugggaucgaccgcaggcucgggcacacgcguaagcucacucccgagcacagccaggacaaggagcuggguagaagaccaaaacaggaaccuaagcccguucaugagaggggcccacaacaucagcuucguaacgcccccggccucacgcucgagcucgcaagggaccgugagcacgguaccgaaagaggucuuagacuccuggacaggcgcguucaacacaaggcgccagccacucuucgcgcacauacgcaagcgcggggaaucgcgcgcguga

SEQ ID NO: 36855 - RNA, 1647 nt, Artificial Sequence
  derived and/or modified sequence opt11 from capsid_protein__Norovirus__ABS12173
augaaaauggccucaaaugacgcaacccccucaaacgacggugcagccggucuugucccagaaaucaacaaugaagcuauggcacucgaccccguagcaggcgcugcaaucgcagcaccccucaccggccaacaaaacauaauagaccccuggaucaugaacaacuucgugcaagccccaggcggcgaguucaccgucuccccacgcaacucccccggcgaaguacuacucaaccucgaacucggacccgagaucaaccccuaccucgcccaccucgcccgcauguacaacggcuacgccggcggcuuugaaguacaagucguacucgccggaaacgccuucaccgccggcaaaaucaucuucgccgcaauacccccgaacuucccaaucgacaaccuaagcgccgcacaaaucacaaugugcccccacgucaucgucgacguacgacagcuagagcccguuaaccuacccaugcccgacguacgcaacaacuuuuuccacuacaaccagggauccgacagucgccuccgucuaaucgcaauguuauauacaccccuccgcgcaaacaacuccggagacgacguuuucaccguuuccugccgaguccucaccagaccaucaccagacuucagcuucaacuuccucgucccacccaccgucgaguccaaaaccaaaccauucacacuccccauucucaccaucucagaaaugucaaacucccgcuuccccguccccaucgacucccuccacaccucaccuaccgaaaacaucgucguccaaugccaaaacggccgagucacucuagacggcgaacucaugggcaccacccaacuccuccccucccaaaucugcgcuuuccgaggcguccucacacguucaaccagcagacccucggaccaagccgauaccgccacaccccgccucuuuaacuacuacuggcacauccaacucgacaaccucaacggcaccccguacgaccccgccgaagacauaccuggaccccuaggcacccccgacuuccgaggcaaaguauucggagucgcaagccaacguaaucccgacuccaccacccgcgcccacgaagccaaagucgacacaaccgccggcagauucacccccaaacucggcucccuugaaaucuccaccgaaucaggcgacuucgaccaaaaccaaccaacccgcuucaccccgguaggcaucggcguagaccacgaagcagacuuucaacaauggucucuucccgacuauucaggccaauucacccacaacaugaacuuagcccccgccgucgccccaaacuucccaggcgaacaacuacucuucuuccguucccaacucccaucauccggaggucgaucaaacggcauucuagacugccucgucccccaagaauggguccaacauuucuaccaagaaagcgcccccgcccagacgcaagucgcccuaguccgcuacgucaacccagauacaggccgaguccucuucgaagccaaacuccacaaacuaggauucaugaccaucgccaaaaauggagacucacccaucacaguaccacccaacggcuacuuccgauuugaauccuggguuaaccccuucuacacucuagcccccaugggcacugggaacggaagacgccgcauacaauaa

SEQ ID NO: 36856 - RNA, 1611 nt, Artificial Sequence
  derived and/or modified sequence opt11 from capsid_protein__Norovirus__ABS12175
augaaaauggccuccaacgacgcuaccccauccgacgacggugcagcaggccucguccccgaaauaaacuccgaagucauggcgcucgaacccgucgccggcgccucacuagcagcccccguagucggacaacaaaacauaaucgaccccuggauacgcaacaacuucguccaagccccagccggagaauuuacuguaucgccccgcaacagcccaggagaacuauuacucgaccucgaacuaggccccgagcucaacccuuaccuugcucaccucgcccgcauguacaacggccacgcuggaggcauggaaguacaaauaguccucgccgguaacgcauucaccgccggaaaaauacuauucgcugcgaucccacccucauuccccuacgaaaaccucucacccgcacaacucaccaugugcccccaugucaucgucgacguccgccaacucgaacccguauuacuucccaugcccgacauccgcaacgucuucuaccauuacaaccaaaacaacagccccaaacuccgccucguagccaugcuauacacaccccuacgagcaaauaacucaggcgacgacgucuucaccgucuccugccgcguccucacccgccccucucccgacuuccaauuuacauuccucgucccacccacagucgaauccaaaacuaaaaauuucacccuccccguccuccgcgucucagaaaugacaaauucccgcuuccccguaguacuugaccaaauguacaccuccagaaacgagaacauaauaguccagccccaaaacggucgaugcacaacggacggcgaacuccucggcaccaccauacuccaaucagucucaaucugcaacuuuaaaggcacaaugcaagcgaagcuaaacgaggaaccccgcuaccaacuccaacuaaccaaucucgacggaucccccauagacccuacugacgacaugcccgcaccccucggcacacccgacuuccaagccaugcuauacggcgucgccagccaacgcuccucccgcgacaaugccaccagagcccacgacgcccaaaucgacaccgccggagauaccuucgcccccaaaaucggccaaguccgauucaaauccuccucgaacgacuucgaccuccacgaccccacuaaauucaccccaaucggaguaaacguagacgaucaacacccauuccgccaaugguuccuacccaacuauggcggccaccuggcccuaaacaaccaccucgcaccagcugucacuccacuauuucccggcgaacaaauacucuuuuuccgcuccuacauccccuccgcaggcggacacacagacggcgccauggacugccuacuaccacaagaauggguagaacacuucuaccaagaagccgcucccucacaauccgacaucgcccuaguccgcuucaucaacccagacaccggccgcgucuuauucgaagccaaacuacacaaacaaggcuuccucacaaucgccgccuccggcgaucaccccaucgucaugccaaccaacggcuauuucagauucgaagcaugggucaaucccuucuacacccucgcacccguuggcacaggaucuggucgacgacgcauccaguaa

SEQ ID NO: 36857 - RNA, 1626 nt, Artificial Sequence
  derived and/or modified sequence opt11 from capsid_protein__Norovirus__ABS29273
augcgaaugucagacggcgccgcccccaaagcaaacggcucagaagccuccggccaagaccuaguucccacagccgucgaacaagccgucccaauacaacccgucgcuggcgcagcccucgcagccccugcagccggccagaucaaccaaauugaccccuggaucuuccaaaacuucguccaaugcccccuaggcgaauuuucuaucucaccccguaacacgcccggcgaaauccucuucgaccucgcacucggcccuggccuaaaccccuaccucgcucaccucucagccauguacacgggcuggguaggaaacauggaaguacaauuaguacuagccggcaacgcauucaccgccgggaaagucgucgucgcacucguaccacccuauuuccccaaaggaucccucaccacagcccaaauaacgugcuucccccacgucaugugcgauguccgaacccucgaacccauacagcucccccuccuugacguccggagaguccuauggcacgccacacaagaccaagaagaaucaaugaggcucgucugcaugcuauacacuccccuacgaaccaacagccccggagacgaaucauucgucguaucaggccgccuccucucaaagcccgcagcagacuucaauuucguauaccucaccccacccaucgaacgcaccaucuaccgcauggucgaccuacccguaauacagccccggcuauguacacaugcccgcuggcccgcacccaucuacggccuucucguugaccccucccuccccuccaacccacaguggcaaaacggacgcguccacgucgacggcacacuccuaggcaccaccccaauaucuggcuccugggucuccugcuuugcagccgaagccgcauaugaguuccaaagcgguaucggagaaguagcaacuuucacccucaucgaacaagacggcucagccuacguccccggcgaccgcgcagcaccccuugguuaccccgauuuuuccggccaacucgaaaucgaagugcaaaccgaaacaacuaaaaccggcgacaagcuaaaggucacaacauucgaaaugauccucggaccaaccaccaacgcagaccaagcccccuaccaaggccgcguauucgccuccgucaccgcagccgcgucccuagaccucgucgacggccgcguucgcgcaguaccccgcucaguauacuccuucugcgacacuaucccagaauauaaugacggccuccucgucccccucgcuccuccaaucggcccauuccuacccggcgaaguacuccuucgcuuccgcacauacaugcggcaacucgauaccgcugacgcagcggccgaagcaauagacugcgcccucccccaagaauuugucuccugguucgcuuccaacgccuucaccgugcaaucagaagcccuccuacuacgcuaccgaaacacccucaccggacaacuacucuucgaaugcaaacuauacucagaagguuacauugcccucagcuacucuggcuccggcccccuaacauucccuaccgacggcuucuucgaaguagucuccuggguuccccgacucuaccaacucgccuccgucggcucccucgccaccggccgaacacucaaacaguaa

SEQ ID NO: 36858 - RNA, 1626 nt, Artificial Sequence
  derived and/or modified sequence opt11 from capsid_protein__Norovirus__ABS29275
augcgaaugucugauggcgccgcaccuaaagccaacggcuccgaagcauccgggcaagaccugguaccaaccgccgucgaacaagcuguccccauccaacccguagccggggcagcccuagccgcaccggcagccggacaaaucaaccaaaucgaccccuggaucuuucagaacuucguccaaugcccacucggcgaauuuuccaucucccccagaaacacaccaggugaaauccucuucgaucucgcccuaggccccggccuaaaccccuaccuagcccacuuauccgccauguauacgggauggguaggaaacauggaaguccagcuaguccuagccggcaacgccuucacagccggcaaggucgucgucgcccuagucccucccuacuuccccaaaggcucccuaaccacugcacaaauaaccugcuucccccacgucaugugcgacgucagaacauuggaacccauccaacucccccuacuagauguccgacgcguacuauggcacgccacccaagaccaagaagaauccaugcgccuagucugcauguuauauacaccacuacgcacuaacuccccaggagacgaauccuucguggucucaggccgccuccuaucuaaacccgccgcagacuucaacuucgucuaccuaacaccaccaaucgaacgaacaaucuaccgaaugguugacuuacccguaauccaaccucgacuaugcacccacgccagauggcccgcccccgucuacggacuucucguagaucccucccugcccuccaacccacaauggcaaaauggccgcguccacgucgacggcacccuccucggcaccacccccaucuccggcucauggguauccugcuucgccgccgaagccgcauacgaauuucaguccgguaucggcgaaguagccaccuucacccucauagaacaagacggcucugccuacauacccggcgaccgcgcugccccucucggcuaucccgacuucucuggccaacucgaaauugaaguccaaaccgaaacaaccaaaaccggcgacaaacucaagguaaccacauucgaaaugguccucggcccaacuaccaacgucgaccaagcacccuaccaaggacgcguuuacgcauccguaaccgcagccgccucccucgaccuagucgacggcagaguacgcgccgucccccgcagcauauacucauuccaagauaccauacccgaauacaaugacggccuccuuguaccucuugccccucccaucggacccuuccuacccggagaaguccuacuucgcuuccgcaccuacaugagacaauuagacaccgcagacgccgcagccgaagcuaucgacugugcccuaccacaagaauuugucuccugguucgcaagcaacgcauucaccguacaguccgaagcacuucuccuacgcuacagaaacacccuaaccggacaacuacucuucgaaugcaaacuauacuccgaaggcuacaucgcucucuccuacuccggcucaggcccacuuacauuuccgacggacggcuucuucgaagucguaucuugggucccccgccucuaccaacuagccucagucggcucacucgcuacaggacgcacacuaaaacaauaa

SEQ ID NO: 36859 - RNA, 1626 nt, Artificial Sequence
  derived and/or modified sequence opt11 from capsid_protein__Norovirus__ABU55541
augcgaauguccgacggcgcugccccaaaagccaacggcucagaagccucaggucaagaccucguacccgcagccguugaacaagccguaccaauccaacccguagccggagcagcacucgccgcaccggcagccggccaaaucaaccaaaucgaccccuggaucuuccaaaacuucguucagugcccccucggcgaguucucaauauccccacgcaauacacccggcgaaauccucuucgaccucgcccucggcccuggacucaacccauaccuagcccaccucucggccauguacacugguuggguaggcaacauggaaguccaacucguacuagcaggaaacgccuucaccgccgguaaagucgucgucgcccucguacccccauacuuccccaaaggcucacucaccaccgcacagaucaccuguuucccccacgucaugugugauguccgcacacucgaacccauacaacucccacuccuagacguucgccggguccuauggcacgccacccaagaccaggaagaaucaaugcgacucgucugcaugcuauacacaccacugagaaccaacuccccaggcgacgagagcuuugucgucucaggccgccuccucuccaaacccgcugccgacuucaacuucguauaccucacucccccaaucgaacgcaccauauaccgcaugguagaccuacccgucauacaacccagacucugcacccacgcccgcuggcccgcacccgucuacggacuacucguugaccccucucuaccauccaacccccaauggcaaaacggcagaguacacguugauggcacacuccucggcaccaccccaauaucaggcucuuggguaagcugcuucgcagccgaagcagccuauaaauuccaaucuggcaccggagaaguagccaccuucacccucaucgaacaagacggauccgcuuacgucccaggugaccgagcagcaccccuaggauaccccgacuucuccggccaacuugaaaucgaaguccaaacagaaaccacaaaaaccggcgacaaacucaaaguaacuaccuucgaaaugauccucggaccaaccaccaacgccgaccaagcccccuaccaaggucgcgucuucgccucgguaacagccgcagccucucucgaccuaguugacggccgcguccgagccgucccacgauccauauacggauuccaggacaccauacccgaauacaacgacggacuccuaguaccccuagcacccccaaucggcccauuccuuccaggagaaguccuacucagauuccgaacauacaugcgucaaauagacaccgcugacgcugcagccgaagccaucgacugugcgcucccacaggaauuugucucaugguucgccucaaacgccuucacaguacagucagaagcccuacuacuccgcuaccgcaacacuuuaacaggacaacuacucuucgaaugcaaacucuauaacgaaggcuauaucgcccuauccuauuccggcuccggcccacuaaccuucccaaccgacggcauauucgaaguaguaucaugggucccgagacucuaccaacucgccuccgugggcucccuugccaccggccgcaugcucaaacaauaa

SEQ ID NO: 36860 - RNA, 1626 nt, Artificial Sequence
  derived and/or modified sequence opt11 from capsid_protein__Norovirus__ABU55544
augcgcaugagcgacggcgcagcccccaaagccaacggcucagaagcauccggacaagaccuagucccagcagcugucgaacaagccguccccauccaaccaguagccggagccgcccuagcagcgcccgcagccggacaaaucaaccaaaucgaccccuggaucuuccaaaacuucguccaaugcccccucggcgaguucucaauaucuccccgcaacacaccaggagaaauccucuuugaccuagcacuaggccccggacucaaccccuaccucgcucaccuauccgccauguacaccgguugggucggcaacauggaaguacagcuaguacucgcaggaaacgccuucacagccggcaaaguagucgucgcccucgucccgcccuacuuccccaaaggaucccucaccaccgcccaaauaacaugcuucccucacgucaugugcgacguccgaacccucgaaccaauccaacuuccccuucuagacguacgccguguccuauggcaugccacccaagaccaagaagaauccaugcgccucguauguaugcucuacacaccccuccgcaccaacucccccggcgacgaauccuucgucguuucaggucgucuccucucaaaacccgcugcagacuucaacuucgucuaccucaccccacccauagaacgaaccaucuaccgcauggucgaucuacccgucauccaacccagacucugcacgcacgcccgcuggcccgccccaguuuacggacuucuagucgaccccucccucccgucaaacccacaauggcaaaacggcaggguacacgucgacggcacucuccucggcaccaccccaaucagcggcucgugggucuccugcuuugccgcagaagcagcuuacaaauuccaauccggaaccggagaagucgccacauucacacuuauagaacaagacggcagcgcauacguacccggagaccgcgccgcaccccuuggauacccagacuucucaggccaacucgaaaucgaaguacaaaccgaaacaacuaaaaccggcgacaaacuaaaaguaaccaccuucgaaaugauccucggacccacaaccaacgcagaccaagccccauaccaaggccgcgucuuugcaagcgugacagccgcugcaucccuagaccuagucgacggccgaguacgcgcagucccccgcagcaucuacggcuuucaagacaccauccccgaauacaacgacggccuacucgucccucuagccccacccaucggucccuuccuccccggagagguacuacuccgauuucgaacguacaugcgccaaaucgacaccgcagacgccgcagccgaagcaaucgacugcgcacucccacaagaguucgucuccugguucgccuccaacgccuucacuguccaauccgaagcucuccuccuccgauaccgcaacacacucacgggacaacuacucuucgaaugcaaacucuacaacgaaggcuacaucgcacucuccuacuccggcucuggaccccucacauuccccaccgauggcauauucgaaguagucuccugggucccccgccuauaccaacucgccuccgucggaucccuagccaccggccguaugcucaaacaauaa

SEQ ID NO: 36861 - RNA, 1626 nt, Artificial Sequence
  derived and/or modified sequence opt11 from capsid_protein__Norovirus__ABU55547
augcgcauguccgacggagcagccccaaaagccaacggcucagaagcaagcggacaagaccucgucccagccgcuguagaacaagcaguucccauccaaccagucgcaggcgccgcccucgccgccccagcugcuggccaaauuaaccaaaucgaucccuggaucuuccagaacuucguccaaugcccccucggcgaguucucaaucaguccucgaaacaccccaggugaaauucucuucgacuuagccuuaggccccggccucaaccccuaccuugcacacuuaucagccauguacaccggcugggucggcaacauggaaguccagcuaguccuagccgguaacgccuucaccgccggcaaagucgucgucgcacucguaccacccuacuuccccaaaggcagccucacuaccgcccaaauaaccugcuucccccacguaaugugugauguccgaacccuagaaccaauccaauuaccacugcucgacguucgccgaguccuuuggcacgccacacaagaccaagaagaaucgaugcgccucgucuguauguuauacaccccacuccgaaccaacuccccaggcgacgaaucauucguugucuccggucgcuuacucuccaaacccgccgccgacuucaacuucgucuaccucaccccacccaucgaacgcacaaucuaccgcaugguagaccugcccguaauccaaccccgccucugcacccacgccagauggcccgcccccgucuacggcuuauuagucgaccccucacuccccuccaauccccaguggcaaaacggccggguccacgucgacggcacacuucuaggcaccacccccauaucugguucuuggguuuccugcuucgccgccgaagccgccuauaaguuccaauccggcaccggcgaagucgccacauucacacucaucgaacaagacggcuccgccuacgucccaggagaucgagcugcuccccuuggauaccccgacuucucgggccaacuugaaauagaaguccaaaccgaaaccaccaaaaccggagacaaacuuaaaguuacuacauucgaaaugauccucggccccacaaccaacgccgaccaagcccccuaccaaggacgagucuucgccuccgucacagccgccgccucccuagaccucgucgacucacgcguacgcgccgucccacgauccauuuacggcuuccaagacaccauccccgaauacaacgacggccuccucgucccccucgccccucccauaggcccguuccuaccaggagagguucuacuccgcuuccguacauacaugcgccaaaucgacaccgcugacgcagccgccgaagcaaucgacugcgcccuuccacaagaguucguauccugguucgcauccaaugccuuuaccguacaauccgaagcccuccuacuccgcuaccgcaacacccuuacaggccaacuacucuucgaaugcaaacucuacaacgaaggauauaucgcccuaucauacagcggcuccggaccacuaacauuccccaccgacggaaucuucgaagucguauccuggguuccccgccuuuaccaacuagcaucagucggcucccuugccacuggucgcaugcuaaaacaauaa

SEQ ID NO: 36862 - RNA, 1626 nt, Artificial Sequence
  derived and/or modified sequence opt11 from capsid_protein__Norovirus__ABU55550
augcgaaugucagacggagccgcacccaaagccaauggaucagaagcauccggccaagaccucguacccgcggcaguagaacaagcagucccaauacaacccgucgcaggagccgcucucgccgcccccgccgccggccaaauaaaccaaaucgaccccuggaucuuccaaaauuucguucaaugcccccucggcgaguucagcaucucuccaagaaacacacccggagaaauccuauucgaccuagcccucggccccggacucaaccccuaccucgcccaccuaucagccauguacaccgguugggucggaaacauggaaguacagcuaguccucgccggaaacgccuuuaccgcgggaaaaguaguagucgcacucgugccacccuacuuccccaaaggaucccucacaacagcucaaaucacaugcuucccccaugucaugugcgacguacguacucucgaacccauccaacucccucuccuagacguccgccguguacucuggcacgcaacccaagaccaagaagaauccaugcgacucgucugcaugcucuacacgccucuacguacaaacucccccggcgacgaauccuucgucgucucaggccgacuucuauccaaaccagccgcagacuucaacuucgucuaccucaccccucccauagaacgaaccaucuauagaauggucgaccucccugucauccaaccucgccuaugcacacacgcccgauggccagcccccguuuacggacuccuaguugacccaucccuccccuccaacccccaauggcaaaacggccgaguccacguagacggaacacuccucggcacaacaccaaucagcggcuccugggucuccugcuucgccgcagaagcugcauacaaauuccaauccggaaccggcgaagucgccaccuuuacacucauagaacaagacggcucugccuaugucccgggcgacagagccgcaccccuaggcuacccagacuuuucuggccaacucgagauagaaguccaaaccgaaaccaccaaaacgggcgacaaacucaaaguaaccaccuucgaaaugauccucggacccaccacaaacgccgaccaagcccccuaccaaggcagaguguucgcauccguaaccgccgccgcgucccucgaccucgucgacggccguguucgagcagucccacggucaauauacggcuuccaagacacaaucccagaauacaacgacggccuacucgucccacuagccccucccaucggacccuuccuacccggagaaguacuucuacgcuuccguaccuauaugagacaaaucgacaccgccgacgccgccgccgaagccauugauugcgcccuuccacaagaguucgucuccugguuugccuccaacgcauucaccguacaaucagaagcccuccuacuccgauaccggaacacccucacagggcaacuacuauucgaaugcaaacuauacaacgaaggcuauaucgcccucuccuacucugguucuggcccccuaaccuucccgacugacggcaucuucgaagucgucucauggguaccaagacuuuaccaacuagccuccgucggcucccuagcaacuggacgcaugcucaaacaauaa

SEQ ID NO: 36863 - RNA, 1626 nt, Artificial Sequence
  derived and/or modified sequence opt11 from capsid_protein__Norovirus__ABU55553
augcgcaugucagacggcgcagcacccaaagccaacggcuccgaagccuccggccaagacuuagucccagccgccgucgaacaagcaguaccaauacaaccagucgccggcgcagcacuugcugccccggcggccggccaaaucaaccaaaucgaccccuggaucuuccaaaacuucguccagugcccucuaggcgaguucuccaucucuccccgaaacacccccggagaaauccucuuugaccucgcccuaggucccggccucaaccccuaccuagcccaucuauccgccauguacacaggcugggucgguaacauggaaguccaacucguccucgccggcaacgcauucacagccggcaaagucguagucgcccucguuccaccauacuucccaaaagguagccucaccaccgcccaaaucacaugcuucccacacgucaugugcgacguaagaacacucgaaccaauccaacucccacuccucgacguccgacgaguccucuggcacgcuacccaagaucaagaagaauccaugcgauuaguaugcaugcuauacacaccucuuagaaccaacucgccaggagacgaauccuuugucgucuccgguagauuacucuccaaacccgccgccgacuuuaacuucgucuaccugaccccucccaucgaacgcaccaucuaccgcauggucgaccuacccguaauucaaccccgccucugcacacaugcacgauggcccgccccaguauauggccuccucgucgaccccucucuucccuccaacccccaauggcaaaauggccgcguccacgucgacggcacacuucuagguaccacaccaauauccggcucuugggucuccugcuucgccgcugaagcugccuauaaguuccaaucgggcacuggagaagucgccacauucacacucauagaacaagacggauccgccuacguccccggagacagagcagcaccccucggcuacccggacuucagcggccagcuugaaaucgaaguccaaacagaaaccacuaaaacaggagacaaacucaaaguaaccaccuucgaaaugauacucggccccacaaccaacgccgaucaagccccauaccaagggcgcguauucgccucagucaccgccgccgccucacucgaccugguagacggccgcguaagagccgucccccgcuccauauacggcuuccaagauaccauccccgaauacaacgacggccugcuugucccccuugccccgcccauaggcccauuccuacccggcgaaguacucuuacgcuucagaacuuacaugcgccaaaucgacaccgcagacgcagcagccgaagccauagacugcgcccuaccucaggaguucgucuccugguucgccuccaacgccuucaccguacaaucagaagcccuucuccuacgcuaccgaaacacacuaaccggccaacuucucuucgaaugcaaacucuacaacgaaggcuauaucgcacucucauacuccggcuccggcccccucaccuucccaaccgacggcaucuucgaagucguauccuggguaccccgccucuaccagcucgcaagcgucggcucccucgccacaggccgcaugcuaaaacaauaa

SEQ ID NO: 36864 - RNA, 1626 nt, Artificial Sequence
  derived and/or modified sequence opt11 from capsid_protein__Norovirus__ABU55556
augcgaaugagcgacggcgcagcucccaaagcaaacgguucagacgcauccggccaagaccucguccccgccgccgucgagcaagccguacccauccaaccugucgcaggcgccgcacuagccgcccccgccgccggacaaauaaaucaaauagaccccuggaucuuccaaaacuucguacaaugcccucuaggagaguucucuauauccccacgaaacacacccggcgaaauccuauucgaccuugcccucggucccggucucaaccccuaccucgcccaccucagcgcaauguacaccggcugggucggcaacauggaaguacagcuuguccuagccggcaacgccuucaccgccgguaaaguaguaguagcccucguacccccauacuucccaaagggaagucuaaccaccgcccaaauaaccugcuucccccacgucaugugcgacguccguacccuagaacccauacagcuaccacuccuagacguccgccgcguccucuggcacgcaacucaagaccaggaagaauccaugcgacucgucugcaugcuauacaccccacuccgaaccaacucacccggcgacgaauccuucgucgucuccggcagacuacuuuccaaacccgcagccgacuucaacuucgucuacuuaacucccccaaucgaacggaccaucuaucgcauggucgaccucccagucauacaacccagauuaugcacacacgccagauggcccgccccaguauacggacuccuuguagacccuucacucccauccaauccccaauggcaaaacggccguguccacgucgacggcaccuuacucggcaccacccccaucuccggcucauggguuuccugcuuugccgccgaagccgcauacaaauuccaauccggaaccggcgaaguugcaaccuucaccuuaaucgaacaagacggcuccgcguacgucccgggcgaccgcgccgcaccccuuggcuacccugacuucucaggacaacucgaaaucgaaguacaaaccgaaacaacaaaaaccggcgacaaacugaaagucaccaccuucgagaugauacucggcccaaccaccaacgccgaccaggccccuuaccaaggccgcgucuucgccagcguaacagcagccgcuucucucgaccucgucgacggccgcguccgagccgucccaagaagcaucuacggcuuccaagacaccauccccgaauacaacgauggccuacucgucccccuagcaccaccaaucggucccuuccuacccggcgaaguacuccuccgcuuucgcaccuacaugcgacaaauagacaccgcagacgcagccgcagaagcuaucgacugcgcccucccucaagaauuugucucaugguucgccuccaacgccuucacaguccaauccgaagcacuccuccuccgcuaccgaaacacacuaaccgggcaacuccuuuucgaaugcaaacucuacaaugaaggcuacaucgcccucagcuacucuggcuccggaccccucacguuccccaccgacggcaucuucgaaguagucuccugggucccacgacucuaccaacuagccuccgucgguucacucgcaaccggccgcaugcucaaacaguaa

SEQ ID NO: 36865 - RNA, 1626 nt, Artificial Sequence
  derived and/or modified sequence opt11 from capsid_protein__Norovirus__ABU55559
augcgcaugucagacggcgccgccccaaaagccaacgguuccgaagcaucaggccaagaccucguaccugcagccguugaacaagcaguccccauccaaccagucgccggagccgcccucgccgccccagccgccggccaaaucaaccaaauagaccccuggauauuccaaaacuucguccaauguccacuaggagaguucucuaucagcccccgcaacacaccaggggaaauccucuucgaucuagcacucggccccggccuaaaccccuaccucgcccaccuauccgccauguacaccggcugggucggcaacauggaaguccaacucguccucgcgggcaaugcauucaccgccggcaaagucgucgucgcgcucguaccucccuacuuccccaaaggcucccuaaccacggcccaaauaaccugcuuuccacacgucaugugugacguccgaacucucgaacccauccaacuaccacuacucgacguuagacgcguccucuggcacgccacccaagaccaagaagaaucaaugcgucucgucugcaugcuauacaccccacuaagaacaaacucccccggcgacgaauccuucgucgucuccggccgccuacucucaaaacccgccgccgacuucaacuucgucuaccucacuccucccaucgaacgcacaaucuaccgaaugguugaccuccccguaauccaaccccgucuaugcacacacgcccgcuggcccgccccaguauacggccuccuagucgaccccucccuacccucaaauccccaauggcagaauggucgcguccacgucgacggcacccuacucgguaccacaccaaucucaggcucauggguaucaugcuucgcagcggaagcagcauacgaguuccaauccgggaccggcgaagucgccaccuucacccucauagaacaagacggauccgcauauguccccggcgaccgcgccgcaccccucggcuacccagacuucagcggccaacucgaaauugaaguccaaacggaaaccacaaaaaccggagacaaacucaaaguaacaaccuuugaaaugauccuagguccaaccaccaacgccgaccaagccccauaccaaggccgcguauucgcauccgugaccgccgcagcgucccucgaccucguagacggacgaguccgggccguaccccgauccaucuacggcuuccaagacaccaucccagaauacaacgacggccuccuugucccucucgccccacccaucggacccuuccuacccggagaaguccuacucagauuucgcacauacaugcgccaaaucgacaccgcagacgccgcugccgaagccaucgauugcgcacucccacaagaguucgucuccugguucgcauccaacgcauucaccguccaauccgaagcucuccuccuccgauacagaaacacccucacaggccaacuccucuucgaaugcaaacuauacaaugaaggauacaucgcacucuccuacucuggcucagguccccuaaccuuucccaccgacggcaucuucgaagucguuuccuggguaccacgccuuuaccaacucgccucugucggaucccucgccaccggccggaugcucaaacaauaa

SEQ ID NO: 36866 - RNA, 1626 nt, Artificial Sequence
  derived and/or modified sequence opt11 from capsid_protein__Norovirus__ABU55562
augcguauguccgacggcgccgcaccuaaagcaaauggcucagaagcaucaggacaagaccucguacccgccgccgucgaacaagccguaccaauccaaccaguagcaggcgccgcccucgcagccccugccgccggacagaucaaccagaucgaccccuggauauuccaaaacuucguccaaugcccccucggagaguucuccaucucaccccgcaauacgcccggagaaauccucuucgaccucgcccuaggccccgggcucaacccauaccuagcacaccuauccgccauguacaccggcuggguaggcaacauggaaguacaacucguccucgcagguaacgccuucaccgcugguaaaguagucguagcccuagucccucccuacuuccccaaaggcucccuaaccaccgcucaaauaaccugcuucccacacgucaugugcgacguaagaacccuagaaccaauccaacucccgcuccuagacgugcgacgcguccuauggcacgcaacacaagaccaagaagaaagcaugcgccucgucugcaugcucuacacuccccuccgaaccaacucccccggcgacgaaucguucguugucucaggcagacucuuauccaaaccagcugccgacuucaacuucguauaucucacuccacccaucgaacgaaccauauaccgcauggucgaucuucccguaauccaaccacggcucugcacccacgcacgcuggccagcccccguauacggccuccuagucgaccccucccuccccuccaacccccaauggcaaaacggacgcguccacguugacgguacacuacuaggcacuacaccuauauccggcaguugggucucuugcuucgcagccgaagcugccuacaaauuccagagcggcaccggcgaaguagcuaccuucacccucaucgaacaagacggcuccgcauacgugccuggagacagagccgccccgcuaggcuacccagacuucuccggccaacucgaaaucgaaguccaaaccgaaacaacgaaaacaggagacaaacuaaagguaacaacauuugaaaugauacuagguccaacgaccaaugcagaccaagcuccauaccaaggacgaguauucgccuccgucaccgccgcagccucccucgaccuaguagacggccgcguccgagcagugccccgcucgaucuacggcuuccaagacacgauccccgaguacaacgacggacuacuuguuccgcucgcaccacccaucggacccuuccuacccggcgaaguccuccuccgcuuccgaaccuacaugcgccaaauagacaccgcagacgcagccgccgaagcuauagacugcgcccuuccccaagaauuuguaucaugguucgccuccaacgcauucaccguccaguccgaagcccuccuacugcgcuaccgcaacacacuaaccggccaacuucuauucgagugcaaacuauacaacgaaggcuacaucgcccucuccuacucaggaucaggcccccucacauucccaaccgacggcauauuugaagucguaucaugggucccccgccucuaccaacucgccucugucggcucccucgccaccggacgcaugcucaaacaauaa

SEQ ID NO: 36867 - RNA, 1626 nt, Artificial Sequence
  derived and/or modified sequence opt11 from capsid_protein__Norovirus__ABU55565
augcgcauguccgacggcgcagcaccuaaagccaacggauccgaagccucaggacaggaccuuguacccgccgccgucgaacaagccguccccauacaacccgucgcuggagccgcucucgcugcccccgcagcaggacaaauaaaucaaauagacccauggaucuuccaaaacuucguccaaugcccacucggagaguucuccaucucuccccgcaacacacccggcgaaauccucuucgaccucgcccucgguccaggccucaacccauaccuggcccaccuauccgccauguacaccggauggguuggcaacauggaaguacagcuuguccuugccggaaacgccuucaccgccggcaaagucguaguagcccuagucccucccuacuuccccaaaggcucccugacaacagcccaaaucacaugcuucccgcacgucaugugugacguccgcacacucgaaccaauccaacuuccccuccucgacguccgccgcguccucuggcacgcaacacaagaccaagaagaaucaaugcgccucgucugcaugcucuacacuccccuccguaccaacucacccggagacgaauccuucguagugucuggacgacuccuaucaaaacccgcagccgacuucaacuucguuuaccuaacacccccuauagaacgcaccauauaccgcauggucgaccuaccagucauacaaccacgacucugcacccacgcccgauggcccgcacccguauauggucuguuagucgaccccucccuacccuccaacccccaauggcaaaacggccgcguacacguagacgguacacuucuaggcaccacgcccaucucaggauccuggguaagcugcuucgccgccgaagcugcauacaaauuucaauccggcaccggugaaguagccaccuucacccuaaucgaacaagacggcagcgcauacgucccaggcgaccgcgccgcaccccucggcuacccagauuucuccggacaacucgaaaucgaaguccaaacagaaaccacaaaaacaggcgacaaacuaaaagucaccaccuucgaaaugauacucggccccacaaccaaugcagaccaagcccccuaccaaggccgcgucuucgccucuguaacagcagccgcaucccucgaccucguagacggcagaguccgagccgucccaagauccaucuacggcuuccaagacacaauccccgaauacaacgacggccuccucgucccccuagcucccccuauaggcccauuucucccaggcgaaguccuccuacgauuccguaccuacaugcgacagaucgacaccgccgacgcugccgccgaagccaucgacugcgcucuaccucaggaguucgucuccugguucgccucaaacgcauuuaccguacaauccgaagcccuucuacuucgauaccgcaacacccuuacaggccaacuccucuuugaaugcaaacuauauaacgaaggauacaucgcacuaucauauucaggcuccggcccucucaccuuccccaccgaugguaucuucgaagucguauccuggguaccccgccucuaccagcuagccucuguugguucucucgccaccggcagaaugcucaaacaauaa

SEQ ID NO: 36868 - RNA, 1626 nt, Artificial Sequence
  derived and/or modified sequence opt11 from capsid_protein__Norovirus__ABU55568
augcguauguccgacggagcagccccuaaagcuaacggauccgaagccuccggacaagacuucguccccgcagccguagaacaggccguccccauccaacccgucgccggcgccgcccuagccgccccugcagccggucagaucaaccaaaucgaccccuggaucuuccaaaacuucguccaaugcccacucggugaauuuuccauaucaccucgcaauacacccggagaaauucucuucgaccuagcucuaggcccaggacucaaccccuaucuagcacaccucucagccauguacaccggaugggucggcaauauggaaguccagcuaguccucgccggcaacgcauucaccgcgggaaaagucgucgucgcccucguaccacccuacuuccccaaaggcucucuaaccacagcccaaaucacaugcuucccccacgucaugugcgauguccgcacccuggaacccauccaacucccccuccucgacguccgccgcguccuauggcacgcaacccaagaccaagaagaaucaaugcgccuaguaugcaugcucuacacaccccuaagaaccaacuccccaggcgacgaaucauucgucgucuccggcagacuccuaucaaaacccgcagcggauuucaauuucgucuaccucaccccacccaucgaacgcaccguauaccgaaugguugaccuccccguccuccaaccccgacucugcacccacgcgcgcuggccugccccgguuuacggccuacucauagacccuucccucccguccaacccccaauggcaaaacggccgaguccacgucaacggcacccuccuaggaaccacacccgucuccggcuccugggucagcugcuuugcagccgaagcugccuacgaauuucaaucaggaaucggagaagucgccacauucaccaugaucgaacaagacggcuccgccuacgucccaggcgaccgcgccgccccacuaggcuacccugacuucuccggacaacuugaaauugaaguucaaaccgaaacuaccaaauccggcgacaaacucaaggucaccaccuuugaaaugauacucggccccaccaccaacgccgaccaaacccccuaccaaggaaaaguauaugcguccauagccgcagccgcaagccuagaucucguggacggaagaguccgcgcaguaccccgcuccgucuacgccuuucaggacguccucccugaauacaacgauggacuccuagucccacuagccccaccccucggccccuuccuccccggcgaagugcuacuacguuuccgaaccuacguaagacaacuugacacagccgacgcagcggcacagcccauagacugcgcccucccacaagaguucauaucuugguucgcauccaacaacuucaccguacaaucugacgccuuacuaauccgcuaucgaaacacccucacaggccagcuacucuuugaagcaaaacucuacucagaagguuacaucgcagucuccuauucaggcagcgguccccucaccuuccccaccgacggauucuuugaagucgucuccugggucccacgccuauuccaacuugccuccguaggcucccucgcaaccggcagaacccuuaaacaauaa

SEQ ID NO: 36869 - RNA, 1626 nt, Artificial Sequence
  derived and/or modified sequence opt11 from capsid_protein__Norovirus__ABU55571
augcgaaugagcgacggcgccgcacccaaggccaacggcuccgaggcuagcggucaagaccucguacccaccgcuguagaacaagcaguacccauccaacccgucgccggcgccgcccucgccgcaccagcagccggccaaaucaaccaaaucgaccccuggaucuuccaaaacuucguucaaugcccccuuggagaauucuccaucucaccacgcaacaccccuggugaaauccuuuucgaccucgcauuaggacccggacuaaacccauaccucgcacaccucuccgccauguacaccggcugggugggaaacauggaaguccaacucguccuagccgguaacgccuucacagcaggaaaggucgucgucgcucuugucccaccauacuuccccaaaggcagccucaccacagcacaaauaacaugcuucccacacgucaugugugacguccgcacccucgagcccauucaacugccccuacuagacgucagacgcguccuuuggcacgccacccaagaccaagaagaaagcaugcgccuagucugcaugcucuacacaccacuacgaaccaacuccccaggcgaugaauccuucguuguauccggaagacuccuauccaaaccggccgcagacuucaacuucgucuaccuaaccccccccaucgaacgcaccgucuaccgcauggucgaccuaccaguacuucaacccaggcuaugcacccacgcccgcuggccagcacccaucuacggacuacugaucgaccccucacuaccguccaacccccaauggcaaaacggcagaguacacgucaacggaacgcuccuuggcaccacacccguuuccggaagcuggguauccugcuucgcagccgaagcagcauaugaauuccaaucaggcaccggagaagucgcuaccuucaccaugauagaacaagacgguuccgccuacguccccggcgaccgagccgccccacucggauaccccgacuucuccggacaauuagaaauugaaguacaaaccgaaacuaccaaaacaggcgacaaacuaaaagucacaaccuucgaaaugguacucggcccuaccacaaacgucgaccaagccccauaccaaggccgcaccuacgcuucccucaccgccgccgccucacucgaccucguugacggaagaguccgcgccguaccacgauccaucuacaguuuccaagacguccucccagaauacaaugacggccuccucguaccacuugccccaccccucggaccauuccuccccggagaaguccuacuccgguucagaaccuacaugcgccaacucgacacagcagacgcagccgcacaaccaaucgacugcgcccucccucaagaauucauauccugguucgccucaaacaacuucaccguccaaucagacgcccugcuaauccgcuaccgcaacacccucaccggucaacuacuauucgaagccaaacucuacuccgaaggauacaucgccguauccuacuccggauccgguccucucacauuccccacagauggauucuucgaagucgucucuugggucccccgucuauuccaacuagccuccgucggcucacuugccacaggccgcacacucaaacaauaa

SEQ ID NO: 36870 - RNA, 1626 nt, Artificial Sequence
  derived and/or modified sequence opt11 from capsid_protein__Norovirus__ABU55577
augcgcauguccgacggagccgcccccaaagccaacggcuccgaagcaauaggacaagaucucguacccaccgccgucgaacaagccguccccauccaaccagucgccggcgcagcccuagcugccccggcggccggacagaucaaucaaaucgacccuuggauauuccaaaacuucguacaaugcccccucggagaauuuucaaucuccccgagaaacaccccaggcgaaauccuuuucgaccucgcccucggccccggacucaacccauaccucgcccaccuauccgcaauguacacaggcugggucggcaacauggaaguccagcucgugcucgcuggaaaugccuucacagccggaaaagucgucgucgcacuugucccacccuauuuccccaaaggaucccuaaccaccgcacaaaucacaugcuucccccacguaaugugcgauguccgcgcccucgaacccauccaacuaccacuccucgacguccguagaguacucuggcacgccacccaagaccaagaagaaagcaugagacucgucugcauguuauacacuccccuccgcaccaacuccccaggugacgaauccuucgucgucuccggccgccugcucuccaaacccgcagccgacuucaauuucgucuaccucacacccccuaucgaacgcaccgucuaccgaaugguagaccuccccguccuacaaccgcgacucugcacccacgcgcgguggccagcccccgucuacggccuacuugucgaccccucacuccccuccaacccccaauggcaaaacggccgaguccacgucaacggaacccuacuaggcaccaccccaguuagcggcuccuggguauccugcuucgcagccgaagccgcauacgaguuccaauccggaaccggcgaaguagccacauucaccaugaucgaacaagacggaucagccuacgucccgggcgaccgagcagcaccccucggauaccccgacuucucaggccaacucgaaauagaaguccaaaccgaaacgacaaaaucgggagacaaacucaaagucacaacauucgaaaugauccuuggccccaccaccaacgccgaccaaaccccauaccaaggccgcguauacgcauccaucgccgccgcugcaccccucgaccuuguagacggccgcguccgcgccgucccccgcucaguauacuucuuccaagacguauuaccugaauacaacgacggccuuuuagucccccuagccccaccccuaggccccuuccuccccggcgaaguauuacuccgcuuccgaaccuacguucgccaacucgacacggccgacgcagcagcccaacccaucgauugcgcucucccccaagaguucaucucuugguucgccuccaacuccuucaccguccaauccgaagcccuccucaucagauaccgcaacacucuaacaggccaacuacucuucgaagccaaacucuacucugaaggauacaucgccgucucauacuccggcagcggcccccucaccuuucccacugacggauucuucgaagucguuucaugggucccccgacucuuccaacucgcaucagucggcucccuugcgaccggccgaacccugaaacaauga

SEQ ID NO: 36871 - RNA, 1626 nt, Artificial Sequence
  derived and/or modified sequence opt11 from capsid_protein__Norovirus__ABU55580
augcgcauguccgacggagccgcccccaaagccaauggcuccgaagcaaucggccaagaccucguucccacagcagucgaacaagccguccccauacaacccgucgccggcgcugcacuugcagcaccggccgccggccaaauaaaccaaauagaccccuggaucuuccaaaacuucguccaaugcccucuaggugaauuuuccauaucaccccguaacacaccuggcgaaauccuauucgaccucgcgcuuggccccggccuaaaccccuaccuagcccaucucuccgccauguacacaggcuggguaggcaacauggaaguacaacucguccucgcaggcaacgcuuucacugccggcaaagucgucguugcccucgugcccccauacuuccccaaaggaucacucacaaccgcccaaauuaccugcuucccccaugucaugugcgacguccgcgcccuugaaccaauccaacucccucuacuugauguccgaagaguacucuggcacgccacccaagaccaagaagaauccaugcgucuagucugcaugcuauacacaccacuuagaaccaacuccccuggcgaugaauccuucgucgucucaggcagacuguuauccaaacccgccgcugacuucaacuucgucuaccuuaccccacccauagaaagaaccgucuaccgcauggucgaccuccccguccuucaaccccgccuaugcacucaugcucgcuggcccgccccaguauacggucuccucguagaccccucacuucccuccaacccacaauggcaaaacggacgaguccacguaaacggaacacuccuaggcaccacacccgucuccggcuccugggucucuugcuucgcagccgaagccgcauacgaguuccagaguggcacaggggaagucgccaccuucacaaugauagaacaggacggcuccgccuacguaccgggcgacagagccgcuccccuaggcuaccccgacuucagcggccaacuugaaauagaaguccaaacagaaacuaccaaaucuggcgacaaacuaaaagucaccaccuucgaaaugauccuaggcccaaccaccaacgcagaccaagcucccuaccaaggccgagucuacgcaagccucgccgccgcugcaccacuagaccucgucgacggucgaguaagagcagucccccgcuccgucuacuucuuccaagauguccucccagaauacaacgauggccuucucgucccacuagccccaccccucggcccguuccuacccggcgaaguacuccuacgcuuccgcaccuacguccgccaacucgauacugccgacgcagccgcccaaccgauagauugcgcccucccccaagaguucauuucgugguucgcaucgaacuccuucacaguacaauccgaagcacuccuuauccgcuaccgaaacacacucacaggccaacuacucuucgaagccaaacucuacuccgaagguuacaucgccgucuccuacuccggcucuggcccccucaccuucccaacagacggcuucuucgaagucgucucuugggucccacgccuuuuccaacucgccuccgucggaucccuagccacuggccgaacccuuaaacaauag

SEQ ID NO: 36872 - RNA, 1626 nt, Artificial Sequence
  derived and/or modified sequence opt11 from capsid_protein__Norovirus__ABU55586
augagaauguccgacggcgccgccccaaaagccaacggaucagaagccauaggccaagaccuuguccccaccgccguagaacaagccguccccauacaacccguagccggugccgcacucgccgcaccagccgccggccaaauaaaccaaaucgacccuuggauauuccaaaacuucguccaaugcccccucggggaauuuuccaucucuccccgcaacacccccggagaaauccuguucgaccuagcacucggacccggacuaaacccuuaccuagcccaccucuccgccauguacacaggcuggguaggcaacauggaaguccagcucguccuagcaggcaacgcuuucaccgcaggaaaagucguagucgcucuaguacccccauacuucccaaaaggcucccucaccacugcccaaauaaccuguuucccccacgucaugugcgacguccgagcacucgaaccaauacaacucccgcuacuugauguacgacgcguacucuggcacgcaacccaagaccaagaagaaucaaugcgccuaguaugcaugcuauauacaccccuucgcacaaauuccccaggcgacgagagcuucgucgucuccggccgacuccucuccaaaccagccgcagacuucaacuucgucuaccucaccccaccaaucgaacgaaccgucuaccgcauggucgaccuacccguccuacaaccccgccucugcacccacgcacgcuggcccgcccccguuuacggacuucuuguugaucccucucuccccucaaacccacaauggcaaaacggacgcguccacguuaacggcacccuccucgggaccacacccgucaguggcuccuggguaucaugcuucgcugccgaagcagccuaugaguuccaauccggcaccggagaagucgccaccuuuaccaugaucgaacaagacgguuccgcauacguucccggcgaccgcgcggcaccacuuggcuaccccgacuucucuggccaacucgaaauugaaguccaaaccgaaaccaccaaaucaggcgacaaacucaaaguuaccacauucgaaaugauacucggcccuaccacaaacgccgaccaagcccccuaccaaggaaaagucuacgccucccucgcagccgcagcaccccuugaucucgucgacggacgaguccgggcugugccccgcucaguauacuucuuucaagacguccuucccgaauacaacgauggccuccuugucccacuagcucccccacucggccccuuccucccgggcgaaguccuccuccgauuccgaacauacguccgccaacucgacaccgccgacgccgccgcacaaccaaucgacugcgcacucccccaagaguucaucucaugguucgccuccaacucauucacaguccaguccgacgcccuccuaauacgcuaccgaaacacccuuacaggccaacuccucuucgaagcaaaacuuuacuccgaaggcuacauagcaguaucuuacucaggcagcggcccacucaccuuccccacagacgguuucuucgaagucgucuccuggguaccccgccucuuccaacucgcuucagucggaucccucgccacaggacguacccucaaacaauaa

SEQ ID NO: 36873 - RNA, 1626 nt, Artificial Sequence
  derived and/or modified sequence opt11 from capsid_protein__Norovirus__ABU55589
augcgaauguccgacggagccgccccuaaagccaacggcucagaagccuccggacaagaccuuguacccacagccgucgaacaagcaguccccauccaaccagucgcaggcgcagcccucgccgcaccagcagcaggccagauaaaucaaaucgacccuuggaucuuccaaaacuucguccaaugcccccuaggcgaauuuuccauaucgccccgcaacacaccaggagaaauccucuucgaucuggcccuaggucccggucuuaaccccuaccucgcacaccucuccgccauguacaccggauggguaggcaacauggaaguacaacucguccuggcaggcaaugcauucaccgcaggcaaaguaguagucgcccuaguuccaccauacuuccccaaaggcucccuaaccaccgcacaaaucacaugcuuuccacacguaaugugcgacguccgcacccucgaacccauacaacucccucuccucgacguccgccgcguucuuuggcaugccacccaagaccaagaagaguccaugcgccucgucugcaugcucuacaccccacuccguaccaacucccccggcgacgaguccuucguuguuuccggucgucuucucuccaaacccgccgccgacuucaacuuugucuaccuaaccccacccauagaacgaaccguauacagaauggucgaccuccccguccuucaaccccgccucugcacccacgcuagauggcccgcacccguauacggccuauuaaucgaccccucccucccauccaauccacaauggcaaaacggcagaguucacguuaacggcacccuccucggcaccacccccgucucaggcuccugggucagcugcuucgccgccgaagcagccuacgaguuccagucaggcaccggagaagucgcaaccuuuaccaugaucgaacaagacggaagcgcauacgugcccggcgaccgcgccgccccgcucggcuaucccgauuucuccggccaacucgaaaucgaagugcaaaccgaaaccacaaaauccggggacaaauugcgaguuacaaccuucgaaaugauccucggacccaccaccaacgucgaccaagccccuuaccaaggacguguuuaugccucccucgcagcagccgccucccuagaccuaguagacggccgugucagagcugucccccgcuccgucuacucuuuccaagacguccuacccgaauacaacgacggacuccucgucccccuugcacccccucucggccccuuccuccccggcgaaguacuccuccgguuccgcaccuacaugcgccaacucgacacagccgacgccgccgcccagcccauugacugcgcccucccccaagaguucaucucaugguucgcaucaaacaauuucaccguccaaucugaugcacuccuaauccguuaccgcaacacacuaacaggccaacuccucuucgaagcaaaacuauacuccgaaggauauaucgccgucucuuacucaggaagcggcccccucacuuucccaacugacggcuucuuugaagucguauccugggucccccgucucuuucaacucgccuccgucggcagccucgccaccggccgcacccucaaacaauaa

SEQ ID NO: 36874 - RNA, 1626 nt, Artificial Sequence
  derived and/or modified sequence opt11 from capsid_protein__Norovirus__ABU55598
augcgcaugagcgacggcgcggcacccaaagccagcggcagcgaagcaucaggccaagaccuaguacccacagccguagaacaggccguucccauacaacccguagcuggcgccgcacucgccgcaccagcagccggacaaaucaaccaaaucgaccccuggaucuuccaaaacuucguccaguguccccucggagaauuuucaauaucaccccgcaacacacccggagaaauccucuucgaccucgcccuugguccaggucuaaaccccuaccucgcucaccucuccgccauguacaccggauggguuggcaacauggaaguacaacucgucuuagcaggcaacgccuucaccgccggaaaagucgucguagcucuaguacccccauacuuccccaaaggaucacuaaccacagcccaaaucacauguuucccccacgucaugugcgacguccgcacccuagaacccauccaacucccccuacucgacguccgccgcguacucuggcacgcaacccaagaucaagaagaaucaaugagacucgucugcaugcucuacacaccccuacgaaccaauucaccaggagacgaauccuucgucguaagcggacgccuccucucaaaaccagccgccgacuucaacuucgucuaccuaacacccccaaucgaacgcaccaucuaccguaugguagaccucccugucuuacaaccacgccucugcacucacgccagauggcccgcccccgucuacggccugcucgucgacccaucccuacccucaaacccccaauggcaaaacggacgaguccacauagacggaacccuacucggcacaaccccaguauccggcuccugggucagcugcuucgcugcugaagccgccuacgaguuccaauccggcaccggcgaagucgcaacauuuacacuuaucgaacaagacggcuccgcauacguucccggggaccgcgccgcaccccucggauaccccgauuuuuccggacaacuugaaaucgaaguccaaacugaaacgacaagagccggcgacaaacuuaaagucacgacauucgaaaugauccucggcccgaccaccaacguagaccaggccccauaccaaggccgagucuacgccagccucaccgcagccgcaucacuagaccucgucgacggccgcguccgagccguaccccgcagcaucuacucauuccaagacguccucccagaauacaacgacggccuacucgucccccucgcaccgcccaucggccccuuccugcccggugaaguccuccuccgcuuccgcacauacaugcgccaagucgacuccucagacgcugcagcagaagccaucgacugcgcgcucccacaagaguucgucuccugguucgcauccaacggauucacaguccaauccgaagcccuccuccuacgauacagaaauacccuuaccggacaacuccucuucgaaugcaaacuauauucagaaggcuacaucgcacuaagcuacuccggcucaggcccccucaccuuccccacagauggauucuuugaaguaguauccugggucccccgccucuuccaacucgcaucagucggcucacucgucacaggccgaacccuuaaacaauaa

SEQ ID NO: 36875 - RNA, 1626 nt, Artificial Sequence
  derived and/or modified sequence opt11 from capsid_protein__Norovirus__ABU55601
augcgcauguccgacggcgcugcccccaaagcaaacggaagcgaagcauccggccaagaccucgucccaaccgcugucgaacaagcaguccccauccaacccgucgccggugcagcccucgccgcccccgccgcaggacaaaucaaccaaauugaccccuggaucuuccaaaacuuuguccaaugcccacucggcgaauuuuccaucagcccacgaaacaccccuggcgaaauccuauucgaccuagcacuuggccccggccuuaaccccuaccucgcucaucuuuccgccauguacacaggauggguuggaaacauggaaguccaacucguucucgccggaaacgccuucaccgcagggaaaguagucgucgcucucgucccaccuuacuuccccaaaggcagccugaccaccgcacaaauaaccugcuucccacacgucaugugcgacguccgaaccuuagaacccauccagcucccccuccucgacguccgucgcgugcuuuggcacgcgacccaagaccaagaagaaucaaugcgccucgucuguaugcuauacaccccacuaagaaccaacucgcccggcgacgaaucauucguaguauccggccgccuccucucaaaaccagccgcagacuucaacuucgucuaccuaacuccgcccaucgaaagaaccauauacagaauggccgaccuaccaguccuccaaccacgccuuugcacccacgcacgcuggcccgcaccagucuacggucuccuaguagacccaucacuuccuuccaacccccaauggcaaaacggacgcguacacgucgacggcacacuucuaggcaccacccccaucuccggauccugggucucuugcuucgccgccgaagcagccuacgaauuucaauccggcaccggagaagucgccacacuaacacucaucgaacaagacggcuccgccuacguacccggcgaccgagcagcaccccucggguaccccgacuucagcggucaacuagaaaucgaaguacaaacagaaaccaccaaagccggcgacaaacuuaaagugaccacauucgacaugauccuaggacccaccaccaacguagaccaagcccccuaccaaggccgggucuaugccuccguaucaaccgccgccucacucggccucgucgacggacgcguccgagcaguaccacgcucaaucuacgguuuccaggacaccauacccgaauauaacgacggacuacuugucccccucgccccacccaucggucccuuccuucccggcgaaguacuccucagauuccguaccuauaugcgacaaauagacaccgcagaugcagcagcagaagccaucgacugugcccugccccaagaguucauaucuugguucgccuccaacgcauucacaguacaauccgaagcccuccuacugcgauaccgcaacacccucaccgggcagcuccuuuucgaaugcaaacuauacucggaaggauacaucgcucucucauacuccggaucuggcccacucaccuuccccacggacggauucuucgaagccgucucuugggucccccgacucuaccaacucgcauccguaggcucccuagccaccggacgaacccucaaacaauaa

SEQ ID NO: 36876 - RNA, 1626 nt, Artificial Sequence
  derived and/or modified sequence opt11 from capsid_protein__Norovirus__ABU55604
augcgaaugucagacggagccgccccacgagcgaacggguccgaagccuccggucaagaccucguccccaccgcugucgaacaagcagucccaauccaacccgucgcuggcgccgcccucgccgcaccagccgccggccaaauaaaccaaauagacccuuggaucuuccaaaacuucguccaaugcccccucggcgaauuuagcauuucaccucgaaacacaccaggagaaauccucuucgaccuagcucucggccccggacuaaaccccuaccucgcccaccucucagccauguacacaggaugggucggaaauauggaaguccaacucguccucgccggcaacgccuucacagccggcaaaguugucgucgcucuaguuccacccuacuuccccaaaggcagccucacaaccgcacaaaucacauguuucccacacgucaugugugacguacguacauuagaacccauccaacucccccuccucgacguccgaagaguccuuuggcacgccacacaagaccaagaagaaucaaugcgauuagucugcaugcuguacacaccccuccgaaccaacagccccggcgacgaauccuucgucguauccggacgccuacucuccaaaccggcugccgacuucaacuucguauaccuaacucccccaaucgaaagaaccaucuaccgcaugguagaccuacccgucauccaaccccgacucugcacccacgcccgauggccugccccaaucuacggucuccucgucgaccccucccuccccucuaacccacaauggcaaaacggccgcguccacguggacggcaccuuacuaggcacaacccccaucuccggguccugggucucgugcuucgcugcagaagccgcuuacgaguuccaauccggcaccggcgaaguagcaaccuucacccucaucgaacaagacggauccgccuacguacccggcgaccgcgcagccccacucggcuaccccgacuucuccggccaacucgagauagaaguacagaccgaaaccaccaaaaccggagacaaacucaaaguaacaacauucgaaaugauccucggccccaccaccaacguugaccaagcccccuaccaaggccgugucuacgccucggucgcagcagccgcaucccuagauuuaguagacggccgcguucgcgcaguaccccgcuccaucuacggcuuccaagacgucaucccagaauacaacgacggacuacuugucccccucgcuccacccaucggacccuuccuaccaggcgagguucuccuccgcuuccgcaccuacaugcgccaacuagacacagccgacgcagccgcugaagcaaucgacugcgcccucccacaagaguucgucucuugguucgccucaaacgccuucacaguacaauccgaagcacuccuacuacgcuaccgaaacacucugacaggccagcucuuauucgaaugcaaacucuacucugaaggauacauagcccuauccuacuccggauccggaccacucaccuucccagcugacggcuucuucgaaguagucuccuggguccccagacuauaccaacuggccucaguagguucccucgcuacuggccguaugcuccgccaauaa

SEQ ID NO: 36877 - RNA, 1626 nt, Artificial Sequence
  derived and/or modified sequence opt11 from capsid_protein__Norovirus__ABU55607
augcgcaugucagacggcgccgcccccaaagcaaacgguucagaagccucuggccaagacuuaguccccaccgcagucgaacaagccgucccaauccaaccagucgcuggugcagcccuagcggcccccgccgcagggcaaauaaaccagaucgaccccuggaucuuccaaaacuucguccaaugcccacuuggcgaguucucaauauccccucgcaacacaccuggugaaauacucuucgaccuagcccuaggccccgggcuaaacccauaccucgcccacuuaagcgccauguacaccggauggguaggcaauauggaaguacagcuaguccucgccggaaacgccuucaccgccgguaaaguagucgucgcccuugucccucccuacuuccccaaggguagccucacaaccgcccaaaucaccuguuuuccccauguaaugugcgacguccgcacacucgaacccauacaacuaccccuacucgacguccgccgaguacucuggcacgcuacccaagaucaagaagaaucuaugcggcucgucugcaugcucuacacaccccuacgcaccaauucccccggcgacgaaucauuugucgucagcggccgccuccucuccaaacccgcccccgacuucaacuucgucuaucucaccccucccauagaacgcaccaucuaccguauggucgaccucccaguccuccagccccgccucugcacccacgcccgcuggccagcacccguauacggccuccucgucgaccccucucuccccucaaacccccaauggcaaaacggacgcguccaagucgauggaacccuacucggcaccacacccgucuccggcucuuggguauccugcuucgccgccgaagcagcauacgaguuccaagcaggcacaggugaagucgucacauucaccaugaucgaacaagacggcucugccuacgucccuggcgacagagccgcuccccucggcuaccccgauuucuccggccaacucgaaaucgaaguacaaaccgaaacaaccaaaacaggcgauaaacuccgcgucaccaccuucgaaaugauccuaggcccaacaacaaacgucgaccaagcaccauaucaaggccgcgccuaugccagccuaaccgccgcggcaucccucgaucucgucgacggucgaguccgagccgucccccgcucaauauacuccuuccaagacgaacucccugaauacaacgauggccuccucguccccuuagccccaccccuaggccccuuccuacccggagaaguacuccuacguuuuagaacauacaugcgccaacuagauacagcggacgccgccgcacaacccaucgacugcgcccuaccccaagaguucaucuccugguucgccucaaacaacuucaccguccaauccgacgcccuccucguacgcuaccgaaacacacucaccggacaacuauuauucgaagcaaaacucuacuccgaagguuauaucgccgucuccuacucaggauccggaccccugacauucccaaccgacggcuucuucgaaguagucucuuggguaccccgccucuuccaacucgcuuccguagguucccuagucaccggacgcacccucaaacaauaa

SEQ ID NO: 36878 - RNA, 1626 nt, Artificial Sequence
  derived and/or modified sequence opt11 from capsid_protein__Norovirus__ABU55610
augcgcauguccgacggcgcugccccaaaagcaaacggcuccgaagccucuggacaagaccucguaccaaccgccgucgaacaggccguacccauacaaccagucgccggcgccgcccuugcugccccagccgcaggucaaaucaaucaaaucgaccccuggauuuuccaaaacuuuguccaaugcccccucggcgaauuuucagucuccccacgcaauacccccggagaaaucuuauucgaccucgcacuaggacccgggcucaaccccuaucucgcccaccuauccgccauguacacuggcugggucgggaacauggaaguccagcuaguacuugccggcaacgcuuucacagcaggcaaagucguuguagcucucgucccgccauacuucccaaaaggcucccucacuaccgcucaaauaaccugcuucccacacgucaugugcgacguccgaacccucgaaccaauccaacuuccccuucuagacguacgccgaguacuauggcacgccacccaagaccaagaagaaagcaugcgccucgucugcaugcuuuacacaccccuccgaaccaacucacccucagaugaauccuucgucgucucaggacgacuacuaucuaaaccagcggccgauuucaacuucguauaccucaccccucccaucgaacgcaccaucuacagaauggucgaccuacccguucuccaacccagacucugcacccacgcccgcuggcccgccccugucuacgggcuccuaguagaccccucgcuucccuccaacccccaauggcaaaacggccgcguccacguagauggcacccuacucggcaccacccccauauccgguuccuggguauccugcuucgcggccgaagcagcauacgaguuccaaucaggcaccggugaagucgcaacauucacucuuguagaacaagauggcagcgccuauguccccggugaccgcgcugcuccccuaggcuaccccgacuucucaggccaacucgaaaucgaaguccaaaccgaaaccaccaaacccggcgaaaaacuaaaaguaaccaccuucgaaaugauacucggaccaaccaccaacgucgaccaagcacccuaccgcggcaagguauucgcaagcaucaccaccgccgcaucccuaucccuugucgacggacgcguccgcgccguacccagaucaaucuacucauuccaagacgucaucccagaauacaacgacggccuccucguaccccuagccccacccaucggccccuuccuccccggagaaguccuccuccguuuccgaaccuacaugcgccaacuagacucugcugacgcggcggcagaagccauagacugcgcccucccacaagaguucgucuccugguucgccuccaacgccuucacaguccaaucugaagcccuccuacuacgcuaccgcaacacccucacaggacaacuccuuuucgaaugcaagcuauacagugaaggcuacauagccuuaagcuauucgggauccggcccccuuaccuuccccaccgacggauucuucgaagucguauccugggucccccgucucuaccaacuggccucagucggaucccuagcaaccggacgcacucucaaacaauaa

SEQ ID NO: 36879 - RNA, 1626 nt, Artificial Sequence
  derived and/or modified sequence opt11 from capsid_protein__Norovirus__ABU55613
augagaauguccgacggcgccgcccccaaggcuaacggaucugaagccucgggccaagaccuugucccgacggcaguagaacaagcaguccccauucaaccagucgcaggcuccgcacuugcagcccccgccgcaggccaaaucaaucaaaucgaccccuggaucuuccaaaacuucguacagugcccacuuggagaauuuuccaucucgccccgcaacacccccggcgaaauccuauucgaccucgcccucggccccggccugaaccccuaccucgcccaccuuuccgcgauguacaccggaugggucggaaacauggaaguccagcuaguacuagccggcaacgcauucacugccggcaaagucgucguagcccuagucccucccuacuuccccaaaggcagccucacuacggcccaaaucacaugcuucccccacguuaugugcgacguacgaacccucgaaccaauccaacucccccuccuagacguccgccgcguccucuggcacgcaacccaagaccaagaagaauccaugcgccucgucugcaugcuuuacacaccccuccgcaccaacucgccaggagacgaaucguuugucgucucaggcagacuacucucuaaaccagccgcagacuucaacuucguauaccucacucccccuaucgaaagaaccauauaccgcauggucgaccuccccguccuacaaccccgacuaugcacccacgcccgauggccagcacccaucuacggacuccucgucgacccuucccuucccucaaacccccaauggcaaaacggccgaguucacguagacggcacauuacucggaacaacgcccgucuccgguuccuggguaaguuguuuugccgccgaagccgccuacgaguuccaauccggcaccggagaagucgccaccuucacccuaauugaacaagacggcagcgccuaugucccaggcgaccgagccgccccguuaggcuacccugauuucagcggccaacucgaaauagaaguccaaaccgaaaccaccaaaacuggggacaaacuaaaagucaccaccuucgaaaugauacucgggccaaccaccaacgucgaucaagcccccuaccaaggccgcgucuaugccucgcuaaccgccgucgcgucacucgaccuugucgacggccgcgucagagccguuccccguucaaucuacggauuccaagacguuauccccgaauacaacgacggccuccuaguuccccuugcucccccgauaggccccuuccuccccggcgaaguucugcuccgcuuuagaaccuacaugcgccaacucgacaccgcugacgcugccgcagaagcaauagacugcgcccucccccaagaauuuaucuccugguucgcauccaacgccuucaccguacaauccgacgcccuccuacuccguuaccgcaacacccuaacaggacaacuccucuucgaaugcaaacuauacucagaaggcuacaucgcccucucauacuccggauccgggccccuaacauuccccaccgauggcuucuucgaaguagucucaugggucccacgccucuuccaacucgcauccgucggcucacucacaacaggccgcacccucaagcaauaa

SEQ ID NO: 36880 - RNA, 1626 nt, Artificial Sequence
  derived and/or modified sequence opt11 from capsid_protein__Norovirus__ABU55616
augcgaauguccgacggcgccgcuccaaaagccaacggcucagaagcaagcggccaagacuuaguaccaaccgccaucgaacaagccgucccaauccaaccagucgccggcucagcacucgccgcccccgccgccggacagaucaaucaaauagaccccuggaucuuccaaaauuucguccaaugcccccucggcgaauuuuccaucucaccucgaaacacucccggcgaaauccuauucgaccucgcccucggccccggccucaaccccuaccuugcccaccucuccgcgauguacaccggaugggugggcaacauggaaguacaacucguccuagcuggcaacgccuucaccgccggaaaagucguugucgcccuagucccaccauacuucccaaaagguuccuuaacuaccgcacaaauaaccugcuucccacacgucaugugcgacguccgaacacucgaaccaauccaacucccuuuacuggauguccgccgcguacucuggcacgcaacccaagaccaggaagaauccaugcgccucgucugcaugcuauacacaccccuccgaaccaacuccccaggagacgaauccuucguugucucaggccgccuacucuccaaaccagcagcagacuucaacuucguauaccuaaccccacccauagaaagaacaauauaccgcauggucgaccuaccaguccuccagccccgacucugcacccacgcgcgauggccagcccccaucuauggccuccucgucgaccccucccuacccucaaacccccaauggcaaaacggccgaguccacguagacggaacucuccucggaacgaccccagucuccggauccuggguuuccugcuuugcugcagaagccgcauacgaauuucaauccggaaccggagaagucgccacauucacacugaucgaacaagacggcuccgccuacguccccggagaccgcgccgccccacuaggcuaccccgauuucaguggccagcucgaaauagaaguacaaaccgaaaccaccaaaaccggcgacaaauuaaaagucaccacauucgaaaugauccucggccccaccacaaacguagaccaagcgcccuaccaaggcaagguauacgcaucccucgcagucgccgcaucgcuagacuuagucgacggacgcguccgugcagucccacgcagcaucuacggauuccaagacguaaucccugaauacaaugacggccuacucguaccccuugccccacccaucggaccuuuccuucccggcgaaauccuccuccgcuuccgcaccuacaugcgucagcucgacaccgcagacgcagcugcagaagccauagacugcgcccuaccccaagaguucaucucaugguucgcuuccaaugccuucacaguucaggcugacgcccuccuacuccgcuaccgcaacacccuuaccggacaacuacuauucgaaugcaaacucuacuccgaaggauacauagcacuauccuacuccggcucagcaccccuaaccuuccccacugacggcuucuucgaagucgucucauggguaccccgccuauuccaacucgccagcgucggcucccucaccaccggccgcacccucaaacaauaa

SEQ ID NO: 36881 - RNA, 1626 nt, Artificial Sequence
  derived and/or modified sequence opt11 from capsid_protein__Norovirus__ABU55619
augagaaugucggacggagccgccccgaaagccaacggcuccgaagcauccggccaagaccuagucccaacagccguggaacaagcaguccccauucaacccguagcaggcuccgcccucgccgccccugcugccggccagaucaaccaaaucgacccauggauauuccaaaacuucgugcaaugcccucuaggcgaauuuucaaucuccccucgaaacacccccggcgaaauccucuucgaccuagcccucggacccggucuuaaccccuaccucgcacaccucagcgcaauguacaccggcugggucggaaacauggaaguacaacucguacuagccggaaacgccuucaccgccggcaaggucgucgucgcccuagucccaccuuacuuccccaaaggcucacuaacuacagcccaaauuaccugcuucccccacgucaugugcgaugucagaacccucgaacccauccaacugccccugcucgacguaagacgcguccucuggcacgccacccaagaccaagaagaaagcaugcgccucguaugcaugcuauacaccccacuacgaaccaacagccccggugacgaauccuucgucgucuccggacgccuccuuucaaaaccagccgccgauuucaacuucguuuaccuaaccccacccaucgaacgcaccaucuacagaaugguagaccucccuguccuccaaccaagacucuguacucacgcacgauggccggccccaaucuacggccuacucgucgacccuagucucccaucaaacccacaauggcaaaacggccgaguccacguagacggcacccuccucggaacuacucccgucagcggcucaugggucagcugcuucgccgccgaagcagccuacgaauuucaaagcggaacaggccaagucgcaaccuucaccuuaaucgaacaagacggcucagccuauguaccaggcgaccgcgcagccccguuaggguaccccgacuucuccggccaacucgaaaucgaaguacaaaccgaaaccaccaaagccggcgacaaacucaaaguaaccaccuucgaaaugauacucggccccaccacaaacguagaccaagcccccuaccaaggacgagucuaugccucacuggcugucgcagccucacucgacuuagucgacggccgcguaagagccgucccacgaagcauccacggauuccaagacgucauacccgaauacaacgacggucuucuuguaccacucgccccacccauaggccccuuccuucccggagaaguccuacuccgcuuccgaacauacaugcgacaacucgauacagccgacgccgccgccgaagccaucgacugcgcacuaccccaagaguucauauccugguucgccucaaacgcauucaccguccaauccgacgcccuccuccuccgcuaccgaaacacccuaacaggccagcuccucuucgaaugcaaacucuacucagaaggcuacauugcacucuccuacagcggaucugggccacuuacauucccaacggacgguuucuucgaagugguaagcugggucccccgccucuuccaacuagccuccgucggaucccucgccacaggccggacccucaaacaauga

SEQ ID NO: 36882 - RNA, 1626 nt, Artificial Sequence
  derived and/or modified sequence opt11 from capsid_protein__Norovirus__ABU55622
augcgcauguccgauggagccacccccaaagcaaauggaagcgaagccuccggccaagaccuagugcccacagccguugaacaggcaguccccauacaacccguugccggcgccgcacucgccgcccccgccgcaggacaaauaaaccagaucgaccccuggaucuuccaaaacuuuguccaaugcccacuuggagaauuuagcaucuccccacgcaacacccccggcgaaauacuuuucgaccucgcacugggucccggccuaaaccccuaccucgcccaccuauccgcuauguacacaggcuggguuggcaacauggaaguacaacucguacucgcaggcaacgccuuuaccgcuggaaaaguagucgucgcauuaguaccaccauacuucccaaaaggcucauuaaccaccgcacaaaucacuugcuuuccccacguaaugugcgauguccgcacccucgaaccuauccaacuuccacuacucgacguaagacgcguccucuggcacgccacacaagaucaagaagaaucaaugcgucucguaugcaugcucuacacaccccuucgcaccaacucacccggcgacgaaucauucguagucucuggccgccuccucuccaaaccagcagcagacuucaacuuugucuaccuaaccccacccaucgaacgcaccaucuaccgcauggucgaccuccccguaauccaaccccgucucugcacccacgccagguggccugcccccguauacggccuacuuguagacccaucccuccccucaaacccccaguggcaaaacggccgagugcacguagacggcacccuccuaggcaccaccccaaucuccggcuccugggucuccuguuucgcugccgaagccgccuacgaguuccaaagcggcaccggcgaaguagccaccuucacacucauagaacaagacggcucagcauacguaccaggugaccgcgcugcaccccucggcuaccccgacuucucgggccaacucgaaaucgaaguccaaaccgaaaccacaaaaaccggcgacaaacuaaaaguaacuaccuuugaaaugauccucggcccaaccacuaacguagaccaagcccccuaccaaggccgcguauucgccagcgucaccgcagccgcgucccuagaccucgucgacggccgcguacgcgccgucccccgguccaucuacggcuuccaagacaccaucccagaauacaacgacggccuccuugucccccucgcaccucccaucggcccauuccuacccggcgaaguccuccucagauucagaacauacaugcgccaacuagauaccgcagacgcugcagcagaagccaucgacugugcccuuccucaagaguucgucucuugguuugccuccaacgccuucacaguccaauccgaagcccuacuccucagguaccguaacacacucaccggucaacuccucuucgaaugcaaacuauauuccgaaggcuacaucgcccucuccuacuccggcuccggcucccucacauucccuacagacggcuucuucgaaguaguauccugggucccucgucuauaccaacucgccucagucgguucgcucgcaacaggacgaacccucaagcaauaa

SEQ ID NO: 36883 - RNA, 1623 nt, Artificial Sequence
  derived and/or modified sequence opt11 from capsid_protein__Norovirus__ABU55628
augcgcauguccgacggagccguaccuaaggccaacggcuccgaagccuccggccaagaccucguacccaccgccguagaacaagccguuccuauccaaccugucgcaggcgcuuccaucgcugcccccgccgccggacaaauaaaccaaauagaccccuggauauuccagaacuucguccaaugcccgcuuggcgaguucuccaucagcccccgaaauaccccaggcgaaauccuauucgaccuugccuuaggccccggucugaacccauaccuagcacaccuaagcgccauguacaccggauggguaggaaacauggaaguccaacuugugcucgcaggcaaugcauucaccgccggaaaaguaguagucgcccucgucccacccuacuucccaaaaggcucccucacaaccgcacaaaucacaugcuucccacacgucaugugcgacguucgcacccuagaacccauccaacuaccccuccucgauguacgcagaguccucuggcacgccacccaggaccaagaagaauccaugcgucucgucugcaugcuauacacaccccuccgcaccaacuccccaggcgacgaauccuucgucgucuccggacgccuacuaucgaaaccagccgccgacuuuaacuucgucuaccuaacucccccaaucgaacgcaccauauaccgcauggucgaccuccccguccuccaaccucgacucugcacccacgcccgauggccagccccaaucuacggccuccucgucgaccccucucuccccagcaacccccaauggcaaaacggucguguacacguagacggaacccugcucggcaccacccccgucucuggcucauggguaucauguuucgcagcagaagccgcuuacgaauuucaaucagguaccggagaagucgcuaccuucacccuaaucgaacaagacggauccgcuuauguccccggcgaccgugccgccccgcucgguuacccagacuucagcggccaauuagaaaucgaaguccaaacagaaacaacuaaaaccggggaaaaauuaaaagucaccacauucgaaaugauccucggcccagccaccaacguagaccaagcccccuuccaaggccgcgucuacgccucacuaaccgccguagccucccucgaccuagucgauggccgcguucgagccgucccacgauccaucuacgcauuccaagacguaauacccgaauacaacgacggccuccucguaccgcucgcaccacccaucggccccuucuuaccaggcgaacuccuccuccgauucagaaccuacaugcgacaaauagacucaagcgacgcagccgccgaagcaauagacugcgcccuaccccaggaguucaucagcugguucgccucaaacgcauucaccguccaaucggaagcccuacuccuacgcuaccgcaacacccucacaggccaacuccuguucgaaugcaaacuauacuccgaaggcuauauagcuuuauccuacagcggcuccggcccccucaccuuccccgccgacggauucuucgaagucgucuccuggguccccagacuauuccaacucgcauccgucggauccagcgccaccggacggacccuaaaauaa

SEQ ID NO: 36884 - RNA, 1593 nt, Artificial Sequence
  derived and/or modified sequence opt11 from capsid_protein__Norovirus__ABW74121
augaugauggcaucuaaagacgcaaccuccuccguagauggagcaucaggcgccggacaacucguacccgagguaaacgccuccgacccccucgccauggauccugucgccggcucauccaccgccgucgccaccgcaggccaagucaaccccaucgaccccuggaucaucaacaacuucguccaagcaccacaaggugaguucaccaucucccccaacaacaccccaggcgauguacuuuucgaccucucccucggcccccaccuaaaccccuuccuccuccaccugucacaaauguauaacggcuggguaggcaacaugcgcguccgaaucaugcuagcaggcaacgccuucaccgcagguaaaaucaucgucuccugcauacccccaggauucggcucccacaaucucaccaucgcccaagcgacccucuucccacacgucaucgcagacguccgcacacuugaccccauagaagucccccucgaagacguaagaaacguccucuuccacaacaacgaccggaaccaacaaaccaugcgccucgucugcaugcucuauacaccacuucgaacuggauccggaaccggcgacagcuucguugucgccggacgaguaaugacaugcccaucccccgacuucaacuuccucuuccucguacccccaaccgucgaacaaaagacccgacccuucacucuacccaaccuuccccuuuccucccuauccaacucccgagccccacuaccaauauccggcaugggcaucucaccugacaauguccaaucaguccaauuccaaaacggccgauguacccuagacggccgccucgucggaaccacacccgucucccuaucccacgucgcgaaaauccgcggaaccucaaacggcaccguaaucaaccucaccgaacucgacgguacccccuuccacccuuucgaaggacccgcccccauagguuuccccgaccucgguggcugcgacuggcacaucaacaugacccaauuuggccacuccucacaaacacaauacgacgucgacaccacacccgacacuuucgucccgcaccucggcucaauccaagcaaacggcaucaacucuggcaauuauaucggcguccucucaugggucucucccccgucccacccauccgguucacaaguagaccucuggaaaauucccaacuacggcucauccaucaccgaagccacccaucucgcccccucagucuuucccccgggcuucggagaaguccuugucuucuucauguccaaaauaccaggccccggagcuuauucccuaccaugucucuuaccccaagaauacauaucccaccucgccuccgaacaagcacccaccgucggcgaagcggcccuccuccacuacguagacccagacaccggccgcaaccucggcgaauuuaaagccuaccccgauggcuuccucacgugcgucccaaacggcgccuccuccggcccucaacaacuccccauaaacggaguuuucguauucguaucaugggucucucguuuuuaccaacucaaacccgucggcacugccuccacagcccgcggacgacuagggcuccgaagauaa

SEQ ID NO: 36885 - RNA, 1593 nt, Artificial Sequence
  derived and/or modified sequence opt11 from capsid_protein__Norovirus__ABW74123
augaugauggccuccaaagacgccaccuccucaguagacggagccuccggcgcaggccaacuuguaccagaagucaacgccuccgacccacuagccauggaccccguugccggcuccucuaccgccgucgcaacagcaggucaagucaacccaaucgaccccuggaucauaaacaacuucguacaagcuccccaaggcgaauuuaccauuagccccaacaacacccccggagacguccuauucgaccucucccucggcccacaccucaaccccuuccuccuccaccuaucccaaauguacaacggcugggucggaaacaugcgcguccguaucaugcuagccgguaacgccuucaccgccggcaaaauuauagucucuugcauuccacccggcuucgguagccacaaccucacaauugcacaagcaacccucuucccccacguaaucgcugacguaagaacccucgaccccauagaaguaccccucgaagacguccgcaauguccucuuccacaacaacgaccguaaccaacaaacuaugcgccuagucugcaugcuuuacacuccccuacgaaccgguggaggcaccggagacuccuucguaguagcaggccgcgugaugacaugcccuucaccagacuucaacuuccuauuccuaguaccacccaccguagaacagaaaacccgccccuucacacucccaaaccucccccucagcucccucucuaacagccgcgcuccccuccccaucuccggcauggguaucucucccgacaacguccaaucaguccaauuccaaaacggcagaugcacccucgacggacgccuuguaggcaccacaccagucuccuuaucucacgucgccaaaauccgaggcaccucaaacggaaccgucauuaaccucaccgaacucgacggcaccccauuccaucccuucgaagguccagccccuaucggcuuccccgaccucggcggcugcgacuggcacaucaacaugacccaauucggccacucaucucaaacccaauacgacgucgacacaacccccgacaccuucguuccgcaccucggauccauccaagccaacggcaucaacucaggaaacuacaucggcguacuguccugggucucaccacccucccaccccuccggcucccaaguagaccuuuggaaaauccccaacuacgguuccuccaucacagaagccacccaccucgcacccucuguuuucccacccggauuuggagaaguccucgucuucuucauguccaaaauacccggccccggcgccuacucccuccccugccuccuaccccaagaauauaucucccaccucgccucugaacaagcccccacagucggagaagccgcacuacuccacuacgucgacccagacacuggccguaaucuaggagaauuuaaagccuaccccgacggcuuccuaacaugcguuccaaauggugcuuccuccgguccacaacaacuccccauaaacggagucuucgucuucgucagcuggguaucccgcuucuaccaacuaaaacccgucggcaccgcaucuacugcccgcggccgacucggccuccgccgcuaa

SEQ ID NO: 36886 - RNA, 1593 nt, Artificial Sequence
  derived and/or modified sequence opt11 from capsid_protein__Norovirus__ABW74124
augaugauggccuccaaagacgcaaccucuucaguagauggcgcgucaggagcaggccaacucgucccagaagucaacgccucugacccccuugccauggacccaguagcugguuccucaaccgccgucgcuacagcuggacaggucaacccaaucgacccauggaucaucaacaacuucguccaggcuccccaaggagaguucaccaucucacccaacaacacucccggcgacguccuauuugaccuuucccuaggcccccaccucaaccccuuccuacuccaccuuucccaaauguacaacggaugggucggcaacaugcgcguccgcaucaugcucgccggcaacgccuucacagccgguaaaauaaucguauccugcauaccacccggcuucggcucccacaaccuaaccaucgcccaagccacccucuucccccacguaaucgcagacguccgaacccucgaccccauagaaguaccgcucgaagacgucagaaacguccucuuccacaacaacgaccgcaaccaacaaaccaugcgccucgucugcaugcucuacacaccccuaagaaccggcggagguaccggcgacucuuucgucguagcuggacgugucaugaccugcccgagcccagacuucaacuuccucuuccucguaccacccaccgucgaacagaaaacccgccccuucacccuucccaaccuaccccuauccucccuuuccaacucccgagcaccccucccaaucuccgggaugggaaucuccccagacaacguacaauccguccaauuccaaaacggccgcugcacccuagacggacgccucguuggcacaacaccgguuagccucagccacgucgccaaaauccgaggaacuucaaacggcacagucaucaaccucaccgaacucgacggaacaccauuccacccauucgaaggccccgcccccauaggcuuccccgaccuaggaggcugcgacuggcacaucaacaugacccaauucgggcacuccucccaaacacaauacgacgucgacaccacgcccgacacauucgucccccaccuaggauccauccaagcaaacggaauaaacuccggcaacuauauaggaguccuauccuggguuagcccucccucccacccaucaggaucccaagucgaucucuggaaaauacccaacuacggaucaucaaucacugaagcaacacaccuagcccccucagucuucccacccggauucggagaaguccucgucuucuucaugucaaaaauucccggaccaggcgcauauucccucccaugccuacucccccaagaauacaucucccaucucgcuuccgaacaagcccccaccguaggcgaagccgcacuacuccacuacguugaccccgacaccggcagaaaccucggagaguucaaggcuuaccccgacggcuuucuaaccugcguccccaacggagcaucuucaggaccccaacaacuacccaucaacggaguauucgucuuugucuccuggguauccagauucuaccaacuaaaacccgucgggacagccuccaccgcacguggccgacucgguuuacgccgguaa

SEQ ID NO: 36887 - RNA, 1593 nt, Artificial Sequence
  derived and/or modified sequence opt11 from capsid_protein__Norovirus__ABW74125
augaugauggccucuaaagacgcaaccuccuccguugacggcgccucaggcgccggccagcuaguccccgaaguuaacgccuccgacccacucgcgauggacccagucgccggcagcucuaccgccgucgcaaccgcaggucaagucaaccccauagaccccuggauaaucaacaacuucguucaagcaccccaaggcgaauuuaccaucuccccuaacaacacacccggcgacguccucuucgaucuaucacucgguccccaccucaacccauuccuacugcaccuaucccagauguacaacgggugggucggcaacaugcgcguccgaauuaugcuugccggcaacgcauucaccgccggaaaaauaaucgucucaugcaucccacccggauucggcucacacaaccucaccaucgcccaagcuacccucuucccccacguaaucgccgacgugcgcacacucgaccccauagaagucccucuagaagacguccgcaacguacucuuccacaacaaugacagaaaccaacaaacaaugcgccucgucugcaugcucuacacaccccuccgcaccggaggggguaccggcgacuccuucguaguugcuggacgagucaugaccugcccaucccccgacuucaauuuccuuuuccuagucccuccaaccguagaacagaaaacccgcccauucacacuaccgaaccuaccccucuccucccuuuccaacucacgagcccccuuacccaucuccggcauggguaucucgcccgacaacguccaaagcguccaauuccaaaacggccguuguacccucgacgggcgccucgucgguacaacccccgucucccuaucacacguagccaaaauacgcggaaccucaaacggcaccgucaucaaccucaccgaauuggacggaacccccuuccaccccuuugaaggaccagcccccaucggcuuccccgaccuaggcggcugcgacuggcacaucaacaugacccaauucgggcacucaucacaaacucaauaugacgucgacacaacucccgacaccuuugucccucaccuaggcuccauccaagccaauggcauaaacuccgguaacuacaucggcguacuaucaugggucucgccacccucccaccccagcggcucucaagucgaucucuggaaaauccccaacuacggcucauccaucaccgaagccacccaccucgcccccuccgucuucccuccuggcuucggcgaaguccugguauucuucaugucuaaaaucccgggucccggcgcauacucccuccccugcuuacucccacaagaauacaucagccaccuggccucagaacaggcccccacagucggugaagccgcacuacuccacuacgucgacccagacaccggacgaaaucucggcgaauuuaaagccuaccccgacggcuuccuaaccugcguacccaacggcgcauccucugguccccaacaacuaccaaucaacggcgucuucgucuucguauccuggguaucccgcuucuaccaacuaaaacccgucggaaccgcauccacagcucgcggacgauuaggccuacgccgauaa

SEQ ID NO: 36888 - RNA, 1593 nt, Artificial Sequence
  derived and/or modified sequence opt11 from capsid_protein__Norovirus__ABW74126
augaugauggcaagcaaagacgcaaccuccuccguugauggagccucaggugccggccaacucgucccagaagucaacgccuccgacccccuagccauggaccccgucgccggcucauccaccgcagucgccaccgccggccaaguaaaccccaucgacccuuggaucaucaacaauuucguacaagccccacaaggcgaguucaccauaagccccaacaacacccccggcgacguccuauucgaccuaucccucggaccccaccuaaaccccuuccuccuacaccuaagccaaauguacaacggauggguuggaaacaugagaguccgcauaaugcucgcaggcaacgccuuuaccgcaggcaagaucaucgucucuugcaucccacccggauucgggucucacaaccuaacuaucgcacaagcaacccucuucccccacguaaucgcagacguccgcacacuagaccccauagaaguuccccucgaagauguccgcaacguucucuuccacaacaacgaucgcaaccaacaaacaaugcgucuagucugcaugcucuacacaccccuccgaaccgguggcggcaccggcgacuccuucgucguagcaggacgaguaaugaccugcccguccccagauuucaacuucuuauuccuaguaccacccaccgucgaacagaaaacccgucccuuuacccuccccaaccucccccucucgucacucucaaauucccgcgcgccccuacccauaagcggcaugggaaucucgcccgacaacguccaauccguacaauuccaaaacggccgaugcacccuggacggacgccuagucggcaccacucccguaucucucagccacguugccaaaauccgcgggaccucaaacggcaccgucauaaaccucaccgaacucgacggaaccccauuccaccccuucgaaggacccgcccccaucggcuuccccgacuuaggcggcugcgacuggcacaucaacaugacccaauucggacacucaagccaaacacaauacgacgucgacaccacccccgacaccuucgucccccaccuaggaucaauccaagcaaacggcauaaacuccggcaauuacaucggcgugcuaucuuggguaucgcccccaucccauccauccggcucccaaguagaccucuggaaaauccccaauuacggauccuccauaacagaagccacccaccucgccccaucagucuucccaccaggcuucggagaaguccucgucuucuucaugagcaaaauacccggccccggcgccuacucgcuacccugccuccucccacaagaauacauaucccaccucgcaucagaacaagcccccaccgucggagaagccgccuuacuccacuauguagacccagacacaggccgaaaccuaggcgaguucaaagccuaucccgacggauuccucacaugcgucccaaacggcgccuccucaggaccacaacaacuccccaucaacggcguguucguguucguauccuggguuucacgauuuuaccaacuaaaaccagucggcacagccucgaccgcccgaggcagacucggacuccgacgauga

SEQ ID NO: 36889 - RNA, 1593 nt, Artificial Sequence
  derived and/or modified sequence opt11 from capsid_protein__Norovirus__ABW74127
augaugauggccuccaaagacgcaaccucaagcgucgacggcgccuccggcgccggccaacucgucccagaagucaaugccucugacccucuagccauggaccccguagccggauccuccaccgccguagcaaccgcaggccaagucaaccccauagacccauggaucaucaacaacuucguacaggcaccacaaggagaauuuaccauuagcccaaacaacacccccggagacguacuauucgaccuuucucucggcccccaccucaacccauuccuccuccaccuuucacaaauguacaacggcuggguaggaaacaugcgcguacgcaucaugcucgcaggcaacgcauucacagccggaaagaucauaguaucaugcaucccacccggcuucggcucacacaaccuuacaauugcccaagccacccucuucccacacgucaucgcggacgucagaacccucgacccaauagaagucccucuagaagacguccgcaacguacuauuccacaacaaugaccgcaaccaacaaacaaugcgccuagucugcaugcucuacacuccccuccgaacaggaggaggcacuggcgauuccuucgucgucgcuggccguguuaugacaugccccucccccgacuucaacuuucucuuccuaguacccccaacagucgaacagaaaacucguccauucacccuccccaaccuaccccucagcucacucuccaacucccgagcuccccuucccauauccggaaugggcauuagccccgacaauguccaaucaguccaauuccaaaacggcagaugcacccuagacggccgccuugucggaacuacccccgucuccuuaucccacgucgccaaaauacgcggcaccucuaauggcaccguaauaaaccucaccgaacucgacggaaccccauuccacccguucgaaggacccgccccaaucggcuuucccgaccucggcggcugcgacuggcacaucaacaugacacaauucggucacuccucccaaacccaauacgacgucgacaccaccccugacaccuuuguuccccaccucgguucuauccaagccaacggcaucaacucaggcaacuacaucggcguccuauccugggugucaccacccucccaccccagcggaucacaggucgaccuuuggaagauucccaacuacggaucaucaaucacagaagccacccaccucgcuccaucaguauucccacccggcuuuggcgaaguccuagucuucuucaugagcaaaauccccggaccaggcgcauacucccucccaugccuccuaccacaagaauacaucucccaccucgccagcgaacaagcccccacagucggcgaagccgcccuccuccacuacgucgaccccgacaccggccgcaaccucggcgaguucaaagcauaccccgacggauuccuaaccugcguccccaacggagcauccucaggcccacaacaacuacccaucaacggcgucuucgucuucgucagcugggucucccgcuuuuaccaacucaaacccgucggaaccgccucaaccgcacgaggccgccuaggucuacgacgcuaa

SEQ ID NO: 36890 - RNA, 1593 nt, Artificial Sequence
  derived and/or modified sequence opt11 from capsid_protein__Norovirus__ABW74128
augaugauggccuccaaagacgccaccucaucggucgacggugcaucuggcgcaggacaacucgucccagaagucaacgccucagacccacucgcaauggacccagucgcaggcuccucuaccgccgucgcaaccgccggacaaguaaacccaaucgaccccuggaucaucaauaacuucguccaagcgccccaaggcgaauuuacaauuucccccaacaacacccccggcgacguccuuuucgaccucucucucggcccccaccucaacccauuccuccuacaccucagccaaauguacaacggcugggucggcaacaugcguguccgcaucaugcuggccgguaacgcauucaccgcaggaaaaaucaucguaucaugcaucccacccgguuucggcucccacaaucucaccaucgcccaagcaacccucuucccccaugucaucgccgacguacgcacccucgaccccauagaagucccauuagaagaugucagaaacguacuuuuccacaacaacgacagaaaccaacaaacaaugagacuuguuugcaugcuauacacaccccuccguaccggcggaggcaccggagacuccuucgucguagccggucgcgucaugacaugccccucaccggacuucaacuuccucuuccuagucccacccaccgucgaacagaaaacucgccccuucacucuccccaaccuaccacucagcagccucucaaauucacgugcaccccuaccuaucucuggaaugggcaucuccccugacaacguacaauccguccaauuccagaacggacgcugcacccuagacggccgccucgucggaaccacccccgucucccucucccacguagccaaaauccgcggaacuucaaauggcaccguaauaaaucucacagaacucgacggcacgcccuuccaccccuuugaaggacccgcccccaucggcuuccccgaccucggaggcugcgacuggcacaucaacaugacccaauucggacacuccucucaaacccaauacgacgucgacaccacucccgacacauucgucccucaccuaggcuccauccaagccaacggaauaaacuccggaaacuacauaggagugcucuccugggucuccccucccucacacccuuccgguucacaagucgaccucuggaaaauccccaauuacggcuccucaauaacagaagcgacccaccuugccccaucagucuucccacccggcuucggcgaaguccuaguauucuucauguccaaaauccccggccccggcgccuacucccucccuugccuucuaccgcaagaauacaucagccaccucgccuccgaacaagcccccaccgucggcgaagccgcccuccuccacuacgucgaccccgacaccggccgcaaccucggugaguucaaagccuaccccgacggauuccuuaccuguguccccaacggugccuccucuggaccccaacaacuccccaucaacggcgucuucgucuucgucagcugggucucccgauucuaccaacuaaaaccaguggggaccgccuccaccgcacgcggccgccucggucuucgccgcuaa

SEQ ID NO: 36891 - RNA, 1620 nt, Artificial Sequence
  derived and/or modified sequence opt11 from capsid_protein__Norovirus__ABW74532
augaaaauggcuucaucagacgccaaccccagcgacggaucagccgccaaccucguccccgaggugaacaaugaaguuauggcccucgaacccgucgucggugcagccaucgcagccccaguugcaggacaacaaaacaucaucgacccguggauaagaaauaauuuuguacaagcaccaggcggagaauuuaccguaagcccccguaacgcaccaggcgaaauacuaugguccgcaccccuaggcccagaccucaacccuuaccugucccaucuauccagaauguacaacggauacgccggcggauucgaaguccaaguaauacucgccggcaacgcauucacagccggcaaaaucaucuucgccgccgucccacccaacuuccccaccgaaggccucagcccaucacaagucaccauguucccccacguuaucguagacguacgucaacucgaacccguccuaaucccucucccugacguacgcaacaacuuuuaccacuacaaccaagcccacgaccccacaaucaaacuaauagccaugcucuacacaccccuccgcgcaaacaacgccggcgacgacgucuucaccgucuccugccgcguucucaccagaccguccccugacuucgacuucaucuuccuagucccucccaccguggaaucacgcaccaagcccuucaccguuccaauacuaaccgucgaagaaaugagcaacucccgcuuucccauaccccuagaaaaacuauacaccggcccauccagcgacuucgucguccaaccacagaacggcagaugcacaaccgacggcguccuacucggcaccacccagcucuccgccguaaacauauguaacuucaaaggcgacgucacccauaucgccggaagccgugacuaccgaaugaaccuaguuucucaaaacuggaacaacuacgauccaaccgaagaaauccccgcaccccucggaacccccgacuuucagggcaaaauccaaggccuccuaacccaaaccaccggugccgacggaagcacccgagcccauaaggccacagucucaaccggcgccgccaacuuuacacccaaacucggauccguacaauucaccacugacaccgauaacgauuuccaaacaggacaaaacacaaaauucaccccugucggaguaauccaagacggaagccaccaucaaaacgaaccacaacaauggguccuaccaaacuacuccggucgcaccguacacaacguccaccuagcccccgccgucgccccaaccuucccaggcgaacaacuccucuuuuuccgcucaaccaugccaggcugcucaggcuaccccaacaugaaccucgacugccuacucccccaagaaugggugaugcacuucuaccaagaggccgccccagcacaaucagacgucgcacuccuccguuucgucaaccccgacaccggacgcguccuauucgaaugcaaacuccacaaagccggcuacaucacagucgcucacacaggccaacacgaccucgucauacccccaaacggauacuuccgcuucgacuccugggucaaccaauucuacacccuagcaccgaugggaaacggugccggccgccgccgugcacucuaa

SEQ ID NO: 36892 - RNA, 1620 nt, Artificial Sequence
  derived and/or modified sequence opt11 from capsid_protein__Norovirus__ABW74533
augaaaauggccuccaacgacgccaacccuucagauggauccaccgccaaccucgucccagaaguuaacaacgagguuauggcauuagaacccgucgugggcgcugcaaucgccgcacccgucgcuggccaacaaaauguaaucgaccccuggaucagaaacaacuuuguccaagcccccggcggcgaguucacagucucaccacggaacgccccaggcgaaauacucuggucagcaccccucggaccagaccucaaccccuaccucucccaccucgcccgcauguacaacggguacgccggcggcuucgaaguucaagucauccucgcaggcaacgcauucacagcgggaaaaaucaucuucgccgcagucccaccaaacuucccuacagaaggccuaucacccucccaagucacaauguucccacacauaauagucgacguccgccaacucgaacccguccuuaucccacuccccgacguccguaacaacuucuaccacuacaaccaauccaacgacuccacaaucaaacucauagccaugcucuacacaccccuccgcgccaacaacgccggcgacgacguuuucaccgucucaugccgcguccuuacccgccccuccccagacuucgacuucaucuuccucguaccacccaccgucgaaucccgaacaaaacccuucacaguccccauccucacagucgaagaaaugucuaacucccgauuccccauuccccuagaaaaacuauacaccggccccucauccgccuucgucguccaaccacaaaacggacguugcaccaccgacggcguucuucucggaaccacccaacucuccgcagucaacauaugcaccuuccgaggcgacguuacacauaucgcuggaucucaugacuacaccaugaaucuagcaucccaaaauuggaacaacuacgacccuaccgaggaaauacccgcuccccucggcacccccgacuucguuggcaaaauucaaggcaugcucacccagaccacacgaggagacggcucuacccgagcccacaaagccacaguaucaacgggcuccguccacuucaccccaaaacucggguccguccaauucacuaccgauaccaacaacgacuuccaaaccggccaaaacaccaaauucacaccaguuggagugauacaagacggcgacaaccaccaaaacgaaccacaacaauggguccuccccaacuacuccggacguacuggccacaacguacaccuugcaccagccguugcucccaccuuccccggcgaacaacucuuauuuuuccgauccaccaugccaggcugcuccggauacccaaauaugaaccucgacugccuccuaccccaagaauggguccaacacuucuaccaagaagccgcccccgcacaaucagacgucgcccuccuccgcuucgucaaccccgacacuggccgcguacucuucgaaugcaaacuccacaagucuggauacgucaccgucgcccacaccggcccacacgaccuugucaucccgcccaacggcuacuuccguuucgauagcugggucaaccaauucuacacucucgcacccaugggcaacggcaccggccggcgccgagcgcucuaa

SEQ ID NO: 36893 - RNA, 1623 nt, Artificial Sequence
  derived and/or modified sequence opt11 from capsid_protein__Norovirus__ABW74534
augaaaauggccucaaacgacgcaucccccucugacggcuccaccgccaaccuaguacccgaaguaaacaaugaaguaauggcacucgaacccguggucggcgccgccauagcagccccagucgcaggacaacaaaacgucaucgacccauggauacgcaacaacuucguccaagcacccggcggcgaguucaccguaagcccacgcaacgccccuggcgaaauccuaugguccgcuccccucggcccagaucuaaacccauaccuuucacaccuagcccgaauguacaacggcuacgcgggcggauucgaaguacaagucauccuagccggaaacgccuuuaccgccggcaaaaucaucuucgccgcuguaccucccaacuuucccaccgaaggcuuaucccccucccaaguaaccauguucccccacauuaucguugacguacgccagcucgaacccgugcuaaucccuuuaccagacguccgcaacaacuucuaccacuacaaccaaagcaacgaccccaccauaaaacucauugccaugcucuacacaccccuacgagcgaacaacgccggcgacgacgucuucacaguaucaugccgaguacuuacccgacccucccccgacuucgacuuuaucuucuuaguaccacccacgguagaaucccgaacccgccccuucacaguccccauccucaccgucgaagaaaugacgaacucccgauuccccaucccccuagaaaaacucuucaccggccccuccggagccuucgucguacaaccccaaaacggccgcugcaccaccgacgguguccuccucggcacaacccagcucuccccagucaacaucuguaccuucagaggagacguuacccacauugccggcacccacgacuacaccaugaaccucgccucccaaaacuggaacaacuaugaccccacugaagaaauaccugcaccacuaggcacacccgacuucguaggcaaaauccagggcguccucucccaaacuacccgcggagacggcuccacccgcggccacaaggccacagucuccacagguagcguucacuuuacacccaaauuaggaucaguccaauucaccacagacaccaacaacgaccucgaaaccggccaaaacaccaaguucacccccguaggaguuguacaagacgguaacuccacccaccagaacgaaccccaacaauggguacuacccaacuacagcggacggaccggccauaacguucaccuagccccagcaguggccccaacuuucccaggagaacaacuccucuuuuuccgcucuaccaugccaggcugcuccggcuacccaaacaugaaccuugauugccuccucccccaagaauggguccaacacuucuaccaggaagccgccccagcccagucagacgucgcacuccuccgcuucgucaaccccgacacuggccgaguauuauucgaaugcaaacuccacaaauccggcuacguuaccgucgcacacaccggacagcacgaccucgucauaccucccaacggcuacuuuagauucgacuccugggucaaccaauucuacacccucgcacccaugggaaacggagccggccgccgccgagcacucuga

SEQ ID NO: 36894 - RNA, 1623 nt, Artificial Sequence
  derived and/or modified sequence opt11 from capsid_protein__Norovirus__ABW74535
augaaaauggccuccaacgacgccaacccaucagauggcucgaccgccaaccucguacccgaaguaaacaacgaagucauggcccucgagccaguaguaggugccgccauagccgcccccgucgcaggccaacaaaacgucaucgacccuuggauacgcaauaacuucguccaagccccaggcggcgaguucaccguuaguccccgcaacgcccccggugaaauucucugguccgcaccccucggcccagaccucaaccccuaccucucccaccuugcccgaauguacaacggauaugccggcggauucgaaguccaagucauccucgccggcaacgccuucaccgccggaaagaucauauucgccgccguacccccaaacuuccccaccgaaggccuauccccaucccaagucaccauguucccucacaucauugucgacguccgucaacuagaaccuguccuaaucccacuacccgacgugcgaaacaacuucuaccauuacaaccaaucaaacgaccccaccaucaaacucaucgccaugcucuacaccccgcuccgcgccaacaacgccggcgaggacguauucaccgucuccugccgaguacucacccgccccagucccgacuucgacuucauauuccuagucccacccaccgucgaaucccgcacaaagccauucacaguaccaauccuuaccgucgaagaaaugaccaacagcagauucccaauaccacuugaaaaacucuucaccggucccuccggagccuucguaguccaaccccaaaacggacgcugcaccaccgacggcguccuccucggcaccacacaacucucccccgucaacaucugcacauuccgaggagacgucacucacauagccggaacccacaacuacaccaugaaccucgcaucccaaaacuggaacaacuacgauccuaccgaagaaaucccugcaccccucggaacgcccgacuucguuggacgcauccaaggcaugcuaacccaaaccacgcgcggcgacggcuccaccagaggucacaaagcaaccgucucaaccggugacguacauuucacccccaagcucggcucaauccaauucaacaccgacaccaacaacgacuucgaaaccggccaaaacacccgauucacucccgucggaguaguacaagacggcaacggcacccaccagaacgaaccccaacaauggguccucccauccuacuccggacggacuggacacaacguccaucuagcccccgcagucgcccccaccuucccaggagaacaacuccuauucuuccgaucuaccaugcccggcugcucgggcuacccaaacaugaaccucgacugccuccuuccucaagaauggguccaacacuucuaccaagaagccgcacccgcccaaucagacguugcccuccuacguuucguaaaccccgacaccggacgcguccuauucgagugcaaacuacauaaaaguggcuacgucaccgucgcccacaccggacaacacgaccuaguaauacccccaaacggcuacuuccgguucgacagcuggguaaaccaauucuacacccucgcaccaaugggcaacggcaccggacgccgccgcgcccuauag

SEQ ID NO: 36895 - RNA, 1620 nt, Artificial Sequence
  derived and/or modified sequence opt11 from capsid_protein__Norovirus__ABW74536
augaaaauggcaagcucagacgcaaaccccucagacggaucaacagcaaaccucgucccagaagucaacaacgaagucauggcccuagaaccagucgucggcgcugcuaucgcagcccccgucgccggccaacaaaacgucauagaccccuggauacgaaacaacuucguacaagcaccuggaggcgaguucaccgucucccccagaaacgcacccggcgaaauacucugguccgcgccccucggaccugaucucaaucccuaccucucacaccucgccagaauguacaacggcuacgccggcggcuucgaaguccaaaccauccucgccggcaacgccuucacagcaggcaaaauaaucuucgccgccguaccucccaacuuccccaccgaaggccucucccccucccaagucaccauguucccccacaucauugucgacguacgccaacucgaacccguccuaauaccccuaccggacguccgaaacaacuucuaccacuacaaccaauccaaugaccccacuaucaaacucauugccaugcuauacacaccccuccgcgcaaauaacgccggcgaugacgucuucaccguauccugcagaguucuaacccgaccaucccccgacuucgacuucauauuccucgucccacccaccgucgaaucacgcacaaaacccuucaccguacccauccucacugucgaagaaaugucaaacuccagauuucccaucccccuagaaaaacuauacaccggccccucauccgccuucguuguucagccacaaaacggacgcugcacaaccgacggaguccuccucggcaccacccaacuuucagcaguaaacaucugcaccuuccgaggagacgucacccacaucgccgguucccacgacuauaccaugaaccucgccucacaaaacuggaacaacuacgaccccaccgaggaaaucccagcaccccuugguacccccgacuucgucggcaaaauccaaggaaugcuuacccaaaccacccgcgaggacggcuccacccgugcccacaaagcaaccgucuccacaggaagcguccacuucacccccaaacuaggcuccguucaauacaccacugacaccaacaacgacuuccaagcaggccaaaacaccaaauucaccccugucggagucauucaggacgguaauaaccaccaaaacgaaccccaacaauggguacuacccaacuauucaggccgaacaggccacaacguucaccuagcucccgccguagcucccacuuuccccggagagcaacuccucuuuuuccguagcaccaugccaggcugcuccggcuaccccaacaugaaccucgacugccuccucccacaagaguggguccaacacuucuaccaagaagccgccccugcccaauccgacguagcccuacuccgauucguaaaucccgacaccggucgcguacucuucgaaugcaaacuacacaaaagcggcuacgucacagucgcccacaccggaccccacgaccucgucaucccgcccaacggauacuuucgcuucgacuccugggucaaucaauucuacacacuagcacccaugggcaacggaacaggacgccgacgcgcacuguaa

SEQ ID NO: 36896 - RNA, 1623 nt, Artificial Sequence
  derived and/or modified sequence opt11 from capsid_protein__Norovirus__ABW74537
augaaaauggcaagcaacgacgccuccccauccgacggcuccacggcaaaccucguccccgaagucaacaacgaagucauggcccuugaacccguaguaggcgcagccauugcggcacccgucgccggccaacaaaacguaauugaccccuggauccgaaacaacuucguccaagcccccggaggugaguucacagucucuccucgcaacgcccccggagaaauccucugguccgcaccccucggaccagaccucaaccccuaccuaucccaccucgccagaauguacaacggcuaugccggcgguuucgaaguccagguaaucuuagccggcaacgcuuucacagcuggcaaaauuauuuucgccgcaguacccccaaauuucccaaccgaaggccucucccccucacaagucacuauguucccacauauaaucgucgacguccggcaacuggaaccaguccuaauaccacuccccgacguccgcaacaacuucuaccacuacaaccaaucuaacgaccccacaaucaaacucaucgccaugcuauacaccccacuccgagccaauaacgccggagaugacguauucaccgucucaugcagaguccucacacgccccuccccagacuucgacuucaucuuccucguaccacccaccgucgaaucccgaaccaaacccuucaccguccccauccuuaccgucgaagaaaugacaaacagccgcuuccccauaccacuggaaaaacucuuuaccggccccucgagcgccuucgucguccaaccccagaacggccgcugcaccaccgacgguguccuacuugguaccacccaacuguccccagucaacaucugcacauuccgcggcgacgucacccauaucccaggcaccagaaccuaucgcaugaaccuugcgucccaaaacuggaacaacuaugaccccaccgaagaaauccccgcaccccucgguacccccgauuucgucggaaaaauacaaggaaugcuaacccaaacaacuaaaggcgacggcucuacaagaggccacaaagccacagucuccacaggcucagucgacuuuacccccaaacuaggcuccguccaauucgccaccgacaccgauaacgacuucgaaaccggacaaaacacccgcuucacccccgucggcguaauccaagacggauccuccgcacaccguaacgaaccccagcaauggguacuccccgacuacuccggccguaccguccacaacguacaccuagcccccgcaguugccccaacuuuccccggcgaacaacuccuuuucuuccgcuccacuaugccaggcugcuccggauaccccaacauggaucuagacugccuacuaccccaagaauggguacaacacuucuaccaagaagccgcacccgcucaaagcgacguagccuuacuccgcuucgucaaccccgacaccggaagaguccucuucgaaugcaaacuacacaaaaccggcuacgucaccguagcacacaccggacagcacgaccuaguuauacccccaaacggcuacuuccgauucgauaguuggguuaaccaauucuacacacuagccccaaugggcaacggugcaggccgccgccgcgcacucuaa

SEQ ID NO: 36897 - RNA, 1623 nt, Artificial Sequence
  derived and/or modified sequence opt11 from capsid_protein__Norovirus__ABW74538
augaaaauggccucaaacgacgccucccccuccgacggcuccaccgccaaccucguccccgaagucaauaacgaagucauggcauuagaacccgucgucggcgcagccauagccgcacccguagccggccaacaaaacguaauagacccauggauacgauccaacuuuguccaagcccccggcggcgaauuuacugucucuccccgcaaugccccgggcgaaauccucugguccgccccacugggcccugaccuuaacccuuaccucucccaccucgcccgcauguacaacggcuacgcaggcggauucgaaguccaaguaauacuagcaggcaacgcguucaccgcuggcaaaaucaucuucgccgcagugccaccaaacuuccccaccgaaggccucuccccaucccaagucaccauguucccccacaucaucguggauguccgccaacuagaaccaguccucaucccacuacccgacguccgaaacaacuucuaccacuacaaccaacucaacgacccaaccauaaaauuaaucgccaugcuuuacacaccccuccgugccaacaacgccggugacgacgucuucaccgucuccugccgcguucucaccaggcccucccccgacuucgacuucauauuccuagucccacccaccguagaaucacgaacaaaacccuucaccguccccauccucacagucgaagaaaugacaaacucccgauuccccauaccucuugaaaaacucuucaccggcccaagcggagccuucgucguacaaccccaaaacggccgcugcacaacagacggaguccuccuaggcacaacccagcucucucccgucaauauuugcacuuuccgaggagacgucacccacauagcaggaacacacgacuacaccaugaaccucgcuucccaaaacuggaacaauuacgacccaacugaagaaaucccagcaccccucgggaccccagacuucgucggcaaaauccaaggaguacucacccaaacuacccgcggcgacggcagcaccagaggacacaaagccaccguaucuacaggcuccguacacuucaccccaaaacugggcuccguccaauuuacaaccgauaccaacaacgaccucgaaaccggccagaacacccguuucacacccgucggcgucguacaagacggaaacuccacacaccaaaacgaaccacaacaauggguacucccaaacuacuccggccgugccggacacaacguccaccucgcaccagccgucgcccccaccuucccaggcgaacagcugcuuuucuuccgcuccacaaugcccggcugcucaggcuaccccaauaugaaccucgauugccuacucccccaggaauggguacagcacuucuaccaagaagccgcaccagcccaguccgacguggcacuacuacgcuucgucaaccccgacacaggacgcguccuauucgaaugcaaacuccacaaaucaggcuacguaaccgucgcccacaccggccaacacgaccuagucaucccacccaacggcuacuuuagauucgacuccuggguaaaccaguucuacacacucgcgcccaugggaaauggcgccggacgacgccgcgcacucuga

SEQ ID NO: 36898 - RNA, 1623 nt, Artificial Sequence
  derived and/or modified sequence opt11 from capsid_protein__Norovirus__ABW74539
augaaaauggccuccaacgacgcaaacccuucagacggcagcacagccaaccucguccccgaagucaacaacgaagucauggcucuagaacccguaguaggggccgcaauagccgccccaguagccggacaacaaaacguaauagaccccuggauccgcaacaacuucguccaagcccccggcggcgaguucaccgucagcccgcgcaacgcacccggcgaaauacucuggucagccccgcuaggcccugaccucaaccccuaccucucacaccucgcacgcauguacaacggauacgccggcggauucgaaguccaagucauccuugcaggaaaugccuucacagccggaaaaauaaucuucgcugccgucccucccaacuuccccaccgaaggccucucacccucccaaguaaccauguucccccauauaaucgucgacguucgccaacuugaacccguacucaucccacuccccgauguccgaaacaacuuuuaccauuacaaccaaaguaaugacucaacuaucaaacuaauagccaugcucuacacaccccuacgcgcuaacaacgccggugacgacguauucaccguauccugcagaguccuaacccgaccaucccccgacuucgacuucaucuuccucguuccaccgaccguagaaagcagaaccaaacccuucaccguacccauccuaacagucgaagaaaugacaaacucucgauuccccaucccacuugaaaaacuuuucaccggacccuccggcgccuucguaguccaaccccaaaacggccgcugcacgacagacggcguccuccucgguacaacacaacucuccccaguuaacaucugcaccuuccgaggagacgucacccacaucgccggcacucgcaacuacacuaugaaccuagccagccaaaacuggaacaacuacgaccccacagaagaaaucccagcuccgcucggaacacccgacuucgucggacgcauacaggguaugcucacccaaaccacccgacgcgacggaucaacccgcggacacaaagccaccguuuccaccggcgacgcccacuucacucccaaacucgguuccauaauguuuuccaccgacacagacaaugacuucgaaacaggacaaaacacaaaguucaccccagucggaguaguccaagacggcaacggcacgcaccaaaacgaaccccaacaauggguccugcccuccuacuccggccgcaccggccacaacguccaccuugcacccgccguagccccuacauuccccggcgaacaacuacuauucuuccgcucaaccaugcccggcugcuccgguuacccaaacaugaaccuggacugucuucucccacaagaauggguccaacacuucuaccaggaagcagccccagcacaauccgacguugcucuccuacgauucguuaacccugacaccggccgaguccucuucgaaugcaaacuccacaaaucaggauacgucaccgucgcucacaccggccaacacgaccucgucaucccacccaacggcuacuuccgcuucgacuccugggucaaccaauuuuacacccuagcacccauggguaacggcacaggccgacgacgggcccucuga

SEQ ID NO: 36899 - RNA, 1623 nt, Artificial Sequence
  derived and/or modified sequence opt11 from capsid_protein__Norovirus__ABW74540
augaaaauggccagcaacgacgcuacaccaucagacggcuccaccgccaaucuaguacccgaagucaacaaugaagucauggcccucgaaccugucgucggcgccgcaaucgcugccccuguagcaggacaacaaaauguaaucgaccccuggauacgaaacaacuuuguccaagcccccgguggcgaguucaccgucucaccccgcaacgcccccggcgaaauacuuugguccgcaccacucggccccgaccucaaccccuacuuaucccaccucgcccgcauguacaacggauaugccggaggcuucgaaguccaaguaauccuagccggaaacgccuucacagcaggcaaaauuaucuucgcagccguacccccuaauuucccaaccgaaggacuaucccccucccaggucacaauguucccccacauaaucgucgacguccgccaacucgaaccuguccucaucccccuaccugacguccgcaacaacuucuaccacuacaaccaaagcaacgaccccacaaucaaacuaaucgccauguuauauacuccccuccgcgccaacaaugccggcgacgacgucuucacaguauccugccgcguacucacacgcccaucccccgacuucgacuucauauuccucgucccuccaacaguugaaucucgcaccaaaccuuucagcguacccauccucaccguagaagaaaugaccaacucucgcuucccuaucccccuagaaaaacucuucaccggcccaucuuccgcuuucguaguccaaccccaaaacggaagaugcaccaccgacgguguccuucucgguaccacccaacuauccccugucaacaucugcaccuucagaggcgacgucacccacaucgcuggcacccaaaacuacaccaugaaccuagccucucaaaacuggaacaacuaugaccccaccgaagaaauacccgccccacucggcacaccggacuucguaggaaaaauacaaggcguccuaacccaaaccacccgccgagacggcucaaccagaggccauaaagcaaccguuuccaccggcuccgugcauuucaccccaaaacuaggcuccguccaauucuccacagacacgucuaaugacuucgaaacaggccaaaacacucgcuucacccccgucggcguaguccaagauggcuccacuacccaccaaaacgaaccccaacaauggguacuacccgacuacucuggccgagacucucacaacguccacuuagcaccagccguugcccccacuuucccaggcgaacaacucuuauucuuccgauccacaaugcccggcugcucagguuaccccaacaugaaccucgacugccuacuuccccaagaguggguccaacauuucuaccaagaaagcgcccccgcccaauccgacguagcccuccuccgauuugucaaccccgacaccggcagaguccucuuugaaugcaaacuucacaagucagguuacgucaccguggcacacaccggccaacacgaccucguaaucccaccaaacggcuacuuucgauucgacucuugggucaaccaauucuacacccuagcccccaugggaaacggcgccggacgucguagagcccucuag

SEQ ID NO: 36900 - RNA, 1623 nt, Artificial Sequence
  derived and/or modified sequence opt11 from capsid_protein__Norovirus__ABW74541
augaaaauggccuccaacgacgcgacacccuccgacggcucaacagcaaaccuaguccccgaaguaaauaacgaaguaauggcccucgaacccgucgucggagccgccaucgccgcccccgucgcuggacaacaaaacgucaucgaccccuggauucgcaacaacuucguccaagccccaggcggcgaauuuaccgucucuccucgcaacgccccaggcgaaauccuaugguccgcaccucucggcccagaccucaacccguaccuaagccaccucgcccgcauguacaacggguacgcuggaggcuucgaaguccaagucauacucgcagguaacgccuucaccgcagguaaaaucaucuucgcagccguuccucccaacuuccccaccgaaggacuuucccccucccaagucaccauguucccccacauuaucguagacguccgccaacucgaacccguucucauuccucuacccgauguccgcaacaacuuuuaccauuauaaccaauccaacgaccccacaaucaaacugaucgccaugcuauacacgccacuacgugcuaacaaugccggcgacgacguauucaccguaucuugccgcguccucacccgacccuccccagacuucgacuucaucuuucucguacccccaacagucgaaucucgcacaaaacccuuuucagucccaauacucaccgucgaagaaaugaccaacuccagauucccaaucccacucgaaaaacucuucacuggcccauccagcucauucgucguacaaccacaaaacggccgcugcaccacagacggcguccuacucggcaccacucaacucucccccguaaacaucugcacauuccgaggcgacgucacccacaucgcaggcacacaaaacuacaccaugaaucucgccucacaaaauuggaacaacuaugaccccacugaagaaauacccgcccccuuaggcacgcccgacuuuguaggcaaaauccaaggcguccucacccaaaccacucgaggcgacggcucuacacgcggccacaaagcaacagucucaaccggaucuguacacuucacacccaaacucggcuccguccaauucuccaccgacacaucuaacgacuucgaaaccggacaaaacaccagauucacacccgucggcguaguacaagacggauccaccacgcaccaaaacgaaccacaacaguggguacucccagacuacuccggacgcaacucccacaacguccaccuugcucccgcaguagccccaacauuuccgggcgaacagcuacucuucuuccgcuccacuaugccaggcugcuccggcuaccccaacaugaaucuugacugccuccucccacaagaauggguccaacacuucuaccaagaaucagcccccgcccaaucagauguugcccuacuccgcuucgucaaccccgacaccggccgcguccuguucgaaugcaaauuacacaaaucgggcuacgucacugucgcccacacaggucaacacgaccucgucauaccacccaacggcuacuucagauucgacuccugggucaaccaauucuacacacucgcucccaugggaaacggcgccggccgccgacgcgcucucuaa

SEQ ID NO: 36901 - RNA, 1623 nt, Artificial Sequence
  derived and/or modified sequence opt11 from capsid_protein__Norovirus__ABW74542
augaaaauggcuucaaacgaugccaacccaagcgacggcucagccgcaaaccuaguccccgaagucaacaaugaagucauggcccucgaacccgucgucggcgccgcaauagccgcaccaguagccggacaacaaaacgucaucgaccccuggauccgaaacaacuucguucaagcuccaggaggcgaguucaccgucagcccccgaaaugcacccggcgaaauacuaugguccgccccacuaggccccgaccuaaacccauaccuaucccaccuggcacgaauguacaacggcuacgcgggcggguucgaaguccaaguaauccucgcaggcaacgcuuucaccgccggcaaaaucaucuucgccgcagucccaccaaacuucccaaccgaaggacucucccccucccaagucacuauguucccccacauaaucgucgacgugcgccaacucgaaccaguacucauaccacuuccagacguacgcaacaacuucuaccauuacaaucaauccaacgacuccaccaucaaacuuaucgcuaugcucuacaccccacuaagagccaacaacgccggcgaagacgucuucaccguaucaugccgcguccuaacccgccccucccccgacuucgacuucaucuuccuagucccaccuaccgucgaaucucgaaccaaaccauucuccguccccauccucaccguugaagaaaugaccaacucccguuuccccauuccccucgaaaaacuauucaccggaccaucaagugccuucguagugcaaccucaaaacggccgcugcaccacggacggaguacuccucggaaccacccaacucucccccguaaacauaugcaccuuucgcggcgacguaacccacaucgccggcacccaagaauacacuaugaaccuugcaucccaaaacuggaacaauuacgaucccaccgaagaaauccccgcaccacuugguacacccgacuucgucggcaaaauucaaggaguacuaacccagaccacccgacgagacggcucaaccagaggccacaaggcaaccguauccaccggauccguacauuucaccccaaaacuaggccgaauccaauucuccaccgauacauccaacgacuucgaaacaggccaaaacacccgguucaccccagucgguguaguccaagacggaagcaccacacaccaaaacgaaccccaacaauggguacuccccaacuacucaggacgugacucucauaauguccaccuggcccccgcuguugcccccuccuuccccggcgaacaacuccuauucuuccgaucuacaaugcccggcugcucaggcuacccaaacauggaccuugacugccuccucccccaagaauggguccagcacuucuaccaagaagccgcacccgcccaaucugacgucgcccuucuucgauucguaaaccccgacaccggccgagucuuauucgaaugcaagcuccacaaauccggauaugucaccgucgcccacaccggccagcacgaccuagugaucccucccaacggcuacuucagauucgacuccugggucaaccaauucuacacccucgcacccaugggcaacggaacuggucgccgccgcgcacucuaa

SEQ ID NO: 36902 - RNA, 1623 nt, Artificial Sequence
  derived and/or modified sequence opt11 from capsid_protein__Norovirus__ABW74544
augaaaauggcauccaacgacgccaaccccuccgacggaucagccgcuaaccucguccccgaaguuaacaacgaagucauggcccucgaacccguagucggagccgccaucgccgcccccgucgccggccaacaaaacguaaucgaccccuggauucgcaacaacuuuguccaagcccccggcggcgaguucaccguaucuccccgcaacgcccccggcgaaauacuaugguccgcaccccucggcccugaccucaaucccuaccucucacaccuagcgcguauguacaacggcuacgccggaggcuuugaaguccaagucauacucgccggaaacgccuucacagccggcaaaaucauauucgccgccguaccacccaacuucccaaccgaaggccuaucccccucacaaguaaccauguucccccacaucaucguagacguccgccaauuggaacccguccucaucccccuacccgacgucaggaacaacuuuuaccacuacaaccaaucaaacgacucuacaaucaaacucaucgcaaugcuauacaccccacucagagcaaacaacgcuggcgaagacguauucacggucuccugccguguccuaacacgccccuccccugacuucgacuucaucuuccuugucccacccaccgucgaaucacgcacuaaacccuucacuguaccaauacucaccgucgaagaaaugaccaacucccgcuuccccaucccccucgaaaaacucuucaccggcccaucaggagccuucguaguacaaccccaaaacggacgcugcaccaccgacggcguacuucucggaaccacucaacuuucacccgucaacaucugcacauuccgcggagacguaacacacaucgccggaucacgcaacuacaccaugaaccuagccucccucaacuggaacaacuacgaccccaccgaagaaauccccgcaccccuaggcacacccgacuucgucggcaaaauccaaggcguccucacccagacuaccaaaggagacgguuccacgcgcggccacaaagcaaccgucuacaccggcucagcccccuucacacccaaacucggcuccguccaauucagcaccgacacagaaaacgacuucgaaacccaccaaaacacaaaauucacaccagucggcguaauccaagacggcucuaccacacaccgcaacgaaccccaacaauggguccuacccuccuacuccggccgcaacguccauaacguccaccucgcaccggcaguagcucccaccuuccccggagaacaacuccucuucuuccgcuccaccaugcccggcugcucaggcuaccccaauauggaccuagacugccuccuaccucaagaauggguacaacacuucuaccaagaagccgccccugcacaauccgacgucgcucuccuacgcuucgucaaccccgacacaggccguguccucuucgaauguaaacuccacaaaucaggauacguuacugucgcacacaccggccagcacgaccuuguaauuccacccaauggcuacuucagauucgacucuuggguuaaccaauucuacacccuugcccccaugggcaacggcaccggccgucgucgagcacucuaa

SEQ ID NO: 36903 - RNA, 1623 nt, Artificial Sequence
  derived and/or modified sequence opt11 from capsid_protein__Norovirus__ABW74545
augaaaauggccuccucagacgccaaccccagcgacggauccacugcaaaucuaguccccgaagucaacaacgaagucauggcccucgaaccagucguuggcgccgccaucgccgcccccguugcaggccaacaaaacguaauugacccuuggaucagaaacaacuucguccaagcccccggcggcgaauuuacugucucaccccgcaacgcccccggcgaaauccucugguccgccccacuaggacccgaccucaaccccuaccucucccaccucgcccgaauguacaacucauacgcaggcggcuucgaaguacaagucauacuugccggaaacgcuuucaccgccggaaaaauaaucuucgcagccgucccacccaacuuccccacagaaggccuauccccaucacaagucacuauguucccccacaucaucguagacguucgccagcucgaaccaguacucauaccccucccagacguucgaaacaacuucuaucacuacaaccaauccaacgaccccacuauuaaacucaucgcaaugcuuuacaccccacuacgcgccaacaaugcuggcgacgacgucuucaccgucagcugccgcguccucacccgcccaucccccgacuucgacuucaucuucuuaguucccccaaccgucgaaucccgcacaaaaccuuucuccguccccauccuaaccgucgaagaaaugacaaacucccgcuuccccauuccccucgaaaaacuauucaccggaccaucaucagccuucguaguccaaccccaaaacggacgcugcacaacagauggcguacuccucggaaccacucaacucucgcccgucaacaucugcacauuccgcggcgacguaacacacaucgccggaacacaagaauacacaaugaaucuagccucccaaaacuggaacaacuacgacccuacggaagaaauccccgcgccucuuggcacccccgauuucgucggaaagauccaaggcguccuaacacaaacaacucgccgcgauggcucaacucgaggccacaaagcuaccgucucuacaggcuccguccacuucacacccaaacucggccgcauccaauucucaacagacacauccaacgauuucgaaaccggacaaaacacacguuucacacccguaggcgucguccaagacggauccaccacccaccaaaacgaaccacaacaaugggucuuacccaacuacucaggccgagacucccacaacguccaucucgcccccgccgucgcccccagcuucccaggcgaacaacuccucuucuuccguuccacuaugcccggcugcucaggcuacccaaacaugaaccucgacugccuccucccacaagaauggguccagcacuucuaccaggaagccgcacccgcacagucagacgucgcccuacuccgcuucguuaaccccgacacuggacgaguauuauucgaaugcaaacuccauaaaucuggauacgucacaguagcccacaccggccaacacgaccuaguaaucccucccaacggcuacuuccgcuucgauucaugggucaaucaauucuacacccucgcccccaugggaaacggaaccggccgccgccgcgcacucuaa

SEQ ID NO: 36904 - RNA, 1623 nt, Artificial Sequence
  derived and/or modified sequence opt11 from capsid_protein__Norovirus__ABW74546
augaaaauggccagcaacgacgccaaccccuccgauggauccgcagccaaccucguaccggaaguaaacaaugaaguaauggcacucgaaccaguuguaggcgccgcaaucgccgcccccgucgcaggccaacagaacgucauagacccauggaucagaaauaauuucguucaagcccccggaggagaguucacaguaucaccccgcaacgcacccggcgaaauccucugguccgccccacuaggaccagaccucaaccccuaucucucccaccucgcucgaauguacaacggcuacgccggaggauucgaaguucaagucauucucgccggcaacgcauucaccgcuggaaaaaucaucuucgccgccguaccucccaacuuccccaccgaaggccucucccccucccaagucacaauguucccccacaucaucguugacguacgucaacuggaaccuguacucauaccccuccccgacguccgcaacaacuucuaccacuacaaccaauccaacgacucaaccaucaaacuaauagccaugcucuacacaccccuccgcgcuaacaacgccggggaagacgucuucaccguauccugccgaguccucacacgccccucacccgacuucgacuucaucuuccuuguaccacccaccgucgaaucucguacuaaacccuuuacaguccccaucuuaaccgucgaagaaaugaccaacucacgauuccccauaccccuagaaaaacuauuuaccggcccauccucagccuucguaguccaaccccaaaacggccgaugcaccacggacggcguacuacucggaaccacccaacuaucucccgucaacaucugcaccuuccgaggcgacgucacccacauagcaggcucucgcaacuacaccaugaaccucgcguccuuaaacuggaacaacuacgaccccacagaagaaaucccagcaccccucggcacgccugacuucgucggcaaaauccaaggcguccucacccaaacuacaaaaggcgacggcuccacccgaggccacaaagccacagucuacacuggauccgcccccuucaccccaaaacuaggcucaguccaauucuccacagacaccgaaaacgacuucgaaacacaccaaaacaccaaauuuacacccgucggcguuauccaagacggcucaaccacccaccgcaacgaaccccagcaauggguccuccccucauacuccggccgaaacguccacaacguucaucucgcccccgccgucgcccccacauuccccggcgaacagcuccuauucuuccgauccaccaugcccggcuguuccggcuacccaaacauggaucuagauugccuacucccccaagaauggguccagcauuuccaccaagaagccgcccccgcccaaucugacgucgccuuacugagauucgucaaccccgacacuggccggguccucuucgaaugcaaacuacauaaauccggcuacguaaccgucgcacacacaggccaacacgaucucgucauacccccaaacggcuacuucagauucgacuccuggguaaaccaauucuacacacucgcacccaugggaaacgguaccggccgccgucgcgcacuuuaa

SEQ ID NO: 36905 - RNA, 1566 nt, Artificial Sequence
  derived and/or modified sequence opt11 from capsid_protein__Norovirus__ABW75843
augaaaauguccgacaaagaaucugcagaaucccccgccucacucggacaaguacucccaccccaaguagacgucgucguccccgucgaacccaccgugggcgcacagauagccgcacccaccgccggucaaaucaaccccauagaccccuggauuuucucaaacuuuguacaagcaccccaaggcgaguucaccaucuccccaaacaacaaccccggcgaaauacuuuucgaaauggaauuaggcccagaccuaaaccccuaccucggccaucuuagaagaauguacaacggcuggaccgguucccuacgcguccgcgucaugcuagccggaaacgccuucuccgccggaaaaauaaucgucuucugcaucccucccggcuucgacaccacauuccucacccccgcccaagccacacaauucccccacguuaucauggacguccgagccccagacccaguugaaguaccacucgaagacgucagaaacguccuauuucaucaaggccccgacaaccgcaugcgacucgucggcaugcucuacaccccacuacgagccaacaguggugccgaucccuucguugucacgggacgcguacucacaugccccucugaaaacuucuccuucuucuuccuaguaccacccacaguagaagaaaaagacguucccuucaccauuccaaacguacccaccuccucccucacaaacucccgcaugcucgaaccagucgccgaacuccgcuccucacgcaacuucgcccuauccguacaauuccaaaacggcaggucuaccaucgaaggcgaacuccucggcacaacaccagccucccuagccgaccucggauccuuccuaugcauccgcgggggcacagccaacuuagccgaacucuuccaaccaaacgaagacgccuucgucgccggcucccacccggcccccuucggcuuccccgacuuuuccaacuguacccuagacuuccuacucuacgacgcaaacggccuauaccaccgucaccuagacgucacauccgccuccaauuucaccccugcacucggacacaucacacucgauggcagugucccagaccgccucacccgagcacgccuugaaggaguccaacgggcauccgagaacacauucuggcgcaugcccgacuaccgcggcgauguccugggagcagaguucgcccccgccgucuccgccccaggaaucggcgaaaccuuacuauuuuucauguccaacguucccuaccacaacggcucaaacccgaaccccuuaccgugccugcucccacuugaauggaucaaccauuucguagccgaacgaccagccaaacaaucugacgucgcacuacucaacuacaucaauccccucaccggccgaguauuauucgaaugcaaacucuacucagcaggcuuccuggcaguaaaccucgggucucaaaccgaagucacccuccccgucgacggcaucuucaaguucguaucauggguauccuacuacuaccaacuccgcccaguaggcaccgucuccgucggcagacgccucccccgcuuggacggacacuaa

SEQ ID NO: 36906 - RNA, 1737 nt, Artificial Sequence
  derived and/or modified sequence opt11 from capsid_protein__Norovirus__ABX71062
augaaaauggccuccaacgacgccgcccccucauccgacggagcuggcaaccuuguaccggaaucacaccaagaaguccucccccuagcaccaguugccggugccgccaucgcagcgcccgucguaggacaacaaaauauaauagaccccuggaucaaagaaaacuuuguccaagcaccccaaggcgaguucacagucucaccuaaaaacucacccggagaaguguuagucaaucucgaacucucaccaaaacuaaaccccuaccucgaccaccugucaaaaauguacaacgcauacgcugguggaauggaaauagaaauaauccucgcaggcaacgccuucaccgcaggaaagguucuaauagccgccguuccacccaacuuccccguagaaaacauauccgucucccaagccucucaauucccccacguaaucgucgauguacgaacccucgagcccauccgccugccccucccagacguccguaccaacuucuuccacuauaccacgcgugacgaacccaaaaugcgcauaguagcauggcucuacacaccccuaagaaccaacggguccggcgacgacagcuucaccgucagcggacgcauccucacccgccccagcgccgacuucgaguucuccuuccuuguaccaccaacugucgaaacaaaaaccgucuccuuuucaguccccggacucaccgucgaagaaaugucaaacucacguuggcccgcacaaaucaacggacucgucguacgcggcaacgaagcacaagucguccacuuccaaaacggacgaugcaccaccgaagggaugcuacucggcacaaccacacucaacgucaacucgauaugcggccuacgcggcacauccaucucccacgccucaguaagagaagccccggcccucagcgaagaaaugccaccccucgaagaugaagucgcccacggagccgccgcaaccuacgccguaggacgagccgcagacaccacucucuggauccgagucgaagaacccaacggacaaccauaugacaucuucggcgagcaaccagccccgcuaggcaccccagacuucaccgcuguaauaauaggcacggccaucaggccccgaaccgcaagcggugccuaccuacacgacgcuuacguagacacccgcccaggcgacgcugacuucacccccuccacuggaaacaccaaaaucguccuccgaggcggcggcucaggccacguaggagaaggucacuacuggcaauuuaaaccgauagcaguugaaggcggcccaaaucgccccgucuaccaagaauacaaccucccagaauacgccggacccaccgccuccaaccacaaccucgcaccacccguugcccccaaaaugcccggugaacuccucuuacuauucgaguccgacaugcccgucugggauaacggauccggcucagcacccacccagaaaauccauugccuacucccgaacgauuucgucacccacuucuucgaccuccaagcacccgcucucgccgaagccgcccuacuacgcuacguccaucccgacuccggacgaaccuuguucgaaugcaaacucuaccgagagggauacaugguugucguagcacccagcggccgacuagacuucccgcuagacgguuacuuuagauucgacuccugggucaacgccuucuacguccucucccccgucgguaacggccaaggacgccgaggucgugccaagaacauauaa

SEQ ID NO: 36907 - RNA, 1605 nt, Artificial Sequence
  derived and/or modified sequence opt11 from capsid_protein__Norovirus__ABY77754
augaagauggcauccaacgacgcaucccccucuuccgacggcucagccaaccucgucccagaaaucaacaacgaagucauggccuuggaacccgucgcaggagcagccaucgccgcgcccguagccggucaacagaauaucauagaucccuggauccgcaacaacuucguccaagcccccggaggagaauuuacagucucaccccgcaacgcccccggcgaaguacuacucaaccucccccuaagcccagacauuaacccauaucuagcccaccucucacgaauguacaauggauacgccggcggcgucgaaguagaaguaguccuagccggaaaugcuuucacugccgguaaaaucaucuucgcggccgugccacccaacuucccacccgaaaaccuaucucccucccagaucacuaugcucccccacaucaucgucgacguccggcaacucgaacccguccgcauccccuuacccgacguacgcaacaacuucuaccacuacucacgagaaaacgacuccacgcucagacugguagccaugcuuuacacuccccucagagccaacaacgccggcgacgacgucuucaccgucuccugccgaguccucacccgccccucaccagacuucgacuucaucuuucuaguuccacccaccgucgaauccaaauccaaacccuucaccauccccauacuaacaaucgaagaaaugaccaacucacgcuuccccgccccucucgaaaugaugacaaccggcccaucccacgacauagucguccagccccaaaacggacgcugcaccauugacggcguccuccucggcacaacacaacuaucucccguaaacaucuguuccaugcgcggaguccccacaaaaagaacaaacggaaccgacaacugcuuuguccaacucgaaaaccccaacggcuccgccuacgauccuaccgaggacauacccgccguccucggcagccccgacuucgucggagaguucuacggaacaauuacccaacgcucacccaacaauuccacucgggcccaccccuucacucuuaacaccggcucaccccgcuacacccccaaaaucggcucugucgacauccacgucaccgacguugacgaccuaaacgaucacgaacccgucaaacucacccccgucggccucuccggcucaucuggaagcauccaccaauggcaacucccaaacuacuccggcguggccacccacaauaugcaccuagcucccucagucgccccucuauucccaggugaacagauccuauucuuccgcuccaccgucccaggcugcggcggcuacccuaacaccaacauugacugccucaucccacaagaauggguccaacacuucuaccaagaaggcgccccagcacgaaccgacgucgcacuacuaagauucaucaaccccgacaccggacguguccucuucgaaugcaaacuccacaaacauggcuuuaucacaguagccuacuccggaaaccacgaucuaguaaugccaccuaacggcuacuuccgcuucgaauccugggucaaccaauuccauacacuagcccccaugggcacaggccgcgcagaagaaauucaauaa

SEQ ID NO: 36908 - RNA, 1608 nt, Artificial Sequence
  derived and/or modified sequence opt11 from capsid_protein__Norovirus__ABZ89549
augaaaauggccuccaacgacgcaucccccucaucagacgggucugccaaccucguacccgaaaucaauaacgaagucauggcacuagaacccgucgccggagcagcaauagccgcccccguagccggacaacaaaacaucaucgacccguggauacgcaacaacuucguccaagcccccggcggcgaguucaccgucuccccgcgcaacgcacccggcgaaguacucuuaaaccuaccacuaucccccgacauaaacccuuaccucgcacaccucucccgaauguacaacgguuacgcuggcggcgucgaagucgaaguaguacucgcaggaaacgcauuuaccgccggaaaaaucaucuucgcagcaguacccccaaacuucccacccgaaaaccuaucccccucccaaaucaccaugcucccucacaucaucgucgacguuagacaacucgaacccguccgcauuccgcuccccgauguacgaaacaacuucuaccacuauagccgcgaaaacgacuccacccuccgacuaaucgcuaugcucuacacuccucuucgcgccaauaacgccggugacgacguauucaccgucuccuguagaguccucacccgccccucacccgacuucgacuucauauuccuaguuccacccacgguagaaucaaaaucaaaacccuuuaccauaccaauccuuacaauagaagagaugaccaacucccgauuucccgcacccuuagaaaugaugaccaccggcccuucacacgacaucgucguccaaccccaaaacggccgcugcaccaucgacggaguccuucucggaaccacccaacuuucaccuguaaauauaugcucgaugcgaggcguaccuaccaaacgaaccaacggcaccgacaacugcuucguacaacucgaaaauccgaacggaucagcauacgaccccaccgaagauauccccgccguccucggcucgcccgacuucguaggcgaguucuacggcacaauaacacaacgaucccccaacaacucgacccgcgcgcaccccuucacccucaacacaggaucaccccgcuacacccccaagauaggcuccgucgacauccacguaacagacguagaagaccuaaacgaucacgaaccagucaaacuaaccccaguaggacuauccggcucauccggaucaauccaccaauggcaacuccccaauuacuccggaguugccacucacaacaugcaccucgccccuucaguagcuccccucuucccaggcgaacaaauccucuuuuuccgauccaccguccccggcugcggaggcuaccccaacacuaacaucgacugccuuaucccccaagaauggguccaacacuucuaccaagaaggagcccccgcccgaaccgacgucgcucuccuccgcuucguaaaccccgacaccggacgaguccucuucgaaugcaaacuucacaaacacggauucaucaccguugccuacucaggcaaccacgaccucguaaugcccccuaacggcuacuuccgcuucgaauccugggucaaccaauuucacacacuagcacccaugggcaccggcuccgguagacgcagaauacaauaa

SEQ ID NO: 36909 - RNA, 1644 nt, Artificial Sequence
  derived and/or modified sequence opt11 from capsid_protein__Norovirus__ACC69023
augaaaauggccuccaacgacgcaccacccucaacagaugguucugcgggccucguucccgaagucaacaacgaaaccauggcccucgagcccgucguaggcgcaccccucgccgcccccgucgccggucaacacaacaucauagacccauggauaaaaaugaauuucguccaggccccaaacggcgaguucaccguaucaccccgcaacgcccccggagaaauucuccuagaccucgaacucggacccgaccuuaaccccuaccuaucccaccucgccagaauguacaauggauacgcgggcggcauggaagcacaggucguacuggccggcaaugccuucaccgccggcaaaauaaucuucgcagcaguacccccuaacuucccagcugaaaaccucuccgccgcccaagucacaaugugcccccacguaaucguagacguccgacaacucgaaccagucaugcuuccaaugccagacauacgcaacaaacuauuccacuacaaccaagucgacgaccccaaacuccgccuccucgccuaccuuuacacuccccuccgcgccaacaacgccggagacgacguauucacaguauccugccgcguacucacccgccccacccccgauuucgaguucauguuccucgugccacccaccgucgaauccaaaacaaagcccuucucccuacccggccuaacacuagacgaacucucaaacucccgcuuccccgccccaaucguccagcucuacacaaacccccacgacaaccucgucguacagccccaaaacggucguugcacuauagacggacucuuacagggcaccacccagcucguauccuguaacgucugcuccuaccgaggcaccaucggagguggccagccagccucccacaccgaagaagaaauaaugccuauggcauucaacauacaacgcgaaauaaugcuagaaaaccuagacggaucccccuacgacccagucgacgacauccccgccguucuagguucaccugacuuccaaggcgucguauucggcauccucucacagcgaaacgccaauggccaaacaagagcccacgaagcaaaagucgauacccgcgccgcccgcuucgcacccaaacuaggcuucguugucgcuaccgucgaaucaacagacuuccacgacaaccaacccuccagauucgcuccagucggacucggcggaaacggcaaccaggauuucaaccaaugggcccuuccagccuacggcggagcccuaacaaacaacaccaaccucgcaccaccaguuaugcccgucuacccaggcgaacaacuccucuucuuccgaagccaacuaccaucauccggcggcgucgucgggggauggcucgauugccuccucccacaagaauggguccaacacuucuuccaagaaagugccacaagccaaagcgacgucgcccucguacgcuacaucaaccccaccacagggagaguccuauucgaagccaaacuccacaaacaaggcuuccuuaccguugccgccucaggauccuacccccuaguagucccggccgacggcuacuuccgauucgaaucauggguaaaccaauucuauacccuagcaccaaugggaaacggcuccggccgccgacgcgcccguuaa

SEQ ID NO: 36910 - RNA, 1644 nt, Artificial Sequence
  derived and/or modified sequence opt11 from capsid_protein__Norovirus__ACC69026
augaaaauggccuccaacgacgcgcccccguccacagacgguucagccggccucguucccgaagucaauaacgaaacuauggcccuugaaccagucgucggcgcaccccucgccgccccagucgccggacaacacaacauaaucgaccccuggaucaaaaugaacuucguccaagccccaaacggcgaauuuaccgucucaccacgcaacgcacccggagaaauccuacuagaccuagaacuaggacccgaccucaacccauaccuaucccaccucgcccgcauguacaacggauacgcaggcggcauggaaguacaaguuguccuagcagguaacgccuucacagccggcaaaaucaucuucgccgccguacccccuaacuucccugccgaaaaccucuccgccgcccaagucaccaugugcccacacgucauaguagacguccgccaacucgaacccgucaugcuaccuaugccagacauaagaaacaaacuauuccacuacaaccaagucgacgacccaaaacuccgccuccuugccuaccuauacaccccacuccgagcaaacaacgccggcgacgacgucuucaccgucuccugccggguacucacccgccccacccccgacuucgaguucauguuccuaguucccccuaccgucgaaucaaaaacuaaaccauucucacuucccggccuaacacucgacgaacucuccaacagccgauuccccgcaccgauaguccaauuauacaccaacccccacgauaaccuagucguccaaccacaaaacggacgcugcaccauagacggucuacuccaagggacaacacaacucgucuccugcaaugucugcucauuccgagggaccauaggcggcggccaacccgcaucucacucugaagaagaaaucaugccaauggccuucaacauccaacgagaaaucaugcucgaaaaccucgacggaucccccuacgaccccgcagacgacaucccagcaguccuaggcucaccagacuuccaaggcgucgucuucggcauccuaucccaacgcaacgccucaggacaaacgcgagcccacgaagccaaagucgacacccgcgcagcacgauucgcccccaaacucggcuucgucguagcaaccguagaauccacugacuuccacgacaaccaaccuucccgcuucacccccguaggccuuggcggcaacggcaaccaagacuucaaccaaugggcccuccccgcauacggcggcgcccucaccaacaacaccaaccucgcaccacccguaaugcccgucuaccccggcgaacaacuacucuucuuccgcucacaacucccauccucaggcggcgucgucggcggaugguuagacugccucuugccacaagaauggguccaacacuucuuccaagaauccgccaccucucaaucagacgucgcacucguccgauacaucaaccccacuaccggccgcguccucuucgaagccaaacuacacaagcaaggcuucuuaacuguagcugcuuccggcucauacccccuaguggucccagccgacggcuacuuccgcuucgaaucauggguaaaccaguucuauacacucgcacccaugggcaacggauccggccgcagacgcgcccgcuaa

SEQ ID NO: 36911 - RNA, 1671 nt, Artificial Sequence
  derived and/or modified sequence opt11 from capsid_protein__Norovirus__ACC69028
augaaaauggcaucaaacgacguugcagcacccaguacagacggauccgcaggacucguaccagaaguaaacaacgaaaccauggcccucgaaccagucgcaggcgccgcgcucgcagccccggucguaggacaacacaacguaaucgaccccuggauucgcggaaacuucguucaagccccuaacggcgaauuuaccgucuccccacgaaacuccccaggcgaaguacuccucaaucuagaacucggacccgaacuuaaccccuaccucgcgcaccucgcccgcauguacaacggcuacgccggcggcauggaaguccagguaguccucgcgggaaacgccuucgccgccgguaaaaucaucuucgcagcagucccuccauccuucccagucgacgcucucuccgcaccaacuaucaccaugugcccccacgucauaguagacguuagacagcuagaaccaguacuacuccccaugcccgacguccgcaacaacuucuuccacuacaaccaauccuccgaccccaaauuacgcuuagucgcaaugcucuacacgccccuccgagcaaacucacccaccgacgaugucuucaccgucucaugccgaguccuaacccgacccucccccgacuucgaguucaccuuucuaaucccacccaccgucgaaucuaaauccaaaccccucacaaucccccaacugacccuauccgaacucucgaacucccgauuccccgcacccaucgacaugcucaacaccucacccaaugacaacaucgucguacagccacagaacggacgcugcacccuugacggugaacugcaaggaacaacccaacuucaacccagccucaucuguuccuuccgcggggucguacuuaacgaaaccucccggauggcuguugacuacgaagaagaagaagaaguacaacgcccccaggcccgcgcauucaaccacgaauaccaccuucaacuucaaaaccucgacgguacagacuacgacccagcaggcgaccucccagccacacucggcgcccccgacuucguaggaaccguauacggcgucgucucccaacgcacaaccagagacucugccgcacgcgcccacgaagccaaaauaauaaccaacgauccccgauacgccccaaaacugggcuccgucgaguucguaacagaauccacagacaucgucaucaacgaccaaaccaaauucacuccugucggucucgcacacaaccgcgccgucgacuacaaacaaugggaauuaccacacuacgccggcgaacuaacggcaaacaccaaucucgcaccacccgucgcccccgucuaccccggggaacaacuccucuucuuccgcagcaaccucccccucgcaggaggcaccgccgcaucaguacucgacuaccuccuaccacaggaauggauacaacacuuuuaccaagaaucauucacaccccaaucagacaucgcccuccucagauacguuaacccagacaccggccgcguucucuucgaagccaaacuucaccgacaaggauacaucacugucgcaggcgcaggcacaucccccguugcagucccacccaacggauacuuccgcuucgaauccugggucucccaauuuuacgcucuagcccccaugggcucaggcaccggccgccgacgaaaccaauaa

SEQ ID NO: 36912 - RNA, 1626 nt, Artificial Sequence
  derived and/or modified sequence opt11 from capsid_protein__Norovirus__ACC96732
augggcauguccgacggagccgcacccaaagcuaacggcuccgaagccucuggccaagaccuaguccccaccgccguagaacaagccgucccaauacaaccaguugcaggcgcagcucucgcugcccccgcugcuggucaaaucaaccagaucgacccuuggaucuuccaaaacuuuguucaaugcccacuuggcgaguucucaaucuccccacgcaacacccccggagaaauccucuucgaccuggcgcuuggaccaggacuaaacccauaucucgcccaucuauccgccauguacacaggcuggguugggaacauggaaguccagcuaguacucgcgggcaacgcuuucacagccggcaaagucgucgucgcccucgucccacccuacuuucccaaaggaucacucaccaccgcucaaauaaccugcuucccccacguuaugugugacguccgaaccuuagaacccauccaacucccacuucucgacguccgacgcguacucuggcaugccacacaagaccaagaagaauccaugcgccucgucugcaugcuauacacaccccuaagaaccaacucccccggagacgaaucuuucguagucucuggccgccuccuaagcaaacccgcagccgacuucaauuucgucuaccuaaccccacccaucgaacgcaccaucuaccgcaugguugaccuccccgucauacaaccccgacucugcacccgagcccgauggccagcucccguuuacggccuccuagucgaccccagccuaccaucgaacccccaauggcaaaacgggcgaguccacguagacggaacacuccucggcacaacaccaauaucaggauccugggucucauguuucgccgccgaggcagccuacgaguuccgcuccggcacaggcgaagaaguuaccuucacccucauagaacaagacggaagcgccuacguacccggcgaccgagccgcaccccuuggcuaccccgacuucucaggucagcuagaaauagaaguccaaaccgaaaccaccaaaacaggugacaagcucaaaguaaccaccuucgaaaugauccucggcccucgaaccaacguagaccaagcccccuaccaaggacgcgccuacgcaucgguaaacgccaccgccucccucaaccuagucgacggacgaguaagagccgucccucgcuccauacacagcuuccaagacgucauccccgaauacaacgacggacuacucgucccacuagccccacccaucggccccuuucuccccuccgaaguucugcuacgcuuccgcaccuacaugcgacaaaucgacacagcagacgccgccgccgaagcuauagacugcgcccuuccccaagaguucgucucuugguucgccuccaacgccuucaccguccaauccgaagcccuucuccugagauaccguaacacacucaccggacaacuccuguucgaaugcaaacuauacucggaaggcuacaucgccuuaagcuacuccggcuccggcccccuaacauuucccacagauggauucuucgaagucguaucaugggucccccgccuauaccaacuagcauccgucggcucccuugccaccggacgaacccucaaacaauaa

SEQ ID NO: 36913 - RNA, 1626 nt, Artificial Sequence
  derived and/or modified sequence opt11 from capsid_protein__Norovirus__ACC96735
augcgcauguccgacggcgcagccccaaaagccaacggcucagaagcuagcggccaggaccucgucccgacagccgucgaacaagccguccccauccaaccaguugccggcgcagcucucgccgcucccgccgccggccaaaucaaccaaaucgaccccuggaucuuccaaaacuucguccaaugcccccucggagaauuuuccaucucuccccgcaacacccccggagaaauacuuuucgaccuugcccuaggccccggacuaaauccauaccucgcacaccucuccgccauguauaccggcugggucggcaacauggaaguacaacucguacucgccggcaacgccuucacugccgguaaaguaguagucgcacucgugcccccauacuucccacgcggcucccucaccacaacccaaauaaccugcuucccacacgucaugugcgacguccgaacccucgaaccaauccagcucccccuccucgacguccgaaggguucucuggcacgccacccaagaccaagaagaaagcaugcgcuuagucugcaugcucuacacaccacuccgaaccaacucaccaggagacgaaucauucguaguaucuggacgccuccuuuccaaacccgccgcagacuuuaacuucguauaccucaccccucccaucgaaagaaccaucuacagaaugguugaccuucccgucguacaacccagacucugcacacacgcccgcuggcccgcuccuaucuacggccuauuagucgaccccucacuccccuccaacccccaauggcaaaacggacgcguacacgucgacggcacacuccucggaacaacaccaaucuccggcagcugggucuccugcuuugcggccgaagcugccuacgaguuccaauccggcaccggcgaagucgcaaccuuuacccugauagaacaagacggcucggccuacguccccggcgaccgcgcugccccacucggcuaccccgacuucucgggccaauuggaaaucgaaguacaaaccgaaaccacaaaaacaggcgacaaacuuaaagucacaaccuucgaaaugauccucggucccgaaacgaacgaagaccaagcccccuaccagggacgcguauucgcauccauauccgcagccgccucccucgaccucguugacggccgagucagagcaguaccacgcagcaucuacggcuuccaagacgucauaccagaauacaacgacggccuccucguaccacucgccccucccaucggacccuuccuacccggagaaguacuucuccgcuucagaaccuacaugcgacaaguagacacccaggacgcugccgcagaagccaucgacugcgcacucccccaagaguucgucuccugguucgcauccaacgccuucacagugcaauccgaagcacuccuacuccguuaucgcaacacacucacuggacagcuacucuucgaauguaaacuauacucagaaggcuacaucgcucuaagcuacuccggucccggcccccuuaccuucccauccaacggcuucuucgaaguagucuccugggucccucgauuguaccaacuagcauccgucggcagccucgccacgggccgcacccucaaacaauaa

SEQ ID NO: 36914 - RNA, 1623 nt, Artificial Sequence
  derived and/or modified sequence opt11 from capsid_protein__Norovirus__ACF41177
augaaaauggccucuaacgacgccaaccccuccgacggcuccaccgcuaaccuaguccccgaggucaacaaugaagucauggccuuagaacccgucgucggugcggcaaucgccgcccccgucgccggccagcaaaacguaauagaccccuggauccgaaacaacuuuguacaagcuccaggcggcgaguucaccgucucuccccgcaaugccccaggcgaaauccucugguccgcaccccucggccccgacuuaaaccccuaucuuucccaccucgcacgcauguacaacggcuacgccggcggauucgaaguccaagucauucucgccggcaacgccuucacagccggcaaaaucauuuucgcggccgucccaccaaacuuccccaccgaaggccuuucacccagccaaguaacuauguucccacauaucauagucgacguacgccaacuagaacccguucucauaccccuaccugacguccgaaacaacuucuaucacuacaaucaaucuaacgacucaaccaucaaacucaucgccaugcucuacacuccccuacgcgccaacaacgccggugacgaugucuucaccgucuccugccgcguccucacacgccccucccccgacuucgacuucauauuccuugucccaccaaccguagaaucccgcaccaaacccuucacaguacccauccucacugucgaagaaaugaccaacucccgauuccccaucccacucgaaaaacucuucaccggccccuccuccgcauucguaguucaaccccaaaacggacgcugcaccacagacggcguacuacucggcacaacccaacuaucaccgguuaacauauguuccuuccgcggcgacgucacccauauccccggcacccgcaccuaccgcaugaaccucgccucacaaaacuggaacaacuacgaccccaccgaagaaauccccgcaccccucggaacacccgacuucgucggcaaaauccaaggcauguuaacacaaaccacaaaaggagacggcucaacucgcggccacaaagccaccgucuccacaggcucaguagacuucacaccaaaacucggcagcguacaauucgccacugacacagacaacgacuucgaaaccggccaaaacacccgcuucaccccagucggcguaauccaagacggcuccuccacccaccgcaacgaaccacaacaauggguccucccagacuauucaggccgcacuguccacaacguucaccuagccccagccguagccccaacauuccccggcgaacaacuccuauuuuuccgcuccaccaugcccggaugcuccggauaccccaacauggaccuagacugccuucucccacaagaguggguccaacacuucuaucaagaagccgcccccucccaauccgacgucgcacuccuacgauucguaaaccccgacacuggcagaguacucuucgagugcaaacuccacaaagccggauacgucaccgucgcccacacaggccaacacgaccucgucauaccacccaacggguauuuccgguucgacucaugggucaaccaauucuacacccucgcccccaugggcaacggcgccggccgacgacgagccucuuaa

SEQ ID NO: 36915 - RNA, 1623 nt, Artificial Sequence
  derived and/or modified sequence opt11 from capsid_protein__Norovirus__ACF41180
augaaaauggccuccaacgacgcuacacccuccgacggcucaaccgccaaccucguccccgaaguaaacaacgaagucauggcccuagaaccagucgucggcgccgcaaucgccgcacccgucgcaggacaacaaaacguaaucgaccccuggaucaggaacaacuucguacaagcccccggcggcgaguucaccgucagcccacguaacgcacccggugaaauccucuggucagcaccucucggacccgaccuaaaccccuaccucucucaccucgcccgaauguacaacggcuacgccgguggcuucgaaguccaagucauccucgccggcaacgcuuucaccgccggcaaaaucaucuucgccgccguacccccuaacuuccccaccgaaggccuaucacccucccaagucaccauguucccccauaucauagucgacguucgccaacucgaaccaguucuaauaccccuccccgacguccguaauaacuucuaccacuacaaccaauccaacgaucccaccaucaaacugaucgccauguuauacaccccgcuacgcgccaacaacgccggagacgacguauucacugucuccugccgcguccucacacgcccuucuccugacuucgacuucaucuuccuaguaccaccuaccgucgaaucucguaccaaacccuucuccguaccaauccuaaccgucgaagaaaugaccaacucccgauucccaaucccccucgaaaaacucuucaccggcccuucuuccgcauucguaguccaaccccagaacggucgcugcacaacugacggcguacuccuuggcacaacccaacuuucucccgucaacaucugcacuuuccgcggcgacgucacacacaucgccggcacccaaaacuacaccaugaaccuugccucccaaaacuggaacaacuacgaccccacugaagaaaucccggcaccccucggaaccccagacuucgucggcaaaauacaaggcguccucacgcaaaccaccaaacgagacggauccacccgcggccacaaagccacagucucaaccggcucaguucacuucacccccaaacuaggauccguacaauucuccacagacaccucaaacgacuucgaaaucggccaaaacacacgauucacacccgucggaguaguccaggacggcuccaccacccaccaaaacgaaccccaacaauggguccuccccaacuacucuggcagggacggacacaacguacaccucgcucccgccgucgcgccaaccuuccccggagaacaacuccuauuuuuccgcuccacaaugccugguugcucuggcuaccccaacaugaaccucgauugccuccuaccccaagaauggguccaacauuucuaccaagaaucagcccccgcucaauccgacguggcccuccuacgcuucguaaaccccgauaccggccgcgcccuauucgaaugcaaacuucacaaauccggcuacguaacaguagcucacaccggccaacacgacuuagucauaccacccaauggcuacuuccgcuucgacucauggguaaaccaauucuacacucuagcccccauggguaacggcgccggacgccgucgcgcacucuaa

SEQ ID NO: 36916 - RNA, 1623 nt, Artificial Sequence
  derived and/or modified sequence opt11 from capsid_protein__Norovirus__ACF41181
augaaaauggccuccaacgacgccaaccccucugacggcucuaccgcaaaccucgucccagaaguaaauaacgaagucauggcacucgaaccugucgucggagcagccauagccgcucccguagccggccaacaaaacguaaucgaccccuggauacgcaauaacuucguccaagccccaggaggcgaauuuaccguuucaccacgcaacgcccccggcgaaauccucuggucagcaccucucggacccgaccuaaauccauaccucucccaccuagcccgaauguauaacggguacgcaggcggcuucgaaguacaaguaauacucgccggcaacgccuucaccgccggaaaaaucauauucgcagccguaccacccaacuuccccaccgaaggccucagccccucacaagucacaauguucccccacauaaucgucgacguccgacagcucgaacccguccucaucccccuccccgacguccgcaacaacuucuaucacuacaaccaaagcaacgacucuacaauaaaacucaucgccaugcucuacaccccacugcgagccaacaacgccggugacgacguauucacaguauccuguagaguacucacccguccauccccagacuucgacuucaucuuccucgucccaccaacagucgaaagccgcacaaaaccauucacuguucccauacucaccguagaagaaaugacaaacucccgcuuccccaucccacucgaaaaacucuucaccggccccuccuccgccuucgucgugcaaccccaaaacggccgaugcaccacagacggcguacuccucggcacaacccaacugucgcccgucaacauaugcacauuccgcggagacgucacacacauccccggcacccgcaccuaccgcaugaaccucgcaucccagaacuggaauaacuacgacccaaccgaagaaauccccgcuccccuaggaacuccagacuucgugggcaaaauacaaggaaugcuaccacaaacuacaaaaggcgacggcucaaccagaggacacaaagccaccguauccacagggucaguagauuucacaccaaaacuaggcuccguccaauucgccacagauacagacaacgacuucgaaaccggccaaaauaccagauucacucccgucggagucauccaagacggcucauccacccaccgcaacgaaccccaacaguggguccuccccgacuacucaggcagaaccgucuacaacguccaccuagcccccgccguagccccaaccuucccuggcgaacaacuacuauucuuccgcagcaccaugcccggcugcuccggcuaccccaacauggaccuagacugccuccucccccaagaauggguucaacacuucuaccaagaagccgcccccagccaaucugacguagcccuacugcgauucguuaacccugacaccggacgcguccuguucgaauguaaacuccacaaagccggcuacgucaccgucgcccacacaggccaacacgaccucgucauaccacccaacggcuauuuccgauucgacagcuggguaaaccaauucuacacacucgcccccaugggcaacggugcaggccgucgacgugcucuauag

SEQ ID NO: 36917 - RNA, 1623 nt, Artificial Sequence
  derived and/or modified sequence opt11 from capsid_protein__Norovirus__ACF41182
augaaaauggccucuaacgacgccuccccaucagacggauccacugcuaaccucguccccgaaguaaacaacgaagucauggcacucgagcccgucgucggagcagccaucgccgcccccgucaccggacaacagaacgucaucgauccuuggauacgcaacaacuucguccaagcccccggcggcgaguucaccgucucaccccgcaacgcacccggcgaaauccucugguccgcaccccucggcccagacuuaaaccccuaucucucccaccuagcccgcauguacaacggcuacgccggcggauuugaaguacaaguaauccucgcaggcaacgccuucacagccgguaaaauaaucuucgcagcagucccacccaacuuccccaccgaaggccucucccccucccaagucaccauguucccacacauaaucgucgacguacgccaacucgaaccaguccuuauaccacuccccgacguccgcaacaacuucuaccacuacaaccaauccaacgacuccaccaucaaacucaucgcgaugcucuacacuccccuucgcgccaacaaugccggcgacgauguuuucaccgucuccugccgcguacuaacccgccccuccccagacuucgacuucaucuuccuagucccucccaccgucgaaagccgaaccaaaccuuucaccgucccuauccucacagucgaagaaaugaccaacucacgcuucccaauaccccucgagaaacuauucaccggcccauccuccgccuucgucguacaaccccaaaacggacgaugcaccaccgacggcguccuccuaggaacaacacagcuaucccccguuaacaucugcaccuuccgcggugacguaacccauauccccggcacccgaaccuaccggaugaaccuagccucacaaaacuggaacaacuacgacccaaccgaagaaaucccagccccucucgguacucccgacuucgucgguaaaauacaaggaaugcucacccaaaccaccaaaggcgacggcucuacucgcggccacaaagccaccgucagcacaggauccguagacuucaccccgaaacucgguucuguacaauucgccaccgacacagacaacgacuucgagacuggccaaaauacccgcuucacaccagucggcguaauccaagacggcucaucuacccacagaaacgaaccccaacaauggguccuccccgacuacuccggcagaacagcccacaacguucaccucgccccagcaguagcccccaccuuccccggcgaacaacuccucuucuucagauccacuaugccaggcugcuccggcuaccccaacauggaccucgacugccucuuaccccaagaauggguccaacauuucuaccaagaagccgcacccucccaauccgaugucgcccuacuccgauucguaaaccccgacaccggccgcguccucuucgaaugcaaacuucacaaagccggcuauguaacagucgcucacaccgggcaacacgaccucguuaucccacccaacggcuauuuccgauucgauucauggguaaaccaauucuacacccucgcccccaugggcaacggcgcuggacgcagacgcgcucucuaa

SEQ ID NO: 36918 - RNA, 1623 nt, Artificial Sequence
  derived and/or modified sequence opt11 from capsid_protein__Norovirus__ACF41183
augaaaauggccucaaacgacgccuccccguccgacggcuccaccgccaaccugguccccgaggucaacaacgaaguaauggcccucgaaccaguagucggcgccgccauagccgccccagucgccggccaacaaaacgucaucgaccccuggauccgcaacaacuucguccaagcacccggcggcgaauuuaccguaucaccucgcaaugcacccggcgaaauacucuggucagcaccccuaggaccagaccuaaaccccuaccuaucucaccucgcccgcauguacaacggcuacgccggcgguuuugaaguccaaguaauacuagcuggcaacgccuucaccgccggcaaaaucauauucgccgcaguacccccuaacuuccccaccgagggccucucacccucccaagucaccauguucccacacaucauagucgacguccgccaacucgaacccguccucaucccacuucccgacguccgcaacaacuucuaccacuacaaccaauccaacgacuccacaaucaaacucauagccaugcuauacacaccccuacgugccaacaacgccggcgacgaugucuucaccgugucaugcagagucuuaaccagaccuuccccggacuucgacuucauauuccuagucccgcccaccgucgaaucacgaaccaaacccuucacagucccaauccucaccguagaagaaaugacaaauucccgcuuccccaucccacucgaaaaacucuuuacaggccccuccuccgccuucguaguccaaccccaaaacggucgcugcaccacugacggaguucuccucggaaccacacaacucucccccgucaacauaugcacauuccgaggcgacguuacacacauacccgguacccgagcauaccguaugaaccucgccucccaaaacuggaacaacuacgacccaaccgaagagauccccgcaccacucggcacgcccgacuucguaggcaaaauacaagggaugcucacacaaaccaccaaaggcgacggcuccacccgcggccacaaagccacugucuccaccggcuccgucgacuucacucccaaacucggaucaguccaauucgccacagacacugacaaugacuucgaaaccggccaaaacacccgauucacuccagucggcgucauccaagacggcuccuccacccaccgcaacgaaccccaacaauggguccucccagacuacucuggaaggaccguccacaacguccaccuagcccccgccguagcccccacauuccccggagagcagcuacuuuucuuucgcucaaccaugcccggaugcuccggauacccaaacauggaccuugacugccuccucccccaagaauggguccagcauuucuaccaagaggcagcccccucgcaaucagacgucgcccuccuccgcuucgucaaccccgacaccggacgcguccucuucgaaugcaaacuccacaaggcaggauacguaaccgucgcccacaccggccagcacgaccucguaaucccacccaacggcuacuuccgcuucgacuccugggucaaccaauuuuacacccucgcccccauggggaacggagccggccgccgucgagcccucuaa

SEQ ID NO: 36919 - RNA, 1623 nt, Artificial Sequence
  derived and/or modified sequence opt11 from capsid_protein__Norovirus__ACF41184
augaaaauggcauccaacgacgccaaccccucagacggcuccgcugcaaaccucgucccagaagucaacaacgaagucauggcccuugaacccguagucggcgccgccauagccgccccugucgcaggacaacaaaacgucaucgacccuuggauccgaaacaacuucguucaagcccccggcggcgaguucaccgucagcccacgcaacgccccaggcgaaauccuuugguccgcaccacucggacccgaccuaaaccccuaccuuucacaccucgcccgcauguauaacggcuacgccggaggauuugaaguccaaguaauccucgccggcaacgccuucaccgccggaaaaauaauauucgccgcaguacccccuaacuucccaacagaaggccucucccccucccaagucacaauguucccacauauaaucgucgacguccgucaacucgaacccguccucauaccccuccccgacguccgaaacaacuucuaccacuacaaccaaagcaaugacucgacaaucaaacugaucgccaugcuauacacaccccuucgcgcuaacaacgccggagaagaugucuucaccguauccugccgaguccuaacccguccgucccccgacuucgacuucauauuccucguaccuccgaccgucgaaucacgaaccaaaccauucaccguucccauuuuagccguugaggaaaugaccaacucccgcuuccccauaccccuugaaaaacucuucacaggcccauccagcgcacucgucguacaaccccagaacggccgauguaccaccgacggaguccuacuuggaacuacacaacucuccccagucaacauuugcacauuccgcggcgacgugacacacauagccggcucccgcaacuacacaaugaaccucgccucgcucaacuggaacaacuacgacccaaccgaagaaauccccgcaccccuaggaacaccugacuucgucggaaaaauccaaggaguccucacacaaaccaccaaaggcgacggcuccacccgaggccacaaagccaccgucuacacaggaucagcccccuucacacccaaacucggauccguccaguucggcacugacaccgaaaacgacuucgaaacccaccaaaacacaaaauucacccccgucggcgucauucaggacggcagcaccacccaccgaaacgaaccacaacaauggguccuucccuccuauagcggucgaaacguccacaacguccaccuagcccccgcagucgccccaacuuuccccggagaacagcuccuauucuuccgcuccaccaugccaggcugcuccggauaccccaacauggaccuagacugccuacucccccaagaauggguccaacacuucuaccaagaagccgcaccagcccaaucugacguugcucuccuacgcuucgucaacccagacaccggccgggugcuauucgaaugcaaacuccacaaaucaggauacgucacagucgcucacacuggccaacacgaccucgucaucccacccaacggcuauuuccguuucgacucuuggguuaaccaguuuuacacccuagcacccaugggaaacggcacaggccgcagacgagcacuauaa

SEQ ID NO: 36920 - RNA, 1623 nt, Artificial Sequence
  derived and/or modified sequence opt11 from capsid_protein__Norovirus__ACF41185
augaaaauggcaucaaacgacgccaacccauccgacggcuccgccgcaaaccucguccccgaagucaacaacgaagucauggcccucgaacccgucgucggcgccgccaucgcugcaccuguagcaggacaacaaaacguaaucgacccuuggauccgaaacaacuucguccaagcccccggaggcgaguucaccguauccccaagaaaugccccaggcgaaauacucugguccgccccucucggccccgaccucaaccccuaccucucacaccuagcccgcauguacaacggcuacgcgggaggauucgaaguccaaguaaucuuagcuggcaacgcauuuacagccggaaaaauuauauucgccgccgucccacccaauuuucccacagaaggccucucacccucacagguaacaauguucccacacaucaucgucgacguaagacaacucgaaccaguucucaucccacuaccagacgucaggaauaacuucuaccacuacaaccaaucaaaugacucaaccaucaaacuaaucgccaugcuauacacaccccuacgcgccaacaacgccggagacgaugucuucaccguauccugcagaguccuuacccgccccucacccgacuucgacuucauauuccucguaccgcccaccgucgaauccagaacaaaacccuucaccgucccgauccucaccgucgaagaaaugacaaacucacgauuccccauaccccuagaaaaacucuucacaggccccucuggcgccuucgucguccaaccccaaaacggccgaugcacaacagacggaguccuccucggcaccacacaacucuccccaguaaacaucugcacuuuccgcggcgacgucacccacaucgcuggcucucgcgacuacaccaugaaccuagcaagccucaauuggaacaauuacgaccccaccgaagaaauccccgcaccccucggcaccccagacuucgucggcaaaauccaagggguacuaacccaaacaaccaaaggcgacgggucaacacgcggccacaaagccaccguauacacgggcagcgcacccuucacgcccaaacucggaucaguacaauuccgcaccgacacagaaaacgauuuugagacccaccaaaauaccaaauucaccccagucggcguaauccaagacggaucaaccacccaccgcaacgaaccucaacaauggguccucccauccuacucuggccgaaauguucauaacguccaccuagcaccagccgucgccccgacauuucccggggaacaacucuuauucuuccgcuccaccaugcccggcugcucuggauaccccaacauggaucuagauugccuccucccccaagaauggguccaacacuucuaucaggaggcagcaccagcacaaucugacguggcccuacuacgauucgucaaucccgauaccggacgaguucucuucgaaugcaaacuccacaaauccggcuacguaacagucgcacacaccggccaacacgaccucgucaucccucccaacggcuacuuccgguucgacucaugggucaaucaguucuacacccuagcccccaugggcaacggaaccgggcggcgccgagcccucuaa

SEQ ID NO: 36921 - RNA, 1623 nt, Artificial Sequence
  derived and/or modified sequence opt11 from capsid_protein__Norovirus__ACF41186
augaaaauggcgucaaacgacgccaacccuuccggcggcucagccgcaaaccucgucccagaagucaacaacgaagucauggcccucgagcccgucguaggugccgcuauugcagcacccgucgccggacaacaaaacgucauagacccuuggauccgcaauaacuucguccaagcacccggcggugaguucaccgucuccccacgcaacgcccccggagaaauccucuggucagcaccccucggcccagaccucaaccccuaccuaucccaccucgccaggauguacaacggcuacgccggcggcuucgaaguucaaguuauccucgccggaaacgccuucacagccggcaaaauuaucuucgccgccguacccccaaacuuucccacugaaggccuaucucccucucaaguaaccauguucccacacaucaucguugacguccgccaacucgaacccguccuaauuccccuccccgacguacgcaacaacuucuaccacuacaaccaaucaaaugacucuaccaucaaacucaucgcaaugcuauacacaccccuacgcgcaaacaacgccggagaagacgucuucaccgucucaugccgcguacuaacccgaccaucacccgacuucgacuucaucuuccuaguucccccgacggucgagucuagaaccaaaccauucaccguacccauccuaacagucgaagaaaugaccaacucccgcuuuccaaucccccuugaaaaacuauucaccggcccaucaagcgccuucguaguccagccucaaaacggcagaugcaccacagacggcguacuucucggcaccacccaacucuccccgguaaacaucugcacuuuccgaggugacguaacccacauagcgggcucucgaaacuacaccaugaaccuagccucccucaacuggaacaacuacgacccaacagaagaaauacccgcaccccucggcacccccgacuucguaggaaaaauccaaggcguccugacgcaaacuacuaaaggcgacgguuccacccgcggacacaaggccacggucuauacagguuccgccccauucacucccaaacucggcucaguccaauucuccaccgacacagaaaacgauuucgaaacccaccaagacaccaaauucacccccguuggagucauccaagacggcggcaccacccaccgcaacgaaccccaacaauggguccuccccaguuacagcggccguaauguccaaaacguccaucuugcccccgccgucgcacccaccuucccuggcgaacaacuccuauucuuucgcucuaccaugcccgguugcucaggcuaccccaacauggaccucgacugucuacuaccccaagaauggguucaacacuucuaucaagaagcugcaccagcccaauccgacgucgcccuccuccgcuucgucaaccccgacacuggacgaguucucuucgaaugcaaacuccacaaauccggcuacguuaccgucgcccacaccggacaacaugaucuaguuaucccacccaauggcuacuuccgcuucgacuccugggucaaccaauucuacacccucgcccccaugggcaacggcacaggacgccgacgggcccucuaa

SEQ ID NO: 36922 - RNA, 1623 nt, Artificial Sequence
  derived and/or modified sequence opt11 from capsid_protein__Norovirus__ACF41187
augaaaauggccucaaacgacgcaaaccccuccgacggcuccgccgcaaaccuaguccccgaaguaaacaacgaagucauggcccuagaaccaguagucggagcugcaauagccgccccagucgcaggccagcaaaacguaaucgaccccuggauacgcaacaacuucguacaagcccccggcggcgaguucaccgucucaccccgaaacgcacccggcgaaauccucuggagcgcuccccucggcccugacuuaaacccauaccucucacaccucgcccgcauguacaacggcuacgccggcggauucgaaguccaaguaauacucgcaggcaacgccuucaccgccggcaagaucauauucgccgccguacccccaaacuucccaaccgaaggccuaucacccagccaagucaccauguuuccccacauaauagucgacguccgccaacucgaacccguccuuaucccucuccccgacguccggaauaacuucuaucacuacaaccaaagcaacgacuccacaauaaaacucauagcaaugcuauauacaccacuccgagccaauaacgcgggcgaagacgucuucaccgucuccugccgaguccuaacccgcccaucccccgacuuugacuucaucuuccucgucccacccaccgucgaaagccgcaccaaacccuucaccguccccaucuuaaccguugaagagaugacaaacuccagauuccccauaccccuagaaaaacuauucaccggccccagcuccgccuucgucguccaaccccagaacggccgcuguacaacagacggcguacuccuaggcaccacccagcucagccccgucaacaucugcaccuuucgcggcgacgucacccacaucgccggcucccgcaacuacaccaugaaccucgcaagccucaacuggaacaacuacgaccccaccgaagaaauccccgcuccccucgguacuccagacuucgucggcaaaauacgaggcguacuaacccaaaccacaaaaggcgacggaagcacccgcgggcacaaagcaacugucuauacaggcucggcccccuucacccccaaacuaggcuccguccaauucucaaccgacacugaaaacgacuucgaaacacaccaaaauaccaaauucacaccaguaggcguaauacaagacgguggcacaacucaccgcaacgaaccccaacaauggguacuccccagcuacuccggccgaaacguacccaauguccaccucgcaccagccgucgcacccaccuuccccggagaacagcuccucuucuucagauccacaaugccuggcugcuccgguuacccuaacauggaccucgacugcuuacucccacaagaauggguacaacacuucuaccaagaagccgcacccgcccaauccgacgucgcccuacuucgcuucgucaacccugacaccggcagaguccucuucgaaugcaaacuacacaaauccggcuacgucaccguugcccacacuggucaacaugaucucgucauaccgcccaauggcuacuuccgcuucgacucaugggucaaccaauucuauacacucgcccccaugggcaacggaaccggccgacgucgagcccucuga

SEQ ID NO: 36923 - RNA, 1623 nt, Artificial Sequence
  derived and/or modified sequence opt11 from capsid_protein__Norovirus__ACF41188
augaaaauggcuagcaacgacgccaaccccuccgacggauccgccgccaaucucguccccgaagucaacaacgaagucauggcacucgaaccaguagucggcgccgccaucgcagcacccgucgccggccaacaaaacguaaucgacccguggaucagaaacaacuucguacaagcaccaggcggcgaguucacagucuccccacgcaacgcccccggagaaauccucuggucagcaccacucggaccugaccucaaccccuaccucucccaccucgccagaauguauaauggcuacgccggaggauucgaaguacaagucauccuugccggcaaugcuuucaccgcaggaaaaaucauuuucgccgccgucccucccaacuuucccacagaaggacucucacccucccaaguaaccauguucccccacaucaucguagacguccggcaacucgaacccguccucaucccccuucccgacguccgaaacaacuucuaccacuauaaucaguccaacgacuccacaaucaaacuaaucgccaugcucuacacaccccuacgcgccaacaaugcaggagaagacgucuucaccguuucaugucguguucucacacgccccucacccgauuucgacuucaucuuccucgucccacccacagucgaaucucgaacuaaacccuucaccguccccauccucaccguagaagaaaugacaaacucccgcuucccaaucccccuagaaaaacuuuucaccggcccuucuuccgccuucguaguccaaccccaaaacggccgcugcacaaccgacggcgucuuacuaggcaccacacaacugucuccagucaacaucugcaccuuccgcggcgacgucacccacaucgccggcucccgaaacuacaccaugaaccuggcaucccucaacuggaacaacuacgaccccaccgaagaaauacccgcaccccucggcaccccagacuucgucggcaaaauucaaggaguccuaacccaaaccaccaaaggagacggcuccaccagaggccacaaagccaccgccuacaccggaucagcucccuucacaccaaaacugggauccguccaauucucaaccgauaccgaaaacgacuucgaaacccaccagaacacuaaauucgcccccgucggcgucauacaagacggcggaaccacccaccgaaacgaaccacaacaauggguccuccccucauacuccggccguaacgucccgaacguccaccucgcaccagccgucgcccccaccuuccccggcgaacaacuacucuucuuccgcucaacaaugcccggcuguuccggcuaccccaacauggaccuagacugccuccucccacaagaauggguccaacauuucuaucaagaagcugcacccgcccaauccgacguugccuuacuccgcuucguaaaccccgacaccggacgcguccuauucgaaugcaaacuacacaaauccggauacgucacugucgcccacacaggccagcaugaccuaguaauaccacccaacggcuacuuccgauucgacuccuggguaaaccaauucuacacccuagcaccaaugggaaacggaacaggccgccgacgagcccuauga

SEQ ID NO: 36924 - RNA, 1623 nt, Artificial Sequence
  derived and/or modified sequence opt11 from capsid_protein__Norovirus__ACF41190
augaaaauggccuccaacgacgcaaaccccagcgacggcuccgccgccaaccucguccccgaaguaaacaaugaagucauggcgcucgaacccgucgucggcgccgccaucgccgccccaguagccggccaacaaaacgucaucgaccccuggauacgaaacaacuucguacaagcucccgguggagaguucaccgucucuccgagaaacgccccaggagaaaucuuguggucugcuccccucggcccugaccuaaacccguaccucucccaccucgcccgcauguacaacggcuacgccggaggcuucgaaguacaggucauacuggcgggcaacgccuucacagcgggcaaaaucaucuucgccgcaguucccccaaacuuccccacagaaggucucucccccagccaagucaccauguucccccacaucauagucgacguccgccaauuagaacccguucucaucccucuccccgacguacguaacaacuucuaccacuacaaccaaucaaacgacucaaccauaaagcugauagccaugcuauacacaccacuacgagcaaacaacgcaggcgaagacgucuucacugucucaugcagaguucucaccagaccaagccccgacuucgacuuuaucuuccucguuccacccacaguggaaucacguaccaaacccuucacaguacccauacuaaccgucgaagaaaugaccaacucccguuucccaauuccucucgaaaaacucuucaccggacccagcuccgcauucgucguacagccacaaaacggccgcugcaccacagacggcguccuccuaggaaccacucaacuuucaccuguaaacaucugcaccuuccgcggagacguaacccacaucgccggaucacgcaacuacacuaugaaccucgcaucacucaacuggaacaacuacgaccccaccgaagagauacccgccccacucgguacaccagacuucguaggcaaaauccaaggaguacuaacccaaacaaccaaaggcgacggcucaacaagaggucacaaagccacagucuacacaggcuccgcacccuucacacccaaacucggcucaguacaauucuccacagacacagagaacgacuucgaaacacaccaaaacaccaaauucacacccguaggaguaauccaagacggcggaaccacacacagaaacgaaccccaacaauggguccuacccuccuauucaggacgaaacgucccaaacguccacuuagccccagcuguagcacccaccuuccccggcgaacaacuacucuucuuccgauccaccaugcccggcuguucaggauaccccaacauggaccucgacugccuacucccccaagaauggguucaacacuucuaccaagaagccgcccccgcccaaucagacguugcccuacuccgauucguaaacccagacacgggaagaguccuauuugaaugcaaacuccauaaaucaggguacgucaccgucgcccacaccggccaacacgaccuggucauacccccaaacggcuacuucagauucgacucaugggucaaccaauucuacacccucgccccaaugggcaacggcacaggccgacgacgagcacucuaa

SEQ ID NO: 36925 - RNA, 1623 nt, Artificial Sequence
  derived and/or modified sequence opt11 from capsid_protein__Norovirus__ACF41191
augaagauggccuccaacgacgccaaccccuccgacggauccgccgccaaccucguccccgaagucaacaacgaagucauggcccuagaacccguagucggcgccgccauugccgcccccgucgcuggacaacaaaacgucaucgaccccuggauccgcaauaacuucguccaagcucccggcggcgaguucaccgucucaccccgcaacgccccaggagaaauacucuggucugcaccacuuggccccgaccuuaaccccuaucucucccaccucgcaagaauguacaauggcuacgccggcggcuucgaaguucaagucauccucgcaggaaacgccuucaccgcaggaaaaaucauauucgccgcagugcccccuaacuuccccaccgaaggccucucacccucccaagucaccauguucccccacaucaucguagacguacgccaacuagaaccuguacucauaccccucccagacguccgcaacaacuucuaccacuacaaccaguccaacgacuccacaaucaaacuaauagcuaugcucuacacaccccuccgugcaaacaacgcaggagaagacgucuucaccguauccugccgaguacuuacccgccccagccccggcuucgacuucaucuuccucguaccacccaccguagaaucccgcaccaaaccguucaccguacccauacucaccguagaagaaaugaccaacucccgauucccaaucccucucgaaaaacuauucacuggccccucuuccgcauucgucguccaaccccaaaacggucgcugcacuaccgacggaguccuccucggcaccacccaacuaucccccgucaacauaugcaccuuccgaggcgacguuacacacauagccgguucucguaacuacaccaugaaccucgccucccucaacuggaacaacuacgaccccaccgaagaaauccccgcuccccucggcacaccagacuucgucggaaaaauccaaggcguauuaacacaaacaaccaaaggcgacggguccacucguggacacaaggccaccgucuauaccggcuccgcccccuucacccccaaacuaggauccguccaauucuccaccgacaccgaaaacgacuucgaaacccaccaaaacacaaaauucacccccgucggagucauccaagacggcggcaccacccaccgcaacgaaccccaacaguggguacuacccagcuacucaggccgcaacguccccaacguacaucuagccccagcaguggcucccaccuuccccggagaacagcuccucuuuuuccgcuccaccaugcccgguugcuccggcuaccccaacauggaccucgacugccuacucccacaagaauggguccaacacuucuaccaagaagcagcacccgcccaauccgacgucgcacuccuccgcuucgucaaccccgacacgggccguguacuuuucgaaugcaaacuacauaaauccggcuacgucacagucgcccacaccggccaacacgaccucgucaucccacccaacggcuacuuccgauucgacuccugggucaaccaauucuacacacucgcucccaugggaaacggcacuggccggcgccgcgcucucuaa

SEQ ID NO: 36926 - RNA, 1647 nt, Artificial Sequence
  derived and/or modified sequence opt11 from capsid_protein__Norovirus__ACF60293
augaaaauggccuccaacgaugcaacccccuccaacgacggcgccgcaggccucgucccugaaauaaacaacgaagccauggcacuagaccccgucgccggagcagccauagccgcaccacucaccggccaacaaaacauaauugacccuuggauaaugaauaacuucguccaagccccgggcggcgaguucaccguuuccccuagaaauucaccaggcgaaguacuccuaaaccuagaacucggccccgaaaucaacccguaccuagcccaccucgcccgcauguacaacggcuacgccggcggcuucgaaguccaagucguacucgccggaaacgcauucacugccggcaaaauuaucuucgccgccauaccaccaaacuuccccauagaaaaccucucagccgcccaaauaaccauguguccccauguuaucgucgacguacgccaacuagagcccgucaaccucccaaugccagacguccgcaacaacuucuuccacuacaaccaaggcucagacucuaaacuucgauuaguagcaaugcucuacacaccccugcgcgccaacaacucaggcgacgacgucuucaccgucuccugcagaguccucacccgccccucccccgacuucagcuucaacuuccucgucccacccaccgucgaaucaaaaacuaaaccauucacacuccccauccucaccauauccgaaaugucaaacucccgcuuccccguccccauagacucucuacacaccucccccaccgaaaacaucgucguccaaugucaaaacggacgcgucacccucgacggcgaacuuaugggaaccacccaacuccucccaucccaaaucugcgcauuccgcggcguccuuacacgcucaaccucccgcgcaucagaccaagcagacacagccacuccgcgccuuuucaacuacuacuggcacauacaacucgacaaccucaacggcacacccuacgauccugcagaagacauacccggaccccuuggcacaccagacuuccgcggaaaagucuucggcgucgcaucccagcgcaauccagauagcacuacucgagcacacgaagcaaaagucgacaccaccgcaggccguuucacccccaaacucggcucccucgaaaucuccaccgaauccggcgacuuugaucaaaaucaaccaacacgcuucacccccgucggcauuggagucgaccaugaagcagacuuucaacaauggucccucccugacuacuccggccaauuuacccacaacaugaaccuagcccccgccgucgcccccaacuuccccggcgaacaacuccucuuuuuccgaucacaacucccauccucuggcggccgauccaacggcauacuagacugcagagucccccaagaauggguccaacacuucuaucaagaaucagcccccgcccagacccaaguagcacuuguccguuacgucaaccccgacaccggacgaguacuuuucgaagccaagcuccacaaacucggcuuuaugaccauugccaaaaacggcgacagcccuaucaccguucccccaaacggauacuucagauucgaauccugggucaacccuuuuuacacacuagcuccaaugggcacuggcaacgggcgcagacgaauccaauaa

SEQ ID NO: 36927 - RNA, 1647 nt, Artificial Sequence
  derived and/or modified sequence opt11 from capsid_protein__Norovirus__ACF60294
augaaaauggccuccaacgacgcaacccccuccaacgacggagcagccggccuagucccagaaaucaacaaugaagcuauggcccuggaccccgucgcaggagcugccaucgccgcaccccucaccggacaacaaaauaucauagaccccuggaucaugaacaacuucguccaagcccccggcggcgaauuuaccgucaguccacgcaacagccccggcgaaguacuccucaaucucgagcuagggcccgaaauaaacccguaccucgcccaccucgcccguauguauaacggcuacgccggcggcuucgaaguccaagucguacucgccggaaacgccuucaccgcaggcaaaauuauauucgccgccaucccacccaacuuccccaucgacaaccuuuccgcagcccaaaucaccaugugcccacacguaaucguagacguccgacaacucgaacccguaaaccuucccaugcccgacguccggaacaacuucuuucacuacaaucaaggcuccgacucaagacuacgccuuguagccaugcucuauacaccccuccgcgccaacaacaguggagacgacgucuucaccgucuccugccgcguacuaaccagacccucccccgacuucucauucaacuuccuaguaccgcccaccguugaauccaagacaaaacccuucacacuuccaauucucacaauauccgaaauguccaacuccagauucccagucccaaucgacucgcuacauacauccccaacagaaaacaucgucguccaaugccaaaacggccgcguaacacucgacggcgaacuaaugggcacaacccaacuccucccaucccaaaucugcgccuuccgcggcguucugacccgcagcacaucacgcgccuccgaccaagcagacacagccacaccccgacucuuuaacuacuacuggcacauacaacucgacaaccuuaacggaacccccuacgacccagccgaagacauccccggcccccuaggcacacccgacuuucgcggcaaagucuucggcgucgcaucacaaagaaaccccgacuccaccacccgcgcacacgaagccaaaguagacaccaccgccggacgcuuuacucccaaacuaggaucccucgaaauuagcaccgaauccggagacuucgaccaaaaucaacccacccgauucacccccgucggcaucggaguagaccacgaagccgacuuccaacaauggucccucccagacuauuccggucaauucacacacaacaugaaccucgcaccagcuguagccccaaacuucccaggcgaacaacuccuauucuuccgaucccaacuacccucuagcggcggacgcuccaacgguauccucgacugccucgucccacaagaauggguccaacacuucuaccaagaauccgcccccgcccagacccaagucgcacucguccgcuacgucaauccagacaccggccgaguacuauucgaagccaaacuccacaaacucggcuucaugaccaucgccaaaaacggugauucgcccaucacagucccacccaacggcuacuuccguuucgaaucauggguaaacccuuucuacacacuagcaccaauggggacaggcaauggccgccgccgaauacaauaa

SEQ ID NO: 36928 - RNA, 1647 nt, Artificial Sequence
  derived and/or modified sequence opt11 from capsid_protein__Norovirus__ACF60295
augaaaauggccucaaacgacgccacacccucaaacgacggcgcagccggccucgugcccgaaaucaacaacgaagcaauggcacucgacccaguagccggugcagcaaucgcagcaccacucaccggccaacagaacaucaucgaccccuggaucaugaacaacuucguccaggcaccaggcggcgaguucacagucucccccagaaacucuccaggagaagucccacucaaccucgaacucggacccgaaauaaacccuuaccuugcccaccuugcccgcauguacaacggauacgccggcggcuucgaaguacaaguugugcuagccgggaacgccuucaccgccggcaagaucaucuuugccgccaucccaccaaauuuucccacagauaaccuauccgccgcucaaaucaccaugugcccccacgucaucgucgauguacgccaacuagaaccagucaaccuaccuaugcccgacguccgcaauaacuucuuccacuacaaucaaggcucagacucacgacuccgucucguagccaugcuguacacaccccuacgugcaaacaacuccggagacgacguauucacagucuccugucgaguccuaacccgacccuccccagacuucuccuucaacuuccucguaccacccaccguagaaucaaaaaccaaacccuucacacucccaauccucacuauauccgaaauguccaacucucguuuccccguccccaucgauucccuccacaccucccccaccgaaaacaucgucguccaaugccaaaauggacgugucacacuagacggagaacuaaugggaaccacccaacuucuccccucccaaaucugcgccuuccgcggcguucucacccgaucaaccucccgcgccagcgaccaagccgacaccgccacuccccgccucuucaacuacuacuggcacauacaacucgacaaccucaacggcacccccuacgacccagccgaagacauccccggcccucuaggcaccccagacuuucgaggaaaaguauucggagucgcaucacagcgcaaccccgacuccacaacuagagcccacgaagcaaaagucgacacaacagcaggacgcuucacccccaagcucggaucccuagaaaucucaacagaauccgacgacuuugaccaaaaucaaccaacucgauucacacccgucggaauaggagucgaccacgaagccgacuuccaacaauggucccucccagacuacucuggacaguucacccacaacaugaaccucgcaccagcaguagccccaaacuucccaggagaacaacuacuauucuuccgcagccaacuccccuccuccggcggccguuccaacggcauccucgacugccuagucccacaagaauggguacaacacuuuuaccaagaaucugcccccgcucaaacccaagucgcccuaguccguuacgucaaccccgacaccggcagaguccuauucgaagccaaacuccauaaacucggauucaugaccauagccaaaaauggcgacucacccaucaccgucccacccaacgguuacuuccgcuucgaauccuggguaaaccccuucuauacccuagcucccaugggcacaggaaacggccgaagacgaauccaauag

SEQ ID NO: 36929 - RNA, 1647 nt, Artificial Sequence
  derived and/or modified sequence opt11 from capsid_protein__Norovirus__ACF60296
augaaaauggccuccaacgacgccaccccuuccaacgacggcgccgccgggcucguccccgaaauaaacaacgaagccauggcucucgaccccgucgccggagccgccauagccgcaccucucaccggacaacagaauauaaucgacccuuggaucaugaacaacuucguucaagcccccggcggcgaguucacaguaucaccccgcaacucccccggcgaagucuuacuaaaccucgaacucggucccgaaaucaauccauaccucgcacaccucgcccgaauguacaacggcuacgcaggcggcuucgaaguucaaguaguccucgcaggcaacgccuucaccgccggcaaaaucaucuucgcagccauacccccaaacuuccccaucgacaaccuuuccgcugcccaaaucaccaugugcccacacguuaucgucgauguccgccaacuagaaccaguaaaccuccccaugcccgacguccgaaacaacuucuuccacuacaaucaaggauccgacucccgucuucgccucgucgccaugcuuuacacaccccugcgcgccaacaacuccggagacgacguuuucaccgucucaugccgcguccucacccgaccauccccagauuucucuuucaacuuccucgucccacccaccgucgaauccaaaaccaaacccuucacccuacccauccucaccaucucagaaaugucaaacucaagauuccccguccccauugacucacuacacaccucacccaccgaaaacaucguaguccaaugccaaaacggccgcguaacacuggacggagagcuuaugggcaccacacaacuccuaccaucccaaaucugugcuuuccgcggcguacucacacgaucaaccucgcgggcaucagaucaagccgacaccgcgacuccacgccucuucaacuacuacuggcacauccagcuagacaaccuaaacggcaccccuuacgacccggcagaagacauacccggaccccucgguacccccgauuuccgaggaaaaguauucggcguagccucgcaacgaaacccugacuccaccacucgagcccacgaagccaaagucgacaccacagccggccgcuucaccccaaaacucggaucauuagaaaucuccacagaaucggacgacuucgaucagaaccaaccaacccgcuucacccccgucggcaucggaguugaccaugaagccgacuuucaacaauggucccuccccgacuacuccggccaauuuacccacaacaugaaccuagcccccgcaguagcacccaacuuccccggagaacaacuccucuucuuucgcucccaacucccgucuagcggcggccgcucaaacggcauccuagacugccucgucccacaagaguggguacaacacuucuaccaagaauccgcacccgcacaaacucaagucgcacucguccgcuacgucaacccugacaccggacgcguacuauucgaagccaaacuccacaaacucggcuucaugacaaucgccaaaaacggagacucaccaaucacaguacccccaaacggcuauuuccgcuucgaauccugggucaaccccuucuacacucucgcucccaugggaaccggaaacggccgccgcagaauccaauaa

SEQ ID NO: 36930 - RNA, 1647 nt, Artificial Sequence
  derived and/or modified sequence opt11 from capsid_protein__Norovirus__ACF60297
augaaaauggccuccaacgacgccacccccuccaacgacggcgccgccggccucguccccgaaauaaauaacgaagccauggcccucgacccaguagccggcgcagcaaucgccgccccucuuaccggacaacaaaacauaaucgaccccuggaucaugaacaauuucguucaagcaccaggcggagaauuuaccgucucccccagaaacucccccggugaaguacuacuaaaccucgaacuaggacccgaaauaaacccauaccucgcccaccuugccagaauguauaauggcuacgccggcgguuucgaaguacaagucguccucgccggcaaugccuucaccgccggcaaaaucaucuucgccgcuauacccccaaacuuccccaucgacaaccuaucagcagcccaaauuaccaugugcccccacgucaucgucgacguccgucaacucgaaccaguaaaccuacccaugccagacguccgcaacaacuucuuccacuauaaccaaggcucggacucacgccuccgccuagucgcaaugcucuacacuccccuacgagccaacaacuccggcgaugacguuuucaccgucuccugcagaguccucacccgaccgucccccgacuucuccuucaacuuccucguucccccaaccgucgaaucaaaaaccaaacccuucacacucccaauucuaaccaucagcgaaaugucaaacucucgcuuccccguaccuauagacucccuuuacaccucccccaccgaaaacauugucguacaaugccaaaacggacgagucacacuugacggcgaacucguaggaacaacucaacuacucccaucccaaaucugcgccuuccggggcguacucacucgcuccaccucacgcgcaucagaccaggcagacaccgccacaccacgacucuucaacuacuacuggcacauccaacucgacaaccucaacggaacuccguacgaccccgccgaagacaucccaggcccacucggcaccccagacuuccgcggcaaaguuuuuggcgucgccucccaacgaaaccccgauuccaccacccgcgcacacgaagccaaagucgacaccaccgcuggcagauucacaccaaaacuugguagccucgaaaucucuaccgaaucaggcgacuucgaccaaaaccaacccacucgauucacccccguagggaucggcgucgaccaugaagccgacuuccaacaauggucccuccccgacuacuccggccaauucacccacaacaugaaccuagcacccgcaguagcccccaacuuccccggagaacaacuucucuucuuccgcucacaacuuccuagcucaggcggacgcucuaacgggauucucgauuguuuagucccccaagaauggguacaacacuuuuaccaagaauccgcccccgcucagacccaagucgcucuaguccgcuacguuaaucccgacaccggccgcguucuauucgaagcaaaacuacacaaacuuggcuucaugaccaucgccaaaaacggcgacucaccaaucaccguaccacccaacggcuacuuccgcuuugaaagcugggucaaccccuucuacacccuagcucccaugggaaccggaaacggacgccgucgaauacaauaa

SEQ ID NO: 36931 - RNA, 1626 nt, Artificial Sequence
  derived and/or modified sequence opt11 from capsid_protein__Norovirus__ACF72688
augcgcaugucagacggcgccgccccaaaagcaaacgguuccgaagcauccggccaagacuuaguacccaccgccgucgaacaagccguccccauccagcccguggcaggcgcggcucucgccgccccagcagccggacaaauaaaccaaaucgaccccuggauauuucaaaacuucguacaaugcccacucggcgaauuuucaaucuccccacgcaacacccccggcgaaauccuauucgaccucgcauuaggacccggccuuaaccccuaccucgcccaucuuuccgccauguacacagguugggucgguaacauggaaguccaacucguccucgcuggcaacgccuucacagcuggcaaaguagucgucgcccuaguaccucccuacuucucgaaaggcucgcucacaaccgcacaaaucacaugcuucccccacgucaugugcgauguccgaacccucgaacccauccaacuuccccuccucgacguccgccguguccuuuggcacgcaacacaagaccaagaagaauccaugcgccuugucugcaugcuauacacuccccuacggaccaacagccccggagacgaauccuucgucgucagcggccgccuccucucaaaaccagcacccgacuucaacuucgucuaucuaaccccucccauagaacguaccaucuacagaaugguagaccucccccuccuccaaccccgccucugcacccacgcccgauggccugcacccguauacggacuccucgucgauccuucgcucccuagcaacccccaauggcaaaauggccgcguccacgucgacggaacccuccuagguaccaccccagucucaggaucuugggucucuuguuucgcagccgaagcagccuacgaguuccaguccggcaucggcgaaguugucaccuucaccaugaucgaacaagacggcucagccuacgucccaggcgaccgcgccgcgccacuuggauaccccgacuucaguggacaacucgaaaucgaaguacaaacagaaaccacaaaaaccggcgacaaacucaaaguaacaacauucgaaaugauccucggacccaccacaaacgucgaucaagcucccuaccaaggccgcgccuacgcaucacucacugccauggccucacuugaccuggucgacggccgcguccgcgcggucccccgcuccauauacucauuccaagacgaacuccccgaauacaacgacggccuacuggucccauuagccccaccccugggccccuuccuacccggagaagugcuacuacgcuuccgcacauacaugcggcaacuugacaccgccgacgccgcagcccaacccaucgacugcgcccuaccccaagaguucaucuccugguucgcauccaacaacuucaccguacaauccgacgcccuccuaguccgcuaccgcaacacccuaaccggccaacuucucuuugaagccaaacuauacagcgaaggcuacaucgccgucucauacagcggcuccggcccacucaccuuccccacugacggauuuuucgaagucguaucaugggucccccgacuauuccaacucgccucugucggaucccucgcaacaggaagaacacucaaacaauaa

SEQ ID NO: 36932 - RNA, 1623 nt, Artificial Sequence
  derived and/or modified sequence opt11 from capsid_protein__Norovirus__ACH42093
augaaaauggccucaaacgacgccacccccucagacggaucuaccgccaaccucguacccgaagucaacaacgaagugauggcacuggaacccguaguaggugcagcaaucgcagcccccgucgccggccaacaaaacguaaucgacccauggauccgcaacaacuucguccaagcccccggcggagaauuuaccgucagcccccgcaaugcccccggagaaauucuauggucagcaccacucggccccgacuuaaaccccuaccuuucacaccuagcccgcauguacaacggcuacgccggcgguuucgaaguacaagucauacuagccggcaaugcauucaccgcaggcaaaauaaucuucgcagcagucccaccaaacuuccccaccgaaggacucucacccucucaagucaccauguucccccacaucauaguagacguucgacaacuagaacccguacuaaucccacuccccgacguacgaaacaacuucuaccacuacaaccaaagcaacgaccccaccauaaaacucauagcaaugcucuacacaccccuacgagccaacaacgccggagacgacgucuuuaccguauccugccgcguccuaacccgaccaucacccgacuuugacuucaucuuccuuguacccccaaccgucgaaucucgcaccaaaccauucagcgucccaauccucacagucgaagaaaugaccaacucacgcuucccuaucccccucgaaaaacucuucaccggacccuccuccgccuucgucguccaaccacaaaacggacggugcacuacagacggaguuuuacucggcaccacgcaacuuucccccgucaacaucugcacauuccgcggagacgucacacacauagccggcacacaaaacuacacaaugaaccucgccucccaaaacuggaauaacuacgaccccacagaagaaauacccgcgccccucggcacccccgacuucguaggcaaaauucagggaguccucacgcaaaccacucgucgugacggauccacccgaggccacaaagccacaguaucaacaggcuccguccacuucacaccaaaacucggaucaguccaauucucaaccgacaccucuaacgacuucgaaaccggucagaacaccaaauucacccccguaggcguuguccaagacggaagcacgacccaucaaaacgagccacaacaauggguccuacccgacuacuccggacgugacagccacaacguucacuuagccccggccgucgccccaacauuccccggugaacagcuccuuuucuuccgcuccaccaugcccgguugcucagguuaccccaacaugaaccucgacugccuauuaccccaagaauggguccaacacuucuaccaggaauccgcccccgcccaauccgacgucgcccuacucagauucgucaaucccgacaccggccgcguccuauucgaaugcaaacuacacaaauccggcuacgucaccgucgcccacaccggccaacacgaucucgucaucccacccaacggauacuuccgcuuugacuccuggguaaaucaauuuuacacucucgcccccaugggcaacggcgccggacgccgucgagcccuauga

SEQ ID NO: 36933 - RNA, 1623 nt, Artificial Sequence
  derived and/or modified sequence opt11 from capsid_protein__Norovirus__ACH42094
augaaaauggcuucaaacgacgccacccccuccgacggcucuacagccaaucuuguacccgaagucaacaacgaagucauggcgcucgaacccguagucggagcagccaucgccgcacccgucgcaggacaacaaaacguaauugacccauggauaagaaacaauuucgugcaagcaccaggcggcgaguucacagucucaccacguaacgcccccggagaaauacuuugguccgccccacucggccccgaccuaaaccccuaccucucacaccucgcccgcauguacaacggcuacgccggaggcuucgaaguucaagucauccucgccggaaacgccuucaccgccggaaaaaucaucuucgcugcagucccucccaacuuccccaccgaaggccuaucccccucccaagucaccauguucccccacaucaucgucgacguacgccaacucgaacccguccucaucccccuaccagauguccgcaacaacuucuaccacuacaaccaauccaacgaccccacaaucaaacuaaucgcaaugcucuacacuccccuccgagccaacaacgcaggcgacgacguauucaccguguccugccgaguacucacacgcccuucaccagacuuugauuucaucuuccuagugcccccaaccguagaauccagaaccaagcccuucucuguacccauucucacugucgaagaaaugaccaacucccguuuccccaucccgcuagaaaaacucuucaccggucccuccagcgcauuugucguacaaccacaaaacggccgaugcaccacugacggaguccuccucggcacuacacaacucucacccgucaacaucugcacauuccggggagacgucacccacaucgcuggcacccaaaacuacacaaugaaccucgcgucccaaaacuggaacaauuacgacccaacagaagaaauccccgcaccucucgguaccccggacuuugucggaaaaauacaaggcguccucacccaaaccacacgcagagacggcuccacacgcggccacaaagccaccgucuccacuggcuccguccacuucaccccaaaacucggcucaguccaauucucaaccgacaccucuaacgacuuugaaaccggacaaaauacucgauucaccccaguaggcgucguucaagacgguuccaccacacaccaaaacgagccccaacaauggguccuccccgacuauuccggccgcgacucacacaacguccaccuagccccagcugucgcaccgacauuccccggcgaacaacuacucuucuuccgaucuacaaugcccggaugcuccggcuacccaaacaugaaccuagacugccuccucccccaagaauggguacaacacuucuaccaagaauccgcacccgcccaaagcgacgucgccuuacuccgcuucguaaaucccgacacuggacguguccuauucgaaugcaaacuccacaaaagcggcuacguaaccguggcacacaccggccaacacgaccucgucaucccucccaacggcuacuuccgauucgauuccugggucaaccaauuuuacacccuagcaccgaugggaaacggugccggaagacgccgcgcacuauaa

SEQ ID NO: 36934 - RNA, 1623 nt, Artificial Sequence
  derived and/or modified sequence opt11 from capsid_protein__Norovirus__ACH42096
augaaaauggcaucaaacgacgccacacccagcgacggcuccaccgccaaccuagucccagaagucaacaacgaaguaauggcacucgaacccguaguaggagccgcaaucgccgccccagucgcuggacaacaaaacgucaucgacccauggauuagaaacaacuucguccaagcccccgguggcgaauuuaccgucuccccacguaacgccccaggcgaaauccuaugguccgcaccccucggcccagaccucaacccauaccucucacaccuagcccgaauguacaacggauacgcuggaggcuucgaaguccaagucauccuagccggcaacgcauuuaccgccggcaaaaucaucuucgccgccguucccccaaacuucccuaccgagggccucucccccucccaagucaccauguuuccacacauuauagucgacguccgacagcuugaacccguucuaauuccccuccccgacguccgcaacaacuuuuaccacuacaaccaauccaacgaccccacaauaaaacucaucgccaugcucuacacuccccuccgcgccaacaacgccggcgacgacguuuucaccgucucaugccgaguccucacccgacccucacccgacuucgacuucaucuuccucguacccccaaccgucgaaucucgaacaaaaccauucuccguccccauacucaccgucgaagaaaugaccaacucccgcuuccccaucccacucgaaaaacucuucaccggaccauccagcgccuucgucguacagccccaaaacggccgcugcacaacagauggaguacuccuaggcacaacccaacuaagcccagucaacauaugcaccuuucguggcgacguuacacacaucgcuggcacccaaaacuacaccaugaaccucgcgucccaaaacuggaacaacuacgaccccaccgaagaaauccccgcaccucucggcacacccgauuucguaggcaaaauccaaggcguacugacccaaacaacacgcagagacggcuccacuagaggccacaaagcaacagucuccacaggauccguccacuucacccccaaacuaggcucuguacaauucucaaccgacacauccaacgacuucgaaaccggccaaaacacccguuucacccccgucggagucguacaagacggcucuacuacccaucagaacgaaccccaacaauggguccucccggacuacucaggucgagacucucacaacguccaccuagcccccgcagucgcccccacauucccaggcgaacaacuccuuuucuucagauccacaaugccaggaugcucaggcuaccccaacaugaaccucgacuguuuacuaccacaagaauggguacaacacuucuaccaagaaagcgccccagcccaauccgacgucgcacuccuccgauucgucaaccccgacaccggccggguccuguucgaauguaaacuccacaaaagcggcuacgugacagucgcacacaccggccaacacgaucuggucauacccccaaacggauacuuccgauucgacuccugggucaaccaauucuacacccuagcacccaugggcaacggcgccggccgacgccgcgcacuauaa

SEQ ID NO: 36935 - RNA, 1623 nt, Artificial Sequence
  derived and/or modified sequence opt11 from capsid_protein__Norovirus__ACH42097
augaaaauggccucaaacgacgccaccccuuccgacggcucaaccgcaaaucucguccccgaagucaacaaugaagucauggcccucgaacccgucgucggcgccgcuaucgcagcacccguugcaggccaacaaaacgucaucgaccccuggauucgcaacaacuucguccaagcccccgggggcgaguucaccgucucaccccguaacgccccgggggaaauccuaugguccgccccucucggccccgaccuaaacccauaccucucacaccucgcacguauguacaacggcuacgccggaggcuucgaaguacaagucauccuagccggaaacgccuucaccgcaggaaagaucauuuucgccgcugucccacccaacuuccccacagaaggccucucccccagccaagucaccauguucccucacaucaucguagacguccgucaacuagaaccaguucucauaccccucccagacgucagaaacaacuucuaucauuacaaccaguccaacgaccccacaauaaaacuaauagccaugcucuacacaccccuacgagcuaacaacgccggagacgacgucuucaccguuucuugccgagugcucacccgcccaucccccgacuucgacuucaucuuucucguacccccaaccgucgaaucucgcacaaagcccuuuuccgucccaauccuuaccgucgaagaaaugacuaacucccgauuccccaucccccuagaaaaacuuuucaccggccccuccuccgccuucgucguccaaccacaaaauggacgcugcaccaccgacggaguacuucuaggcacaacccaacuuuccccagucaacauuugcacauuccgcggcgacguaacucacaucgccgguacccaaaacuacacaaugaaccuagcaucccaaaacuggaacaacuaugaucccacugaagaaauccccgcuccccucggcacccccgacuuuguaggcaaaauccaaggcguccucacacagacaacccgccgagacggcucaacccguggacacaaagccacaguauccaccggaucaguccacuucacccccaaacuaggcagcguccaauucucaacagacaccucaaacgacuucgaaacaggccaaaacacccgcuucacccccgucggcgucguccaagacggcucaaccacccaccaaaacgaaccacaacaauggguccuacccgacuauuccggacgugacagccacaacguacacuuagcccccgccgucgcccccaccuucccaggcgaacaacuacucuucuuccgcucgaccaugccaggcugcucaggauaucccaacaugaaccuagacugccuccucccacaagaauggguccaacauuucuaccaagaaucagcccccgcccaaagcgacgucgcccuacuaagauucguaaacccagacacaggccgaguccuauucgaaugcaaacuccacaaguccggcuaugucaccguagcccacacuggccagcacgaucucgucauaccacccaacggcuacuuccgauucgacuccugggucaaccaauuuuacacccucgcccccaugggcaacggggcaggccgacgccgcgcccuauaa

SEQ ID NO: 36936 - RNA, 1623 nt, Artificial Sequence
  derived and/or modified sequence opt11 from capsid_protein__Norovirus__ACH42098
augaaaauggccuccaacgacgccacaccuucagacggaucaaccgccaaccucguacccgaaguaaacaacgaaguaauggcccuagagcccgucguaggcgcagccaucgccgcccccgucgccggccaacaaaaugucauagacccauggauccguaacaacuucguacaagccccaggcggggaguucaccgucagcccccgaaacgcccccggagaaauacucugguccgccccacuaggcccggaucucaacccauaccuaucccaccucgcacgcauguacaacggcuacgccgggggcuucgaaguccaaguuauccucgcaggcaacgccuucacagccggcaaaauaauauucgccgcagucccaccaaacuuccccaccgaaggacucagcccaucccaagucacgauguuuccccacaucauagucgacguccgccaacucgaaccaguucucaucccccucccugacguccgaaacaacuucuaccacuacaaccaauccaacgaccccacaaucaaacuaaucgccaugcucuauacaccccuacgcgccaacaaugcaggggacgacgucuucacagugagcugcagaguccucacccgcccaaguccagacuucgacuucauauuccucgucccacccacagucgaaucacgcaccaaacccuucucagucccuauacucacaguggaagaaaugaccaacucacgauuccccauaccccuagaaaaacuauucacuggacccucaucagccuucgucguccaaccccaaaauggccgcugcacgacugacggcguacuccuuggcacaacacaacucuccccagugaacaucuguacauuccgcggagacguaacucacaucgcaggcacccaaaacuacacaaugaaccucgcaagccagaacuggaacaauuacgaccccaccgaagaaaucccagccccacuaggaacacccgacuuuguaggcaaaauacaaggaguacucacacagaccacacgccgagacggauccacacgaggccacaaagccacagucucaaccggcuccguccacuucaccccaaaacucgguucuguccaauucuccacagauaccagcaacgacuucgaaaccggacaaaacacccgcuucacacccguaggcgucguacaagacggauccaccacacaccaaaacgaaccccaacaauggguucuccccgacuacuccggucgcgacucccacaacgugcaccucgcccccgcagucgcccccaccuuucccggagaacaacuacucuucuuccgcuccaccaugccaggcugcucaggcuaccccaacaugaaccucgacugccuucuuccccaagaauggguacaacacuuuuaccaagaaucagcgcccgcucaauccgacgucgcacuccuccguuucgucaacccugacacaggccgcguacuauucgaaugcaaacuacauaaaucagguuacgucaccguagcacacaccggccaacacgaccuagucauuccaccaaacggcuacuucagauucgacuccugggucaaccaauucuauacccuugcacccaugggcaacggcgccggccgacgacgcgcacucuaa

SEQ ID NO: 36937 - RNA, 1623 nt, Artificial Sequence
  derived and/or modified sequence opt11 from capsid_protein__Norovirus__ACJ66263
augaaaauggcguccaaugacgccaaccccuccgacggcuccacugccaaccucguccccgaagucaacaacgaagucauggcacucgaacccgucguuggcgccgccaucgcagccccaguagccggacaacagaacguuaucgacccauggauccgcaacaacuucguccaagcacccggaggugaguucacagucagcccccgcaaugcacccggagaaauucucugguccgcaccacuagguccagaccucaaccccuaccucucccaccucgcccgcauguacaacggauacgcaggaggauucgagguucaaguaauccuagcaggaaacgccuucaccgccggcaaaauaauuuucgccgccgugccacccaauuuucccaccgaagggcucuccccaucacaagucaccauguucccccacaucaucguagacguccgacaacucgaacccguucucauaccccuaccugacguacgcaacaauuuuuaccacuacaaccaauccaacgaccccaccaucaaacuaaucgccaugcucuauacaccccugcgcgccaacaacgccggagacgacguauucacaguuuccugccgcguccucacacgccccagccccgacuucgacuucaucuuccuaguaccucccacagucgaaucccgcaccaaacccuucaccguuccgauccuuaccgucgaagagaugacuaacucccgcuuccccauaccccuugaacgccucuacacaggccccucauccgcuuucgucguacaaccccagaacggccgcugcaccaccgacgguguccuccuuggaaccacccaacucucugcggucaacaucuguaccuuccgaggcgacgucacccauaucgcaggcucccgcaacuacacuaugaaccuagccucccaaaacuggaacaacuacgaccccacagaagaaauuccagcgccccuaggaaccccagacuucgucgguaaaauccaagguaugcuaacccaaaccaccagaucagacggauccacccgaggacacaaagccaccguccuaaccggcuccgccgacuucgcccccaaacuaggacgcguccaauucgccaccgacaccgacaacgacuucgaauccggucaaaacacaaaauucacccccgucggcgucauacaagacgguucgacaacccaccgcaacgaaccccaacaauggguacuccccaacuacuccggcagaaccggucacaacguccaccucgccccagccgucgcccccaccuauccaggagaacagcuacuauucuuccgcucuaccaugcccggcugcuccggcuauccaaacauggaccuggacugccuacucccccaagaauggguacaacacuucuaucaagaagccgcacccgcacaaucagacgucgcccuccuacgauucgucaacccagacaccggacgaguccucuucgaaugcaaacugcacaaaucuggcuacgucaccgucgcccauaccggccaacacgaccuagucaucccaccaaacggcuauuucagauucgacucaugggucaaccaauucuacacacucgcccccaugggaaacggagccggccgccgccgcgcacucuaa

SEQ ID NO: 36938 - RNA, 1623 nt, Artificial Sequence
  derived and/or modified sequence opt11 from capsid_protein__Norovirus__ACJ66265
augaaaauggccuccucagacgccaacccaucagacggcuccaccgcaaaccuagucccagaggucaacaacgaagucauggcccuagaacccgucgucggggcagccauagccgcacccgucgccggccagcaaaacguaaucgauccauggauacgaaacaacuucguucaagccccaggcggcgaguucaccgucucaccccgaaaugcaccaggagaaauccuaugguccgcaccccugggcccagaccucaaucccuaccucucccaccucgcccgcauguacaacggguacgccggaggauucgaaguccaagucauacuagcaggcaacgccuuuaccgccggcaaaaucaucuucgccgccgugcccccaaacuuuccaaccgaaggccuaucucccucccaaguaaccauguccccacauaucaucgucgacgucagacaacucgaaccaguauuaaucccccuccccgacguacgcaacaacuucuaccacuacaaccaguccaacgaccccaccaucaaacuaaucgccaugcucuauacaccccuccgcgccaacaaugccggcgaugacgucuucaccgucagcugccgcguccucacccgccccucccccgacuuugacuucauauuccucguaccacccaccgucgaaucacgcaccaaacccuucucaguccccauccucaccgucgaagaaaugacaaacucucgcuucccaaucccacucgaacgccucuucaccggcccauccuccgccuucguuguucagccacaaaacggacgcugcaccaccgauggcguacuacuagggaccacacaacucucacccgucaacaucugcaccuuccgcggagacgucacacacaucgccggaacccaggaauacaccaugaaccucgcaucucaaaacuggaacaacuacgacccaaccgaagaaauccccgccccacuaggcacacccgauuucgucggcaaaauccaaggaguacucacccaaaccacucgccgcgacggcucaaccagaggacacaaagcgaccguaucaacagguuccguccacuucaccccaaagcucggccggauacaauucagcacugacaccuccaacgacuuugaaacuggccaaaauacucgcuucacccccguaggcguuguccaagacggaggaaccacccaccaaaacgaaccccaacaauggguccuccccaacuacuccgggcgcgauggccacaacguccaccuagccccagccgucgccccauccuuccccggggaacagcuccucuuuuuccgauccaccaugcccggcugcuccggcuacccaaacaugaaccucgacugccuacucccccaggaauggguacaacacuucuaccaagaagccgcaccagcccaauccgacguugcacuccuacgauucguaaaccccgacaccggccgcguccucuucgaaugcaaacuccacaaauccggcuacguaaccguagcacauaccggacaacacgaccucguaauaccgcccaacggcuacuuccgcuucgacucaugggucaaccaauucuacacccuagccccuaugggcaacggcacaggccguagacgcgcccuauaa

SEQ ID NO: 36939 - RNA, 1623 nt, Artificial Sequence
  derived and/or modified sequence opt11 from capsid_protein__Norovirus__ACJ66267
augaaaauggccagcaacgacgccaaccccuccgauggcucaacagccaaucucguccccgaagucaacuccgaagucauggcacucgaacccgucgucggagccgcuauagcggcccccgucgccggccaacaaaacgucaucgaccccuggauccgaaacaacuucgugcaggcccccgggggagaauuuacaguauccccacgcaacgccccuggagaaauccuaugguccgccccacucggccccgaccuaaacccauaccucucacaucucgcacgaauguacaacggcuacgccggcggcuucgaaguucaaguaauccucgccggaaacgccuucacugcuggcaagauaaucuucgccgcagucccaccaaacuuccccacugaaggccuaucucccucccaaguuaccauguucccccacauaaucguagacguucgccaacucgaaccaguccucaucccccuccccgacguccgcaacaacuucuaccacuauaaccaaucaaacgacccuaccauaaaacuaauagccaugcuguacacuccccuccgagcaaacaacgcaggagacgacgucuucaccgucuccugcagaguccucacacgaccaucccccgacuucgacuucauauuucuugucccucccaccguugaaucacgcaccaaacccuucacaguccccauccuuacagucgaagaaaugacaaacucccgcuuccccaucccacucgaaagacuauacaccggccccucuucagccuucgucguucaaccccaaaacggccguugcaccaccgaugggguccuccucggcacaacccaacucucagcuguuaacaucugcacauuccgcggcgacguuacccacaucgccggcucccgcaacuacacaaugaaccucgccucccaaaacuggaacaacuacgaccccacagaagaaauccccgcuccccucggcacaccugacuucgucggaaaaauccaaggaaugcucacccagacaacccgcuccgacggaucaacacgaggccacaaagccaccguacuaaccggauccgccgacuucgcaccaaaacuaggacgaguccaguucgcaaccgacaccgacaacgacuuugaauccggucaaaacacuaaauucacuccagucggcgucauccaagacggcuccaccacucaccgcaacgaaccccaacaauggguccuccccuccuacucaggccgcaccggucacaacguacaccuagccccugccguugcccccacauaccccggagaacaacuccuauucuuccgauccacaaugcccggcugcuccggauauccaaacauggaccucgacugccuccuaccccaagaauggguccaacacuucuaccaagaagccgcccccgcccaauccgacguagcacuccucagauucgucaacccagacacuggccgcguccucuucgaauguaaauuacacaaaucuggcuacgucacggucgcgcacaccggacaacacgaccuaguaaucccacccaacgguuacuuccgauucgacuccuggguaaaccaauuuuacacccucgcccccaugggcaacggagccggacguagacgagcucuauag

SEQ ID NO: 36940 - RNA, 1623 nt, Artificial Sequence
  derived and/or modified sequence opt11 from capsid_protein__Norovirus__ACJ66269
augaaaauggccucauccgacgccaacccgagcgacggcuccacagccaaccugguccccgaagucaacaacgaaguaauggcauuagaaccagucgucggcgcagccaucgccgcacccguugcaggccagcaaaacgucaucgaccccuggauccgcaacaacuucguucaagcccccggcggcgaauuuacagucagcccucgcaacgcccccggcgaaauucucugguccgcaccccucggacccgaccuaaaccccuaucucucccaccucgcccggauguauaacggauacgccggcggcuucgaaguccaagucauacucgccggcaacgccuucaccgccggcaaaaucaucuucgcagcagucccacccaacuuccccacagaaggacuuucaccaucacaaguaaccauguucccgcauauaauagucgacguccgccaacucgaacccguccucaucccccuccccgacguacguaacaacuucuaccacuacaaucaaucaaacgaccccacaaucaaacucaucgccaugcucuacaccccacuccgggccaacaacgccggggaugacgucuucacuguauccugccgcguacucacccgacccucacccgacuuugauuuuauauuccucgucccucccaccguagaaucccgaaccaaacccuucuccguccccauucuuaccguugaagaaaugacaaacucccgcuuccccaucccccucgaacgccucuucaccggcccaucguccgccuucgucguccaaccccaaaacggccgcugcacaacugacggcguccuccuuggcacaacacaacucucccccgcaaacaucugcaccuuccgcggcgacguuacccacaucgcaggcacacaagaauacaccaugaaucucgccagccaaaacuggaacaacuacgaccccacugaagaaauacccgccccacucggcaccccagacuucguuggcaaaauccaaggaguccucacacaaacaacccgacgagacgguucaacccgcggucauaaagccaccgucuccaccggcagcguacacuucaccccaaaguuaggccgcauccaauucuccacagauacauccaacgacuuugaaaccggacaaaacacacgauucacccccguaggcgucguacaagacggcggcaccacccaccaaaacgaaccccaacaauggguacuccccaacuacucuggccgcgacggacacaacguacaccuugcuccagccgucgcccccucauuccccggcgaacaacuucuuuucuuccgcuccacaaugcccggcugcucaggauaccccaacaugaacuuagacugccucuuaccucaagaauggguucaacacuucuaccaagaagcagcccccgcucaauccgacguagcccuccugagauucgucaacccagacaccggccgcguacuauucgaaugcaaacuucacaaauccggcuacguaacuguugcucacacaggccaacacgaccucgucauucccccaaacggcuacuuccgauucgauuccuggguaaaccaauuuuacacccucgccccaaugggcaauggaaccggccgccgacgugcccuauaa

SEQ ID NO: 36941 - RNA, 1623 nt, Artificial Sequence
  derived and/or modified sequence opt11 from capsid_protein__Norovirus__ACJ66271
augaaaauggccagcuccgacgccaaccccuccgacggcucaaccgcaaaccuagucccagaaguaaacaacgaaguaauggcacucgaacccgucgucggcgccgccaucgcggcucccgucgcuggccaacagaacgucauagacccguggauacguaacaacuucguacaagcccccggcggagaguucaccguuucaccccgcaacgcccccggcgaaauccuaugguccgcaccccuaggccccgaccuaaaucccuaccucucacaccucgccagaauguauaacggcuacgccggaggauucgaagugcaagucauacucgcaggcaacgccuuuaccgcgggaaaaaucaucuucgcugccguacccccuaacuuccccaccgaaggccuuucccccagccaagucaccauguucccccacaucauagucgacguaaggcaacuagaacccguucuuaucccacucccggacguccgcaacaacuucuaccacuauaaccaaagcaacgaccccaccaucaaauugauagcgaugcucuauacaccccuccgcgccaacaacgccggcgacgacgucuucacagucuccugccguguccucaccagacccucccccgacuuugacuucaucuuccucguuccacccaccgucgaaucacgcacaaaacccuucuccguucccauacuuacagucgaagaaaugaccaacagccgcuuccccaucccccuagaacgccucuucacaggcccuucauccgcuuucgucguccaaccccaaaacggccguugcaccaccgauggcguccuacuuggaaccacacaauuauccucuguuaacauaugcaccuuccgcggagacgucacccauauagcgggaacccaagaauacaccaugaaccucgcaucucaaaacuggaauaacuacgaucccaccgaagaaauacccgcuccccucggcaccccagacuucguaggcaaaauacaaggcguacucacccaaaccaccagacgcgacgguuccacccgaggacacaaggccaccguauccaccggauccguccacuucacccccaaacuaggccgcauccaauucuccaccgacacguccaacgacuucgaaacaggccaaaacacccgcuuuacaccagugggaguaguccaagauggcagcacaacccaccaaaacgaaccccaacaauggguucuaccgaacuacuccggccgagauggacacaacguccaccuagccccagccgucgccccauccuuucccggcgaacaacuucucuucuuccgauccacaaugcccggcugcuccggauaccccaacaugaaccucgacugccuccucccccaagaauggguacaacauuucuaccaagaagccgcacccgcccaauccgacguagcccuccuccguuucgucaacccugacaccggccgcguccucuucgaaugcaaacuccacaaaucaggcuacguuaccgucgcucacaccggccaacacgaucugguaauacccccaaacggcuacuucagauucgacuccugggucaaccaauucuacacacucgccccaaugggcaacgguacuggacgccgccgcgcccucuaa

SEQ ID NO: 36942 - RNA, 1623 nt, Artificial Sequence
  derived and/or modified sequence opt11 from capsid_protein__Norovirus__ACJ66273
augaaaauggccuccucggacgccaacccauccgacggcuccacugccaacuuaguccccgaagucaacaacgaaguaauggcacuagaacccgucgucggugccgccaucgccgcaccugucgcaggccaacaaaacgucaucgaccccuggauccgaaacaauuucguccaagcccccgguggcgaguucaccgucagcccccgcaacgcccccggcgaaauccuaugguccgcaccacuuggaccagaccucaaccccuaccucucccaccuagcccgcauguacaacuccuacgccggaggcuucgaaguacaagucauauuagcagguaacgccuucaccgccggaaaaauaaucuucgccgccguacccccaaacuuccccacagaaggacucucaccaucacaggucacuauguucccccauaucaucguagacgucagacaacuagaacccguccuuaucccccuacccgacguccgaaacaacuucuaccacuacaaucaaagcaacgaccccacaauuaaacucaucgccaugcuauacaccccacuccgcgcgaacaaugcaggagaugaugucuucaccguaucaugccgcguccucacacgccccucaccggacuucgacuucaucuuccuagucccacccaccguagaaucucgcaccaaacccuucuccguccccaucuuaaccgucgaagaaaugaccaacuccagauuccccaucccucucgaaaaacuuuucacaggccccucaucugcguucgucguccaaccacaaaacgggcgcugcacaaccgacggaguacuacucggcacgacacaacuaucccccguaaacauaugcacauucagaggcgacgucacccauaucgccggcacucaagaauacacaaugaaccuagccucccaaaacuggaacaacuacgaccccaccgaagaaauccccgcuccccuaggcacaccagacuucgucggcaagauucaaggcguccucacacaaacuacccgaagagacggcuccacccgaggccacaaagccaccgucucaaccggcucgguacacuucacccccaaacucggccgcauccaauucucaaccgacaccucuaacgauuucgaaaccggacaaaacacgcgcuucacccccguaggcguaguccaagacggcucaaccacccaccaaaacgaaccccaacagugggucuuaccaucuuacucaggacgagacucccacaacguccaccuagcccccgccguagcccccuccuucccuggagaacaacuacucuucuuccgcucaacaaugcccggaugcuccggcuaucccaacaugaaccucgacugccuccucccucaagaauggguacaacacuucuaccaagaagcugcacccgcccaauccgacguagcccucuuacgauucgucaaccccgacaccggacgcguucuauucgaaugcaaacuccacaaaucaggguacgucaccgucgcgcacacgggacaacacgaccucgucaucccucccaacggcuacuuccguuucgacuccugggucaaccaauucuacacacucgccccuaugggcaacggcgcuggacgacgacgcgcacucuaa

SEQ ID NO: 36943 - RNA, 1623 nt, Artificial Sequence
  derived and/or modified sequence opt11 from capsid_protein__Norovirus__ACJ66275
augaaaauggccuccuccgacgccucccccuccgacggauccgccgccaaccucguccccgaaguuaacaacgaaguaauggcucuagagcccguagucggcgcagcuaucgccgcacccguagccggacaacaaaacaucaucgaccccuggauacgaaacaacuucguccaagcacccggcggggaguucaccguaagcccucgaaacgcccccggugaaauccuaugguccgccccacucggcccagaccucaaccccuaccuaucacaccucucccgcauguauaacggcuacgccgguggcuucgaaguacaagucauacucgccggcaacgccuuuacggccggcaaaguaauauuugcagccguaccacccaacuuccccaccgaaggccuaucacccucucaagucaccauguucccccacaucaucgucgacguccgccaacucgaaccaguucuaaucccacuccccgacguccgcaacaacuucuaccacuacaaccaaacaaacgacccaaccauaaaacuuauagcuaugcucuacacaccccuucgugcuaacaacgccggcgacgacguauucaccguaagcugccgcguccuaacccgccccucccccgauuucgacuucauuuuucucguaccacccaccgucgaaucccgcaccaaacccuucacaguacccauccuaaccgucgaagaaaugaccaacucccgcuuccccaucccccucgaacgacucuacaccgguccauccuccgcuuucgucguccaaccccaaaacggccgcugcaccacagacggaguacuccucgguaccacccaacuauccgccguuaacaucugcaccuuccgcggagacgucacccacauagcaggcucccgcaacuacacuaugaaccucgcaucccaaaacuggaacaacuacgaccccacagaagaaaucccagcaccccuaggcaccccagacuuugucggaaaaauucaaggcaugcucacccaaaccacccgcggcgacggcucaacgcgaggccacaaagccacugucuacacaggcucagccgacuucgcccccaagcuaggccgcguacaauucgccaccgacaccgauaacgauuuugaguccaaccaaaacacaaaauucacacccguaggcgucauccaagacggcaacacaacccaccgcaaugaaccacaacaauggguccuacccggcuacucaggccgagauggccacaacguccaccucgcccccgccguugcccccaccuaccccggcgaacaacuacuauucuuccgcucuacaaugccaggcugcuccggcuaccccaacauggacuuagacugccuacucccccaagaauggguccaacacuucuaccaagaagcagcuccugcucaauccgaagucgcccuacugcgauucgucaaccccgauacaggccgaguccucuuugagugcaaacuccacaaguccggcuacgucaccgucgcccacaccggucaacacgaccuuguaaucccacccaacgguuacuucagauucgacuccugggucaaccaguucuacacacuagcacccaugggcaacggagcuggccgacgccgcgcccucuaa

SEQ ID NO: 36944 - RNA, 1623 nt, Artificial Sequence
  derived and/or modified sequence opt11 from capsid_protein__Norovirus__ACJ66279
augaaaauggccucaaacgacgccaccccuucagacggcucaaccgccaaccucguacccgaagucaacaacgaaguuauggcacucgaacccguagucggcgccgccaucgccgcccccgucgcuggucaacaaaacgucauagacccauggauucgaaacaacuucguccaagcccccggcggcgaguucaccgucucccccagaaacgcccccggcgaaauccuauggucugccccucucggacccgaccucaauccguaccucucacaccucgcccgaauguacaacggcuacgcaggaggauucgaaguccaagucauccucgccggcaaugccuucaccgcaggcaaaaucaucuucgccgcuguuccucccaacuuccccaccgaaggccucucacccucgcaagucacgauguuuccccacaucauagucgacguccgccaacucgaacccguucucauaccccuccccgacguccgcaacaauuuuuaccacuacaaccaauccaaugaccccaccauaaaacuaaucgccaugcuguacaccccucuucgugccaacaacgccggcgacgacgucuucacagucuccugccgcguccucacucgccccucccccgauuucgacuuuauauuccuaguaccacccacggucgaaucccgcaccaaacccuucucaguccccauacugacaguagaagaaaugacaaacucaagauucccaaucccacuagaaaaacuuuucaccggcccuuccuccgccuucguuguccaaccccaaaacggacgcugcacaacagacggcguccuccucggcaccacccaacuuucccccguaaacaucugcaccuuccgcggcgacgucacccacaucgccggcacgcaaaacuacaccaugaaccucgccucccaaaacuggaacaacuacgaccccaccgaagaaaucccagcaccacucggcacccccgacuuuguaggaaaaauccaaggaguccuaacacaaacaacccgacgugacgguuccacacgcggucacaaagcuacagucucaacaggcuccguacacuucaccccaaagcucggcagcguacaauuuuccaccgacacauccaacgacuuugaaacaggacaaaauacaagauucacaccugucggcgucguccaagacggcuccaccacccaccaaaacgaaccucaacaguggguacuccccgacuacucaggacgcgacucccacaacguccaccucgcacccgccgucgcccccaacuuuccaggagaacaacuucucuuuuuccgcucaaccaugcccggcugcucaggauauccaaacaugaaccucgacugccuccucccccaagaauggguccaacacuucuaccaagaauccgcucccgcccaauccgacgucgcacuacuccgcuucgucaaccccgacaccggacgcguacuauucgaaugcaaacuucacaaauccgguuacgucacugucgcucacaccggccaacacgaccuaguuaucccacccaacggauacuuccgcuucgacuccuggguuaaccaguucuacacccucgcccccaugggcaacggagccggccgccgccgugcccuauaa

SEQ ID NO: 36945 - RNA, 1623 nt, Artificial Sequence
  derived and/or modified sequence opt11 from capsid_protein__Norovirus__ACJ66281
augaaaauggccagcaacgacgccaacccauccgacggcucagcagccaaccuaguccccgaagucagcaacgaagucauggcucuagaacccguagucggcgccgccaucgccgcccccgucgccggacagcaaaacgucauugaccccuggauacgcaacaauuucguacaagcccccggcggcgaguucacugucucaccgcgaaacgccccaggcgaaauccucuggucagcaccacucggacccgaccucaaccccuaccuaucccaccuugcccgaauguacaacgguuacgccggcggauucgaaguacaagucauccuagccggcaacgccuucacagccggcaaaaucauauucgccgccguacccccgaauuuccccacggaaggccuaagccccucccaagucaccauguucccacacaucauagucgacguucgccaacuagaaccaguccuaaucccucuacccgacguacgcaacaacuucuaccacuacaaccaaagcaacgacuccacuaucaaacugaucgccaugcuauauacuccucuacgcgcaaacaacgccggcgaagacguauucaccguaucaugccgcguccuuacccgccccagcccagacuucgacuucaucuuucuggucccaccaacuguagaaucccgcacaaaaccauucacaguaccgauccuaacagucgagaaaaugaccaacucucgauuccccaucccacuugaaaaacucuucaccggaccaucaggcgccuucguaguccaaccccaaaacggccguugcaccaccgacggcguacuucucggaacaacacaacucucccccguaaacauaugcaccuuccguggcgacgucacccacaucgcaggcucccgcaacuacaccaugaaccuagccucacuaaacuggaacaacuacgaccccaccgaagaaauccccgccccacucgguacccccgacuucgucggcaagauccaaggugugcucacacaaaccacaaaaggagacggaucaacacgagggcacaaagccaccgucuauacuggguccgcucccuucacccccaaacuaggcagcguccaauucuccaccgauaccgaaaacgacuucgaaacccaccaaaacaccaaauucacacccguuggcguuauucaagacggcucaacaacacaccgcaaugaaccccaacaauggguccuaccauccuacagcggccgaaacguccacaacguccaccucgcacccgccgucgcccccacauuccccggcgaacaacuccuauucuuucgaucuaccaugcccggcugcuccggcuacccaaauauggaccuagacugccuccuaccccaagaauggguccaacacuucuaucaggaagcugcaccagcacaauccgacguagcccuccuccgcuucguaaaccccgacacaggcagaguccucuucgaaugcaaacuccacaaauccggcuacguuacagucgcacauaccggucaacaugaccuagucaucccacccaacggcuacuuccgcuucgacucaugggucaaccaauucuacacccucgcccccaugggaaacggcaccggccgccgccgagcccucuaa

SEQ ID NO: 36946 - RNA, 1623 nt, Artificial Sequence
  derived and/or modified sequence opt11 from capsid_protein__Norovirus__ACJ66283
augaaaauggccuccaaugacgcaaaucccuccgacgggagcgcagccaaccuuguccucgaaguaaacaacgaaguaauggcccucgaacccgucgucggagcugcuaucgccgcccccgucgccggacaacagaauguaaucgaccccuggauacgcaacaacuucguacaagcccccggcggcgaauuuaccgucuccccacgaaaugcacccggcgaaauucuguggucagcaccccuaggaccagaccuaaaucccuaccuuucccaccuagcccgcauguauaacggauacgccggcggauucgaaguccaagucauccuugccggaaacgccuucaccgcaggcaaaaucaucuucgccgccgucccacccaacuucccaaccgaaggccucucccccucccaagucaccauguucccccacauaauaguagacguccgccaacucgaacccguccuaaucccacuccccgacguccgaaacaacuucuaccacuacaaccaaucuaacgacucaacaauuaaacucaucgccaugcuauacacaccucuccgcgccaacaacgcgggcgaagacgucuucaccguaagcugccgaguacucacacgccccagccccgacuucgacuucaucuuccucguacccccaacugucgaaucccgaaccaaaccauucaccguacccauccucacagucgaagaaaugacaaacucacgcuucccaaucccacuagaaaaacucuuuaccggucccuccggagccuucguaguccaaccccagaauggaaggugcaccaccgacggaguccuacucggcaccacccaacucucccccgucaacaucugcaccuuccgcggcgacgucacccacauagcuggaucccgcaacuacaccaugaaccucgccagccucaacuggaacaacuacgaccccaccgaagaaauacccgccccacucggcacacccgacuucgucggcaaaauccaaggaguccuaacucaaaccaccaaaggugacggcuccacucgcggccacaaagcgacgguuuauacaggaucagcaccauucaccccaaaacucggaucuguccaauucuccaccgacaccgaaaacgacuucgaaacacaccaaaacacaaaauucacccccguaggcguaauccaagacggcuccaccacccaccguaacgaaccccaacaauggguccucccauccuacucaggccgcaacguacacaacguccaccucgcccccgccgucgcacccacauuccccggagaacaacuacucuucuuccgcuccaccaugcccggaugcucugguuaccccaacauggaccuagacugccuacuaccucaagaauggguccaacacuucuaccaagaagccgcccccgcccaauccgacguugcacuccuacgguucgucaacccagacaccgguagagugcuuuucgaaugcaaacuacacaaauccggcuacgucacagucgcgcacaccggccaacacgaccucguuaucccgcccaacggauacuuccgauucgacuccugggucaaccaauucuacacccucgcacccaugggaaacgguaccggcaggagacgagcacucuaa

SEQ ID NO: 36947 - RNA, 1623 nt, Artificial Sequence
  derived and/or modified sequence opt11 from capsid_protein__Norovirus__ACJ66285
augaaaauggcaucaucugacgccaaccccagcgacggcuccaccgccaaccugguccccgaagucaacaacgaagucauggcccucgagcccgucguaggcgccgcaauugccgcaccaguagccggccaacaaaacgucaucgacccacgcauccgcaacaacuucguacaagcccccggcggagaguucaccgucagcccccgaaaugcuccaggagaaauccucugguccgccccacucggcccagaucuaaaccccuaccucucccaccuggcacgcauguacaacucauacgccggcgguuucgaaguucaaguaauccucgccggaaacgcuuucacagccggaaaaaucaucuucgcagccgucccucccaacuuccccaccgaaggacucucccccucucaagucaccauguucccucacauaaucgucgacguccgccaacuagaaccaguucucaucccccucccagacguccgcaacaauuuuuaccacuacaaucagagcaacgaccccaccaucaaacucaucgccaugcuuuacacaccccuacgcgcuaacaacgccggcgaugacgucuucacugucuccugcuggguacucacucgacccuccccagacuucgacuuuaucuuccucguaccucccaccgucgaauccagaaccaaaccauucuccgucccuauccuaacagucgaagaaaugaccaacucccgcuucccaauuccccucgaaaaacucuucacaggccccuccuccgccuucgucguacagccccaaaacggccguugcaccacugacggaguccuccucggcaccacacaacucucccccgucaauauaugcaccuuccgcggcgacgucacucacauagcuggcacccaggaauacaccaugaaucucgccucccaaaacuggaacaacuacgaccccacagaagaaauccccgcaccccucggaaccccugacuucgucggcaaaauacaaggaguccucacccaaaccacccgcucugacggcuccacccgcggucacaaagccacaguaagcaccggcagcguccacuucacccccaaauuaggcagaauacaauucagcacagacaccuccaacgacuucgaaacaggccaaaacacccgcuuuaccccagugggcgucguccaagacggcuccaccacacaccaaaacgaaccccaacaauggguuuuacccaacuacucaggccgcgacucccacaacguccaccuugcccccgccguagccccauccuucccaggcgagcaacuccuauucuuccgaucaacaaugccuggcuguucaggcuaucccaacaugaaccucgacugccuacucccacaagaguggguacaacacuuuuaccaagaggccgcccccgcccaguccgacgucgcccuacuucgcuucgugaaucccgacaccggcagaguccuauucgaaugcaaacuccacaaaucaggcuaugucacgguagcucacaccggccagcaugaccuagucaucccacccaacggcuacuuccgcuucgacagcuggguuaaccaauucuacacacucgcacccaugggcaacggcaccggccgccgucgcgcacuauaa

SEQ ID NO: 36948 - RNA, 1623 nt, Artificial Sequence
  derived and/or modified sequence opt11 from capsid_protein__Norovirus__ACJ66286
augaaaauggcauccaacgacgccaacccuuccgacggauccgccgccaaccucguucccgaaguaaacaaugaagucauggcccucgaaccagucguaggugcagccaucgccgcccccgucgcaggacaacaaaacguaauagaccccuggauccgaaauaacuucguccaggcacccggcggagaguucaccgucuccccacgaaacgcccccggcgaaaucuuauggucugcaccccugggaccagaucuuaacccauaccucucacaccucgcccguauguacaacggcuacgccggcggcuucgaaguccaaguuauccucgccggaaacgccuucaccgccggcaaaaucauauucgcagcagucccacccaacuuucccaccgaaggucucucacccucucaagucaccauguucccccauaucauagucgacgugcgacaacuagaacccguccugauaccccuacccgacguucgcaauaacuucuaccacuacaaccaaucuaacgacuccaccaucaaacuaauugccaugcucuacacuccccuccgcgccaacaacgcaggcgaggacguauucaccgucucaugccgaguccucacccgaccauccccugacuucgacuucaucuuccuagucccacccaccgucgaaucacgcacaaaacccuuuaccguccccauccuaaccgucgaagaaaugaccaacucacgauuccccauuccccuggagaaacuauucaccggccccucaggcgccuucgugguacaaccacaaaacggccgaugcacaaccgauggaguccuucucggcaccacucaauuauccccggucaacauuugcaccuuccgaggcgacguaacccauaucgccggcucucgcaacuacaccaugaaccucgcaucucuuaacuggaacaacuacgauccaacagaggaaauacccgcaccccucggcaccccagacuucgucggcaaaauccaagguguccucacccaaaccaccaaaggcgacggcucaacccgaggacacaaagccacagucuacaccggguccgcccccuucacccccaaacucggaucuguccaauucucuacugacacugagaacgacuucgaaacacaccaaaacacaaaauucacacccgucggcgucauccaagacggcuccaccacucaccgcaacgaaccccagcaauggguacucccauccuauucuggcagaaacguacacaacguacaccucgcccccgcagucgcccccacauuccccggcgaacaacuccucuuuuuccgcuccaccaugccaggauguucuggcuacccaaacauggaccuugacugccuccucccccaagaauggguucaacacuucuaccaagaagcagcaccagcacaauccgacgucgcccuccuccgcuucgucaacccagacaccggacgcguccuauucgaaugcaaacuccacaaaucuggcuacgucaccgucgcacacaccggacaacacgaccuugugauaccacccaacggguacuuccgcuucgacucauggguaaaccaguucuacacacucgcaccaaugggaaauggaacaggcaggcgacgcgcacuauaa

SEQ ID NO: 36949 - RNA, 1626 nt, Artificial Sequence
  derived and/or modified sequence opt11 from capsid_protein__Norovirus__ACJ72216
augcgcauguccgacggagccgcccccaaagccaacggcuccgaagcaucuggacaagaccucguacccaccgcagucgaacaagccgugcccauccaaccaguagccggcgcagcacuagcagcccccgccgccggacagaucaaccaaaucgacccauggaucuuccagaacuucguccaaugcccucucggcgaauuuuccaucucgccccgcaacacaccgggcgaaauacucuucgaucuagcacucggccccggacuaaaccccuaccucgcccacuuauccgcuauguacaccggcugggucggcaacauggaaguccaacucguccuagcaggcaacgcuuucaccgccggcaaagucguagucgcccuuguucccccauacuuccccaaaggcucccucacaacagcccaaauaaccugcuucccacacgucaugugugacguccgcacccuagaacccauacaacucccucuccuugacguccgccgcgucuuauggcacgccacucaggaccaagaagaaucaaugcgccuaguuuguauguuauacacaccccucagaacaaacucccccggcgacgaauccuucguugucuccggaagacucuuauccaaacccgcagcagacuucaacuucguauaucucacaccacccaucgaacgcaccauauacagaauggucgacuuacccguccuacaaccccgacucugcacacacgcacgcuggcccgccccaauauacggccuacucguagacccaucucugccauccaacccccaauggcaaaacggccgcguccacgucgacggcacccuacuaggcacaacuccuaucucaggcagcugggucucaugcuucgccgccgaagccgcauacgaguuccaaucagguaccggugaagucgucacauucuccaugauagaacaagacggaucagcauacguacccggcgacagagcagcaccacuagguuaccccgacuauuccggacaacucgaaaucgaaguccaaaccgaaacuaccaaagccggagacaaacugaaggucacaacauucgaaaugauucuuggaccaaccacaaacgucgaccaagccccuuaucaaggcaaagcauacgcaucccucuccaccaccgcaagccucgaccucgucgauggccgaguaagagccgucccucgaucaguuuauucguuccaggacguacuccccgaauacaacgacggccuccuagucccccucgcucccccacucggccccuaccuacccggcgaaguccuacuccgcuuccgaacauacaugcgacaacucgacaccgccgacgccgccgcccaaccaaucgacugcgcccuuccccaagaguucaucucaugguucgccucauccaacuuuacaguccaauccgaagcccuccuagucagauaccgcaacacccuaacuggucagcuccuauucgaagcuaaacucuacuccgaaggauacaucgcagucuccuacucaggcucaggcccccucaccuuccccaccgacggauucuucgaaguaguauccuggguaccccgacuauuccaauuagccagcguaggaucccuagcgacaggccgcacccuaaaacaauaa

SEQ ID NO: 36950 - RNA, 1620 nt, Artificial Sequence
  derived and/or modified sequence opt11 from capsid_protein__Norovirus__ACL27297
augaaaauggccucaaacgacgccaacccuucugacggcuccaccgccaaccucguaccagaaguaaacaacgaaguaauggcacucgaacccgucguaggugccgcaaucgccgcccccgucgccggccaacaaaacguuauagaccccuggauccggaacaacuucguacaagcccccggcggcgaguucaccguaucaccccgcaaugcccccggcgaaauccuuugguccgcuccccucggcccggaccuuaacccauaccucucccaccuagcccgcauguacaacggcuacgcaggcggcuucgaaguccaagugauccuagccggcaacgcauucaccgccggcaaaauuaucuucgccgccgugcccccaaauuuccccacagaaggccuauccccuucccaagucaccauguucccccacaucaucgucgacguccgccaacucgaacccguccuaauaccccuacccgacguccgaaacaacuucuaucacuauaaccaaucuaacgacaguacuaucaaacuaauagcaaugcuguacacaccccuccgcgccaacaacgccggcgccgacguuuucaccguaucacggcgcguccucacccguccaucaccagacuucgacuuuauauuuucuguuccacccacugucgaaucccggaccaaacccuucacaguacccauccucacugucgaagaaaugucuaacucacguuuccccaucccccuggaaaaacucuacacaggaccauccucagcauuugucguccaaccacaaaacggacgauguaccacagacggaguccuacucggcacaacacaacuaagcgcugucaauauaugcacauuucgcggcgacgucacccacauagcaggaucacacgacuacacaaugaaccuagccucccaaaacuggaacaacuacgacccaacagaagaaauuccagcgccccuaggcacacccgacuucgucggcaaaauccaaggcaugcucacgcaaaccacccgcgaagacggcucaacacgcgcccacaaagccaccgucuccacaggcucaguacacuucacccccaaacucggcucaguacaguauacaacagacaccaauaacgacuuccaaaccggacaaaacacuaaauucaccccaguaggggucauccaagacggcaacaaccaccaaaacgaaccccaacaauggguccucccaaacuacucuggacgcacgggccacaacguccaccucgccccagccguagccccaaccuuucccggcgaacaacuccuauucuuccgauccaccaugcccggaugcuccggauaccccaacaugaaccuagacugccuccucccucaagaauggguccaacacuucuaccaagaagccgcccccgcccaaucagacgucgcacuacuccguuucguaaaccccgacaccggccgaguucucuucgaaugcaaacuccacaaauccggcuacguaacugucgcccacacaggcccccaugaccucguaaucccgcccaacggauacuuccgcuucgacuccuggguuaaccaauucuacacccucgcccccaugggaaacggcgcuggccgccgccgcgcccucuaa

SEQ ID NO: 36951 - RNA, 1623 nt, Artificial Sequence
  derived and/or modified sequence opt11 from capsid_protein__Norovirus__ACL27298
augaaaauggccucaaacgacgccuccccauccgauggcuccaccgccaaccuuguaccggaaguaaacaacgaagucauggcacuugaacccgucguaggcgccgcaauagccgccccaguugcaggacaacaaaauguaaucgaccccuggauaagaaacaacuucguccaagcccccgguggagaguucaccgucuccccacgaaacgccccaggcgaaauccuuuggagcgcaccuuuaggcccagaccucaaccccuaccugucucaccuagcacgaauguacaacggcuacgccgguggcuucgaaguacaaguaauccuugccgguaacgcuuucaccgcaggcaaaauaaucuucgccgccguuccacccaacuuccccaccgaaggccuaucccccucccaagugaccauguucccccacaucauagucgacguccggcagcuagaacccguccucaucccacuccccgacguccgaaacaacuuuuaccacuacaaccaauccaacgaccccaccauuaagcuaaucgcuaugcucuacacaccccuccgcgccaacaacgccggcgaagauguauuuacaguuucaugccgcguccuaacccgaccaucccccgacuucgacuucaucuuccucguaccacccaccgucgaaucccgcacaaaacccuucaccgucccaauacucaccgucgaagaaaugacgaacucccgauuccccaucccacucgagaaacucuucaccggucccucaggugccuucgucguccaaccccaaaacggccgcugcacuacugacggcguacuucucggcaccacccaacucucacccgucaacauaugcaccuucagaggcgacgucacccacauagccgguacacaugacuauacaaugaaccucgcaucucagaacuggaacaacuacgaccccaccgaagaaauccccgcaccccuaggcaccccagacuuugucgguaaaauccaaggcgucuuaacccaaaccacccgcggcgacggcuccacacgcggccauaaagcaaccguguccaccggaagcguccacuucacccccaaacucggcucaguccaauucaccacagacaccaacaacgacuucgaaaccggccaaaacaccaaauuuacucccguaggcgucguccaagacggcaacagcacacaccaaaacgaaccccaacaguggguccuccccaacuacagcggccgcaccggacauaacguacaccucgccccagccgucgcccccacauuccccggugaacaacuccucuucuuccgcuccacaaugccaggauguucaggcuaccccaacaugaaucuagacugccuccucccacaagaauggguacaacacuucuaucaagaagccgcccccgcccaauccgacgucgcacuccuccgauucguuaaucccgacacuggccgcguccucuucgaaugcaaacuccacaaauccggauacgucaccguagcucacaccggccaacacgaccucguaauaccuccaaauggcuacuuccgguucgacagcuggguaaaccaauucuacacccucgccccaaugggaaacggagcaggccgcagacgcgcacucuaa

SEQ ID NO: 36952 - RNA, 1623 nt, Artificial Sequence
  derived and/or modified sequence opt11 from capsid_protein__Norovirus__ACL27299
augaaaauggcaagcaacgacgccaacccauccgacggcucaacagccaaucucguacccgaaguaaacaaugaagucauggcccuagaaccuguaguaggagccgccaucgcagcccccguagcuggccaacaaaacgucaucgaccccuggauacgcaacaacuucguccaagccccuggcggcgaauuuaccguuuccccacgcaacgcccccggcgagauccuaugguccgcaccccucggccccgaucucaacccauaccucucccaccuagcccguauguacaacggauacgcaggcggcuucgaaguccaaguaauccuugcaggcaacgccuucaccgccggaaaaaucaucuucgccgccguacccccaaacuucccaacagaaggccuaucacccucucaagucaccauguucccucacaugauagucgacguccgccagcucgaacccguccucaucccccuccccgacguccgcaacaacuucuaucacuacaaccaauccaacgacccaaccaucaaacuaaucgccaugcucuauaccccacucagagccaacaacgcaggcgacgacgucuucaccgucucaugucgaguccucacacgacccucccccgacuucgacuucauauuccuaguaccucccaccgucgaaucccgcaccaaacccuuuacagucccaauccuuacaguggaggaaaugaccaacagcagauuccccauuccccuagaacgccucuauacaggacccuccuccgccuucguuguccaaccgcaaaacggccgcugcaccaccgacgguguacuccuaggcacaacccaacucucagccgucaacauaugcacauucagaggcgaugucacccacaucgccgguucccgaaauuacaccaugaaccucgccagccaaaauugguccaacuacgaccccaccgaagaaauaccugcaccccuaggaacccccgacuucgucggaaaaauccaaggcauguuaacacaaaccacccggcgcgacggaaguacacguggacacaaagccacuguccuaaccggcagugccgacuucgcccccaaacucggcagaguacaguucgcaaccgacaccgacaacgacuucgaauccggcgaaaacaccaaauucacccccgucggcgucauacaagacggcuccacuacccaccgcaacgaaccccaacaauggguacuccccaacuacagcggccgcaccggacacaacguacaccucgcacccgccguagccccuaccuaccccggagagcaacuccuauucuuccgauccaccaugcccggcugcuccggcuaucccaacauggauuuagacugccuccucccucaagaaugggucagacacuucuaccaagaagccgcccccgcccaauccgacgucgcccuacucagauucguaaaccccgacaccggacguguacuauucgaaugcaaacuccacaaaucaggcuacguaacagucgcccacaccggacaacacgaucucgucauaccucccaacggcuacuuccgauucgacagcugggucaaccaauucuacacccuagcccccaugggcaacggagccggacgucgccgcgcccuuuaa

SEQ ID NO: 36953 - RNA, 1623 nt, Artificial Sequence
  derived and/or modified sequence opt11 from capsid_protein__Norovirus__ACL27300
augaaaauggcauccaacgacgccaaccccucagacggauccacugccaaccuaguccccgaggucaacaacgaagucauggcccuagaacccgucgucggugccgccaucgcugcaccagucgccggccaacaaaacguaaucgacccauggauccgaaacaacuucguacaagcacccggaggcgaguucaccguaagcccacggaacgcccccggagaaauccucugguccgcaccccucggcccagaccucaaucccuaucuaucccaccucgcccguauguacaacggcuacgccggcggcuucgaaguccaagucauucuggcagggaacgccuucacugccggcaaaaucaucuucgccgccgucccacccaauuuccccacagaaggccucuccccaucacaagucacuauguucccccacauaauagucgacguccgacaacucgaaccaguacucauaccccuacccgauguaagaaacaacuucuaucacuacaaccaauccaacgacccaaccaucaaacugauagcaaugcucuacaccccacuccgagcaaauaacgcaggagacgacgucuuuaccgucuccuguagaguccucacccgcccaucccccgacuucgacuucaucuuucucguacccccaacuguagaaucccgaacaaaacccuucacaguuccaaucuuaaccgucgaagaaaugaccaacucacgcuuccccaucccucucgaacgccucuacaccggcccaucuuccgccuucgucguccaaccacaaaacggacgcugcaccaccgacggcguacuacuagguacaacccaacuaagcgccgucaauaucugcaccuuccgcggggacgucacacacaucgccggcucccgcaacuacaccaugaaccucgccucucaaaacuggucgaacuacgaccccaccgaagaaauccccgccccacucggcaccccagacuucgucggcaaaauccaaggaaugcucacccaaaccacccgaagagauggcuccacacgcggccacaaagccaccguucuaaccggcucagccgacuucgcaccaaaacucggccgcguccaauucgccacagacacagacaacgacuucgaauccggugaaaacaccaaauucaccccaguaggcguuauccaggacgguuccacaacccaccgcaaugagccccaacaauggguccucccaaacuacagcggccguaccggccacaacguccaccucgcccccgccguagccccuaccuaccccggagaacaacuccucuuuuuccgcucaaccaugccaggcugcagcggauaccccaacauggaccucgacugccuacuuccacaagaauggguacgucacuucuaccaagaggccgcccccgcacaaucggacguugcccugcuacgcuucgucaacccagacacgggccgaguacucuucgaaugcaaacuucacaaaucaggauacgucacaguagcccacaccggccaacacgaccucgucauacccccaaacggcuacuucagauucgacucaugggucaaccaauucuacacccuagccccaaugggcaacggggccggccgccgucgcgcacucuga

SEQ ID NO: 36954 - RNA, 1623 nt, Artificial Sequence
  derived and/or modified sequence opt11 from capsid_protein__Norovirus__ACL31312
augaaaauggccucuuccgacgcaaaccccagcgacggauccaccgccaaccuggucccugaagucaacaaugaaguaauggcacucgagcccguagucggcgcagcaauagcugccccuguagccggacaacaaaacgucaucgacccuuggauccgcaauaacuucguccaagcaccuggaggggaguucaccgucuccccacgcaacgcacccggcgaaauccucuggucggcaccccucggcccugaccuaaaccccuaccucucgcaccucgccagaauguacaauggauacgcaggcggauucgaaguccaaguaauccucgccggcaacgccuucaccgcaggcaaaaucauauucgcagccgucccacccaacuuccccacagaaggccuaucacccucccaagucaccauguucccacacauaauaguagacguccgacaacucgaaccuguccucaucccacucccagauguccgaaacaacuucuaccacuacaaccaauccaacgaccccaccaucaaacuuaucgcgaugcucuacacaccucuacgagcaaauaacgccggggacgacgucuucaccgucuccugccgcguccuaacccgacccuccccagacuucgacuucaucuuccucguacccccuaccgucgaaucucgcaccaaaccuuucuccgucccgauacugaccgucgaagaaaugacaaacuccagauuccccaucccacuagaaaaacucuucacgggcccauccagcgccuucgucguccaaccacaaaacggacgaugcacaaccgacggcguccuauuaggaacaacacaacucagccccgucaacaucugcacuuuccgcggcgacgucacccacauugcaggaacucaagaguacacaaugaaccucgccucgcaaaacuggaacaacuacgaucccacagaagaaaucccagcaccacucggaaccccugauuucgucggcaagauacaagguguccuuacccaaacaacccgacgcgacgggaguacccgaggccacaaagccaccgucuccacagguucaguucacuucacacccaaacuuggacgcauucaauucuccaccgacacuuccaacgacuucgaaaccggccaaaacaccagguucacccccgucggcguuguccaagacggcagcacaacacaccaaaacgaaccgcaacaauggguccucccagacuacucuggucgcgacagccacaacguucaccucgcccccgcgguagcacccagcuuccccggcgaacaacuacucuucuuucguucaaccaugcccggcugcuccggcuaccccaacaugaaccucgauugccuccucccccaagagugggugcaacacuuuuaccaagaggccgcccccgcucaaagcgacguagcccuccuacgcuucguaaaccccgacaccggccgaguacucuucgaauguaaacuccauaaaucaggcuaugucaccguagcccacaccggccaacacgaccucgucaucccgcccaacggcuacuuccgcuucgacucuuggguaaaccaauucuacacccucgcacccaugggcaacggaacaggccgccgacgagcacucuaa

SEQ ID NO: 36955 - RNA, 1623 nt, Artificial Sequence
  derived and/or modified sequence opt11 from capsid_protein__Norovirus__ACL31313
augaagauggccuccaacgacgcaacacccuccgacggauccaccgccaaccucguccccgaggucaacaacgaagugauggcccuagaaccagucguaggagccgccaucgccgcucccgucgccggccaacagaauguuauagaccccuggauccgcaacaacuucguccaggcaccaggcggcgaguucacaguuuccccacgaaacgcacccggagaaauccuaugguccgcaccccucggccccgaccuuaaccccuaucuaucacaccucgcacguauguacaacggauacgccggcggcuucgaaguacaagucauccuagccggcaaugccuuuacagccggcaaaauuaucuucgccgcagucccacccaacuuccccacagaaggccucucucccucccaagucaccauguucccccacaucaucgucgauguacgccaacuagaacccguacuaauaccucucccugacguacgcaacaacuucuaucacuauaaucaaaguaacgacccaaccaucaaacucaucgccaugcuauacacaccccuccgcgcuaauaacgcgggcgacgacgucuucaccgucuccugccguguccucacccgaccuucacccgacuucgacuucaucuuccucgugcccccaacugucgaaucacgaaccaagcccuucuccguacccauccucaccguagaagaaaugaccaacucacgcuucccaaucccccucgaaaaacucuuuaccggacccucauccgccuucgucguccaaccccaaaacggccgaugcaccacggacggcguccugcucggcaccacacagcucucaccaguuaacaucugcaccuuccgaggcgacgucacucacaucgcaggaacacaaaacuacacgaugaaccuggcaagccaaaacuggaauaacuacgaccccaccgaagaaaucccagcacccuuagggacacccgacuucgucggcaagauacaaggcguccugacccaaaccacacgcggcgauggaagcacacgaggccacaaagccacagucuccaccggcuccguccacuuuacccccaaauuaggcucuguccaauucucaaccgacaccuccaaugacuucgaaaccggccaaaacacccgcuucacacccguaggcgucguccaagacggcagcaccacccaccaaaacgaaccccaacaauggguucuccccgccuauuccggccgagacaaccacaacguacaccucgcucccgcagucgccccuaccuuccccggagaacaacucuuauucuuccgcagcacaaugccaggcuguucaggcuaucccaacaugaaccuagacugccuccuaccacaagaauggguccaacacuucuaccaagaauccgcccccgcucaaagcgacgucgcucuuuuacgauucgucaacccagacacaggcagaguccuauucgagugcaaacuacacaaauccggauacgucaccgucgcccacacaggccaacacgaccucguaaucccucccaauggauacuucagauucgacuccuggguuaaccaauucuacacacuugcacccaugggaaacggcgccggccgucggcgcgcacucuaa

SEQ ID NO: 36956 - RNA, 1623 nt, Artificial Sequence
  derived and/or modified sequence opt11 from capsid_protein__Norovirus__ACL31316
augaaaauggccucauccgacgccaccccauccgacggcuccaccgccaaccucguccccgaaguaaacaacgaagucauggcccucgaacccguagucggcgccgcuaucgccgcacccgucgccggccaacaaaacgucauagaccccuggauccgcaacaauuucguccaagcccccggcggagaguucaccguuucaccacgcaacgccccaggcgaaauacucuggucggccccacucggaccagaccucaaucccuaccucucacaccuagcccgaauguacaacggauacgccggcggauucgaaguccaaguaauccucgccggcaacgccuucacugcagggaaaaucauauucgccgcagugccuccaaacuuccccaccgaaggccuaucaccaucccaagucaccauguucccccacauaaucgucgacguccgccaauuagaaccaguccucauaccccuccccgauguacgcaacaacuucuaucacuacaaccaaucaaacgaccccacaaucaaacuaaucgccaugcuauacacaccccuuagagccaacaacgccggcgacgacguauucaccguuagcugucgaguccucacccgucccucaccagacuuugacuuuauuuuccucgucccacccaccgucgaaucccgaacaaaacccuucucaguucccauccucaccgucgaagaaaugaccaacucccgauucccaaucccacucgaaaagcuauucaccggccccucguccgcauucguaguucaaccccaaaacggucgcugcacaaccgauggaguccuucucggcaccacccaacucuccccagucaauaucugcacauuccgaggcgacguaacacacauagccgguacucaaaacuacacaaugaaccucgcaucccaaaacuggaacaacuacgacccaaccgaagaaaucccagcuccccuaggcacucccgacuuugucggcaaaauacaaggcaugccaacacaaacaacccgcggcgacggauccacccgcggucacaaagcaaccgucucgaccggauccguacacuucacccccaaacucggcucaguacaguucuccacugacaccuccaacgacuucgagacaggccaaaauacccgcuucacccccguaggcgucgugcaagacggcuccaccacccaccaaaacgaaccacaacaauggguccucccaaacuauuccggccgagauagccacaauguccaccuggccccagcgguugccccgacauucccaggcgaacagcuacucuucuuccgcuccaccaugcccggcugcuccggcuaccccaacaugaaccucgacugccuacucccacaagaauggguacaacacuucuaccaagaauccgccccagcacaaucugacgucgcacuccuccgcuucgucaaucccgacacaggccgcguccuguucgaaugcaaacuccacaaauccggauacguaacagucgcacacaccggacaacacgaccuaguuauucccccuaacgguuauuuccgcuuugacagcuggguaaaccaauucuacacacucgcccccaugggcaacggcgccggucgccgucgcgcccuauaa

SEQ ID NO: 36957 - RNA, 1623 nt, Artificial Sequence
  derived and/or modified sequence opt11 from capsid_protein__Norovirus__ACL31317
augaaaauggcauccuccgaugcaaaccccucagacggauccaccgcuaaccuuguuccugaagucaacaacgaagucauggcccuugaacccgucgucggcgccgcaaucgcugcccccgucgccggacaacaaaaugucaucgaccccuggauccgcaacaacuucguccaagccccuggcggcgaauuuaccgucucaccccgcaacgccccaggugaaauccucuggucagcaccccuaggccccgaucucaaccccuaccuaucucaccuugcccgaauguauaacggauacgccgguggcuucgaaguccaaguuauccucgccggcaaugccuucacagccggcaagaucaucuucgcagccguucccccaaauuuccccaccgaaggccuaucaccuucucaagucaccauguucccccacaucaucgucgacguacgccaacucgaacccguccucaucccccuccccgacgucagaaacaacuucuaccacuacaaccaaucaaacgacccaaccaucaaacucaucgccaugcuuuauacuccccucagagccaacaacgccggagacgacgucuucaccgucuccugccgcguccucacgcgacccucccccgacuucgacuucaucuuccucgucccaccaacagucgaaucccgcacaaaaccauucucaguccccauccucaccguagaagaaaugacaaacucccgcuuccccaucccccucgaacgacuauucacaggccccuccuccgccuucgucguccaaccucaaaauggacgaugcacaacagaugguguccuccucggaacaacccaacuuucacccguuaacaucugcacauuccggggcgaugucacccacauagccggcacccaggaauacacaaugaaccucgccucccaaaacuggaacaacuacgauccaaccgaagaaaucccugcuccccucggcacaccggacuucgucggcaaaauacaaggcguccuaacccagaccacccgucgugacggauccacacgcggacacaaagccaccguaagcaccggcuccguccacuucaccccaaaacuaggccguauacaauucagcaccgacaccuccaaugacuuugaaacuggccaaaauacacgcuucacccccguaggcguaguccaagauggcuccacaacucaccaaaaugaaccccaacaauggguacucccagacuacuccggccgcgacggacacaauguccaccucgcucccgccgucgcccccuccuuccccggagaacaacuacucuucuuccgcucaacuaugcccggcugcuccgguuaccccaauaugaaccucgacugccucuuaccacaagaauggguacaacacuucuaccaggaagcagcucccgcucaaagcgacgucgcccuccuacgcuucguaaaccccgacaccggacguguacuauucgaaugcaaacuucacaaauccgguuacguaaccguugcacacacaggccaacacgaucucgucaucccuccaaacggcuacuuccgcuucgacucaugggucaaccaauucuacacccuagccccaaugggaaacggaaccggccgucgcagagcucucuaa

SEQ ID NO: 36958 - RNA, 1623 nt, Artificial Sequence
  derived and/or modified sequence opt11 from capsid_protein__Norovirus__ACL31319
augaaaauggcauccuccgacgccaaccccucagacgguuccacagccaaccuuguccccgaagucaacaacgaagucauggcucucgaaccggucgucggcgccgccauugcagcacccguugccggucaacaaaacguaauagaccccuggauccguaacaacuucguccaagcccccggcggagaauuuacugucagcccccgaaacgcacccggcgaaauccucugguccgcuccccucggacccgaccucaaccccuaccucucccaccucgcccguauguacaacggcuacgccggaggcuucgaaguccaaguccuccuagccggaaacgccuucaccgccgguaaaaucauuuucgccgccguaccucccaacuuccccaccgaaggacuaucccccucacaaguaaccauguucccccacauuaucgucgacguccgccaacucgaacccguacucauaccacuccccgacgucagaaacaacuucuaccacuacaaucaaucgaacgaccccacaaucaaacucaucgccaugcucuacacaccccuccgagcaaacaacgccggcgacgacguauucacagucucaugucgaguacucacuaggccuagcccagacuucgauuucauuuuccucgucccacccaccguagaaucacgcacaaaacccuucuccguccccauccuuaccgucgaagaaaugaccaacucccgcuucccuauaccacucgaacgacucuucacaggacccuccucagccuucgucguccaaccacagaacggccgauguaccaccgacggaguacuccucggcaccacccaacuaucccccguuaauaucugcaccuuccgcggcgacgucacacauauagcuggcacgcaagaauacaccaugaaccucgccucacaaaacuggaacaacuaugacccaaccgaagaaauacccgcgccccucgguaccccagacuucgucggaaaaauacaaggaguccucacacaaaccacacgccgcgauggaucaacccgcggacacaaagccaccgucuccaccggaucaguccacuucacccccaaacuuggacgaauacaguucagcaccgacacauccaacgacuucgaaaccggccaaaacacacgcuucaccccagucggcgucguccaagacggcggaacuacacaccaaaacgaaccacagcaauggguucuaccagauuauagcggucgcgacucccauaacguccaccuagccccugccguagcccccucauuucccggcgaacaacucuuauucuuccgcuccacaaugcccggcugcuccgguuacccaaauaugaaucucgacugccucuuaccacaagaauggguacaacacuucuaccaagaagccgcccccgcccaguccgacgucgcacuccuccgauucgucaaccccgacaccggucgcguacucuucgaaugcaaacuucauaaauccggguacgucacuguagcccacaccggccaacacgaccuaguaaucccaccaaacggauacuuccgcuucgacagcuggguaaaccaauucuacacccuugcccccaugggcaacggaaccggacgccgccgagcccucuaa

SEQ ID NO: 36959 - RNA, 1623 nt, Artificial Sequence
  derived and/or modified sequence opt11 from capsid_protein__Norovirus__ACL31320
augaaaauggccuccuccgacgccaaccccuccgacggaucaacggccaaucucgucccagaaguaaacaacgaaguaauggcucucgaaccggucguaggcgccgccauugcagcacccgucgcaggucaacaaaacguaaucgaccccuggauccgcaacaacuucguccaagccccaggcggcgaguucacaguaucuccacgcaacgcaccuggcgaaauacucugguccgcaccccuuggccccgaccuaaaccccuaccucagccaccuagccagaauguacaacggauaugccggcggauucgaaguucaaguaauacucgccggcaaugccuuuaccgccggcaaaauaaucuuugcugcagucccucccaacuuccccaccgaagggcucucccccucccaggucaccauguucccacacauaaucguagacguccgccaacucgaaccaguccucauaccacuaccagacguccgcaacaacuuuuaccacuacaaccaaucgaacgacccaaccaucaaacuaauugcaaugcuauacacuccccuccgcgcaaacaacgccggcgacgacgucuucaccgucagcugccgcguccuuacccgccccucccccgauuuugacuucauauuccuagucccacccaccgucgaaucccggaccaaaccuuucuccguacccauccucaccgucgaagaaaugaccaacucccgcuuuccaaucccacuugaacgacucuucaccggaccuuccucugccuucguaguccaaccccaaaacggccgcugcaccaccgacggcguccuacucggcacaacccaacucucucccguuaacaucugcaccuuccgcggagacguaacccacauagcaggcacccaagaauacaccaugaaccucgccucgcaaaacuggaacaacuacgaccccacagaagaaaucccugcaccccucggcacccccgauuuuguaggcaaaauccaagggguccuuacacaaaccacccgccgagacggaucuaccagaggccacaaagccaccguauccaccggcucagucaacuuuacccccaaacucggccguauacaauucuccacagacacauccaacgacuucgaaacaggccaaaacacccgauucacccccgugggagucguccaagacggcagcaccacccaccaaaaugaaccccagcaauggguccuaccagacuacucagguagagacucccacaacgugcaccucgcccccgccguagccccaucauuuccaggcgaacaacuccuauucuuccgcuccaccaugcccggcugcuccggauaccccaacaugaaccucgacugccuacucccucaagaauggguccaacacuucuaccaagaagccgcccccgcccaaucugacgucgccuuacuccgcuucguaaacccggacaccggacgaguccucuucgaauguaagcuccacaaaucuggauacguaaccgucgcccacaccggccaacacgacuuagucaucccucccaacggauacuuccguuucgauucuuggguaaaccaauucuacacacucgccccaaugggcaacggcacuggccgccgccgcgcccuuuaa

SEQ ID NO: 36960 - RNA, 1623 nt, Artificial Sequence
  derived and/or modified sequence opt11 from capsid_protein__Norovirus__ACL31322
augaaaauggccucauccgaugccaaccccuccgacggaagcaccgccaaccucguccccgaagucaacaacgaaguaauggcacucgaacccguggucggagccgccaucgcagcaccagucgcuggccaacaaaacguaaucgaccccuggauccgaaacaacuucguccaggcucccggcggcgaguucacugucuccccucgcaacgcccccggcgaaauccucuggucugcaccccucggcccagaccucaacccauaccucucccaucuugcucggauguacaacgguuacgcaggcggcuucgaaguccaagucauacuagcaggcaacgccuuuacugcaggcaaaaucauauucgcagcagucccaccuaacuuccccacagaaggacuuucccccucccaagucacaauguucccccacaucaucgucgacguccgccaacucgaaccuguccucaucccccucccagacguccgcaacaacuucuaccacuacaaccagagcaaugaccccaccauaaaacucaucgccaugcucuacacaccccuucgcgccaacaacgcaggcgacgaugucuucaccguuucaugccgcguacucacccgccccucacccgacuucgacuucaucuuccuaguaccucccaccgucgaaucacgaaccaaacccuucucaguccccauacucaccguugaagaaaugaccaacucucgcuucccaauaccacucgaaaaacucuucacagggccauccuccgccuucguuguacagccucaaaacggccgaugcacaacagacggcguccuacuaggaacuacccaacucucccccgucaacauaugcaccuuccgaggagacguaacccacaucgccgguacacaagaauauaccaugaaccuagccucccaaaacuggaacaauuaugaccccacagaagaaaucccagcuccacucggcaccccagacuuugucggaaaaauacaaggaguccuaacccaaacuacacgccgagacggaagcacucgcggccacaaagcaaccgucaguaccggcucaguacacuucacacccaaacucggacgaauacaguucucaaccgacacguccaacgacuucgagacaggacaaaacacacgcuucacccccguuggcguaguccaagacggcuccacaacccaccaaaacgaaccccaacaaugggcccuaccagacuacagcggacgugacucccacaacguucaccucgcaccggcaguagcccccuccuuccccggagaacaacuacucuucuuccgcuccaccaugccagguuguuccggcuaccccaauaugaaccuagacugccuccuaccccaagaauggguccaacacuucuaucaagaagccgcucccgcccaaucagacguagcccuccuccguuucgucaaccccgacaccggcaggguacucuucgaaugcaaacuccacaagucuggcuacguaaccgucgcccacaccggacaacacgaccugguaauacccccaaacggcuacuuccgcuucgacucaugggucaaccaauucuacacacuugcccccaugggcaacggcacaggccgccgccgagcccuauga

SEQ ID NO: 36961 - RNA, 1623 nt, Artificial Sequence
  derived and/or modified sequence opt11 from capsid_protein__Norovirus__ACL31324
augaaaauggccucuuccgacgcaaaccccucagauggcucuaccgccaaucucguacccgaagucaacaacgaaguuauggcucucgaacccguugucggagccgccauagcggccccagucgccggccaacaaaacgucaucgaccccuggauacgcaacaacuucguccaagcacccggcggagaguucaccguauccccacgcaacgcaccuggagaaauacuaugguccgcaccccucggcccagaccuaaacccauaccucucacaccuagcccgcauguacaacggcuaugccggcggcuucgaagugcaaguaauccucgccggaaacgccuucacagcaggcaaaaucaucuucgccgcagucccacccaacuucccaacagaaggccucucccccucccaagucacaauguucccacacaucaucgucgacguacgccagcucgaaccaguacuuaucccacuaccagacguccgcaacaauuuuuaccacuacaaucaaucuaaugacaguacaaucaaacuaauagccaugcucuacacgccccuccgcgcaaauaacgccggugacgacgucuucaccguaucaugccguguccucacccgacccucgcccgacuucgacuucauauucuuagucccucccacagucgaaucacgcacaaaaccauucuccgucccaauacuaacagucgaagaaaugaccaauucacgcuuuccaaucccgcucgaacgucucuucaccggccccucuucagcauucgucguccaaccccaaaacggucgcugcaccacagacgguguucuccuaggcaccacccaacucuccccagugaacaucugcaccuuccgcggcgacgucacacacaucgccggaacccaagaauacaccaugaaccuugccucacaaaacuggaacaacuacgacccuaccgaagaaauccccgcaccacucggcacccccgacuucguaggcaagauccaaggcguccucacacaaaccaccagacgagacggcuccacccgcggucacaaagcuacaguuuccaccggcucaguacacuucaccccaaagcuaggccgcauucaauucucaacggacaccuccaacgacuucgaaaccggccaaaacacccgauucacacccgucggcguaguccaagacggaggcaccacucaccaaaaugaaccucaacaauggguccuacccgacuacucuggccgagacggacacaacguccaccucgcccccgcaguagcccccuccuucccaggagaacaauuacuauucuuccguagcacaaugcccggcugcuccggcuaucccaacaugaaccuagacugccuccucccccaagaauggguccaacacuuuuaccaagaagccgccccagcccaauccgacguugcccuucuacgauucguuaaccccgacacaggccgcguccuuuuugaaugcaaacuccauaaauccggauacgucacagucgcccacaccggccaacacgaccuagucauuccacccaacggauacuuccgauucgauucuugggucaaccaguucuacacacucgcccccaugggcaacggcaccggacgccgucgagcauuauaa

SEQ ID NO: 36962 - RNA, 1608 nt, Artificial Sequence
  derived and/or modified sequence opt11 from capsid_protein__Norovirus__ACL31325
augaaaauggccucuaacgacgccgccccauccaaugacggcgccgcuggacucguccccgaaguuaacaacgaaaccauggcccuggaaccagucguaggcgccuccaucgccgccccacucaccggacaaaacaacgucaucgacccauggauccgacucaauuuuguccaagcacccaacggcgaguucacugucuccccucgcaacucccccggcgaaguccuccuaaaccuagaacucggacccgaacuuaacccuuaccucgcacaccucucccgaauguacaacgguuacgcaggcggcguagaaguccaaguacuccucgccggcacggcuuuuaccgccggcaagcuagucuucgcagcaguacccccacacuucccccuagaaaacauaucccccggccaaaucaccauguucccccacgucaucauagacguccgcacacucgaacccguccuacuaccccuaccagacguccgcaacaacuucuuccacuacaaccaacaaaacgaaccccgcaugcgacucgucgcaaugcucuacacuccccuccguuccaacggaucuggcgacgacgucuucaccgucucaugccguguccucacccgcccuuccccugacuucgacuucaacuaccuagucccaccaaccguagaauccaaaaccaaacccuucacccucccaauccucaccaucggcgaacucaccaacucccgcuucccuguacccaucgacgaacuauauacuucccccaaugaaucccucgucguccaaccccagaacggacgcugcgcccuagacggagaacuccaagguacuacacagcuccuccccaccgccauuugcuccuuccgcggaaggaucaaccaaaaagucuccggcgaaaaccacgucuggaacaugcaagucacuaacaucaacggaacucccuucgaccccacagaagacgucccagcaccccucggcacaccagacuucucaggaaaacuuuucgguguacucucccagcgggaccacgccaacgccugccgcucccacgacgccguaauagccacaaacucagccaaauucacucccaaacucggagcaauccaaauaggcaccugggaacaagacgacguccacaucaaccaaccaaccaaauucacuccgguaggacuauucgaaaacgaaggcuucaaccaauggacccuccccaacuauuccggcgcucuaacccuuaauaugggacuagcuccaccagucgcccccacauuccccggagaacaaauccuuuucuucagaucccacauuccccuuaaagguggcgucgcagaccccguaaucgacugucuccucccccaagaauggauacaacaucucuaccaagaauccgcucccucccaaaccgacguagcccucauucguuucaccaaccccgacaccggccgcguccucuucgaagccaaacuccaccgcuccggauacauaaccguagccaauaccggcagcagacccaucguuguccccgcaaauggauacuuccgcuucgauagcugggucaaccaauucuacucacuagcccccaugggcacaggcaacggccgucgccgugugcaauaa

SEQ ID NO: 36963 - RNA, 1629 nt, Artificial Sequence
  derived and/or modified sequence opt11 from capsid_protein__Norovirus__ACL31326
augaaaauggccuccaacgacgccgcucccuccaacgacggagcagccucacucguacccgaaggagucaacgaaacuaugccccucgaacccguagccggagcuucaaucgccgcuccagucgcaggccaaacuaacaucaucgaccccuggaucagaacuaacuucguccaagcccccaacggcgaguucaccgucucuccccgcaacucccccggcgaaauccuccucaaccuagaacuuggucccgaccucaacccguacuuagcccaccucucccguauguacaacggcuacgcaggaggcgucgaaguccaaguacuccuagccggaaacgcauucacagccggcaagauauuauucgccgccauacccccuaacuuccccguagacaugaucuccccagcccaaaucaccaugcuaccacaccucaucgucgacgugcgaacacuagaaccaaucaugaucccccuacccgacguacgcaauguauucuaccacuucaacaaccaaccccaaccccgaaugcgucuaguagccaugcucuacacaccccuucgauccaacgguucuggcgaugacgucuucacagucuccugccgaguccucacucggcccacccccgauuucgaguucaucuaccuaguaccacccuccgucgaauccaaaacaaaacccuucacacuuccaauccucaccaucuccgaacucaccaauucacgauuuccuauccccaucgaacaacuguacaccgccccaaaugaaaccaacgucguccaaugccaaaacggccgaugcacacucgauggcgaacuucagggcacuacucaacuccuaagcuccgccguuugcucauaccgcgguagaacagucgccaacucaggcgacaacugggaccaaaaucuacuccaacuuacauaccccaacggcgcaucuuaugacccaaccgacgaaguccccgcuccccucggaacccaagacuucuccggcaugcucuacggcguccuaacccaagacaacguuaacguuucaaccggcgaagcuaaaaacgcaaaaggcauauacaucagcaccaccuccggcaaauucacccccaaaaucggcuccauaggccuccacucaaucaccgaacauguccaccccaaccaacaaucacgcuucaccccagucggcgucgccguaaacgaaaacacuccauuccaacaauggguccucccccacuacgccggcucccuagcccucaacacuaaccuagcgcccgccguagcaccaaccuucccaggagaacaacuucucuucuuccgaucacgaguacccugcguccaaggccuucagggccaagacgcguucaucgauugccucuuaccacaagaauggguuaaccacuucuaccaagaagccgccccaucccaagccgacguagcacuuauacguuacguaaaccccgauaccggccgcacccucuucgaagccaaacuacaccgauccggcuucaucaccgucucccacaccggcgcguacccacucguaguaccucccaacggucacuuccgcuucgauucgugggucaaccaauucuacucacucgcccccaugggcacaggaaacggacgccgccgcguacaauaa

SEQ ID NO: 36964 - RNA, 1623 nt, Artificial Sequence
  derived and/or modified sequence opt11 from capsid_protein__Norovirus__ACL31340
augaaaauggcuuccaacgacgcuacccccucugacgggucuaccgccaaccucguccccgaaguaaacaacgaaguaauggcucuggaacccguaguaggcgccgccauagccgcaccaguagccggccaacaaaacgucaucgaccccuggauccgcaacaacuucguccaagcaccaggcggcgaauuuacuguauccccacgcaaugcgcccggcgaaauacucuggucagcaccuuuaggcccagaccuaaaccccuaccuaucucaccucucgcgcauguacaacggcuacgccggaggauucgaaguacaggucauccucgccggcaacgccuucaccgccggcaaaaucaucuucgccgccgucccuccuaacuuccccaccgaaggacuuucccccucgcaagucacuauguucccccacaucaucgucgacguucgacaacucgaacccguccucaucccacuccccgacguacgcaacaacuucuaccacuacaaccaauccaacgaccccaccaucaaacuaaucgccaugcuauacacaccccuccgagcaaacaacgccggagaugacgucuucaccgucucaugcagaguccuaacccgccccucccccgacuucgacuuuauuuuccuuguaccacccaccgucgaaucccgaacaaagcccuucucaguacccauccucacuguagaagaaaugaccaacucacgcuucccaauaccccucgaaaaacuauucacaggccccucauccgccuucgucguccaaccacaaaacggccgcuguaccaccgacggaguccuccuuggcacaacccaacuuagccccguuaacauuuguaccuuccgcggcaacguaaccaacaucgccggaucccaaaccuacacuaugaaccucgcaucucagaacuggaacaacuacgaucccaccgaagaaauccccgcuccccucggcacaccagacuucgucggcaaaauccaaggcguacucacccaaacaaccaaaggcgacggcucgacccguggacacaaagccaccguauccaccggcucagcacaguucacccccaaacuagguuccguccaauucuccaccgacaccucaaccgacuucgaaacuggccaaaacacgcgcuuuacacccguuggagucauccaggacggcuccaccacccacaaaaacgaaccccaacaauggguacucccauccuacuccggccgcgacucacacaauguccaccucgcccccgccguagcuccgaccuuccccggcgaacagauucucuucuuccgcucuaccaugcccggcugcucaggauacccuaacauggaucucgacugucuacucccccaagaauggguccaacauuucuaccaagaaucagcacccgcccaauccgacgucgcccuucuucgauucguaaaccccgacacaggacgcguacucuucgaaugcaaacuacacaaaagcggauacgucacuguggcccacaccggacaacaugaucuuguaaucccucccaacggcuacuucagauucgacuccugggucaaccaauucuacacccucgcccccaugggcaacggcgcgggacguagacgagcccuauaa

SEQ ID NO: 36965 - RNA, 1623 nt, Artificial Sequence
  derived and/or modified sequence opt11 from capsid_protein__Norovirus__ACL31354
augaaaauggccucaaacgacgcaaaccccucugacggcucagccgccaaccucguccccgaagucuccaacgaagucauggcccucgaacccguaguaggcgccgccauagcagcccccgucgccggacaacaaaacgucauagaccccuggauacgcaacaacuucguacaagcccccggcggcgaguucaccguauccccucgaaacgcacccggcgaaauacucuggagcgcaccucucggaccagaccuaaaccccuaccucagccaccucgcccguauguauaauggcuacgccggaggcuucgaaguccaaguaauccucgcuggcaacgcauucaccgccggaaaaaucaucuucgccgcaguucccccuaacuuccccaccgaaggucucagccccucacaagucaccauguucccccacaucaucgucgacguccgucaacucgagcccguccucaucccacuccccgacgucagaaacaauuucuaucacuacaaucaacucaaugacucaaccauuaaacucaucgccaugcuauacacaccccuccgugcuaacaacgccggcgaagaugucuucacggucuccugccgcguccucacacgccccucucccgacuucgauuucaucuuccuaguacccccaaccgucgaaucacgcaccaaaccauucacagucccaauccucaccguagaagaaaugaccaacagccgcuucccgaucccacucgaaaaacucuucaccggucccucaggcgccuucgucguccaaccccaaaacggccgaugcaccaccgacggcguccuccucggcaccacccaacuaucccccguaaacaucugcacauuccgcggcgacgucacacacaucgcuggcucccgcgauuauacuaugaaccucgccucauuaaacuggaacaacuacgaccccaccgaagagauuccagcaccccuaggaacucccgacuucgucggcaaaauccaaggaguccucacccaaaccaccaaaggcgacggcuccacccgcggccacaaagccacagucuacaccggcucagcccccuucacccccaaacuuggauccguccaauucuccaccgacaccgaaaacgacuucgaaacacaccagaacaccaaauucacccccgucggcguaauccaagacggauccaccacccaccgcaacgaaccccagcaauggguccuucccucauacucuggacgcaacguccacaacguccaccucgccccagccgucgcucccaccuucccuggagaacaacuccucuucuuccgcuccaccaugcccggcugcucaggauaccccaacauggaccucgacugccuccuuccacaagaauggguucaacacuucuaccaagaagccgcccccgcccaauccgacgucgcacuucuucgauucgucaacccagauacaggccgaguccucuucgaaugcaaacuacacaaaucaggauacgucacagucgcccacaccggccaacacgaucuaguuauaccgcccaauggcuacuuccgcuuugacagcugggucaaccaauucuacacccuagcccccaugggaaacgggaccggacgcagacgcgcccucuaa

SEQ ID NO: 36966 - RNA, 1623 nt, Artificial Sequence
  derived and/or modified sequence opt11 from capsid_protein__Norovirus__ACL31355
augaaaauggcgucuaacgacgccaaccccucagacggauccgcagccaaccucguccccgaaguaucaaacgaagucauggcccucgaacccgucgucggagcggccaucgccgcacccgucgcaggccaacaaaacgucaucgauccauggauccgcaacaacuucguccaggcacccggaggcgaguucacagucucacccagaaaugcccccggcgaaauacucugguccgccccucuaggcccagaccucaaccccuaccugucucaccucgcgcggauguauaacggauaugcaggcggauucgaaguccaaguaauccucgccggaaacgcauucacagccggcaaaauaaucuuugcagcaguuccaccaaacuucccaacagaaggccucuccccuucccaaguaacaauguucccccacaucaucgucgacguacgucaacuagaaccaguacuaaucccccuaccagacguccgcaacaacuucuaccacuauaaccaauccaacgacuccaccauaaaacucaucgccaugcucuacacgcccuuacgcgcaaacaacgccggcgaagacgucuucaccguuucaugccgcguacucacacgaccaucccccgacuucgacuucaucuuccuaguaccacccaccgucgaaucacgcaccaagcccuucaccgucccuauccuaacaguugaagaaaugacaaacucacgcuucccuauuccccuugaaaaacucuucacuggcccaucuggcgccuucguaguacaaccacaaaacggccgcugcaccaccgacggaguccuauuaggcaccacccaacucagccccgucaacaucuguacuuuccgcggagacguaacccacaucgccggaagccgcaacuacacuaugaaccucgcaucccuuaacuggaacaacuacgaccccacagaagaaauccccgccccucuuggcacaccagacuucguaggcaaaauacaaggcguacucacccagaccaccaaaggcgacggcagcacacgaggccacaaagccaccguauacacaggcagcgcgccauucacucccaaacuaggcuccguccaauucucaaccgacaccgaaaacgauuucgaggcacaucaaaacacuaaauucaccccagucggcguaauccaagacggcggcaccacacaccgcaacgaaccacaacaguggguacuacccucguacagcggccgcaacguacacaacguccaccucgcacccgccguagcgccaaccuuuccaggugaacaauuacucuucuuccgcuccaccaugcccgguugcuccggcuaccccaacauggaccucgacugccuacuaccccaagaauggguccaacacuucuaccaagaagcagcacccgcccaauccgacgucgcccuccuccgguucgucaaucccgacacaggccgagugcuauucgaaugcaagcuccacaaauccggauacguaaccguagcccacaccggccagcacgaccuaguaauaccacccaacgguuacuuccgcuucgacucuugggucaaccaguucuacacccucgcccccaugggcaacgguaccggacgacgccgcgcccucuga

SEQ ID NO: 36967 - RNA, 1623 nt, Artificial Sequence
  derived and/or modified sequence opt11 from capsid_protein__Norovirus__ACL31356
augaaaauggcuagcaacgacgccaacccuucagacggcucagccgccaaccuagucccagaagucuccaacgaagucauggcccuagaacccguagucggcgccgccaucgccgcccccgucgcaggacaacagaaugucauagaccccuggauccgcaacaacuucguccaagcccccggcggcgaguucacagucucuccccgaaacgcccccggagaaauccucuggucagcaccccucggcccugaccuuaaccccuaccucucgcaucuagccagaauguacaacggcuacgcaggcggcuucgaaguccaggucauccucgcagguaaugccuucaccgcagguaaaauaaucuucgccgcaguucccccaaacuuccccaccgaaggacugucccccucucaagucaccauguucccacacaucaucgucgacguccgccaacucgagcccguccucauuccccuccccgacguccguaacaacuuuuaccacuacaaccaaagcaacgauuccaccaucaaacucaucgcuaugcuauacacaccucuacgagcaaacaacgccggcgaagaugucuuuaccgucucaugccgcguccucacccgcccaucacccgacuucgacuucaucuuccuaguacccccaacagucgaaucucgaaccaaaccauuuaccgucccaauccucaccgucgaagaaaugaccaacucccgcuuccccauaccccuagagaaacucuucacaggccccuccggcgcguucgucguccaaccccaaaacggaagaugcaccacagacggaguccuccucggcacaacccaacuaucaccagucaacaucuguaccuuccgcggagacgucacccacaucgccggcucacgcaacuacaccaugaaccuugcaagccuaaacuggaacaacuacgacccaaccgaagagauccccgccccgcucggcacccccgacuucgucggcaaaauacaaggaguccucacucaaacaaccaaaggagacggcucaacacgcggccacaaagccaccgucuacacaggcagcgcacccuuuaccccaaaacucgguuccguccaauucagcaccgacacagaaaacgauuucgaaacccaccaaaacaccaaauucacccccgucggugucauucaagacggauccaccacacaccgcaacgaaccccaacaauggguccuccccuccuacuccggcagaaacguccauaacguccaccuagcacccgcaguugcucccacauucccgggagaacaacuccuauucuuccgcuccaccaugcccggaugcuccggauacccaaacauggaccucgacugccuccuaccccaagaauggguccaacacuucuaccaggaagcagccccugcucaaucggacguugccuuacuuagauucguaaacccggacaccggacgcguucucuucgaaugcaaacuccacaaaagcgguuacgucaccguugcccacaccggccaacacgaccuugucaucccucccaacggcuacuuccgauucgacuccuggguaaaccaauucuacaccuuagcccccaugggaaacgggaccggacgccgccgcgcacuuuaa

SEQ ID NO: 36968 - RNA, 1623 nt, Artificial Sequence
  derived and/or modified sequence opt11 from capsid_protein__Norovirus__ACL31358
augaaaauggccucaaacgacgccaaccccucggacggaucagccgcaaaccuagucccagaagugucaaacgaagucauggcccuagaacccguugucggugcagcuaucgccgcccccguugcaggucagcaaaacguaaucgacccauggauccgaaacaacuuuguccaggcaccaggcggagaauuuaccgucucgccccgcaacgccccaggagaaauccucugguccgcaccccuaggccccgaccucaacccauaccucucccaccucgcccggauguauaacggcuacgccggcggauucgaaguacaaguaauccucgccggaaacgcauucacugccggaaaaaucaucuucgcugccgucccacccaacuuccccaccgaaggauuaucccccucacaaguaacaauguucccacacaucauagucgacguccgccaacucgaacccguccucaucccacuucccgacguccgcaacaacuucuaccacuacaaucaauccaacgacagcaccauaaaacucaucgcaaugcuauacacaccccuccgcgcgaacaacgccggcgaagacgucuucacaguaucaugccgcguccucacccgcccaagccccgacuucgacuucaucuuccucgucccucccacagucgaaucaagaacaaaacccuucaccguccccaucuuaaccgucgaagaaaugacaaacagccgcuuccccaucccccucgaaaaacucuucacaggaccuuccggcgccuucgucguacaaccccaaaauggacgcugcaccacugacggcguccuccucggcaccacacaauuaucccccgucaacaucugcacuuuccgaggcgacgucauccacaucgcagguucacgcaacuauaccaugaaucucgccucccuuaacuggaacaacuacgaccccaccgaagaaauccccgcaccccucggcacacccgacuucgucggcaagauacaaggaguccuaacccaaaccaccaagggcgacggaucaacacgcggccacaaagccaccgucuacacuggcuccgcccccuucacaccaaaacuaggcuccguccaauucuccacggacacagaaaacgacuucgaagcccaccagaauaccaaauuuacacccgucggcgucauccaagacggcggcacaacccaccgcaacgaaccccaacaaugggugcuccccagcuacucaggccgcaacguccacaacguccaccucgccccagccgucgcccccaccuuccccggcgaacagcuccuauucuuccgcucaaccaugcccggcugcagcggcuacccaaacauggaucucgacugccuccucccccaagaauggguccaacacuucuaccaagaagccgcccccgcccaauccgacgucgcacuucuacgcuucgucaaccccgacaccgguagaguccucuuugaaugcaagcuacauaaauccggauaugucaccgucgcacacaccggccaacaugaccucgucauacccccuaacgguuauuuccgcuucgacucuugggucaaccaguucuacacccucgcacccaugggaaacggaaccggccgccgacgcgcccuauaa

SEQ ID NO: 36969 - RNA, 1647 nt, Artificial Sequence
  derived and/or modified sequence opt11 from capsid_protein__Norovirus__ACL31361
augaaaauggccucaaacgacgccgcgccauccaacgacggcgcggcaggccuuguaccagaaauaaauaacgaagccauggcccuugaacccgucgcaggcgccgcaauagcugcaccacuaacuggccaacaaaacaucauagaccccuggaucaugaacaacuucguccaagcccccggaggagaauuuacugucagcccccgaaacucccccggagaaguacuacucaaccucgaacucggccccgaaaucaaccccuaccucgcccaccucgcccgaauguacaacgguuacgcaggcggcuucgaaguccaaguuguccucgccggaaacgcauucacagcaggcaaaaucauauucgccgcaauaccaccaaacuuccccaucgacaaccucuccgccgcacaaaucacaaugugcccccacgucaucgucgacguccgccaacuugaacccguaaaucucccaaugcccgacguacgcaacaacuucuuccacuacaaccaaggauccgacucccgccuacggcuaaucgccaugcuauacaccccacuccgagcuaacaauucaggagacgacgucuucacagucuccugccgcguccucacgcgacccucaccagacuucagcuucaacuuccuugucccacccaccguagaauccaagacaaaacccuucucccucccaauacuuacaaucuccgaaaugucaaacucacgcuucccaguccccauagacucucuccacaccucccccaccgaaaauaucguaguacaaugccaaaacggccguguaacauuagacggcgaacucaugggcacuacccaacuccucccuucccaaaucugcgccuuccgcggcguccugacccgcuccacaagccgagccuccgaccaagcagacacagcaaccccacgacucuucaacuauuacuggcacauccaacuagacaaccucaacggcacuccuuacgaccccgccgaagacauaccaggcccccuaggaacaccagacuuccgaggcaaagucuucggagucgcaucccaacgaaacccagauuccaccacucgcgcacacgaagcaaaaauugacaccaccuccggccgcuucacccccaaacuuggcucccucgaaauuucgacagaauccgacgacuucgaccaaaauaaaccuacccgauucacaccaguaggcauuggcgucgaccacgaagccgacuuccaacagugggcgcuaccagacuacgccggccaauucacucauaacaugaaccuagccccugcaguugcucccaauuuccccggcgaacaacugcucuuuuuccgcucacaacuccccucaucagggggccgcucuaacggcauccuagacugcuuagucccacaagaauggguccaacacuucuaccaagaauccgcaccaucccaaucccaagucgcccuaguucgcuacaucaacccagacacaggacgcguacuauucgaagccaaacuacacaaacucgguuucaucaccauagccaaaaacggcgacucucccauaaccgucccacccaacggauacuuccgauucgaauccugggucaaccccuucuacacgcuagccccuauggguacugguaacggccgacgcagaauacaauaa

SEQ ID NO: 36970 - RNA, 1623 nt, Artificial Sequence
  derived and/or modified sequence opt11 from capsid_protein__Norovirus__ACL31365
augaaaauggccucaaacgacgccaaccccuccgauggauccgcggccaacuuagucccagaagucucaaacgaaguaauggcccucgaacccguagucggcgcagcaaucgcagcaccagucgccggccaacaaaacgucaucgacccauggauccgcaacaacuucguccaagccccuggaggugaauuuacugucagcccacgcaacgcccccggugaaauccucugguccgcaccccuuggccccgaccucaacccauaccucucccaccucgcccguauguacaacggcuacgccggcggauucgaaguccaagucauccucgccggaaacgcauucacugcaggcaagaucaucuucgcagccguaccucccaacuuccccaccgaaggccuaagccccucacaagucaccauguucccacacauaauagucgauguccgucaacuagaacccguacuuaucccacuaccagacguccgaaacaacuucuaccacuacaaccaaucaaacgacucaacgauaaaacucaucgccaugcucuacacaccacuccgugcaaacaacgcuggcgaagacgucuucacagucucaugcagaguccucacacgccccucccccgacuucgacuucaucuuccucguacccccaaccguagaaucacguaccaaacccuucaccguccccauucuaacaguggaagaaaugaccaacucacgauucccaauuccacucgaaaaacuauucacuggccccucaggagccuucguaguccaaccccaaaacggacgcugcacuacagacggcguacuacuaggaaccacacaacuaucaccagucaacauuugcaccuucagaggcgauguaacacacaucgcagggucccacaacuacaccaugaaccucgcaucucuaaacuggaacaacuaugacccaaccgaagaaauccccgcaccccuaggcacacccgacuuugucggaaaaauccaaggcguccuaacacaaacaaccaaaggagacggcucaacccgaggccacaaagccaccgucuacacuggaucugcccccuucacucccaaacuaggcucaguccaauucucaacagacaccgaaaacgacuucgaaacccaccaaaacaccaaauucacccccgucggcguaauccaagacggcuccacaacccaccgcaacgaaccccaacaauggguacucccauccuacucaggcucuaacguacacaacguccaccuagcuccagccgucgcccccacauucccaggagaacaacuccucuucuuccguucaacuaugccgggcugcucaggcuaccccaacauggaccuagacugccuccuaccacaagaauggguucagcacuucuaccaagaagccgcccccgcacaauccgacgucgcacuccuccgcuucgucaaccccgacaccggccgcguccuauucgagugcaaacuccacaaaagcggcuacgucacagucgcccacaccggacaacacgaccuagucaucccgccaaacggcuacuucagauucgacagcugggugaaccaauucuacacacucgcccccaugggcaacggaaccggacgccgccgcgcccucuaa

SEQ ID NO: 36971 - RNA, 1623 nt, Artificial Sequence
  derived and/or modified sequence opt11 from capsid_protein__Norovirus__ACL36375
augaaaauggccagcaacgacgcaaaccccucagauggcucugccgcaaaccucguccccgaaguaaacaacgaagucauggcccuagaaccuguaguaggcgcagcaaucgcugccccugucgcuggacaacaaaacguuauagaccccuggauccgcaacaacuucguccaagcccccggcggcgaguucacaguaucaccccgcaacgcacccggcgaaauacucuggucagcuccucucggacccgaccucaaccccuaccucucacaccucgcccguauguacaacggauacgcuggaggcuuugaaguacaagucauccuagcgggcaacgcauucaccgccggcaagaucaucuucgccgccgucccacccaacuuccccaccgaaggccucucucccagccaagucacaauguucccccacaucaucgucgacguaagacaacucgaacccguacuuaucccccuacccgauguccguaacaacuucuaccacuauaaccaauccaacgaccccaccauuaaacucaucgccaugcucuacaccccucuacgagccaacaacgccggagaagacguuuucaccgucuccugcagaguccucacacggcccucacccgacuucgacuuuaucuuccuugucccacccaccgucgaaucccgcacuaaacccuucaccguacccauccucaccgucgaagaaaugaccaacucuagauuccccauaccccuagaaaaacuauucaccggccccuccuccgccuucguaguccaaccacaaaacggucgcugcaccaccgacggcguccuccucgguaccacccaacucucacccgucaacaucugcacuuuccgaggagacgucacccacauagccggcucucgcaacuacaccaugaaccuugcuucacucaacuggaacaauuacgauccgacagaagaaguaccagcaccccucggcacacccgauuucguaggaaaaauacaaggaguccuaacccaaaccacaaaaggcgacggcuccacccgaggccacaaagccaccgucuacaccggcucagcccccuucaccccaaaacuagguucuguacaauucucuacagacacagaaaacgacuucgaaacucaccaaaacaccaaguucaccccugucggagucauccaagacggcuccacaacccaccguaaugaaccccaacaauggguccucccguccuacucuggacgcaacguucaaaacguccaccuagccccugcuguagcccccaccuuccccggcgaacaacuccuauucuuucgcuccacuaugcccggcugcuccggauaucccaacauggaccucgacugccuccucccccaagaauggguccaacacuucuaucaagaagccgcccccgcccaaucagacgucgcccuacuacgcuucguaaaccccgacaccggccguguacuauucgagugcaaacuucacaaauccggcuauguaacagucgcacacaccggacaacacgaccucgucaucccacccaacggauacuuccgcuuugacuccuggguuaaccaguucuacacccucgcccccaugggcaacggcaccggacgccgccgagcccuauag

SEQ ID NO: 36972 - RNA, 1593 nt, Artificial Sequence
  derived and/or modified sequence opt11 from capsid_protein__Norovirus__ACN32270
augaugauggccucuaaagacgccacauccagcgucgacggcgccuccggagccggacaacucgucccugaagucaacgccucggacccucuagccauggacccagucgccggcuccucaacagccgucgccaccgccggacaagucaaccccauagauccauggauaauaaacaacuucguccaagcuccccagggcgaauuuaccauauccccuaacaacaccccaggcgauguccuauucgaucuuucccucggcccccaccucaaccccuuccuccuucaccucagccaaauguacaacggcuggguaggcaacaugcgcguccgaaucaugcucgccggaaacgccuucaccgccggaaaaaucaucgucuccugcaucccacccggcuucggcucccacaaccucaccauugcccaggcuacucuauucccccacguuauagcagacguacgcacucuugacccuaucgaagucccccucgaagacguacgaaauguccucuuccacaauaacgaccgcaaccaacaaaccaugcgacucgucugcaugcuauacacgccccuacgcacaggaggaggaaccggcgacuccuucgucgucgccggucguguuaugacaugccccucccccgacuucaauuuccucuuccucgucccacccaccguagaacaaaagacccgucccuucacacuucccaaucuaccccucuccucccucuccaauucccgcgcaccccucccaaucuccggcaugggaaucucucccgacaacguacaauccguccaauuccaaaacggaaggugcacccucgauggccgccuagucggaaccacccccgucucacuaucucacgucgccaaaauccgagggaccagcaacggaacagugauuaaccuaacggaacuagacggcacccccuuccacccauucgaaggacccgccccaaucgguuucccugaucuaggcggcugcgacuggcauaucaacaugacccaguucggccacuccucccaaacccaauacgacgucgacaccacccccgacacuuucgucccccaccucggcuccauccaagcaaacggcauaaacucaggcaacuacaucggcguucucuccuggguguccccacccucccacccgucaggcagccaagucgaccucuggaaaauacccaacuacggauccucaaucaccgaagcaacccaccucgcccccucagucuucccacccggauucggcgaaguccucgucuucuucaugucaaaaaucccaggacccggcgcuuauucccucccgugccuccucccacaagaauacauaucacaccucgccuccgaacaagcccccacggucggagaagccgcccuacuccauuacguagacccggacaccggccgcaaccuaggugaauuuaaagccuacccagacgguuuccucacaugcgucccuaacggcgccucaucaggcccucaacaacuccccaucaacggaguauucgucuucgucuccugggugucacgauucuaccaacuuaaacccguaggcaccgccucgacugcgcgcggcagacucggccuccgucgcuaa

SEQ ID NO: 36973 - RNA, 1608 nt, Artificial Sequence
  derived and/or modified sequence opt11 from capsid_protein__Norovirus__ACT52403
augaaaauggcauccaacgacgccagcccauccuccgacggcuccgccaaccucgucccagagaucaacaacgaagucauggcccucgagcccgucgccggagccgccaucgccgcuccaguagcaggccaacaaaauauaaucgaccccuggauccgcaacaacuucguccaagcccccggcggcgaguucaccguaucuccccgcuccgcacccggugaaguacuucucaaccucccccucuccccagacaucaaccccuaccucgcacaccucucacgcauguacaacggcuacgccgguggagucgaagucgaagucguccuagccggcaacgcuuucaccgccggcaaaaucauauucgcagccguucccccaaacuuuccucccgagaaccucucccccucacaaauaaccaugcucccacacaucaucgucgauguccgccagcucgaacccguccgaauaccccuucccgacguccgcaacaacuucuaccacuacucccgcgaaaacgacucgacacuccgccucauugcuaugcucuacacaccccucagagccaacaacgcaggagacgacgucuucaccguauccugcagaguucucacccgccccuccccagacuucgauuucauauuccuagucccaccuaccgucgaauccaaaucaaaacccuucaccauacccauccuuaccauugaagaaaugacaaacucucgcuuucccgcaccccuggaaaugaugaccacaggucccucccacgacaucgucguccaaccacaaaacggccgcugcaccaucgacggcguacuccucggcaccacacaacuuucucccgucaauauaugcuccaugcgcggaguccccaccaaacgcaccaacggcacugacaauugcuucguccaacucgaaaaccccaacggcucagcauacgaucccaccgaagacauucccgcaguccuuggcuccccagacuucguaggcgaguucuacggaaccaucacccaacgaucuccaaacaacuccacccgagcacaccccuuuacccucaacaccggaucaccacgcuauacccccaaaaucggcucagucgacauccacguuacagacgucgaagaccuaaacgaccacgaacccguaaaacucacacccgucggccuauccggauccucaggcucaauccaccaauggcaacuacccaacuacucaggagucgccacccacaacaugcaccuugcccccuccgucgccccucucuucccaggcgagcaaauccucuucuuccgauccaccgucccaggcugcggaggauaccccaacacaaacaucgacugccucauaccacaagaguggguccagcacuucuaccaagaaggggcuccugcccggacugacguagcucuccuacgcuucaucaaccccgacacaggccgaguccucuucgaaugcaaacuccacaagcacggcuuuaucaccgucgcauacucagguaaccacgaccucguaaugccacccaacggauacuuucgauucgaauccugggucaaccaauuccacacccuugccccaaugggcaccggcucaggucgccgccggauacaauaa

SEQ ID NO: 36974 - RNA, 1647 nt, Artificial Sequence
  derived and/or modified sequence opt11 from capsid_protein__Norovirus__ACT52405
augaaaauggccuccaacgacgccacccccucuaacgacggcgcagccggccucgucccagaaauaaauaacgaagcaauggcccucgacccaguagccggcgccgccaucgccgcaccccuaaccggccaacaaaacaucauagaucccuggauuauggauaacuucguccaagccccaggaggcgaguucaccguaucuccccgaaacucacccggcgaaguccuacucaaccuugaacucggccccgaaaucaaccccuaccucgcccaccuagcacguauguacaacggauacgccggcggcuucgaaguccaagucguccucgccggaaacgccuucaccgcuggcaaaauaauauuugccgccauaccacccaacuucccaauagacaaccucuccgccgcucaaaucaccaugugcccacacgucaucgucgacguaagacaacucgaaccagucaaccucccgaugccagacguccgcaacaacuucuuccacuacaaccaaggcucugauuccaggcuaagacucaucgcuaugcucuacacaccccuacgagccaacaacuccggcgacgacgucuucaccgucuccugccgcguucuaacccgcccuucuccagacuucucguucaacuuccuaguacccccaacugucgaauccaaaaccaaacccuucacgcuaccuaucuuaacaauaucagaaaugagcaacucccgauucccaguccccauugacucccuccacaccagccccaccgacaacaucguaguacaaugccagaacggccgcguaacccuagacggggaacucaugggcaccacccaacuucuacccucccaaaucugcgccuucagaggaguccuaacacgcuccaccucacgcgccucggaucaggcagacaccgccacaccccgacucuucaacuacuacuggcacauacaacucgacaaccucaacggcacacccuacgaucccgccgaagauaucccaggaccccucggcaccccagacuuccgaggcaaggucuucggcgucgccagccaaaggaauccugacucaaccacccgcgcucacgaagccaaaguugacaccaccgccggccgauucacccccaaauuaggaucccuagaaaucuccacagaaucaaacgacuucgaccaaaaccaacccacacgcuucaccccuguagguaucgguguagaccacgaagccgacuuccaacaguggucacucccagauuauuccggccaauucacccauaauaugaaccucgucccagccguagccccaaacuuccccggcgaacaacuccucuucuuccgaucccaacuccccuccucaggcggacgcagcaacggcauccucgacugccucguaccacaagaauggguccaacacuucuaccaggaaucagcccccgcccagacccaagucgcacucgugcgcuacguaaacccagacaccggccgaguacucuuugaagccaaacuccacaaacuaggcuuuaugaccaucgccaaaaacggcgauucccccaucaccguaccucccaauggcuacuuccgcuucgaauccuggguaaaccccuucuacacacuugcccccaugggcaccggcaacggacgacgucgcaaccaauaa

SEQ ID NO: 36975 - RNA, 1647 nt, Artificial Sequence
  derived and/or modified sequence opt11 from capsid_protein__Norovirus__ACT52407
augaaaauggcauccaaugacgccaccccauccaacgacggagccgcaggucuaguaccugaaauuaacaacgaagccauggcacucgauccuguagccggagccgccaucgcugcuccccucacaggccaacaaaacauuauagaccccuggauaaugaacaacuucguccaagcccccggaggcgaauuuaccgucucaccccgcaacucccccggcgaaguucuccucaacuuagaacuaggccccgaaaucaacccauaccucucccaucuagcccgaauguacaacggcuacgccggcggcuucgaaguacaagugguacucgcaggaaacgccuucacagccggaaaaauaauauucgccgcuaucccgcccaacuuccccaucgacaaccucuccgcugcccaaaucaccaugugcccacaugucauaguagacguucgccaacucgaaccagucaaccuccccaugcccgacguacgcaacaacuucuuccauuacaaccaaggcucagauucccgccuucgccucauagccaugcucuacacaccccuucgagccaacaauuccggcgacgacgucuucaccguauccugccgcguccuaacccgccccucccccgacuucuccuucaacuuccuagucccacccaccguggaaucaaaaaccaagcccuucacccuacccauccucacgaucucagaaaugucaaacucucgcuuccccguacccauagacucacuucacaccuccccaacagaaaacaucgucguacaaugccaaaacggccgaguaacccucgacggcgaacucaugggaaccacacaacuccuacccucucaaaucugcgcauuccgaggcguucucacccgcucaacaucccgcgcauccgaucaagccgacaccgcuacccccagacucuucaacuacuacuggcauauccaacucgacaaccuaaacggcacccccuacgaccccgcagaagacauccccggcccucuagguacucccgacuuccguggcaaagucuucggcgucgccucccaacguaacccagauuccaccacccgcgcucacgaagccaaagucgacaccacagcaggccgauucaccccuaaacucggaucccuagaaauaagcaccgaaucagacgauuucgaccaaaaccaaccgacccgcuucacacccgucggcauaggcguagaccacgaagcagacuuucaacaauggucccucccagacuacucaggccaauucacacacaacaugaaccuugcacccgccguagcacccaacuuccccggagaacaacuccuauucuuccgaucccagcuucccucauccggcggccguucuaacgguauucuagacugccucgucccacaagaauggguacaacacuucuaccaagaaucagccccugcccaaacacaagucgcccucgugagauacguaaaucccgacacaggccgcguccuauucgaagcuaaacuacauaaacucgguuucaugaccauagccaaaaacggcgacucaccaaucaccguucccccaaacggcuacuuccgcuuugaauccugggucaaccccuucuacacccucgcaccaaugggcacaggcaacggccgacgccgcaaccaguaa

SEQ ID NO: 36976 - RNA, 1608 nt, Artificial Sequence
  derived and/or modified sequence opt11 from capsid_protein__Norovirus__ACT52409
augaaaauggcaucaaacgacgccgcccccagcaacgacggagccgcaggccucguccccgaagucaacaacgaaaccauggcccucgaacccgucgcaggcgccuccaucgccgcaccucuuacaggucaaaauaauguaaucgaccccuggauuagaaugaacuuuguccaagcccccaacggcgaauuuaccgucucuccccgcaacucccccggugaaauccuacucaaccucgaacucggacccgaacuaaacccauuccuagcccaccuaucccgcauguacaacggcuacgccggcggcgucgaaguccaaguccuacucgccggcaaugccuucacagccggcaagcuagucuuugccgcaaucccuccccacuuccccaucgaaaaccucucccccggccaaaucaccauguucccccauguaaucaucgacguccgcacacuagaacccguccuucucccacuacccgacguacgcaauuccuucuuccacuacaaccaagaacccgaacccagaaugcgacucgucgccaugcuauacaccccacucagauccaacgguuccggcgacgacguuuucaccguaucuugccguguucucacccgaccauccccagacuucgacuucaacuaccuuguaccucccaccguagaauccaaaacaaaacccuucacccuccccauacuuaccaucggggaacuauccaacucacgcuuccccgcccccaucgacgaacuauacacaucucccaacgaaggccuugucguacaaccacaaaacggucgcucaacccuagacggugaacuccucggaacaacccagcuaguacccuccaacaucugcucccuucgaggccgcaccaacgcacaucuaccagacaaccaacacagauggaacaugcaagucacaaaccccaacggcacacccuucgaccccacagaagacgucccagcuccccuaggcaccccagacuuccucgccaacaucuacggagucaccucccaacgaaaccccaacaauaccugccgcgcccacgacggcauccuugccacauggucaccaaaauucacccccaaacucgguuccgucguacucgguaccugggaagaucgagacuucgacaucaaccaaccaacacgcuucacacccgucggccucuacgacacagaccauuucaaccaaugggcacucccaaacuacuccggcgcccucacccucaacaugaaccuugcccccagcgucgcuccccuauucccaggcgaacaacuacucuuuuuccgcucccacauccccuuaaaaggcggaaccucgaacggcgccaucgacugucuucuuccccaagaauggguacaacacuucuaucaagaauccgcccccucuucaaccgacgucgcccucauucgcuacacaaacccugacacaggccgcguccucuucgaagccaaacuccaccgccaaggcuucauuacagucucuaacuccgguucccgacccaucguuguaccacccaacggcuauuuccgcuucgacagcugggucaaccaauucuacucccuagcucccaugggcaccggaaacggccgacgccguguacaauaa

SEQ ID NO: 36977 - RNA, 1623 nt, Artificial Sequence
  derived and/or modified sequence opt11 from capsid_protein__Norovirus__ACT78459
augaaaauggcaagcucugacgccaacccauccgacggcucaaccgcaaaccucgucccagaaguaaacaacgaaguuauggcccucgaacccguugucggcgccgcgaucgccgccccugucgcaggacaacaaaacguaauagaucccuggauacgcaacaacuucguucaagcccccggcggagaguucaccguuucaccccgcaacgcacccggagaaaucuuaugguccgcaccccuaggaccggaccucaaccccuaccucucgcaccucgcacgcauguacaacgguuacgccgguggauucgaaguccaagucauacuugcaggcaacgccuucaccgcagguaaaaucaucuucgcugccguuccacccaacuuccccaccgaaggccuaagccccucccaagucacuauguucccacauaucaucgucgacguacgccaacuugaaccugugcucaucccacucccugacguccgcaacaacuucuaccacuacaaccaauccaaugacccgacaauaaaacuaaucgcaaugcucuacacuccccuucgcgccaacaacgcaggagacgacguuuucaccguauccugccgcguccucacccgacccucccccgacuuugacuucauauuccuugugccaccuaccgucgaaucccgcaccaaaccauucucagucccuauccuaaccguagaagaaaugaccaacucccgauuccccauuccccuagaaaaacuauucacaggccccuccucggcauucgucguccaaccacagaacggacguugcaccaccgacggaguccuacucggcaccacccaacucucccccgucaacaucugcaccuuccgcggcgacgucacccacaucaccgguucccgcaacuauaccaugaaccucgcgacucagaacuggaacuccuacgacccaaccgaagaaauccccgcaccccuuggaacacccgacuucguuggaaaaauucaaggcguccucacacaaaccacacgggccgacggcagcacccgcggccacaaagccaccguauauaccggcuccgccgacuucgcccccaaacucggccgcguacaauucgcaacagacaccgaccacgacuucgacgccaaccaaaacacaaaauucacaccugucggaguuauccaagacggcgacaccgcccaccgcaacgaaccccaacaauggguccuccccuccuacuccggacgaaacagccacaacguccaccuugccccagccguagcacccaccuucccaggcgaacaacuacuuuucuuccgcuccaccaugcccggaugcucuggcuacccaaacauggaccucgauugccuccuuccccaagaauggguccaauacuucuaccaagaagccgcaccagcccaauccgacguugcacuacuacguuucguaaaccccgacaccggccgaguccucuucgaauguaaacuacacaaauccggcuaugucacagucgcacacacaggucaacacgaccucgucaucccacccaacggauacuuccgauucgacuccugggucaaccaauucuacacgcucgcccccaugggaaacggaaccggccgccgccgcgcacucuaa

SEQ ID NO: 36978 - RNA, 1641 nt, Artificial Sequence
  derived and/or modified sequence opt11 from capsid_protein__Norovirus__ACU56258
augaugauggccuccaaagacgcaccccaaagcgccgacggcgcauccggcgccggccagcuaguccccgaagucaauacggcagacccccuucccauggaacccguugcuggucccaccaccgcugucgccaccgccggccaaguaaacaugaucgaccccuggaucgucaacaacuucguccaauccccacaaggcgaauuuacaauaucacccaacaacacacccggcgacauccucuucgaccuacaacuagguccccaccuaaaccccuuccucagucaccucucacaaauguacaacggcuggguugguaacaugcgcguccgaauccuacucgcaggcaacgccuucucugccgguaaaauaauugucugcugcguaccgcccggauucacauccuccuccuuaacaaucgcacaagcaacacucuucccccacguaauagccgauguccgcacccuagaaccaaucgaaaugccccuugaagacguccgcaacguccucuaccacacaaacgacaaccaacccaccaugagacucgucugcaugcucuacacaccccuacgcaccggcggcggauccggcaacucagacucuuucgucgucgccggccgcgugcuuaccgcucccucaucggacuucaguuuccuauuccucguacccccuaccaucgaacagaaaacccgcgccuucaccguccccaacaucccccuccaaacccuuuccaacucccgcuucccgucccucauucaaggaaugauccuaucacccgacgccucucaagucguccaauuccaaaacggacgaugucucaucgacggucaacuccuuggaaccacacccgccaccucaggacaacucuuccgcguccgaggcaaaauaaaccaaggcgcccgaacccuuaaccucacagaagucgacggcaaacccuucauggccuucgacuccccugccccagucggcuuccccgacuucggcaaaugcgacuggcacaugcgaauauccaaaacaccaaacaacaccuccagcggagaccccaugcgcagcgucgacguccaaacagacguccaaggauucguuccccaccucggcuccauccaauucgacgaaguauucaaccaucccaccggcgacuacaucgguaccaucgaauggaucagccaacccuccaccccacccggaacagacaucaaucuaugggaaauccccgacuacgggucuagccucucccaagccgccaaccucgcacccccagucuucccacccggauucggcgaagcccuagucuacuucgucucagccuuccccggccccaacaaccgauccgcccccaacgacguucccugccuccuaccccaagaauacguaacccacuucgucucagaacaagccccaaccaugggcgacgccgcgcuucuccacuacgucgaccccgacacuaaccgcaaccuaggcgaauuuaaacuguaccccggaggcuaccuuaccugcguaccaaacggcguuggcgccggcccccaacaacuaccgcuaaaugguguauuccuuuucguaucaugggucucgcgcuucuaccaacucaaacccguaggcaccgccagcaccgcccgcggccgccuuggaguccgcagaaucuaa

SEQ ID NO: 36979 - RNA, 1638 nt, Artificial Sequence
  derived and/or modified sequence opt11 from capsid_protein__Norovirus__ACX33982
augaugauggccucaaaagacgcacccaccaacauggacggcaccagcggugccggacaacucguccccgaagccaacacagccgaacccauuagcauggaaccggucgccggcgccgccaccgccgccgccaccgccggccaagucaacaugaucgaccccuggaucaugaacaacuacguacaagcaccccaaggcgaguucacaauaucaccuaacaacacccccggcgacguccuauucgaccuccaauuaggcccacaccuuaacccauuccuaucacaccuagcacaaauguacaacggcugggucggaaacaugaaagucaaaguccuccucgccggaaacgcuuucaccgccggcaaaauaauuaucucaugcauaccacccggauucgccgcacaaaacuucuccaucgcccaagccaccauguucccccacgucaucgccgacguccguguccucgaacccauagaagucccccuagaagacguccgcaacguacucuuccacaacaacgacaacaccccgaccaugcgccuagucugcauguuauacacaccccuccgagcuucaggaucgucuuccggaacagaccccuucguuaucgcaggccgcguucuuaccugccccucacccgacuucucauuccucuuccuuguacccccaaacgucgaacagaaaaccaaaccauucuccgucccaaaccuaccccucaauacccuuucaaacagccgaguccccucccucaucaaauccaugaugaucucacgagaccacggccaaaugguacaauuccaaaacggacgcguaacccuagacggccaacuccaaggcaccacucccaccuccgcgucccaacuaugcaaaauacgcggaagcgucuuccaugccaacggugggaacggcuacaaccucacugaacucgacggaucccccuaccacgccuucgaaucacccgcccccaucggcuucccugaccuaggagaaugcgacuggcacauggaagcauccccuaucacacaauucgacacaggcgaugucaucaaacaaauuaacguuaaacaagaauccgccuucgcaccacaccuuggaacuguccaagcugacggacuuuccgacguguccgccaacaccaacaugaucgccaaacuaggcugggucucucccguauccgacggacaccgcucagauguggacccaugggucauuccccgcuacggcucaacacucaccgaagccgcacaacucgcacccccaaucuaucccccaggauucggagaagccauaguauucuucauguccgacuuccccauagcacacggcacaaacggccucagcgucccaugcacaaucccccaagaguucguaacccacuucgucaacgaacaagcacccacucgcggcgaagcugcccuccuacacuaccucgacccagacacccacagaaaccuaggcgaguucaaacucuaccccgacggcuucaugaccugcguacccaauuccuccggcaccggaccccaaacacuuccaaucaacgguguauucguguucgucucaugggucucccgcuuuuaccaacuaaaacccguggguaccgccggcccagcccgcagacuaggcaucaggcgcuccuaa

SEQ ID NO: 36980 - RNA, 1638 nt, Artificial Sequence
  derived and/or modified sequence opt11 from capsid_protein__Norovirus__ACX33983
augaugauggccagcaaagacgcccccaccaacauggacggcacuucuggcgcaggacaacucgucccagaagcuaacaccgcugaaccaaucagcauggaaccagucgcaggcgccgccaccgccgccgccacagcaggccaagucaacaugaucgacccauggauaaugaacaacuacguacaagcaccccaaggcgaauuuaccauaucacccaacaauacacccggcgacguccuauucgaccugcaacucggcccccaccucaaccccuuccuaucccaccucgcacaaauguacaacggcugggucggaaacaugaaagucaagguacuacucgcaggcaacgcuuucacagccgguaaaauuaucaucuccugcauaccacccggcuucgucgcacaaaauuucuccaucgcccaagcaacaauguucccccacgucauagccgaugucagaguacuagaaccuauagaaguaccacuagaagacgucagaaacguucucuuccacaacaaugacaacaccccgaccaugcgacucgucuguaugcuauacacaccccuacgcgccggcggcagcucuaguggcaccgaccccuuugucauagccggccguguucuuaccugccccucccccgacuucagcuuccuauuucucguaccacccaacgucgaacagaaaaccaaacccuucuccguacccaaccucccccugaacacucucuccaacucccgcguacccucccucaucaaauccaugaugaucucccgcgaccacggccaaaugguacaauuccaaaacggccgaguaacccucgacggucaacuccagggcacuacccccaccuccgccucucaacucugcaaaauccgcggauccgucuuccacgccaacggcggcaauggguacaaccuuacagaacucgauggcucccccuaccacgccuuugaaucacccgcucccauuggguuccccgaccuaggagaaugcgacuggcacauggaagcaucccccacaacccaauucgacaccggcgacgucauuaaacaaaucaacgucaaacaagaauccgccuucgcgccccaccugggaacaguacaggccgacggacuuagcgacguauccgccaacaccaacaugauagccaagcucggaugggucucaccugucuccgacggucaccgaucagacgucgacccuugggucaucccccgauacgguuccacccucaccgaagccgcccaacuggcucccccuaucuauccucccggcuucggagaagccauagucuucuucauguccgacuucccaaucgcccacggaacgaacggccuauccguaccaugcacaaucccacaagaguucgucacccacuucguaaacgaacaagcccccacccgcggcgaagcugcacugcuucacuaccucgauccugacacccaccgaaaccucggagaauuuaagcucuacccagacggguuuaugaccugcguccccaacuccucaggcaccggaccccaaacacuaccaaucaacggugucuucgucuucguauccuggguaucccgauucuaccaacuaaaacccgucggaacagccggccccgcacgccgacuaggaauccgccgcucuuaa

SEQ ID NO: 36981 - RNA, 1611 nt, Artificial Sequence
  derived and/or modified sequence opt11 from capsid_protein__Norovirus__ACX81341
augaaaauggccagcaacgacgcaacaccauccgacgacggcgccgccggacucguaccagagauuaacaacgaagucauggcacucgaaccagucgcuggcgccuccaucgcugcacccgucgucggccagcaaaacaucaucgaccccuggauccgcaauaacuuuguucaagccccagccggagaguucacaguaucaccacgaaacagcccuggcgaacuacuccucgaccuagaacucggccccgaacucaaccccuaccucgcgcaccucgcccgcauguacaacggccacgcaggcggcauggaaguccaaauuguccuugccggcaacgcuuucaccgcaggcaaaauccuauucgcagccaucccucccucuuuccccuacgaaaaccucucacccgcccaacucaccaugugcccccacgucaucgucgacguacgccaacucgaacccguccuccuccccaugcccgacauccgcaacgucuuuuaccacuacaaccaaaacaacagccccaaacuccgucucgucgccaugcuauacacaccccuccgcgccaauaacaguggcgacgacgucuucaccguaucaugccguguccucacaagaccuucaccagacuuccaauucaccuuccucgucccacccaccgucgaaucaaaaaccaaaaacuucacccuuccaguacuccgaguaagcgaaaugacaaacucccgauuccccguaguacucgaccaaauguacacaucccgcaaugaaaacaucaucguccaaccccagaauggccgcugcaccacugacggagaacuccuaggcaccaccaucuugcaaucaguaucgauauguaacuucaagggcaccaugcaagcuaaacucaacgaggaaccucgauaucagcuacaacuaacaaaccucgacggaucccccauagaccccaccgaugacaugccagcaccccuuggcacccccgacuuccaagccaugcucuacggagucgccucccaacgcuccuccaucgacaacgccacacgagcacaugacgcccaaaucgacacugccggcgacacauucgcgccaaaaaucggacaaguccgcuucaaaucuagcucaaacgacuucgaccuccaugaccccaccaaauucacaccaauaggcgucaacgucgacgaccaacacccuuuccgccaauggucccucccuaacuacggcggccaccucgcccuaaacaaccaccucgccccagccgucaccccucucuuuccgggcgaacaaauccucuucuuccgcucuuacauacccuccgccggcggucacaccgacggcgccauggacugccuacucccccaagaauggguagaacacuucuaccaagaagccgcacccucacaaagcgacaucgcacucgucagauucaucaacccagacaccggccguguccuauucgaggcgaaacuccacaaacaagguuuccucacaauugcggcauccggcgaccacccuauugucaugccaaccaacggauacuuccgauucgaagccuggguaaacccauucuacacccuagcacccguaggcacugguuccggccgccgcagaauccaauaa

SEQ ID NO: 36982 - RNA, 1611 nt, Artificial Sequence
  derived and/or modified sequence opt11 from capsid_protein__Norovirus__ACX81343
augaaaauggcaucaaacgacgccaccccauccgacgauggagccgccggucuagucccugaaaucaacaacgaagucauggcacuugaaccagucgccggagccucgaucgcugccccugucgucggucaacagaacaucaucgaccccuggauacguaacaacuucguccaagcucccgccggcgaguucaccguaucacccagaaauucaccaggcgaacuacuccuagaccucgaacuaggacccgaacuaaauccuuaccucgcacaccucgcucgaauguauaacggacacgcaggaggaauggaagugcaaaucguccuugcaggcaacgcauucaccgccggcaaaauccucuucgccgccauaccucccuccuuccccuacgaaaaccuuucccccgcccagcucacaaugugcccccacgucaucgucgacguacgccaacucgaacccguccuccuacccaugcccgacauccgcaacgucuucuaccacuacaaccaaaacaacucccccaaacuccgccuagucgccaugcuauacacuccccuacgcgcuaacaacuccggcgacgacgucuuuaccgucagcugccgcguacuaacccgccccucccccgacuuccaauucaccuuccuaguaccaccaaccgucgaauccaaaaccaaaaauuucacccuccccguccuccgaguauccgaaaugaccaacucccgcuucccagucguccucgaccaaauguacaccucacgcaaugaaaacauaaucguccagccacaaaacggacgcugcacaacugacggcgaacuccucggcaccaccauccugcaaucugucuccaucugcaacuucaaagguaccaugcaagcaaaacucaacgaagaaccacgauaccagcuccaacucaccaaccucgauggcucccccaucgaccccacagaugacaugcccgccccucuaggcacaccagacuuccaagccaugcuuuacggagucgccucccaacgcuccuccaucgacaacgccacccgagcacacgacgcccaaauugauaccgcaggcgacaccuucgcccccaaaaucggccaaguacgauucaaaucaagcuccaacgauuucgaccuccacgacccaaccaaauucacaccaauaggagucaacgucgacgaucaacauccauuccgccaauggucacucccaaacuacggaggccaccucgcccucaacaaccaccuugccccagccguaacgccccucuuccccggcgaacaaauacucuuuuuccgcuccuauauacccuccgccggcggccacaccgacggcgccauggacugucuccuaccccaagaauggguagaacacuucuaccaagaagcugccccaucccaguccgacauagcacucguccgcuucaucaacccagacaccggccgcguccucuucgaagccaagcuacacaaacagggcuuccuaaccauagccgcaagcggagaccaucccaucgucaugcccacaaacggcuauuuccgauucgaggcaugggucaaucccuucuacacacucgcacccgucgguaccgguuccggacgacgacguauccaauaa

SEQ ID NO: 36983 - RNA, 1611 nt, Artificial Sequence
  derived and/or modified sequence opt11 from capsid_protein__Norovirus__ACX81345
augaaaauggcaagcaacgacgccacccccuccgacgacggggcugcaggccuaguacccgaaaucaacucagaagucauggcccucgagcccgucgccggagccucccucgccgcaccagucguuggacaacaaaacaucauagacccauggaucagaaacaacuucguccaagcccccgccggagaauuuaccguaagcccccgaaacucccccggcgaacuccuccucgacuuagaacucggccccgaacucaacccauaccucgcucaccucgcucgaauguacaacggccacgccggcggaauggaaguccaaaucguccucgcaggcaacgccuucaccgcaggaaaaauacucuucgcagccaucccucccagcuuccccuaugaaaaccuaucaccagcucaacuuacaauguccccacacgucaucguagacgucagacagcucaaaccaguccuacucccaaugccagacaucaaaaacgacuucaaccacuauaaccagaaaaacaacacuaaacuccgccuaguugccaugcuauacaccccguuacgcgccaacaacucaggagacgacgucuguacagaauccugucgcguccucacccgaccauccccagacuuccaauucaccuuccucgucccaccuacaguagaauccaaaaccaaaaacuucacccuucccguccuacgagucucagaaaugaccaacuccagauuccccguaguccucgaccaaauguacacgucacgcaacgaaaacauaauaguccaaccccaaaauggacgcugcacaacagacggcgaacuccucggcaccacaauccuccaaucagucucaaucugcaacuucaaaggaaccaugcaagccaaacucaacgaagaaccacgcuaccaacuucagcuaaccaaccucgacggcucacccaucgaccccaccgacgacaugcccgccccacucggcacccccgacuuccaagccaugcucuacggcguagccucucaaagaagcuccauagacaacgccacccgcgcccaugacgcucaaaucgacacagcaggcgacacauucgcacccaaaauugggcaaguacgauucaaaagcucauccaacgacuuugaccuucacgaccccaccaaauucaccccuaucggcguuaacguggacgaccaacaccccuucagacaauggucacuucccaacuacggugggcaccuagcccuaaauaaccaccucgcacccgccgucacaccccucuuccccggcgaacagauccucuucuuccgauccuacauacccucagccggaggccacaccgacggcgcuauggauugccuccucccacaggaaugggucgaacauuucuaccaagaagccgccccaucgcaaucagacaucgcccucguccgguucaucaaccccgacacaggccgcguacuauucgaagccaaacuccacaaacaaggcuuccucaccaucgccgccuccggcgaccaccccaucgucaugccuaccaacggcuauuuccgcuucgaggcuuggguuaacccauucuacacccuagcccccgucggcacuggcagcggccgaagacgaauacaauaa

SEQ ID NO: 36984 - RNA, 1611 nt, Artificial Sequence
  derived and/or modified sequence opt11 from capsid_protein__Norovirus__ACX81347
augaaaauggcuuccaacgacgcgacccccuccgaugacggggccgcuggccucguccccgaaaucaacaacgaagucauggcccucgaacccgucgccggugccuccauugcagccccggucgucggccaacaaaacaucauagacccauggauaagaaacaacuucguccaagcuccagcuggagaguucaccgucucuccccguaacuccccgggagaacuccugcucgaccucgaacucggaccugaacucaaccccuaccucgcacaccucgcgcgcauguacaacggucacgccggagguauggaaguacaaaucguucuagccggcaacgccuucaccgccggcaaaauccucuuugccgccauacccccauccuucccauacgaaaaccuauccccugcccagcugacaaugugcccccaugucaucguagacgugcgccaacucgaacccgugcuacuccccaugccagacauucgcaacgucuucuaccacuacaaccaaaacaacucccccaaacuccgacucguagccaugcuauacacccccuuaagagcaaacaacuccggugacgaugucuucaccgucuccugccgcguacuaacacgcccauccccagacuuccaauucaccuuccuagucccucccaccguagaauccaaaaccaaaaauuucacacuccccguccuacgcguaucugaaaugacaaacucacgcuuccccguaguacucgaccaaauguacaccucccgcaacgaaaacaucauaguccaaccccaaaacggacgaugcaccacagacggcgaacuccucggcacaacaauccuccaaucggucucaauaugcaacuuuaaaggcaccaugcaagccaaacuuaacgaagaaccccgauaccaacuccaacugaccaaccucgacggcucccccaucgaccccaccgaugacaugccugcaccccucggcaccccagacuuccaagcaaugcuauacggcguagcuucccaacgcagcucgaucgacaaugccacacgcgcccacgacgcacaaaucgacaccgccggugacacuuucgcccccaagaucggccaaguccgcuucaaauccuccuccaacgacuuugaccuacacgacccaaccaaauucacccccaucggcguaaacgucgacgaccaacaccccuucagacaauggucacuccccaacuacggaggacaccucgcccuaaacaaccaccucgcccccgccgucacccccuuauuccccggcgaacaaauccuguucuuucgcagcuacauccccucagcaggcggacacaccgacggcgcaauggauugccuacucccacaggaaugggucgaacauuucuaccaagaggccgccccaucccaauccgacaucgcccuugugcgauucauaaaccccgacaccggcaggguccuauucgaagccaaacuccacaaacagggcuuccucacuaucgcagcaagcggcgaccacccaaucgucaugccaaccaacggcuacuuccgauucgaagcaugggucaaccccuucuacacccuagccccugucggcaccggcagcggccgacgccgcauccaauga

SEQ ID NO: 36985 - RNA, 1611 nt, Artificial Sequence
  derived and/or modified sequence opt11 from capsid_protein__Norovirus__ACX81349
augaaaauggcaagcaaugacgccaccccauccgacgauggagccgcgggccucguccccgaaaucaacaacgaaguuauggcccuagaaccaguugccggcgccuccaucgccgccccggucguaggccaacaaaacaucauagacccauggauccgcaacaacuucguccaggcccccgcaggcgaguucaccguaucaccccgcaacucaccaggcgaacuccuucuagaccucgaacucggacccgaacuuaacccauaccuagcccaccuugcgcgcauguacaacggacacgcaggcggcauggaaguccaaaucguccuggcgggcaacgccuucaccgccggcaaaauucucuucgccgccauacccccaucauuccccuacgaaaaccuuuccccugcccaacuaaccaugugcccccacgucauaguagacguccgccaacucgaacccguacuucuccccaugccggacauccguaaugucuucuaccacuacaaccaaaacaacagcccaaaacuccgccuaguugccaugcucuacacaccccuccgcgccaacaacucaggcgacgacgucuuuaccgucaguugccgcguacucacccgucccuccccagacuuccaauucaccuuccucgucccacccacugucgaauccaaaaccaaaaacuucacacuccccgucuuaagagucuccgaaaugaccaacucccgauuccccgucguacucgaccaaauguauacaucccguaacgaaaacaucauaguccaaccccaaaacggccgcugcacaaccgacggggaacuccuaggcacaacaauccugcaauccguauccaucugcaacuucaaaggaaccaugcaagccaaacucaacgaggaaccacgauaccaacuccagcuaaccaacuuagacggcucucccaucgacccgacagaugacaugcccgcgccccuaggcacucccgauuuccaagcaaugcuauacggcgucgccucccaacgcuccucaauugauaacgccacccgcgcccaugacgcucaaaucgauacagccggcgacacauucgcucccaaaaucggccaaguccgcuucaaauccuccuccaacgacuucgaccuucacgaccccacaaaguuuacccccauaggagucaacguagacgaccaacaccccuuccgccaauggucucucccaaacuacggaggacaccuagcccuaaacaaucaccuagccccugccgucacgccccucuuccccggugaacaaauccucuucuuccgcucauacauacccuccgccggcggccauaccgacggcgccauggacugccuacucccacaagaaugggucgaacacuucuaccaagaagccgcccccucccaaucagacauagcccucguucguuucaucaacccagacaccggacgcguacuauucgaagccaagcuccacaaacaaggcuuccucaccaucgcagccucuggugaccacccaaucgucaugcccacaaacggauacuuccgcuuugaagcaugggucaacccauucuacacacucgcacccguaggcacuggcuccggacgccgacgaauacaauaa

SEQ ID NO: 36986 - RNA, 1611 nt, Artificial Sequence
  derived and/or modified sequence opt11 from capsid_protein__Norovirus__ACX81351
augaaaauggccagcaacgacgccaccccaagcgacgacggcgcagcaggccucguacccgagauaaacaacgaagucauggcgcuagaaccaguggcaggagcauccauugcagcccccgucgugggccaacaaaacaucauagaccccuggauccgcaacaacuucguccaggccccugccggugaguucaccgugucaccccguaacucccccggcgaacuccuacuagaucucgaacuaggccccgaacucaaccccuaccucgcacaucuagcacgcauguacaauggccacgcaggaggcauggaaguccaaauuguacucgccggcaacgccuucaccgcaggcaaaauccuauucgccgccauuccacccucauuucccuacgaaaaccucucgcccgcgcaacucaccaugugcccccacguaaucgucgacgucagacaacucgaacccguccugcuacccaugccugacauucgcaacgucuuuuaccacuacaaccaaaacaacucccccaaacuacgucuagucgccaugcucuacacaccccuccgagcaaacaacagcggcgacgacgucuucacagucucaugucgaguccucacccgccccuccccggacuuccaauucaccuuccucgucccacccaccgucgaauccaaaaccaaaaacuucacacuccccguccuacgcgucucugaaaugaccaacucccgauuccccgucguccuagaccaaauguauacaucacgcaacgaaaacauaaucguucaaccccaaaacggccgcuguacuaccgacggcgaacuccuaggaaccacaauauuacaauccgucuccaucugcaacuucaaaggcaccaugcaagcaaagcucaacgaagaaccccgauaccaacuacaacuaacaaaccuagacggcucccccaucgaccccacagaugacaugcccgcaccccucggcaccccugacuuccaggccaugcuauacggcguugccucacaacgauccucaaucgacaacgcaacccgcgcccacgacgcccagauagacaccgcaggcgacaccuucgcacccaaaaucggacaaguacgauuuaaauccuccuccaacgacuucgaccuccacgacccaaccaaauucacccccaucggcgucaacgucgacgaccagcaccccuuccgacaauggucacuacccaacuacggaggacaccucgcccucaacaaccaccuugcccccgccgucacaccccucuucccaggcgaacagauucucuucuuccgcuccuacaucccaucugccggcggccacaccgacggagccauggacugccuacucccacaagaaugggucgaacacuucuaccaggaagcagccccaucccaaucagacauagcacucguccgcuucaucaaccccgacacaggccgcguacucuucgaagccaaacuccacaaacaaggcuuccucacaauagccgccucgggcgaccaccccaucgucaugcccacaaacggcuacuuccgcuucgaggccuggguaaaccccuucuacacacucgcucccgucggcaccggcagcggccgccgccgcauacaauaa

SEQ ID NO: 36987 - RNA, 1611 nt, Artificial Sequence
  derived and/or modified sequence opt11 from capsid_protein__Norovirus__ACX81353
augaaaauggccuccaacgacgccacucccagcgacgacggugccgcuggucugguccccgaaauaaacaacgaagucauggcucuugaacccguagccggugccucaaucgccgccccagucguaggccagcaaaacauaaucgaccccuggauccgcaacaacuucguacaggcccccgccggcgaauuuaccgucucaccccgcaacagcccaggagagcuccuccuagaucucgaacugggccccgaacucaacccauaccuagcccaccucgcccguauguacaacggccacgccggcggaauggaaguucagaucguacuagcaggaaacgccuucaccgccggaaaaauccuauucgccgccauaccgcccuccuuccccuacgaaaaccuaagcccagcccagcucaccaugugcccacacgucaucgucgacguaagacaacucgaaccaguccuccucccaaugcccgacauccgaaacguauucuaccacuacaaccaaaauaacucccccaaacuccgccuugucgcaaugcucuacacgccacuucgcgcaaacaacuccggugacgacguauuuaccguauccugccgcguacucacccgccccucaccagacuuccaauucacauuccucguucccccuaccgucgagucaaaaaccaaaaacuucaccuuaccaguccuccguguauccgaaaugacaaacucccguuucccaguaguccuugaccaaauguauaccucccgcaacgaaaacauaauaguccaaccacaaaacggccgcugcaccaccgacggcgaacuccuagguaccaccauccuccaauccgucuccauuugcaacuucaaaggcaccaugcaagcaaaacuaaacgaagaaccccgauaccagcuccaacuuaccaaccucgacgggucccccaucgacccaacugacgacaugcccgcuccccucggcacccccgacuuccaagccaugcucuacggaguagccucacaacgauccucccgagacaacgccacacgagcccaugacgcccaaauagauaccgcaggcgacaccuucgcccccaaaaucggacaaguacgcuucaaauccuccucuaacgacuucgaccuacacgaccccaccaaauuuaccccaauugguguaaacgucgacgaccaacaccccuuccgccaauggucucuccccaacuacgguggccaccucgcacuaaacaaccaccucgccccagccgucacaccccuauuccccggcgaacaaauacucuucuuccgcuccuacauccccuccgccggcggccacaccgacggcgccauggacugccuacucccccaagaaugggucgaacacuucuaccaagaagccgccccaucccaauccgacaucgcacuuguucgcuucauuaacccagauacuggccgaguacucuucgaagccaaacuccacaaacaaggcuuccuuaccaucgccgcuuccggcgaccacccaauugucaugcccacaaacggcuacuuucgcuucgaagcaugggucaacccauucuacacccucgccccagucggaaccggaucaggccgcaggcgcauccaauaa

SEQ ID NO: 36988 - RNA, 1611 nt, Artificial Sequence
  derived and/or modified sequence opt11 from capsid_protein__Norovirus__ACX81355
augaaaauggccucaaacgaugccacacccuccgacgacggcgccgccggccucgucccugaaauuaacaacgaagucauggcacuugaacccgucgcaggcgcaagcauugccgcaccuguagucggacaacagaacauaaucgaccccuggaucagaaacaacuucguccaagccccugcaggagaguuuaccgucuccccacgaaacuccccuggugaacuccuccucgaccucgaacucggccccgaacucaaccccuaccucgcacaccucgcucgcauguacaacggccaugccggcggcauggaaguucaaaucguccucgccggcaacgcguucacagccggcaaaauccuuuucgccgcaaucccacccuccuuccccuaugaaaaccucucacccgcccaacuaaccaugugcccucauguaaucguagacguccgccaacucgaacccguucuccuccccaugccugacauccgcaaugucuucuaccacuacaaccaaaacaacucccccaaacuccgacucgucgccaugcucuacacuccacuacgagccaacaacuccggagacgaugucuuuaccguuucuugccgcgucuuaacccgccccucccccgacuuccaauucaccuuccuaguacccccgaccgucgaauccaaaaccaagaacuuuacacuccccguccuccgcguuucagaaaugacuaacucacgcuuucccgucguccucgaccaaauguauaccucccgcaacgaaaacaucaucguccaaccccaaaacggccgaugcacuacggacggcgaacuccuagguaccaccauauuacaaucagucuccauaugcaacuucaaaggcaccaugcaagcaaaacucaacgaggaaccccgauaucaacuccaacucacuaaccuagacggcucccccaucgacccaacagaugacaugccagcaccccucggaacacccgacuuccaagccaugcuauacggcgucgcaucccaacggucaagcaucgacaacgccacacgugcccacgacgcucaaauagacaccgcaggagacaccuucgcccccaaaaucggccaaguacgcuucaaauccuccuccaacgacuucgaucuacacgaccccaccaaauucacccccaucggcgucaacgucgacgaccaacaccccuuccgccaauggucacugcccaacuacggcggacaccuagcacucaacaaccaccucgcccccgccgucacaccccucuuccccggugaacaaauccucuucuuccguuccuacauacccagcgccgguggccacacugacggcgcaauggacugccuacucccccaagaauggguagaacacuucuaccaagaagccgccccaagccaauccgacauagcccuaguccgcuucaucaaucccgacacaggucgaguucucuucgaagcgaaacuacauaaacaaggcuuccucaccauagccgccucuggcgaccacccaauuguaaugcccaccaaugguuauuuccguuucgaagccuggguuaacccauucuacacccucgcaccugucggcaccggcuccggaagacgccgaauacaauaa

SEQ ID NO: 36989 - RNA, 1623 nt, Artificial Sequence
  derived and/or modified sequence opt11 from capsid_protein__Norovirus__ACX85806
augaaaauggcuuccucugacgccaaccccuccgacggauccacagcaaaccucguccccgaaguaaacaaugaagucauggcccucgaacccgucguaggcgcagcaaucgccgcccccguagcaggccaacaaaacgucaucgaccccuggauccgcaacaacuucguacaagcaccgggaggcgaguucaccgucuccccacgaaacgcccccggcgaaauacucuggucugcaccccucggacccgaccucaaccccuaccucucacaccucgcccgcauguacaauucuuacgccggcggauucgaagugcaaguaauacucgccggcaacgcauucaccgccggcaaaauaaucuucgccgcagugccacccaacuuccccacagaaggacucuccccuucccaagucaccauguucccccacauagucgucgacgucagacaacucgaacccguucucaucccacuccccgauguccgcaacaacuucuaccacuacaaccaaucuaaugaucccaccaucaaacucaucgccaugcucuacacuccccuacgcgcuaacaacgccggagacgacguauucaccgucuccugccgaguccucacucgcccauccccggacuucgacuuuaucuuccuaguucccccuaccgucgaaucacgcacaaaacccuucuccguccccauacucacagucgaggaaaugaccaacucccgauucccaaucccacuagaaaaacucuucaccggcccuuccucagcuuucgucguccaaccccaaaauggccgcugcaccaccgacggaguacuccucggcacaacccaacuauccccagucaacaucugcacauuccgcggcaauguaacccacaucgcaggaacccaagaauacaccaugaaccuagccucacaaaacuggaacaacuacgacccaacagaagaaauccccgcaccccuagguacccccgacuucguagguaaaauccaaggcguacucacccaaacaacacgccgcgacggauccacccgaggccacaaagccacaguauccaccggauccguccacuucacccccaaacuaggccgcauacaauucuccaccgauacaucaaacgacuucgaaacaggacaaaacacccguuucacaccagucggcguuguccaagacggauccacaacucaccagaacgaaccucaacaauggguccuccccaacuacucaggccgagacucacacaacguacaccucgcccccgcagucgcgccuuccuuccccggcgaacaacuauuauucuuucgcucuacaaugcccggcugcucgggauaccccaacaugaaucuagacugccuccuaccccaagaauggguucaacacuucuaccaagaagccgcccccgcacaauccgacgucgcccuccuacguuucguuaaccccgacaccggccgaguacucuucgaaugcaaacuccauaaauccggguacguaaccguugcccacaccgggcagcacgaccuagucaucccacccaacggcuacuuucgauucgacuccuggguaaaccaauucuacacccucgcccccaugggcaauggcaccggccgccgccgcgcacucuaa

SEQ ID NO: 36990 - RNA, 1647 nt, Artificial Sequence
  derived and/or modified sequence opt11 from capsid_protein__Norovirus__ACX85807
augaaaauggccuccaacgacgcagcaccguccaacgacggugccgccggcuuaguaccagaaaucaacuccgaagccauggcacucgaaccuguagcaggcgccgcuaucgccgccccucuaaccggacaacaaaacaucaucgaccccuggaucaugaauaacuuuguccaagccccagguggagaguucaccgugagcccccgcaacagccccggcgaaguccuccugaaucuggaacucggacccgaaaucaaccccuaccucgcccaccuugcccgaauguacaacggauacgccgggggcuucgaaguacaaguaguacucgcuggaaacgcccugacagccggaaaaaucaucuucgccgccaucccacccaacuuccccaucgacaaccucuccgcugcccaaaucaccaugugcccccacgucauagucgacguccgacaacuggaacccgugaaccuccccaugcccgacguacgcaacaacuucuuccacuacaaccaaggcucagacagccgccucagacucaucgccaugcuuuacacuccccuccgcgccaacaacucaggcgacgacgucuucaccguuuccugccgaguccucacucgccccucccccgacuucuccuucaacuuccuuguacccccaacagucgaauccaaaaccaaaccauucucacuacccauccuaaccaucuccgaaauguccaacucccgcuuccccgucccuauugacagccuccacaccucgcccaccgaaaacauagucguacaaugccaaaacggccgcgucacccucgacggcgaacucaugggcacuacccaacuacuaccaucacaaauaugcgccuuccgaggcguacucacccgaucaaccucccgcgccagugaccaagccgacaccgccacgccccgccuauucaacuacuacuggcacauacaacucgacaaccuaaacggaacaccauacgaccccgccgaagacauacccggcccccucggcacccccgauuuccgaggcaaaguauucggagucgccucccaacguaaccccgaugccacgacucgcgcacacgaagccaaaaucgacacuaccuccggccgcuucaccccaaaacuaggaucacuagaaaucuccaccgaaucagacgauuucgaccaaaacaaacccacacgcuucacaccagucggcaucgguguugaccacgaagaagacuuccagcaauggacccuccccgacuacgccggccaauucacccacaacaugaaucucgcacccgccgucgccccaaauuuccccggagaacaacuccucuucuuccgcucacaacucccaucauccgguggucgaagcaauggcauccuugacugucuagucccccaagaguggguacaacacuucuaccaagaaucagccccaucccaaacacaagucgcacucguaagauacaucaacccagacacuggccguguccucuucgaagcaaaacuacacaaacuaggauucaugaccaucgccaaaaacggugacucuccaauaacagucccucccaacggcuacuuucgcuucgaaucaugggucaaccccuucuacacccucgccccuaugggcaccggaaacggccgccggcgcauccaguaa

SEQ ID NO: 36991 - RNA, 1623 nt, Artificial Sequence
  derived and/or modified sequence opt11 from capsid_protein__Norovirus__ACX85809
augaaaauggccucgaacgacgcagcccccuccaacgacggcgccgccggccuuguccccgaaaucaacaacgaagucaugccccucgaacccgucgccggcgcuucccuggccacccccguaguaggccaacaaaacaucauugaccccuggauacgaaauaacuucguccaagccccagccggagaguucacugucagcccacgcaacuccccgggcgaaauccuccuggaccuagaacucggucccgaacucaaccccuaccuugcacaccuugcccggauguacaacggacacgccggcgguauggaaguacaaauaguacucgcaggcaacgccuucacagcagggaaaaucauauucgcagccaucccucccggcuuccccuacgaaaaccucagccccagccaaaucacaaugugcccacaugucaucaucgacguacgccaacucgaacccguacuccuaccuaugcccgacauccgcaacaacuucuuccacuacaaccaaggcaacgaucccaaacuccgccucauagcuaugcucuacaccccacuucgcgccaacaacuccggcgacgacgucuucaccguaucauggcgcggccugacuaaaaccagccccgacuuugaguucaccuuccuuguaccacccaccgucgaauccaagaccaaacaauucacccugcccauccucaaaaucagcgaaaugaccaacucccgcuuccccguacccguagaaaugauguacaccgccagaaacgaaaaccaaguaguccaaccccaaaacggccgcguaacccucgacggcgaacuccucggcacuacaccccuacucgcagucaacaucugcaaauucaaaggagaagucaucgccaaaaacggcgacguccguuccuaucguauggacauggaaaucaccaacaccgacggcacccccaucgaccccaccgaagacacgcccggaccgauaggcuccccagacuuucaaggaauacuauucggcgucgcaucccaacgaaacaagaacgaacaaaaccccgccacccgagcacacgaagccaacauaaacaccgguggcgaccaauacgcccccaaacucgcccaaguaaaauuuuucuccgaaucccaagacuucgaaguccaccaacccacuguauucacccccguaggcgucgccggugacacuucccaccccuuccgucaauggguacuaccccgcuacggcggccaccucaccaacaacacccaccuagccccugccgucgcaccacucuuccccggcgaacagauccucuucuuccgcucacaaaucccuucauccggcggccacgaacucggcuacauggacugccucguaccucaagaauggguacaacacuucuaccaagaggccgccaccgcccaauccgaagucgcacuaaucagauuuaucaaccccgacacaggccguguccucuucgaagccaaacuccacaaacaaggcuucaucacgguagcccauaccggagacaacccaaucgucaugcccccuaacggcuacuucagauucgaagcaugggucaaucaauucuacagccucgcccccgucggcaccggaaacggccgccgccgcauccaauaa

SEQ ID NO: 36992 - RNA, 1623 nt, Artificial Sequence
  derived and/or modified sequence opt11 from capsid_protein__Norovirus__ACX85810
augaaaauggccuccaacgacgccgccccaagcaacgauggcgccgccggccucguucccgaaaucaacaacgaaguaaugccccuagaacccgucgccggcgccucacucgcaacccccguaguaggccaacaaaacaucauagaccccuggauccgaaacaacuucguccaggccccagcuggcgaauuuaccgucucuccccgcaacucccccggcgaaauccuccuagacuuagaacuaggcccagaacuaaauccauaccuagcccaccucgcccggauguacaacggccacgccggcggcauggaaguccaaauaguacuagccggcaacgccuucacagcuggaaaaauuaucuucgccgccauucccccaggcuucccauacgaaaaccuaucaccgucacaaaucaccauguguccccacgucaucaucgacguacgccaacuagaaccaguacucuuacccaugccagacaucaggaacaacuucuuccacuacaaccaaggcaacgacccaaaacuccgccuaauagccauguuauacaccccacuccgagccaacaacagcggcgacgacguuuucacagucagcugccggguccucacaaaacccucaccagacuucgaguucacuuuccucguacccccaaccgucgaaucaaaaaccaaacaauucacacugcccauucuaaaaauaucagaaaugacaaacucucgcuucccagucccugucgaaaugauguacacugccagaaacgaaaaccaagucguccaaccccaaaacggaagagucacucucgacggagaauuacucggcacuaccccacuccuagcagucaacaucugcaaauucaagggagaaguaauugccaaaaacggcgacguacgauccuaccgcauggacauggaaauuaccaacacugacggcacccccauagaccccaccgaagacaccccuggcccaauaggaucucccgacuuccaaggcauccuuuucggcgucgcaucccagcgaaacaaaaacgaacaaaacccagccacccgcgcccaugaagcaaacauaaacaccggcggagaccaauacgcacccaaacuagcucaagucaaauucuucucagaaucccaagacuuugaaguccaccaacccacaguauucacccccgucggugucgcaggcgacaccagccaccccuuccgccaauggguccuaccgcgcuacggcggccaccuuaccaacaacacccaccucgcaccggccgucgccccacucuuccccggcgaacaaauccucuucuuccgcucccaaauacccucauccggcggccacgaacucggcuacauggacugccucguaccacaggaauggguccagcacuuuuaccaagaagccgcagccgcacaaagcgaaguagcacucauccgcuucaucaacccagacaccggacgcguacucuucgaagccaaacuacacaaacaaggauucaucaccguagcccacacaggcgacaaccccaucgucaugccacccaacggguacuuccguuuugaagccugggucaaccaauucuauucacuggcacccguaggcaccgggaacggccgacgccgcauccaauaa

SEQ ID NO: 36993 - RNA, 1569 nt, Artificial Sequence
  derived and/or modified sequence opt11 from capsid_protein__Norovirus__ACY41155
augaaaaugacugaccgcgacacaaccgaccccgcaccagcccucggacaagucuuacccccagaaguugaagccucaguaccaguugaacccaccgccggcgcccccgucgcagccgccaccgccggccaaguaaacccuauagaccccuggaucuucgcaaacuucguccaagcaccccaaggcgaguucaccaucuccccaaacaacaaccccggcgaaauccuauucgaacuggaauuaggccccgaacucaaccccuaccucgcccaccuccgcagaauguacaacggcuggaccggcucaaugcgaguccgaguucuccuagccggcaacgccuucucagccggaaaagucguaguuuucugcguacccccaggauuugacgcuuccuaccuaaccccuucccaagccacccaauucccccacguccuaaucgacguccgcgcacccgaaccagucgaaaugccacuagaagacguccgcaacauccucuuccaccaaggcccugacucccgcaugcgccucaugggcaugcuauacaccccacuccgagcaaauuccggcgcugaccccuucgucgucacuggacgcguccuaaccugccccucccccaacuucucuuucuucuuccucguuccacccaccgucgaagaacgcgaaguccccuuuacccuaccaaaccuccccguaaacaaccuaucccacucgcgcgucauggaaccgauagcacaaaugauguccucucgcaaccuccccgcuucaguacaauuccaaaacggacgaugcacccucgccggagaccuacucgguaccacacccucauccccagccgaccucggcaccuucgucggucucaucgccgagccuggcucacgcgucguagaacucuuccaacccaaccaggaagacuuccacgccggcucugccccagcaccccucgguuuccccgacuucucagacuguucccucacauucgucgucgccuccagcaccacuguaggcgaacgcaccgucaacucaagauccccucaaaacuucacacccgcccucggccacgucacccucgacgaagaagccccagccgacuuauuccgagcccgccuccgcaaccucugggacccuaccgaacacucauucuggcgcaucccagacuaccgugccgauguccuaggauccgaguucgcccccuccguauccgcccccggcgucggcgaaacccuccuauucuucaugugcaacgucccucgacucaacggagcuaacccuaacccaugcccaugccuucucccucaagaauggaucacccacuucguuuccgaacgcgccgcucuccaaggugacguagcccuccucaacuacgucaacccaaacaccggccgcguccucuucgaaugcaaacucuacgcaaacggcuuccucaccgucaaccucggcgccuccgaccaggccacucuuccaguugacggcaucuuuaaauucgucucauggguaucauucuacuaccaacucagacccgucgguaacgcauccgucggccgacgccucccccgacucaacggguucuaa

SEQ ID NO: 36994 - RNA, 1623 nt, Artificial Sequence
  derived and/or modified sequence opt11 from capsid_protein__Norovirus__ADA77528
augaaaauggcaucaaacgacgccucgcccagcgauggcucuacagccaaccuaguccccgaaguaaacaacgaagucauggcacucgaacccgucgucggagccgccaucgcggccccaguagccggacaacaaaacgucauagacccauggaucagaaacaacuucguacaagcccccggaggcgaauuuaccguuucaccccgcaacgcccccggagaaauccuuuggucagccccucucggucccgaccucaacccguaccuaucacaccucgcccgcauguacaacggcuacgcuggcggauucgaaguccaaguaauccuagcaggcaacgccuucacugcaggcaaaaucaucuucgccgcagucccgcccaacuucccaacggaaggccucucacccucacaaguaaccauguucccccacaucauagucgacguacgccaacucgaacccguccuaauaccccuccccgacguccgaaacaacuucuaccacuacaaccaauccaacgacucaaccaucaaacucauagcaaugcucuacacaccccuccgcgcuaacaacgcaggagacgacguuuucacagucucaugccgcguacuaacccgaccuucccccgacuucgacuucaucuuccucgucccacccaccgucgaaucucgaacuaaacccuucaccguccccauccucaccgucgaagaaaugaccaacuccagauuucccaucccccuugaaaaacucuucacaggcccauccuccgccuucguuguccagccccaaaacggucgaugcaccaccgacggaguacuccucggcacuacccaacugagccccgucaacaucugcaccuuccgcggagacgucacccauauacccgguacacguaccuaccgcaugaaccuggcuucacaaaauuggaacaacuacgaccccacagaagagaucccugcaccacucggcaccccagacuucguuggcaaaauccaaggcaugcucacgcaaaccaccaaaggcgacggaucuacgcgcggucacaaagccacaguaagcacagguagcguagacuucacucccaaacuaggcucaguccaauucgcuaccgauaccgacaacgacuucgaaaccggccaaaacacccgauucacacccguaggcgucauccaagacggcuccuccacccacagaaacgaaccacaacaauggguccuacccgacuacucaggccgcacugcacacaauguccaccucgcccccgcggucgcccccacauuccccggcgaacaacuccucuucuucagauccaccaugcccgguugcucagguuaccccaauauggaccucgauugccuacucccccaagaauggguccagcacuucuaucaagaagcugcuccaucacaaucagacgucgcccuacuccgcuucgucaacccagacaccggccgcguccuauucgaaugcaaacuccacaaagccggcuacguaaccgucgcccacaccggccaacacgaccuagucauacccccuaacggcuacuuccgauucgacucaugggucaaucaauucuacacccucgccccaaugggaaacggugccggccgccgccgagcccuuuga

SEQ ID NO: 36995 - RNA, 1620 nt, Artificial Sequence
  derived and/or modified sequence opt11 from capsid_protein__Norovirus__ADB22512
augaaaauggccucaaacgacgcagcucccaguaacgacggcgccacgggccuaguccccgaagucaacaccgaaacucucccccuagaacccgucgccggagcugccaucgccgcccccgucacuggucaaaacaauauaaucgacccauggauccgaucuaacuucguccaagcacccaacggcgaguucacagucuccccacgaaacucacccggcgaaauucucaugaaccucgaacuaggaccagaccuaaaccccuaccuagcccaccucucacgcauguacaacggcuacgccggcggcgucgaaguccaaguccuacucgcaggcaacgcauucaccgccggaaaaauccucuucgccgccguaccacccaauuuuccagucgacaugcuuucaccagcacaaaucaccaugcucccacaccuaauagucgacguucguacccuagaaccaauaaugaucccauuaccugauguacgaaacgucuucuaccacuucaauaaccaacccgcaccccgcaugcgcuuagucgccaugcuauauacaccgcuccguuccaauggaucaggcgacgacgucuuuacagucucaugccgcguccucacccgcccuaccccagacuucgaguucacauaccuaguucccccuuccgucgaaucaaaaacaaaacccuucacacuccccauccucacaauaggcgaauuaaccaacucccgcuuccccgcacccaucgaucaacucuacacaucacccaacgcagacgucgucguccagccccagaacggacgcugcacccucgacggcgaacuucaaggaaccacccaacuccucaccaccgcuauauguucauaccgcggaaugacauccaacccuaccuccgacuauugggacggccaccuacuccaccucguacacccaaacggcgccaccuacgacccaaccgaagacguccccgccccuuucggaacccaagacuuccguggcauccuauacggcaugcucacccaaaacccccgaaccaguggagacgaagccgcaaacucacacggagucuacaucucuucaacuucagaaaaauucacccccaaacuuggaaccaucggacuccaucaaguccaaggcgaccacucccaacaacaacaaucaaaauucacaccagucggcaucgccgucaacggcaacacccccuuccgccaaugggaacuaccuaacuacuccggcgcucucacccucaacaccaaccucgccccagccgucggacccaacuuccccggcgaacaaauccucuucuuccgcucaaacguaccaucaguccagggcggccaaccaauagaaaucgacugccucaucccccaagaaugggucucccacuuuuaccaagaauccgcccccucccaaucagacguagcccucguacgcuacgucaaucccgacacaggucgcaccauauucgaagccaaacuccaccgccaaggcuucauuacuauagccgcaaccggcucaaacccggucgucguuccaccaaacggcuacuuccgcuucgacuccugggucaaccaauucuacgcccucgccccaaugggcaccggaaauggccgccgccguauccaauaa

SEQ ID NO: 36996 - RNA, 1623 nt, Artificial Sequence
  derived and/or modified sequence opt11 from capsid_protein__Norovirus__ADC91993
augaaaauggccuccaacgacgccaaccccuccgauggcucagccgccaaccuuguccccgaaguaaacaacgaaguaauggcccucgagcccgucgucggcgccgccaucgcagccccaguagccggccaacaaaacguaaucgacccauggauccgcaacaauuucguccaagcccccggcggugaguucaccgucucaccccgcaacgcaccaggagaaauacuuugguccgccccacuaggccccgaccucaaccccuaccucucccaccuagcacgaauguacaacggcuacgccggaggauucgaaguacaagucauacucgcaggaaacgccuuuaccgcaggcaagauaaucuucgccgccguaccacccaacuuccccacagaaggacuuucacccucccaagucacaauguuuccucacauaaucguagacguacgacaacuagaaccaguccuaaucccacucccagacgucagaaacaacuucuaucacuacaaucaaagcucugacucaaccaucaaacugaucgccaugcucuacacaccccuucgcgccaacaaugccggugaagauguauucacugucuccugucgcguccuuacucgcccaaguccagacuucgacuucaucuuccuggucccaccuaccgucgaaucacgcaccaaaccguucaccgucccaauccuaacgguagaagaaaugaccaacucccgcuuccccauaccacuagaaaaauuauucacaggcccaucuagcgcauucgucguucaaccccaaaacggccgcugcaccaccgacggaguccuccucggaaccacgcaacuaucacccgucaacauaugcacauuccgcggcgacguuacccacauagccggcucacgcaacuacaccaugaaccucgcaucacucaacuggaacaacuacgaccccaccgaagaaaucccagcaccccucggcacccccgacuucguaggaaaaauccaaggaguccuaacccaaacaaccaaaggcgacggcuccacccgaggacacaaagccacugucuacacaggauccgcccccuucacccccaaacucggauccguccaguucuccaccgauaccgaaaacgacuucgaaacacaccaaaacacaaaauucacuccuguuggagucauccaagacggcggcaccacccaccgcaacgaaccccagcaauggguccuccccuccuauucaggucgcaauguccaaaacguccaccuggcacccgcagucgcccccaccuucccaggugaacaacuccuauucuuccgauccaccaugccagguugcucaggcuaccccaacauggaccucgacugccuacucccccaagaguggguacaacacuucuaccaagaggcugcccccgcccaaucugacguagcccuccuccgauucgucaaucccgacacaggccgcguccuuuucgaaugcaaacuacacaaauccggcuacgucaccgucgcacacacuggucaacaugaucuugugaucccacccaacggcuauuuccgcuucgacuccuggguaaaucaauucuacacccuugcacccaugggcaacggcaccggccgcagacgcgcccuauaa

SEQ ID NO: 36997 - RNA, 1623 nt, Artificial Sequence
  derived and/or modified sequence opt11 from capsid_protein__Norovirus__ADC91994
augaaaauggccuccaacgacgccacccccagcgacggcuccaccgccaaccucgucccggaagucaacaacgaagucauggcccucgaaccaguagucggagcagccauagcagcaccaguagccgggcaacaaaacguaauagaccccuggauccgcaacaacuucguccaagccccaggcggugaguucaccgucucuccgcgcaacgcccccggugaaauccucugguccgccccacucggucccgaccucaaccccuaccuaucccaccucgcucgaauguauaacggcuacgccggcggcuucgaaguccaaguaauccuagccggcaacgccuucaccgcaggcaaaauaauuuucgccgccguucccccaaacuucccgaccgaaggacucuccccaucccaagucacaauguucccacauauaauagucgauguccgccaacuugaacccguccuaauaccacuacccgacgucagaaacaacuucuaccacuacaaccaauccaacgaccccacaaucaaacuuaucgccaugcucuacacaccccuaagagccaacaacgccggugacgacgucuucacagucuccugccgaguccucacacgcccuuccccggacuucgacuucaucuuccuaguucccccaaccgucgaaucccgaacuaaacccuucuccgucccaauacuaaccgucgaagaaaugacaaauucccgcuuccccaucccacucgaaaaacucuucaccggccccucuucagcauucgucguccaaccccagaacggucgcugcaccacugacggaguccuucucggcaccacgcaacucuccccagucaauaucugcaccuuccgaggagacguaacccacaucaccggcucucguaacuacacaaugaaccucgcaacccaaaacuggaacucuuacgaccccacagaagaaauacccgccccacucggaacucccgacuucgucggcaaaauccagggcguccuuacucaaacaacacgcgccgacggcucaacccggggccacaaagcaaccgucuacaccggcucagcagacuucucacccaaacuaggccggguccaauucgccaccgauaccgacaaugacuucgacgcuaaccaaaacacaaaauucaccccagucggcguaauccaagacggcgauacagcccaccgcaacgaaccacaacaauggguccucccauccuacucaggcaggaacucccacaacguccaccucgccccagccgucgcccccaccuuccccggcgaacagcuccuauucuuucgcucaaccaugccuggcugcuccggcuaucccaacauggaccuugauugccuccucccccaagaauggguccaauacuucuaccaagaagcugccccagcacaauccgauguagcacugcuccgauucgucaaucccgacacaggccgcguccuuuucgaaugcaaacuccacaaauccggauacguaaccgucgcacacaccggacaacacgaccuggucaucccacccaacggcuacuuccgcuucgacuccuggguaaaucaauucuacacacucgcccccauggguaaugguacaggucgacgccgagcacuauaa

SEQ ID NO: 36998 - RNA, 1611 nt, Artificial Sequence
  derived and/or modified sequence opt11 from capsid_protein__Norovirus__ADE28701
augaaaauggcauccaacgacgccacccccuccgacgacggcgccgccggccuuguccccgaaaucaacaacgaagucauggcccucgaacccgucgccggagccuccaucgccgcccccgucgucggccaacaaaacaucauugaccccuggauacgaaacaacuucguccaagcacccgcaggcgaguucacuguaagccccagaaacuccccaggagaacuacuccucgaccuagaacucggccccgaacucaaccccuaccuagcccaccucgcacguauguacaacggccacgccggcggcauggaaguccaaauaguacucgccggcaacgcauucacagcaggcaaaauccucuucgcagccauaccacccaguuucccauacgaaaaccucucacccgcgcaacuaacgaugugcccccauguaaucguagacguccgucaacuagaacccguccuccucccaaugccagacauccgcaacgucuucuaccacuacaaccaaaacaacucaccaaagcuccgccucgucgcuaugcuuuacacuccacuacgcgcaaacaauuccggcgacgacgucuucaccgucucaugcagaguccucacccgaccauccccagacuuccaguucacauuucuagucccacccacugucgaauccaaaacuaaaaacuucacccuccccguccuacgugucucagaaaugaccaacucccgcuuccccgucguacucgaccaaauguauaccucucgaaacgaaaacaucaucguccaaccucaaaacggccgcugcaccaccgacggcgaacuccucgguacuacgauacuccaaucaguguccaucugcaacuucaaaggaacaaugcaagccaaacuaaacgaagaaccacgauaccagcuccaacuaacaaaccuagacggcucccccauagaccccaccgacgacaugccugcaccccucgguaccccagacuuccaagccaugcuuuauggcguagcaucacaaagguccagcauagacaacgccacacgcgcccacgacgcacaaauugacaccgcaggcgacacguucgccccaaaaaucggccaaguccgauucaaaagcucauccaacgacuucgaccuccacgaccccacgaaauucacccccaucggcgucaacguggacgaccaacaccccuuccgccaauggucccuucccaauuacgguggucaccuagcccucaacaaccaccuagcuccagccgucacaccacucuuccccggcgaacaaauccuauucuuuagaucuuacaucccaucugcuggcggacacaccgacggagccauggacugccuucuaccccaggaguggguagaacacuucuaccaagaagcagcucccagccaaucugacauagcccucguccgcuuuaucaaccccgacaccggaagaguuuuauucgaagcaaaacuccacaaacaaggguuccuaaccauagcugccucaggcgaccaccccauugucaugcccacuaacggcuacuuccgauucgaagcaugggucaaccccuucuacacccuagcacccguaggcaccggcucuggccgucgaagaauacaauaa

SEQ ID NO: 36999 - RNA, 1644 nt, Artificial Sequence
  derived and/or modified sequence opt11 from capsid_protein__Norovirus__ADE28721
augaaaauggccagcaacgacgccgcccccuccaacgacggcgcagccaaccuaguccccgaagccaacaacgaagucauggcccucgaacccguggucggggccuccaucgccgcccccgucguaggccaacaaaacauaaucgacccauggauccgagaaaacuucguccaagccccucaaggagaauuuaccguaucaccucgcaacucccccggcgaaaugcuccuaaaccucgaacuaggcccagaacucaaccccuaccucucccaccugucucgcauguacaacggauacgccgguggaaugcaaguccaagucguccuugccggcaacgccuucaccgcaggcaaaauaaucuucgccgcagucccaccccacuuccccgucgaaaacaucuccgccgcacaaaucaccauguguccccacgucauagucgacguccgacagcuagaaccuguccuucuuccccuuccagacauccgcaacagauucuuccacuacaaccaagaaaacaccccacgaaugcgccucgucgccaugcucuacacaccacuccgcgccaacucuggcgaagacgucuucaccgucuccugccgagucuuaacacgcccagcccccgacuucgaauuuaccuuccuuguacccccaacagucgaauccaaaacaaagcccuucacccugccaauccucacacucggagaacuauccaacucacgauuccccgccccaaucgacaugcuauaucccgaccccaacgaaggcauagucguccaaccacaaaacggccgaugcacccucgacggcacucuacaaggaacaacacaacucgucccaacacaaaucugcgccuuccgcggcacacucaucggacagaccucgcgcuccuccgacuccaccgacucagccccacgccggcgagaccacccacuccacguccaacucaaaaaccucgacggcacacaauacgaccccacagacgaaguccccgcugugcucggcgcuauagauuucaaaggcaccgucuucggcguagccucccaacgcgacgucucaggccaacaagucggcgccaccagagcccacgaaguucacaucaauaccaccgaccccagauauacaccaaaacucggaucaauacucaugcacuccgaaucagacgacuucgugacaggccaaccuguacguuucaccccaaucgguaugggugacaacgauuggcaccaaugggaacuacccgacuacucaggccaccuuacccuaaauaugucacuagcacccgccgucgcucccgccuucccaggcgaacgaauacuauucuuccguuccaucguccccuccgcaggcggcuacggcagcgguuacaucgacugccuaauaccccaagaauggguccaacacuucuaucaagaagcagcccccucccaauccgccgucgccuuaauccgauacguaaacccagacaccggucguaacaucuucgaagccaaacuucaccgcgaaggauucaucaccgucgccaacucaggcaacaacccaauagucgucccucccaacggauacuuccgcuucgaagccuggguaaaccaauucuacaccuuaacacccauggguaccggccaaggccgccgccgaaaccaauaa

SEQ ID NO: 37000 - RNA, 1644 nt, Artificial Sequence
  derived and/or modified sequence opt11 from capsid_protein__Norovirus__ADE28722
augaaaauggccuccaaugacgcagccccauccaacgacggcgcagccaaccucguccccgaagccaacaacgaagugauggcacuagaacccgucguuggagcauccaucgcagccccaguaguuggacaacaaaacaucaucgaccccuggauccgcgaaaacuucguccaggccccacaaggcgaauuuaccgucucccccagaaauagccccggcgaaaugcuacucaaccuagaacucggccccgaacuaaacccauaccucucccaccuaucccgaauguacaacgguuacgccgguggcaugcaaguacaaguagugcucgcuggcaacgccuucaccgccggcaaaaucauuuucgccgccgucccaccccacuuccccgucgaaaacauauccgccgcccaaaucaccaugugcccccacgucauaguugacguucgacaacucgaacccgugcuccucccccugcccgauauccgaaauagauucuuccacuacaaccaagaaaauacaccccgcaugcgucucguagccaugcucuacacaccccuccgagcaaacuccggcgaagacgucuucaccgucuccugccgaguacuaacccgcccagcccccgacuucgaguucaccuuccucgucccucccaccguagaauccaaaaccaaacccuucacccuccccauauuaacccuuggcgaacucuccaacucccgcuuccccgccccgaucgacauguucuacaccgaccccaacgaagguaucgucguacacccccagaacggccgcugcacccucgacggcacccuacaaggcaccacccaacucgucccaacccaaaucugcgccuuccgaggcacccuuaucggucaaaccucacgguccuccgacagcaccgacucagccccaagacgccgagaccacccauuacacguccagcucaaaaaccucgauggaacacaauacgaccccacugacgaaguacccgccguacuaggcgcuauagacuucaaaggcaccgucuucggcgucgccucucaacgagacguaucaggacaacaagucggcgccacaagagcccacgaaguccacaucaacaccaccgacccacgauacacucccaaacucggguccauacucaugcauuccgaaucagacgacuucguaacuggacaaccaguccgcuucacccccauaggcaugggagacaaugacuggcaccaaugggaacuucccgacuacucaggccaucucacacuuaacaugaaccucgcccccgcggucgcccccgccuuccccggcgaacgaauccucuucuucagauccaucgucccuuccgccggcggcuacggauccggcuacaucgacugccucauaccacaagaaugggugcagcacuuuuaccaagaagccgccccaucacaaagcgccgucgcccucauccgauacgucaaucccgacaccggacgaaacaucuucgaagcaaaacuccacagagaaggcuucaucaccgucgcaaacuccggaaacaaccccaucgucgucccacccaacggauacuuccgauucgaagcaugggucaaccaauucuacacccuaacccccaugggcaccggccagggccgccgacgaaaccaauaa

SEQ ID NO: 37001 - RNA, 1644 nt, Artificial Sequence
  derived and/or modified sequence opt11 from capsid_protein__Norovirus__ADE28723
augaaaauggcuucaaacgacgccgcccccucaaacgauggagcagcuaaccucguaccagaagccaacaacgaagucauggcucuugaacccguagucggcgccucaaucgcagcacccgucgucggccaacaaaacaucaucgaccccuggauccgagagaacuucguucaagcaccccaaggcgaguucaccgucucaccccguaacuccccaggagaaaugcuccucaaucucgaauuaggccccgaacucaacccauaccucucccacuuaucccgcauguauaacggcuaugccggaggcaugcaaguccagguaguccuagcaggcaacgccuucaccgccggcaaaaucaucuucgccgcagucccaccacacuuucccguagaaaacauaucagccgcacaaauuacuaugugcccccacgucaucguagacguccgucagcuagaacccguccuucugccacuccccgauauccgaaaccgguucuuccacuacaaccaagaaaacacuccacgcaugcgccuagucgccaugcucuacacaccccuacgagcaaacucaggcgaggacgucuucaccguaucaugcagagugcucacccgcccugcccccgacuucgaguucacguuccuugucccacccaccgucgaauccaaaaccaaacccuucacauuacccauccuaacccucggagaacucuccaacucccgcuuccccgcucccaucgacaugcucuacaccgaucccaacgaagguaucguaguacaaccccaaaacggcagaugcacccuagauggcacacuacaaggaaccacccagcuaguccccacccaaauaugcgccuuccgagguacucucaucggccaaaucucccgcuccagcgacuccaccgacuccgccccgcgcagacgagaccacccccuccacguccaacuuaaaaaccuagacggaacacaauacgaucccaccgacgaaguucccgcagucuuaggcgcaaucgacuucaaaggcaccgucuucggcgucgcaucccaacgcgacgucuccggacaacaagucggagccacuagagcccacgaaguacacaucaacacuacagacccacgauacaccccaaaacucggcuccauacucaugcacuccgaaucugacgacuucgucacaggacaacccguucgauucacccccaucgguaugggcgacaacgauuggcaccaaugggaacuacccgacuauuccggccaccucacccucaacaugaaccucgccccugccgucgcgcccgccuucccgggcgaacgcauacucuucuuccgcucuauagucccguccgcgggcggcuacggauccggauacaucgacugccucaucccacaagaauggguccaacacuucuaccaagaagccgcccccucccaauccgccgucgcccuaauucgcuacgucaaccccgacaccggcagaaacauuuucgaagcaaaacuacaccgggaaggguucaucaccguugccaacucaggcaacaaccccauagucguaccacccaacggauacuuccgcuucgaggcuuggguuaaccaguucuacacacucacccccauggguaccggccaaggacgccgacgaaaccaauaa

SEQ ID NO: 37002 - RNA, 1644 nt, Artificial Sequence
  derived and/or modified sequence opt11 from capsid_protein__Norovirus__ADE28724
augaaaauggcuagcaacgaugccgcccccagcaacgacggcgccgccaaccucgucccagaagccaacaacgaagucauggcacuagaaccagucgucggagcgucaaucgccgccccagucguaggccaacaaaacauuaucgacccuuggauccgcgaaaacuucguccaagccccacaaggcgaguucacagucagcccccguaacucccccggcgaaaugcuacuaaaccucgaacuaggucccgaacuaaacccauaccuaucccaccucuccagaauguacaacggauacgccggcggaaugcaaguccaaguaguacucgccggcaacgccuuuacagcuggcaagaucaucuucgcagccguacccccucauuucccagucgaaaacaucuccgcagcacaaaucacaaugugcccccacgucaucgucgacguccgccaacucgaacccguacucuuaccacugccagacauccguaacagauucuuucacuacaaccaagaaaacacaccacgaaugcgccucguagcuaugcuguacacaccccuccgagcuaacucaggcgaagacguauuuaccgucucaugccggguccuaacgaggcccgccccugacuucgaguucaccuuccucgucccacccaccgucgaaucuaaaaccaaacccuucacauuacccauacucacccuaggcgaacucagcaacagccgcuuccccgcacccauagauaugcucuacaccgaccccaacgaaggaaucgucguccagccucaaaacggcagaugcacacuagacggaacccuccaaggcacuacacaacucguccccacccaaaucugcgcuuuccgcggaacccugaucggacaaacuucucgaucuuccgacagcacugacucagccccacgccgcagagaccauccccuccacguccaacucaaaaaccuagacggaacucaauacgaccccacugacgaaguccccgccguccucggagcaauagacuucaagggcaccgucuucggcgucgcaucccaacgagacgucucgggccaacaagucggcgccacccgcgcccaugaaguacacauaaacaccacggauccacgguacacaccaaaacucggauccauacuaaugcacuccgaaagcgacgacuuugucaccggccaaccaguccgcuucaccccuaucggcaugggugauaacgacuggcaucaaugggaacuccccgacuacagcggccaccucacacuaaacaugaaucucgcacccgcagucgcccccgccuuccccggugaacgaauccucuucuuccgauccaucguucccagcgcaggcggauacgguucagacuacaucgacugccucauuccccaagaauggguacaacacuucuaccaagaagccgcccccucccaaucagccguugcacuuauccgcuacgucaaccccgacaccggccgcaacaucuucgaagccaaacuacaccgagaaggauucaucaccguagcaaacuccggcaacaauccaauaguagucccacccaauggauauuuccgguuugaagccugggucaaccaauucuacacccuagcccccauggguaccggccaaggccgucgccgcaaccaauaa

SEQ ID NO: 37003 - RNA, 1647 nt, Artificial Sequence
  derived and/or modified sequence opt11 from capsid_protein__Norovirus__ADK23787
augaaaauggcguccaaugacgcaacacccucuaacgacggcgccgccggacucgucccagaaaucucaaacgaagccauggcccucgaccccguagccggagcagcaaucgccgcaccccuaaccggacaacaaaacaucaucgaccccuggaucaugaacaacuucguccaagcccccgguggcgaguucacaguauccccucgcaacucccccggagaaguccuccuaaaccucgaacucggccccgaaaucaacccauaucucgcccaccuagcccgaauguacaacggcuacgccggcggauucgaaguccaaguuguccucgccggcaacgccuucaccgcaggcaaaaucauauucgccgcaaucccgcccaacuuccccaucgacaaccucucagcagcccaaaucaccaugugcccccacgucaucguagauguccgacaacucgaacccgucaaccuccccaugcccgacguacgcaacaauuucuuccacuauaaccaaggaagcgacagccgucuccgacucguagcuaugcucuacacaccccuacgcgcaaacaacagcggcgaugacguauucaccgucucuugcagaguccucacccgccccucccccgacuucucauucaacuuucuagucccacccaccgucgaauccaaaaccaaaccauucacccucccaauccuaaccaucucagaaaugucuaauucacgauucccuguccccaucgacucccuacacaccuccccaaccgaaaacgucgucguccaaugccaaaauggcagagucacccuagacggcgaacucaugggcaccacacaacuccuaccaucucaaaucugcgccuuccgcggaguccuaacccgcuccaccucccgcgccucagaccaagcagacacugcaacccccagacucuucaacuacuauuggcacauccagcucgacaaccucaacggcacccccuacgauccagcagaagacauccccggcccccuaggcacccccgacuucaggggcaaagucuucggcgucgccagccaacgcaaccccgacuccacuacccgcgcacaugaagccaagaucgacacaaccgcaggccgguucacaccaaaacuaggcucccucgaaaucagcaccgaauccggcgacuuugaccaaaaucaaccaacgcgauucacccccgucggcaucggcguagaccacgaagcagacuuucaacaauggucucuacccgacuauucaggccaguucacacacaacaugaaccucgcccccgccgucgccccaaacuuccccggcgaacaacuccuauucuuccgcagccaacuacccucauccggcggccgcaguaacggcauccucgacugucuugucccacaagaauggguccaacacuucuaccaggaaucagcacccgcccaaacccaagucgcacuuguccgcuacgucaaccccgauacaggacgaguccucuucgaagccaaacuacacaaacucggauuuaugacuaucgccaaaaauggcgacucccccauaaccguuccacccaacgguuacuuucgcuucgaaucaugggucaaccccuucuacacccucgcccccaugggaaccggaaacggccgacgccgaauccaauaa

SEQ ID NO: 37004 - RNA, 1623 nt, Artificial Sequence
  derived and/or modified sequence opt11 from capsid_protein__Norovirus__ADM52743
augaagauggcauccaacgacgccaaccccuccgacggauccaccgcaaaccucguccccgaaguaaacaacgaagucauggcccucgaacccgucgucggcgccgcaaucgccgcccccguagcaggccaacaaaacgugaucgacccuuggauccguaacaacuucguacaagcaccgggaggagaauuuaccgucuccccacguaacgccccaggcgaaaucuuauggucugccccgcucggacccgaccucaaccccuaccucucucaccucgcccgcauguacaacggcuacgcuggcggcuucgaaguccaaguaauccucgccggcaacgcuuucaccgcaggcaaaaucaucuuugcagccguacccccaaacuuccccaccgaaggccuaucccccucccaagucacaauguucccccacauaaucgucgacgugagacaacucgaacccguccucauaccacuaccagacguucggaacaacuucuaccacuacaaccaaucaaacgacccaacaaucaaacuaauugcaaugcucuacaccccacucagagccaacaaugccggcgacgacguuuucaccguauccugccgaguccuaacaagacccucuccagacuucgacuucaucuuccucgucccacccaccgucgaauccagaaccaaacccuucuccguccccauccuaacagucgaagaaaugaccaacucacgcuuccccaucccccucgaaaaacucuucaccggcccuucaucagccuuuguaguacagccacaaaacggccgcuguacaaccgauggcguccuauuaggaaccacccaacucucccccgucaacaucugcaccuuccgcggcgacguaacacacaucaccggcucacggaacuacacaaugaaccuagccacucaaaacuggaacucauacgaccccaccgaagaaauccccgcaccccucggaacacccgacuucgucggaaaaauccaaggcguucucacccagacaacccgagccgacggcucaacccgcggacacaaagccacagucuacaccggcucugccgacuucgccccaaaacuaggucgaguccaauucgcaaccgacacagacaacgacuucgacgccaaccaaaacacaaaauucacaccaguaggagucauacaagacggcaacacagcccaccguaacgaaccgcaacaauggguccucccauccuauucaggacggaacucacauaacguccaccucgcccccgcagucgcaccaaccuucccaggcgaacaacuacucuuuuuccgauccaccaugccaggaugcucaggauaccccaacauggaccucgacugccuccucccccaagaauggguucaauacuucuaccaagaagcagcucccgcccaaagcgacguagcccuccuucgcuucgugaaccccgacacuggacgcguccucuucgaaugcaaacuccacaaauccggcuacguaaccgucgcacacaccggacaacacgaccucgucauaccacccaacgguuacuuccgcuucgacuccugggucaaucaauucuacacacucgcacccaugggaaacggcacuggccgccgcagagcccucuaa

SEQ ID NO: 37005 - RNA, 1623 nt, Artificial Sequence
  derived and/or modified sequence opt11 from capsid_protein__Norovirus__ADR57234
augaagauggcauccuccgacgcaaaccccuccgacggauccaccgccaaccucguaccagaagucaacaacgaagucauggcacuugaacccgucgucggugccgcaaucgcagcccccgucgccggacaacaaaacgucaucgacccauggaucagaaacaacuucguccaagcacccggaggcgaguucaccguuaguccacgcaacgccccaggcgaaauccucuggucagccccacucggaccagaccugaaccccuaucuaucccaccucgcacgaauguauaacggauacgccggcggcuucgaaguccaagucauauuagcaggcaacgccuucaccgcaggaaagauuauauuugccgccgugcccccaaacuuccccacagaaggccucucccccucccaagucaccauguucccacacaucaucgucgacguccgccaacucgaaccaguccucaucccacuacccgacgucagaaacaacuucuaucacuacaaccaacucaacgaccccaccaucaagcucaucgccaugcuguacacuccccuccgcgccaacaacgccggcgaugaugucuucacggucaguugccgaguucucacccgcccauccccggacuucgacuucaucuuccuuguaccacccaccgucgaaucucgaacaaaacccuucucggucccaauccucaccgucgaagaaaugaccaacucccgcuucccaaucccccucgaaaaacucuucaccggccccuccuccgcuuucgucguccaaccccaaaacggacgaugcacuaccgacggcguccuccuaggcaccacacaauuaucccccguaaacauaugcaccuuccgcggcgacgucacccacauaaccggaucccacaacuacaccaugaaccucgccucucaaaacuggaacucauaugacccaacggaagaaauccccgcaccacuaggcacaccagacuucguaggcaagauacaaggcguccuuacccaaacaacucgagccgacggaucaacccgcggccaccgugccaccgucuacaccggaagcgcagaguucgcuccaaaacucggccgcguccaauucgccacugacaccgaaaacgacuucgacaccaaccaaaacaccaaauucacccccgucggaguaauccaggacggcaacacaacccaccgcaacgaaccacaacaauggguucuccccucguacuccggccgcaacucccacaacguacaccucgcccccgccgucgcccccacauuccccggagaacaacuucuguucuuccgcucaaccaugcccgguuguucgggauaucccaaccucgaccuugacugccuccucccacaagaauggguccaacacuucuaccaagaagcagcacccgcccaaucggacguagcuuuacuucgcuucgucaaccccgacaccggucgcguccucuucgaauguaaacuccacaaaucuggcuacgucaccguagcucacacaggacaacacgaccuaguuaucccucccaacggcuacuuccgauucgacucaugggucaaccaauucuacacacucgcuccuaugggcaacggcaccggcagacgccgagcacucuaa

SEQ ID NO: 37006 - RNA, 1626 nt, Artificial Sequence
  derived and/or modified sequence opt11 from capsid_protein__Norovirus__AEA07712
augcgcauguccgacggcgcugcccccaaagcaucaggauccgaagccucaggucaagaccucguuccaucagccgucgaacaagcaguacccauccaacccgucguaggcgccacccuugccgcccccgccgccggucaaaucaaccaaaucgacccauggaucuuccaaaacuucgugcaaugcccucucggggaauuuucgaucucucccagaaauacccccggagaaauccuauucgaccucgcacuaggacccggccucaacccauaccucgcucaccucagcgcaauguacacaggauggguaggcaacauggaaguacaacucguccucgccggcaacgcguucaccgccgggaaagucgucgucgcucucguucccccauacuucccaaagggcuccaucacgaccgcccaaaucacuugcuucccccacgucaugugcgauguccgcacccucgaacccauccaacucccccuccucgacguucgccgcguccucuggcacgcaacccaagaccaagaagaaucaaugagacucgucugcaugcuauauaccccuuuacgcaccaacuccccuggcgacgaaucuuucgucguauccggcagacuacuuucuaaaccagccgccgacuucaacuucgucuaccucacaccacccaucgaacgaaccaucuaccgcaugguagaucuacccguacuacaacccagacuaugcacacacgcacgcuggcccgccccagucuacggccuucugguggaccccucacuaccaucaaacccacaauggcaaaacggccgcguacacgucgacggcacccuccuaggcaccacccccguauccggcuccugggucuccuguuucgccgccgaagcugcauacgaguuccaaucaggcaucggugaaguugccaccuucacccuaaucgaacaagauggcuccgcauaucuccccggcgaucgagccgcuccccucggauacccugacuucagcggccaacuggaaauagaaguccaaaccgaaaccaccaaagccggcgacaagcucaaagucaccaccuucgaaauggcccucggcccuaccacaaacguagaccaagcaccauaucaaggacgcguauucgcauccuucacugccuccgccucccucgaucuugucgacggccgcguccgcgcaguuccacgcuccaucuucggcuuccaagacguaguccccgaauacaacgacggacuacucguaccccucgcacccccaaucggcccauuccuccccggagaaguccuccuccgcuucagaacauacaugcgacaaauagacucaucagaugccgccgccgaagccaucgacugcgcccucccccaggaguucgucuccugguucgccucaaacggauucaccgugcaaucugacgcacuacuucuacgauaccgaaacacccucaccggccaacuccuauucgaaugcaaacuauacucagacggauacaucgcacuaucauacagcggcuccggcccacuaacuuucccaacagacggcuucuucgaagucgucucaugggucccacgccuauaccaacucgcaucaguaggcucacucgccaccggccgcacacucaaacaauaa

SEQ ID NO: 37007 - RNA, 1623 nt, Artificial Sequence
  derived and/or modified sequence opt11 from capsid_protein__Norovirus__AEK05311
augaaaauggccuccaacgacgccaaccccuccgaugguuccgccgccaaccuaguccccgaagucaauaacgaagucauggcccuugagcccgucgucggcgccgccaucgccgccccuguugccggacaacaaaacguaaucgacccauggauccgcaacaacuuuguccaagcccccggaggugaguucgcaguaucuccucggaacgcuccaggagaaauacuuugguccgcgccccucggcccagaccucaaccccuaccucucccaccucgcccgcauguacaacggauacgcaggaggcuucgaaguccaagucauccucgccggcaacgccuucacagcagguaaaauaauauucgccgcagucccacccaacuuuccaacagaaggacucuccccaucccaaguaacaauguucccacacauaauaguagacgugcgacaacucgaaccaguccucaucccucuccccgacguacgcaacaacuucuaccacuacaaccaaucaaacgacuccaccauuaaacuaaucgcaaugcuuuacacaccccuacgcgccaacaacgccggugaagacgucuucacaguauccugccgcguccuaacacgucccucacccgacuuugacuucaucuuccucgucccacccacagucgaaucuagaaccaaacccuucaccguccccauccucaccguugaagaaaugaccaacucccgauuucccaucccccucgaaaaacucuucaccggccccuccggcgccuuugucguccaaccacaaaacgguagaugcacaacugacggcguacuccucggcacaacccaacucucccccgucaacaucuguacuuuccgcggagacgucacacacaucgcaggaucacgcaacuacacaaugaaccuagccucccuaaacuggaacaacuacgaccccacagaagaaauccccgccccucuagguaccccagacuuuguaggcaaaauccaaggcguccuaacacagaccaccaaaggagacggauccacccgaggccacaaagccacagucuacacaggcuccgcgcccuuuacccccaagcuaggcuccguccaauucucaaccgacaccgaaaacgacuuugaaacccaccaaaacaccaaauucgcccccgucggaguaauccaagacggauccacaacccaccgcaacgaaccccagcaauggguccuccccucuuacuccggcggcaacguccacaacguccaccuugcccccgcaguugcccccaccuuccccggcgaacaacuacucuucuuccgauccaccaugccuggcugcuccggcuacccaaacauggaccucgacugccuacucccccaagaauggguccaacacuuuuaccaagaagccgccccagcccaauccgaugucgcucuccuacgcuucgucaaccccgacaccggccgaguccuauucgaaugcaagcuccacaaauccggcuacguaaccgucgcccacacaggccaacacgaccucguaaucccucccaacggauacuucagauucgauuccugggucaaccaauucuacacccucgcacccaugggcaacggaaccggccgcagacgcgcccucuaa

SEQ ID NO: 37008 - RNA, 1608 nt, Artificial Sequence
  derived and/or modified sequence opt11 from capsid_protein__Norovirus__AEP16505
augaaaauggccuccuccgacgcagcacccucaaacgacggcgccgccggcuuagucccagaaguaaauaaugaaaccauggcacucgaaccagucgccggugcauccauagcagcuccccucaccggacaaaacaacgucauagaccccuggauccguaugaacuuuguccaagcccccaacggcgaguucacagucucaccccguaacucccccggcgaaguacugcucaaccucgaacuaggcccugaacucaaccccuuccucgcccaccucucccgaauguacaacggcuaugccgguggugucgaaguacagguucuccucgcaggcaacgccuucacagcgggcaaacucgucuucgccgccauaccuccccacuucccccucgaaaaccucucccccggccaaauaaccauguucccccacguaaucauagacguacguacacucgaacccguucuucuaccacugcccgacguccgcaacaacuucuuccacuacaaccaacaacccgaaccccgcaugcgucucguugccaugcuauacaccccacuccguucuaacggcuccggugacgacgucuucaccguaucaugucgcguacucacccgccccucacccgacuucgacuucaacuaccugguacccccgaccgucgaaucaaaaaccaaaccauucacccucccaauccucaccaucggcgaacucucaaacucacgcuucccagucccuaucgacgaacucuacaccucccccaacgaaggcgucgucguccaaccacaaaacggccgcuccacacuggacggcgaacuccucggaaccacccagcuuguacccucaaacauaugcgcucuccgcggccgcaucaacgcccaaguccccgacgaccaccaccaauggaacuuacaagucaccaaugcuaacggcaccuccuuugaccccacugaagacgugcccgcgccccugggcaccccagacuuccucgccaacaucuacggcgucaccucccaacgcaaccccgacaauaccugccgcgcccacgacggaguacuagccacauggucacccaaauucacccccaagcucggcagcguaguccuuggcaccugggaagaaucugaccuagaccuuaaccaacccacccguuucaccccugugggccucuacgacaccaaccacuucgaccaauggauacuaccuaacuacuccggacgacuuacccucaacaugaaccuagcucccuccgucgcuccccucuuucccggcgagcaaauacuuuucuuccgcucccacaucccccuaaaaggaggcaccuccaacggagccaucgacugccuccugccccaagaauggauacaacacuucuaccaagaaucggccccaucacccacugacgucgcccucauccgcuacccaaacccagacaccggacgaguucuauucgaagccaaacugcuacgccccggauucauaaccguagccaacuucggcuucaagcccaucgucguucccccaaaaggcuacuuccgcuucgacuccugggucaaccaauucuacagccucgcacccauggggacagggaauggacgacgacgcguccaauaa

SEQ ID NO: 37009 - RNA, 1632 nt, Artificial Sequence
  derived and/or modified sequence opt11 from capsid_protein__Norovirus__AEY77318
augaugauggccuccaaagacgccccuaccaauauggacggcaccuccggcgcaggccaacucguaccggaaguguccacagccgaacccaucuccauggaaccagucgcaggcgccgcuaccgccgccgccaccgcaggccaagucaacaugaucgaccccuggaucauguccaacuacguccaagcaccccaaggcgaauuuaccauaagccccaacaacacccccggcgacauucucuucgaccuacaacuggguccccaccuaaacccauuccuaucucaucuagcccaaauguacaacgguugggucggcaacaugaagguccgcguacuccucgccggcaacgccuucacugcagggaaaauaaucaucuccugcguacccccugguuucgccgcacaaaacgucucaaucgcccaagcaaccauguucccccacguuaucgccgacguccgcguucucgaacccauagaagucccccuugaagacguccgaaacguccucuuccacaacaacgacuccaccccaaccaugcgacucauuugcaugcucuacaccccacuccgagcuucaggcuccucuuccggcacugacccauucgucaucgccggccgcguccucaccugucccuccccagacuucaacuuccuuuuccucguaccacccaacguagaacagaaaacuaaacccuucucugucccaaaccucccccucaacguacucucuaacucccgcguacccucccucauaaaauccaugaugguaucccaagaccacggccaaaugguacaauuccaaaacgguagaguaacccuagacggccaacuccaaggaacaacacccacauccgccucacaacucuguaaaauaagaggcaccgucuaccacgccaccggaggccaaggacucaaccuaaccgaaaucgacgggacaccauaccacgccuucgaaucuccagcacccaucgguuuccccgaccucggcgaaugugacuggcacaucaacgcaucacccgccaacgcuuucacagaugguuccaucauucaccgaauagacgucgcccaagacuccaccuucgcuccccaccucgguacaauacacuacaccaacgccgacuacaacgccaacgucggccuaauaugcucccuagaauggcucagcccacccucuggcggcgcccccaaagucaacccuugggccaucccacgcuauggauccacccucacagaagccgcacaacucgccccaccaauauaucccccaggcuucggcgaagccaucguauucuucauguccgacuucccaauagccaacggcuccgacggccucucaguccccugcacuaucccccaagaauuugucacccauuucguaaacgaacaagcgcccacccgcggcgaagccgccuuauuacacuacguagaccccgacacccaccgaaaccucggcgaguucaaacucuaccccgaaggcuucaugaccugcgucccaaacucaucaggaucaggcccccaaacccuccccauaaacggcgucuucacauucaucucuuggguaucccgcuucuaccaacucaagcccgucggaacaacaggacccguacgccgucucggaauacgacgauccuaa

SEQ ID NO: 37010 - RNA, 1626 nt, Artificial Sequence
  derived and/or modified sequence opt11 from capsid_protein__Norovirus__AEY83583
augcgcauguccgacggcgccgcacccaaagccaacggauccgaagcauccggacaagaccuugucccaaccgccgucgaacaggccguccccauccaacccguagcaggcgccgcacuugccgcacccgccgcaggccagaucaaccaaaucgacccauggauauuccaaaacuucguccagugcccacuaggcgaguucucaaucucaccacgaaacacacccggcgaaauacucuuugaccuagcacucggucccggccucaaccccuaucucgcacaucuaucagccauguacaccgggugggucggaaacauggaaguccaacucguccuagccggcaacgcuuuuacagccggcaaaguaguagucgcccuaguucccccauauuucccuaaaggcucucucaccacagcacaaauuaccugcuucccccacguaaugugcgacguccgcacccucgaaccaauccaacuaccccuccucgacguccgccgcguccucuggcacgcaacacaagaccaagaagaaucaaugcgucuugucugcaugcucuacaccccuuuacgaaccaacucacccggggacgaauccuucgucguaucaggccgucuacucuccaaacccgcccccgacuucaacuucguuuaccucacacccccuaucgaacguaccaucuaccgcaugguagaccuucccguacuccaaccccgacuaugcacccacgcccgcuggcccgcucccgucuacggacuccuugucgaccccucacucccauccaacccccaauggcaaaacggccgcguacaaguagacggcacgcuacucggaacaacacccguuucuggcucaugggucuccugcuucgcagccgaagcagcauacgaguuccaagcuggcacuggcgaagucgucaccuucacaaugaucgaacaagacggcucagcauacguaccuggagaccgagccgcaccacuaggcuaccccgacuucuccggccaacucgaaauagaaguccaaaccgaaacaaccaaaacaggcgacaaacucagaguaaccaccuucgaaaugauccucggccccaccacaaacgucgaucaggcacccuaccaaggccgagcauaugccucacuaaccgccgccgccucccuagaccucgucgacggccgcguaagagcgguuccccgcuccaucuacuccuuccaagacgaacuacccgaauacaacgacggcguccuaguaccccucgcacccccacucggucccuuucucccaggcgaaguccuucuucgcuuccgaacauacaugcgccagcucgacacagccgacgcagccgcccaacccauagacugcgcccuaccccaagaguucaucucaugguucgccucaaauaacuucaccguacaauccgacgcccuccucguccgcuaccgaaacacccucaccggucaacuccuauucgaagccaaacucuacuccgaaggcuacauagcugucagcuacucaggcucaggcccccuaacauuccccacagacggcuucuucgaagucguaucaugggucccacggcuauuccaacucgccucugucggcucccuaguaacaggccgcacccuaaagcaauga

SEQ ID NO: 37011 - RNA, 1629 nt, Artificial Sequence
  derived and/or modified sequence opt11 from capsid_protein__Norovirus__AFB18010
augaaaauggccucgaacgacgccgcuccaucaaccgacggugcugcaggccucguacccgaauccaacaacgaaguaauggcccucgaaccagucgccggcgccgcccucgccgcacccguaaccggccaaacaaacauaaucgaccccuggauacgcaccaacuucguccaagcaccaaauggagaauuuaccgucagcccccgcaacgcacccggagaaguccuacucaaccucgaacuuggcccagaacuaaacccauacuuggcccaccucgcccgcauguacaacggcuacgccggcggaauggaaguacaaguaaugcucgccgggaacgcauucacagccggcaagcucguauucgccgccguacccccucacuuccccgucgaaaaccucuccccacaacaaaucaccauguucccccaugucaucaucgacguccgaacccuugaaccaguccuccucccacuucccgacguccgcaauaauuucuuccacuacaaccaaaaagacgaccccaaaaugcguauagucgccaugcucuacacaccccuccgaagcaacggcucaggcgacgacgucuucaccgucuccugccgcguccugacccgccccuccccagacuucgacuucaccuaccuuguacccccaacugucgaguucaaaaccaaacccuucacccuucccauccucacacuaggugaaauguccaacucccgcuucccagucccaaucgaccaaauguacacauccccaaacgaaauaaucucaguccaaugccaaaacggccgcugcacacucgacggcgaacuacaaggcaccacccaacuccaagucuccggcaucugcgcauucaaaggacaggucaccgcacaccuccaagacaacgaacaccuauacaauguaacuauaaccaaccuuaacggcucgcccuucgaccccucugaagacauccccgcaccccucggcgucccagacuucgaaggccggguauucggcguaauaucccaacgcgacaacuacaacucaggcggacaaaaccaaccagccaaccggucccacgacgccgucgucccaacauacaccgcccaauacacccccaaacucggacaaauacaaaucggaaccuggcaaaccgacgacaucacugucgaccaacccgccaaauucaccccaguaggccucucagacaccgaccauucuaaccaaugggucguaccccgcuacgccggcgcccucaaccucaacaccaaccucgcacccucuguagccccggucuucccaggcgaacgacucuuauucuucagaucuuacauaccccucaaaggaggauucggcaaccccgccaucgacugucuaguaccgcaagaauggauccaacauuuuuaccaagaagcggcccccucccucuccgaagucgcccucgcccgcuacaucaaccccgacacaggccgagcacuauucgaagcaaaacuccaucgugccggcuucaugaccgucuccuccaauacuagcgcacccguggucgucccagcaaacggauacuuccgcuucgacucuugggucaaccaauucuacucccuagcccccaugggcacaggcaacggccgccgacgaauccaauaa

SEQ ID NO: 37012 - RNA, 1623 nt, Artificial Sequence
  derived and/or modified sequence opt11 from capsid_protein__Norovirus__AFB18013
augaaaauggccuccaacgacgcaaaccccuccgacggcuccacagcuaaccucguccccgaagucaacaacgaaguuauggcacuugaaccaguagucggcgccgcaaucgcagcaccagucgccggacaacaaaacgucauagacccuuggauaagaaauaacuuuguccaagcccccggaggagaauuuacaguaucuccccgaaacgcuccaggcgaaauacucugguccgcaccccugggcccagaccucaacccauaccucucccaccuagcccgcauguacaacggcuacgccggcggcuucgaaguccaagucauacuagccggcaacgcauucacagcaggcaaaguaauauucgcagcaguacccccuaacuuccccaccgaaggccucucccccucacaagucacaauguucccucacaucgucgucgacguccgccaacucgaaccaguccuuaucccacuccccgacguccgcaacaauuucuaccacuacaaccagucaaacgaccccacuaucaaauuaauagcaaugcucuauaccccucuucgcgccaacaaugcaggcgaagacguauucaccgucuccugccgcguccuaacacgucccagcccugacuucgacuucauauuccucguuccacccaccgucgaaucccgaaccaaacccuucaccguccccauacucaccguugaagaaaugacuaacucccgauuccccaucccacuagaaaaacucuucaccggccccuccggcgcuuucguaguacaaccacaaaacggacgauguaccacggacggcguccuccucggcacaacccaacuuucccccgucaacaucugcacauuucgaggagacgucacccacaucgccggcacccacaauuacacaaugaaccucgccucucaaaacuggaauaacuacgacccuacagaagaaauccccgcaccccuggguacucccgacuuugucggcagaauccaaggcaugcucacacaaacaacaagaggcgacggcucaacccgcggucacaaggccaccgucucaacaggcgacguccacuucacaccaaaacuaggcagcauccaauucaacaccgacacaaacaacgacuucgaaacaggccagaauaccaaauucacccccguaggcgucguccaagacggcaacggcacccaccaaaacgaaccucagcaauggguccuccccuccuacagcggccgaacaggccacaacguccaccucgccccagccguagcccccacguucccaggagaacaacuccucuucuuccgcucaaccaugccaggcugcagcggcuacccaaauaugaaccucgacugccuccuuccacaagaauggguccaacacuuuuaccaagaagccgcucccgcccaauccgacguagcccuacuacgauucguaaaucccgacaccggccgaguccuauucgaaugcaaacuacacaaauccggauacguaaccgucgcccacaccggccaacacgacuuaguuaucccaccuaacggcuacuuccgcuucgacuccugggucaaccaauucuacacccucgcccccaugggcaauggcaccggacgccgacgcgcccucuaa

SEQ ID NO: 37013 - RNA, 1743 nt, Artificial Sequence
  derived and/or modified sequence opt11 from capsid_protein__Norovirus__AFJ05624
augaaaauggcuucuaaugacgcaacagccccaucccaagacggagcagccaaccuuguccccgaaucacaacacgaaguacucgcccuagagcccgucgccggcgccgcccuagcagcacccgucgcaggccaauucaacgcuaucgaccccuggauaaaacaaaacuucguccaagcaccagccggcgaguucaccgucucaccccguaaugcccccggcgaaauccuaauggaccucgaacucggacccgaacucaacccuuuccuagcacaccucgcacaaauguauaacgccuacgccggcggaauggaaguucaaaucauccuagcaggaaacgcauucaccgccggcaaaauaauagucugcgccguuccgcccaacuucccacccgaccgccucuccgccucacaagcaaccaacuucccccacgucaucauggacguacgcacccucgaaccggucauccucccccuaccagacgucagagcuggauucuuucacuacaaccaacuccgagaaccacgcaugcgccucauggcgcuccuauauacaccccuacgcgcaaacggcaccggcgacgaugcauucaccguaucgugccgaguacuaacucggcccaugcaagacuucgaguucauguuccucguuccucccaccguugaaucccgcguuacacccuucucuguccccaccuaccccguaguagaaaugaccaacucacgcuggcccgcccgcauaucaggcaugcacguuaacgccaaccagaccuuagccguacaauuccaaaacgguagaugcacucucgacggacaacucaugggaacuacacaacucugcgccgcagacguaugcaggaugcgcggccgcuacaccuccacccgugccgaccucgccgguguugaccauacagaccaaggcccgucccuuggaaccggacccucugacgacuccgucuccgucccagaagcacgagcccaaacacggacaggcgucuccgcccaccuacaacuugaagaacucaacggacaaccauacgaagucuacggagaacagccagcaccccuuggcacccccgacuuccggugccgccuaaugggcgaacucguccgccuaccgucaaccucccccgccgcccaaucacguuuccgugacgcauucuucgacaccuacggcgcccucuucgccccagcagucggauccaccaccuuuaccgucaacaacagcucaaccucagauuucgccaacggccaacccuucgaauuucuccccaucggcgucgaaaucggcaauuccgcacaauaugacgaauuugcccuacccucauacaacggcgcaauaggugaaaaccgacaccuagcacccgucgccgcaccuggcuuccccggcgaaaacauagucuucuucucaagcaaccuccccgucugggacuccacauccgcccaaaacaaccgccgcaucagcugccuacucccaaacgaauuuguacaacacuucuacgaccuccaggcccccagucaguccgacgucgccuuacuccguuauguccacccugaaucaggccgcguucuauucgaaugcaaauuauacagagacggauuccucaccguuaacggagccucacucgcggaguuccccgucaauggauacuuccgcuucgacucaugggucaaccaauucuucacucucuccccuguaggcaccgguuccggccgccgaggucgaucacgcaacgcacaauaa

SEQ ID NO: 37014 - RNA, 1746 nt, Artificial Sequence
  derived and/or modified sequence opt11 from capsid_protein__Norovirus__AFJ05628
augaaaauggccucaaacgacgccgcauccccuucauccgacggagccgccaaccuugugcccgaaaucaacaacgaagucauggcccuagaaccagucgccggcgcacagcuugccgcccccgucgcagggcaauucaacgcaaucgacccuuggauaagacaaaacuucguucaagcccccgagggagaauucaccguauccccccgcaacgcccccggcgaaauccuccucaaccuagaacuaggcccacaccucaacccauuucuccaacaccucgcacaaauguacaaugcauacgccggcgguauggaaguccaagucguacucgcaggcaacgcguucaccgccggcaaaauaaucuucgcagcagucccaccacacuucccaccagaacgacuaucggccgcacaagccacccaauucccccacgucaucgucgacguacgacaacuugaacccaucauucuaccccuccccgacguccgccacaaccucuuccacuucaaccaacaaaacgacgaaagaaugcaccuugucgccuuccucuacaccccccuccgagcaaacagcggcuccggcgaugauguuuucaccgugucuugccgcguucucacgcgacccucgcaagacuucgaauuuauguuccucguccccccaacagucgagaaaaaaaccgucgccuucucccuaccccaauuagccaucggcgaaauguccaauucccgcuggcccgcacgaauaacaggacuugucguugauccccgacucccucaaguacuccacauccaaaacggcagaugcacucucgacgguacucuaauggguaccacccagcuaaaccccaacgauaucugccgaaucagaggcuacuucuccucaucccgcccugaacuccuuugcgaaaacgaagaauccgcaaccgacccaaugccuaccgaaaccgacaccgacaaccaaccccccgaaguccgagcacaagcccgagccacccaacgcugguucgccgucacagaacucaauggccaagucuacgaccccuucggcgaccaacccgccccccuaggcguacccgacuucaaagcccgcauacuaggcgcccuaaugagacugcccggcacaaauccaaccuccaacucccgcuucgaggacgccugggucgaaaccaacaaucaaaccaccuacgccccagcugccggcguugucgcaaucacaaccaacgacaacuccucuuccaacuacgccaacgaccaaaccugcgaguucgucccacucggaauagaaaucacugacuccgcccccuaucaugaauucgaccuacccuccuauggcggagccgcauccuccggcaaccgaaaccucgcaccuacaguagcacccaccuuccccggcgaagccauacuccucuucggauccaacaugcccgucuacaaccguaacaccggcacauccaacaaagauauacgcugccuacuaccaaacgaauacguccaacaucuuuaugacacccaagcccccucccucuccgacgucgcccucguccgcuaugucaaucgcgacacuggccgaguccuauuugaagcaaaacuucaccgcgacggauucaugacuguaaacgccuccucuacaaccguccucccuguugacggcuacuuccgcuucgauuccugggucaaccaauucuacgcucuuuccccaguggguaacgcauccggccgacgcggccgaucccgccaaacaaacuga

SEQ ID NO: 37015 - RNA, 1623 nt, Artificial Sequence
  derived and/or modified sequence opt11 from capsid_protein__Norovirus__AFJ24945
augaaaauggcauccaacgacgccaaccccuccgacggcucugccgccucccucguacccgaaguuaacaacgaaguaauggcccuggaacccgucguaggagccgccaucgcagcacccgucgcaggacaacaaaacgucauagaccccuggauccgcaacaacuucguccaagcccccggaggagaguucacaguaucaccuagaaacgcacccggcgaaauccucugguccgccccacuuggcccagaucucaaccccuaccuaucccaccuugcccgcauguacaacggauacgccggcggcuucgaaguccaggucauccucgccggaaacgccuucaccgcaggaaaaaucauauucgccgcuguaccucccaauuuccccaccgaaggccuuuccccaucucaaguaaccauguucccacacaucauagucgacguccgccaacuagaacccguucucaucccucucccagauguccguaacaacuucuaccacuacaaccaauccaacgacuccacaaucaaacuaaucgcgaugcuuuacacuccccuccgcgccaacaacgccggcgaagauguauucacaguaagcugccggguccucacccgacccuccccagacuucgacuuuaucuuccucguucccccaacagucgaaucccgcaccaaaccauucacggucccuauccuuacagucgaagaaaugacaaacucacgauuccccaucccccucgaaaaacucuucaccggccccucauccgccuucguaguccaaccucaaaacggccgcugcaccacagacggcguccuucucggcaccacccaacuguccccagucaauaucugcacuuucagaggcgacguaacacacaucgccggcucccgaaacuauacuaugaaccucgccucccucaacuggaacaacuacgaccccacagaagaaauacccgcaccccuaggcacccccgacuucgucggaaaaauucaaggaguccuuacccaaaccaccaaaggagacggauccacacgcggccauaaagccaccgucuacacgggcucagcccccuucacacccaaacuaggcuccguccaauucucuaccgacaccgaaaacgacuucgaaacccaccaaaacaccaaauucacccccguaggcguuauccaggacggcagcaccacucacagaaacgaaccccagcaguggguccuuccauccuacucaggcgguaacguccacaacguucaucucgcccccgccgucgcccccaccuuccccggcgaacaacuccucuucuuccgauccaccaugcccggcugcucaggcuaccccaauauggaccuggacugccuccucccgcaggaauggguacaacauuucuaccaagaagccgcccccgcacaauccgaugucgcucuccuacguuucguaaacccagacaccggccguguccuauucgaaugcaaacuccauaaauccggcuauguaaccguggcccauacaggacaacaugaucucgucaucccuccaaacggcuacuuccgauucgacucaugggucaaucaauucuacacacuugccccaaugggcaacggcaccggccgacgccgagcccucuaa

SEQ ID NO: 37016 - RNA, 1638 nt, Artificial Sequence
  derived and/or modified sequence opt11 from capsid_protein__Norovirus__AFK75851
augaugauggccucaaaagacgcacccccaaacauggacggcacauccggagccggccaacucguccccgaagccaacacagccgaaccaaucucaauggaaccaguagccggcgcagccaccgcagcagcaaccgcaggccaaguaaacaugaucgacccauggaucaugaacaacuacguccaagcaccccaaggcgaauuuaccaucucccccaacaacacaccaggagacauccucuucgaccuacaacuaggcccacaccuaaaccccuuccucucucaccucgcucaaauguacaacggcuggguuggcaacaugaaagucaaaguccuccucgccggcaacgccuucaccgcuggcaaaauaauuaucuccugcaucccaccaggauuugccgcccaaaauaucagcaucgcccaagcaacaauguucccccacgucaucgcagacguccgcguacucgaacccauagaaguaccccucgaagacguccgaaacguucuuuuccacaacaaugacaacacuccaaccaugcgacucgucugcaugcuauacacaccccuccgcgccagcgguuccucauccggcaccgaccccuuugucaucgccggucgcguucuaaccugccccuccccagacuucucuuuccuauucuuaguacccccaaacgucgaacagaaaaccaaacccuucuccguccccaaccuuccccucaauacccucuccaacucccgcguccccucacuaauccgcucgaugauggucucccgcgaccacggacaaaugguacaauuccaaaauggccgcgucacccucgacggccaauuacaaggcaccacccccaccuccgcuucccaacugugcaagauccgcggcuccgucuuccacgccaacggcggcaacggcuacaaccucaccgaacucgacggcuccccauaccacgcauucgaauccccagcucccaucggcuucccugaccucggagaaugcgacuggcacauggaagccuccccuacaacacaauucgacaccggagacgucauaaaacagaucaacgucaaacaagaagccgcuuucgccccacaccucgguacaauccaagccgacggccucuccgauguauccgucaacaccaacaugauugccaaacucgguugggucucacccgucucagacggccaccgcggauccgucgacccaugggucaucccaagauauggcuccacccuaaccgaagcagcccaacucgccccaccaaucuacccacccggcuucggagaagcaaucguguucuucauguccgacuuccccauagcucauggcgccaacggccuauccguccccugcaccaucccccaagaguucgucacccacuucgucaacgaacaggcuccaacucguggcgaagccgcacugcuccacuaccucgacccagauacccaccgaaaccuaggagaguucaaacucuacccagaaggcuucaugaccugcguccccaacuccucagguaccggcccacaaacauuaccaaucaacggagucuucgccuuuguuuccugggucucacgcuucuaccaacucaaacccguuggcaccgccggccccgcacgacgccucggaauacgccgcuccuga

SEQ ID NO: 37017 - RNA, 1635 nt, Artificial Sequence
  derived and/or modified sequence opt11 from capsid_protein__Norovirus__AFK75852
augaugauggccuccaaagaugcaacccccuccgcagacggcgccacuggcgccggccaacucguacccgaagucaacaccgccgacccaauuccaaucgaucccguagccgguuccuccacagcccucgccaccgcaggccaaguaaaccucauugacccuuggauaaucaacaauuucguucaagcuccccaaggagaguucaccaucucacccaacaacacccccggcgacguacucuucgaccuccaacuaggcccucaucucaaccccuuccucucucaccucucccaaauguacaacggauggguagguaacaugcgcguccgaguaguccucgcaggaaacgcauuuaccgccggcaaagucaucaucugcugcguaccgcccggcuuccaaucacgcacccucuccaucgcacaagcgacacucuucccccacgucaucgcggacgugcgcacguuagaccccgucgaagucccccuugaagacguuagaaacguacucuaccacaacaacgacacccaaccaaccaugcgccuccucugcaugcucuacaccccacuccgcaccggcggcgccucaggcggcacagacuccuucgucgucgcaggccgagucuuaacaugcccaggacccgacuucaauuuucucuuccucgucccgcccacuguagaacagaaaacccgacccuucaccguccccaacauaccccucaaauacuuaucaaauucucgcaucccuaaccccaucgaaggcaugucucucucuccggaccaaacccaaaacguccaauuccaaaauggccguugcaccaucgacggccaaccccuaggcaccaccccagucuccgucucccaacuaugcaaguuccgaggacgcauuacuuccggacaaaaaguccucaaccucacugaacucgacggcucgcccuuuauggccuucgcugcccccgcccccgccggcuucccagaccucggcucaugcgacuggcacaucgaaaugagcaaaauccccaacucauccacacaauccaacccuaucguugucaacuccgucaaaccaaacucccagcaauucguaccccaccucuccucaauuacccucgacgacaacgucucuuccgguggcgacuacaucggaacaauccaauggacauccccaccuuccgacuccggcggugccaacacaaauuucuggaaaaucccagacuacgguuccucacucgccgaagccagccaacucgcacccgccgucuaucccccaggcuucaacgaaguaaucguauacuucauggccucaauccccggccccaaccaaucaggcagccccaaccucgucccuugccuccucccucaagaauacaucacccacuucauaagcgaacaagccccaauacaaggcgaagcagcacuccuccacuacgucgacccagacacaaacagaaaccuaggagaguucaaacuauacccaggcggauaccuaaccugcguucccaacuccucaagcaccggcccacaacaacucccccucgacggcgucuucgucuuugccuccuggguuucacgcuucuaccagcucaaaccgguaggcaccgccggccccgcgcgcggccgccuaggcguacguagauaa

SEQ ID NO: 37018 - RNA, 1641 nt, Artificial Sequence
  derived and/or modified sequence opt11 from capsid_protein__Norovirus__AFK75853
augaugauggcaucaaaagacgccagccaaucagcagacggcgccuccggagcaggccagcucguccccgaagucaacacagccgacccccuucccauggaacccgucgcaggccccacaaccgccguugccacagccggccaagucaauaugaucgaccccuggaucgucaacaacuucguccaaucgccccaaggagaguucacaaucagccccaacaacacccccggggacauacuauucgaccuacaacucggcccccaccucaacccauucuuaucccaccucucacagauguacaacggcuggguuggaaacaugcgcguacgcauccuacuugccgguaacgccuucuccgcagggaaaaucaucgucugcugcgucccgcccggguucaccucauccucccuaaccauagcucaagccacccucuucccccacgucaucgccgacgucaggacccucgaacccaucgaaaugccccuugaagacguccgaaacguacuauaccacaccaacgacaaccaaccaaccaugcgccuaguauguaugcucuacacgccccuucgcaccggcggcgguucgggaaacagcgacuccuucgucgucgccggccgcguacucaccgcccccaguucugacuucuccuuccucuuccucgucccacccacaauagaacagaaaacccgagccuucaccguucccaacaucccccuacaaacccucuccaauucccgauuccccucccuuauccaaggcaugauccucucgcccgaugccucacaaguaguccaauuccagaacggccguugccucauagacggacaacuccuuggcaccacgcccgccaccuccggacaacucuuccgaguccgcggaaaaaucaaccagggcgcccgcacccucaaccucaccgaaguagacggcaaacccuucauggcauucgacucccccgccccaguuggauucccagacuucggcaaaugcgacuggcauaugcgcauaagcaaaacacccaacaacaccucaucaggagacccaaugcgcucagucucaguacaaacaaauguacaaggcuucguaccccaccuaggcuccauccaauucgacgaagucuucaaccaccccaccggcgacuacaucggcacaaucgaauggaucucccaaccaucgacaccacccggcacagacaucaauuuaugggaaauacccgauuauggaucuucccuaucccaagccgccaaucuggcaccacccgucuucccucccggcuucggcgaagccuuagucuacuucguauccgccuuccccggccccaacaaccgcuccgcccccaacgacguccccugucuacucccccaagaauacauaacccacuucgucucugagcaagccccuaccaugggcgacgccgcccuucuccacuacgucgacccugacaccaaccgaaaccuaggugaguucaagcucuaccccggcggauaccuuaccugcguaccuaacggcguuggcgcaggcccgcaacaacucccacucaacggcgucuuccucuucgucucaugggucucacgcuucuaucagcuaaaaccaguuggcaccgcuucaaccgcccgaggucgacuaggaguaagaagaaucuaa

SEQ ID NO: 37019 - RNA, 1647 nt, Artificial Sequence
  derived and/or modified sequence opt11 from capsid_protein__Norovirus__AFK75854
augaaaauggcauccaacgacgcagcucccuccaacgacggcgcagccggccucguccccgaaaucaacaacgaggccauggcccuugauccaguagccggcgcagcuaucgccgcgccacucacugggcaacaaaacauuauagaccccuggaucaugaauaacuucguccaagcacccggcggcgaguucaccgucucaccccgcaacucaccaggcgaaguacuacucaaccucgaacucggccccgaaaucaaccccuaccuagcccaccucgcucgaauguacaauggcuacgccggcggcuucgaaguccaaguuguccuugccggcaacgccuucaccgccggcaaagucaucuucgcagcuauaccacccaacuuucccauugacaaccucucugccgcccaaaucacuaugugcccccacgucauagucgacguaagacaacuugaacccaucaaccuccccaugcccgacguccgcaacaccuucuuccacuacaaccaagacucggacucacgccuucgucucauagccaugcucuacacuccccugcgcgcuaacaacucaggcgacgacgucuucaccgucuccugccgcguccuuacucgccccucaccugacuucucauucaacuuccucguaccucccaccgucgaaucaaagaccaaacucuucacccuucccauccuaaccauauccgaaaugucaaacucacgauucccuguaccaauagacucccuccacacaucacccacugaaaacauagucguacaaugccaaaauggccgcgucacacucgacggcgaacucauggguaccacucaacuccucccaucccaaaucugcgccuuccgcgguacacucacccgcuccacaucacgcgcuucagaccaggccgacacccccacaccacgucucuucaaucaccgcuggcacauccaacuugacaacuuaaacgguaccccuuacgauccagccgaagacauccccgcaccacuaggcaccccugacuuucgcggaaaagucuucggaguggccucccaacgaaaccccgauuccaccacccgcgcacacgaagccaaagucgacacaaccuccggccgcuuuacccccaaacuaggcucccuagaaaucaccaccgaauccgacgacuucgacaccaaccaguccacaaaauucacccccgucggcaucgguguggacaaugaagccgaguuccaacaauggucacuacccaacuacucaggccaauucacccacaacaugaaccucgccccagcagucgcccccaacuuccccggcgaacaacuccucuucuuccgaucucaacuccccuccucuggcgguugguccaacggaguacucgacugccucgucccccaggaauggguccaacacuucuaccaagaauccgccccagcccaaacccaagucgcccuaguucgcuacgucaacccugacaccggccgcguucucuucgaagcaaaacuccacaaacucgguuucaugacaauagcaaagaacggcgacucacccaucaccgucccacccaacggcuacuuccgcuuugagagcugggucaaccccuucuacacccucgcacccaugggcaccggcaacggucgacgacgaauccaauaa

SEQ ID NO: 37020 - RNA, 1671 nt, Artificial Sequence
  derived and/or modified sequence opt11 from capsid_protein__Norovirus__AFN61315
augaaaauggcaucaucugaugccgcccccucagccgacggcgcaggcaaccuuguccccgaaucgcaacaagaagucuuaccacucgcaccaguagccggcgccgcgcucgccgcccccgucgucgggcaaaccaacaucaucgauccuuggaucaaagaaaauuucguacaagccccucaaggagaguucaccgucucccccaagaacucccccggagaaauccucgucaaccuggagcuaggccccaaacucaacccuuaccuggaccaccucucccgcauguacaacagcuacgcaggcgguaucgacgucaugguaguccuagccggcaacgcauucaccgccggaaaaguccucauagccgccauaccucccaauuuccccgucgaaggcgucuccgccucacaagccacacaauucccucacgucauuaucgacgucagaacccuagaccccguucgccucccucucccugacguccgauccaccuucuuccauuacacuaacgacaccgaacccaaaaugcgccucgucaucuggcucuacaccccacuccguacaaacggcuccggcgacgacucauucaccguuucaggacgcauccuuacccgacccucccaagauuucgaguuugccuuucuaaucccaccaacaguagaaaccaaaaccacccccuucucagucccaggcuucuccguccaagaaaugagcaacucccguuggcccgcugccauuucagcaauggucguccgaggcaacgaaccucaaguuguccaauuccaaaacggccgugcacaccuagacggcaugcuccucggcaccaccccuguuuccccaaacuacauagcuagcuaccgaggcauaagcaccggcaauucacgcucagccuccucagaagccgacgaacgcgccgugggcagcuucgacgucuggauacgccuucaagaacccgacggacaaccauacgacauuuucggcaaacaaccagcaccaaucggcacccccgacuucaaagcuguaaucguaggcuucgcugcccgaccccucaccuccggcucauacgcaaacgaagcauacguaaacaccacagccuccgacuacgccccugccaccggcaacaugcgauuuaccguccgcaacggaggcacaggucacaucuccgccaacaaauacugggaauuucgcucauucggagucgaaggcgaacgccacaccgacguccaauaccaagaauaugaacuacccgacuacuccggccaagucgccuccaaccacaaucuugcaccucccgucgcaccccgaaugcccggagaaucccuacuccuguuccaauccaauaugcccgucugggacgacggccgcggcgaauccaccccaaagaaaauccacugccuacucccacaagaguucaucggccauuucuucgacaaacaagcccccagccucggcgacgccgcccuccuccgauacgucaaccaagaaaccaaccgcguacucuucgaaugcaaacuguaccgcgacggcuacaucaccguagcagccgccucaggccuccuagacuucccccuggacggcuucuuccgcuucgacucaugggucagcuccuucuacauccuaucucccgucgggucaggccaaggucgucgaggacgaguccgauuucaauaa

SEQ ID NO: 37021 - RNA, 1623 nt, Artificial Sequence
  derived and/or modified sequence opt11 from capsid_protein__Norovirus__AFQ00511
augaaaauggcaucaaacgaugcaaaccccuccgacggcuccgccgccaaccucguccccgaagucaacaaugaaguaauggcucucgaacccguaguuggagcugccaucgccgcccccgucgcuggccaacaaaacgucaucgacccauggauccgaaacaacuucguccaggcacccgguggagaguucaccguaucccccagaaacgccccaggcgaaauacugugguccgccccacucggccccgaccuuaaccccuaccuaucccacuuagcccgaauguacaacggauacgccgguggauucgaaguacaagucauacuggcaggcaacgccuucaccgcaggcaaaauuauuuucgccgcagugccucccaacuuccccacagaaggccuuagccccucccaagucaccauguucccccacaucaucguagacguucgacaacucgaacccguccuuaucccccucccugacguccgaaacaacuucuaccacuauaaccaauccaacgacucaaccaucaaacuuaucgccaugcucuacacuccccuacgcgccaacaacgccggcgaagacgucuucaccguaucaugccgcguccuaacccgccccucaccugacuuugacuucaucuuccucgucccucccaccguagaaagccgcaccaagccuuuuacaguccccauccuuaccgucgaagaaaugaccaauucacgcuucccaaucccucucgaaaaacucuucacgggacccucauccgcauucgucguccaaccccagaacggccgcugcaccacagacggcguacuacucggcaccacucaacucucccccgucaacaucugcaccuuucgaggagacguaacacacaucgccggaucacgaaacuauaccaugaaccuagccucucucaacuggaacaacuacgaccccacugaagaaauccccgccccgcuuggaacaccagacuucgucggcaaaauacaaggcguucuaacccaaacuacaaaaggugacgguuccacccgcggccacaaagccaccgucuauaccggcucagcccccuucacccccaaacuaggcucaguccaauucucgacagacacagaaaacgacuucgaaacucaccaaaacaccaaauucaccccagucggcguaauccaagacggcggcaccacccacagaaacgaaccccaacaguggguucuccccuccuacucuggucgcaacgucccuaacguccaccucgcaccagcgguugcccccaccuuccccggcgaacaacuccuauucuuucgcuccacuaugccaggcuguucgggcuacccgaacauggaccuagacugccuacucccacaagaauggguacaacacuucuaucaagaggccgcacccgcccaaucagacgucgcacuacuacgcuucguaaaccccgacacaggccgcguccucuucgaaugcaaacuccacaaaucaggauacgucaccguagcccacacuggccaacacgaccuaguaaucccacccaacggcuacuuccgcuuugacuccuggguuaaccaauucuacacccucgcccccaugggaaacggcaccggucgccgucgaguacucuga

SEQ ID NO: 37022 - RNA, 1623 nt, Artificial Sequence
  derived and/or modified sequence opt11 from capsid_protein__Norovirus__AFQ00512
augaaaauggcauccaacgacgccaaccccuccgacggcucugcagcaaaccucguacccgaagucaacaacgaagucauggcccucgaacccguggucggcgcugccaucgccgcacccgucgcuggccaacaaaacguaauugaccccuggauccgaaacaacuuuguucaagcccccggcggugaauuuacugucaguccacgcaacgcaccuggagaaauccuuugguccgcaccacucgguccagaccucaacccauaccucucccaccucgcccgcauguacaacggcuacgccgguggcuucgaagugcaagucauccucgccggaaacgccuucaccgccggcaaaauaauauucgcugcugucccacccaacuuccccacagaaggacucucucccucccaggugaccauguucccucacauuauagucgacguacgacaacucgaaccgguccucauuccacuuccagauguccgcaacaacuucuaucacuacaaucaauccaaugacucgacaaucaaacucauagccaugcucuacacccccuuacgcgccaacaacgccggcgaagacgucuucaccgucuccugccguguccucacccgccccucccccgacuucgacuucauuuuccuaguucccccaaccgucgaaucccgaacaaaacccuuuaccguccccauccuaaccguagaagaaaugaccaacucucgcuuccccaucccccucgaaaagcuauuuaccggucccucauccgcauucgucguacagccacaaaacggccgcugcaccacagacggaguccuccucggcaccacccaacucucaccaguaaacaucugcacauucagaggcgacguaacccacauagcaggcucccgcaacuacaccaugaaccucgccucccucaacuggaacaacuacgauccaaccgaagaaauccccgcaccccuaggcacacccgacuuugucggaaaaauacaaggcguacucacacaaaccaccaaaggcgacggcagcacccguggacacaaagccacgguauacaccggcucugccccauucacccccaaacuaggcuccguccaauucuccaccgacaccgaaaacgacuucgaaacucaccaaaacaccaaauucacacccgucggggucauacaagacggcggcaccacccaccgcaacgaaccccaacaauggguccuaccuucauacagcggacgcaacguccccaacguacaccuugcacccgccgucgccccgacauucccaggugaacaacuacucuucuuccgcucaaccaugcccggcugcucaggcuauccaaacauggaccuagacugccuacucccucaagaauggguucaacacuucuaccaagaagccgcccccgcucaauccgacgucgcccuccuccgcuucgucaaccccgacaccggccgcguacuuuucgaaugcaaacuucacaagucuggauacgucaccgucgcacacaccggccaacacgaccuaguaauuccuccaaacggcuacuuccgauuugacuccuggguuaaccaauucuacacccucgccccaaugggcaacggcaccggccgccgccgcgcccucuaa

SEQ ID NO: 37023 - RNA, 1623 nt, Artificial Sequence
  derived and/or modified sequence opt11 from capsid_protein__Norovirus__AFQ00513
augaaaauggccuccaacgacgcaaaccccuccgacgguuccgccgcaaaccucguacccgaagucaacaacgaagucauggcacucgaacccgucguaggcgccgccaucgccgcccccgucgcaggacaacagaaugucauagaccccuggauucgcaacaacuucguccaagccccaggcggcgaauuuaccguuucaccacgcaacgccccuggagaaauccucugguccgccccucucggccccgaccucaaccccuaucuaucccaccucgcccgcauguacaaugguuacgccggcggcuucgagguucaagucauucuugccgguaacgccuucaccgcaggaaaaaucauuuucgccgcagucccucccaacuuccccacagaaggccucucccccucacaagucacaauguucccccacaucauaguagacguacgucaacuugaacccgugcuuauuccccuccccgacguacgaaacaacuucuaccacuacaaccaauccaacgacucaaccaucaagcucaucgcaaugcuauacacuccccuacgagccaacaacgccggcgacgacgucuuuaccguauccugccgcguacuaacccgacccagcccagauuucgacuucauuuuccucguuccucccaccgucgaaucaagaaccaaacccuucaccguccccauccucaccguagaggaaaugacaaacucccgcuucccgaucccccuggaaaaacuuuucacaggccccucuucagccuucgucguccaaccccaaaacggucgaugcaccaccgacggcguacuccuaggaaccacccaacucucacccgucaacaucugcaccuuucgcggugacguaacccacauagcuggcucacgcaacuacacaaugaaccucgcuucacucaacuggaacaacuacgaccccaccgaagagauccccgccccacuaggaaccccagacuucguaggaaaaauacaaggaguccuuacccaaaccacaaaaggcgauggcuccacccgcggccacaaagcaaccgucuacacuggaucagcccccuucaccccaaaacucggcucaguucaauucucaacagacaccgaaaacgacuucgaaacacaccaaaacaccaaguucacacccgucggagucauccaagaugggucgacuacccaccgaaacgaaccacagcaauggguacuccccuccuacuccggccgcaacguccaaaacguacaccuggcccccgcagucgcccccaccuucccaggugagcaacuauuauucuuccgcucaaccaugccaggcugcuccggcuaccccaauauggaccucgacugccuacuaccccaagagugggugcaacacuucuaccaagaagcagcacccgcccaauccgacgucgcccucuuacgcuucgucaaccccgacaccggccgcguccucuucgaauguaaacuacacaaaucaggauacgucaccgucgcccacacaggccaacacgaccucguaaucccacccaacggcuacuuccgauucgacucaugggucaaccaauucuacacucucgcccccaugggcaauggaaccggacgacgacgcgcacucuaa

SEQ ID NO: 37024 - RNA, 1623 nt, Artificial Sequence
  derived and/or modified sequence opt11 from capsid_protein__Norovirus__AFQ00516
augaaaauggcuuccaacgacgcaaaccccuccgacggcuccgccgccaaccucguacccgaggucaauaaugaagucauggcccucgaacccgucgucggugcggccaucgccgcccccgucgccggccaacaaaaugucauagaccccuggauccgcuccaauuucguccaagcacccggcggggaguucacugucuccccaagaaaugcaccgggagaaauccucugguccgcuccacucggcccagaccucaacccauaccucucccaccuagcacguauguacaacggcuacgcuggcgguuucgaaguucaaguaauacucgcuggcaacgccuucaccgcgggaaaaauaaucuucgcagccgucccucccaacuuccccacagaaggccuuucacccucccaggucacaauguucccccacauaaucgucgacguccgccagcucgaaccaguccuaauuccccuccccgauguccgaaacaacuucuaccacuacaaccaauccaacgacuccacaaucaaacucaucgcaaugcuuuacacuccccuacgagccaacaacgcuggagaagacgucuucaccguauccugccgcguccuuacccgccccaguccagacuucgacuucauauuccuuguucccccaacugucgaaucacgcaccaaacccuucaccgucccgauccucaccgucgaagaaaugacaaacucacgcuucccaaucccacucgaaaaacucuucaccggacccuccucugcauucgucguacaaccccaaaacggacgaugcacuacggacggcguacuccucggaaccacgcaacuaucaccgguaaauauaugcacauuucgcggagaugucacccacauagcaggcucccgcaacuacaccaugaaccucgcaucccucaacuggaacaacuacgacccaaccgaagaaaucccggccccucuuggcacccccgacuucgucgguaaaauucaaggcguccuuacacagaccacaaaaggggacggauccacccgcggccacaaagcaaccguauacaccggcuccgccccauucacccccaaacucggguccguccaauucggcacagacacagaaaacgauuucgaaacucaccaaaacaccaaauucacccccguaggugucauccaagacggaggaacaacacaccgcaacgagccccaacaauggguccuacccuccuauucuggucgcaacguaccgaacguccaccuagcccccgcggucgcaccaaccuuccccggcgaacaacuccucuucuuccgcagcaccaugcccggcugcuccggcuacccaaacauggaccucgacugccuccucccccaagaauggguccagcacuucuaccaagaagcagcccccgcccaaucugacguagcccuccuccgauuuguaaaccccgacaccggcagaguccuauucgaaugcaaacuccacaaaucaggauacgucaccgucgcccacaccggccaacacgaccuuguaaucccacccaauggcuacuuccgauucgacucgugggucaaccaauucuauacacucgcacccaugggcaauggaacuggccgucgacgcgcccuauaa

SEQ ID NO: 37025 - RNA, 1623 nt, Artificial Sequence
  derived and/or modified sequence opt11 from capsid_protein__Norovirus__AFQ00517
augaagauggccuccaacgacgccaaccccucagacggauccgcagccaaccucguccccgaagucaacaacgaaguaauggcacucgaacccgucgucggagccgcaaucgccgccccagucgcaggccaacagaacgugauagacccauggauccgcaacaauuucguucaagccccagguggagaauuuaccgucuccccacgcaaugcccccggcgaaauccugugguccgcaccccucggccccgaccuuaacccauaccucagccaucucgccagaauguacaacggcuacgccggcgguuucgaaguucaagucauccucgccggcaacgcauucaccgcuggaaaaaucaucuucgccgccgucccucccaacuuccccacagaaggacucucccccucccaagucaccauguucccccacauaauaguugacguccggcaacuugaacccguccucauccccuuacccgacguacgcaauaauuucuaccacuacaaccaauccaacgacuccaccauaaaacugauagcaaugcuauacacaccccuccgcgcaaacaacgccggagaagacguguuuaccgucagcugucgcguccucaccagaccaucccccgacuucgacuucauauuccucgucccuccaaccgucgaaucccgcaccaaaccauucaccguucccauccuuaccguagaagagaugaccaauucucgcuuucccauaccccuagaaaaacucuucaccggcccaucaucugcauucgucguacaaccacaaaacggccgcugcaccaccgacggcguacuccucggcaccacccaacucucacccgucaacaucugcaccuuucgcggcgacgucacccacaucgcuggcucucgcaacuauacaaugaaccucgccucccuuaacuggaauaacuacgacccgacugaggaaauccccgcgccccucggaacuccagacuucgucggcaaaauacaaggcguccucacccaaaccaccaaaggcgacggcuccacaagaggccacaaagccacugucuacacaggcuccgcccccuucacccccaaacuaggauccguacaauucuccaccgacacagaaaacgauuucgaaacccaccaaaauaccaaauucacacccgucggcgucauacaagacggcggcaccacccaccgaaacgaaccacaacaauggguacugcccuccuacagcggccgaaacgucccaaacguccaccucgcccccgcuguagcgccaaccuucccuggcgaacaacuacuuuucuucagauccacuaugcccggcugcucaggcuaccccaacauggaccucgacugccuccuaccccaagaauggguccaacacuucuaccaagaagccgcuccagcccaauccgaugucgccuuacuccgauucguaaacccagacaccggccgaguccucuucgaaugcaaacuccacaaauccggcuacgucacugucgcccacaccggccaacacgaccucgucaucccucccaacggcuacuuccgauucgacucauggguaaaccaauucuacacccucgcccccauggguaacggcacaggccgucgucgagcccucuaa

SEQ ID NO: 37026 - RNA, 1623 nt, Artificial Sequence
  derived and/or modified sequence opt11 from capsid_protein__Norovirus__AFQ00518
augaaaauggccucuaacgaugccaacccauccgacggaagcgccgcaaaccucgucccagaagucaacaacgaagucauggcgcuagaaccagucgucggugccgccauagccgcccccgucgccgggcaacaaaacguaaucgacccauggauccgcaauaacuucguccaagcucccggaggagaguucacaguuucgccccgaaacgccccaggagaaauucuaugguccgcgccauuaggccccgaccucaaccccuacuuaucccaccuagcacgcauguacaacggcuacgccggggguuuugaaguccaggucauacuagcaggcaacgcauucaccgcuggaaagaucauauucgcagccguacccccaaacuuccccaccgaaggacucucccccucacaagucaccauguucccccacaucaucgucgacgucagacaacuagaacccguacuaaucccccuccccgacguccgcaacaacuucuaccauuacaaccaauccaacgacucuaccaucaaacucaucgcaaugcuauacaccccacuccgagccaacaacgcaggcgaagacgucuucaccgucuccugccgcguacuaacccgacccucccccgacuucgacuucaucuuccuaguaccaccaaccguagaaucccgcaccaaaccauucacaguuccgauccucaccguagaagaaaugaccaacucacgauuucccauuccccucgaaaaacucuucacagguccaucauccgccuucgucguacaaccccaaaacggacgcugcaccaccgacgggguccuucuaggaacuacacagcucucccccgucaacauuugcaccuuucgcggcgacgucacucacaucgccggaucucggaacuacacaaugaaccuagcaucccuaaacuggaacaauuacgacccaaccgaagaaaucccugcaccccuaggcacacccgauuucguuggcaaaauccaaggaguccugacucaaaccaccaaaggcgacggcuccacccgcggccacaaagcuaccguauauaccgguagcgcacccuucacacccaaacuaggcucaguccaauucuccaccgacacagaaaacgacuucgagacccaccaaaacacaaaauucacccccguaggagucauccaagacgguggaaccacccaccguaacgaaccgcaacaauggguucuucccuccuacuccggccgcgacguaccuaauguucacuuagccccugcggucgccccaacuuuucccggcgaacagcuccuauucuuccgcucaacaaugccaggcugcucaggcuaccccaacauggaccuagacugccuacuuccacaagaauggguacaacacuucuaccaagaagccgcccccgcccaaucagacgucgcccuccucagauucgucaaccccgacacaggccgaguccuuuucgaaugcaaacuccauaaaucaggcuacgucaccgucgcccacaccggccaacacgaccucguaaucccaccaaacggcuauuuccgcuucgacucuuggguuaaccaauucuacacacucgcacccaugggcaacggcaccggccgccgacgcgcccucuaa

SEQ ID NO: 37027 - RNA, 1623 nt, Artificial Sequence
  derived and/or modified sequence opt11 from capsid_protein__Norovirus__AFQ00519
augaaaauggccucaaacgacgccaaccccuccgacggcuccgcagccaaccuaguccccgaagugaacaacgaagucauggcccuagaaccagucgucggcgcagcaauugcagcccccguagccggccaacagaacguaaucgaccccuggauccggaacaacuucguacaagcacccggaggugaguucaccguuagcccacgaaacgcccccggcgaaauacucuggucagcaccccuagguccugaccucaacccauaccucagccaccucgcccguauguacaacggcuacgccggcggcuucgaaguccaagucauccucgccggcaacgccuucacagccggcaagaucaucuucgcagcagucccacccaacuuccccacagaaggacucucucccagccaaguaaccauguuuccccacaucaucgucgacguacgccaacucgaacccguacucaucccacuacccgacguucgcaacaacuucuaccacuacaaccaauccaacgacuccacgaucaaacuaauagcaaugcucuacacgccccucagagcaaacaacgcgggagaagacguauucaccgucuccugccgcguucucaccaggcccucaccagacuuugacuucaucuuccuuguucccccaaccgucgaaucaagaaccaaacccuucaccgucccaauacucaccgucgaagaaaugaccaacucacgcuuccccaucccccucgaaaaacucuucaccgguccuuccuccgcauucguaguccaaccacaaaacggccgcugcacaaccgacggcguccuacuaggcacgacccaacuauccccuguaaacaucugcaccuuccgaggcgacgucacccacaucgcaggcucccgcaacuacaccaugaaccucgccucacuaaacuggaacaacuacgaccccaccgaagaaauuccggcaccccucggcacacccgacuucguaggaaagauacaaggcguacucacccaaaccacccgcggcgauggcucuacccgaggccacaaagccaccguuuauaccggcucagccccauucaccccaaaaaugggcagcguccaauucuccaccgacaccgaaaaugauuucgaaacacaucaaaacaccaaguucacccccguaggcguuauccaagacggcggcaccacccaccgcaacgaaccacaacaauggguacucccuucauacucaggcagaaauguacccaacguacaccucgcccccgccguagcccccacauucccaggcgaacaacuccucuucuucagaucaacaaugccaggcugcaguggcuaccccaacauggaccucgacugccuucucccccaagaauggguacagcacuucuaccaagaagccgcuccugcccaaucugacguugcccuacuccgguucgucaaccccgacaccggccgaguauuauucgaaugcaaacuucacaaaagcggauacguaaccguagcacacaccggccaacacgaccucgucauucccccaaacggcuacuuucgcuucgacucaugggucaaccaauucuacacccucgcccccaugggaaauggaaccggacgccgccgcgcacucuaa

SEQ ID NO: 37028 - RNA, 1623 nt, Artificial Sequence
  derived and/or modified sequence opt11 from capsid_protein__Norovirus__AFQ00520
augaaaauggccuccaacgacgccaaccccuccgacggcagcgccgcuaaccucguccccgaaguaaauaacgaaguaauggcacuugaaccagucgucggagccgccaucgccgcccccgucgccggacaacaaaacgucaucgaccccuggauccgcaauaacuucguccaagcccccgguggagaguucaccguuucuccccgcaacgcccccggcgaaauccuaugguccgcaccccucggucccgaccucaaccccuaccuaucccaccucgcgcgcauguacaacggcuacgccggcggauucgaaguccaagucauccuagccggcaacgccuuuacagcaggcaaaaucaucuucgccgcugucccucccaacuuccccacagaaggccuguccccuucucaagucaccauguucccccacaucauugucgauguccgacaacucgagcccgucuuaauccccuuacccgauguccgcaacaacuucuaccacuacaaccaauccaacgauaguaccaucaaacuaaucgcaaugcuuuacacaccacuccgcgccaacaacgccggagaagacguauucaccguuucaugccgcguccucacccgaccuuccccugacuucgacuucaucuuccucguacccccaacagucgaaucucgaacaaaaccuuucaccguuccuauucucacgguagaagaaaugacuaacagccgcuuccccaucccccuugaaaaacucuucaccggccccuccucagccuucguaguccaaccccaaaacggccgauguaccacagacggcguccuacucggaacaacacaacuuucccccgucaacauuugcacuuuccgaggcgacguaacccacauagcuggaucccgcaacuacaccaugaaccucgcuucccuaaacuggaauaacuacgacccaaccgaagaaaucccugccccacucggcacccccgacuucguaggcaagauacaaggcaugcuaacccaaaccacaaaaggggacggcuccacaagaggacacaaagcaaccgucuacaccgguuccgccccuuucacccccaaacucggcucaguccaauucuccacagacaccgaaaacgacuucgaaacccaccaaaacaccaaauucacccccgucggcgucauacaagacggcuccaccacccaucgcaacgaaccgcaacaauggguacuacccagcuacagcggccgcaacguaccaaacguccaccuugcccccgccgucgcccccaccuuccccggggaacaacuucuauucuuccgcucaaccaugcccggcugcagcggcuaccccaacauggaccucgauugccuccuaccacaagaguggguccagcacuucuaucaagaagccgcacccgcccaauccgacguagcccuacucagauucguuaaccccgacaccggccgaguccucuucgaaugcaaacuccacaaacccggauaugucaccgucgcccacaccggccaacacgaccucguaauaccacccaauggauacuuccgcuucgacuccugggucaaccaauucuacacccucgcacccaugggcaacggcaccggacgccgcagagcccucuaa

SEQ ID NO: 37029 - RNA, 1623 nt, Artificial Sequence
  derived and/or modified sequence opt11 from capsid_protein__Norovirus__AFQ00521
augaaaauggccagcaacgacgcaaaccccucagacggaagugccgcgaaccucguacccgaaguaaacaacgaagucauggcccuggagcccguaguaggcgccgccaucgccgcgcccguugcaggccaacaaaacguaaucgaccccuggauuagaaacaauuucguccaagccccuggaggcgaguucaccgucucccccagaaacgcccccggagaaauccuaugguccgccccacuuggacccgaccuaaaccccuaccucucccaucucgcccgcauguacaacggcuacgccggcggcuucgaaguccaagucauccucgccggaaacgccuuuacagccggcaaaaucaucuucgcagccguacccccuaauuuucccaccgaaggccucucccccucacaagucacaauguuuccacacaucauagucgacguccgccaacucgaaccagucuuaauuccccucccagauguccgcaacaacuucuaccacuacaaccaguccaacgacucaaccaucaaacuaaucgccaugcucuacaccccacuacgcgcaaacaacgcuggcgaagacgucuucaccgucucaugccggguacucacccgcccgucccccgacuucgacuucauauuccuaguacccccaaccgucgaaucccgaaccaaacccuucaccguccccauacucaccgucgaagaaaugacaaacucuagauucccaauuccacucgaaaaacucuucacgggaccauccucagcauucgucguccaaccccaaaacggacgaugcacaacagacgguguccuacugggcaccacccaacucagccccgucaacaucugcacauuccgcggugacgucacacacaucgcuggcucucgcaacuacaccaugaaccuagccagccucaacuggaacaacuacgaccccaccgaagaaauacccgcaccucucggaacaccagacuucgucggaaagauccaaggaguccuaacccaaaccaccaaaggcgacggcuccacccgaggccacaaggccaccgucuacacagguuccgcacccuucacccccaaacuaggcucaguccaguucagcacagacaccgaaaacgacuucgagacgcaccaaaacacuaaauucaccccagucggagucauacaagacggcggaacuacacacagaaacgaaccacaacaaugggucuuacccuccuacuccggacgaaacguccaaaacguacaccuagccccagccguggcacccacauucccaggcgaacaacuacucuucuuccgcucaacuaugcccggcugcuccggcuaccccaacauggaccucgacugccuccucccccaagaauggguccagcacuucuaucaggaagcagcccccgcacagucggacguugcccuucugcgauuugucaaccccgacacaggacgaguucucuucgaaugcaaacuccacaaauccggcuacguaacaguugcacacaccggccaacacgaccuagucauuccacccaacggcuacuuccguuucgacuccuggguuaaucaauucuacacccuagcccccaugggcaacggcaccggccgccgccgcguacucuaa

SEQ ID NO: 37030 - RNA, 1623 nt, Artificial Sequence
  derived and/or modified sequence opt11 from capsid_protein__Norovirus__AFQ00522
augaaaauggccuccaacgacgcaaacccuuccgacggaucagcagccaaccucguccccgaagucaacaacgaagucauggcccuugaaccagucgucggcgcagccaucgccgcgcccguggcaggucaacagaacguaaucgacccauggauccgcaacaacuucguccaagccccaggcggagaguucaccguaagcccccguaacgcccccggagaaauccucuggagugcaccccuuggucccgaccucaacccauaccucucucaucucgcucgcauguacaauggcuacgcgggcggcuucgaaguccaagucauccuugccgguaacgcauuuacagccggaaaaauaauauucgcagccguacccccaaauuucccaaccgaaggccucucccccucacaagucaccauguucccucacaucaucguagacguccgccaacuagagcccguccucaucccccuccccgacguaagaaacaacuucuaccacuacaaccaaucaaacgacuccacgauaaaacucaucgcaaugcucuauacaccccuacgcgccaacaacgccggcgaagacgucuucaccgucucaugccgcguucucacgagaccaucccccgacuucgacuucauauuccucguacccccaacuguugaaucacgaaccaaaccauuuacaguccccauccucaccguagaagaaaugaccaacuccagauuccccaucccccucgaaaaacuauucaccggacccuccucugccuucgucguccaaccccaaaacggacgcugcacaacagacggcguacugcuaggcaccacccaacucucacccguaaacauuugcaccuuccgcggagacgucacgcacaucgccggcucacgcaacuacacaaugaaccucgcaucccucaauuggaacaacuacgaccccacagaagagauaccagcaccccucggcacaccagacuucgucggcaagauacaaggaguacuaacacaaaccacuaaaggagacggcagcacacgcggacauaaagcuaccgucuauaccggauccgccccauuuacccccaaacucggcagcgugcaguucagcacagauaccgaaaacgacuucgaaacccaccaaaacaccaaauucaccccuguaggcgucauccaagacggagggacuacucaccgcaacgaaccccaacaauggguccucccauccuacagcggccgaaaugucccuaacguccaccuagccccagccgucgcaccuaccuuccccggagaacaacuccucuucuuccgauccaccaugcccggcugcucuggcuacccaaauauggaccucgacugccuucuaccacaagaauggguccagcacuucuaccaagaagcagcccccgcccaauccgacguagcccuacuccgcuucguuaaccccgacaccggccgcguacucuucgaaugcaaauuacacaaacccggauaugucaccgucgcccacaccggacaacacgaccuugucauaccuccaaacggauacuuccgcuucgacucaugggucaaccaauucuacacccucgcaccaaugggcaacggcacaggccgacgacgcgcccucuaa

SEQ ID NO: 37031 - RNA, 1623 nt, Artificial Sequence
  derived and/or modified sequence opt11 from capsid_protein__Norovirus__AFQ00523
augaaaauggccuccaacgaugccaaccccuccgacggcuccgcggccaaccucguacccgagguaaacaacgaagucauggcacucgaaccugucgucggugcagccaucgccgcacccguagccggccagcaaaacguaauagacccuuggauccgcaacaacuucguacaagcccccggcggcgaguucaccguaucaccccgcaacgcucccggugaaauccucugguccgccccgcucggccccgaccuaaaccccuacuuaucccacuuagcccgcauguauaacggcuacgcuggcggguucgaaguucaggucauccucgcagggaacgccuuuaccgcuggaaagaucaucuucgccgccgugcccccuaacuuccccacagaaggacucucccccucacaagucacaauguucccccacaucauagucgacgucaggcaacucgaacccguccucaucccccuccccgacguccgcaauaacuucuaccacuauaaucaaagcaacgacucaaccaucaagcucauagcaaugcuuuacaccccacuaagagccaacaacgcuggcgaagacgucuucaccgucuccugccgcguacucacccgucccuccccagacuucgacuucaucuuccucgucccaccaaccgucgaaucccgcaccaaaccauucaccguccccauccuaacaguagaagaaaugaccaacagccgcuuccccauaccccucgaaaaacuuuucacuggccccucaucagccuucguuguccaaccacaaaacggccgaugcacaacagacgggguccuccuuggcacuacacaacuuucacccgucaacaucugcacauuccgaggagacgucacacacaucgccggcucccgcaacuacaccaugaaccuagcaucacucaacuggaauaacuacgaccccaccgaggaaauacccgccccacucggcaccccagacuucguaggcaaaauccaaggcguccuaacccaaaccaccaaaggcgacggcucaacccguggucacaaagcaaccgucuacacgggcucugcccccuuuaccccaaaacucggcuccguacaauucucaacugacacggaaaacgacuucgaaacccaucaaaacacgaaauucaccccaguaggaguuauacaagauggcggcaccacccaccgcaacgagccccaacaauggguauuacccagcuacagcggacgcaacgucccuaacguccaccuagcccccgcaguagcccccaccuucccaggcgaacaacuucuauucuuccgaagcaccaugcccggcugcucaggcuacccuaacauggaucucgacugccucuuaccucaagaauggguccaacauuuuuaccaagaagccgcacccgcgcaauccgaugucgcccuccuacgauucgucaaccccgacaccggccgaguacuauucgaaugcaaacuccacaaacccggauacgucacaguagcacacacaggccaacacgacuuagucaucccaccaaacggcuacuuccgcuucgacagcugggucaaccaauucuacacucucgcccccaugggaaacggaacaggucgacgacgcgcccucuag

SEQ ID NO: 37032 - RNA, 1623 nt, Artificial Sequence
  derived and/or modified sequence opt11 from capsid_protein__Norovirus__AFQ00524
augaaaauggcuuccaacgaugccaaccccuccgacggcucagcagcaaaccuagucccagaagucaacaacgaagucauggcccucgaaccaguagucggcgccgcuauagccgcacccgucgccggucaacaaaacgucaucgaccccuggauccgaaauaacuucguccaagcccccggaggagaauuuaccgucucaccacgcaacgcacccggagaaauacuauggucagccccacucggccccgaucucaacccuuaccuaucccacuuagcccgcauguacaacgguuacgccggcggauucgaaguccaagucauccuugcaggcaacgcauucacagccggaaaaauaaucuucgcagccguacccccaaacuucccuaccgaaggccuuuccccgagccaagucaccauguucccccacaucaucguagacguccgccaacuagaacccguccuaauaccacuccccgauguacgcaacaauuucuaccacuacaaccaaagcaaugacuccaccaucaaacuaaucgcaaugcuuuacacaccucuacgcgcaaacaaugcuggugaagacguauucacuguauccuguagaguacucacccguccgagccccgacuucgacuucauauuccuagucccacccaccgucgaaagucgcacuaaacccuucacuguacccaucuuaacaguagaggaaaugaccaacucaagguuccccauacccuuagaaaaacuauucacaggacccucauccgccuucgucguacaaccacaaaacggccgcugcaccaccgacggcguucuacucggcaccacccaacuuucccccgucaacaucugcacauuccgaggcgacgucacccacaucgcaggaucccgcaacuacacaaugaaccucgccucacuaaauuggaacaacuacgaucccaccgaagagaucccagccccacugggaacacccgauuucgucggaaaaauacaaggcguccucacccaaacaacaaaaggcgacggcucaacccgaggccauaaagccacagucuauaccgguuccgcccccuucaccccaaaacucggcuccguccaauucuccaccgacacagaaaacgacuucgaaacacaccaaaacaccaaauucacccccgucggcgucauacaggauggaggaacaacacaccgcaacgaaccccaacaauggguccuccccucauacucaggccgcgacguccccaacguccaccuagcacccgcagucgccccaacauuccccggcgagcaacucuuauucuuccgcuccaccaugcccggcugcucaggauacccuaacauggaucucgacugccuccucccccaagaauggguccaacacuucuaccaagaagccgccccagcccaauccgacgucgcccuccuacgcuucguuaaccccgacacaggaagaguccuauucgaaugcaaacuucacaaaucuggcuacguaacggucgcacauaccggccagcacgaccucgucaucccgcccaacggcuacuuccgguucgacuccugggucaaccaauucuacacccucgcccccaugggcaauggcacaggucgccgccgcgcucuauaa

SEQ ID NO: 37033 - RNA, 1623 nt, Artificial Sequence
  derived and/or modified sequence opt11 from capsid_protein__Norovirus__AFQ00525
augaaaauggccuccaacgacgccaacccaagcgacggaucagcagccaaccucguccccgaagucaacaacgaaguaauggcacuugaaccagucguaggcgcagccauugccgcacccgucgcuggccaacaaaacguaaucgacccauggauccgcaacaacuucguccaagcccccggcggcgaauuuaccguaucaccccgcaacgcaccaggcgaaauccuguggucagcaccccuuggccccgaucucaacccauaccuuucccaccuggcccgcauguacaacgguuacgcaggcgguuucgaaguacaagucauacucgccggcaaugcuuucacagccgguaaaauaaucuuugcugccgucccacccaacuuucccacugaaggccucucccccucccaaguaaccauguucccccauaucaucgucgacguccgucaacucgaaccaguacuaauaccccuccccgacgucagaaacaauuucuaccacuauaaucaaagcaacgacucuaccauuaaacugaucgcuaugcucuacacaccacuccgagccaacaacgccggagaagacguuuucacagucagcugucgcguccucacaagacccuccccagacuucgacuucauauuccucguucccccuaccgucgaaucacgcacaaaaccauucaccguacccauccucacagucgaggaaaugaccaacucucgcuuccccauaccacuugaaaaacucuucaccggccccuccucagccuucguaguccaaccucagaacggccgauguacaaccgacggcguccuccucggcacuacccaacuauccccaguaaacauauguacauuccgcggcgacgucacccacauagccggcucccggaacuacaccaugaaccucgcaucacucaacuggaacaacuacgaccccaccgaagaaauacccgccccucuuggcacacccgacuucgucggcaaaauucaaggaguccucacccaaaccaccaaaggcgacgguuccacccgcggccacaaagccaccguuuacaccggaucagcacccuucacccccaaacucggcucaguccaauucuccaccgacaccgagaacgacuucgagacccaccaaaacaccaaauucaccccagucggugucauccaagacggcggcaccacacaucgcaacgaaccccaacaauggguacuacccuccuacuccggacgcgacguccccaacguccaccuggcccccgccguagccccaaccuuccccggcgaacaacucuuauucuuccgcagcaccaugccagguugcucagguuaccccaacauggaccucgacugccuucuaccucaagaauggguucaacacuucuaccaagaagccgccccagcccaauccgaugucgcccuccucagguucgucaaccccgacaccggacgcguacuauucgaaugcaagcuccacaaaucaggcuaugucaccgucgcacacaccggccaacacgaccucguaaucccacccaauggcuacuucagauucgacuccuggguaaaccaauucuacacacucgcucccaugggcaacggcaccggccgacgccgcgcccuuuaa

SEQ ID NO: 37034 - RNA, 1623 nt, Artificial Sequence
  derived and/or modified sequence opt11 from capsid_protein__Norovirus__AFQ00526
augaaaauggcauccaacgacgcaaaccccuccgacggcucggccgcaaacuuagucccagaagucaacaacgaaguaauggcacuggaacccgucgucggagccgccaucgccgccccagucgccggccaacaaaacgucauagaccccuggauccgcaacaacuucguccaagcacccggaggagaguucacagucucaccccgcaacgccccaggcgaaauccucugguccgccccucuuggccccgaccuuaaccccuaccucucccaccuugcccgcauguacaacggcuacgcgggagguuucgaaguccaagucaucuuagcaggaaacgccuucaccgcgggcaaaaucaucuucgccgccguuccacccaacuuccccaccgaaggccucucccccucccaagucaccauguucccacacaucaucgucgacguccgacaacucgaaccaguacucauuccacuccccgacguccguaacaauuucuaccacuacaaccaguccaacgacucuaccaucaaacucauagcaaugcucuacacaccccuucgugccaacaacgcaggagaagacgucuucaccgucuccugccguguccucacccgaccaagccccgacuucgacuucaucuuccuuguaccacccaccgucgaaucccgcaccaaacccuucaccguccccaucuuaaccgucgaagaaaugaccaacucccgcuucccaauaccacuugaaaaacucuucaccggccccucaagcgcauucguaguccaaccacagaauggccgaugcaccacagacggcguacuccuaggcacuacacaacuauccccagucaauaucugcaccuuccgcggcgaugucacccacauagcaggcucccacaacuacgccaugaaccuagcaagccucaacuggaauaacuacgaccccacugaagaaauccccgcaccccucggaacccccgacuucgucggcaagauccaaggcguccuaacgcaaacaaccaaaggagacggcucaacucgcggccacaaagcuaccaucuacacaggcuccgcccccuucaccccaaaacuaggaucaguccaauucucgaccgauaccgagaacgacuucgaaacacaccaaaacaccaaauucaccccagucggcgucauccaagacggcggaaccacacaccgcaacgaaccacaacaguggguucuacccucauacuccggccgcaacguccccaacguccaccuagcaccagccguugccccaacuuuccccggcgagcagcuacuuuucuuccgaucaacaaugccgggaugcucuggcuaccccaacauggaccuagauugccuccuaccccaagaauggguccaacacuucuaccaagaagccgcucccgcacaaucagacgucgcccuucugcgcuucguuaaccccgacacuggccgaguccuuuucgaauguaaacuccacaaauccggcuaccuaacuguagcucacaccggucaacacgaccucgucaucccacccaacggauacuuccgauucgacucuugggucaaccaauucuacacccuagcccccaugggcaacggaaccggacgccgccgagcccuauaa

SEQ ID NO: 37035 - RNA, 1623 nt, Artificial Sequence
  derived and/or modified sequence opt11 from capsid_protein__Norovirus__AFQ00527
augaaaauggcaucgaacgacgcaaacccuuccgacggcucugccgcuaaccucguccccgaagucaacaacgaaguaauggcccucgaacccgucguuggagccgccauugccgcccccgucgccggccaacaaaaugucaucgaccccuggauccgaaacaacuucguucaagcccccggcggcgaguucaccguguccccucgaaacgcacccggcgaaauacuauggucugcaccauuaggacccgaccucaaccccuaucucucccaucuagcacguauguacaacgguuacgccggcggcuucgaagugcaagucauacuagcuggcaacgccuucacagcuggcaaaauuauauucgccgccgucccucccaacuuucccacagaaggccuaagccccucucaaguaaccauguucccucacaucaucgucgacguucgccaacuagaaccaguccucauaccccuaccugauguccgaaacaauuucuaccacuacaaccaauccaaugacuccaccaucaaacuaauagcaaugcucuacacccccuuacgcgccaacaacgcuggcgaagacgucuuuacagucuccugccgcguccucaccagacccucacccgacuucgacuucaucuuucucguaccaccuacagucgaaucacgcacaaaacccuucaccguuccaauucucaccgucgaagaaaugaccaacucccgauuccccaucccccucgaaaaacucuucaccggacccucauccgccuucgucguacaaccacagaacggccgaugcacuaccgacggaguccuccucggcacuacacaacucucgccagucaauaucuguacauuucgcggagacgucacccacauagccggaucucguaacuauaccaugaaccuagccucccuaaacuggaacaacuacgaccccacugaagaaauccccgcaccccuuggcacccccgacuucgucggaaagauccaagguguccucacccagaccaccaagggcgacggcuccacccggggccacaaagccaccgucuacacaggcuccgcccccuucacccccaaacucggcuccguacaauucuccacagacacggaaaacgacuucgaaacccaccagaacacaaaauucacccccgucggcgucauccaagacggaggcaccacccacagaaacgaaccccaacaauggguccuaccauccuacucaggcagagacgucccgaacguacaccuugccccagccgucgccccaacauuccccggcgaacaacucuuauucuuccguuccaccaugcccgguugcucaggcuaccccaacauggaccucgauugccuccuuccccaagaguggguccaacacuucuaccaagaagcagcccccgcucaauccgaugucgcccuacuccgcuucgucaauccagacacaggccgcguccucuucgaaugcaaacuacauaaauccggauaugucaccguugcacacaccggccaacacgaccucgucaucccacccaacgguuauuuccguuucgacuccugggucaaccaauucuacacccuagccccaaugggcaacggaaccggucgucgccgagcacuauag

SEQ ID NO: 37036 - RNA, 1623 nt, Artificial Sequence
  derived and/or modified sequence opt11 from capsid_protein__Norovirus__AFQ00528
augaagauggcauccaacgacgccaaccccucagacggcucugcugcaaaccugguacccgaagucaacaacgaaguaauggcgcuggaacccgucgucggugcagcaauagcggcacccgucgccggacaacaaaacgucaucgaccccuggaucagaaacaacuuuguccaagcaccuggcggagaauuuacagucaguccacgcaacgcccccggugaaauccuguggucugcaccucucggccccgacuuaaaucccuaccucucccaccucgcccgcauguacaacggcuacgcgggcggauucgaaguacagguuauacucgccggaaacgccuucacugccggaaaaaucauuuucgccgccguacccccaaacuuccccaccgaaggacucuccccuucucaagucaccauguucccucacaucauagucgacguccgccaacucgaacccguacuuauaccacuacccgacguccgaaacaacuucuaccacuauaaccaauccaacgacccgaccaucaaauuaaucgcaaugcuauacacaccccuucgugcuaacaacgccggagaagacguauucaccgugagcugccgaguacuuacgagaccaucacccgacuucgacuucaucuuccuugucccacccaccguagaaucacgcaccaaacccuucaccguacccauccuaaccgucgaagaaaugacaaacucccgcuuccccauaccucuggaaaaacucuucaccggaccuuccuccgccuucgugguccaaccucaaaacggccgcuguacaaccgacggcguccuccucgguaccacacagcucucccccgucaacaucugcacuuuccgcggugacguaacccacaucgccgguucccgaaacuacacuaugaaccucgccucacucaacuggaacaacuacgaccccaccgaagaaaucccagcaccccuagguacccccgacuucguaggaaaaauacaaggaguccucacccagaccacaaaaggagacggcuccacccgaggccacaaagccacaguuuacacaggaagcgcccccuucacccccaaacucggcuccguccaauucuccaccgacaccgaaaacgacuucgaaacccaccagaacaccaaguucaccccagucggaguuauccaagacggcggcacaacccaccgcaacgaaccccaacaauggguacucccaucauacuccggacgcgauguccccaacgcccaccucgccccagccgucgcacccaccuuccccggggaacagcuccucuucuuccgcagcaccaugccaggcugcagcggcuacccaaacauggaccucgacugccuccuaccccaagaauggguucaacacuucuaccaagaagccgccccagcccaauccgacguagcccuccuacgcuucguaaaccccgauaccggccgaguccucuucgaauguaaacuacacaaauccggcuacgucacaguagcccacaccggccaacacgaucucgucaucccacccaacggcuacuuccgcuucgacagcuggguuaaccaauucuauacccuugcacccaugggcaacggcaccggccgacgccgcgcccuauaa

SEQ ID NO: 37037 - RNA, 1644 nt, Artificial Sequence
  derived and/or modified sequence opt11 from capsid_protein__Norovirus__AGC66782
augaaaauggccucgaacgacgccgcccccuccaacgacggagccgccaaccuaguccccgaagccaacaacgaaguaauggcacuugaacccgucguaggagccucaaucgcagcacccgucgucggccaacaaaacaucauagaccccuggauccgcgaaaauuucguccaagccccccaaggcgaauucaccguaucaccccgaaacucaccuggagaaaugcuacucaaccuagaacucggaccugaacucaaccccuaccucucacacuuauccagaauguacaacggcuacgcuggcggaaugcaaguacaaguaguacucgccggcaacgccuucaccgccggcaaaaucauauuugccgcuguccccccccacuuccccguggaaaacauauccgccgcacagaucacaaugugcccccacgucauaguagacguccgccaacucgaacccguacucuugccccuaccagacauccgcaaccgcuucuuucauuacaaccaagaagauaccccacgcaugcgccucgucgccaugcucuacaccccccuccgcgccaacucgggugaagacgucuucacaguauccugucgcguacuuaccagaccugcucccgacuucgaauucaccuuccuaguucccccaaccguagagucuaaaacaaaacccuucacccuccccauccucacucucggcgaacucucaaacucucgcuucccagcccccaucgacaugcucuacacagaccccaacgaaaccaucgucguacaaccccaaaucggcagaugcacacucgacggcucccuccaagguaccacacaacucgucccuacccaaaucugcuccuucggcggcacccuuaucucccaaaccuccagaucagcagacucuaccgacuccgccccccgcguccgcaaccacccccuacacguccaacuaaaaaacuuagacggaacccccuaugaccccaccgacgagguccccgcaguccucggagcaaucgacuucaaaggcacuguguucggcgucgcgucacaacgcaauacuacuggaggcagcguuggcgccacccgcgcucacgaaguccacaucgacaccaccaaccccagauacacacccaaauuaggcucagcccucauguacuccgaaucggacgacuucgacgacggacagcccacccgauucacacccauaggcaugggugcagaugacuggcaccaaugggaacuccccgaauacucaggccaccucacccucaacaugaaucuagcccccgcaguagccccugccuucccaggagaacgcauccucuuuuuccgauccgucguacccuccgccggaggcuacggauccggacaaaucgacugccuaauaccccaggaguggguccaacacuucuaccaagaagcggcccccucccaaucagccguagcccucauccgauacgucaaccccgacaccggccgcaauauacucgaagcuaaacuccaccgcgaaggauucaucacaguagcaaacucuggaaacaacccuaucgucguucccccgaacggauauuuccgcuucgaagcuugggucaaccaauucuacacccuaacucccaugggaaccggccaaggucgccgacggguacaguaa

SEQ ID NO: 37038 - RNA, 1623 nt, Artificial Sequence
  derived and/or modified sequence opt11 from capsid_protein__Norovirus__AGC66784
augaaaauggcaucaaacgacgcaaaccccuccgacggcagcgcagccaaccuuguacccgaagucaacaacgaagucauggcccuugaacccguaguuggggccgccauagccgccccugucgccggccaacaaaacguaaucgaccccuggauacgcaacaacuucguccaagccccuggaggcgaguucaccguauccccacgcaacgccccaggcgaaauccucuggagcgcaccccuaggcccagaucucaauccauaucucucccaucuagccagaauguauaacggcuacgccggcggcuucgaaguacaaguaauacuggccggaaacgccuucaccgccggcaaaaucaucuucgccgccguaccacccaacuuucccacagaaggccucucaccuucgcaagucaccauguucccccacauaaucguagacguacgccaacucgaacccguccuaaucccccuccccgacguccgcaacaacuucuaucacuacaaccaaagcaacgacuccaccaucaaacuaauagccaugcuauauacuccccuccgagccaacaacgccggcgaagacgucuucacugucaguugccgcguccucacccgcccaucuuccgacuucgacuucaucuuucuaguacccccuaccgucgaaucacgcacaaaacccuucaccguacccauacuaacaguagaagaaaugacaaacagccgcuucccaaucccccuagaaaaacucuucaccgggcccuccucagccuucguaguccagccccaaaacggccguuguacaaccgacggcguccuacucggaaccacgcaacuaucccccgucaauaccugcacuuuccguggcgacgucacucacaucgcuggcucccgcaacuacaccaugaaccucgccucacuaaacuggaacaacuacgaccccacagaagaaauccccgcgccccuuggaacccccgacuucguuggcaaaauccaaggcguccucacacaaacaaccaaaggcgacggcagcaccagaggccacaaggccaccauuuacaccggaagcgcccccuucaccccaaaacucggaucaguccaguucaacacugacaccgaaaacgacuucgaaacccaccaaaacacaaaauucaccccaguuggaguaauacaggacggaggaacaacccacagaaacgaaccccaacaauggguacuaccguccuacucuggucgcaacauaccaaacguucaucucgcccccgccguagcccccacauuccccggcgagcaacuacucuucuuccgguccacaaugcccggauguuccggcuaccccaacauggaccuagacugccuccucccccaagaauggguacaacacuucuaccaagaagccgccccggcccaauccgacguagcccuacugcgauucguaaacccugacacaggacgaguccucuucgaaugcaaacuucacaaaucaggcuacgugacagucgcccacaccggacaacacgaccucgucaucccacccaacggcuacuuccgauucgacuccugggucaaccaauucuacacacucgcacccaugggcaacggcaccggccgacgacgagcccuauaa

SEQ ID NO: 37039 - RNA, 1647 nt, Artificial Sequence
  derived and/or modified sequence opt11 from capsid_protein__Norovirus__AGC66785
augaaaauggccuccaacgacgcaacuccauccaacgauggcgccgcaggccucguaccagaaauaaacucagaagcaauggcccucgaaccagucgccggcgccgccaucgcagcuccccuuaccggccaacaaaacaucaucgacccauggauaaugaacaacuucguccaagccccuggcggagaguucaccgucuccccacgcaacagccccggagaaguacuccuuaaucuagaacuaggucccgagauaaaccccuaccuagcccaccucgcccgcauguacaacggcuacgccggcgguuucgaaguccaagucguccuagccggcaacgccuucaccgccggaaaaaucauauucgcagccauaccacccaauuuccccaucgacaaccucagcgcugcucagaucaccaugugcccucacgucaucguugauguacgucaacucgaacccgucaaccucccaaugcccgacguccgcaauaacuucuuccacuauaaccaaggcucagacucccgacuacggcucaucgcaaugcucuacacaccccuccgggccaacaacucuggcgacgacguauucaccguuagcugccgagucuuaacucgacccucccccgauuucucauucaacuuccuagucccucccaccguagaaagcaaaacaaaacccuucucccuucccauccucaccaucucugaaauguccaacucaagauucccaguacccaucgauagccuccacaccucaccgaccgaaaacaucguaguccaaugccaaaacggccgcgucacgcucgacggcgaacucaugggcaccacccaacuacuccccucccaaaucugcgccuuccgcggaaugcugacacgaucaaccucccgcgccuccgaccaagccgauaccgcaacaccacgccucuucaacuacuacuggcacauccaacuagacaaccuaaacggcacgcccuacgaccccgccgaagauauccccggaccucucggcacccccgacuuccgaggaaaagucuucggggucgcaucgcaacgcaacccagacgccaccacccgcgcccacgaagccaaaaucgauaccaccucgggaagauucacucccaaacuaggcucacucgaaaucucaacagaaagcggagacuucgaccaaaaccaacccacccgauucacacccguaggcaucggcguagaccgagaggccgacuuccaacaauggacccuccccgacuaugccggacaauucacccauaacaugaaccuagcccccgccgucgccccgaacuuccccggcgaacaacuccuguuuuuccgcucucaacuacccuccuccggaggccgcuccaacggaauacuagacugccuugucccgcaagaauggguccaacacuucuaccaagaauccgcccccagccaaacccaaguagcccuaguccgauacaucaaucccgacaccggacgcguccucuucgaagccaaacuucacaaacucgguuucaugacaaucgcuaaauccggcgauucucccaucacagucccacccaacggcuacuuucgcuucgagucaugggucaaccccuucuacacacucgcaccaauggguacagguaauggacgcagacgcauccaauaa

SEQ ID NO: 37040 - RNA, 1644 nt, Artificial Sequence
  derived and/or modified sequence opt11 from capsid_protein__Norovirus__AGC66786
augaaaauggcauccaacgacgcagcccccucuaacgacggcgccgccaaccucguaccugaagccgacaacgaaguaauggcacucgaacccgucgucggagccuccauagcagccccagucgucggccaacaaaacauaaucgaccccuggauccgcgaaaacuucguccaagcaccccaaggcgaguucacggucucaccccgaaacucccccggagaaaugcuacucaaccucgaacucggccccggccuaaaccccuaccucucccaucuaucccgcauguauaacggcuaugccggcggaaugcaaguccaaguaguacucgcaggcaaugccuucaccgcaggcaagaucauuuucgcagccgugcccccacacuuccccgucgaaaacaucucugccgcccaaauaaccaugugcccacacguaauaguagacguccgccaacuugaacccguacuacucccccuacccgacauccgcaaccgauucuuccacuauaaccaggaagacacaccccgcaugcgacuugucgccauguuauacacaccccuccgugccaauuccggagaagacgucuucaccgucucuugccgaguccucacccgccccgcgcccgacuucgaguucaccuuccucguucccccuaccgucgaauccaagaccaagccauucacccuaccaauccuaacccuaggcgagcuaucaaauucccgauucccagcccccauugacaugcucuacacagaccccaacgaaaccauagucguacagccccaauccgggcgcugcacacuagacggcacucuccaaggaacuacacaacucguaccaacacaaaucugcuccuuccgaggcacccucaucucgcaaacaucccgcuccgccgacuccacugacucagcuccccgaguucgcaaccacccaccccacguccaacuaaagaaccucgacggaaccccauacgauccaaccgacgaaguuccugccguucuaggcgccauagacuucaaaggaacugucuucggcgucgccucccaacgcaauaccacaggaggauccgucggcgccacccgugcacacgagguccacaucgacaccacaaauccacgcuacacccccaaacuaggauccguccucauguacucagaauccgacgacuuugacgacgggcaaccaacccgcuucacccccauuggcaugggcgccgacgacuggcaccaaugggaacuccccgaauauucaggacaccucacucucaacaugaaccuugcccccgccguagcccccgccuucccaggagagcgcauccuauucuuccgauccguaguccccucagccggugguuacggcuccggccaaauugacugcuuaaucccccaagaauggguccaacacuucuaucaagaagccgcccccagccaauccgccgucgcacuaauacgauaugucaaccccgacaccggacgcaauauauucgaagccaaacuccacagagaaggcuucaucacagucgcuaacuccggcaacaaccccaucguaguacccccaaauggauacuuccgcuuugaagccugggucaaccaauucuacacacuaaccccaauggguacgggccaaggacgccggcgaguacaguaa

SEQ ID NO: 37041 - RNA, 1623 nt, Artificial Sequence
  derived and/or modified sequence opt11 from capsid_protein__Norovirus__AGC66788
augaaaauggccuccaacgacgccaaccccuccgacggaucagccgccaaccucguaccagaagucaacaacgaagucauggcccuagaaccagucgucggcgcagcaauagccgcacccgucgcuggacaacaaaacgucaucgacccauggauccgcaacaacuucguccaagcccccggcggcgaguucacaguaucaccccguaacgccccgggagaaauccucuggagcgcaccccucggccccgaccuuaaccccuaccuaucccaccuagcccgcauguauaacggcuacgccggcggcuucgaaguacaagucauacucgccggcaacgccuucacagccggaaaaaucauauucgccgccguaccaccaaacuuccccaccgaaggccucucccccucacaaguuacaauguucccccacaucaucguugauguccgacaacucgaaccgguacucaucccacucccagacguccgcaacaacuucuaccacuacaaccaaucaaacgacucaaccaucaagcucaucgccaugcucuacacaccacucagagcaaacaacgcaggcgaagacguauucacagucuccugccgcguacuaacccgacccuccccagacuucgacuucaucuuccucguaccaccgacaguagaaucccgcaccaaaccuuucaccgucccaauccuaacagucgaagaaaugaccaacucccgauuccccaucccccucgaaaaacucuucacaggacccucaagcgcauucgucguccaaccacaaaacggccgcugcaccacagacggaguccuccuaggcaccacccaacucucccccgucaacaucugcacguuccgcggagacguuacucacaucgcaggcucccgcaacuacaccaugaaccucgcaucccuaaauuggaacaacuacgaccccacagaggaaauaccggccccucucgguacccccgacuucguaggcaaaauacaagggguccuaacacaaaccacaaaaggcgauggcagcacccgcggacacaaagcaacugucuacacaggcuccgcccccuucacucccaagcucggauccguaagauucucaaccgacaccgagaacgacuucgaaacccaccaaaauaccaaauucacacccguuggcgucauccaagacggcggcaccacacaccgaaacgaaccccaacaauggguccuuccaaauuacagcgguuccgacguccccaacguccaccuagcaccagcagucgccccaaauuuccccggcgaacaacuccucuucuuccgcuccaccaugcccggaugcucaggcuauccaaauauggaucucgacugccuacuaccgcaagaguggguacaacacuucuaccaagaagccgcacccgcacaaucagacgucgcccuccuacgcuucgucaaccccgacacgggacgcguccucuuugaaugcaaacuccacaaauccggauacgucacuguagcacacaccggccaacacgaucucgucauaccaccaaacggcuacuuccgcuucgacagcugggucaaccaauucuacacccucgcacccaugggcaacggaaccggccgaagacgagcccuauaa

SEQ ID NO: 37042 - RNA, 1629 nt, Artificial Sequence
  derived and/or modified sequence opt11 from capsid_protein__Norovirus__AGL96587
augaaaauggccagcaacgacgcagccccuucuaacgacggcgccgccucccucguccccgaaggaauaaaugaaacuaugccccucgaacccgucgcaggcgccucaauagccgcccccguagccggucaaaccaacaucaucgacccauggauccgcacuaacuucguacaagcaccaaacggcgaauuuaccguauccccacgaaacucccccggagaaauacuacucaaccuugaacuaggccccgaccuaaaccccuaccucgcccaccucccccgcauguacaauggcuacgcaggaggcguagaaguccaaguccuucucgcuggcaacgccuucaccgcaggcaaaauccucuuugccgccaucccucccaacuucccugucgacaugaucucacccgcucaaaucaccaugcucccucaccuaaucgucgacguccgcacacucgaaccuaucaugauaccccuccccgacguaagaaacguauucuaccacuucaacaaccaaccacaaccccgcaugcgacucguagccaugcucuacacccccuuacguagcaacggcuccggcgaugacguccucacagucuccugccgcguccuaacccgacccacacccgauuucgaauuuaucuaccucguacccccuuccgucgaauccaaaacaaaacccuucacucuccccauccuuaccaucuccgaacucacuaacucccgcuuccccaucccuaucgaacaacucuacacagcccccaacgaaaccaacguuguccaaugucaaaacggucggugcacacucgacggcgaacuccaaggcaccacccagcuccucuccuccgccguuugcagcuaccgcggccgcaccgucgccaacaacggcgacaacugggaucaaaaccuacuacaacucaccuacccaaacggcgccucuuacgaccccacagacgaagucccggcaccccucggaacucaagacuucuccggcaugcucuacggcguccucacucaagacaacguaaacgucuccacaggcgaagccaagaacgcaaagggcaucuacaucuccacaaccuccggcaaauucaccccuaagaucggcuccauaggccugcacuccauuaccgaacacguucacccaaaccaacaaucccgcuucacacccgucggaguagcaguaaacgaaaauacccccuuccaacaauggguccuaccccacuacgcaggcucaacccgcucccacaccaaccucggcaccgcacucgcuccuaccuuccccggcgaacaacuucucuuuuuccguucccgcguccccugcguccagggacuccaaggacaagacgccuucauagauugccuacucccccaagaauggguaaaccacuucuaucaagaagcagcacccucacaagcagacgucgcccucauccguuacgucaaccccgacacaggccgaacccucuucgaagccaaacuccaccgcucaggcuucaucaccgucucucacaccggagccuacccccuugucgucccacccaacggacacuuccgcuucgacuccuggguaaaccaauucuacucacuugcccccaugggcacaggcaacggccgccgcagaauccaauaa

SEQ ID NO: 37043 - RNA, 1623 nt, Artificial Sequence
  derived and/or modified sequence opt11 from capsid_protein__Norovirus__AGQ57036
augaaaauggcauccaacgacgcagcccccucaaacgacggagccgccggucuuguccccgaaaucaacaacgaaguaaugccccuagagccaguagccggcgcuagccucgcaacccccgucguaggacaacaaaacauuauagaccccuggauccgcaacaacuucguccaagcccccgccggcgaguucaccgucucaccccguaacucccccggagaaauccuccucgaccucgaacucggucccgaacucaaccccuacuuagcccaccuagcccgcauguacaacgggcacgccggaggcauggaaguccaaauaguccucgccggcaaugcauucaccgccggcaaaaucauauucgccgccaucccacccggcuuccccuacgaaaaccucucccccucucaaaucaccaugugcccacacgucaucaucgacguacgacaacucgaacccguacuacuccccaugccagacauacgaaacaacuucuuccacuacaaccaagguaacgaccccaagcuacgccucgucgcuaugcucuacacaccccuccgcgcaaacaacuccggcgacgacguauucaccguauccugccgcguucucaccaaacccucaccugacuucgaguucacuuuccucguaccacccacggucgaaagcaagacaaaacaguucacccuucccauacucaagauauccgaaaugaccaacucccgcuucccuguucccgucgaaaugauguacaccgccagaaacgaaaaccaagucguccagccccaaaacggacgcguaacucuagauggcgaacuacuuggcaccacuccacuucucgccgucaacaucugcaaauucaaaggcgaagucauagccaaaaacggcgacguccgcucauaccgaauggauauggaaaucacaaacacugacggcacacccaucgaccccaccgaggauacccccggacccaucggcuccccagacuuccaaggcauccuauuuggcguugcaucccaacgcaacaaaaacgaacaaaaccccgccacccgagcccacgaagcugacauaaacaccggaggagaccaguacgccccaaaacucgcacaagucaaauucuucuccgagucccaagacuucgaaguccaccaacccacaguauucacccccgucggaguagccggagacgcaucccaccccuuccgacaauggguccuaccacgcuacggaggccaccuaaccaacaauacccaccucgcaccagcagucgcaccccucuuccccggugaacaaauucucuucuucagaucacaaauccccuccuccggcggccacgaacuaggcuacauggacugccuagugccccaagaauggguccagcacuucuaccaagaagccgccacagcucaauccgaagucgcccucauaagauucauaaaccccgacacgggccgcguacucuucgaagcaaaacuccauaaacaaggcuucaucacaguagcccacacaggagacaaccccaucgucaugcccccuaacggguacuuccgcuucgaggcaugggucaaccaauucuacucccuagcccccgucggcaccgguaacggccguagacgcauccaauag

SEQ ID NO: 37044 - RNA, 1623 nt, Artificial Sequence
  derived and/or modified sequence opt11 from capsid_protein__Norovirus__AGT95926
augaaaauggcaagcuccgacgccaaccccuccgacggcuccgccgcaaaccucguccccgaaguaaauaacgaaguaauggcucucgaaccugucgucggcgccgccauagcagcccccgucgcaggacagcaaaacgucaucgaccccuggauccgcaacaacuucguccaagcccccggaggggaauuuaccgucucaccccguaacgcccccggcgaaauacucugguccgccccgcucggccccgaccuuaaccccuaccucucccaccucgcccgcauguacaacggcuacgccggaggauucgaaguucaagucauccucgccggcaaugccuucaccgcaggcaaagucaucuucgccgcaguaccacccaacuuucccaccgaaggacuaucccccucacaaguaacaauguucccccacaucgucgucgacguaagacaacuugaacccguccuaauccccuuacccgacguccgaaacaacuucuaccacuauaaccaauccaacgacccuaccaucaaacucaucgccaugcucuacaccccacuacgugccaacaacgcaggagacgaugucuuuaccguuagcugccguguccuaacacgaccaucaccagacuucgacuucauauuccuaguaccacccaccgucgaaucacgcaccaaacccuucucuguacccguccucaccguagaagagaugaccaacucccgcuuccccauuccccucgaaaagcuauucaccggacccuccuccgcauucgucguccaaccccaaaacggccgcugcacaaccgauggcguacuccucggaaccacucaacuaucaccagucaacauaugcaccuucaggggcgacguuacccauaucaccggaucccgaaacuacacaaugaaccuagccucgcaaaacuggaacaacuacgaccccacagaagaaauacccgcaccucuaggcacaccagacuucguaggcaagauccaaggaguacuaacccaaaccacuagaaccgacgguucaacgcgcggccacaaggccaccgucuacaccggaucagccgauuucgccccuaaacuaggccgcguccaauucgaaacagacacagaccacgacuucgaagccaaccaaaacacaaaauucacccccgucggcgucauccaagacggcagcaccacucacagaaaugaaccccaacaguggguacuccccucuuauucaggccgcaacacccacaacguccaccucgccccugcagucgcccccacauucccaggcgaacaacuacuauucuuccgcuccaccaugccaggcugcuccggcuaccccaacauggaccuugacugccuucuaccacaagaguggguacaauacuucuaccaagaagccgccccagcucaauccgacgucgcucuacuccgauucgucaaccccgacaccggacgcguccuauucgagugcaagcuacacaagucaggcuacgucaccguagcccacaccggacaacacgaccucgucauaccacccaauggauauuuccgcuucgacucaugggucaaccaauucuacacccuagcccccauggggaacggaaccggaagacgccgcguggucuaa

SEQ ID NO: 37045 - RNA, 1623 nt, Artificial Sequence
  derived and/or modified sequence opt11 from capsid_protein__Norovirus__AGT95927
augaagauggccucaucagaugccaacccauccgacggauccgccgcaaaccuugucccagaagucaacaacgaggucauggcucucgaacccgucguaggcgcagccaucgcagcccccguugccggccaacaaaacguuaucgaccccuggauucgaaacaacuucguccaagcccccggcggcgaguucaccgucucuccccgaaacgcccccggcgaaauacucugguccgcaccccucggcccagaccuaaacccauaccucucccaccucgcccgcauguacaacggauacgccggcggauucgaaguacaagucauccucgccggcaacgcauucacagccggcaaaguaaucuucgcagccguuccucccaacuucccaaccgaaggccucuccccaucacaaguaaccauguucccccacauaguugucgacguccgccaacucgaaccagugcuaaucccccuuccagauguccgcaacaacuucuaccacuacaaccaaagcaacgacccaaccauuaaacuaaucgccaugcuauacacaccccuacgcgccaacaaugccggcgacgacgucuucaccgucuccugccgaguccuaacccguccaucccccgacuucgacuuuauauuccucguucccccaaccgucgaaucccgcacuaaacccuucuccguaccaguacucacagucgaagaaaugaccaacucucgcuuccccacaccccuagaaaaacucuucaccggaccguccucagcauucgucguccagccacaaaacggucgcugcaccaccgacgggguucuacucggaacaacccaacucagcccaguaaacaucugcaccuuccggggcgacgucacacacaucaccggcucucgcaacuacaccaugaaccucgccucacaaaacuggaacaacuacgaccccacugaagaaauccccgcaccccucggcacucccgauuucguaggaaaaauccaaggcguccucacacaaacuaccagaaccgauggcuccacccgcggccacaaagccaccguauacaccggcuccgccgacuucgcacccaaacucggacggguccaauucgaaacagacaccgaccacgacuucgaaguaaaccaaaacaccaaauucacccccguaggcgucauccaagacggaggaaccacccaccgcaacgaaccucaacaauggguccugcccuccuacucuggacguaacacccacaacguacaccuagcccccgcagucgcaccaaccuuuccuggcgaacaacuccucuucuucagaagcaccaugccaggaugcucaggauaccccaacauggaccuagauugccuucucccccaggaauggguccaauacuucuaccaagaagccgcccccgcacaauccgacgucgcccucuuacguuucgucaacccagacacuggccgcguacuuuucgaaugcaaacuacacaaauccggcuaugucacggucgcccacaccggccaacacgaccuaguaauuccucccaacggcuacuuccgcuucgacuccuggguaaaccaauucuacacacucgcccccaugggaaacggaaccggacggcgccgcgucgucuaa

SEQ ID NO: 37046 - RNA, 1623 nt, Artificial Sequence
  derived and/or modified sequence opt11 from capsid_protein__Norovirus__AGT95928
augaaaauggccuccucugacgcaaaccccuccgacggaucugcugccaaccucguacccgaagucaacaacgaagucauggcccuagaaccugucgucggcgcagccauugcagcccccguagccggacaacaaaacguaauagacccauggauucgcaacaacuucguccaagcccccggcggcgaguucaccgucagcccccggaacgcccccggugaaauacucuggucugcccccuuaggccccgaccuuaacccauaccucucccaucucgcccgaauguacaacggcuacgccggcggcuucgaaguccaaguaauccuugcugguaacgccuucaccgcgggaaaagucauauucgccgcaguacccccaaacuucccaaccgaaggccucucccccucccaagucaccauguucccccacaucgucgucgacguccgccagcuagaacccgucuuaauaccucuaccugacguccgcaacaacuucuaccacuacaaccaauccaacgacccuacuauaaaacuaaucgccaugcuuuacacaccccuccgagcaaacaacgccggugacgacgucuucaccguguccugccgcguacuaacccgacccuccccagacuucgacuuuauauuucucgucccuccuaccguagaaucccgcaccaaaccuuucucagucccaguucucacagucgaagaaaugacaaacucuagauuccccauaccccuugaaaaguuguucaccggcccaucauccgcauuugucguccaaccccaaaacggccgcugcaccacagauggaguccuacucggcaccacacaacucucacccgucuccaucugcaccuuccgcggugacgucacccacauaaccggaucucgcaacuacaccaugaaccucgcaucccaaaacuggaacaacuacgacccaacagaagaaauccccgccccacucggaacacccgacuucgucggcaaaauccaaggcaugcuaacccaaaccacaagggcggacggaucaacccgaggccauaaagcgaccguauacacaggcucagccgauuucgccccaaagcucggccgcguacaauucgaaaccgacaccgaccacgacuucgaagccaaccaaaauaccaaauucacacccgucggcgucauucaggacggcucuaccacacaccgaaacgaaccccagcaauggguacuccccagcuauucaggccgaaacacccacaacguccaccuagcacccgccgucgccccaaccuucccaggcgaacaacucuuauucuuccgauccacaaugcccggcugcuccggcuaccccaacauggaccuagacugccuccucccucaagaauggguccaauacuucuaccaagaagcagcucccgcccaauccgacgucgcauuacuccgcuucguuaacccugacaccggccgcguccucuucgaauguaagcuccauaaaucaggcuaugucacaguagcacacaccggucaacaugaccucguaaucccucccaacggauacuuccgcuucgauucuugggucaaucaauucuacacacucgccccaaugggcaacggaacuggccgccgacgaguagucuaa

SEQ ID NO: 37047 - RNA, 1623 nt, Artificial Sequence
  derived and/or modified sequence opt11 from capsid_protein__Norovirus__AGT95929
augaaaauggccuccuccgacgccaaccccucagauggcucugccgccaaccucguacccgaaguaaacaacgaggucauggcacuagaacccgucgucggugcagccauagccgcuccagucgccggccaacaaaacgucauagaccccuggauacgcaacaauuucguccaggcucccggaggagaguucacagucucaccccgaaacgcaccuggagaaauucucugguccgccccacucggccccgaccuaaaccccuaccucucccaccucgcccgcauguacaacggauacgcuggaggcuucgaaguccagguaauacuagccggcaaugccuucaccgcaggcaaagucaucuucgccgcagucccucccaacuuccccacagaaggucuuucacccucccaagucacaauguucccacacauagucguagacguacgacaacuagaaccaguucucaucccacuacccgacguacgaaacaacuucuaccacuacaaccaguccaacgaccccacaauaaaacuaaucgccaugcuuuacacaccacuacgcgcgaacaacgcaggcgacgacguauucacagucuccugccgaguccucacacgaccuucccccgacuuugacuucaucuuccuugucccacccaccguagaaucccgcacaaaaccuuucuccguccccguacuuaccgucgaagaaaugaccaauucacguuuccccaucccacuagaaaaacucuucaccggccccucauccgccuucgucguccaaccacaaaacggccgcugcacaacagacggcguccuacucgguaccacacagcucucccccgucaacaucugcaccuuccgaggcgacguaacccacaucaccggaagccgcaacuacaccaugaaccucgcgagccaaaacuggaacaauuacgaccccaccgaagaaauccccgccccgcucggcacccccgauuuuguaggaaagauucaaggcguccucacccagacaacaagaacagacggcucaacccgaggucacaaggccaccgucuacaccggcuccgccgacuucgcucccaaacucggucgaguccaauucgaaaccgacacagaucacgacuucgaagccaaccagaacacaaaauucacccccgucggcgucauccaagacggcuccaccacacaccgaaacgaaccucagcaauggguccuccccucauauuccggccgcaacacacauaacguccaccucgcuccagcagucgcccccaccuucccaggcgaacagcuccuguucuuccgcuccacaaugcccggcugcuccggauaccccaacauggaucucgacugccuccuaccacaagaauggguccaauacuucuaccaagaagccgcuccagcgcaaucagacgucgcacuccuccgcuucgucaacccugacaccggcagaguacuauucgaaugcaaacuacacaaauccgguuacgucaccgucgcacacacaggccaacacgaccuagucaucccacccaacggcuacuuucgauuugacucauggguaaaccaauucuacacccuagcccccaugggcaacggcaccggacgaaaacgcgucgucuaa

SEQ ID NO: 37048 - RNA, 1623 nt, Artificial Sequence
  derived and/or modified sequence opt11 from capsid_protein__Norovirus__AGT95930
augaaaauggcguccagcgacgccaacccaucagacgguucagcugccaaccuaguccccgaagucaacaacgaagucauggcacuugaacccgucgucggcgccgcaaucgcugcacccguagccggccaacaaaacguaaucgaccccuggauccgcaauaacuucguucaggccccuggcggcgaguucaccguaucgccccgcaacgcccccggcgaaauccucugguccgccccacucggccccgaccucaaccccuaccucucacaccucgcccgcauguacaacggcuacgccggcggcuucgaaguacaaguaauccucgccggcaacgcauucaccgccggcaaaguaaucuucgccgccgucccucccaacuuccccacggaaggccuaucacccucacaaguaacuauguucccucacauaguaguugacguccgccaacucgaacccguucuaaucccccuccccgacguccguaacaacuucuaccacuacaaccaaagcaacgauccaaccaucaaacugaucgccaugcuauacaccccucuacgugccaacaacgccggcgacgacguauucacaguaucaugccgaguccuaacacgccccucccccgauuuugacuucauauuccuagucccacccaccgucgaaucccgcaccaaaccauucuccguccccguacuaaccgucgaagaaaugacuaacucccgauucccaaucccacucgaaaaacucuucaccggcccauccucagcguucgucguccaaccccaaaacggccgaugcaccacugacggaguccuacucggaaccacgcaauuaucccccguaaacaucugcaccuuccgaggagacgucacacacaucaccggaucacgcaacuacacaaugaaccuagccagccaaaacuggaacaacuacgaccccaccgaagaaauacccgcaccccucggaacacccgauuucguaggcaaaauccaaggaguccucacacaaacaacccgcaccgauggaagcacccgcggccacaaagcaacagucuacacaggcagcacugacuucgcccccaaacucggccgcguacaauucgaaaccgacacagaucacgacuucgaggccaaucaaaacaccaaauucacacccgucggagucauacaagacggauccacaacccaccgcaacgaaccccaacaauggguacuaccaucauacuccggccgcaacacacacaacguacaccuagcucccgccguugcucccacauucccaggagaacaauuacuauucuuccgaucuacgaugcccggcugcucaggauaucccaacauggaccuagauugccuucucccccaagaauggguccaauacuucuaccaagaagccgcucccgcccaauccgacgucgcccuacuccgcuucgucaaccccgacaccggccgcguacuauucgaaugcaaacuucacaaauccgguuacgucacagucgcacacaccggccaacacgaccuaguaauaccacccaacggauacuuccgcuucgacuccuggguaaaccaauucuacacccucgcucccaugggcaacggaaccggaagaagacgagccguauaa

SEQ ID NO: 37049 - RNA, 1623 nt, Artificial Sequence
  derived and/or modified sequence opt11 from capsid_protein__Norovirus__AGT95931
augaaaauggccagcuccgacgccaaccccuccgacggaucagccgccaaccuuguccccgaaguaaacaacgaaguaauggcccucgagccagucguaggcgccgccauagcagcaccagucgccggccaacaaaacgucauugacccguggauccgcaacaacuucguccaagcccccggaggagaauuuaccgucucuccccgcaacgcccccggcgaaauacuaugguccgccccgcuaggucccgaccucaacccauaccucucccacuuagcccgcauguacaacggauacgccggcggcuucgaaguccaagugaucuuagcaggcaacgccuucacagccggcaaagucaucuucgccgcagucccacccaacuuucccacagaaggccugucucccucacaagucaccauguucccccacauugucguugacgucagacaacucgaacccguccucauaccacuccccgacguccgcaacaacuucuaccacuacaaccaauccaacgaccccacaauaaaacucaucgcaaugcuauacacaccccuccgcgcgaacaacgcuggcgacgacgucuucaccguaucaugccgaguccucacccgcccaagccccgacuuugacuucauauuucuaguucccccaaccguagaaucucguacaaaaccauucuccguccccguccuaaccgucgaagaaaugacaaacuccagauucccuaucccccuagaaaaacuuuucaccggcccaucauccgccuucgugguacaaccacaaaacggccgaugcacgaccgacggaguacuccucggaaccacucaacucucacccgucaacauuugcacauuccgcggagacguaacccacaucaccggcucccgaaacuacacaaugaaccucgccucucaaaacuggaacaacuaugacccaaccgaggaaauccccgccccacucggcacccccgacuucgucggaaaaauacaaggcguacuaacccagacaacccgcaccgacggcucaacccgaggacacaaagccaccguauacacgggcuccgcugacuucgcacccaaauuaggccgcguccaauucgagaccgacaccgaccacgacuucgaaaccaaccaaaauaccaaauucacccccguaggcgucauacaagacgguucaacaacccaccguaacgaaccccaacaauggguccuuccauccuacuccggccgaaacacacacaacguccaccuagcaccggccgucgcacccacauuccccggagaacaacuccuguucuucaggagcacaaugccggguugcuccggauaccccaacauggaucucgacugccuacuuccccaagaauggguccaauauuucuaucaagaagcagcccccgcccaauccgacgucgcccuccuccguuuuguuaaccccgacaccggccgaguucuuuucgagugcaaacuacacaaauccggcuacgucacugucgcccacaccggccaacacgaucuagucauaccacccaacgguuacuuccgauucgacuccuggguaaaccaauucuauacccuagcccccaugggcaacggaaccggacgacgccgcgcagucuaa

SEQ ID NO: 37050 - RNA, 1623 nt, Artificial Sequence
  derived and/or modified sequence opt11 from capsid_protein__Norovirus__AHC12655
augaaaauggcaagcuccgacgccaacccauccgacggcuccgcugccaaccucgucccugaaguaaacaacgaagucauggcacucgaacccgucguuggcgccgccaucgccgcccccgucgccggccaacaaaacgucaucgacccauggauccgcaacaacuucguacaagccccgggaggcgaguucaccguauccccacgaaacgcccccggagaaauccucuggagcgcaccccucggcccugaccucaaccccuaccuaucccaccucgcccgcauguacaacggcuacgccgguggauucgaaguccaagugauccucgccggcaaugccuucacagcaggcaaagucaucuucgccgccguuccacccaacuuccccaccgaaggacuaagccccagccaaguaacuauguuuccacacauagucgucgacguccgccaacucgaacccguucucaucccccucccagacguccggaacaacuucuaccacuacaaccaauccaaugaccccaccauuaaacucaucgccaugcuauauaccccacuacgcgccaauaaugccggcgaugaugucuccaccguauccugcaggguccucacccgacccucccccgacuucgauuucaucuuccucgucccucccaccgucgaaucccgcaccaaacccuucuccguccccguccuaaccguagaagaaaugaccaacucccgcuuccccauccccuuggaaaaacucuucaccggccccuccucagccuucgucguucaaccacaaaacggccgcugcacgacagacggaguccuucucggcacaacccaauugucgcccgucaacaucugcacauuccgaggcgaugugacucacauuaccggcuccagaaacuacaccaugaaccucgcaagccaaaauuggaacaacuacgaccccaccgaagaaauccccgcaccccucggcacaccugacuucguaggcaaaauacagggcaugcucacccaaacuacccgaaccgacggcucaacacgcggccacaaagcaaccguauacacaggauccgccgacuucgccccuaagcuaggacgaguccaauucgaaaccgacaccgaccacgacuucgaagccaaccaaaacacaaaauucacccccaucggcguaauccaagacgguuccaccacccaccgcaacgaaccacaacaauggguccucccauccuauuccggccgaaacacacacaacguacaccuggccccagccguagcccccaccuuccccggugaacaacuccucuucuuccgcucaaccaugccaggcugcucuggcuaccccaacauggaucuagacugccuucucccccaagaauggguccaauauuucuaccaagaagccgccccggcacaauccgacgucgcccuacuacgcuucgucaacccagacacaggacgaguccuauucgaaugcaaacuccacaaaucuggcuacguaaccgucgcccacaccggccaacacgaccuaguaaucccuccaaacggcuauuuucgcuuugacuccugggugaaccaauucuacacacucgcccccaugggcaacggcacaggccgccgaagaguaguauaa

SEQ ID NO: 37051 - RNA, 1623 nt, Artificial Sequence
  derived and/or modified sequence opt11 from capsid_protein__Norovirus__AHC12658
augaagauggcguccuccgacgcaaacccaucagacggcuccgccgcaaaccucgugccagaggucaacaacgaagucauggcccuagaacccguaguuggagccgccaucgcagcacccgucgccggccaacaaaacguaaucgaccccuggauaagaaacaacuucgugcaagcgcccggcggagaguucaccguaagcccacgcaacgcacccggcgaaauacuaugguccgcaccccucggccccgaccucaaccccuaccucucucaccucgccagaauguacaacggcuacgccggcggcuucgaaguccaaguaauccucgcaggcaacgccuucacagccggcaaagucaucuucgccgccaucccacccaacuuccccaccgaaggccucucacccucucaaguaaccauguucccccacauugucguagacguccgacaacuagaaccaguccuaaucccacuacccgacguacgcaauaacuucuaccacuacaaccaauccaacgacccaacaauaaaacucaucgccaugcucuacacuccacuccgcgccaacaacgccggcggcgacgucuucaccgucuccugccgaguacuaacacgccccucacccgacuucgacuucaucuuccucgugccacccaccgucgaaucccgcaccaagccauucagcguccccguccuaacaguagaagaaaugaccaacucccgcuuccccauaccccucgaaaaacuuuuuaccggacccuccuccgcauucguuguccaaccucaaaacggccgaugcaccacagacgggguccuacucgggacaacgcaacuauccccugucaacaucugcaccuuccgcggugaugucacccacauaacaggcucccgaaacuacacaaugaaccucgcaucccaaaacuggaacaauuacgaccccaccgaagaaauccccgcuccccucggcacaccagauuucgucggcaaaauccaaggcaugcuaacccagaccacccgaaccgacggcuccacccgcggacacaaggccacagucuacacagguuccgccgauuucgccccaaaacuaggcagaguccaauucgaaaccgacaccgaccacgacuucgaagccaaccaaaucaccaaauucacccccaucggagucauccaagacggcuccaccacccaccgcaacgaaccacaacaauggguucuccccucuuacucaggaagaaacacacacaacguacaccucgccccagcagucgcacccacauucccaggcgaacaacuucuauucuucagaucgaccaugccaggauguucaggcuaccccaacauggaccuugacugccuacucccccaagaguggguccaauacuucuaccaggaagcggccccagcccaaucggacgucgcccuacuucgcuuuguaaaccccgacaccggacgcguccuauucgaaugcaaacuacacaaaucaggauacguaaccgucgcccacaccgggcaacaugaccuagucaucccaccaaacggcuacuuccgauuugacucuuggguaaaccaauucuacacacucgcccccaugggcaacggcaccggccgucgccgugucguauaa

SEQ ID NO: 37052 - RNA, 1632 nt, Artificial Sequence
  derived and/or modified sequence opt11 from capsid_protein__Norovirus__AHW99832
augaugauggccuccaaagaugcccccagcuccgccgacggagcuaacggcgcaggccaacucguccccgaagucaacaacgcagaaccccuaccccuugacccgguagccggcgccuccacugcccuagccacugcaggccaaguaaacaugauagaccccuggaucuuuaacaacuucguccaagcaccccaaggugaguucaccauaucuccaaacaacacccccggagacauccucuucgaucuccaacucggcccccaccuaaacccauuccuagcccaucucucccaaauguacaacggcuggguagguaacaugcgaguccgagucauccucgccggcaacgccuucaccgccggaaaaguaaucauaugcugcgucccucccggauuccagucccgcacccucuccaucgcacaagccacacucuucccacacaucaucgccgacguccgaacccucgaaccaauagaaaucccccucgaagacguacgaaacacgcuauaccacaccaacgacaaccagcccaccaugcgccuccucuguaugcuuuacacgccacuccgcaccggaggaggcucaggcggcacagaugcauucgucguagcaggccgcguacuaaccugcccaagcuccgacuucaacuuccucuuccucguaccacccacaguagaacagaaaacccgccccuucuccguaccaaacaucccacuacaacuccuaucaaacucucgcguuccaaaccucauccaaucaaugguccuuuccccagaccaagcacaaaacguccaauuccaaaacggcagaugcaccacggacggccaacuacucggcacaacuccagucuccgucucccaaauccuaaaauuccgcggcaaggucucagccggaucaaaaguaaucaaccuaaccgaacuggacgggucccccuuucucgccuucgaagcccccgcccccaccggcuuucccgaccucggaacaucggacuggcacgucgaaaugucucucaacagcaacucccaaucuuccggaaacccaauccuacuccgcgacauccacccaaacucaucagaguucgucccccaccuuggcucagucugcgucaccgcagccaucgaagucgcuggagacuacaccggaacuauccaauggaccucccagcccuccaaugucacacccguacccgacgucaacuucuggaccauaccacacuacggcuccaaccuagcagaagcaucccaacucgcuccugucgucuaucccccaggcuucggcgaagcaaucgucuacuucaugagccccauccccgguccgaacaccgcccacaaacccaaccucguaccgugccuacucccccaagaauuuguaacccacuucgucuccgaacaagcacccuccaugggagaagccgcccuuguccacuacguugaccccgacaccaaccguaaccucggcgaguucaaacucuaccccgaaggcuucaucacaugcguccccaacggcacgggcccccaacaacuuccucucaacggcgucuucguauucgccuccuggguaucuagauucuaccaacucaaacccguuggcacugcuucguccgcccgcggccgucucggcguacgucguuaa

SEQ ID NO: 37053 - RNA, 1647 nt, Artificial Sequence
  derived and/or modified sequence opt11 from capsid_protein__Norovirus__AHZ12735
augaaaauggcuucaaacgacgccacccccucuaacgacggcgccgcaggacucguccccgaaauaaauaacgaagccauggcacuggaacccgucgccggcgcugccaucgccgcuccacuuaccggccaacaaaacaucauagacccuuggauaaugaacaacuucguacaagcccccggaggagaguucacagucagcccccgcaacuccccuggcgaaguccuacuaaaccucgaacucggccaagaaaucaacccauaccuagcccaccuugcaagaauguacaacggauacgcaggaggcuucgaaguccaagucguccucgccggcaacgccuucaccgccggaaaaaucaucuucgcugccauaccucccaacuuccccaucgacaaccucuccgccgcccaaaucaccaugugcccacacgucaucguagacguacgccagcuagaaccuguuaaccucccaaugcccgacguacgcaacaacuucuuccacuacaaccaaggcuccgacucacggcuaagauuaguagccaugcucuacacuccccuacgugcaaacaacuccggagacgacguauucaccgugucaugccgcguacucacaagacccuccccagaguucuccuucaacuuccuugucccucccaccgucgaaucuaaaaccaaaccauucacucuacccauccucaccaucuccgaaaugucaaauucccgauucccaguccccauagacucucuccauacuucucccaccgaaaacaucgucguccaaugccaaaacggccgagucacucucgacggcgaacuaaugggaaccacacaacuucuccccucacaaaucugcgccuuucgcggaguccucacacgguccaccucccgcaccuccgaccaagccgacaccgccacaccccgccuauucaauuacuacuggcauauccaacuugacaaccuaaacggaaccccuuacgacccagccgaagacauccccggcccccuaggcaccccagacuuccgcggcaaagucuucggcgucgccagccaacgcaaccccgacuccaccacccgcgcacacgaagccaaagucgacaccaccgccggacgcuucacacccaaacucggcucccucgaaaucuccaccgaauccggcgacuucgaucaaaaccaaccaaccagauuuacccccguuggcaucggugucgaccgcgaggccgacuuccagcaauggucccuaccagacuacagcggacaauucacacacaacaugaaccucgccccugccguggccccuaacuuccccggcgaacaacuucuauucuuccgcucccaacuccccucuuccggaggccgcuccaacggcauccucgacugccucguaccacaagaauggguacaacacuucuaccaagaauccgcccccgcacaaacccaagucgcacucgucagauacgucaauccagacacaggccgcguccucuucgaggccaaacuccacaaacucggauucaugaccauagccaaaaauggcgacucuccuauuaccguuccacccaacggcuauuuccguuucgaaagcuggguaaaccccuuuuauacccuugcccccaugggaaccggcaacggcagacgacgcguacaauaa

SEQ ID NO: 37054 - RNA, 1647 nt, Artificial Sequence
  derived and/or modified sequence opt11 from capsid_protein__Norovirus__AHZ12736
augaaaauggccuccaacgacgccaccccaucaaacgacggggcagccggccuagucccugaaauaaacaacgaagccauggcccucgaccccguagccggcgccgcuaucgccgcaccccuuaccggccaacaaaacauaaucgaccccuggaucaugaacaacuucguacaagcaccaggaggagaguucaccgucuccccacgcaacucaccaggagaaguccuccugaaccuagaacucggccccgagaucaacccuuaucucgcccacuuagcacgaauguacaacggcuacgccgguggcuucgaaguccaagucguacucgcaggaaacgcauucacagccggcaagauaaucuucgcagccauaccacccaacuuccccauagacaaccucuccgccgcccaaaucaccaugugcccacacgucauugucgacguccgccaacuagaaccaguaaaucucccuaugccagacguccgcaacaacuucuuccacuacaaccaaggcucagacucccgacuccgccucguugccaugcuauacacaccccuccgggccaacaacuccggcgacgacgucuucaccgucuccugucguguccucaccagacccucaccagaguucuccuucaacuuccucguucccccaaccgucgaaucaaaaaccaaacccuucacccuacccauacucaccaucucugagaugucuaacucccgcuuucccguuccuaucgauucccuccacaccagccccacagaaaacauaguuguccaaugccaaaacggccgcgucacccucgacggcgaacucaugggcaccacacaacuccuccccucacaaaucugcgccuuccgcggaguccucacuagaucaacaucucgcgccuccgaccaggccgacaccgcaacaccccgccucuucaacuacuacuggcacauccaacuagacaaccucaacggcaccccauacgauccagccgaagacauccccggcccccucggaaccccagacuuccgcggcaaaguauucggcguagcaucccaacgcaaccccgacaacacaacccgggcccacgaagccaaagucgacacaaccgccgggcgcuucacccccaaacucggcucccucgaaaucuccaccgaauccggcgacuucgaccaaaaccaacccacccgauucacacccgucggcauuggagucgaccacgaagcugacuuccaacaauggucacucccagacuacucaggacaauucacacacaacaugaaccucgcacccgccgucgccccuaacuuccccggcgaacaacuccuauuuuuccgcucccaacugcccucaucagggggcagaucaaacggcauacucgacugccuagucccccaagaauggguccaacauuucuaccaagaauccgcccccgcucaaacucaaguagcccucgucagauacgucaaccccgacacaggccgcguccuauucgaagccaaacuucacaagcucggcuucaugacuauagccaaaaauggcgacuccccgauaacaguaccacccaacggcuacuuccgguucgaguccuggguuaaccccuuuuacacuuuagcccccaugggcacaggcaauggacgucgacgcguccaauaa

SEQ ID NO: 37055 - RNA, 1647 nt, Artificial Sequence
  derived and/or modified sequence opt11 from capsid_protein__Norovirus__AHZ12737
augaaaauggccucgaacgaugccgcccccuccaacgacggcgccgcaggacucguccccgaaaucaacuccgaagccauggcacuugaaccagucgccggcgccgcaauagccgcuccccucaccggucaacaaaacaucaucgaccccuggaucaugaauaacuucguccaagcccccggcggcgaguucaccguauccccacgcaacuccccuggcgaaguccuccuaaaccuugaacuaggccccgaaaucaaccccuaccuagcacaccucgcucgcauguacaacgguuacgccggcgguuucgaaguccaaguuguucuggcuggcaacgccuucaccgccggcaaaaucauuuucgccgcaaucccacccaacuuucccauagacaaccuuuccgccgcccaaaucacaaugugcccccacgucaucgucgacguucgucaacucgaacccgucaaccucccuaugccagacguccgaaacaacuucuuccacuacaaccaaggauccgacucacgccuccgccucaucgcaaugcucuacaccccacuacgcgcaaacaacucuggugacgacgucuuuacaguaucaugccgcguccucacccgcccaucacccgacuucuccuucaacuuccuugucccaccaaccgucgaaucaaaaaccaagcccuucucccuacccauacucacuaucagcgaaauguccaacucccgcuuucccgucccaaucgacucucuccacacuucacccaccgaaaacauaguaguacaaugccagaacggccgugucacccuggauggugaacuaaugggcaccacacaacuccuacccucccaaauaugcgcauuccgcggaacccucacccgcuccacaucacgcgcauccgaucaagcagacaccgcgacaccccgccuauucaacuacuacuggcacauccagcucgacaaccucaacggaacucccuacgaccccgcugaagacauccccggcccccucggaacccccgacuuccggggcaaagucuucggcgucgccucgcaacgaaacccugacgccaccacccgcgcacacgaagcaaaaauagacaccaccuccggacgauucacccccaaacucggcucccucgaaaucuccacagaauccgacgacuucgaucaaaaucaaccaacccgauucacccccgucggcgucggcgucgaccacgagccagacuuccaacaauggguacuccccgacuacgcaggccaauucacucacaacaugaaccuugcacccgccgucgcgccaaacuuccccggcgaacagcuacucuucuuccgaucccagcuccccuccuccggcggccgcucaaauggcauccuugacugccuaguaccgcaagaauggguacaacacuucuaccaggaauccgcccccagccagacacaaguagcacucguucgcuacgucaacccagacaccggccgcguccucuuugaagcaaaauuacacaaacucggauucaugacuauugcaaaauccggagacucacccaucacagucccucccaaugguuacuuucgcuucgaauccuggguaaaccccuucuacacccuggcccccaugggcaccggaaacggccgacgcagaauccaauag

SEQ ID NO: 37056 - RNA, 1647 nt, Artificial Sequence
  derived and/or modified sequence opt11 from capsid_protein__Norovirus__AHZ12738
augaaaauggcaucgaacgacgcgacccccaguaacgacggcgccgccggccuaguccccgaaaucaacaacgaagccauggcccucgaucccgucgccggcgccgccaucgcagcaccccuuaccggccaacaaaacaucauagacccauggaucaugaacaauuucguacaagccccuggaggagaauuuaccgucucaccucgcaacucgcccggcgaaguccuucuaaaccuugaacucggcccugaaaucaaccccuaccuagcccaccucgccagaauguacaacggcuaugcaggcggcuucgaaguacaagucguacucgccggcaacgccuucacagcaggaaaaaucauauucgccgccauacccccaaacuuuccaaucgacaaccucuccgccgcacaaaucaccaugugcccacacgucaucguagacguacgccaacucgaaccaguaaaccucccaaugcccgacguccgcaacaacuuuuuccacuacaaccaaggcuccgacagcagacuccggcuagucgccaugcucuacacaccccuucgagccaacaacuccggcgacgacguauuuaccgucucaugccgcguccucacccgaccauccccagaguucuccuucaacuuccucgucccaccaaccguagaauccaaaaccaaaccuuucacacuccccauccuaaccaucuccgaaaugucaaacagccguuuccccgucccaaucgacucccuccacacauccccaaccgaaaacaucguaguacaaugccagaauggccgagucacacuagacggcgaacucaugggcacaacccaacuacuucccucacaaaucugcgccuucaggggcguccuuacccgauccacaucacgcgccuccgaccaagccgacacggcuaccccucgccucuucaacuauuauuggcacauacaacucgacaaccucaacggaacacccuacgacccagcagaagacauccccggcccccuaggcaccccugacuuccgaggcaaagucuucggcguugcaucccagagaaaccccgacucaaccacccgcgcccacgaagccaaagucgacaccaccgccggacgcuucacaccaaaacucggcucacucgaaaucucuaccgaaagcggugacuucgaccaaaaccaacccacccgauucaccccaguugguauaggaguagaccacgaagccgacuuccaacaauggucccuacccgacuacucuggccaauucacccacaauaugaaccucgccccagccgucgccccgaacuuucccggagaacaacuacucuucuuccgaucacaacuccccuccuccggcggccgauccaacggcauacucgacugucucguaccccaagaauggguccaacacuucuaucaggaaucugcccccgcacagacccaagucgcccuaguucgcuacgucaaccccgacaccggccgcguccuauucgaagccaaacuucacaaacuaggcuucaugacuauagccaaaaacggagauucuccgaucacuguacccccaaacgguuacuuccgcuucgaauccugggucaaccccuucuauacccucgccccaaugggcacgggcaacggacgccgccguguacaauaa

SEQ ID NO: 37057 - RNA, 1647 nt, Artificial Sequence
  derived and/or modified sequence opt11 from capsid_protein__Norovirus__AHZ12739
augaaaauggcuuccaacgacgccacccccucaaacgacggugccgccggacucguccccgaaauaaacaacgaagcaauggcucuugaccccguagcaggcgcagccaucgcagcaccccucaccggccaacagaacaucaucgaccccuggaucaugaacaacuucguccaagcccccgggggcgaauuuaccgucucuccccgcaauucucccggcgaaguccucuuaaaccucgaacucggccccgaaaucaaccccuaucuagcccaccuagccagaauguacaacggauacgccggcgguuucgaaguacaagucguccuugccggaaacgccuucaccgccggcaaaaucauauucgccgccauaccacccaacuuccccaucgauaaucucuccgcagcccaaauaacaaugugcccacaugugauugucgacguccgccagcucgaacccguaaaccuacccaugccagacguacgcaacaauuucuuccacuauaaccaggguucagacucccgccuacgccuagucgccaugcuuuacacaccccuacgcgccaacaacuccggagacgacgucuucaccgucucaugccgcgugcucacccgcccaagcccagaguucuccuucaacuuccuagucccacccaccgucgaaucuaaaaccaaacccuucacccucccaauccucaccauaagcgaaauguccaacucacgcuucccgguccccaucgauucacuacauacaucacccaccgaaaacaucgucguccaaugccaaaacggaagagucacccuugacggcgaacuaaugggaaccacacaacuccuaccaucccaaaucugcgcauuccgcgguguacuaacucgauccacaucacgcacaucagaccaagccgacaccgccacaccccgccuauuuaacuacuacuggcacauacaacucgacaaccucaacggaacacccuacgaccccgccgaagacauaccgggcccccuugguacccccgacuuccguggcaaagucuucggcguagcaucccaacgcaauccagauucuacaacacgagcacacgaagccaaagucgacacaacagccggacguuucacuccgaaacucgguucacucgaaaucuccaccgaauccggagauuucgaccaaaaccaaccgacacgauucacacccgucggcauaggugucgaccacgaagccgacuuccaacaauggucucuuccagacuacagcggccaauucacacacaacaugaaccucgcacccgcuguugcccccaacuuccccggcgaacaacuccuauucuuccguucccaacuucccucaaguggaggccgcucaaacggcauccucgacugccugguuccacaagaauggguacaacacuuuuaccaagaauccgcacccgcccaaacacaaguagcccucguacguuauguaaaccccgauaccggacgcguacuauucgaagccaaacuacauaaacuagguuucaugacaaucgcuaaaaacggagacucuccgauaacaguaccaccaaacggcuacuuccgauucgaauccugggucaaccccuucuacacacuagccccgaugggaaccggcaacggccgccggagaguccaauaa

SEQ ID NO: 37058 - RNA, 1623 nt, Artificial Sequence
  derived and/or modified sequence opt11 from capsid_protein__Norovirus__AHZ12912
augaaaauggcguccucggacgccaacccauccgacggaucaaccgcaaaccuaguccccgaagucaacaacgaagugauggcccucgagcccguaguaggagccgccaucgcagcccccguugcaggacaacaaaacgucaucgaccccuggauccguaacaacuucguccaagcccccgguggagaguucaccgucucaccccgcaacgcccccggggaaauccucugguccgccccacuuggccccgaccucaacccauaccucucccaccucgcccgaauguauaacggcuacgccggcggcuucgagguucaagucauccucgcuggcaaugcauucacagccggaaaaaucaucuucgccgccguacccccaaacuucccaaccgaaggacuauccccaucccaagucacaauguucccccacaucaucguagacguccgccaacucgaacccguacuaaucccacuccccgauguacgcaacaacuucuaccacuacaaccagucaaacgacuccacaauaaaacucauagcaaugcuauacacaccucuacgcgcgaacaaugccggugaugacguauucaccgucuccugccgcguacucacccgccccucacccgacuucgacuucauauuccucguucccccaacggucgaaucccgaacaaaacccuucucgguuccuguccuaacaguagaagaaaugacaaacucaagauucccuaucccacuagaaaaacuauucaccggccccuccuccgccuucgucguccaaccucagaacggucgauguaccaccgacggcguacuucuaggaaccacccaacuaucccccgucucaaucugcacauuuagaggcgacgucacccacauccccggcucccacaacuacacuaugaaccucgccucccagaacuggaacuccuacgaccccacagaagaaauccccgcaccccucggaacccccgauuucgucggaaaaauccaaggaguacucacccaaaccacacgcacaaacggcagcacacgaggccauaaagcaacagucuacaccggaucagcugacuucuccccuaaacuaggccgaguccaauucgcaaccgacacaaacaacgacuucgaaaccaaccaaaacacaaaauucacgcccgugggagucauccaagacggcuccacaacccccagaaacgaaccccaacaauggguccucccaucguacucaggucgcaacauccacaacguccaccuggcccccgccgucgcccccaccuuccccggcgagcaacuccuuuucuuucgcuccaccaugcccggcugcucaggauacccaaauauggaccucgacugccuacucccacaagaauggguccaauacuucuaucaggaagcugcccccgcucaaucugacgucgcccuccuacgcuucgucaacccagacaccggaagaguccucuucgaaugcaaacuccacaagucaggcuacgucaccguugcacacaccggacaacacgaccucgugauacccccuaacggcuacuuccgauucgacuccugggucaaccaauucuacacacucgcccccaugggcaacggaaccggccgucgccgcgcccucuga

SEQ ID NO: 37059 - RNA, 1623 nt, Artificial Sequence
  derived and/or modified sequence opt11 from capsid_protein__Norovirus__AHZ12913
augaaaauggccucuucugacgccaaccccuccgacggcucaaccgccaaccuuguccccgaagucaacaacgaaguuauggcccuagagccugucgucggcgcagcaauugcagcccccgucgccggccaacaaaacgucauagacccguggauccgcaacaacuuuguacaagcucccggaggcgaguucaccgucucaccccgaaacgccccuggcgaaauccuaugguccgcuccccucggccccgaucucaaccccuaccucucccaccucgcccgcauguacaacggguacgcuggcggcuucgaaguccaagucauccucgccggcaacgccuucacugccggcaaaauaaucuucgcugcuguaccacccaacuuccccaccgaaggacuaucgcccucccaagucacaauguucccccacaucaucguagacgucagacaauuagaacccguacuaaucccacucccagacguccguaacaacuucuaccacuacaaccaaucaaacgacuccaccauuaaacucaucgcaaugcuauacaccccacuacgcgcaaacaacgccggagacgacguuuucacaguaucuugccgaguccucacacgaccaucccccgacuucgacuucaucuuccucgucccacccacagucgagucacgcacaaaacccuucucuguuccaguccucaccgucgaagaaaugacaaacucacgcuuccccauaccccuagaaaaacuauucaccggaccauccucugcauucgucguccaaccacaaaacggccgcugcacaacagacggaguacuacucgggacgacacaacugagccccgucucaaucugcaccuuccgaggcgacgucacacacauaccgggaucccacaauuacaccaugaaccucgcaucacaaaacuggaacucauacgacccaaccgaagaaauacccgccccucuuggcaccccagacuucguaggcaaaauacagggaguccucacccagaccacccgcaccaacggaagcacucgaggacacaaagccacggucuacaccggcuccgccgacuucuccccaaaacucggccgaguccaauucgcaaccgacaccaacaacgacuucgaaaccaaccaaaacaccaaauucacccccguaggcgucauccaagacggcucuaccacaccccgcaacgaaccccaacaauggguccuccccucguauuccggccgcaacauucacaacguacaccuagcaccagccgucgcccccaccuuccccggagaacaacuccuauucuuccgcucaacaaugcccggcugcucugguuaccccaacauggaccucgacugucuccucccacaagaauggguacaauacuucuaccaagaagcugcacccgcccaauccgacgucgcccuccuccgauucgucaaccccgacacugggcgaguacucuucgagugcaaacuccacaaauccggauacgucacggucgcccacaccggacaacaugaccucgucaucccacccaacggcuacuuccgcuucgacuccugggugaaccaauucuacacacuagcccccaugggaaacggcacaggacgccgacgugcccuauaa

SEQ ID NO: 37060 - RNA, 1623 nt, Artificial Sequence
  derived and/or modified sequence opt11 from capsid_protein__Norovirus__AHZ12998
augaaaauggccucuucugaugcaaaccccuccgauggaucaacagcaaaucucguccccgaggucaauaacgaaguaauggcccucgaacccgucgucggugccgccaucgcagcccccguagccggacaacaaaacguaaucgaccccuggauacgcaacaacuucguacaagccccagguggagaguucacagucuccccacgcaacgcacccggagaaauccuuugguccgcaccccucggcccagaccuaaaccccuaccucucccaccuagcccgcauguacaacggcuacgccggcgguuuugaaguacaaguuauccuagccggcaacgccuucacugcagguaaaaucauuuuugcugccgucccucccaacuuccccacugaaggccuuucccccucacaaguaacaauguucccccacaucaucgucgacguccgacaacuugaaccaguacucaucccccucccggacguccgaaacaacuuuuaccacuacaaccaaucaaacgaccccaccaucaaacucauugccaugcuuuacacgccccuccgcgcaaauaaugccggugacgaugucuuuaccgucuccugccgcguccuuacccgacccucccccgacuuugacuucaucuuccuugucccacccaccgucgaaucccguaccaaacccuucuccguccccguccuuaccguagaagaaaugaccaacucccgcuuucccaucccccuugaaaagcuauucacuggccccuccuccgccuucgucguccaaccccaaaacggccgcuguacaacagacggaguccuucuaggaaccacccaacucuccccgguaaacaucugcacuuuccgcggagacguaauccacaucuccggcucccguaacuacaccaugaaccuagccucacaaaacuggaacucauacgacccaacugaagaaauccccgcaccccucggcacaccagacuucguaggcaaaauacaaggcguacugacccaaaccacucgcaccaacggaagcacccgcggccacaaagccaccguauacacgggaucagcugacuucuccccuaaacucggucgcguccaauucgccaccgauacagacaacgacuuugaaaccaaucagaacacaaaauuuacacccguuggugucauccaagacgguuccacuaccccuagaaaugaaccccaacaauggguacuccccagcuacuccggccgcaacauccacaacguccaccuagccccagccguagcccccaccuucccaggagaacaacuucucuucuuccgcuccacgaugcccggaugcucaggauacccaaacauggaccucgacugccuacuaccccaggaauggguccaguacuucuaccaggaagccgccccugcccaaagcgaugucgcacuacugcguuucgucaacccugacaccggacguguccucuuugaauguaaacuacacaaguccggauacguaaccgucgcacacaccggccaacacgaccucguaauacccccuaauggcuauuuccgauucgacuccuggguaaaccaauucuacacauuagcuccaauggguaacggaacaggccgacgccgcgcccuauga

SEQ ID NO: 37061 - RNA, 1623 nt, Artificial Sequence
  derived and/or modified sequence opt11 from capsid_protein__Norovirus__AHZ13001
augaaaauggcuagcuccgacgccaaccccucugauggcuccaccgcuaaccucguacccgaaguaaacaacgaagucauggcccucgaacccgucgucggcgcagccauagccgcaccaguagccggccaacaaaacgucauagacccauggauacgcaacaacuucguucaagccccaggcggcgaguucaccguaucuccccgcaacgccccaggugaaauccuuugguccgcuccccuaggccccgaucucaaccccuaccucucccaccuagcccgaauguacaacggcuacgccggaggauucgaaguccaagucauccucgccggcaacgccuuuaccgcaggcaaaauuauauucgccgccgucccucccaacuuucccaccgaaggccucucacccucacaagucaccauguucccccacaucaucgucgacguccgccaacuugaacccguccucaucccccuccccgauguucgcaacaacuuuuaccacuacaaccaaucaaaugaccccaccauuaagcuaaucgcaaugcucuacacaccccuucgcgccaauaacgccggcgacgacgucuucaccgucuccugccgcgugcucacacgacccucacccgacuucgauuucaucuuucucgucccacccaccgucgaaucccgcaccaaacccuucagcguccccguucuuaccgucgaagaaaugacuaacucgcgcuuccccaucccccuagaaaaacuuuucaccggccccuccucugccuucgucguacaaccccaaaacggccgcugcaccacagacggcguccuccuaggcaccacucaacuuucacccguaaacauaugcaccuuccgcggcgacgucauccacaucucaggcucccgcaacuacacaaugaaccucgcaucccaaaacuggaacucauaugaccccaccgaagaaaucccagccccacucggcaccccagacuuugucggcaaaauccaaggaguacucacgcaaaccacacgcaccaauggauccacccguggccacaaagcaaccgucuacacaggcuccgcugacuuuuccccuaaacucggccgaguccaauucgccacagauacugacaacgacuucgaaaccaaccaaaacaccaaauucacacccguaggcgucauccaagacggcucaaccacuccccgaaacgagccccaacaauggguccuccccuccuacuccggccgcaacauccacaacguccaccucgcccccgcugucgccccaaccuucccaggugaacaacuccuauucuuucgcucgacaaugcccggcugcucuggauaccccaacauggaccuagauugccuccuaccgcaagaauggguccaguacuucuaccaagaagcggcccccgcacaaucagacguggcccuccuacgcuucguaaaccccgacaccggccgugucuuguucgaaugcaaacuccacaaaucaggcuacgucaccguugcacacaccggccaacacgaccucguaaucccuccaaacggcuacuuccgcuucgacucauggguaaaccaauuuuacacccucgcccccaugggcaacggcaccggccgucgacgcgcccucuga

SEQ ID NO: 37062 - RNA, 1623 nt, Artificial Sequence
  derived and/or modified sequence opt11 from capsid_protein__Norovirus__AHZ13004
augaaaauggccaguuccgacgccaaccccagcgacggcucaaccgcuaaccuaguccccgaagucaacaacgaaguuauggcacuggaacccguaguuggcgccgcaaucgccgcccccgucgccggccaacaaaacgucauugacccauggauacgaaacaauuucguccaggcacccggcggcgaguucaccgucucaccccgcaacgcacccggcgaaauccucuggucggcaccccucggcccagaccucaaccccuaccucucccaccuagcccguauguacaacggauacgccgguggcuucgaaguccaggucauccucgccggcaacgccuucaccgccggcaagaucaucuucgcagcaguucccccuaacuuccccaccgaaggccuaucccccucccaagucaccauguucccccacaucaucgucgacguccgccaacuagaacccguccucaucccccugcccgacguacgcaacaacuucuaucauuacaaccaauccaacgaccccacuaucaaauuaauagccauguuauacaccccucuaagagccaacaacgcaggcgacgacgucuucaccguaucaugccgaguccucacacgccccucacccgacuucgacuuuaucuuccucguucccccuacugucgaaucucgcaccaaacccuucuccgucccuguacucaccgucgaagaaaugacuaacucccgcuuccccaucccccuugaaaaacucuucacaggcccaucaagcgcuuucgucguacaaccccaaaacggccgaugcaccaccgacggcguccuccucggcacgacacaacuaucccccguaaacaucugcaccuuccgcggugacguaauacacauauccggcucacguaacuacaccaugaaccuagcuucccaaaacuggaacucauacgaccccaccgaagaaauccccgccccacucggaaccccugacuuugucggcaagauccaaggcguccuuacacaaaccacccgaacaaacggauccacacguggacacaaagcaacugucuacaccggcucagcagacuucuccccaaaacucggccgaguccaauucgcaacugacaccgauaacgacuucgagaccaaccaaaacaccaaauucacucccguaggugucauacaagacgguaguaccacccccagaaaugaaccucaacaguggguccuccccagcuacucaggaagaaacauacacaacguccaccucgcacccgcagucgcccccacauuccccggugaacaacuacucuucuuccgaucaacaaugcccggcuguuccgguuaccccaacauggaccucgacugccuucucccccaagaauggguacaauacuuuuaccaagaagccgcccccgcacaaucugacgucgcccuccuccgauuugucaacccagacaccggccguguccucuucgaaugcaaacuacacaaauccggcuacguuaccgucgcucauaccggccaacacgaccucguaaucccacccaacggcuacuuccgauucgacuccugggucaaccaauuuuacacucucgcccccaugggcaacggaaccggacgacgucgcgcccuauaa

SEQ ID NO: 37063 - RNA, 1623 nt, Artificial Sequence
  derived and/or modified sequence opt11 from capsid_protein__Norovirus__AHZ13010
augaaaauggcuuccuccgacgccaacccaucugacggcuccaccgcaaaccuaguacccgaagugaacaacgaagucauggcccuagaacccguugucggcgccgcaaucgccgcccccgucgccggccaacaaaacgucaucgaccccuggauacgcaacaacuucguacaagcccccggcggagaguucacagucucaccccgcaacgcccccggcgaaauccucugguccgcaccccucgggcccgaccucaaccccuaccucucucaccucgcccggauguacaacgguuaugccggaggauucgaaguccaagugauacuagccggaaacgccuuuaccgccggaaaaaucaucuucgcagcaguaccacccaacuuccccaccgaaggccuaucacccucucaagucaccauguucccccacauaaucguagacguccgccaacucgaacccguacuaaucccccuacccgacgucagaaacaauuucuaccauuacaaccaauccaaugaccccaccaucaagcucauagcaaugcucuacaccccacuccgcgcaaacaaugcaggcgacgacguauucaccgucuccugccgcguccucacccgucccagccccgacuucgauuucaucuuccuagucccaccaacaguagaaucucgcaccaaaccuuucuccguccccguccucacugucgaagagaugaccaacucccgcuuccccaucccacucgaaaaacucuucacaggccccucaagcgcauucguaguccaaccacaaaacggccgcugcaccacagacggaguacuacucggcaccacccaacucucaccagucaacauaugcacuuuccggggagacgucauucacaucucuggcucccgaaacuauacaaugaaccucgcaucccaaaacuggaacucauacgacccaaccgaagaaauacccgcaccccuggguaccccagacuucgucggcaaaauucaaggcguacucacucaaaccacacgaacaaacggcuccaccagaggacacaaagccaccgucuacacuggcagcgccgacuucagccccaaacucggcagaguccaauucgccaccgauacagacaacgacuucgaaacaaaccaaaacacaaaauucacccccguaggcgucauccaagacggaucaacaacuccccgcaacgaaccccaacaauggguccucccaucauacucaggccguaacauccacaacguccaccuagccccagccgucgccccaaccuuucccggcgaacaacuccuauucuuccgcagcaccaugcccggcugcucagguuaccccaacauggacuuagacugccuacucccacaagaauggguccaauacuucuaccaagaagcagcccccgcccaaucagauguagcccuccucagauuuguaaaccccgacacaggucgcgucuuauuugagugcaagcuccacaaauccggcuacguaaccgucgcccacaccggccagcacgaccucguaauucccccuaacggcuacuuccgauucgacagcuggguaaaccaauucuacacccucgcucccaugggcaacggaaccggccgccgccgcgcccucuag

SEQ ID NO: 37064 - RNA, 1623 nt, Artificial Sequence
  derived and/or modified sequence opt11 from capsid_protein__Norovirus__AHZ13015
augaagauggcauccucugacgccaacccuucggauggcucaacagccaaccucguacccgaagucaacaacgaagucauggcacucgaaccagucguuggcgccgcaauagccgcacccgucgccggccaacaaaacgucaucgacccauggauccgaaacaacuucguccaagccccaggaggugaauuuacagucucaccccgcaacgccccuggcgaaauacucugguccgccccacucggacccgacuuaaaccccuaccucucccaccuagcccgcauguacaacggcuaugcaggcggcuucgaaguccaaguaauccuugccggcaacgccuucacagcaggcaaaaucauauucgcugcggucccacccaacuuccccacagaaggccucucucccucccaggucaccauguucccccacaucaucguugacguacgccaacucgaacccguccucauaccccuacccgacguucguaacaacuucuaccacuacaaccaauccaacgaccccaccaucaaacugaucgcaaugcuauacacaccccuccgagcaaacaacgccggagacgacgucuucaccgucuccugccguguccucacccgacccucucccgacuucgacuucaucuuucucguaccucccaccguggaaucccgcaccaaacccuucuccguccccguccucaccguagaagaaaugacuaacucacgcuuuccaaucccacucgaaaaacuauucacaggaccaucauccgcguuuguuguccaaccccaaaacggccgcugcacaacggacggaguccuacucggcaccacccaacugucacccgucaauaucugcaccuuccgcggagacguuauccacauaagcggaucacgcaacuacaccaugaaccucgcaucccagaacuggaacucauacgaucccacugaagaaauccccgcuccccucggaacaccagacuucgucggcaaaauccaaggcguucuaacccaaaccacccgcaccaacggaucaacccgcggccacaaagcaaccgucuacacuggcuccgcagacuucagccccaaacugggacgcguccaauucgcaacagacacagacaacgacuucgaaaccaaccaaaacaccaaguucacaccugucggcguaauccaggacggcucuacaaccccacgaaacgaaccccaacaauggguccuccccucauacuccggccgcaacauccauaacguacaccuagccccagccgucgccccaacauuccccggcgaacaacuccuguucuuccgaagcacaaugcccggcuguuccgguuaccccaacauggaccucgacugccuacuaccacaagaauggguccaauacuuuuaccaagaagcagcacccgcccaaucagaugucgcccuucuccgcuucguaaacccagacaccggccgaguacucuucgaaugcaagcuccacaaguccggauacgucacugucgcccacacaggccaacacgaccuugucauaccaccaaacggcuauuuccgcuucgacuccugggucaaccaauucuacacacuugcaccaaugggcaacggcaccggacgccgacgcgcacuauga

SEQ ID NO: 37065 - RNA, 1623 nt, Artificial Sequence
  derived and/or modified sequence opt11 from capsid_protein__Norovirus__AHZ13020
augaaaauggccucuuccgacgccaaccccucggacggaucaaccgcaaaccucguucccgaaguuaacaacgaagucauggcacucgaacccgucgucggugcagccaucgcagcaccuguugccggccaacaaaacgucaucgaccccuggauacgcaauaacuucguccaagcaccaggcggcgaguucacagucucaccccgaaacgcccccggcgaaauccucuggucagccccucucggcccagaccucaaucccuaccucucucaccucgcacgaauguacaacggcuacgccggaggcuucgaaguccaggucauccuugccggcaacgccuucacugcaggaaaaaucauauucgcagcugucccacccaacuuccccaccgaaggccucucccccucccaagucacuauguucccccacauuaucgucgacgugcgccaacuagaacccguucucaucccccuucccgacguacgcaacaauuucuaucacuacaaucaaucaaacgaccccacaaucaaacucaucgccaugcucuacacaccacuccgcgccaacaacgccggcgacgacguauucacaguauccugccgcguccucacccgacccagcccagacuucgacuucauauucuuaguucccccaaccgucgaaucacguaccaaaccauucuccguccccguauuaaccgucgaagaaaugaccaacucucgcuuccccauuccccucgaaaaacuuuucacaggccccuccucugccuucgucguucaaccccaaaauggaagaugcaccaccgacggcguccuacucggcaccacccaacucucgccugucaacaucugcaccuuucgaggcgacgucauacacaucuccggcagccgaaacuacaccaugaacuuggcaucacaaaacuggaacuccuacgaccccaccgaagaaauacccgccccauuaggaacccccgacuucguggggaaaauacaaggaguccuuacccaaaccacccgaaccaacggaaguacccgcggacacaaagcaacagucuacaccggcuccgccgacuucuccccuaaacuaggccgaguccaauucgccaccgacacagacaacgacuucgaaaccaaccaaaacacaaaauucaccccaguaggaguaauacaagacggcuccaccacaccccgaaacgaaccccaacaauggguacuaccuagcuacuccggccgcaacauccacaacguucaccucgccccagccguagccccuaccuuuccaggugaacaacugcuauucuuccgcucaaccaugcccggcugcuccggcuaccccaacauggaccucgacugccuccucccucaagaaugggugcaauacuuuuaccaagaagccgcacccgcccaauccgacguagcccuucuccgcuucgucaacccugacaccggucgcguccuauucgaaugcaaacuccacaaauccggauacguaaccguagcccacaccggacagcacgaucuugucauacccccgaacggauacuuccgcuucgacuccuggguuaaccaauucuacacacuugcacccaugggcaacggaacaggaagacgacgcgcacuauaa

SEQ ID NO: 37066 - RNA, 1623 nt, Artificial Sequence
  derived and/or modified sequence opt11 from capsid_protein__Norovirus__AHZ13023
augaaaauggcaucauccgacgccaaccccuccgacggcuccaccgccaaccuaguacccgaaguaaacaacgaaguuauggcccuagaaccagucgucggagccgcaaucgccgcacccgucgccggacaacaaaacgucaucgauccguggauccgcaacaacuuuguccaagccccuggcggcgaguucaccguauccccacgaaacgcccccggcgaaauacucugguccgccccacucggcccggaccucaaccccuaccucucacaccucgcccguauguacaacggauacgccggugguuucgaaguacaaguaauccucgcgggcaacgccuucacagcaggcaaaaucaucuucgccgcugucccacccaacuuccccaccgaaggucucucucccucccaaguaaccauguucccccacaucaucgucgacguccgccaacucgaaccgguacucauuccauuacccgacguacgcaacaacuucuaccacuacaaccagucaaaugaccccaccauaaaacucauagcuaugcucuacacaccacuacgugccaauaacgcaggcgacgacguauucacugucuccugcagaguccuaacccgccccuccccagauuucgacuucaucuuccuaguucccccuacagucgaaucccgaaccaaaccauucucagucccaguccugaccgucgaagaaaugacaaacucacgcuuccccaucccucuagaaaaacuauucaccggccccuccucagcauucgucguccagccucagaauggccguugcacaacagacgggguccucuuagggaccacccaacucuccccagucaacaucugcaccuuccgaggagacgucauacacaucuccggcucacgcaacuacacgaugaaccucgccucacaaaacuggaacucuuaugaccccaccgaagaaauacccgcaccccuaggcaccccagacuucgucgguaaaauacaaggaguccuuacacagaccacccgaacaaacggcucaacccgcggccacaaagccacagucuacaccggaucagccgacuucucgcccaaacuaggccgaguccaauucgccacagacacugacaacgacuucgaaaccaaccaaaacacuaaauucacacccgucggaguaauacaagacggcuccaccacaccccgcaaugaaccccaacaauggguacuccccuccuacucaggucguaacauacacaacguccaccuagcccccgcaguagcgccgaccuucccaggcgaacagcuccucuucuuucguucaaccaugcccgguugcucaggauaccccaacauggaccucgacugccuccucccccaagaauggguacaauauuuuuaccaagaagcagcccccgcccaaucagacgucgcccuacuccgcuucguaaacccagacaccggacgaguucuuuucgaaugcaaacuacacaagucuggguacgucaccgucgcccacaccggccaacacgaccucgucauacccccuaacggguacuuccgcuucgacuccuggguaaaccaauucuacacucuagcacccaugggcaacggcaccggcagacgccgcgcucuauaa

SEQ ID NO: 37067 - RNA, 1545 nt, Artificial Sequence
  derived and/or modified sequence opt11 from capsid_protein__Norovirus__AIC32559
auggcucuugaacccguagucggcgcagcaauagcggcacccgucgccggccagcaaaacgucaucgauccuuggauccgaaacaauuucguccaagcacccggcggcgaguucaccguaucuccccgaaacgccccgggugaaauccuaugguccgcuccccucggaccagaccuaaaccccuaccuaucccacuuagcccgcauguacaacgguuacgcaggcgguuucgaaguccaaguuauccucgccggcaacgcauucacagccggcaaagucaucuucgccgccgucccacccaauuuucccacagaaggacuuuccccaucacaggucacaauguucccccacaucguaguagacgucaggcaacuagaaccaguccuaaucccacuuccagacguacgcaacaauuucuaccacuacaaccaauccaacgacccaaccauaaaacuaaucgccaugcucuacacaccccuacgcgcuaacaacgccggagacgacgucuucaccgucucaugccgcguccucacccgacccucccccgacuuugacuucaucuuccucguacccccaaccgucgaaucccgaaccaaacccuucagcguccccguccuuaccgucgaagaaaugaccaacuccagauuccccaucccccucgaaaaacuuuuuaccggcccauccuccgcauuuguuguccaaccccagaacggccguugcacuaccgauggcguacuccucggcaccacccaacucucacccguuaacauaugcacuuuucgcggagacguaacacacaucaccggaucccgcaacuacacaaugaaucucgccucacaaaacuggaacaacuacgaccccacagaagaaaucccagcaccccuaggcgcccccgacuucgucggaaagauacaaggaaugcucacccaaaccacccgcgcagacgguuccacccgcggccacaaagcuacagucuacacaggcucagcagacuucgcaccuaaacucggccgcguacaauucgaaacagacaccgaccacgacuucgaagcgaaccaaaacacaaaauucacaccugucggagucauccaagacggcuccaccacacaccgcaacgaaccccaacaauggguccuccccucuuauuccggccgcaacacucacaacguacaccuagccccagcagucgcccccacuuucccaggcgaacaacuacucuucuuccgauccaccaugccuggaugcuccggcuaucccaacauggaccucgacugccuacuaccccaagaguggguccaauacuucuaccaagaggccgcccccgcccaauccgacgucgcgcuccuccgauucgucaacccagacacaggacgaguacuuuucgaaugcaaacuccacaaguccggcuacgucaccgucgcccacaccggccaacacgaccucguaauaccacccaauggcuacuuccgcuucgacucauggguaaaccaauucuacacccuagcaccaaugggcaacggcgccggaaggcgccgagucgucuaa

SEQ ID NO: 37068 - RNA, 1617 nt, Artificial Sequence
  derived and/or modified sequence opt11 from capsid_protein__Norovirus__AID51474
auggcaucaaacgacgcaacccccuccaacgacggcgccgccggacucguucccgaaagcaacaaugaagccauggcacucgaacccgucguaggugcuagccuugccgcccccgugaccggccaaaccaauauaaucgacccauggauccgcacaaacuucguccaagcucccaacggagaguucaccgucucaccccgcaacuccccaggagaaauccuugucaaccucgaacucggcccagaacuaaacccauaccuugcccaccucgcccgcauguacaauggcuaugcaggaggcauggaaguucaagucaugcuagcuggcaacgccuucaccgcaggcaaaaucauuuucgcugcugucccacccuacuuccccgucgaaaaccucagccccagccagaucacaauguucccccacgucauaauagacguccgcacccucgaacccguccuacuacccaugccagacguccgauccacacucuuccacuucaaccaaaaagacgaacccaagaugcgccuuguagccaugcucuacacaccucuaagauccaacggcuccggcgacgacgucuucacagucucuugcagaauccugacacgucccuccccagaauuugauuucaccuaccuugucccacccaccguagaaucaaaaacuaaacccuucacccuacccguccuaacacucggcgaacucuccaauucccgcuucccccucucaaucgacgaaaugguaacuucacccaacgaaucaauagucguccaaccccaaaacggacgggucacacucgacggagaacuacuaggaaccacacaacuacaggccugcaacaucugcucuauccgcggcaaaguaaccggccaaguccccaaugaacaacacauguggaaucuugaaauaacaaaccucaacggcacccaauucgacccuaccgacgacgucccagcuccccucggcguccccgacuucgccggcgaagucuucggcguccuaucgcaacgcaaucgcggcgaauccaaccccgccaaccgagcacaugacgccgucgucgcaacauacucagacaaauacaccccaaaacuuggccuuguccaaaucggcaccuggaacacaaacgacguagagaaccaacccaccaaauucacaccaaucggccucaacgaaguagcaaacggccaccgcuucgagcaauggacccuacccagauacucuggcgcccuaacacucaacaugaaccucgcccccgcagucgcaccccucuuccccggagaacgccuccuuuucuuccgcuccuacgucccacucaagggcggcuucggaaacccagccaucgacugccuuguaccccaagaauggguccagcauuucuaccaggaaucugccccuagccucggcgacguugcgcucguccgcuacguaaaccccgacacaggacgaguacucuucgaagccaaacuccacaaaggcggcuuccucaccgucucaucuacaucaaccggacccguuguagucccagccaacggcuacuuccgauucgacucaugggucaaccaguucuacagccucgcccccaugggaaccggaaacggccgaagaagauuccaauaa

SEQ ID NO: 37069 - RNA, 1617 nt, Artificial Sequence
  derived and/or modified sequence opt11 from capsid_protein__Norovirus__AID51477
auggccuccaacgacgcaacucccuccaacgacggagccgcuggacucguacccgaaagcaacaacgaagccauggcacuagaaccaguagucggugccucccucgcagcacccgucacaggccaaaccaacauaaucgaccccuggaucagaaccaacuuuguccaagcccccaacggcgaauuuacuguauccccucgaaacuccccuggcgaaauccuaguaaaccucgaacucggcccggaacucaaccccuaccuggcccaccucgcaagaauguacaacggcuacgccggagguauggaaguacaaguuaugcucgccggcaacgccuucaccgcuggcaaaaucauauucgcagccgucccgcccuacuuccccgucgaaaaccuaucacccucacaaaucaccauguucccccacgucaucauugacguccgcacccucgaacccguccuccucccaaugcccgacguacgcuccacccucuuccacuucaaccaaaaagacgaaccaaaaaugcgccuugucgccauguuguacacaccccuacgcuccaacggaagcggcgacgauguauucaccguguccugccgcauccucacccgcccaucacccgaguucgacuucacauaccuaguacccccaacagucgaaucaaaaaccaaaccuuucacacuacccguacucacacucggcgaacuuucgaacagccgauucccacucuccaucgacgaaaugguaaccucacccaacgaaucaaucgucguccaaccccaaaacggucgcgucacccucgacggcgaacuccucggcacgacgcaacuccaagccuguaacauaugcagcauccggggaaaagucaccggccaaguucccaacgaacaacacauguggaaccucgaaaucaccaaccuuaacggcacccaauucgauccaacagacgacguccccgcaccccuaggagucccagacuucgcaggagaagucuucgggguccuaucccaacgcaaccgaggcgaauccaacccagccaaccgcgcccacgacgccgucgucgcaacauacuccgacaaauauaccccuaaauuaggacucguccagauagguaccuggaacaccaacgacguagaaaaucaaccaaccaaauucacccccauaggacucaacgaagucgccaacggccacagauucgaacaauggaccuuaccccgauacuccggugcauuaacccuaaacaugaaccuugcccccgccgucgccccucucuuuccaggagaacgucuacucuucuuucgcucuuacgucccacucaaaggcggauucggcaaccccgccaucgacugccucgucccccaagaauggguccaacacuucuaccaagaaucagcccccagccuaggcgacgucgcccucguucgcuacgucaacccugacacagguagagucuuauucgaagcuaaacuccauaaaggcggcuuccuaacagucuccuccacuuccaccggccccguuguggucccugcaaacggcuacuuccgauucgacuccugggucaaucaguucuacucucucgcacccaugggcacaggcaacggccgcagacgcuuccaauaa

SEQ ID NO: 37070 - RNA, 1617 nt, Artificial Sequence
  derived and/or modified sequence opt11 from capsid_protein__Norovirus__AID51480
auggccagcaacgacgcaaccccaucuaacgacggcgcagccggacuuguccccgaaucuaacaacgaagccauggcccucgaacccgucguaggagcaucacucgcagcaccaguaaccggccaaacuaacaucauagaccccuggauccgcacaaacuuuguccaagcccccaacggcgaguucaccguaucacccaggaacucccccggcgaaauacucgucaaucuagaacuuggccccgaacucaaccccuaccucgcccaccucgcacgcauguacaacggcuacgccgguggaauggaaguacaagucaugcuagcaggcaaugcauucacugccggcaaaauaauauucgccgccgucccacccuacuucccagucgaaaaccucucccccucccagaucaccauguucccacacguaaucauagaugucagaacccucgaaccaguccuccucccaaugcccgacguccgauccacccucuuucacuucaaccaaaaagacgaacccaaaaugcgacucgucgccaugcucuacaccccacuccgcagcaauggcucaggugacgacgucuucacugucuccugccgaauccucacaagaccaucccccgaguucgacuucaccuaccuagucccgcccacaguagaaucaaaaaccaaaccauucacccuaccaguccucacccugggagaacucagcaacucccgauucccccuguccaucgacgaaauggucaccaguccgaacgaauccauaguaguacaaccccagaacggccgcgucacccucgacggagaacugcuaggaacaacccaacuccaagcaugcaacauaugcucuauacgcggcaaagucacaggacaaguccccaacgaacaacacauguggaaccuggaaaucacuaaccucaacggcacccaauucgacccaacagacgacgucccagccccacucggaguacccgacuucgcaggagaagucuucggaguccucucccaacgaaaccggggcgaaagcaacccagccaaccgcgcccacgacgccguaguugcuaccuacucagacaaauacacccccaaauuaggccuaguccaaaucggcacuuggaacaccaacgaugucgaaaaccagccaacaaaauucacaccuaucggacucaacgaagucgcaaacggccaccgcuuugaacaauggacccuaccccgcuauuccggagcacucacacucaacaugaaccucgcacccgcagucgcuccccucuucccgggcgaacgacuucuauucuucagauccuacgucccacuuaaaggaggcuucggaaacccggccaucgacugccucguaccucaggaauggguccaacacuucuaccaagaaagcgcccccagccuuggagacgucgcacucguacgcuacguuaacccagauacgggccgaguacuuuucgaagccaaacuccacaaaggcggauuccucacugucuccucuacauccacaggccccgucgucguccccgccaacggcuacuuccgcuucgacuccugggucaaccaauucuacucacucgcccccaugggcacaggcaacggccggcgccgcuuccaauaa

SEQ ID NO: 37071 - RNA, 1617 nt, Artificial Sequence
  derived and/or modified sequence opt11 from capsid_protein__Norovirus__AID51483
auggccucgaacgacgcuacccccuccaacgacggagcugccggucucgucccagaauccaacaacgaagccauggcccucgaaccgguaguaggggccucacucgccgcccccgucaccggccaaaccaacaucaucgaccccuggauccguacaaacuucguccaagcccccaacggcgaguucacagucucaccccggaacuccccaggcgaaauccuuguaaaccuggaacugggaccagaacuuaacccauacuuagcacaccucgcccgcauguacaacggcuacgcaggcggcauggaaguccaagucaugcuagcgggaaaugccuuuacggccggcaaaaucauauucgccgcuguacccccauacuuccccgucgaaaaccuaucccccucccaaaucaccauguucccacacgucauaauugacguacgcacucuagaacccguauuacuccccaugccagacguacgcucgaccuuauuucacuuuaaccaaaaagacgaaccuaaaaugcgacucgucgccaugcucuacacccccuuacgcuccaacggcucgggcgacgacguauucacaguauccugccgcauccucacacgccccucucccgaguucgacuucacuuaccucgucccuccaacagucgaaucaaagaccaaacccuucacacuccccguccucacccucggcgaauuaucaaacagccgcuucccccucagcauagacgaaaugguaaccagccccaacgaauccaucgucguccaaccccaaaacggccgaguaacacucgacggcgaacuccucggcacuacacagcuccaagccugcaacauaugcucaauccgcggcaaagucacaggacaaguccccaacgaacaacacauguggaaccuagaaauaaccaaccucaacggaacacaauucgaccccaccgaugacguucccgccccacucggcgucccagacuucgcaggagaagucuuuggcguacucucacaaaggaacagaggcgaaucaaacccagcuaaccgagcccacgacgcuguagucgcaaccuacuccgacaaguacacacccaagcucggacucguccaaauagguaccuggaacaccaaugacguugaaaaccagccaaccaaauucacacccauaggccucaacgaagucgccaacgggcaccgcuucgaacaauggacccucccccgcuacuccggagcccucacccucaacaugaaccucgccccagccgucgcuccccucuuccccggcgaacgccuacucuucuuccgcuccuacguaccccucaaaggcggcuucggcaauccugccaucgacugcuuggucccacaagaauggguccaacacuucuaccaggaauccgccccgucccuaggcgacgucgcccuuguccgcuacguaaaccccgacaccggccgaguacuauucgaagccaaacuccacaaggguggguuccuaaccgucagcuccaccucaaccggcccuguggucguacccgccaacggcuacuuccgauucgacucaugggucaaccaauucuacucccuagccccaaugggcaccggcaauggccgacgccgcuuucaauaa

SEQ ID NO: 37072 - RNA, 1617 nt, Artificial Sequence
  derived and/or modified sequence opt11 from capsid_protein__Norovirus__AID51486
auggccuccaacgacgcaaccccauccaacgacggcgcagccggccuaguacccgaguccaacaacgaagcaauggcccucgaacccgucguaggagccucccuagccgcccccgugacaggucaaacaaacauaaucgaccccuggauccguaccaacuuuguccaagcccccaauggagaguucaccgucuccccacgcaacucccccggcgaaauccuugucaaccuagaacuaggcccagaacucaacccuuaccuugcacaccucgcccgaauguacaacggcuacgcuggcggaauggaaguccagguaaugcucgccgggaacgccuucaccgccggcaagaucaucuucgcagcagucccucccuacuuccccguggaaaaccuuucacccucacaaauaaccauguucccccacgucaucaucgacguccgcacccucgaacccguccuacuccccaugcccgacguacgcuccacccucuuccacuucaaccagaaagacgaacccaaaaugcgccuagucgcuaugcucuacacaccccuaagaucaaacggaagcggcgacgacgucuucaccguauccugccgcauccucacucgcccauccccagaguucgacuuuacauaccuugucccaccaaccgucgaauccaaaaccaaaccauucacucuacccgucuuaacccucggcgaacuaucaaacagccgcuucccacuuucaauagacgaaauggucaccucacccaacgaaucaaucgucguacaaccccaaaacggaagagucacucuagacggagaacuccucggcacaacccaacuccaagcaugcaacauaugcagcauccgcggaaaagucaccggccaaguacccaacgaacaacacauguggaaccucgaaaucacaaaccucaacggcacucaauucgauccaaccgacgacguaccagcaccccucggcguccccgacuuugccggagaagucuucggaguccucucacaacgaaacaggggagaguccaauccagcaaaccgagcccacgacgccgucguagccacuuacucagacaaauacaccccaaagcuaggacucguccaaaucggcaccuggaacaccaaugacgucgaaaaccaacccaccaaauucacacccauaggccucaaugaaguagccaacggacacagauucgaacaauggacacucccacgcuacagcggagcucucacccucaacaugaaccucgcccccgccgucgcaccccuauuccccggagaacgacuccuauucuucagaucuuacguaccccucaaaggcggcuucggcaacccggcaaucgacugccucgucccccaagaauggguccaacacuucuaccaagaaucagcacccuccuuaggugacgucgcacucguccgcuacgucaaccccgacaccggacgaguacuauuugaggccaaacuccacaaaggcggcuuccuuaccguuucaucaacguccaccggucccgucguaguccccgccaacggauacuuccgcuucgacucaugggucaaccaauucuacucccuggcacccaugggcacuggcaacggacgucgcagauuucaauag

SEQ ID NO: 37073 - RNA, 1617 nt, Artificial Sequence
  derived and/or modified sequence opt11 from capsid_protein__Norovirus__AID51489
auggccuccaacgacgcaacgcccagcaacgacggcgcagccggccucguacccgaaucaaacaacgaagccauggcccuugaaccggucgucggcgcaagccuagccgcuccaguaacuggccaaaccaacauaauugaccccuggaucagaacuaauuucguccaagccccaaacggcgaguucaccgucucaccccggaacuccccuggagaaauccuagucaaccucgaacuaggcccagaacugaaccccuaccucgcccaccucgcucgcauguacaacggcuacgccggaggcauggaaguccaaguuaugcucgcaggcaacgccuucacagccggcaaaauaaucuucgcugcaguuccacccuacuuccccguagaaaaccucucccccucccaaaucacaauguuuccccacgucaucaucgacguccgcacccuagaaccaguccuccuuccaaugccagacguccgaucaacacuuuuccacuucaaccaaaaagacgagccaaaaaugcgccucgucgcaaugcucuacacuccccuccgcucaaacggauccggcgaugaugucuuuaccgucuccugccgcauccucacccgcccaucacccgaguucgacuuuaccuaccucgucccucccacagucgaauccaaaacaaaacccuucacacucccgguccuaacccucggcgaacuauccaacucccgauucccccucuccaucgacgaaaugguuacgagccccaacgaauccaucguaguccaaccccaaaacggacgagucacucuagacggcgaacuacuaggaaccacccaacuucaagccugcaacaucugcuccauacgaggaaaagucacaggccaaguucccaacgaacaacauauguggaaucucgagauaacaaacuuaaacggaacacaauuugaccccaccgacgauguucccgcaccccucggcgucccugacuucgccggcgaaguuuucggcguccuuucccaacgcaaucgcggagaauccaaccccgccaaccgugcucacgacgcagugguagccacauacuccgacaaauacaccccaaaacucggacucguucaaaucggaaccuggaacaccaacgacgucgaaaaccaacccaccaaauucacaccaauuggacuaaacgaaguagcaaacggacaccgcuucgaacaauggacccuccccagauacagcggcgcccuuacccuuaacaugaaccucgccccagccgucgccccacuguuucccggugagcgccuccuauucuuccgcuccuacguaccucuaaaaggcggcuucggaaacccagccaucgacugccucgucccacaagaauggguccaacacuucuaccaagaaucagcccccagccuaggagacguagcccuaguccgauaugucaaccccgacaccggccgcguccucuucgaagcaaagcuacauaaaggcggcuuccucacggucuccagcaccucuaccggcccagucgucgucccagcaaacggcuacuuccgcuucgacucaugggucaaccaauucuacucccucgcccccaugggaaccggcaacggccgccgccgcuuccaauaa

SEQ ID NO: 37074 - RNA, 1617 nt, Artificial Sequence
  derived and/or modified sequence opt11 from capsid_protein__Norovirus__AID51492
auggccucaaacgacgcaacaccuuccaacgacggagccgccggccucguacccgaauccaacaacgaagccauggcacucgaaccaguugugggcgcaucacuagccgcaccugucacuggccaaaccaacaucaucgaccccuggauccgcaccaauuucguacaggcuccaaacggcgaauuuaccgucuccccaaggaacucacccggcgaaauccuugucaaccuagaacucggcccagaacuaaaccccuaucucgcccaccuagcccgcauguacaauggcuaugccggcggcauggaaguccaagucaugcuagccggcaacgccuucaccgcaggcaaaaucauauucgcagccguacccccuuacuuccccguugaaaaccucagccccucgcaaaucaccauguucccacacgucaucaucgacguccgaacacuagaaccaguccuacuuccaaugccugacguccgcagcacacuauuccacuucaaccaaaaagacgaacccaaaaugcgacugguugcaaugcucuacacgccccucagaucaaacggcuccggagacgacguauucaccgucuccugccgcauacuaacccgacccucacccgaguucgacuucaccuaucucgucccgcccaccgucgaaucgaaaacaaagcccuucacccuaccaguacucacccuuggagaacuaucaaacucacgcuucccacucuccaucgacgaaauggucacaucccccaacgaauccauagucguccagccacaaaacggccgcgucacccucgacggcgaacuacugggcacuacccaacuccaagccugcaacaucugcagcauccgcggcaaagucaccggccaagucccaaacgaacaacacauguggaaucuagaaaucacaaaccuuaacggcacccaguuugacccuacagacgacgucccagcaccccuaggcgucccagacuucgccggcgaaguauucggaguccugucccaacgcaaccgcggagaaucaaacccggcaaaucgcgcccacgacgccguagucgcaacauacagcgacaaguacacccccaaacuaggccuuguccaaaucggaaccuggaacacaaacgacgucgaaaaccaaccaaccaaauucacccccaucggacuaaacgaaguagccaacggacaucgguucgaacaauggacacucccccgcuacucaggagcacugacccuaaacaugaaccucgcgcccgcagucgcaccacucuuucccggugaacgccuccucuucuuccgauccuacguaccacuaaaaggcggcuucggaaaccccgccauugacugccuggucccacaagaauggguacaacacuucuaucaagaauccgcuccaucacucggagacgucgcacucguccgcuacguuaacccagacaccggacgcguccuauucgaagcaaagcuccauaaaggcggguuccucaccgucagcuccaccuccacuggccccgucgucguccccgccaacggguacuuccgauucgacuccugggucaaccaauucuacucccuagcccccauggguaccggcaacggucgacguagauuccaauaa

SEQ ID NO: 37075 - RNA, 1617 nt, Artificial Sequence
  derived and/or modified sequence opt11 from capsid_protein__Norovirus__AID51495
auggccagcaacgacgccacccccuccaacgacggugccgccggcuuaguacccgaaucaaacaacgaagccauggcccuagaacccgucgucggcgccucacuagcagccccagucaccggccaaaccaacauaaucgaccccuggauccgcacaaacuucguccaagcaccaaacggcgaguucacaguaucacccagaaacucccccggcgaaauccucguaaaccuagaacucgguccagaacucaacccguaccucgcccaccuugcccguauguacaacggcuacgcaggaggaauggaaguacaaguaaugcuagcaggcaacgccuucaccgcaggaaagaucaucuucgcagcaguacccccuuacuuccccguagaaaaccucucccccagccaaauaaccauguucccacacguaaucaucgacguacgaacacuagaacccguccucuuaccaaugccagacguccgcuccacacucuuccauuucaaccaaaaagacgaaccaaaaaugcgccuagucgcuaugcucuacacaccccuccgaucaaacggcagcggcgacgacgucuucaccgucucuugccgaauccucacccgacccucccccgaguucgacuuuaccuaccuugucccacccacagucgaaucuaaaaccaaaccauucacccuccccguacuuacccucggugaacucucuaacucccgcuucccccucuccauagacgaaauggucaccucaccuaacgaauccaucguaguccaaccccaaaacggccgcgucacccucgacggagaacuccucggcaccacccaacuucaggcuugcaacaucugcuccauccggggcaaaguuaccggccaaguccccaacgaacaacacauguggaaccucgaaaucacaaaccucaauggcacacaauucgaccccaccgacgauguccccgcuccccucggcguacccgacuucgccggcgaagucuucggcguccucucacaacguaaucggggcgaaucgaaccccgcuaaccgagcccacgacgcaguaguagcaaccuacucugacaaauacaccccaaaacuaggacuuguccaaauuggaaccuggaacaccaaugacgucgaaaaccaaccaacaaaauucacacccaucggauuaaacgaaguagccaacggucaccgauucgaacaauggacacucccccgcuacuccggcgcccucacauuaaacaugaaccucgcccccgccgucgcaccccuguuuccaggugaacgccuccucuucuuccgcagcuacgucccccucaaaggaggauucggaaaccccgccauagacugccuugucccccaagaauggguacaacauuucuaccaagaaagcgcccccucccucggagaugucgcccucguacgcuacgucaacccagacaccggacgcguacuauucgaagccaaacuccauaaaggcggcuuccucacaguaucaagcaccuccacaggacccgucguaguccccgccaacggauacuucagauucgacuccugggucaaccaauucuacucccuagccccuaugggcacuggaaacggccgccgccgcuuccaauaa

SEQ ID NO: 37076 - RNA, 1623 nt, Artificial Sequence
  derived and/or modified sequence opt11 from capsid_protein__Norovirus__AIE40036
augaaaauggccucaaacgacgccaaccccuccgacggcucagccgccaaccuuguccccgaaguaaacaacgaagucauggcacuagaacccgucguaggagcagccauagcugcccccgucgccggccaacagaacgucaucgacccauggauccgaaacaacuuugugcaagccccaggcggcgaguucaccguaagcccccguaaugccccaggcgaaauacucuggucagcuccacucggacccgaccucaaucccuaccuaucacaccuagcccgaauguacaacggcuacgcgggaggcuucgaaguccaaguuauccuagccgguaacgccuucaccgccggcaagaucauauucgccgccgucccacccaauuuccccaccgaaggccucucacccagccaaguaaccauguucccucacaucaucguagacguccggcaacucgaacccguccuaaucccccuacccgacguccgcaauaacuucuaccacuauaaccaaucuaacgacuccaccaucaaacuaaucgccaugcuauacacccccuuacgagcaaacaaugccggagacgacgucuucaccguaucaugccgcguccuaacccgccccuccccugacuucgacuucauuuuccuaguaccacccaccgucgaaucccgcaccaaacccuucucaguacccguucuaaccauagaagaaaugaccaauucccgcuuccccauaccccucgaaaaacuauucaccggccccagcucugccuucguaguucaaccccaaaauggccgcuguacaaccgacggcguccuacucggaaccacccagcucucacccguuaacauuugcaccuuccgaggcgacguaacacacauaaccggcucacgcaacuacacaaugaaccucgccucccaaaacuggaacaacuacgaccccaccgaagaaauccccgcaccccucggcaccccagacuucgucggaaaaauacaagguaugcucacccaaaccaccagaaccgacggaucgaccagaggccacaaagccaccgucuacaccggaucagcugacuucgcccccaaacucggcagaguccaauucgaaacugacaccgaccacgacuucgaagccaaccaaaacaccaaauucacgcccaucggcguaauccaagauggaucaaccacccaccgcaacgaaccccaacaauggguucucccaucuuacucaggccgaaacacccacaacguacaccucgcccccgcagucgcaccaaccuuccccggagaacaacuccuauucuuccguuccacaaugcccggaugcuccggauacccaaacauggaucucgacugccuccucccacaagaauggguacaauacuucuaccaagaagcagccccugcccaguccgacgucgcccuccuccgcuucguaaacccugacacaggccgcguacucuucgaaugcaaacuucacaaauccggcuacguaacgguagcccacacuggacaacacgaccuugucauacccccaaacggcuacuuucgcuucgacagcuggguuaaucaauucuacacacucgcgcccaugggcaacggaacaggacgaagacgcgcccucuaa

SEQ ID NO: 37077 - RNA, 1647 nt, Artificial Sequence
  derived and/or modified sequence opt11 from capsid_protein__Norovirus__AJW87644
augaaaauggccuccaacgacgccgccccguccaacgacggagcagcaggccucguccccgaaauaaacaacgaagccauggcccucgaaccaguagccggcgccgcuaucgccgcaccccucacaggacaacaaaauaucauagacccauggaucaugaacaacuucguacaggccccaggcggagaguucacaguaucuccccgcaacuccccaggcgaaguccuacucaaucuugaacucggcccagaaauaaacccuuaccucgcccaucucgccagaauguacaacggcuacgccggcggcuucgaaguacaaguaguucucgccggcaacgccuucaccgccgguaaaaucaucuucgccgccaucccacccaacuuccccaucgacaaccucuccgcugcccaaaucaccauguguccccacguuauagucgacgucagacaacucgaacccgucaaccuacccaugcccgauguccgaaacaacuuuuuccacuacaaucaaggcuccgacucccgacucagacucauagccaugcucuacacuccccuucgcgcaaacaacuccggagacgacguuuucaccguaucaugccgcgugcucacccgcccaucaccagacuucuccuucaacuuccuagucccacccaccgucgaauccaaaaccaaacccuucucucuacccauacucaccaucucugaaauguccaacucccgauuccccguacccaucgacucacuccacaccuccccuaccgaaaauaucguuguccagugccaaaacggccgcgucacccucgacggcgaacucaugggcacuacacaacuccuaccuucccaaauaugcgcauuccgcggcguccuaauccgcuccacaucccgugccuccgaccaagccgacacagccacaccccgccucuucaauuacuacuggcacauccaacucgacaaccucaauggcacccccuaugaccccgccgaagauauccccggcccacucggcacccccgacuuucgagggaaaguuuuuggagucgcaucccaacgcaaccccgacaccacaacccgugcccacgaggccaaaauagacacaaccuccggccgcuucacccccaaacuaggaucucuugaaaucuccaccgaauccgaugacuucgaccaaaacaaaccaacacgcuucaccccaguuggcauaggcgucgaccacgaagccgacuuccaacaauggacacucccggacuacgcuggccaauucacacacaacaugaaccucgccccagcagucgcccccaacuucccaggcgaacaacuacuauucuuucgcucacaacuacccagcuccggcggacgcucaaacggcauacucgacugccucgucccccaagaauggguccaacacuucuaucaagaaucagcccccucccagucccaaguagcccucguccgauacauaaacccagauacaggacgcguucuauuugaagcaaagcuccacaaacucggcuuuaucacaaucgccaaaaauggcgacucucccaucaccgugcccccaaacggcuacuuccgcuucgagucaugggucaaccccuuuuacacgcucgcacccaugggcaccgguaacggccgacgccgaauccaauaa

SEQ ID NO: 37078 - RNA, 1623 nt, Artificial Sequence
  derived and/or modified sequence opt11 from capsid_protein__Norovirus__ALG05457
augaaaauggccuccaaugacgcagcccccagcaacgacggcgcagccggccuagucccugaaggcaacaacgaaacucucccccucgaaccagucgcgggagccgccaucgcagcacccgucaccggccaaaacaauaucaucgauccauggauacgcaccaacuucguccaagcccccaacggagaguucaccguuuccccacgcaacuccccuggcgaaauacuccucaaucucgaacuaucccccgaccuaaaccccuacuuagcccaccucuccagaauguacaacggauacgcaggcggcgucgaaguccagguacuccuagccggcaacgccuucaccgcgggcaagauacucuucgccgccguacccccaaacuuccccgucgaguuccuauccccagcccaaauuacgaugcucccccaccucaucgucgacguccgcacacuugaaccuaucaugauuccucucccugacgucagaaacaccuucuuucacuacuccaaccaaccaaauucccgcaugcgacuugucgcaaugcucuacacaccccuacgcuccaacggauccggugacgaugucuucaccgucuccugccgcguucuaacucgaccuacaccagauuucgaauuuacauaccuaguuccgcccuccgucgaauccaaaaccaaacccuucucccucccaauccuuacucuauccgaacucaccaacagccgcuuccccguccccauagacucccuuuucaccgcccaaaacaauguccuccaaguacaaugccaaaacggaagaugcacccucgacggcgaacuacaagguacaacccaacuacuuccuucaggcauaugcgcauuccguggucgcgucacagcccaaauaaaccagcgcgaccgauggcacaugcaguuacaaaaccuaaauggaaccaccuacgaccccaccgacgacguccccgcaccccucggcacaccagacuucaaaggugucgucuucggcauggugucucaacgcaacguaggaaacgacgccccuggcuccacucgcgcccaacaagccuggguauccaccuacagcccacaauucguacccaaacucggcuccgucaacuuacgcaucuccgacaacgacgacuuccaauuccaacccaccaaauucacccccgucggugucaacgacgaugaugacggccaucccuuccgccaaugggaacuaccaaacuacuccggagaacuaacccucaacaugaaccuagcaccaccgguagcccccaacuuccccggcgaacaacuucucuuuuuccgcuccuuuguucccugcuccggaggcuacaaucaaggaaucaucgacugccucauaccccaagaauggauccaacacuucuaccaagaaucagcuccuucccaauccgaugucgcccuaauucgcuacguaaaccccgacaccggccgcacucuauucgaagccaaacuacaccgcuccggcuacauaaccguagcacacucuggcgacuauccccucgucguccccgcaaauggccacuuccgcuucgacuccugggucaaccaauuuuauucacucgcccccaugggcacuggcaacggucgccgccgcgcccaauga

SEQ ID NO: 37079 - RNA, 1623 nt, Artificial Sequence
  derived and/or modified sequence opt11 from capsid_protein__Norovirus__ALG05460
augaagauggcuuccaacgacgccgcgcccucuaacgacggcgcagcaggucuugucccugaaggcaacgacgaaacccucccucuagaaccugucgccggggccgccaucgccgcccccgucacaggccaaaacaacaucauugaccccuggauuagaacaaacuucguccaagccccuaacggagaauuuaccgucucgccccgaaacucaccuggcgaaauacuacuaaaccuagaacucggaccugaucuaaaucccuaccuagcccaccucucaagaauguacaacgguuaugccggcggcguagaaguacaaguccuccucgcaggcaaugcuuucaccgccggcaaaauccuguucgccgcaguaccacccaacuuccccguugaguuccuuucccccgcucaaaucaccaugcucccccaucuuauagucgacguccgaaccuuagaacccaucaugauacccuuaccugacguccgcaacaccuucuuccacuguagcaaccaaccaaacucccggaugcgacuugucgccaugcucuacacgccccuccgcuccaacggcucuggcgaugacguauucaccguuuccugccgcguccucacccgacccaccccagacuucgaguucaccuaccucgugcccccuuccgucgaauccaaaacaaaacccuucucccuacccauccuuacucuaucagaacuuaccaauucacgcuuccccguccccaucgacucccucuucacagcccaaaacaacguccuccaaguccaaugccagaacggccgaugcacccucgacggagaacuacaaggcaccacucaacuucucccauccggcaucugcgccuuccgcggccgcgucaccgcccaaaucaaccaacgcgaccgcuggcacaugcaacuacaaaaccucaacggcacaaccuacgaccccaccgacgacguccccgccccacuaggcacccccgauuucaaaggagucgucuucggcauggucucacaacgcaacgucggcaacgacgcccccggcuccacuagagcccaacaggccugggucuccaccuacucuccccaauucguacccaaacucgguuccguaaaccuccgcaucucugacaacgacgauuuccaauuccaacccacucaauucacccccgucggcgucaacgacgacgacgauggccaucccuuccgacaaugggaacuaccuaacuacuccggcgaacuaacccuuaacaugaaccuagccccaccugucgcaccaaacuuccccggagaacaacuccucuuuuuccguuccuucgucccaugcucaggcggcuacaaccaaggcaucauagacugccuaaucccccaagaauggauacagcacuucuaucaagaaucagcccccucccaaucagacgucgcucucauccgcuacguaaaccccgacacaggccgaacacuuuucgaagcaaaacuucaccguuccggauacaucaccgucgcucacuccggcgacuacccccuaguagucccagcaaacggacacuuccgcuucgacuccuggguaaaccaauucuacucccucgcccccaugggcacaggcaauggccgccgacgugcccaguaa

SEQ ID NO: 37080 - RNA, 1623 nt, Artificial Sequence
  derived and/or modified sequence opt11 from capsid_protein__Norovirus__ALL73873
augaaaauggcaucuaacgacgcagcacccuccaacgacggugccgcuggccucguacccgaaggcaacaacgaaacccuuccccucgaacccguagcaggagccgccaucgccgcccccgucacuggacaaaacaauaucaucgacccguggaucagaacaaacuucguucaagcccccaauggcgaauuuaccgucuccccacgcaacucccccggagaaauauuacucaaccuagaacucggucccgaccuaaacccuuaccuagcgcaucuaucccgaauguacaacggauacgccggcggagucgaaguccagguucuccucgccggcaacgccuucaccgcaggcaaaauccuuuucgccgccgucccacccaacuuccccguagaauuucuuucacccgcgcaaauaacaaugcucccccaccugaucgucgacguacgaacccucgaacccauaaugaucccccuacccgacguacgaaacaccuucuuccacuacucuaaccaacccaauucucgcaugcgucucgucgccaugcuauacacaccccuccgaagcaacggcucaggugacgacgucuucaccgucagcugccgcguccucacccgccccaccccggacuucgaguucaccuaccucgucccacccucagucgaauccaaaacgaagcccuucucccuccccauccucacccucucagaacucaccaacucccgcuuccccguaccaaucgacucucucuucacagcccaaaacaacguacuacaaguccaaugccaaaacggccgcugcacccucgacggcgaacuccaaggcaccacucaacugcucccauccgguaucugcgccuuccguggcagagucaccgcccaaaucaaccaacgcgaccgcuggcacaugcaauuacaaaaccucaacggcaccaccuacgacccaacugacgacguacccgccccacucggaacccccgacuucaaaggcgucgucuucggcauggucagccaaagaaacgucggauccgacgccccaggcaguacacgcgcccaacaagccugggucuccaccuacuccccucaguucguccccaaacucggauccgucaaccuacgaaucuccgacaacgacgacuuccaauuccagcccacgaaauucacccccgucggcgucaaugaugacgaugacggacaccccuucagacaaugggaacuacccaacuacuccggagagcucaccuuaaacaugaaccucgccccuccaguugccccaaacuuccccggcgaacaacuacucuucuuucgauccuucgucccaugcucuggcggcuacaaccaaggcauaauagacugccuaaucccacaagaauggauccaacauuucuaccaagaaucagccccaucucaaucggacgucgcucuuaucagauacguuaaucccgacacuggacgcacccucuucgaagcuaaacuccaccgcuccggcuacauaaccgucgcacacucaggcgacuauccacugguaguccccgccaacggucauuuccgcuucgacucuugggucaaccaauuuuacucccuagccccaaugggcacuggaaacggacgucggcgcgcccaauaa

SEQ ID NO: 37081 - RNA, 1623 nt, Artificial Sequence
  derived and/or modified sequence opt11 from capsid_protein__Norovirus__ALL73876
augaaaauggcuuccaacgacgccgccccaucgaaugacggagccgccggccucguccccgaaggcaacaacgaaacccuaccacucgaacccgucgccggcgcagcuaucgccgcccccguuacuggccaaaauaauauaauagaccccuggauccguacaaacuuuguccaagcccccaacggggaguucaccgucuccccacgaaauuccccaggcgaaauucuccuuaaccuagaacucggccccgaucuuaaucccuaccucgcccaccucucccgcauguacaacggauacgccggaggagucgaaguccaaguccuccuugcaggcaaugccuucacagccggcaaaauucucuucgccgccguuccaccaaacuuucccgucgaauuucucucacccgcccaaaucacuaugcucccucaccucaucgucgacguccgaacccucgaaccaaucaugaucccccuccccgacguccgcaacacuuucuuccacuauucaaaccaaccaaacucccgcaugcgccuagucgccaugcucuauacaccccuccgauccaacggaucuggcgacgacgucuucaccguauccugccgcguccuaacccgacccacccccgacuucgaguucaccuaccuugucccacccagcguagaaucuaaaaccaaacccuucucccuccccauccuuacccuaagcgaauuaaccaacucgcgguucccaguacccaucgacucucucuucaccgcccaaaacaacguucuccaaguccagugccaaaacggacgcugcacccucgacggugaacuccaaggaaccacccaacuacuccccagcggcauaugcgcauuccgcggccgcgucaccgcacaaaucaaccagcgcgaccgcuggcauaugcaacuccaaaaccucaacggcacaaccuacgaccccacagacgacguacccgcuccccucggcacacccgacuucaaaggagucguuuucggaauggucucccaacgcaacguaggcaacgacgcacccggaagcacccgcgcccaacaagccugggucucgaccuacuccccacaauucguccccaaacuaggcuccguaaaccuccgcauuucagacaaugacgauuuccaauuccaacccacuaaauuuacccccgucggagucaacgacgacgacgacggccacccguuccgccaaugggaacuccccaacuauucaggagaacucacccucaacaugaaccucgcaccucccguagcccccaacuuccccggcgaacaacuccucuucuuucguagcuucguacccugcagcggaggcuacaaccaaggcauaaucgacugccuaauuccgcaagaauggauacagcacuucuaucaagaauccgccccgucccaauccgacguagcccuaauccgcuacgucaacccagacaccggucgaacccucuucgaagcaaaacuccacagaucuggauacauaaccgucgcccacuccggagacuacccccucgucguccccgccaacggccacuucagauucgauuccuggguuaaccaauucuacucacuugcaccaauggguaccggcaacggcagacgcagagcacaauaa

SEQ ID NO: 37082 - RNA, 1623 nt, Artificial Sequence
  derived and/or modified sequence opt11 from capsid_protein__Norovirus__ALL73879
augaaaauggccucuaaugaugcagcccccuccaacgacggcgccgcaggccuaguccccgaagggaauaacgaaacccucccacucgaaccagucgcaggagccgccauagcugccuccgucaccggccaaaacaacaucauugacccauggauccgcacaaacuucguacaggccccgaacggcgaguucaccgucuccccacgcaacucccccggcgaaauccuccucaaccuugaacucggaccagaccucaaccccuaccucgcccaccucucccgaauguacaacggcuacgcaggcggagucgagguccaaguccuccucgccggcaacgccuuuaccgccggaaaaauccucuucgcagcuguaccuccaaacuuccccgucgaguuccucucccccgcacaaaucaccaugcuaccccaccugauuguagauguacgaacccucgaaccaaucaugauaccccucccagacguccggaacacuuucuuccacuacucaaaccaacccaacagccgcaugcgccuugucgcaaugcucuacacaccccuucgcuccaacggcuccggcgacgaugucuucaccguguccugccgcguucuuacccgccccaccccugacuucgaguucaccuaccuaguaccacccagcguagaaucaaaaaccaaaccauucucacuaccaauccuaaccuuaucagaacuaaccaacucccgauuccccguccccaucgacucacucuucaccgcacaaaacaauguccuccaaguccaaugccaaaacggacgcugcacccucgacggcgaacuacaaggcacuacacaacugcucccaucaggcauaugugccuucagaggccgcguaaccgcacaaauuaaccagcgagacagauggcacaugcaacuccaaaaccuaaacggaacaacauacgaccccaccgacgacgucccagcaccccucggcaccccagacuucaaaggagucgucuucgguaugguuucccaacgcaaugucggcaaugacgcccccggauccacccgcgcacaacaagcaugggucucaaccuacucaccccaauucguaccaaaacuuggcuccgucaaccuccgcaucuccgacaacgacgauuuccaauuccaaccaaccaaauucacacccgucggggugaacgacgacgacgauggccacccguuccgacaaugggaacuaccgaacuacagcggagaauuaacccucaacaugaaccuagccccucccgucgcucccaacuucccaggcgaacaacuacucuucuuccgaucuuucgucccaugcuccggcggcuacaaccaaggcaucaucgacugccucauaccacaagaauggauccaacacuuuuaccaggaaucagccccuucacaauccgacgucgcacucaucagauacgucaacccagauaccggccggacgcuauucgaagcaaaacuucaccgaucaggcuacaucaccguagcucacucaggagacuacccccuagucgucccagccaauggccacuuuagauucgacuccugggucaaccaauucuauucacucgcacccaugggcaccggcaacggacgacggcgcgcccaauaa

SEQ ID NO: 37083 - RNA, 1623 nt, Artificial Sequence
  derived and/or modified sequence opt11 from capsid_protein__Norovirus__ALL73882
augaaaauggccuccaacgacgccgccccauccaacgacggcgccgcagggcuaguccccgaagguaacaacgaaacccucccacuugaacccgucgcuggcgccgcaaucgccgcccccgucaccggccaaaauaacauaaucgaccccuggauccgcaccaacuucguacaagccccaaauggcgaauucaccgucucaccucgcaacucacccggcgaaauccuucucaaccuagaacucggccccgaccucaacccuuaccucgcccaccuaucccgaauguacaacggauacgccggcggaguagaaguccaaguacuccuagccggcaacgcauucacggccggcaagauccucuucgccgccguccccccuaacuuccccgucgaauuccuuuccccugcccaaaucacaaugcucccccaccucauagucgauguccgcacucuugaacccauaaugaucccgcuccccgaugucagaaacacuuucuuucacuacucgaaccaacccaacucccgcaugcgccucguugccaugcuauacacaccucuccgcucaaacgggucuggggacgacgucuucaccgucucaugccguguacuuaccagaccaaccccugacuucgaguucaccuaccucgucccacccuccguagaauccaaaacuaaacccuucucccuccccauccuaacccucagcgaacucaccaacucccgcuuccccguccccaucgacucccuauucaccgcacaaaacaacguccuacaaguccaaugccaaaauggacgaugcacccuagacggcgaacuccaaggaacuacacaacuucucccauccggcauaugugcauuccgcggccgcgucaccgcacaaaucaaccaacgcgaccgauggcacaugcaacuccagaaccucaacggcacaaccuacgaccccaccgacgacguacccgccccccucggcacacccgacuucaagggcguaguauucggcaugguaucccaacguaaugucggcaacgacgccccuggcuccacccgugcccagcaagcaugggucucaaccuacucuccccaauucguacccaaacucggcucagucaaccuccguaucucagauaaugacgacuuccaauuccaacccacuaaauucaccccaguuggcgucaaugaugacgacgauggacaucccuuccgccaaugggaacuaccaaacuacagcggcgaacucacccucaacaugaaccuggccccucccguagcccccaauuuccccggugaacagcuacuauucuuccggucguucguacccugcuccggaggcuacaaccaaggaauaaucgacugccuaaucccccaagaauggauccaacauuucuaccaagaaagcgcccccucccaguccgacgucgcccucauccgcuacgucaacccagacacaggccgcacccuuuucgaagccaaacuucaccgcuccggcuauauuaccguggcacacucuggcgacuacccccucgucgucccagccaauggccacuuccguuucgacuccugggucaaccaauucuacucacucgcuccaaugggcacuggcaacggucgccgccgagcccaauga

SEQ ID NO: 37084 - RNA, 1623 nt, Artificial Sequence
  derived and/or modified sequence opt11 from capsid_protein__Norovirus__ALL73888
augaaaauggccuccaacgacgcugcccccucgaacgacggagccgcaggccuuguccccgaaggcaacaacgaaacacuuccccucgaaccaguggcaggagcagcaauugccgcuccagucaccggccaaaacaacauaaucgacccauggauucggacaaacuucguacaagcccccaacggagaguucaccguguccccaagaaauuccccaggagaaauccuccuuaaccucgaacucggccccgaccuaaacccuuaccucgcacaccucucccgcauguauaauggauacgcaggcggcgucgaaguccaaguccuacucgcuggcaacgccuucacagcaggcaaaauacuauucgcagccguacccccuaacuuccccgucgaguuccucucacccgcccaaauaaccaugcucccacaccucaucguagacguucgcacccucgaacccauaaugaucccccuccccgacguucgcaacaccuucuuccauuacagcaaucaacccaauucaagaaugcgccucguagcuaugcuuuauacuccccuacgcuccaacggcucuggagacgacgucuuuaccgucagcugucgaguucuaacacgccccacccccgacuucgaguucacauaccucguacccccuuccgucgaauccaaaaccaaacccuucucccuccccauccuaacacuauccgaacuuacuaacucucgauuccccguuccuaucgacucccucuucacagcccaaaacaacguccuccaaguccaaugccaaaacggacgcugcacccuagacggagaacuccaaggaaccacucaacuucuccccuccggcaucugcgccuuccgcggccgcgucacagcccaaaucaaccaacgugaccgcuggcacaugcaauuacaaaaccucaacggcaccaccuacgacccaaccgacgacgucccagccccacuaggcaccccugacuuuaaaggcgucguauucgguauggucucccaacgcaacgucggcaacgacgcccccggcuccacccgcgcccaacaagccugggucucaaccuacagcccccaauucguacccaaacucggcuccgucaaccucagaauauccgacaacgacgacuuccaauuccaacccacgaaauucacccccguaggcgucaacgacgacgacgacggccaccccuuccgccaaugggaacuccccaacuacuccggcgaacuuacacuaaacaugaaccuagcaccacccguagcacccaacuuccccggagaacaauuacuauuuuuccgcuccuucgucccuugcucaggcggauauaaucaaggcauaaucgacugccuaaucccccaagaauggauccaacauuucuaccaagaauccgcacccucccaauccgacgucgcccucauacgauacguaaacccugacaccggccgcacacuuuucgaagcaaaacuccaccgcuccgguuacaucaccgucgcccacucgggcgauuacccccuagucguacccgccaacggccacuuucgauucgacucaugggucaaccaauucuacucccucgcucccaugggcaccggcaacggccgcagacgcgcccaauag

SEQ ID NO: 37085 - RNA, 1623 nt, Artificial Sequence
  derived and/or modified sequence opt11 from capsid_protein__Norovirus__ALQ43927
augaaaauggcaagcuccgacgcaaauccauccgacggcuccgccgcaaacuuaguccccgaaguaaacaacgaagucauggcccuugaaccagucgucggcgccgccaucgccgcacccgucgccggacaacaaaacgucaucgaucccuggaucagaaacaacuucguacaagcccccggcggcgaauuuaccguuucuccccgcaaugcccccggagaaauccucuggucugcaccccuaggacccgaccugaaccccuaccugucccaccucgcccgcauguacaacggcuacgccggcggcuucgaaguacaagucauccucgccggcaacgccuucacagccggcaaagucaucuucgccgccguaccuccuaacuucccuaccgaaggccucucacccucccaaguuaccauguuuccacacauugucguagacguccgccaacuagaacccguccugaucccacuccccgacguaagaaacaacuucuaccacuacaaccaguccaacgaccccacaaucaaacuaauagccaugcucuacaccccacuacgcgcaaacaacgcuggagacgacgucuucacugucucaugccgcguauuaacccgccccucccccgacuucgacuucaucuuccucgucccacccacaguugaaucacgcacaaaacccuucagcgucccuguccucacaguagaagaaaugacaaacucccgauuccccaucccccucgaaaagcuauucacaggccccucaagcgcuuucgucguccaaccccaaaacggccguugcaccacagacggcguccuccucggaacuacgcagcuaucacccguaaacaucugcaccuucagaggcgacgucacccacauaaccggcagucacaacuauaccaugaaccucgccucccaaaacuggagcaacuacgaucccacagaagaaaucccugcgccccuugguacccccgauuucguaggcaaaauacaaggcguccucacccaaaccacccgcaccgacggcucaacccgcggccacaaagccacagucuauaccggcucagccgacuucgcccccaagcucggcagaguacaauucgagacagacacugaccacgacuucgaagcaaaucaaaacaccaaauucacccccguaggcgucauucaagacgguggcaccacccacagaaacgaaccacagcaguggguccuaccuuccuacucaggacgaaacacccccaacguacaucuagccccagccgucgcaccaacauuccccggagaacaacuccuuuucuuucgcagcaccaugcccggcugcuccggcuaucccaacauggaccucgauugccuccuaccccaagaauggguccaauacuucuaccaagaagcggcccccgcccaguccgacgucgcacuccuccgguucgucaacccagacaccggccgcguccucuucgaauguaaacuacacaaauccggauacgucacaguugcccacaccggacaacacgaucucguaauacccccaaacggcuauuuucgcuucgacuccugggucaaccaauuuuacacccucgccccgaugggaaauggcaccggacgccgucgcccacuauaa

SEQ ID NO: 37086 - RNA, 1623 nt, Artificial Sequence
  derived and/or modified sequence opt11 from capsid_protein__Norovirus__ALQ43928
augaaaauggccucaucagacgcuaaccccagcgacggauccgcugccaaccuugucccagaagucaacaacgaagucauggcccuugaacccgucgucggcgccgcaauagccgcccccguggcaggccaacaaaacgucaucgaccccuggauccgcaacaacuucguacaagcacccggcggcgaauuuaccguuucacccagaaacgcacccggcgaaauccugugguccgcuccccucggccccgaccucaaccccuaccucucacaccuagccagaauguacaacggcuaugccggagguuucgaaguccaagucauucuagcagguaacgccuucaccgcuggcaaaguaaucuucgccgcagucccacccaacuuccccaccgaaggucuuucccccucacaagugaccauguucccacacauaguugucgacguccgccaacucgaaccaguccucaucccccucccagacguccgcaacaacuuuuaccacuacaaccaauccaacgacccaaccaucaaacuuaucgccaugcuuuacacaccccuaagagcaaacaacgccggcgaugacguuuucaccgucuccugccgaguacucacccguccgagccccgacuucgacuucauauuccucguacccccuaccguagaaucacgcaccaagcccuucucuguucccguccuaacagucgaagaaaugaccaacucccgauuccccaucccccucgaaaaacuguucaccgguccauccagcgccuucgucguccaaccacaaaauggccgaugcaccaccgacggcguccuccucgguaccacccaacucucgcccgucaauaucugcacauuucgaggagacgucacccacauaacaggcucacgaaacuacaccaugaaccuagccucccaaaauugguccaacuacgaucccacagaagaaauccccgcaccccucggcacccccgacuucgucggcaaaauccaaggaaugcuaacccaaaccacccgcaccgacgguuccacccgcggccacaaagccacugucuacacuggcucugccgauuuugccccaaaacucggccguguccaauucgaaaccgacacugaccacgacuucgaagcuaaccaaaacaccaaauucacccccgucggcguaauccaagacggauccacaacccaccgcaacgaaccacaacaauggguacucccaagcuauucaggccgaaacacacccaacguacaccuagcacccgccguagcccccaccuuccccggagaacagcuacucuucuuccgcuccaccaugccgggcugcuccggauauccaaacauggaucuagacugccuacuuccacaagaauggguccaauacuucuaccaagaagccgcccccgcccaauccgauguagcccuacuacgguucgucaaccccgacacaggccguguccucuuugaaugcaaacuacacaaauccggauacgucacugucgcccacaccggacaacacgaccucguaauacccccaaacggauauuuccgcuucgacucuuggguaaaccaauucuacacacuagcccccauggguaacggaacgggacgccgccgcccccuuuaa

SEQ ID NO: 37087 - RNA, 1623 nt, Artificial Sequence
  derived and/or modified sequence opt11 from capsid_protein__Norovirus__ALQ44123
augaaaauggcuucaaacgacgcugccccauccaaugacggugccgcaggccuugucccugaaggcaacaacgagacccuaccccuagaaccugucgccggggcagccaucgccgccccagucaccggacaaaacaauauaaucgaucccuggauacgcaccaacuucguccaggcccccaacggcgaauuuacaguaucuccccgcaacucccccggagaaauccuacucaaccucgaacuaggaccagaccuuaaccccuaucucgcccaccucucacgcauguacaacggcuacgccggcggugucgaaguccaaguacuccuagcuggcaacgccuucacagccggcaagauucucuucgccgccguacccccaaacuuucccgucgaguuccuaucgcccgcccaaaucaccaugcuaccucaccuaaucgucgacguaagaacccuagaacccaucaugaucccccugcccgacguccgcaacaccuucuuucauuacuccaaccaaccuaacucccgcaugagacucgucgccaugcuauacacaccccuaagaucaaacggcucaggcgacgacgucuucaccgucucaugccgaguucucacccgcccuaccccagacuucgaauuuacuuacuuaguacccccaucggucgaauccaaaaccaaacccuucucccuccccauccucacacucagcgaacucaccaacagccgcuucccgguccccaucgacucucuauuuaccgcucaaaacaacguccuccaaguccaaugccaaaacggacgaugcacauuagacggugaacuucaaggcacuacacaacuccuaccuaccgggaucugcgccuuucgcggccgcgucaccgcccaaauaaaccagcgcgaccguuggcacaugcaacuccaaaaccucaacggcaccaccuacgaccccaccgacgacgucccugccccacucggcacccccgacuucaaaggugucgucuucggcaugguaucccaacgcaacgucggcaacgacgccccagguucaacacgcgcccaacaggccugggucuccacauacuccccacaguucguucccaaacuaggcucggucaaccuccgaauauccgacaacgaugacuuccaguuccaaccaaccaaauucaccccugucggcgucaaugacgacgacgacggccacccguuccgccaaugggaacuacccaacuacuccggcgaacucacccucaacaugaaccuagccccucccgucgcccccaacuuccccggcgaacaacuucuuuucuuccgcuccuucguccccuguagcggcggcuauaaccaaggcaucaucgacugucuuauaccccaagaauggauacaacacuuuuaccaagaauccgcacccucacaaucagacguagcccuaauccgcuauguuaacccugacaccggccgcacccuauucgaagcaaaacuacaccgcuccggcuacauaaccguugcucacuccggagacuacccccucgucguccccgccaacggccacuucagauucgacuccuggguaaaccaauucuauucccuagccccaaugggcacuggaaacggccgaagacgcgcccaauaa

SEQ ID NO: 37088 - RNA, 1623 nt, Artificial Sequence
  derived and/or modified sequence opt11 from capsid_protein__Norovirus__ALQ44124
augaaaauggccucuaacgacgccgccccauccaaugacggcgccgcaggccucguccccgaaggaaacaacgaaacccuaccccucgaacccguagccggcgccgccaucgcagccccagucacaggccaaaauaacaucauagaccccuggauacgcaccaacuucguacaggcaccaaacggcgaauucaccgucucuccccgcaauuccccaggcgaaauacuccucaaccucgaacuaggccccgaccucaaccccuaccuagcacaccuaucacgcauguacaacggauacgcaggcggagucgaaguccaaguacuccuggccggcaacgcuuucaccgccggcaaaauacucuucgcugcgguccccccaaacuucccuguagaauuccuaucccccgcccaaaucaccaugcucccccaccuaaucguagacguacggacgcucgaaccuaucaugauaccucuccccgacguccgcaacacauucuuccacuacuccaaccaacccaacucccgaaugcgccucgucgccaugcucuacacaccccucaggucaaacggcucaggagacgacgucuucacggucuccugccgcguacucacucgccccacccccgauuucgaauucaccuaccuaguuccccccuccgucgaguccaaaacuaaaccauucucacucccuauccuaacacucucagaacucacaaauucacgcuuccccguccccaucgacucgcuuuucacugcccaaaacaacguacuccaaguccaaugccaaaacggccguugcacccucgacggcgaacuccaaggcaccacacaacuacuccccagcggcaucugcgcuuuccgaggccgcguaaccgcccaaaucaaucaaagagaccgauggcacaugcaacuccaaaaccucaacggcacaaccuacgaccccacugacgacguacccgccccccuaggcacccccgacuucaaaggcguagucuucggaauggucucacaacgaaacguagguaacgaugcacccggcagcacucgcgcucaacaagccugggucuccacauacucuccccaauuuguccccaaacuaggcuccgucaaccucaggaucucagacaacgacgacuuccaauuccaaccaacuaaauucacccccgucgguguaaacgacgacgacgacggccauccauuccgccaaugggaacucccaaacuacagcggcgaacucacacucaauaugaaccuagcaccccccgucgcccccaacuuccccggcgaacaacuccucuucuuccgcucauucgucccaugcuccgguggcuacaaccaaggcaucauugacugccucauuccgcaagaauggauacaacacuucuaccaagaaagcgcccccucacaaucggacgucgcccucauccgcuacgucaacccugacaccggccgcacacucuucgaagccaaacuccaucguucaggcuacauaaccguagcgcauucuggcgacuacccacucguaguacccgcaaauggccacuuccgcuucgacuccugggucaaccaauucuacucccucgcacccaugggcacaggaaacggucgccgccgagcccaauaa

SEQ ID NO: 37089 - RNA, 1623 nt, Artificial Sequence
  derived and/or modified sequence opt11 from capsid_protein__Norovirus__ALQ44125
augaaaauggccucaaacgacgccgccccgucuaaugacggugcagccggccucguccccgaaggcaacaacgaaacucucccccuugaacccgucgccggagcagccauagcugcaccagucaccggacaaaacaacaucauugaccccuggauccgcaccaacuucguacaagccccaaacggcgaauucaccgucucccccagaaacucgcccggcgaaauccuccucaaccucgaacuaggacccgaccucaaccccuaccucgcccaccucucccgaauguacaacggauacgccggaggugucgaaguacaaguacuccucgcaggaaacgcauucacagcaggaaaaauccucuucgccgcagucccccccaacuucccagucgaauuccuaucccccgcccaaaucacaaugcucccccaccucaucgucgacguuagaacccucgaacccaucaugaucccccucccugacguccguaacaccuucuuccacuauuccaaccaaccgaacagccgcaugcgccuuguugccaugcuuuacaccccacuccgcagcaacggcuccggcgacgacgucuucaccguaucaugucgugucuuaacccgacccaccccagacuucgaauucacauaccucguacccccuagcgucgaauccaaaaccaaacccuucucccucccaauccucacgcucucagaacucacaaacucacgauucccuguacccauugacucacucuucaccgcccaaaacaacguccuacaaguccaaugccaaaacggccgauguacccucgauggcgaauuacaaggcaccacccaacuccuuccaucugguaucugcgcauuccgaggaagaguuacugcccaaauuaaccaacgagaccgauggcauaugcaacuacaaaaccuuaacggcacgacauaugaccccacagacgacguccccgccccucucggcaccccagacuucaaaggcgucgucuucggcauggucucccaaagaaacgucggaaacgacgccccaggcucaacccgcgcccaacaagccuggguaucuaccuacuccccccaauucguaccuaaacucggcagcguuaaccuucgaauuucagacaacgacgacuuccaauuccaacccaccaaauucacccccgucggcgucaacgacgacgacgacggucacccauuccgacaaugggaacuacccaacuacagcggcgaacuaacacucaauaugaaccucgccccccccgucgcacccaacuuccccggcgaacaacuacucuucuuccgcuccuucguucccugcagcggcgguuacaaccaaggcauaauagacugccucaucccccaggaguggauccaacacuucuaccaagaauccgccccaucucaauccgacgucgcccucauccgcuacguaaacccagacaccggcagaacacucuucgaagccaaacuacaucgauccggcuacauuaccgucgcccauucuggagauuacccccuuguuguucccgcaaacggacauuuucgcuucgacuccuggguuaaucaguucuacucccuggccccaauggguacaggcaauggccgccgccgcgcccaauga

SEQ ID NO: 37090 - RNA, 1644 nt, Artificial Sequence
  derived and/or modified sequence opt11 from capsid_protein__Norovirus__BAB83514
augaaaauggcguccucugacgcagcccccuccaccgacggcucugcaggccucguacccgaagucaacaacgaaacaauggcacucgaaccugucgucggcgcaccccucgccgcacccgucgccggccaacacaacauaaucgaccccuggaucaaaaugaacuucguacaggcccccaacggagaguucaccgucagcccccgaaaugccccaggcgaaauccuucucgaccucgaacuuggacccgaccucaacccauaccucagccaccuagcucgcauguacaacggauacgccggcggcauggaaguucaagucguucuagccggcaacgccuucacagccggaaaaauuaucuucgccgcagucccaccaaauuuccccgccgaaaaccucagcgccgcgcaagucaccaugugcccccacguaaucguugacguacgccaacuagaaccagucaugcuccccaugcccgacauccgaaacaaacucuuccacuacaaccaaguagacgacccaaaacuccgccuucuagccuaccuauacacgccacuccgcgcaaacaacgccggcgacgacgucuucaccgucuccugccguguacuaacccgcccuaccccagacuucgaguucauguuccucgucccacccaccgucgaauccaaaaccaaacccuucucccuccccucccuaacccuugacgaacugucaaacagccgcuuucccgcccccaucguccaacucuacaccaacccacacgacaaccuaguaguucaaccccaaaacggacgcugcaccaucgauggccuacuacaaggcaccacucaacucgucucuugcaacgucugcuccuuccgcggcaccauaggagacggacaaccagcaucccauuccgaagaagaaaucaugcccauggcauucaacauacaacgcgaaaucaugcuugaaaaccucgacggaacaccguacgaccccgccgacgacauuccugcgguccuaggcucaccagacuuccaaggagugaucuucggcauccucucacaaagaaacaccgacggccaaacacgagcccacgaagcuaagguagacacccgcgcugcccgcuucgcaccaaaacucggauuuguagucgcuacagucgaauccaccgacuuucacgcaaaccaacccucccgauucaccccaguaggccucggaggcgacaacaaccaagacuucaaccaauggcgacuccccgccuacgggggcgcacuaaccaacaacacaaaccucgcacccccaguaaugccagucuaccccggcgaacaacuccucuucuuccgaucccaacuacccuccuccggaggagucgucggcggcuggcucgacugcuuacuaccccaagaauggguccaacauuucuuccaagaaucagcaacaucccagucagacgucgcccucguacgcuacauuaacccaaccaccgggagaguccucuucgaagccaaauuacacaaacaaggcuuccuaaccgucgccgccuccggauccuacccccuagucgucccugccgacgguuacuuucgcuucgaauccugggucaaccaauucuacacacuagcccccaugggcaacggcagcggccgcagacgcgcucguuaa

SEQ ID NO: 37091 - RNA, 1644 nt, Artificial Sequence
  derived and/or modified sequence opt11 from capsid_protein__Norovirus__BAB83516
augaaaauggcauccucugaugcaccacccuccacagacggcuccgccggccucguccccgagguaaacaacgaaaccauggcacuagaacccgucguaggcgcaccccuggccgcccccgucgccggccaacacaacaucaucgaccccuggauaaaaaugaauuucguacaagcccccaacggggaguucaccgucucuccccgaaacgcccccggcgaaauccuccuagaccucgaacucggaccugaccuuaacccauacuuaucccaccucgcacgaauguacaacggcuacgccggcggcauggaaguccaagucguccuagcuggcaacgcauucaccgccggaaaaaucaucuucgcagccguaccuccuaacuuccccgcagaaaaucucucugccgcucaagucacaauguguccucacgucauaguagacguacgccaacuagaacccgucaugcuacccaugccagauaucaggaacaaacucuuccacuacaaccaagucgacgaccccaaacuacgccuacucgcauaccucuacaccccacuccgagccaacaaugccggagacgacguauucaccgucucaugccgcguacucacccgcccaaccccagacuucgaguucauguuucuugucccaccaacaguagaaucaaagacaaaacccuucucacuccccggacucacgcuagacgaacucaguaacucccguuuccccgcccccauuguccaacuauacaccaacccccacgacaaccucauuguccaaccccaaaacggacgcugcaccauugacggucuccuccaaggcaccacccagcucguaucaugcaacgucugcucguuucgcggcaccaugggagaaggccaaccagcugcccauagcgaagacgaaaucaugcccauggcauucaacguccaacgcgaaauaaugcuugaaaaccucgacgggucgcccuacgacccaaccgacgacauccccgccguccugggaucccccgacuuccaaggggucauguuuggcauccuaucacaacgcaacaccgacggucaaacacgcgcccacgaagcuaagguagacacccgcgcagcccgcuucgcaccgaaacucggcuuugucguagccacagucgaaucuacagacuuucacgccaaccaacccagccgcuucacccccgucggccuaggcggcgacaccaaccgcgauuucaaccaguggcaacuccccgccuacggaggagcccuaaccaacaacacaaaccucgcacccccaguaaugcccgucuacccgggcgaacaacuccucuucuuccgcucacaacucccuuccucaggaggugucguggccggauggcuagacugccuccucccacaagaauggguccaacacuucuuccaagaauccgccacaucccaauccgacguagcccucgucagauaugucaacccaaccaccggccgaguacucuucgaagccaaacuccacaaacaaggcuuccucacagucgccgcauccggauccuacccucuaguaguccccgcggacggauacuuucgcuuugaaucuuggguuaaccaauucuacacccuggccccuaugggcaacggcuccggcagacgcagagcucgcuga

SEQ ID NO: 37092 - RNA, 1629 nt, Artificial Sequence
  derived and/or modified sequence opt11 from capsid_protein__Norovirus__BAD72797
augaaaauggcaucaaacgacgcagcaccgucaaccgacggcgcagccggacucgucccugaaucaaacaacgaaguaauggcccuagaacccgucgcuggagccgcccucgcagcacccguuaccggucaaacaaacaucaucgaccccuggauccgugcaaauuucguccaagcccccaacggcgaguucaccguauccccacgcaaugcacccggcgaaguacuccuaucccuagaacucgguccagaacuaaaccccuaccuggcacaccuugcacgcauguacaacggcuacgccggcggcauggaaguccaagucaugcucgcaggcaacgccuucacagccggaaaacucgucuucgccgccgucccaccccacuuccccgucgaaaaucucagcccccaacaaaucacaauguucccacacgucauuaucgacguuagaacccucgaacccguccuucucccccuccccgacguccgaaacaacuucuuccacuacaaccaaaaagaugacccuaaaaugcgaauagucgcuaugcuuuacacaccacuccgcuccaacggcuccggcgaugacgucuucacagucuccugccgcguccucacacgccccucacccgacuucgacuuuaccuaccucguacccccuaccgucgaaucaaaaacaaaacccuucacccuuccaauucuaacacucggcgagcucucgaacucccgauuccccgucuccaucgaccaaauguacaccucccccaacgaagucaucagcguucaaugccaaaacggccgcuguacacucgacggcgaacuacaaggcaccacccaacuccaaguguccggcauaugcgccuuuaaaggcgaagucacagcacaccuccacgacaacgaccaccucuacaacguaaccauaacaaauuuaaacgguccacccuucgaccccuccgaagacaucccagcuccccucggcguccccgacuuccaaggcagagucuucggcgucauaucccaacgagacaagcaaaacgccgccggccacucagaaccagccaauagaggacacgacgcagucgucccaaccuacaccgcacaauacacacccaagcucggacagguccaaaucggcaccuggcaaaccgacgaccuacaaguaaaccaacccgucaaauucaccccagucggacucaacgauacggaacacuucaaccaaugggucguaccccgauacgccggcgcccuaaaccucaacacaaaucuugcucccucaguagcacccgucuuccccggcgaacgccuccucuucuuccgcuccuacauaccccucaaaggcggcuacggcaauccagcaaucgacugccuccuuccccaggaauggguccaacacuucuaccaagaagccgcccccuccaugucagaagucgcccucguccgcuacauaaaucccgacacgggccgcgcacucuucgaagcaaaacuccaccgagcaggauucgucaccgucucuagcaacaccucugcccccgucgucguccccgcaaauggcuauuuccgguucgacuccuggguaaaccaauucuacucacucgcacccaugggagcuggcaacggacgccgaaggguccaauag

SEQ ID NO: 37093 - RNA, 1647 nt, Artificial Sequence
  derived and/or modified sequence opt11 from capsid_protein__Norovirus__BAD72798
augaaaauggcaucaaacgacgccgccccauccaacgauggagcagccggacugguccccgagaucaacaacgaagccauggcccuagauccagucgcgggcgccgcaauagccgcaccccuaacaggacaacagaacaucaucgaccccuggauaaugaacaacuucguccaggccccaggcggcgaguucaccgugagcccccgcaacucgccaggcgaaguccuccuaaaccuugaacuaggacccgagaucaaccccuaccucgcccaucuagcgcgcauguacaacggcuacgcaggcggcuucgaaguccaagucguccucgccgguaacgccuucacagccggcaaaauaauauucgccgccauucccccaaacuuuccaaucgacaaccucuccgccgcccaaauuaccaugugcccccacgucauagucgacgugcgccaacucgaacccgucaaucuaccaaugcccgacgucagaaacaacuucuucuacuacaaccaaggaagcgacucccgccuccgacuaauagccaugcucuacacaccccuccgagcaaacaacucuggcgaugacguuuucaccguauccugccgcguccuaacccgucccucccccgacuucucauucaacuuccuaguucccccaacggucgagucaaaaaccaaacccuucacccuaccaauccucaccaucuccgaaauguccaacucacgcuucccaguccccauugagucacuacacaccucacccaccgaaaacauagucguccaaugccaaaacggccgcgucacccuagacggagaacuaaugggaacaacacaacuccuccccucccaaaucugcgcauucagaggaguacucacccgcuccaccucccgagccucugaccaagccgacacagccacaccaagacucuucaacuacuacuggcacguccaacucgacaaccucaacggcacccccuacgacccggcagaagacaucccaggaccccuagguacccccgacuuccgaggaaaagucuucggagucgccucacaacgcaacccagacucuacaacccgagcccacgaagcaaagguagacacaaccgcaggucgauucacacccaaacuaggaucccucgaaauaaguacagaauccucagacuucgaccaaaaccaacccacuagauucacacccguaggcaucggcgucgauaacgaagcagauuuccaacaauggagccucccagacuacucaggccaauucacccacaauaugaaccucgccccagccguagcaccuaacuucccuggcgagcaacuacuauucuuccgaucccaacucccuuccucaggaggacgcucaaacggcguccuagacugccuagucccacaagaauggguacaacacuucuaccaagaaucugcccccgcacaaacccaaguagcccucguccgauacguaaaccccgauaccggccgcguacucuucggcgccaaacuccacaaacuaggauucaugaccaucgcuaaaaauggcgacucacccauaaccguuccacccaacggauacuuccgauucgaaucaugggucaacccguucuacacccucgcccccaugggcaccggcaacggccgccgccgcauccaauaa

SEQ ID NO: 37094 - RNA, 1647 nt, Artificial Sequence
  derived and/or modified sequence opt11 from capsid_protein__Norovirus__BAD72799
augaaaauggcguccaacgacgccgcccccuccaacgauggcgcagccggccugguaccagaaucgaacaacgaagucauggcccucgaacccguagcaggagcaucccucgccgcccccgucaccggccaaacaaacaucauugaccccuggauccgcaugaacuucguacaagcacccaacggcgaauuuaccgucagcccccgcaacucccccggagaaguccuccucaaccucgaacucggccccgaacucaacccauaccucgcccaccucucccgcauguacaacggcuaugccggaggcauggaaguacaaaucaugcucgcaggaaacgccuucaccgcgggaaaacucaucuucgcugcuguaccuccccacuuccccaucgaaaaccuaagcccaccccaaaucacaauguucccccacguaauuaucgacguccgcacccucgaacccguccuacucccaaugcccgacauccgcaacagcuuuuuccacuucauacaacgugacgaacccaaaaugcgccucgucgcaaugcucuacacuccccucagaucaaacggaucaggcgaugacguauucaccgucucaugccgcguccucacccgccccacccccgacuucgacuuuaccuaccucgucccacccaccgucgagucaaaaucaaagcccuucacccuccccauucucacucuuggcgaacuaacaaacucccguuucccccuacccauagacguccuauacaccaaucccaacgaguccgccaucguccaaugccaaaacggcagaugcacccuuggcggcgagcuccaaggaaccgcccaacuacuccccacaggcaucugcgccuuuagaggcaaagucacccaacaaguucaagacgaacaccgcggaacucacuggaacaugacagucaccaaacuaaacggaacacccuucgacccuacagaagacgucccagcaccacuaggaacccccgacuucuccggacaaaucuacggaguaaucucccaaagaaacaccaacaccgucccaggcgaaggcaaccugcccgcaaaccgcgcucacgaagcagucauagcaaccuauucccccaaauucacccccaaacuaggcaacauccaauucuccacuugggaaacacaagacgucuccuccggacaaccaaccaaauucacuccagucggccuagccucagucgacgccaacagccacuucgaccaauggacucuccccucauacuccggcgcccucacucucaacaugaacuuagcucccuccgucgcccccgucuucccaggugaaugccuucucuucuucagaucuuucaucccccucaaaggcggcuacggaaaccccgcgaucgauugccucaugccccaagaauggguacaacaccucuaccaagaaucagcccccucucucucggacgucgcccuagucagauacgucaaccccgaaacaggacgcacucucuucgaagcaaaacuccaucgaaacggauuccucaccgucgcccgcaacagcgccgguccagucguggcccccaccaacggcuacuucagauucgacuccuggguaaaccaauucuacacccucgcccccaugggcaacggaucuggccgacgccgcauccaauaa

SEQ ID NO: 37095 - RNA, 1623 nt, Artificial Sequence
  derived and/or modified sequence opt11 from capsid_protein__Norovirus__BAD72800
augaaaauggccucuaacgacgccgcccccucaaacgacggcgccgccggccuagugcccgaagucaauaacgaaaccauggcccuagaaccaguagcaggagccaguaucgccgccccacucacaggacaaaacaacgucauugaccccuggauccgccucaacuucguccaagcccccaacggugaauuuacagucucaccccgcaacucccccggcgaaauacuccuaaaccuagaacuuggacccgaacucaaccccuaccucgcccaccucgcaagaauguacaacggcuaugccggcggcgucgaaguccagguccuccuagcaggaaaugcauucaccgccggaaagcuagucuuugccgccauucccccacacuuccccgucgacaaccuaucacccggacaaaucacuauguucccgcacgucaucaucgacguccgcacccucgagccuguccuccuuccccuacccgacguccgcaauaacuucuuccacuacaaccaacaauccgaccaacgcaugcgccucaucgcaaugcucuacacaccccuacguuccaacgguuccggcgacgacguauucaccguuuccugccgcguacucacccgccccucccccgacuuccauuuccacuaccucguaccuccaaccgucgaaucuaaaaccaaaccauucucaguccccguccucacccucaacgaacucaccaauucccgcuuccccguacccaucgacgccauguacaccucccccaacgacagcaucgucguucaaccccaaaacggccgagccacaauagacggcgagcuccuuggcacaacccaacucauccccucuggaaucugcucauuccgcggcaaaaucaccacccaccucgcugacgaccgccaccuauggaacauccaagucucaaaccuaaacggcacacccuuugaucccaccgacgacguccccgcaccccuagggaugcccgacuucucaggacaaauauucggcguugucuccgaacgugacaccggaaccaaccccgccaaccgcgcccacgacgcuguucuagccaccuacucugccaaauacacgccaaaacucggcucaguccaaauaggcacaugggacaccgaagacuuacuggagcgucaacccguaaaauucacccccgucggccuuaacgaaauaggccaggacaaacacuuugaccaauggguacuacccaacuacucaggugcccuuggccuaaacaugcaccucgcuccagccgucagcccccuuuuucccggagaacgccugcuauucuuccgauccuauauaccucucaaaggcggccauggagaccccuucaucgacugucucgucccccaagaauggauucaacacuucuaucaagaauccgcucccgcccaguccucagucgcccuacuccguuacguaaaccccgauacaggaagaacucuauucgaagccaaacuccacaaagaaggcuucauaacagucuccagcaccgaaaaccgcccaguaauagucccacccaacggcuacuuccgauucgacucuugggucaaccaauucuacuccuuagcuccaaugggcaccggaaauggacgacgaagaauacaauaa

SEQ ID NO: 37096 - RNA, 1620 nt, Artificial Sequence
  derived and/or modified sequence opt11 from capsid_protein__Norovirus__BAD88558
augaaaauggccucaaaugaugucaaccccuccgauggcuccgccgccaaccucguccccgaagucaauaacgaagucauggcccucgaacccguagucggcgccgccaucgccgcccccguagcaggccagcaaaacaucaucgaccccuggauacgaaacaacuucguccaagcccccggcggcgaguucaccguuucucccagaaacgcgcccggcgaaauccuuuggucugccccucucggcccggaccucaaccccuaccucagccaccuaucccgcauguacaacggcuacgccggcggcuucgaaguccaaguaauccuugcagguaacgccuucacagcaggcaaaguaauauucgccgccgugccaccaaacuucccaaccgaaggccucucacccucccaaguaacaauguucccucacauuauuguggacguacgccaacucgaaccaguccucaucccccuucccgauguaagaaauaacuucuaccacuacaaccaggcucacgacuccacccugaaacucaucgccaugcuauacacaccccuacgcgccaacaacgccggcgacgacgucuucaccguaucaugccgaguccucaccagacccuccccagacuucgacuucauauuccucgucccaccgaccguugaaagccgcaccaaaucauucaccguccccguccuaaccguagaagaaaugacaaacuccagauuccccauaccccucgaaaagcucuacacgggccccuccuccgccuucguaguccaaccacagaauggccgcugcaccacagacggcguucuccuuggaaccacccaacuauccgcagucaacauaugcaccuuccgcggugacgugacacacaucgccggcucacgcaauuacaccaugaaccucgcaucccagaauuggaacaacuacgaccccacugaagagauccccgccccacucggaauaccagauuucgucggcaaaauacaaggccuccucacacaaaccacacgcgccgacgguuccacccgagcacacaaagccaccguauccaccggcuccguccacuucacucccaaacucggcuccguccaauucuccacagacaccgacaacgacuuccaacccggacagaacaccaaauucaccccaguuggagucauacaagacggcgaccgacaccaaaacgaaccgcaacaauggguacuccccgacuacucaggacgaaccggacauaacguacaccuggcacccgcagucgccccaaccuucccaggcgaacaauuacucuucuuucgcagcacuaugccaggcugcuccggcuaccccaacaugaaccuagacugccuuuuaccccaagaauggguccuacacuucuaucaagaauccgcuccagcucaaucagacguagcccuccuaagauucguaaaccccgacaccaaccgaguccucuucgaaugcaagcuccacaaauccgguuacaucaccgucgcucacaccggacaacacgaccuaauccucccacccaacggauacuuccgauuugauuccuggguaaaccaauucuacacccucgcucccauggggaacggagccggccgccgacgcgcccccuaa

SEQ ID NO: 37097 - RNA, 1623 nt, Artificial Sequence
  derived and/or modified sequence opt11 from capsid_protein__Norovirus__BAD98240
augaaaauggccuccaacgacgccacccccuccaaugacggcgccgcaggccucguacccgaauccaacaacgaagccauggcacuagagccugucguaggagcaucacuggcagcuccggucaccggacagacaaacauaauagaccccuggauacgaaccaacuucguccaagcccccaacggcgaguucaccguaagcccucgcaacucacccggcgaaauccuagucaaccuagaauugggccccgaacucaaccccuaccucgcccaccuagcccgcauguacaacggcuacgccggcggaauggaaguccaagucaugcuagccggcaacgccuucaccgcaggcaaaauaauauucgccgccguaccacccuacuuccccgucgaaaaccuaucgcccucccaaauaaccauguucccccacgucauaaucgacguccgcacccucgaacccguucuccucccaaugcccgaugugcgcuccacacuauuccacuucaaccaaaaagaugaaccaaaaaugcgucucgucgcaaugcuauacacuccacuacguuccaacggcucgggagacgaugucuucaccguauccugccggauucucaccagaccuagccccgaauuugacuucaccuaccucgugcccccaaccguagaaucaaaaacgaaacccuucacccuacccgugcucacccucggcgaacucucaaacagccgcuucccccuuagcaucgaugaaauggucaccucaccaaacgaauccaucgucguccaaccccagaauggccgcgucacccucgauggagaacuccucggaaccacccaacuacaagcaugcaacauaugcuccauccgcggcaaagucaccggacaaguccccaacgaacaacacauguggaaccuugaaaucaccaaccucaacggaacucaauucgaccccaccgacgacguacccgccccacucggcguaccagacuucgcuggcgaggucuucggcguccuaucccaacgaaaccgaggcgaauccaaccccgccaaccgagcccacgacgccgucguagcaacauacuccgauaaauauaccccaaaacuaggccuaguccaaaucggaacauggaacacaaacgacgucgaaaaccaacccacuaaauucacaccuauaggccucaacgaaguagccaacggacaccgcuucgagcaauggacccucccccgcuacaguggcgcccucacccuaaacaugaaccucgcccccgccgucgcuccacuauuccccggcgaacgccuacucuucuuccguuccuacgucccacucaaaggaggauucgggaacccagcaaucgacugccucgucccccaagaauggguacaacacuucuaccaagaauccgcccccucacugggcgacgucgcccucguacgcuacgucaacccugacacaggccgaguccucuucgaagccaaacuucacaaaggcgguuuccucaccgucucauccacaucaacagguccagucgucguccccgccaacggcuacuuccgcuuugacuccuggguaaaccaguucuacucccucgccccgaugggcacaggcaacggccguagacgauuucaauaa

SEQ ID NO: 37098 - RNA, 1632 nt, Artificial Sequence
  derived and/or modified sequence opt11 from capsid_protein__Norovirus__BAE43833
augaugauggcuuccaaagacgcccccaccaacauggacggcacauccggcgccggccaacuuguacccgaagccucuaccgccgaaccaaucagcauggaacccgucgcaggcgccgccaccgcagcagccacagccggacaagucaacaugauagaccccuggaucaugucaaacuacguacaagcaccgcaaggcgaauuuacuauuucacccaacaacacccccggagauauacuauucgaccuccaacucggcccucaccucaaccccuuccucucccaccucgcccaaauguacaacggcugggucggaaacaugaaaguccgaguacuucucgccgguaacgccuucaccgccggcaaaaucaucaucuccugcgucccaccaggauucgcugcucaaaacgucucuauagcccaagcaacaauguucccccacguaaucgccgacguccgcguccucgaacccauagaaguuccccucgaagacguccgcaacguccucuuccauaauaacgacuccacccccacaaugcggcugaucugcaugcucuacacuccccuccgcgccuccggcuccucaucaggcaccgaccccuucgucaucgcaggccgaguacuuaccugcccuucccccgacuucaacuucuuauuccucguucccccaaaugucgaacagaaaaccaaaccauucagcguccccaaucuaccccuaaacguucuaucaaauucacguguaccaucacucauaaaaaguaugaugguaucccaagaccacggccaaauggugcacuuccaaaucggacgcgucacccucgacggacaacuccaaggaaccaccccuaccagcgccucucaacucuguaaaauccgcggcaccgucuaccacgccacgggcggacaaggccucaaccuuacugaaauugacggcaccccauaccacgcuuucgaaucaccagcaccaaucggauucccugaccucggcgaaugcgacuggcacauaaacgccagccccgcaaacgcauucaccgacggcuccaucauccaccgcauagaugucgcccaagacuccacauucgcaccccaccucggaaccauccacuacaccaacgccaacuacgacgccaacgucucccucaucugcucccucgaauggcucuccccucccagcggcggcgcccccaaggucaaccccugggccaucccacgauacggcuccacccucaccgaagcagcucaacucgcucccccaauuuauccacccggauucggcgaagccauaguauuuuucauguccgacuuccccaucgcaaacggaucagacggacucucaguccccugcaccauaccccaagaguucguuacccacuucguaaaugaacaagcaccaacccgaggcgaagccgcccuccuccauuacguagacccagacacccaccgcaaccuaggagaguucaaacuauacccagaagguuucaugaccugcguacccaacuccucaggcucaggcccccaaacccucccuauuaacggcguauucaccuucauuuccuggguaucucgcuucuaccaacucaaacccgucggcaccaccggacccgucagacgucuaggcauacgacgaagcuaa

SEQ ID NO: 37099 - RNA, 1647 nt, Artificial Sequence
  derived and/or modified sequence opt11 from capsid_protein__Norovirus__BAE48588
augaaaauggccuccaacgacgcaacccccuccaacgacggcgccgccggccucguccccgaaaucaacaacgaagccauggcucuagaccccguugccggcgccgccauagcagcaccccucacaggccaacaaaacaucaucgacccauggaucaugaacaacuucguacaagcccccggcggagaguucaccgucuccccacgcaacucccccggcgaaguccuacuaaaccuagaacucggccccgaaaucaaccccuaccucgcucaccucgcgcgaauguacaacggcuacgccggcgguuucgaaguucaaguuguccuagcaggcaacgcauucaccgcucgcaaaauuauauucgccgccauucccccaaacuuccccaucgauaaccuauccgccgcucacaucacuaugugcccucacgucauagucgacguccgccaacucgaacccguaaaccuccccaugccagacguccgcaacaacuucuuccacuacaaccaaggcucugacucacgccuacgccucaucgccaugcucuacacuccccuaagagcuaacaacucaggcgacgacgucuucaccgucagcugccgcguacuaacccgacccucaccugacuucuccuuuaacuuccucgucccuccaacacuugaaucuaaaacuaaaccauucacccuuccaauacuaaccaucagcgaaaugucuaacucacgcuucccuguuccaaucgacucccuacacaccagucccacagaaaacaucgucguccaaugccaaaacggccgugucacccuagacggcgagcuaauggguacaacccaacuacuacccucccaaaucugcgccuuccgaggcguacucaccagaucaaccucucgcgcccgcgaccaagcagauaccgcaacccccagacuauuuaacuacuacuggcacauucaacucgacaaccucaacggcacccccuacgauccagcagaagacaucccaggaccccucggaacccccgacuuccgcggcaaagucuucggcguugccucgcaacguaacccugacuccacuacccgcgcacacgaagccaaaguggacaccaccgccggccgcuucacacccaaacucggcucacuugaaauaagcacagaauccgacgacuuugaccaaaaccagccaacacguuucaccccaguaggcauagguguugacaacgaagccgacuuucaacaauggucccucccagacuacagcggccaauucacccacaacaugaaccucgccccagcggucgccccaaacuuuccaggcgaacaacuacucuucuuccgcucucaacugcccuccucuggcggccgcuccaacggcauccuagacugccucgucccccaagaauggguacagcacuuuuaccaagaaucagccccaucacaaacccaggucgcccucguccgcuacgucaaccccgacaccggcagaguccuuuucgaagcuaaacuccacaaacuaggcuuuaccaccaucgccaaaaacggcgacagccccauuacugucccaccuaacggauacuuccgcuucgaaagcugggucaaccccuucuauacccuugcccccaugggcacaggcaacggacgccgccguaaccaguag

SEQ ID NO: 37100 - RNA, 1647 nt, Artificial Sequence
  derived and/or modified sequence opt11 from capsid_protein__Norovirus__BAE48589
augaaaauggcauccaaugacgccacccccuccaacgacggcgcagccggccuaguacccgaaaucaacaaugaagcaauggcccucgaccccgucgccggagcagccauagccgcaccacucaccggccaacagaacaucauugacccauggaucaugaacaacuuuguccaagcccccggcggcgaguucaccgucucccccagaaacucacccggcgagguccuucucaaccucgaacucggccccgagaucaacccauaccucgcccaccuagcccgcauguacaacggcuacgcuggcggcuucgaaguccaaguuguucucgcaggcaacgccuucaccgcaggaaaaaucaucuucgccgcaaucccgcccuacuuccccaucgacaaccucuccgccgcccaaaucaccaugugcccgcauguuaucguugacguccgccaacuagaacccgucaaccucccuaugcccgacguacgcaauaacuucuuccacuacaaccaaggauccgacucacgccuccgccuagucgcaaugcucuacacaccacuccgcgccaacaacuccggugacgacgucuuuaccguaucccuacgcguccucacccgcccuucccccgacuucuccuucaacuuccuaguaccacccacagucgagucgaaaacaaaacccuucacacuccccauucucaccauaagcgaaaugucaaacucccgauuccccguaccaaucgacucccuacacacaagcccaaccgaaaacauugucguccaaugccaaaacggccgagucacccucgauggcgaacuuaugggaacaacccaacuccucccaagucaaaucugcgccuuccgugguguccucacccgcucgaccucccgagcaucagaccaagccgacaccgccaccccucgccucuucaacuacuacuggcacauccaacuugacaaccucaauggcacucccuacgacccagccgaagacauacccggcccccucggcaccccagacuuccgaggaaaggucuucggagucgccucucaacgcaaucccgacuccacaacccgugcccacgaagcgaaaguagacaccaccgccggucgauucacccccaaacuagguucccucgagaucuccaccgaaucagacgacuucgaccaaaaccaacccacccgcuucacccccguaggaauaggcguagaccaugaagccgacuuccaacaauggucccuucccgacuauuccggccaauuuacccacaacaugaaccucgcgccagcagucgccccuaacuucccuggagaacagcuacucuucuuucguucccaacuccccagcucagguggccgcuccaacggcauccucgacugccucguaccccaagaauggguccagcacuucuaccaagaaucagcgccagcacaaacccagguagcccuaguaagauacguaaauccagacacgggccgcguacuauucgaagcaaaacuccacaaauuaggcuucaugaccaucgccaaaaacggggacucgcccaucaccgucccacccaacggcuacuucagauucgaaucuuggguuaaccccuucuauacccuugcccccaugggaaccggcaacggacgacgacgcauccaauaa

SEQ ID NO: 37101 - RNA, 1647 nt, Artificial Sequence
  derived and/or modified sequence opt11 from capsid_protein__Norovirus__BAE48590
augaaaauggccucuaacgacgccacacccucuaacgacggcgcagccggccuaguccccgaaauaaacaaugaagccauggccuuagaccccgucgccggggccgccaucgcugcaccccucaccggccagcagaacaucaucgacccauggauaaugaacaacuucguccaagcccccggcggagaguucaccgucucacccagaaacucccccggcgaaguacuucuagaccuggaacucggccccgaaauaaacccauaccuagcccaccucgcacgcauguacaacggcuacgcaggcggcuucgaaguccaagucguccuggccggaaacgccuucaccgccggcaagaucaucuucgcugccauucccccaaauuuccccauagacaaccucucagcagcacaaaucaccaugugcccccacgucaucgucgacguacgacaacuagaacccgucaaccuccccaugcccgacguccgcaacaccuucuuccacuacaaccaaggaucagacucccgacuccgacuuaucgcuaugcuauacaccccacuccgcgccaacaacucaggcgacgacgucuuuacagucucaugcagaguacuaacccgcccaucuccagauuucagcuucaacuuccucgucccucccacuguagaaucuaaaaccaaacccuucacccuccccauccucaccauuuccgaaaugucuaacagccgauuccccguccccaucgacucccuucauacaucccccacagaaagcaucgucguccaaugccaaaacggacgggucacccucgacggcgaacucaugggcaccacacaacuccuccccucacaaauaugcgcauucagaggcguccucacacgcucaacuucucgcgcgucugaucaagccgacaccgccacaccacgccucuucaauuacuacuggcacauccaacucgacaaccucaacggaacccccuacgauccagccgaagacauacccggcccccuaggcaccccagacuuccguggcaaaguguucggcguugccucucaacgcaacccagacuccaccacacgagcccacgaagccaaagucgauaccaccacuggccgcuucaccccuaaacuaggcucccucgaaauaucuaccgaaucagacgacuucgaccagaaccaacccacccgcuucaccccagucggaaucggcguugaccacgaggccgacuuucaacaauggucccucccagacuauuccggccaguucacccacaacaugaaucucgcccccgccgucgcccccaacuuccggggcgaacaacuacucuucuuccguucccaauuaccaucaucaggaggcagaucuaacggcacgcuagacugccucguaccacaagaauggguccaacacuucuaucaagaaucugcccccgcacaaacucaaguugcauuaguccguuacguaaaucccgacaccggccgcguccucuucgaagccaaacuccauaaacucggcuucaugacaauugccaagaacggcgauucccccauuaccgucccuccaaauggauacuuccgcuucgaauccugggucaaccccuucuacacccucgcaccaauggguacuggcaacggccgcagacgaauccaauaa

SEQ ID NO: 37102 - RNA, 1644 nt, Artificial Sequence
  derived and/or modified sequence opt11 from capsid_protein__Norovirus__BAE92970
augaaaauggccucaaacgacgccagccccuccacggacggcucugcaggucuagucccagaaguaaacaaugaaacuauggcccuugaacccgucgucggcgcaccccucgccgcccccgucgccggucaacacaacaucaucgaccccuggauaaaaaugaacuucgugcaagccccaaacggcgaguucacagucucaccccgcaacgcccccggcgaaauucucuuagaccuagaacucggucccgacuuaaaccccuaccuaucacaccuagcccgcauguacaacggauacgccggaggcauggaaguccaagucguacucgcaggcaaugccuucaccgcaggaaaaaucaucuucgccgcagucccacccaauuuccccgccgaaaaccuauccgccgcacaagucaccaugugcccacacguaauaguagacguccgucaacuagaacccguaaugcugcccaugcccgacauccgcaacaaacuauuucacuacaaucagguggacgaccccaaacuccgccuccuagccuaccucuacacaccucuccgagcaaacaacgccggcgacgauguuuucaccgucuccugucggguacuaacccgcccaacccccgacuucgaguucauguuccuagucccacccaccgucgaaucaaaaacaaaacccuucucacuacccagccucacccucgacgaacuauccaacucacgauuuccagcccccauuguccaacucuacaccaacccacacgacaacuuagucguccaaccacaaaacggccgaugcacaauugacggacuccuccaaggcaccacacaacuggucuccuguaacguaugcuccuuccgcggcacacucggcgacggccagcccgcaucccauuccgaagaagaaauuaugccaauggcauuuaacguccaacgagaaaucaugcucgaaaaccucgacggcucaccauacgaccccacugaugauauacccgccguacuuggaucacccgacuuccaaggcgucgucuucggcauccuaucccaaagaaacacagacggccaaacgcgcgcccacgaagccaaaguggacacccgagcagcacgcuucgcccccaaacucggcuucgucgucgccaccgucgaauccacggacuuccacgcaaaucaacccucccgauucacccccgucggccuaggcggcgacggcaaucaagacuucaaccaauggucccuacccgccuacggcggcgcgcuaacaaacaacaccaaccuagcacccccagccaugccagucuacccgggcgaacaacuacucuucuucagaucccaacuccccuccucggguggaguaguaggcgguuggcucgacugccuccucccccaagaauggguccaacacuucuuccaagaauccgcuacuucccaauccgacgucgcccucguccgcuacaucaaccccacaacgggacgcguccuauucgaagccaaacuccacaaacaaggcuuccuaacaguugcugccagcggcagcuacccccuggucgucccagcagacggauacuuccgauucgaaucauggguaaaccaauucuacacccuugcccccaugggcaacggcuccgguagacgcuccgcccgcuga

SEQ ID NO: 37103 - RNA, 1623 nt, Artificial Sequence
  derived and/or modified sequence opt11 from capsid_protein__Norovirus__BAE98191
augaaaauggccuccaaugacgccucaccuucagacggcucaacagccaaucucguucccgaaguaaacaacgaaguaauggcccucgaaccugucguaggugcugccauugccgccccaguugcaggccaacaaaacgucaucgaccccuggauccgcacuaacuucguccaggcccccggcggggaauuuacaguaucccccagaaacgcacccggcgaaauacuguggagcgcaccccucggacccgaccucaaccccuaccucucccaccuagcccgcauguacaacggcuaugccggcggcuucgaaguccaagucauacuagccggaaacgcauucaccgccggaaaaauaauauucgcugccgucccaccuaacuucccaaccgaaggacucuccccaucccaagucaccauguucccccacaucaucgucgacguccgccaacuagaacccguccucaucccgcuacccgaugucagaaauaacuucuaccacuacaaccaaucgaacgauucgaccauaaaacucauagccaugcuauacacaccccuccgcgcaaacaacgcaggagacgacgucuucaccguguccugccgaguccucacacgccccucacccgacuucgacuucaucuuccuagugccucccaccgucgaaucccgaaccaaacccuucacaguacccauccuaaccguagaagaaaugacuaacucccguuuccccauuccccucgaaaaacucuucacaggccccucauccgccuucgucguucaaccacaaaauggaagaugcacaaccgacggcguacuccucggcaccacacaacuaucccccguaaacauaugcacauuccgaggcgacgucauccacaucccaggcacacgaaccuaccgcaugaaccucgccagccaaaacuggaacaacuacgacccaacagaagaaaucccagcaccacuaggcaccccugacuucguaggcaaaauccaaggcaugcucacccaaaccacaaaaggcgacggcucuacccgcggccacaaagccaccgucuccacaggcuccgucgacuucacacccaaacuaggcuccguacaguucgcaacagacacagacaacgacuucgaaacaggacaaaacacccgcuucacacccgucggcguaauccaagacggauccuccgcucaccgaaacgaaccacaacaauggguccuccccgacuacuccggccgaaccguacacaauguacaccuagcccccgcugucgccccaaccuucccaggcgaacaacuacuauuuuuccguuccacaaugccaggcugcuccggcuaccccaacauggaccuagacugccuacuaccccaagaauggguccaacacuucuaccaagaagcagcccccagucaaucagacguugcgcuccuacgcuucgucaaccccgacacaggucgcguacucuucgaaugcaaacuccacaaagccggcuacguaaccguagcccacacagggcaacacgaccuggucaucccaccaaacggcuacuuccgcuucgacuccuggguaaaccaauucuauacacuagcccccaugggcaacggagcaggccgccgccgcgcacucuaa

SEQ ID NO: 37104 - RNA, 1623 nt, Artificial Sequence
  derived and/or modified sequence opt11 from capsid_protein__Norovirus__BAE98194
augaaaauggccucgaacgacgcaucaccaucugacggcuccacagccaaccucgucccagaagucaacaacgaagugauggcccucgaacccgucgucggagccgccaucgccgccccagucgccggccaacaaaacguaaucgaccccuggauccggaacaacuucguccaagcaccaggcggcgaguucaccgucagcccccgcaacgccccaggagaaauccucuggucugccccucugggcccagaccucaaccccuaucucucacaccuagccagaauguacaacggcuacgcgggcggauucgaaguacaagucauccucgcaggaaacgccuucaccgccggcaaaaucaucuucgccgccgucccgcccaacuuccccacagagggacucuccccaagccaagucaccauguucccacacaucaucguagacguucgccaacucgaacccguccucaucccacucccagacguccgaaacaacuuuuaccacuauaaucaaucgaacgacuccaccaucaaacucaucgcaaugcuauacacuccccuacgcgccaacaacgccggagacgacgucuucaccguuucaugccgcguccucaccagacccucacccgacuucgacuucauauuccuaguaccaccaaccgucgaaucucgaacaaaaccauucacugucccuauccucaccguugaggaaaugacaaacucacgauuccccauaccacucgaaaaauuauucaccggacccaguuccgcauucgucguccaaccccaaaacggccguugcaccacagacggaguucuacucggcacaacccagcuaucacccgucaacaucuguaccuuccgcggcgacgucacccacauuccaggaacccgaacauaccgaaugaaccuagccagccaaaauuggaacaacuacgacccaaccgaagaaauacccgcaccccucggcacccccgacuucguaggaaaaauccaaggcaugcucacccaaaccaccaaaggcgacgguuccaccagaggccacaaagcaaccgucucaaccggcucggucgacuucacacccaaacugggcuccguacaauucgccaccgacacugacaacgacuucgaaaccggccaaaauacacgauucacacccguaggaguaauacaagacggaucuuccgcccaccgcaacgaaccacaacaauggguacuccccgacuacuccggccgcaccguacacaacguccaucuagcccccgccguagccccaacauucccgggagaacaacuccucuucuuccgaucaaccaugcccggaugcuccggcuaccccaacauggacuuagacugccuacucccccaagaauggguccaacacuucuaccaagaagccgcacccagccaauccgacguugcacuacuacgcuucguaaaccccgacacuggacgcguccucuucgaaugcaagcuccacaaagccggcuacguaaccguugcccacacaggccaacacgaccucgucauacccccaaacggcuacuuccgauucgacagcugggucaaccaauucuacacauuggcacccaugggaaauggcgccggccgccgccgagcacuauga

SEQ ID NO: 37105 - RNA, 1623 nt, Artificial Sequence
  derived and/or modified sequence opt11 from capsid_protein__Norovirus__BAE98197
augaaaauggccuccaacgacgccuccccaucagacggcucuacagccaaccucgugcccgaaguaaacaacgaaguuauggcucucgaacccgucgucggagcagcaaucgccgcccccguugccggacaacaaaacgucauagaccccuggauacguaacaacuucguccaagcaccugguggagaauuuacaguaaguccuagaaacgcccccggcgaaauacucugguccgcaccucucggcccagaccucaaccccuaccuaucacaucucgcccgcauguauaacggcuaugcaggcggcuucgagguccaaguaauacucgccggaaacgccuucaccgccggcaaaaucaucuucgcagccgucccacccaacuuccccaccgaaggacucuccccaucccaagucaccauguucccccacauaaucguagacguacgacaacucgaacccguccucauaccccuacccgauguccgaaacaacuucuaccacuacaaccaaucuaacgacuccaccauaaaguuaaucgcaaugcucuacacaccccucagagcaaacaacgcaggagacgacgucuucaccgucuccugccgcguucuaacccgcccauccccagacuuugacuucaucuuccucgucccacccacagucgaaucccgcacaaaacccuucacaguacccauacuuacugucgaagaaaugacuaacucacgguuccccaucccccuggaaaaacuauuuaccggccccuccuccgccuuuguaguacagccacaaaacggacgaugcaccaccgacggaguccuccucgguacaacccagcucuccccagucaacaucugcacauuccgcggcgacguuacccacaucuccggcacccgaaccuaccgcaugaaccuagccucacaaaacuggaacaacuacgaccccaccgaagaaauccccgcaccccucggcacccccgacuucgucggcaaaauacaaggaaugcucacccaaaccaccaaaggugacggcucaacccgaggccacaaagccacagucuccaccggcagcgucgacuucacccccaagcuaggcucaguccaauucgccaccgacacagacaaugacuucgaaaccggccaaaacacucgauucaccccagucggcgucauucaagacggaucaucaacccacagaaaugaaccccagcaguggguucuacccgacuacucaggacgcacuguacacaacgugcaccuagcccccgcaguagcccccacauuccccggagaacaacuccucuucuuccgcucaacaaugccaggcuguuccggauacccuaacauggaccucgacugccuccuaccucaagaauggguccaacauuucuaccaggaagcugcccccucgcaaagcgacguugcccuccuucgcuucguaaaccccgacacaggccgcguccuuuucgagugcaaacuccacaaagcaggcuacguaacaguagcccacaccggccaacacgaccucguaauacccccaaacggauacuuccgcuucgacucaugggugaaccaauucuacacccuagcacccaugggcaacggcgccggacgaagacgcgcccuauaa

SEQ ID NO: 37106 - RNA, 1623 nt, Artificial Sequence
  derived and/or modified sequence opt11 from capsid_protein__Norovirus__BAF45861
augaaaauggcuagcaacgacgccaaccccuccgacggcuccgcggcaaaccucguacccgaagucaacaacgaagucauggcccucgaacccgucgucggcgccgcgaucgccgcaccagucgccggacaaacaaacguaaucgacccauggaucagaaacaacuucguacaagcccccgguggcgaguucaccgucuccccacgaaacgccccaggcgaaauccucuggucagcaccccuaggccccgaccuuaacccauaccuaucccaccucgcccgaauguacaacggucacgccggaggguucgaaguccaggucauacuagccggcaacgccuucacagccggaaaaauaauuuucgccgccgucccaccaaacuuccccaccgaaggucucucacccucacaagucacaauguucccccacauuaucgucgacgugcgccaacuagaacccguacucaucccccuccccgauguccgcaacaacuucuaccacuacaaccaaucuaacgacuccaccauaaaacuaauagccaugcuauacacaccacuucgcgccaacaacgcaggcgaagacgucuucaccgucuccugccgaguccucacccgcccaucgcccgacuuugauuucauauuccuuguacccccaaccgucgaaucccgcaccaaaccauucaccgucccaauccuuaccgucgaagaaaugaccaauucacgcuuccccaucccccuagaaaaacucuucacaggaccaucaggcgccuucgucguccaaccccaaaacggccguugcaccaccgacggcgucuuacucggcaccacacaacuaucccccguaaacauaugcacauuccguggcgacgucacccacaucgccggcucccggaauuacacaaugaaucucgccucccuaaacuggaauaacuacgaccccaccgaagaaauaccagcaccccucggcaccccugacuuuguaggaaaaauccaaggcguccucacccaaaccaccaaaggcgacggcucaacucgcggccacaaagccacugucuacaccggcuccgccccauucacacccaaacuaggcucuguacaauucaguacugacaccgaaaacgacuucgaaacccaccaaaauaccaaauucacccccgucggcguuauacaagauggcucgaccacccaccgcaacgaaccacaacaauggguacuccccucguacuccggacgcaauguacacaacguucaccucgccccagcugucgcaccaacguuccccggcgaacaacuacucuucuuccgaucuaccaugcccgguugcuccggauaccccaauauggaccucgauugccugcucccccaagaauggguucaacacuucuaccaagaggccgcucccgcccaauccgacgucgcccuccuccgauucgucaaccccgacaccggccgaguccucuucgaauguaaacuccacaaaucgggcuacguaacuguagcacacaccggacaacacgaccuagucauaccacccaacggcuacuuucgcuucgacucaugggucaaucaauucuacacccucgcacccauggguaacggcacaggucgaagacgagcccucuga

SEQ ID NO: 37107 - RNA, 1620 nt, Artificial Sequence
  derived and/or modified sequence opt11 from capsid_protein__Norovirus__BAF74508
augaaaauggccucaaacgacgcaacccccuccgacgggucaaccgccaaucucgucccagaagucaacaacgaagugauggcccucgaaccaguagucggcgcugccauagcugcccccguagccggccaacaaaacgucaucgaccccuggauacgcucaaacuucguccaagccccuggcggagaguucaccgucagcccacgcaacgcgccaggugaaauacuaugguccgcaccacuaggcccggaccuuaaccccuaccucagccaccuagcccguauguacaacggcuacgccggaggcuucgaaguccaagucauccucgccggcaacgccuucaccgccggcaagaucaucuucgcagccgucccacccaacuuccccacugaaggccucagccccucccaagucacuauguucccccacaucauuguagacguacgccagcuugaacccgucuuaauaccucuccccgacguacgaaacaacuucuaccacuacaaucaaucuaaugacucuacaaucaaacuaauagccaugcucuacacaccacuccgagccaacaacgccggagacgacgucuucacuguaucaugccgcguccucacccgaccaucuccagacuucgacuucaucuuccucguacccccaacugucgaaagccgcaccaagccguucacgguccccauacuaacaguagaagaaaugucuaacucacgcuuccccaucccccucgaaaaauuauacacaggccccuccuccgcauucgucguucaaccgcaaaacggacgcugcacaaccgacggcguccuccuaggcaccacacaacuuuccgccgucaacaucugcaccuuccgcggagacguaacccacaucgccggaucucacgacuacaccaugaaccuagccucccaaaacuggaacaacuacgaccccacagaagaaauaccagccccacuaggcaccccagacuuuguaggaaaaauccaaggaguccucacccaaaccacccgcggagacggaucgacccgcgcccacaaagcuacagucucaaccggcucaguccauuucacaccaaaacucggauccguccaauacacaaccgacacgaacaacgacuuccaaacaggccaaaacacaaaauucaccccggucggagucauacaagacggcgacaaccaccaaaacgaaccccaacaguggguccucccaaacuacucuggacgaacaggccacaacguccaccuagccccagccgucgccccaaccuuccccggcgaacaacuacucuucuuccgcucaaccaugccaggcugcuccggauacccaaacaugaaccucgacugccuccucccccaagaauggguacaacacuucuaccaagaagccgcccccgcacagucagacguagccuuacuccgcuucgucaacccugacaccggccgcguacuauucgaaugcaaacuccacaaaucugguuacguaaccgucgcccacaccggcccacacgaccucgucauaccacccaacggauacuuccgcuucgacagcuggguuaaccaauucuacacucucgcccccauggguaacggcgccggccgccgucgcgcgcuuuaa

SEQ ID NO: 37108 - RNA, 1620 nt, Artificial Sequence
  derived and/or modified sequence opt11 from capsid_protein__Norovirus__BAF74509
augaaaauggcuuccaacgacgccaaccccagcgacggcucaacagccaaccuagucccugaagucaacaaugaggucauggcccucgagcccgucguaggcgccgccaucgccgcccccguagccggacaacaaaacguaaucgacccauggauccgaaacaacuucguacaagcccccggcggcgaguucaccguuucaccccgaaacgcccccggcgaaauccucugguccgccccacucggccccgaccucaaucccuaccucucccaccucgccagaauguacaacggcuacgcaggcggcuucgaaguucaaguaauucuagccggcaacgccuucacagcaggaaaaaucaucuuugccgccgucccacccaacuuccccacagaaggccuaucccccucacagguaacuauguucccacauaucauagucgacguccgucagcucgagcccguccuaaucccccucccagacguucgaaacaacuucuaccacuacaaucaaucaaacgacucaacaaucaaacucaucgcuaugcuuuacacaccccuccgcgcgaacaaugccggcgacgacgucuucaccgucucaugccgaguccucacacgaccuucacccgacuucgacuucaucuuucuaguacccccuacagucgaaucccgaaccaaaccuuucaccguccccauccuuaccgucgaagagauguccaacucccgauuccccaucccucucgaaaaacuauacacaggccccucuucagccuucguaguccaaccccaaaacggccgcugcaccaccgacggcguccuccucggcaccacccagcuaucagccguaaacauauguacauuccgcggcgacguuacccacaucgcaggcagccacgauuacaccaugaaccuugccucccagaacuggaacaacuacgacccuaccgaagaaauccccgccccacucgggacucccgacuucgucggcaaaauccaaggcaugcucacccaaaccacacgcgaagacggcucaacccgcgcucacaaggccacuguaagcaccggcuccguccacuucaccccaaaacucgguuccguccaauacacaacagacaccaauaacgacuuccaaacgggacaaaacacuaaauucaccccaguagguguaauacaagacggaaacaaucaccaaaacgaaccccaacaauggguccuucccaacuacucaggacgcacaggccacaacguccaccucgcaccagccguagcccccaccuucccuggagaacaauuguuauucuuccgcucuaccaugcccggcugcucaggcuacccaaacaugaaccucgacugccuacuuccccaagaauggguccaacacuucuaccaagaagccgcaccagcccaguccgacguagcccuccuccgauucgucaaccccgacaccgggcguguccucuucgaaugcaaacuccacaaaagcggcuacgucacagucgcacauaccggcccacacgaccucguaauaccuccaaacggauacuuccgcuucgacucuugggucaaucaauuuuacacacuggcccccaugggcaauggcgcugggcgacgacgagcccuauaa

SEQ ID NO: 37109 - RNA, 1620 nt, Artificial Sequence
  derived and/or modified sequence opt11 from capsid_protein__Norovirus__BAF74510
augaaaauggccuccaacgaugccaaccccucagauggcuccacagcaaaccucgucccagaagucaacaacgaagucauggcccucgagccugucguaggcgccgcaaucgcagccccagucgcaggccaacaaaacguaaucgacccuuggauccgcaacaacuucguccaagccccaggaggcgaguucaccguaagcccucgcaacgcacccggcgaaauccuuuggucagcaccccucggaccagaccucaacccauaucucucccaccuagcccgcauguacaacggcuacgccggcggauucgaaguccaagucauccuagccggcaacgcauucaccgccgguaaaaucauauucgccgccgucccucccaacuuccccacagaaggucuaucccccucucaagucaccauguucccccacauaaucguggacguacgccagcuagaaccaguccuaaucccucuccccgacguccguaacaacuucuaccacuauaaccaguccaaugacuccacaauaaaacucaucgcaaugcuguauaccccacuccgcgccaacaacgcaggcgacgacguauucaccgucuucugccgaguccuaacccgacccucccccgacuucgacuuuaucuuccucgucccacccaccgucgaaucucgcaccaaaccguucacaguaccaauccucacaguagaagaaauguccaacuccagauuccccauaccccucgaaaaacucuacaccggacccucaucagcuuucgucguccaaccccaaaacggacgcugcacuaccgacggugucuuacuaggcacaacacaauugucagccgucaacaucuguacauucagaggagacguaacccauaucgcuggcucacacgacuacaccaugaaccucgccucccaaaacuggaauaacuacgacccaaccgaagaaauacccgccccacucggcacccccgacuucgucggcaaaauccaaggcaugcucacccaaacaacaagagaagacggaagcaccagagcucauaaagccacaguuuccaccggcucaguccauuuuaccccaaaacucggcuccguacaauacaccaccgacaccaacaaugacuuccagacaggacaaaacaccaaauucacucccguaggcguaauacaagacggcaacaaccaccaaaacgaaccccaacaauggguccuaccaaacuacucgggccgcaccggccauaacguccaccuagccccagccguagccccaacuuucccaggcgaacaacuucuuuucuucagaucaaccaugcccggcugcuccggcuaccccaacaugaauuuagacugucugcucccacaagaauggguccaacacuucuaucaagaagccgcccccgcccaauccgacguagcgcuccuacgauucgugaacccagacaccggacgcguacucuucgaaugcaaacuccacaaaagcggcuacguaacagucgcacacaccggcccccacgaccucgucaucccucccaacggcuacuuccgcuucgacuccuggguaaaccaauucuacacccucgcccccaugggcaacggcgcaggccgccgccgcgcccuauaa

SEQ ID NO: 37110 - RNA, 1620 nt, Artificial Sequence
  derived and/or modified sequence opt11 from capsid_protein__Norovirus__BAF74511
augaaaauggcauccaacgacgcaaaccccuccgacggcuccacggccaaccuaguacccgaaguaaacaacgaagucauggcacucgaacccguagucggcgccgcaauagcagcacccguagccggucagcagaacgucauagaccccuggauccgcaacaacuucguacaggcccccggcggcgaauuuacagucucuccccgcaacgccccaggcgaaauacucuggucagcaccccuaggccccgaccucaaccccuaucucucccaucuggccagaauguacaacggcuacgccggcggauucgaaguacaagucauccuugccggaaaugccuucaccgccggcaaaaucaucuucgccgccgucccacccaauuuccccaccgaaggacuaucgcccucccaagucacgauguucccccacaucauagucgacguacggcaacucgaaccaguacucaucccacuuccagacgucagaaacaacuucuaucacuacaaucaaucaaacgacuccacaauaaaacucauagcuaugcuauacacuccccuacgcgccaacaacgccggcgaugacgucuucaccgucuccugccggguccucacccguccaucaccagacuucgacuucaucuuccucgucccacccacagucgaaucccgcacaaaacccuucacaguacccauacucaccguugaagaaauguccaauucacgcuuccccauuccccuggaaaaacucuucacuggacccuccucagccuucgucguacaaccacaaaacggacgcugcaccaccgacggcguacuccuuggcaccacccaacuauccgcggucaacaucugcacuuuccgcggagacguaacucacaucgcagggucccacgacuacaccaugaaccuugccucacagaacuggaacaacuacgacccuaccgaagaaauccccgcuccccucggaacucccgacuucgucggcaaaauacaaggcaugcucacucaaaccacacgggaagacggcucgacccgcgcccacaaagcaaccguauccaccggcucuguccacuucacccccaaauuaggguccguccaauacacuaccgacaccaacaacgacuuccaaaccggccaaaacaccaaguucaccccggucggcguaauacaagauggcaacaaccaccaaaaugaaccacaacaauggguccucccaaacuauuccggccgaaccggacacaacguccaccuagcccccgcagucgccccaaccuuccccggcgaacaacuccucuucuuccgauccaccaugcccggaugcagcggguaccccaacauggaccucgacugccuucucccacaagaauggguacagcacuucuaccaagaagccgcgccugcccaaucagacguagcacuccuccgcuucguaaaccccgacaccgguagaguacucuucgaaugcaaacuccacaaauccggcuacgucaccgucgcccacaccggcccccacgaccuagucauaccacccaacgguuacuuccgcuucgacucuuggaucaaccaauucuacacccucgcccccaugggaaacggcgccggccgccgucgcgcccuauaa

SEQ ID NO: 37111 - RNA, 1620 nt, Artificial Sequence
  derived and/or modified sequence opt11 from capsid_protein__Norovirus__BAF74512
augaaaauggccucaaacgacgccacucccuccgacggauccaccgcaaaccucguccccgaaguuaacaacgaaguaauggcacuagaaccagucgucggggcagcaauugccgcacgcgucgccggacaacaaaaugucauagacccuuggauacgcaacaacuucguacaagccccaggcggcgaguucaccgucucaccucgcaacgccccaggcgaaauacuaugguccgccccacugggccccgaccucaacccuuaccuaucccacuuagcccgaauguacaacggauaugcaggcggauucgaaguccaagucauacuagccggcaacgccuucaccgcaggcaaaaucaucuucgccgcagucccaccaaacuuccccaccgaaggccucuccccaucacaaguaacaauguucccccacaucaucguagacguucgucaacuugaacccguccucauucccuuaccugacguccggaacaacuucuaccacuacaaccagucaaacgacucaacuaucaaacucaucgcuaugcucuacacgccccuccgcgccaacaaugccggcgacgacgucuucaccgucagcugccgaguucucacacgaccaucccccgacuucgacuucaucuuucucguacccccaaccgucgaaucccgaaccaaacccuucacaguccccauacucaccgucgaagaaauguccaauucuagauuccccgucccacucgaaaaacucuacaccggcccaucaucggccuuugucguccagccacaaaacggccguugcacaaccgacgggguccuacucggaacaacccaacuauccgccgucaacaucugcaccuuccgaggagacguaacccacaucgccggaagccacgacuacaccaugaacuuagccagccaaaacuggaacaauuacgacccaacggaagaaauccccgcaccacuugguacccccgacuucgucggcaaaauccaagggguccucacccaaaccacccgcgaagacggcuccacccgagcccacaaagcaaccgucuccacaggcuccguccacuucacccccaaacucgguucaguacaauacaccacugacacaaacaacgacuuccagacaggccaaaacaccaaauucacccccguaggcguaauucaagacggauccaaccaccaaaacgaaccccaacaauggguccuccccaacuacuccggccgcaccggccacaacguacaucucgcccccgccguagcccccacauucccaggcgaacaacuucucuucuuccgaagcacaaugcccggcugcuccggcuacccaaacaugaaccucgacugccuucucccacaagaauggguacaacacuucuaccaggaagcagcccccgcccaaagcgacgucgcacuacuccgcuucgucaacccagacacaggccgaguucucuucgaaugcaaacuacacaaauccggauaugucacagucgcccacaccggcccccacgaccucgucaucccacccaacggauacuuucguuucgacuccugggucaaccaauucuacacccuggcccccaugggaaacggcgccggccgcuccuccgcacuauaa

SEQ ID NO: 37112 - RNA, 1620 nt, Artificial Sequence
  derived and/or modified sequence opt11 from capsid_protein__Norovirus__BAF74513
augaaaauggccuccaacgacgccaacccauccgacggcagcaccgcaaaccuaguccccgaagucaacaacgaaguaauggcucuugaaccuguaguuggagcagcaaucgccgcccccgucgcuggccaacaaaacgucaucgaucccuggauccgaucuaacuucguccaagcccccggcggagaauuuaccgucucaccccgaaacgcacccggcgaaauccuaugguccgcaccccucggcccagaccucaaccccuaccucucccaccuagcccguauguacaacggcuacgccggaggauucgaaguccaaguaauucuagcaggaaacgcauucacagccggcaaaaucaucuucgcagccguaccacccaacuucccaacagaaggacucuccccaucccagguaacaauguucccacacaucaucgucgacguuagacaacuugaaccaguacucauaccccucccagacguccgaaacaacuucuaccacuauaaccaaucgaacgacuccacaaucaaacuaaucgccaugcucuacaccccacuaagagcaaacaaugccggagacgacguauucaccgucucaugucgaguccucacccgcccuucaccagacuucgacuucaucuuccucgucccacccacagucgaaucucgaaccaaacccuucacuguccccauccucaccgucgaagaaauguccaacucaagauuccccguaccccucgaaaaacuauacaccggccccaguagcgccuucgucguccaaccccaaaauggacgcugcacaaccgacgguguccuacuaggcacaacccaacucucagcagucaacaucugcacauuccgaggagacgucacccacauagcuggaucccacgauuacaccaugaaccuugccagccaaaacuggaacaacuacgaccccacugaagaaaucccagcaccucuaggaacaccagacuucgucggcaaaauccaaggcguucuaacacaaaccacccgcgaagacggcuccacgcgcgcccacaaagcaacagucucuacugguuccguccauuucacacccaaacucggcuccguccaauacacaacagacacaaacaacgacuuccaaaccggccaaaacacaaaauucaccccaguaggcgucauccaagacggcuccaaccaccaaaacgaaccccaacaauggguccuacccaacuacuccggacgcaccggccacaacguccaccuugccccugcggucgcuccuacauuccccggagaacaacuccuauuuuuccgcuccaccaugcccggcugcuccggauaccccaacaugaaccucgacugccuacucccccaagaauggguccagcacuucuaccaggaagcugccccagcccaauccgacguagcccuccuccgguucgucaaccccgacacaggacgaguccuauucgaaugcaaacuccacaaaucaggcuacgucaccgucgcacacacaggcccacacgaccuaguaaucccacccaacggcuacuuccgcuucgacuccuggguaaaccaauucuauacacucgcacccaugggcaacggagcaggucgacgccgcgcccucuga

SEQ ID NO: 37113 - RNA, 1623 nt, Artificial Sequence
  derived and/or modified sequence opt11 from capsid_protein__Norovirus__BAF74514
augaaaauggcaucaaacgaugcuaaccccuccgacggcuccacagccaaccucguacccgaagucaacaacgaagucauggcccucgaacccgucguuggcgccgccaucgcagcacccguugcaggccaacaaaacguaauagacccauggauccguaacaacuucguacaagcccccggcggcgaguucaccguaucaccccgaaacgcccccggugaaauccuuugguccgccccacucggacccgaccuaaaccccuaccuaucccaccucgcccgaauguacaacggcuacgccggcggcuucgaaguccaaguaauacucgcuggcaacgccuucacugccggcaaaaucaucuucgccgcagucccuccaaacuuccccaccgaaggccucucucccucccaaguaaccauguucccccacaucauagucgacguccgacaacucgaaccuguccucaucccccucccagauguccgcaacaauuuuuaccauuacaaccaaucuaacgaccccaccauaaaacucaucgccaugcuuuacacaccgcuacgugccaacaacgcaggcgaagacgucuucacugucagcugccgcguacuuacacgacccuccccagacuucgacuucauuuuccuugucccucccaccguagaaucccgaaccaaacccuucaccguccccauccucaccguagaagaaaugaccaacucccguuuucccauccccuuagaaaaacucuucaccggaccaagcggcgccuuuguaguucaaccucaaaacggccgaugcacuaccgacggcguccuccuaggcacaacacagcucucaccaguaaacaucugcacgcuccgcggagacguaacccacauagcaggcacucacaacuauacaaugaaucucgccagccaaaacuggaacaacuacgacccaaccgaagaaauuccagcaccacuuggaacacccgacuucgucggucgcauccaaggcguacuaacacaaaccacccgcggcgacggcuccacccgcggacacaaagccacaguaucaaccggagacguacacuucacccccaaacucggcagcguccaauucaacaccgacaccaacaacgacuucgaaauaggccaaaacacccgcuucacaccgguaggagucguccaagacggaaacggaacccaccaaaaugaaccacaacaauggguccuccccucuuacuccggccgaacuggacacaacguacaccucgcaccagccguugcccccacauucccaggagaacaacuccucuuuuuccgcucaaccaugcccggcugcucggguuaccccaacaugaaccuagacugccuccucccccaagaguggguucaacacuucuaccaagaagccgccccugcacaauccgacgucgcccuccuccgauuugucaaccccgacaccggacgaguccucuucgaaugcaaacuccacaaauccggauacgucaccgucgcccacacaggccaacacgaccucgucaucccacccaacggcuauuuccgauucgacuccugggucaaccaauucuacacccuagcccccaugggcaacggcaccggccgucgccgugcacucuaa

SEQ ID NO: 37114 - RNA, 1620 nt, Artificial Sequence
  derived and/or modified sequence opt11 from capsid_protein__Norovirus__BAF74515
augaaaauggccuccaacgaugccaaccccagcgacgggucagccgccaaucuaguacccgaagucaacaacgaagucauggcccucgaacccgucguaggagccgccaucgccgcccccgucgccggccaacaaaacaucaucgaccccuggauccgcaacaacuuuguccaggcccccggaggagaguucacagucagcccccgcaacgcgcccggugaaauccucugguccgcaccacuaggccccgaccucaaccccuaccucucccauuuaucccguauguauaacggcuacgccggcggcuucgaaguacaaguaauccucgccggcaacgcauucaccgcuggcaagguaauuuucgccgcgguuccgcccaacuucccuaccgaagggcucuccccaucccaaguaaccauguucccacacaucaucgucgacguccgccagcucgaacccguccucauuccccucccagacguacgcaacaacuucuaccacuacaaccaagcccacgacuccacacuuaaacuuaucgcuaugcuauacacaccccuccgcgccaacaacgccggcgacgacguguucaccgucuccugccgcgugcucacccgacccucccccgacuuugacuuuaucuuccucguaccacccaccgucgaaucccgcaccaaacccuucacuguccccguacuaacagucgaagaaaugaccaacucccgcuucccaaucccccucgaaaaacuauacaccggacccucauccgccaucguaguacaaccccaaaacggccgcugcaccaccgacggcguucuacucggcacaacccaacuuuccgccgucaacauaugcacauuucgcggagacgucacccacauagcagggucccgcaacuacacuaugaaccucgccucccaaaacuggaacaacuacgacccaaccgaggaaaucccagccccacuuggcacaccagacuucgucggaaaaauacaaggacuacuuacccagaccacucgcgccgacggcucuaccagagcccacaaagcaaccgucucuacaggauccguccacuucaccccaaaacugggcucaguccaauuuuccacagacacagacaacgauuuucaaccaggccaaaauacaaaauucacaccagucggcgucauccaggacggagaccgccaccaaaaugaaccacaacaauggguucucccagacuucagcggccgcacaggccacaacgugcaccucgccccagcugucgcaccaacauuccccggugaacaacuccucuucuucagaucaacuaugcccggccgcucuggcuacccaaacaugaaccuugacugccuccucccacaagaauggguccuccacuucuaccaagagucugccccagcccaauccgacgucgcacuccuccgauucgucaaccccgacaccaaccgcguccuauucgaauguaaacuccacaaauccggcuacauaaccguagcacacaccggccaccacgaccuaauccucccucccaacggcuacuuucgauucgacuccugggucaaccaauucuacacccuagccccgaugggcaacggagccggccgacgccgcgcacccuaa

SEQ ID NO: 37115 - RNA, 1623 nt, Artificial Sequence
  derived and/or modified sequence opt11 from capsid_protein__Norovirus__BAF74516
augaaaauggccuccaacgacgcaacccccucagacggcuccaccgccaaccuagucccggaagucaacaaugaagucauggcacuagaacccgucgucggcgcagccaucgccgccccugucgcuggacaacaaaacgucaucgaccccuggauacgcaacaacuucguacaggcacccggcggagaguucaccguaucgccccgcaacgccccuggcgaaauccucuggagcgcaccccucggccccgaccuuaacccauaccuuucacaccuagcucgcauguacaacggcuacgccggaggguucgaaguccaagucguacuugcaggcaacgccuucacagccggcaaaauaaucuucgcagccguaccacccaacuucccaaccgaaggacuaucacccucccaagucaccauguucccacacauaauagucgacguccgacaacuagaaccaguccuaauuccacuccccgauguccgaaacaaccucuaccacuauaaccaaucaaaugacccaaccaucaaacucauagcaaugcucuacacuccccuaagagcaaacaacgccggcgaagacgucuucaccguuuccugccgaguccuaacccggcccuccccagacuucgacuucaucuuccucguacccccuacugucgaaucacgaaccaaaccauucacaguccccauccucacuggugaagaaaugaccaacucccgauucccaaucccacuagaaaaacucuucacaggccccucaggagcuuucguaguccaaccccaaaacggcagaugcaccaccgacggcguacuccucgguaccacccaacugcuacccgucaauaucugcaccuuucgcggcgacgucacccacaucgcaggcacucacaacuacacaaugaaucuugcaucccaaaacuggaacaacuacgauccaacggaagaaauaccugccccacucggaaccccagacuuugucggccgaauccaaggcaugcucacccaaacaacccgaggcgacgguuccacccgcggccacaaagccacagucuccaccggugacguccacuucacucccaaacuaggguccauccaauucaacaccgacacaaacaacgauuucgaaaccggccaaaacaccaaauucacccccguaggcgucguccaagacgguaacggcacacaccaaaacgaaccccagcaauggguacuacccucuuacucuggcagaacaucccacaauguccaccuagccccagccguagcccccacuuucccgggcgaacagcucuuauucuuccgcuccaccaugcccggcugcagcggcuacccaaacaugaaccucgacugccuccucccacaagaauggguccaacacuucuaccaagaagccgccccagcacaaucugacguagcucuccuccgauucgucaacccggacaccggacgaguccuauuugaaugcaaacuccacaaauccggcuacguuaccgucgcccacaccggccaacacgaccucgucaucccaccaaacggcuacuuccgcuucgacagcuggguaaaccaauuuuacacccuugcccccaugggaaacggaacaggucgcagacgagcccucuag

SEQ ID NO: 37116 - RNA, 1623 nt, Artificial Sequence
  derived and/or modified sequence opt11 from capsid_protein__Norovirus__BAF74517
augaaaauggccuccaacgacgccaaccccuccgacggcuccgccgccaaccuugucccagaaguaaacaacgaagucauggcacucgaacccguugucggcgccgcaaucgccgcaccagucgccggccaacaaaacguaaucgaccccuggauacgcaacaacuucguccaagcccccggcggcgaauuuacaguaucuccccguaacgcccccggagagauucucugguccgccccacuaggaccagaccucaaccccuaccuuucacaccuagcucgaauguacaauggcuacgccggcggcuucgaaguacaagucauccucgccggcaacgcauucaccgcaggaaaaauaaucuucgccgcaguacccccaaacuuccccacagaaggacucucucccucacaagucacaauguucccccacaucaucguugacguucgccaacuagaacccguccuaaucccccuccccgacguacgcaauaacuucuaucacuacaaccaguccaacgacucuacuaucaaacuaaucgccaugcucuacaccccacugcgagcaaacaacgccggugaagacgucuucaccgucuccugccgcguccucaccagacccuccccagacuucgacuucaucuuccuagucccacccaccgucgaaucccgcacaaaacccuucacaguccccauccucaccgucgaagaaaugaccaacuccagauuccccauuccacuagaaaaauuauucaccggcccauccggcgccuucgucguacaaccccaaaacggccgcugcacaacugacggcgucuuacucggcaccacacaacuaucccccguaaacauaugcaccuuccgcggcgacguuacccacauagccggcacccacaacuacaccaugaaccucgcaucgcaaaacuggaacaacuacgaccccacugaagaaauaccagcaccccucggcacacccgacuucguuggccgcauucaaggaaugcucacacaaaccacacgcggcgacggcagcacacgcggacacaaagccacagucuccacaggagacguccacuucaccccaaaacucggcuccauccaguucaacacagacaccaacaacgacuucgaaaccggccaaaacacaaaauucacacccgucggaguaguccaagacggcaacggcgcccaucaaaacgaaccccaacaauggguccuccccucauacucuggccgcacaggccacaacguacaccuggcccccgcgguagcccccaccuuccccggcgaacaacuucuuuucuuccgcuccaccaugcccggcugcucaggcuaccccaacaugaaccucgacugccuccuaccacaagaauggguacaacacuucuaccaagaagccgcaccagcacaauccgacguugcacuguuacgauucgucaacccugacaccggacguguccucuuugaaugcaaacuccacaaauccggguacgucaccgucgcccauaccggccaacacgaccucgucauucccccuaauggcuacuuccgauucgacucauggguuaaccaauucuacacccucgcacccaugggcaauggcaccggccgaagacgagcccucuag

SEQ ID NO: 37117 - RNA, 1623 nt, Artificial Sequence
  derived and/or modified sequence opt11 from capsid_protein__Norovirus__BAF74518
augaaaauggccucaaacgaugcaaacccaucagacggcucuacugccaaccuaguccccgaaguaaacaacgaaguaauggcccuagagcccgucguaggagccgccaucgccgcacccgucgccggucaacaaaacgucaucgaccccuggaucagaaauaacuucguccaagcgcccggaggagaguucaccguuucuccacgcaacgccccaggcgaaauacugugguccgcuccccucggaccagaccucaaucccuaccucagucaccucgcccgcauguacaacggcuacgccggcggcuucgaagugcaaguaauucuugccggcaacgcauucaccgccggcaaaauaaucuucgcagcaguacccccaaacuucccaacugaaggccucucccccucccaagucaccauguucccucacaucauagucgacguccgccaacuugaacccguacucauaccccucccagacguccgcaacaacuucuaccacuacaaccaauccaacgaccccaccaucaaacucaucgccaugcuguacacaccccuucgcgcaaacaacgccggagaagacguauucaccgucuccugccgcguccuaaccagaccaucacccgacuucgacuuuaucuuccucgucccacccacugucgaaucacgaacaaaacccuucacaguccccauacuaacagucgaagaaaugacaaacucccgauuucccaucccacuugaaaaacuauucacaggacccuccggcgccuucgucguccagccccaaaacggccgaugcacaacugauggcguccuccucggaaccacccaacucucccccguaaacauaugcacuuuccgaggugacguaacacacauugccgguacucacaacuacaccaugaaccuagccucccaaaacuggaacaacuaugaccccacugaagagauccccgcuccccucggcacccccgacuucguaggacgaauccaaggaaugcucacacaaaccacccgcggcgacggaagcacccgcggacacaaagccacgguauccaccggcgacguccacuucacacccaaacuaggaaguguccaauucaacaccgacaccaacaacgacuucgaaaccggccaaaacacccgauucaccccaguaggcgucguccaggacggcaacggcacccaucaaaacgaaccccaacaguggguccuacccuccuacuccgguagaaccggccacaacguacaccuagcccccgccgucgcccccaccuuuccaggcgaacaacuucucuucuuucgcuccaccaugcccggcugcuccgguuacccuaacaugaaccuggacugccuucucccacaagaauggguucaacacuucuaccaagaagccgcccccgcccagucagacguagcccuccuccgcuucguaaacccugacacaggccgaguccuuuucgaaugcaaacuccacaaauccgguuacgucaccguagcgcacaccggccagcacgaccucgucaucccgccaaacggauacuuccgcuucgacuccugggucaaccaauucuacacacuagccccaaugggcaauggcaccggccgccgccgagcacucuaa

SEQ ID NO: 37118 - RNA, 1623 nt, Artificial Sequence
  derived and/or modified sequence opt11 from capsid_protein__Norovirus__BAF74519
augaaaauggccucaaaugacgccacccccucagacggaucuaccgccaaccucgucccggagguaaacaacgaaguaauggcacucgaacccgucgucggcgccgcuaucgcugccccagucgcaggccaacagaaugucaucgacccuuggauacgcaacaacuuuguccaggcacccggaggagaguucaccgucagcccgagaaacgcacccggcgaaauccucuggucagcaccccucggccccgaccucaaccccuaccuuucacaccuggcccgcauguacaacggcuacgccggcggcuucgaaguccaagucauccuagcaggcaacgccuucaccgccggcaaaaucaucuucgccgccguacccccaaacuuccccaccgaaggccucuccccaucacaaguaaccauguucccccacauaaucgucgacguccgccagcuagaacccguccugaucccccucccagauguccgcaacaacuucuaucacuacaaccaaagcaacgaccccacaaucaaacuaaucgcuaugcucuauacaccccuccgagccaacaacgccggugaagacgucuucaccgucuccugccgaguacuaacccgaccuuccccagacuucgacuucaucuuccuugucccacccaccguugaaagccgaacaaaacccuucaccguccccauccucaccgucgaagagaugacgaacucccgcuuccccaucccccuugaaaaacucuucacaggacccuccggcgccuucgucguccaaccccaaaacggcagaugcaccaccgacggaguucuccuaggaacaacacaacucucacccgucaacaucugcaccuuccgcggcgacgucacacacaucgcaggcacacacaacuacacuaugaaccucgccagccaaaacuggaacaacuacgaccccacugaagaaaucccagcaccccucggcacaccugauuucguaggacgaauccaaggcaugcuuacccaaaccacccgcggugacgguucaacccgcggacacaaagccacaguaucaaccggcgacguccacuucacaccaaaacuaggcuccauucaauucaacaccgacaccaacaacgacuuugagacaggacaaaacacaaaauucacacccguaggagucguacaagacggcaacggcacccaccaaaacgaaccacaacaauggguccuuccaagcuacuccggccgcaccggucauaacguccaccucgccccagccgucgcccccaccuuccccggggaacaacuacuuuucuuccgcucaaccaugcccggcugcagcggcuaccccaacaugaaccucgacugccuccuaccucaagaauggguacaacacuucuaucaagaagcagcccccgcccaguccgaugucgccuugcuccguuucgugaacccugacacuggacgcguucucuucgaaugcaaacuccacaagucaggcuaccucaccgucgcacacaccggacaacacgaccucguaauucccccuaacggauacuuccgauucgacuccugggucaaucaauucuauacccucgcacccaugggcaacggaaccggacgaagacgcgcucucuaa

SEQ ID NO: 37119 - RNA, 1623 nt, Artificial Sequence
  derived and/or modified sequence opt11 from capsid_protein__Norovirus__BAF74520
augaaaauggccuccaacgacgccaaccccucagacggcucgaccgcuaaccuaguccccgaagucaacaacgaaguaauggcucuagaaccagucgucggcgccgccauagccgccccagucgccggacaacaaaacgucaucgaccccuggauccgaaacaacuucguccaagcccccggcggcgaguucaccguaucgccccgcaacgcccccggcgaaauccuaugguccgccccgcuaggcccugaccucaaccccuaucucucccaccuugcccgcauguacaacggauacgcaggaggauuugaaguccaagucauacuagcaggaaacgcauuuacugccggaaaaaucaucuucgccgcaguacccccuaacuuucccaccgaaggauuaucccccucccaagucaccauguucccacacauaaucgucgacguacgccagcuagaacccguccuuauaccacuaccagauguccgcaacaacuucuaccacuacaaccaauccaacgaccccaccaucaaacucaucgccaugcucuacacaccccuacgugcaaacaacgccggagaagacguuuucaccgucuccugccgaguucuuacccgcccaagcccagacuucgacuucauauuccuaguuccaccaaccguagaaucucgaaccaaacccuucacaguacccauacucacagucgaagaaaugaccaacucccgcuucccuaucccccuagaaaaacucuucacaggccccuccggagccuucguaguccagccccaaaacggccgcugcacaaccgacggaguucuccucgguacuacccaacucagcccagucaacaucugcacauuccgcggagacguaacccacaucgcaggcacccacaacuacaccaugaaccucgcaucacaaaacuggaacaacuacgaccccaccgaagagauccccgcaccacucggcacccccgacuucguaggccgcauccaaggaaugcucacacaaacaacccgcggagacggcuccacucgaggacacaaagcaaccgucucaacaggagacguccacuucacacccaaacucggcagcauccaauucaacaccgacaccaauaacgacuucgaaacaggccaaaacacaaaauucacucccguaggcgucauccaagacggcaacggagcccaucaaaacgaaccccaacaauggguccuccccuccuacuccggacgcaccggacacaacguacaccucgcccccgcaguugccccuaccuuccccggcgaacaacuucucuucuucagaagcacaaugcccggcugcuccggcuaccccaacaugaaccuagacugccuccuaccccaagaauggguccaacacuucuaccaagaggccgcccccgcacaaucagacgucgcacuacuucgauucgucaacccagacacaggccguguccuauucgagugcaaacuacacaaauccggcuacaucacagucgcccacacuggacaacacgaccuagucauaccacccaacggcuacuuccgauucgacuccugggucaaccaauucuacaccuuagcacccaugggcaacggaacaggcagacgucgcgcacucuga

SEQ ID NO: 37120 - RNA, 1623 nt, Artificial Sequence
  derived and/or modified sequence opt11 from capsid_protein__Norovirus__BAF74521
augaagauggccucaaacgacgcaaaccccuccgacggcuccaccgcaaaccucguccccgaagucaacaacgaagucauggcccucgaacccgucguaggcgcagccaucgccgcacccgucgccggccagcagaacgucaucgauccauggauccgcaacaacuucguccaagcucccggcggagaguucacaguaucuccucgcaacgccccaggugaaauccuuuggucagccccucuaggacccgaccuaaaccccuaucuaucccaccucgcacgcauguacaaugguuacgccggcggcuucgaaguccaggucaucuuagccggcaacgcauucaccgccgguaaaaucaucuucgccgcaguaccacccagcuucccaaccgaaggccuuucacccucccaagucaccauguucccucacauaaucguugacguacgccaacucgaaccaguccuuauccccuuacccgacguccgaaacaacuucuaccacuacaaccaauccaacgacccaaccaucaaacucaucgccaugcucuacaccccauuacgagccaacaacgccggugaagaugucuucacaguaucaugccgcguucucacuagacccagcccugacuuugacuucaucuuccuaguacccccaacagucgaaucacgaaccaaaccauucaccguccccauccucaccgucgaagaaaugacuaacucucgcuucccuaucccccuagaaaaguuauucaccggacccuccggcgccuucgucguccagccacaaaacggccgcugcaccaccgacggaguacuacucggcaccacacaacucucaccagucaacaucuguacauuccgcggugacguaacccacaucgccggcacccacaacuacaccaugaaccuagccucacaaaacuggaacaauuacgaccccaccgaagaaaucccagcuccccucggcaccccggacuucgucggccguauucaaggcaugcucacccaaaccacacgcggagacggcucaacacggggccacaaagccacagucagcaccggcgauguccacuucacaccuaaacucggauccauccaauucaacacagacaccaacaacgauuucgaaacaggccaaaacaccaaauucacccccguaggaguuguccaagacggcaacggcacccaccaaaacgaaccccaacaaugggugcuccccuccuacuccggccguaccggacacaacguccaccucgcccccgccgucgcccccacauuucccggcgaacaacuccucuucuuucgaucaaccaugccaggcugcuccggcuauccaaacaugaaccucgacugccuacucccucaagaauggguccaacacuucuaucaggaagccgcuccggcccaaagcgacgucgcccuccuacgauucgucaaccccgacacgggcagaguccucuucgaaugcaaacuccauaagucgggcuacgucaccguagcccacaccggucaacacgaucuaguaaucccacccaacggcuacuucagauucgacuccuggguaaaccaauucuacacccuagcuccaaugggcaacggcacaggccgccgcagagcccucuaa

SEQ ID NO: 37121 - RNA, 1623 nt, Artificial Sequence
  derived and/or modified sequence opt11 from capsid_protein__Norovirus__BAF74522
augaagauggccucaaacgacgcaacccccucagacggcuccaccgccaacuuagucccagaagucaacaacgaagucauggcccucgagcccgucguuggagccgccaucgccgccccugucgccggacaacaaaacgucaucgaccccuggauccgaaacaacuuuguacaagcacccggcggcgaguucaccgucucaccacgaaacgcccccggcgaaauccucugguccgccccacuaggccccgaccuaaaucccuaccucucacaccuagcccgcauguacaacggcuaugccggugguuucgaaguccaaguaauacuagccggcaacgccuuuacagccggcaagaucaucuuugccgcaguacccccgucauuccccaccgaaggacuaucccccucucaaguaaccauguucccccacaucauagucgauguacgccaacuagaacccguccuaauccccuuacccgacguucgcaacaacuucuaccacuauaaccaauccaacgacccaacaauuaaacuaauagcaaugcucuacacaccccuccgagcaaacaacgccggggaagacgucuucaccgucucuugccgcguccucacccguccaucccccgauuucgacuucaucuuccuagucccaccaaccguagaaucccgcaccaagccguucaccguccccauccucaccgucgaagaaaugaccaacucccgcuuccccauaccccuagaaaaacucuucaccggucccuccggcgcauucguuguccagccccaaaacggucgaugcaccacagacggaguccuccucggcaccacccagcucuccccagucaacaucugcacuuuccgcggagacgucacccauaucgcaggcacacacaacuacaccaugaaucucgccucccaaaacuggaauaacuacgaccccaccgaagaaauacccgccccacucggaaccccagacuucgucggccgaauacaaggcaugcuaacacaaaccacacgcggcgacggcuccacccgcggacacaaagcuacugugucuaccggcgacguccacuucacacccaaacuaggcuccguacaauucgacaccgacaccaacuccgacuucgaaaccggucaaaacacaaaauucacacccguaggcgucguccaagacggcaacggcgcacaccaaaaugaaccccaacaauggguauuaccuuccuauucaggucguaccggacacaacgcacaccucgccccagccgucgcccccacauuccccggcgaacaacuccuauucuuccgcagcacaaugccaggaugcuccgguuaccccaacaugaaccucgacugccuacucccacaagaauggguccaacacuuuuaccaagaagccgcccccgcccaaucggacguugcccuccuccgcuucgucaacccugacacuggccgcguacucuucgaaugcaaacuacacaaauccggcuacgucaccgucgcccacaccggccaacacgaccucgucaucccacccaacggcuacuucagauucgacucguggguuaaccaauucuacacccucgcccccauggguaauggcaccggacgucgccgcgcccucuaa

SEQ ID NO: 37122 - RNA, 1623 nt, Artificial Sequence
  derived and/or modified sequence opt11 from capsid_protein__Norovirus__BAF74523
augaaaauggccucuaacgacgccacgccuucagacggcuccacggccaaccucguucccgaagucaacaacgaggucauggcacucgaaccuguggucggcgcagcaaucgcugcccccguagcaggccaacaaaacgucaucgaccccuggauccgcaauaacuucguccaagcccccggcggcgaguucaccguuagcccccgcaaugcuccaggugaaauccuaugguccgcaccccucggccccgaccucaaccccuaccucucccaccucgcccgcauguacaauggguacgcugguggcuucgaaguacaagucauccucgccggcaacgccuucaccgccggcaaaaucauauucgccgcaguacccccaaacuuccccacagaaggccucucccccucacaagucacgauguucccccauaucaucgucgacguucgccagcucgagccaguccuaaucccccugcccgacguccgcaacaacuucuaccacuacaaccaaucaaacgaccccaccaucaaacucaucgcuaugcucuacaccccacuaagagcuaacaaugcaggagacgaugucuuuacugucuccugccgcguacuaacuagacccagcccggacuucgacuucaucuuucuaguaccacccaccguugaaucgcgcacaaaacccuucuccguaccaauccucaccguagaagaaaugaccaacucccgcuuccccaucccccucgaaaaacucuuuaccggucccuccuccgccuucguuguccaaccccaaaacggacgcugcacaaccgacggaguccuccucgguacaacccaacucagcccagucaacaucuguacauucagaggcgacguaacccacaucgccggcacccaaaacuacaccaugaaccucgcaucccaaaacuggaacaacuacgacccaaccgaagaaauucccgcaccccucggcacaccugacuucguuggcaaaauucaaggcgugcucacccagaccacgcgacgcgacggcucaacucgcggacacaaagccaccgucucaaccggcuccguacacuucacccccaaacuaggguccguccaauucuccacagacaccucgaacgacuucgaaaccggucaaaacacccgcuucacccccgucggcguaguccaagacggcuccacaacccaccaaaacgaaccacaacaauggguccuacccgacuacagcggccgagacucacacaacguacaccuagcccccgccgucgcacccaccuuccccggcgaacaacuacuauucuuccgcucaaccaugcccggcugcucaggcuacccaaacaugaaccuagacugccuccucccccaagaauggguacaacacuucuaccaagaaagcgccccugcccaauccgacgucgcccuauuaagguucgucaaccccgacaccggccgcguccucuucgaaugcaaacuccacaaaucuggauacguaaccguagcccacaccggucaacacgaucucgucauacccccaaacggcuauuucagauucgacagcugggucaaccaauucuacacacucgcccccaugggcaauggagccggcagacguagagcccucuaa

SEQ ID NO: 37123 - RNA, 1623 nt, Artificial Sequence
  derived and/or modified sequence opt11 from capsid_protein__Norovirus__BAF74524
augaagauggcaucaaacgacgccacccccuccgacggauccaccgccaaccuaguacccgaaguaaacaacgaagugauggcccuagaaccaguagucggcgcagccauagcagcccccgucgcgggccaacaaaacgucaucgacccauggauaagaaacaacuucguccaagcccccgguggcgaguucacaguaucaccccgaaacgcccccggagaaauccucuggucugcaccccucggcccagaccucaaccccuaccucucccaccuagcccguauguacaacggauacgccggcggauucgaaguacaagucauccucgccggcaacgcauucacagcaggaaaaauaaucuuugccgccguaccacccaacuuccccaccgaaggccuaagcccuucucaagucaccauguucccccacaucauaguagacguccgccaacuagaacccguacucaucccccuccccgacguccgcaacaacuucuaucacuacaaccaauccaacgaucccaccauaaagcucauagccaugcucuacacuccccuacgugcaaacaacgcaggagacgacguauucaccgugagcugccgcguccucacccgcccaucacccgacuucgacuucaucuuccucgugccaccaaccgucgaaagccgcaccaagccauucucaguccccauucucacagucgaagaaaugaccaacucucgcuuccccaucccccucgaaaaacucuucaccggacccuccuccgcuuucguaguccaaccccaaaauggcagaugcacaaccgacggaguccuacuuggcaccacacaacucucccccgucaacaucugcacuuuucgcggagacguaacacacauagcaggaacacaaaacuacacaaugaaccuagcaucacaaaacuggaacaacuaugacccaaccgaagaaauccccgcaccccuuggcacccccgacuuugucggcaaaauccaaggcguacuuacccaaacaacucgacgagacggauccacccgcggccacaaagccaccguguccacaggcuccguccacuucacucccaaacucggcuccguacaauucucaaccgacaccucuaacgacuucgaaaccggccagaauacucgcuucacccccgucggugucguccaagacggaucaaccacacaccaaaaugaaccccaacaauggguauuaccugacuacuccggccgcgacucucacaacguccaccuagccccagccgucgcccccacauucccaggcgaacaacuccucuucuuccguuccaccaugcccggaugcuccggauacccaaacaugaaccucgacugccuacuaccccaagaauggguacaacauuucuaccaagaaucagcccccgcccaaagcgacgucgcucuccuccgcuucguuaacccugacacaggacgcguccucuucgaauguaaacuacacaaauccggcuacgucaccgucgcccacaccggucaacacgaccucgucauaccucccaacggcuacuuccgcuucgacagcugggucaaucaauucuacacgcucgccccuaugggaaacggcgccggccgccgacgugcccuauaa

SEQ ID NO: 37124 - RNA, 1623 nt, Artificial Sequence
  derived and/or modified sequence opt11 from capsid_protein__Norovirus__BAF74525
augaaaauggccuccaacgacgccacacccuccgacggauccaccgcaaaccucguccccgaagucaauaacgaaguaauggcccuagaacccguagucggcgccgccaucgccgcccccguugcaggacaacaaaacgucaucgaccccuggauccgcaacaauuucguccaagccccuggcggcgaguucacagugucuccccgaaacgcccccggcgaaaucuuaugguccgccccucucggccccgaccuaaaccccuaccucucccacuuagcacgcauguacaacggcuacgcaggcggauuugaaguccagguaauccucgccggaaaugccuucacagcagguaaaauaaucuucgcagcaguacccccuaacuuccccacagaaggcuuaucccccucccaagucaccauguucccccacaucaucgucgauguccgacaacuagaacccguccugaucccccuccccgacgucagaaacaacuucuaccacuacaaccaauccaacgaccccaccauaaaacuaauagcuaugcucuacacgccccuccgagccaacaacgccggcgacgacgucuucaccgucuccugccgcguccuaacccgcccuucccccgacuucgacuucaucuuccucguuccgcccacuguugaauccagaaccaaacccuucuccguucccauccucacuguagaagaaaugaccaacucuagauuccccaucccccucgaaaaacucuucacaggcccuucuuccgccuucgucguccagccacaaaacggccgcugcacuaccgacggcguccuacucggcaccacccaacucucacccgucaacauaugcaccuucaggggagacgucacacacaucgcaggaacccaaaauuacacaaugaaccucgcgucacaaaauuggaacaacuacgacccaaccgaagaaaucccagcaccgcucggcacccccgacuucguaggcaaaauccaaggcguccuuacccaaacaacccgccgugauggcucaacacgcggccacaaagccacaguauccaccgguuccguacacuucacccccaaacuuggcagcguccaauucucaaccgacacauccaacgacuucgaaaccggccaaaacacacgcuuuacccccgucggcguuguccaagacggauccaccacacaccaaaacgaaccccaacaauggguccuccccgacuacuccggacgagacucccacaacguccaccucgccccugcugucgcccccaccuuccccggcgagcaacuccucuuuuucagauccaccaugccaggcugcucaggcuaucccaacaugaaccuagacugccuccucccccaagaauggguacaacacuucuaccaagaauccgcccccgcccaaucugacguagcccuccuaagauuuguaaaccccgacacaggcagagucuuauucgaaugcaaacuacacaaaucaggauacguuacugucgcccacacuggacaacacgaccucgucaucccgcccaacggauacuuccgauuugacuccugggucaaccaauucuacacccuagcccccaugggcaacggagcuggccgucgccgggcccucuag

SEQ ID NO: 37125 - RNA, 1623 nt, Artificial Sequence
  derived and/or modified sequence opt11 from capsid_protein__Norovirus__BAF74526
augaaaauggccuccaacgacgccacucccucagacggcuccaccgcuaaccucgucccugaaguaaauaccgaagucauggcccucgaacccgucgucggagcagccauagccgcccccgucgcuggccagcagaacgucauagaccccuggauccguaauaauuucguccaagccccaggaggagaguucacaguaucaccccgcaacgcacccggcgaaauccucuggucugcuccccucggccccgacuuaaaccccuaccuaucccacuuagcccgcauguacaacggcuacgcaggcggcuucgaaguucaaguaauccuggcaggcaacgcuuucacagcaggcaaaaucaucuucgccgccguacccccaaacuuccccaccgaaggacucucccccucacaagucaccauguucccucacaucauagucgacguaagacaacucgaaccuguacuaaucccccuccccgacguccgcaacaacuucuaccacuacaaucaaucuaacgaccccaccauaaaacucauugcuaugcucuacacaccccuacgaaccaacaacgccggcgacgaugucuucaccgucuccugucgcguccuuacccgccccucccccgacuucgacuucauauuccuagucccacccacuguugaaucacgaaccaaacccuucucgguaccuauacucaccgucgaagaaaugaccaauucucgauuccccaucccacuugaaaaacuauucacuggaccaucuucagccuucguaguccagccccaaaacggacgaugcaccaccgacggaguccuauuaggcaccacccaacucuccccuguaaacaucugcacauuccgaggcgacguaacucauaucgccggcacacaaaacuacaccaugaaccucgcaucccaaaacuggaacaacuacgacccaaccgaagaaauccccgcgccccucggcacacccgauuucgugggcaaaauccaaggaguacucacccaaacuacccgccgugacgguucuacucgcggacacaaagccaccgucuccaccggcuccauacauuucacccccaaacugggcucaguccaauucuccaccgacaccucaaacgacuucgaaaccggccaaaacacccguuucacccccguaggggucguacaagacggcuccaccacccaucaaaacgaaccccaacaauggguccuacccgacuacuccggcagagacucccacaacguacaccucgccccagccgucgccccaaccuucccaggagaacaacuauuauucuuccgaucaacuaugcccggcugcucaggcuaccccaacaugaaccuugauugcuuacuaccacaggaauggguccaacacuucuaccaagaauccgcuccagcacaaagcgacgucgcccuccucagauucguaaacccugauaccggacgaguacuguuugaaugcaaacuccacaaaucaggcuacguaaccgucgcccacacuggucaacacgaccucgucaucccacccaacggauacuuccgcuucgacucuuggguaaaccaguucuacacucucgcccccaugggcaacggcgcaggucgccgacgcgcacuauaa

SEQ ID NO: 37126 - RNA, 1623 nt, Artificial Sequence
  derived and/or modified sequence opt11 from capsid_protein__Norovirus__BAF74527
augaaaauggcuuccaacgacgccacacccuccgacggcuccacugcuaaccuuguccccgaaguaaacaacgaagucauggcccucgaacccgucgucggcgcugcaaucgccgccccaguugccggccaacaaaacgucauagaccccuggauccgcaacaacuucguccaggccccaggcggcgaauuuacagucucuccccgcaacgcccccggcgaaauacucuggucagcaccccucggccccgaucucaacccauaccuuucccaccucgcccgcauguauaacggcuaugcgggcggcuucgaaguccaagucauacucgcaggcaacgcguucaccgcagguaaaaucauauucgcagccgucccacccaauuuccccacagaaggacuaucaccaucccaagucacaauguucccccauaucaucgucgacguacgccagcuagaacccguacucauuccccuacccgacguccgcaacaacuucuaccacuauaaccaaucuaaugacccaacaaucaaacuaaucgccaugcuguacacuccccuccgcgccaacaacgcuggcgacgacguauucaccgucuccugccgcguccuaaccagaccauccccagacuucgacuucauuuuccucgucccucccacggucgaaucacgcaccaaacccuucucaguccccauacuuacgguugaagaaaugaccaacucccgauucccaauaccccuggaaaaacuauucaccggcccaucauccgccuucgucguccaaccccaaaacggacgcuguacaacagacggcguacuacugggcaccacgcaacuguccccggucaacaucugcaccuuccgcggcgacgucacccacaucgccgguacccagaacuacaccaugaaccucgcuucccaaaacuggaacaacuacgacccaaccgaagaaauccccgcaccccuaggcacaccagacuucgucggaaaaauccaaggcguucucacccaaaccacccgccgcgacggcagcacccgaggccacaaagccacugucucuacaggcuccauccacuucaccccaaaacucggauccguacaauucuccaccgacaccuccaacgacuucgaaaccggccaaaacacaagauucacccccguaggcgucguacaagacggcagcacaacccaccaaaacgaaccccaacaguggguccuaccagacuacuccggucgagauucccacaacguccaccuugcccccgccguagccccaacauuccccggagaacagcuccuauucuuccgcucaaccaugcccggcugcucuggcuaccccaacaugaaccucgacugccuccucccacaggaauggguccaacacuucuaccaagaaucugcacccgcacaauccgacgucgcacuccuccgcuucguaaaccccgacaccggccgcguacucuucgaaugcaaacuccacaaauccggcuaugucacagucgcgcacaccggccaacaugaccuuguaauacccccaaacggauacuuccgcuuugacuccuggguaaaccaguucuacacccucgccccuauggguaacggagccggcagacgacgcgcccucuaa

SEQ ID NO: 37127 - RNA, 1620 nt, Artificial Sequence
  derived and/or modified sequence opt11 from capsid_protein__Norovirus__BAF95499
augaaaauggccuccaacgacgccaacccguccgacggauccaccgccaaccucgucccagaagucaacaacgaagucauggcacuagaacccgucguuggcgccgcaaucgccgcccccgucgccggccagcaaaacgucaucgaccccuggauacgaaacaacuucguacaagcacccgguggagaguucacagucucaccccgaaacgcccccggagaaauccuaugguccgcccccuuaggccccgaccugaacccauaccucucacaccucgcccguauguacaacgguuaugccgguggauucgaaguccaagucaucuuagcuggcaacgcuuucacugcaggcaaaaucauuuucgccgccgucccacccaacuuccccaccgaaggacucucacccucacaagucaccauguucccccacaucaucgucgacguacgccaacucgaaccgguacucaucccccuccccgacgucagaaacaacuucuaccacuacaaccaauccaacgacucaaccauaaaacucauagcaaugcucuacaccccacuacgcgccaacaacgccggagacgacgucuucacagucagcugccgcguccucacccgccccucuccagacuucgacuucaucuuccucguacccccuacaguagaaucucguacaaaaccuuucacaguccccauccuaaccgucgaagaaauguccaacucacguuucccagucccccucgaaaaacuuuacacaggacccucauccgccuucgucguccagccacaaaacggccggugcaccacagacggcguccuacuuggcacaacccaacuuucagcaguaaauaucugcacauuucgcggcgacguaacccacaucgccggcucccacgacuacaccaugaaccucgccucccaaaauuggaacaacuaugauccaaccgaagaaauccccgccccucucggcacacccgacuucgucggcaaaauccaaggcgucuuaacccaaaccacccgcgaagacgguucuacccgcgcccauaaggccaccgucucuacaggcagcguucacuucacccccaaacucggcuccguacaauacaccaccgacaccaacaacgacuuccaaaccggacagaacaccaaauucaccccagucggagucauccaagacggcucaaaccaccaaaacgaaccacaacaauggguccuacccaacuacuccggccggacagggcauaacguucaccuagccccagcgguugcccccaccuuccccggugaacaacuccucuucuuccgauccacaaugcccggcugcucaggauaccccaacaugaaccuagacugccuacucccccaggaauggguccaacacuucuaccaagaagcagccccagcccaauccgacguggcacuccuccgcuucguaaacccagacaccggucguguccucuucgaaugcaaacuccacaaaagcggauacgucaccgucgcccacaccggcccacacgaccuggucauacccccaaacggcuacuuccgauuugacuccuggguuaaccaauucuacacacucgcccccauggguaacggagccggccgccgccgcgcccucuag

SEQ ID NO: 37128 - RNA, 1620 nt, Artificial Sequence
  derived and/or modified sequence opt11 from capsid_protein__Norovirus__BAF95501
augaaaauggccuccaaugacgucaaccccuccgauggauccgccgccaaccuaguaccagaaguuaacaacgaaguaauggcacucgaaccagucgucggagcagcaaucgccgcaccuguagccggccaacaaaacauaaucgaccccuggauacgcaacaauuucguucaagcucccggcggcgaguucaccgucuccccucguaacgcacccggcgaaauccuauggucggcaccccuaggccccgaucucaacccuuaccuaucacaccuauccagaauguacaacggcuacgccggcggcuucgaaguacaagucauacuagcuggcaacgccuucacagccggcaaggucaucuuugccgcagucccacccaacuuccccaccgagggccuaucucccucucaagucacuauguucccccacaucaucguugacguccgccaacucgaaccgguccuaauaccccuacccgacguccgaaacaauuuuuaccacuacaaccaagcccacgauuccacccucaaacuuauagccaugcucuacacaccccuacgcgccaacaacgcaggcgacgaugucuuuaccgucucuugccgcguccuaacaagacccucccccgauuucgacuucaucuuucuagucccacccaccgucgaaucccggaccaaacccuucaccguccccguccucacagucgaagaaaugaccaacucacgcuuucccaucccccucgagaaacuuuacacaggccccucauccgcauucgucguccaaccacaaaacggccgaugcaccacagacggcguccuccuuggcacaacccaacucucagccguaaacaucugcaccuuuagaggggaugucacucacauagccggcucccguaacuauacaaugaaccucgccucccaaaacuggaacaacuacgaucccaccgaagaaauacccgcaccccucggcaccccugacuucgucggcaaaauccaaggccuccuuacucagaccacccgagccgacggcuccacccgagcacacaaagcaacgguauccaccggauccguccacuucacccccaaacugggauccguccaauucuccaccgacaccgacaacgacuuccaacccggccaaaacacaaaauucacccccgucggcgucauccaagacggcgaccgacaccaaaaugaaccccaacaauggguccuacccgacuacucuggacgaaccggccacaacguacaucucgcccccgcagucgcucccaccuucccaggagaacaacucuuauucuuccgcucaacaaugccugguugcuccggcuaccccaacaugaacuuagauugccuccugccccaagaaugggugcuccauuucuaccaagaauccgcccccgcccaauccgacgucgcccuacuuagauucgucaaccccgauacaaaccgcguucucuucgaaugcaaacuacacaaauccggcuacaucacagucgcccacacaggucaacacgaucucauccucccacccaacggcuacuuccgauucgauuccugggucaaccaauucuacacacucgcccccaugggcaacggagcaggccgccgucgggcccccuaa

SEQ ID NO: 37129 - RNA, 1623 nt, Artificial Sequence
  derived and/or modified sequence opt11 from capsid_protein__Norovirus__BAF95503
augaaaauggccuccaacgacgccaacccaagcgacggaucaaccgccaaccucguucccgaagucaacaacgaaguaauggcacucgaacccguagucggagccgccauagcagcccccguagccggacaacaaaaugucauugauccauggauccgcaacaacuucguccaagcaccuggaggggaauuuacaguauccccacgcaacgcccccggcgaaauccucuggucagccccacucggcccagaccugaacccauaccucucacaccuugcacgcauguacaacggcuacgccggaggcuucgaaguccaaguaauacucgccggcaacgccuucaccgcaggcaagaucaucuucgcugccguacccccaaacuuccccacugaaggccucucccccagccaagucaccauguucccccacauuauagucgacguccgacaacucgaaccaguccuaauaccccuccccgacguccgcaacaacuucuaccacuacaaccaaucuaacgaccccaccauaaaacuaauagccaugcuauacacaccacuacgcgccaacaacgccggcgaagacgucuucacugucucaugccgcguccuaacacgcccaagcccagacuucgacuucauauuccucgugcccccaaccgucgaaucccgcaccaaacccuucacuguccccauauuaaccgucgaagaaaugacaaacucccgauuccccaucccccuggaaaaacuauucacuggacccucgggcgccuucgucguacaaccccaaaacggccgcugcaccacagacgguguacuccuaggcaccacccaacuuucccccguaaacaucuguacuuuccgcggcgacgucacccacaucgccggcacccacaacuacaccaugaaccucgcgagccaaaacuggaacaacuacgacccaaccgaagaaaucccugccccacucgggaccccggacuucguuggucgcauccaaggaaugcuaacccagaccacaaaaggcgacggcucaacacgcggacacaaggccaccguaucaaccggcgacguacacuuuaccccgaaacucgguucaauacaauucaacaccgacacaaauaacgacuucgaaaccggccaaaacacaaaauucacccccguaggugucguccaagacggcaacgguacgcaccaaaacgaaccccaacaauggguccuccccucauacagcggccgcacuggacacaacguccaccuagcccccgccgucgcacccacauucccgggagaacaacuccucuucuuccgauccaccaugccaggcugcuccggauaccccaacaugaaccuagacugccuccucccacaagaauggguccaacauuucuaccaagaagcagccccugcccaaucagacgucgcccuacuccgauucgucaaccccgacaccggcagaguccucuucgaauguaagcuccacaaaucuggcuacguuacugucgcacacacaggccaacacgaccuagucaucccacccaacggcuacuuccgauucgacucuuggguaaaccaauucuacacacucgcccccaugggcaacggaacaggaagacgccgugcccucuga

SEQ ID NO: 37130 - RNA, 1623 nt, Artificial Sequence
  derived and/or modified sequence opt11 from capsid_protein__Norovirus__BAF95505
augaaaauggccagcaacgacgccaacccuagcgacggauccaccgccaaccuaguccccgaagucaacaacgaaguaauggcccuggaacccguugucggcgcagccaucgcagcacccguagcaggacaacaaaacguuaucgaccccuggauacgaaacaacuucguacaagccccagguggagaauuuaccguaucaccacgcaacgcccccggagaaauacuaugguccgcaccccuaggcccugaccucaaccccuaccucucacaccucgcacgcauguacaacggauacgcaggcggauucgaaguccagguuauccuagccggaaacgcguucacugcaggcaaaaucaucuucgcagccguacccccaaacuucccaacagaaggacucucgccaucccaagugacaauguucccacacaucauaguugacguccgacaacucgaacccguucuaaucccccuccccgacguccgcaacaacuucuaccacuacaaccaguccaacgaccccaccaucaaacucaucgccauguuauacacaccccucagagccaacaacgccggagaagacguauucaccgucuccugccgcguccucacacgccccuccccagacuucgacuucauauuucuuguacccccaaccgucgagagccgcaccaaacccuucaccguccccguccucacagucgaagaaaugacaaacucuagauucccaaucccccucgaaaaacuauucaccggccccuccggcgccuucguaguccaaccccaaaauggacgcugcacaaccgacggaguccuccucgguaccacacaacuuucccccgucaacaucugcaccuuccgaggagacgucacccacauagccggaacucacaauuacacaaugaaucuagccagccagaacuggaacaacuacgaccccaccgaagaaauccccgccccacuaggcaccccugacuucgucggcagaauacaagggaugcugacccaaaccacaaaaggcgacgguucaacccgcggacacaaagcaacggucucuacaggcgacguacacuucacccccaaacucgguucaauccaauucaacaccgacacuaacaacgacuucgaaacaggccaaaacaccaaauuuacucccgucggaguuguccaagacgguaacgguacccaccaaaaugaaccccaacaguggguucuuccauccuacucaggccgcaccggccacaacguacaccuagcccccgcugucgcccccaccuucccaggagagcaauuacucuucuuccgcucaacgaugccaggaugcuccggcuacccuaacaugaaccucgacugccuccuaccacaagaauggguccaacacuucuaucaagaagccgcacccgcccaauccgacgucgcccuccuacgauuuguuaacccagacacaggccgcguccucuucgaaugcaaacuccacaaauccggauacgucacagucgcccacacaggccaacacgaccuagucauucccccaaacggcuacuuccgcuucgacuccugggucaaccaauucuacaccuuagcccccaugggcaacggcacuggccgacgacgcgcccucuaa

SEQ ID NO: 37131 - RNA, 1623 nt, Artificial Sequence
  derived and/or modified sequence opt11 from capsid_protein__Norovirus__BAF95507
augaaaauggccuccaacgaugccucacccucggacggcuccacagcaaaccucguccccgaaguuaacaacgaaguaauggcccucgaacccgucguaggcgcagccaucgccgccccagucgccggccagcaaaacguaaucgaccccuggauacgaaacaacuucguccaagcacccggaggcgaguucaccguaagcccccgcaacgcccccggugaaauacuaugguccgccccacucggcccugaccuaaaucccuaccucucccaccucgcaagaauguacaacgguuacgccggaggcuucgaaguccaaguaauccuagcuggcaacgcauucaccgcaggcaaaaucauauucgccgccguacccccaaacuucccuaccgaaggcuuaucccccucccaagucaccauguucccacacauaaucgucgacguccgccaacucgaaccgguccucaucccccuacccgacguccgaaauaacuucuaccauuacaaccaauccaacgacucaaccaucaaacucauagccaugcucuacaccccacuccgugccaauaaugccggcgacgacguauucaccguaucaugucggguccucacccgaccaagcccagacuucgacuucauauuccuaguuccucccaccgucgaaucccgcaccaaacccuucacuguccccauccucacgguagaagaaaugaccaacucacgguuccccaucccacucgaaaaacuuuucacaggucccagcuccgccuucgucguacaaccccaaaacggccgauguacgacugacggcguacuacuaggcaccacccaacucagccccgucaauaucugcaccuuccgcggcgacguaacacacauccccggaacacgaaccuaccgcaugaaccuagcgucccaaaacuggaacaacuacgaccccaccgaggaaauccccgccccacucggaacccccgacuucguuggaaaaauccaaggcaugcuuacacaaacaaccaaaggcgacggcuccacacgaggccauaaagcaacugucuccacaggcuccguagacuucaccccuaaacucggcucaguccaauucgcuaccgacaccgauaacgacuucgaaaccggacaaaacacacgcuucaccccaguaggggucauacaagacggcuccuccgcccaccgcaacgaaccccaacaauggguccucccagauuacuccggacgcaccguacauaacguccaccucgcccccgcaguagcaccaacguuccccggcgaacaacuacucuucuuccgaucaaccaugccugggugcucaggcuacccuaacauggaccucgacugccuacucccucaggaauggguccaacacuuuuaucaagaagccgcaccaucacaaucagacgucgcccugcucagauucgucaaccccgauacaggccgaguucucuucgaaugcaaacuacacaaagcaggcuacgucaccguagcccacacaggacaacacgaccuagucaucccucccaacggcuacuuccgcuucgacuccugggucaaccaauucuacacccucgcacccaugggaaacggcgccggccgccgacgagcccucuaa

SEQ ID NO: 37132 - RNA, 1623 nt, Artificial Sequence
  derived and/or modified sequence opt11 from capsid_protein__Norovirus__BAF95509
augaaaauggcauccaacgacgccaccccauccgacggcagcaccgccaaccuagugcccgaaguaaacaacgaagucauggcauuagagcccguaguaggcgccgcaauagccgcaccuguagcaggacaacaaaacguaaucgacccauggauacgaaacaacuucguacaagcccccggaggagaguucaccgucucuccccgcaacgccccaggcgaaauacuaugguccgcgccccuaggacccgaccuaaacccguaccuaucacacuuagcccgcauguacaaugguuacgccgguggauucgaaguccaaguaauacucgccggaaacgcauucaccgccggcaaaaucauauucgccgccgucccaccaaacuucccaacagaaggccuguccccaucacaaguaaccauguucccccacaucaucgucgacguacgacaacucgaaccaguccuaauaccgcuccccgacguccgcaacaacuucuaccacuacaaccaauccaacgaccccaccaucaaacucauagccaugcucuacacuccccuacgagcaaacaacgcaggagacgacguauucacgguauccuguagaguccuaacccgacccucgcccgauuucgacuucaucuuccugguuccacccacagucgaaucccgaaccaaacccuucucaguucccauccucacggucgaagaaaugacuaacucaagguuccccaucccgcucgaaaaacucuucacaggccccucuucagcauucgucguucaaccccaaaauggcagaugcaccaccgauggcguccuccuuggaacuacccaacucucccccgucaacaucugcaccuuccgaggcgacgucacccacauagccggcacccagaacuacacuaugaaccuagccucccaaaacuggaacaacuaugacccaacagaagaaauucccgcaccccucggcacacccgacuucgucgguaagauacaaggcguccucacacaaaccacccgcggcgacggcucaacacguggacacaaagccaccgucagcacuggcuccguccacuucacacccaaacuagguucuguacaauucuccaccgacaccuccaacgacuucgaaaccggccaaaacacacgcuucacccccguuggcgucguccaagacggcuccacaacccaccaaaaugaaccacaacaauggguccuacccaacuacuccggccgugacucucacaauguccaccucgcccccgccguugcccccacuuucccaggcgaacaacuccuauuuuuccgcuccaccaugccuggcugcucgggcuaccccaacaugaaccuugacugucuacucccacaagaauggguccaacacuucuaccaagaauccgccccagcacaauccgacgucgcccuacugcgcuucguaaacccagacacaggacgcguacucuucgaaugcaaacuccacaaaucaggguacgucacuguugcacacaccggccaacacgaccucguaaucccacccaacggcuacuuccgcuuugacucauggguuaaccaauucuauacccucgcccccaugggcaacggagcaggacgaagacgcgcacuauaa

SEQ ID NO: 37133 - RNA, 1623 nt, Artificial Sequence
  derived and/or modified sequence opt11 from capsid_protein__Norovirus__BAF95511
augaaaauggccucaaacgacgccacccccucagacggcucuaccgccaaccucguaccagaaguaaacaacgaagucauggcacuagaacccgucgugggcgccgccauagccgcccccguagcaggccaacaaaacguaaucgacccguggauaagaaauaacuucguccaggccccgggcggagaauuuaccgucucaccacgcaacgcccccggcgaaauacuaugguccgcaccacucggccccgaccucaaccccuaccucagccaccuagcccgaauguacaacggcuacgccggcggcuucgaaguacaagucauccuugcuggcaacgcauucacugcaggcaaaaucauauucgcggccguacccccgaacuuccccacagaaggacuaucaccaucccaaguaacaauguucccccacauaauagucgauguccgacagcuggaacccguacuaauaccccucccagacgucagaaacaacuucuaccacuacaaccaaucaaacgacccaacaaucaaacuaauagccaugcuauacacuccccuccgagccaacaacgccggcgacgacguauucaccgucagcugucgcguacucaccagacccucccccgacuucgacuucaucuuccucguaccacccaccgucgaaucccgcacaaaaccguucuccguaccaauccucacagucgaagaaaugacuaacucccgauuccccauaccccucgaaaaacucuucaccggacccucauccgccuucguuguccaaccacaaaacggccgcugcacaacagacggcguccuacuaggcaccacccaacuauccccaguaaacaucuguaccuuccgaggcgacgucacacacaucgccggcacacagaacuauaccaugaaucucgccucccaaaacuggaacaacuacgacccaaccgaagaaauacccgcaccacuaggcacccccgacuuugucggaaaaauacaagggguacucacccaaaccacccgccgcgacggaagcacccgcggacacaaagccaccgucucgaccggauccguccacuucacccccaagcucggcucaguacaauucucaacagacaccuccaacgacuucgaaaccggccaaaacacacguuucacacccgucggcguaguccaagauggcuccaccacucaccaaaaugaaccacaacagugggugcuccccaacuauagcggccgcgacucucauaacguccaccucgcccccgccguugccccaaccuuccccggcgaacaacuccucuucuuucgcuccaccaugcccggaugcaguggcuauccaaauaugaaccuugacugccuccuuccacaagaauggguucaacacuucuaccaagaaucugcccccgcacaauccgacguagcacuucuccgcuucgucaacccagacaccggccgaguacucuucgaaugcaaacuccacaaaucgggcuacguuaccgucgcacacacaggccaacacgaccucguaaucccacccaacggcuacuuccgauucgacuccugggucaaccaauucuauacccuagccccgaugggaaacggugccggccgacgacgcgcccuauaa

SEQ ID NO: 37134 - RNA, 1623 nt, Artificial Sequence
  derived and/or modified sequence opt11 from capsid_protein__Norovirus__BAF95513
augaaaauggccuccaacgacgccacgccauccgacggaucaaccgcaaaccuaguaccugaaguaaacaacgaaguaauggcccucgaaccagucgucggagccgcaaucgccgcccccguagcaggccaacaaaacgucaucgacccauggauccguaacaacuucguacaagcacccggaggcgaguucaccguaucaccccgcaacgcccccggagaaauccucugguccgcaccccucggcccugaccuuaacccauaccuaucccaccuagcccgaauguacaacggcuacgccggcggcuucgaaguccaagucauccucgcuggcaacgcauuuaccgccggcaaaaucaucuuugccgcaguaccacccaauuucccaaccgaagggcucucccccucccaagucacgauguucccacacauaauagucgacguccgccaacucgaaccagugcucaucccucucccugauguaaggaacaacuucuaccacuacaaccaauccaacgacuccaccauaaaacuaauugccaugcuauacaccccucuacgcgccaacaaugccggcgacgacgucuucacagucucaugccgagugcucacacgcccaucccccgacuucgacuucaucuuucuugucccaccaaccguggaaucacgcacaaaaccuuucucaguccccaucuuaaccguagaggaaaugacaaacucacgcuuccccaucccacucgaaaaacuuuucacaggaccaagcucagccuucgucguucaaccccaaaacggucgcugcaccacugacggaguccuccuaggcacaacccaacucuccccaguaaacaucugcaccuuuagaggagacgucacacacaucgccggcacccaaaacuacaccaugaaccucgccucacagaacuggaacaacuaugaccccaccgaagaaaucccagcuccucugggcacccccgauuucguaggcaaaauccaaggaguacuuacacaaacaacaagaagggacggauccaccagaggccacaaagcaacaguaucaaccggauccguccacuuuacccccaaacucggcucuguucaauucuccaccgacaccuccaacgauuucgagaccggccaaaacacacgcuucacccccgugggcguaguccaagacggaaguacaacacaucaaaacgaaccccaacaauggguccuaccgaacuacucaggccgcgacagccacaacguacaccucgccccugccgucgcccccaccuuccccggagaacaacuccuauucuuccgcuccacuaugcccggcugcuccggcuaccccaacaugaaccuagacugccuacucccucaagaauggguacaacacuucuaccaagaauccgcccccgcacaauccgacgucgcccuccuccgauucgucaacccugacaccggccgcguccucuucgaaugcaaacuccacaaauccgguuacgucaccgucgcccacaccggacaacacgaccucguaaucccacccaacggauacuuccgcuucgacuccugggucaaccaauucuacacacuagcccccaugggcaauggcgccggccgacgccgagcccuauaa

SEQ ID NO: 37135 - RNA, 1623 nt, Artificial Sequence
  derived and/or modified sequence opt11 from capsid_protein__Norovirus__BAF95515
augaaaauggccuccaaugacgccagcccuuccgacgguucaacagcaaaccuuguucccgaaguuaacaacgaaguaauggcccucgaaccagucgucggugccgcaaucgccgcaccaguugccggccagcaaaacgucaucgaccccuggauaagaaacaacuucguacaagcccccggaggcgaguucacuguaucaccccgaaacgccccaggggaaauccuaugguccgcaccccucggccccgaccucaaccccuaucuaucccaucucgcccguauguauaacggauacgccggcggauucgaaguccaagucauccuugccggaaacgccuucaccgccggaaaaaucaucuucgcagccgucccgcccaacuuccccacagaaggccucucccccucacaaguaacaauguucccccacaucauaguagacgucagacaacuagaacccguacuaaucccacucccagacguccgcaacaacuucuaccacuacaaccaaaguaacgauuccacaaucaaacuaaucgcaaugcuuuacaccccacuccgagccaacaacgcaggagacgacgucuucaccgucucaugccgcgucuuaaccagacccucccccgacuucgacuucaucuuccuaguacccccaacagucgaaucccgaacaaaaccuuucaccguccccauccuaacggucgaagaaaugaccaacucccgauucccaauuccccucgaaaaacuauuuaccggacccuccuccgccuucgucguccaaccacaaaacggacgaugcacaacugacggcguccuacuaggaaccacccaacuaucccccgucaauaucugcacguuccgcggcgacguaacccacauacccggcacccguaccuaccgcaugaaccuagccucacaaaauuggaacaacuacgaccccaccgaagaaauacccgcaccccucgguaccccagacuucgucggaaaaauccaaggcaugcucacccaaaccaccaaaggcgacggauccacaagaggacacaaagccaccguauccaccggauccgucgacuucaccccaaaacuaggcuccguacaauucgccacagacaccgacaacgacuucgaaaccggacaaaauacacguuucacccccguaggcgucauccaggacgguuccagcacacacagaaacgaaccacaacaauggguacuacccgacuacucagguagaaccguccacaacgugcaccuagcccccgccgucgcccccaccuuccccggcgaacaacuacuauucuuccgauccaccaugcccggaugcuccggauaccccaacauggaccucgauugccuacucccgcaagaauggguccaacacuucuaccaagaagccgcacccucacaauccgacguagcccuucuacgauucgucaaccccgacacaggccgcguccucuucgaaugcaaacuacacaaagccggauacgucacagucgcacacacaggacaacacgaccuuguaauacccccaaacggauacuuccgcuucgacucaugggucaaccaguucuacacacucgcacccaugggcaacggagccggacgccgccgagcucuauaa

SEQ ID NO: 37136 - RNA, 1623 nt, Artificial Sequence
  derived and/or modified sequence opt11 from capsid_protein__Norovirus__BAF95517
augaaaauggcauccaacgacgccucccccuccgacggcuccgccgcgaaccucguccccgaagucaacaacgaagucauggcauuagaaccugucguaggcgccgcaaucgccgcaccaguagcaggccaacaaaacgucauagacccuuggauccgcaacaacuucguccaagcgccuggaggcgaguucacagucucaccccgaaaugccccaggcgaaauccuauggucagcaccacuaggccccgaccucaaccccuaccucucccacuuagcacggauguacaacggauacgccggcggcuucgaaguccaaguaauacucgccggcaacgccuucacagccggcaaaaucauauucgccgccgucccucccaacuuccccacagaaggccuaucacccucccaagucaccauguucccccacaucauaguagacguccgccagcuagaacccgucuuaauaccccucccugauguccgaaacaacuucuaccacuauaaccaauccaaugacuccaccaucaaacuaaucgcaauguuauacacaccccuacgcgcaaacaaugccggugaugacguauuuacggucucaugcagaguccucacccgcccaagccccgacuucgacuucaucuuccucguacccccaaccgucgaaucccgcacaaaacccuucacaguccccauccuaaccgucgaagaaaugaccaacucgcgauuccccaucccacuagaaaaacuauucaccggccccucauccgcauucgucguacaaccccagaacggacgaugcacaaccgacggcguucuccucggaacaacucaacuaagcccugucaacaucugcaccuuccgcggcgacgucacccacaucuccggcaccagaaccuaucgaaugaaccucgcaucccaaaacuggaacaacuacgacccaaccgaagaaauccccgcaccacucggcaccccagacuucguaggcaaaauccaaggaaugcucacccagaccacaaaaggcgacgggucuacucgcggccacaaagccaccgucagcaccgguuccgucgacuucacucccaaacucggcuccguccaauucgcaaccgacacagacaacgacuuugaaaccggccaaaacacccgcuucaccccuguuggcguaauccaagacgguucauccgcccaccgcaacgagccucaacaauggguucuccccgacuacagcggccgcacaguacacaauguccaccucgccccugcagucgcccccacuuuucccggagaacagcuccucuucuuccgaucaacaaugcccggaugcuccggauaccccaacauggaucuagacugccuccuaccucaagaauggguccaacacuucuaccaagaagccgcccccucccaaucagacguugcacuacuccgauucguuaacccagacaccggccgcguccucuucgaaugcaaacuccacaaagcuggauacgucaccgucgcccacaccggucagcacgaucucgucaucccacccaacggcuacuuccgcuuugacucuugggucaaccaauucuacacccucgcccccauggguaacggcgccggccguagacgagcacuauaa

SEQ ID NO: 37137 - RNA, 1623 nt, Artificial Sequence
  derived and/or modified sequence opt11 from capsid_protein__Norovirus__BAF95519
augaaaauggccuccaacgacgccacuccauccgacggcucaaccgccaaccucguccccgaagucaacaacgaagucauggcccucgaacccguagucggcgcugccauugcagcaccugucgcaggacaacagaacguuaucgaccccuggauacggaacaacuucguucaagcccccggcggcgaauuuacagucuccccacgcaacgcccccggcgaaauccucuggucugcaccacucggucccgaccucaacccauaucuaucccaccuagccagaauguacaacggcuacgccggcggcuucgaaguccaaguaauccucgcaggcaacgcguucaccgcuggaaaaaucaucuucgccgcaguaccucccaacuuccccaccgaaggacuaagccccucccaagucaccauguucccacacaucauuguugacguucgucaacucgaaccuguccucauaccccuacccgacguaagaaacaacuucuaccacuacaaccaauccaacgacuccaccaucaaacucauagcaaugcuauacaccccacuccgugcaaacaaugcuggcgacgacguguucacagucuccugccgaguccucaccagacccucccccgacuucgacuuuaucuuccucgucccuccuacugucgaaucccgaacuaaacccuucucuguaccaauccucaccguggaagaaaugacuaacucccgcuuccccaucccccucgaaaaacuauucaccggcccuuccucggccuucgucguacaaccccaaaacggacgcugcaccacagauggcguccuuuuaggcaccacccaacuaagcccugucaacaucugcaccuuccgcggcgauguaacacacaucgcugguacccaaaacuacaccaugaaccucgccucacaaaacuggaacaacuacgacccaaccgaagaaauacccgccccacucggcacccccgacuucgucggaaaaauccaaggcguacuaacucaaacaacaacccgcgacggcagcacccgcggccacaaagccaccguaucaaccggcuccguccacuucacucccaaacuaggaucaguccaauucuccaccgacaccagcaacgacuucgaaaccggccaaaauacccgcuucaccccagucggaguaguacaagacggcuccaccacccaccaaaacgaaccccaacaauggguccucccugacuauucaggucgagacucucacaauguccaccuagcacccgcagucgcacccaccuuccccggagaacaacuucucuuuuucagguccaccaugccaggcugcucuggcuaccccaacaugaaccucgacugccuacucccccaagaauggguccaacacuucuaccaagaauccgcacccgcccaaucugacgucgcccuccuccgauucguaaaccccgacaccggccgcguucucuucgaaugcaaacuccacaaaucaggcuauguaacugucgcucacaccggccaacaugaccucguaauaccaccaaauggcuacuuccgcuucgacuccuggguaaaccaauucuacacacuggcccccauggguaacggcgccggccgacgccgugcauuauaa

SEQ ID NO: 37138 - RNA, 1623 nt, Artificial Sequence
  derived and/or modified sequence opt11 from capsid_protein__Norovirus__BAF95521
augaaaauggccuccucggacgccaacccaagcgacggcucaacagcaaaccucguccccgaaguuaacaaugaaguuauggcauuagaacccgucgucggcgccgccaucgccgccccugucgccggacagcaaaacguaaucgaccccuggauccgcaacaacuucguccaggccccgggcggcgaguucaccguauccccacggaacgcaccaggagaaauacuauggucugcuccccucgguccugaccucaacccuuaccucucccaccucgcccgcauguacaacucauacgccggcggcuuugaaguccaagucauacuagcggguaacgcuuucacagccggcaaaaucaucuucgcagccguacccccaaacuuccccacggaaggccugucccccucucaagucaccauguucccccauaucaucgucgacguuagacaacucgaaccaguccucaucccacugcccgacguccgcaacaacuucuaucauuacaaccaauccaacgacccuaccauaaaacuaaucgccaugcucuacaccccacuccgagcuaacaacgccggggacgacguauucaccgucuccugccgcguccuaacccgaccaagccccgacuucgacuucauauuccuaguuccacccacugucgagagccgcacaaaacccuucucuguccccauacucaccguagaagaaaugaccaacucacguuuccccaucccccuugaaaaacucuucacaggaccaucauccgccuucguuguccaaccacaaaacggacgcugcacaaccgacggcguccuacucggcaccacccaacuuuccccaguaaacauauguacauuccgaggcgacguaacccauauagcuggcacccaagaguacaccaugaaccucgccagccaaaauuggaacaacuacgaucccaccgaggaaauaccagccccacucggcacaccggacuucgucggaaaaauccaaggcguccucacccaaaccacccgccgagacggcuccacccgcggccacaaagccacagucucaaccggcucaguccacuucaccccuaaacucggucgaauccaguucuccaccgauaccucuaacgacuucgagaccggccaaaacacucgauucacaccaguaggcgucguacaagacggaggcaccacccaccaaaaugaaccccaacaauggguccuaccuaacuacuccggacgcgacagccacaacguccaccuagcccccgcagucgcgcccuccuucccuggggaacaacuccuauucuuccgcuccaccaugcccggcugcuccggauauccaaacaugaaucucgacugccuccucccacaagaguggguccaacacuucuaccaagaagccgccccagcgcaaucagacguagcucuccuuagauucguaaaccccgacacaggccgcguacuauucgaaugcaaauuacacaaauccggauacgucaccguagcccacacaggccaacacgaccugguaauucccccaaacggauacuuccgcuucgacagcugggucaaccaauucuacacccuagccccaaugggcaacggcacuggccggcgacgagcccuuuaa

SEQ ID NO: 37139 - RNA, 1623 nt, Artificial Sequence
  derived and/or modified sequence opt11 from capsid_protein__Norovirus__BAF95523
augaaaauggcaucauccgacgccaaccccucagacggcuccacugccaaccuaguaccagaaguaaacaacgagguaauggcccucgaacccgucguaggcgcugcaaucgcagcccccguggcaggccaacaaaacgugaucgaccccuggauacgcaacaacuucguucaagccccaggaggagaguucaccguauccccacgcaacgccccaggcgaaauacucuggucugcuccccucggccccgaucucaacccuuaccucucacaccuugcccgcauguacaauuccuacgccggcggcuucgaaguccaaguaauccucgccggcaacgccuucaccgccggcaaaaucaucuucgccgccgucccacccaacuuccccacugaaggccuaucccccucucaagucacaauguucccacacaucaucguggacguccgccaacucgaacccguacucauaccacuccccgacguccggaacaacuucuaucacuacaaccaaucgaacgaccccaccauaaaacucauagccaugcuauacacaccccuccgcgcaaacaaugccggcgaugacgucuuuaccguaagcugcagaguccugacccgaccaucuccagacuucgacuucaucuuccucguaccacccacagucgaaucacgaaccaaaccauucuccguccccauccuaacagucgaagaaaugaccaacuccagauuccccaucccccucgaaaaauuauucaccggacccuccuccgcauucgucguucaaccccaaaacggacgaugcaccaccgacggcguccuccucggcaccacccaacuaucccccgucaacauaugcacauuccgcggcgacguaacccacaucgcgggaacccaagaauacaccaugaaccucgccucacaaaacuggaacaauuacgacccaaccgaagaaauccccgcuccauuaggcacccccgacuucgucggcaaaauccaaggaguccucacccaaaccaccagacgcgacggcucaacacgcggacacaaagcuaccguauccacaggcuccguccacuucaccccaaaacuuggccgcauccaauucucaacagacaccucuaacgacuucgaaaccggccaaaacacacguuucaccccagugggcguaguccaagacggauccacaacucaucaaaacgaaccccaacaauggguacuccccaacuacuccggccgcgacucccacaacguacaccucgcaccagccguugcacccucauuccccggcgaacaacuccuauucuuccgcuccaccaugcccggcugcuccgguuauccaaacaugaaccucgacugccuccuaccccaagaauggguccaacacuucuaccaagaagccgcacccgcccaauccgacguagcccuccuccgauucguaaaccccgauacaggccgcguccucuucgaaugcaaacuccacaaaucagguuacgugacugucgcccacaccggccaacacgaccuagucauucccccaaauggcuacuuccgauuugacucaugggucaaccaguucuacacccucgcccccaugggcaacggcacuggccgccgccgcgcccucuaa

SEQ ID NO: 37140 - RNA, 1623 nt, Artificial Sequence
  derived and/or modified sequence opt11 from capsid_protein__Norovirus__BAF95525
augaaaauggccuccaacgacgccucacccuccgauggaucaacagccaaccucguucccgaaguaaacaacgaagucauggcacuagaacccguugucggcgccgcaaucgccgcccccguagccggccaacagaacgucauagaccccuggauccggaacaacuucguccaagcacccggcggcgaauuuaccguaucaccucgcaaugcccccggugaaauacuuuggagcgcaccccucggcccugaccuuaaccccuaccucagccaccuugcccgcauguacaacggcuacgcaggcgguuucgaaguacaaguaauccucgcuggcaacgcuuucacagccggaaaaaucauauucgccgcagucccgcccaacuuccccaccgaaggccuuucaccaucacaaguaaccauguucccccacaucaucgucgauguacgccaacucgaacccguacucauaccccucccggacguucgcaacaacuucuaccacuacaaccaaagcaacgauuccaccauaaaacucaucgcaaugcucuacacgccccuccgagccaacaacgccggcgacgacgucuucaccgucagcugcagaguccucacccgacccucaccugacuucgacuucaucuuccuaguaccacccaccgucgaauccagaaccaaacccuucaccgugcccauacuaaccgucgaagaaaugacgaacucacgauuccccaucccacucgaaaaacucuucaccggccccuccucagccuucgucguccaaccccaaaacggcagaugcaccaccgacgguguccuucucggcacaacccaacuaucccccguaaacaucugcacuuuccggggcgacgucacgcacauccccggcacccgaacauaucgcaugaaccucgcaucccaaaauuggaacaacuacgacccaaccgaagaaauaccagcaccccuaggaacacccgacuucgucgguaaaauacaaggaaugcucacccaaaccaccaaaggcgacggauccacccgcggccacaaagccaccgucucaaccggcucagucgacuucacccccaaacucggcuccguccaguucgccaccgacaccgacaacgacuucgaaacaggccaaaacacacgcuucacucccgucggagucauccaagacggauccuccacacaccguaacgaaccccaacaauggguccuccccgauuacuccggaagaacaguccacaacguccaccucgccccagccgucgcccccacuuuccccggcgaacaacuccuguucuuccguuccaccaugcccggcugcucuggauaccccaacauggaccuggacugccuccucccacaagaauggguccaacauuucuaucaagaagcagcccccucacaaucugacguagcccuccuacgcuuuguaaaccccgauaccggccgcguccucuucgaaugcaaacuccacaaagcaggcuacgucaccguugcacacacaggccaacacgaccuagucauucccccaaacggauacuuccgcuucgacuccugggucaaccaauucuacacccuagcccccauggggaacggagccggccgcaggcgagcccuauag

SEQ ID NO: 37141 - RNA, 1623 nt, Artificial Sequence
  derived and/or modified sequence opt11 from capsid_protein__Norovirus__BAF95527
augaaaauggccuccaacgacgcuucccccuccgacggauccacagcuaaccuagucccugaagucaacaacgaagucauggcccucgaacccgucgucggugccgccaucgccgcccccgucgccggccagcaaaacguaaucgacccauggauccgcaauaacuucguacaagccccaggcggcgaguucaccgucaguccacgaaacgcccccggcgaaauccucuggucagcuccccucggacccgaccucaaccccuaccuaucacaccuagcccgcauguacaacggcuacgccggcgguuucgacguccaaguuauacucgccggcaacgccuucaccgccgggaaaauaauauucgccgccgucccuccaaacuuccccacagaaggacucucccccucccaagucacaauguucccccacaucauaguagacguccgccagcuagaaccaguucucaucccccuacccgacguccguaacaacuucuaccacuacaaccaauccaacgacuccacaauaaaacuuaucgccaugcucuacacaccacuccgagcaaacaaugccggcgacgacgucuucaccgucuccugccguguccucacccgccccucaccagacuucgacuucauauuccuagucccacccaccgucgaaucucgaaccaaaccauucaccguccccauccuuaccgucgaagaaaugacuaacucccgcuucccaauuccccuagaaaaacucuucaccggccccucaucagccuucguaguccaaccccaaaacggcagaugcacaaccgacggcguacuacuaggcaccacccaacuaagcccagucaacaucugcacauuucgcggcgacguaacccacauacccggcacgcgcaccuaucguaugaaccucgcuucccaaaacuggaacaacuacgaucccacagaagaaaucccagcaccccucggcaccccagacuuugucggcaagauucaaggaaugcugacacaaacaaccaaaggcgacggcuccacccgcggacacaaggccaccgucuccaccggcucagucgacuucaccccaaaacuaggcucaguccaauucgccacagacaccgacaaugacuucgaaacaggacagaauacccguuucacuccuguaggagucauccaagacggguccucuacacaccgaaacgaaccccaacaauggguccuccccgacuacagcggccguaccguacacaacguccaccucgccccagcagucgcccccaccuucccaggcgaacaacuccucuucuuccgcuccacaaugcccggaugcucaggcuaccccaacauggaccucgacugccuccuaccacaagaauggguccaacauuucuaccaagaagccgcaccaucccaguccgacguugcccuccuacgcuucguuaacccagacaccggccgcguccucuucgaaugcaaacuccacaaagcaggauacgucaccgucgcccacaccggacaacacgaucucgucauucccccaaauggcuacuuccgcuucgacuccugggucaaccaauucuacacccuagccccuaugggaaacggcgccggacgaagacgagcccucuaa

SEQ ID NO: 37142 - RNA, 1623 nt, Artificial Sequence
  derived and/or modified sequence opt11 from capsid_protein__Norovirus__BAF95529
augaaaauggcaagcaacgacgccaaccccuccgacggcuccgccgccaaucucguacccgaagucaacaacgaagucauggcgcucgaacccgucgucggagccgccauugccgcccccguagccggccagcagaaugucaucgaccccuggaucagaaacaacuucguucaagcccccggcggcgaauuuaccgucagcccccgcaacgccccaggcgaaauccucugguccgcaccucucggucccgaccuuaacccauaccucucccaucuagcccgcauguacaacggcuacgccggcggauucgaaguccaagucauccucgcaggaaacgccuucaccgccggaaaaaucauauucgcugccgucccuccaaacuucccaaccgaaggccuaucacccucccaaguuaccauguucccccacauaaucgucgauguucgccaacucgaacccguccucaucccccuccccgauguccgcaacaacuucuaccacuacaaccagagcaaugacucaaccaucaaacucauagccaugcucuacaccccuuuacgagccaacaacgcaggcgaagaugucuucacuguauccugccgcguacucaccagaccauccccagacuucgacuucaucuuccucgucccucccacagucgaaucacgcacaaagcccuucacaguaccgauccuaaccguagaagaaaugaccaauucacgcuuccccaucccccuagaaaaacuauucaccggacccucaggagccuucgucguacaaccccaaaacggucgcugcacaaccgacggcguucuccucggcaccacacaacucucucccgucaacaucugcaccuuccgcggcgacguuacacauaucgccggcucccgaaauuacacaaugaaccucgccucccuaaacuggaacaacuacgaccccacagaagaaauccccgcaccacucggaacccccgacuucgucgguaaaauccaaggcaugcuaacccaaaccacaaaaggugacgguuccacccgcggccacaaagccaccgucuacacaggcucagccccauucacccccaaacucggcuccguccaauucucuacugauaccgaaaacgacuucgaaacacaccaaaacacaaaauucaccccagucggcguaauccaagacggcuccaccacccaccgcaacgaaccgcaacaauggguccucccuuccuacucaggcagaaacguccacaacguccaccucgcacccgcaguugcccccaccuuucccggagaacaacuacuauucuuccguuccaccaugcccggcugcucaggcuacccaaacauggaccucgauugccuccucccccaagaauggguacaacacuucuaccaagaagcugcucccgcacaaucagacguagcacuccuccgauucgucaaccccgacacuggacguguacucuucgaaugcaaacuacacaaauccggauacguaaccgucgcccacaccggccaacaugaccucgucaucccacccaacggcuacuuccgauucgacuccugggucaaccaauucuacacucuugcacccaugggcaauggcaccggccgccgccgcgcacuuuaa

SEQ ID NO: 37143 - RNA, 1623 nt, Artificial Sequence
  derived and/or modified sequence opt11 from capsid_protein__Norovirus__BAF95531
augaaaauggccucaaacgacgccaacccuucagacggcucagccgcaaaccuaguacccgaaguaaacaacgaagucauggcccucgaacccgucgucggcgccgcaaucgcagcaccagucgccggacagcagaacguaauagaccccuggauccgcaacaacuucguccaagcccccggcggagaauuuacugucucaccccgcaacgcacccggugaaauacuuugguccgcaccccuaggccccgaccucaacccauaccuuucccaccuagcccgaauguacaacggcuacgccggcggcuucgaaguccaaguaauacucgcgggaaacgccuucaccgcuggcaaaaucaucuucgccgccguaccacccaauuucccaaccgaaggccucuccccaucucaagucacaauguuuccccacaucauaguugacgucagacaacucgaaccaguucucaucccccuccccgacguccgaaauaacuucuaccacuacaaccaauccaacgacucaacaaucaaacuaaucgccaugcuauacacaccacuccgugccaacaacgccggcgaagacguauucaccgucuccugcagaguccucacccgccccuccccagacuucgacuucaucuuccucgucccacccaccgucgaaucgcguaccaagccuuucacaguacccauccuaaccgucgaagaaaugacaaacucccgcuuccccauaccacucgaaaaacuauucacuggcccauccggcgcguucgucguccaaccacaaaacggccgaugcacaacagacggcguccuccugggcaccacccaacuuucccccguuaacaucugcaccuuccgcggagacgucacacauaucgccggcuccagaaacuacacaaugaaccucgcaucgcucaacuggaacaacuaugaccccacagaagaaaucccugccccucucgguacccccgacuucguaggcaaaauccaaggcguccucacccaaaccacaaaaggcgacgguuccacaagaggccacaaagcaacagucuacacuggcuccgcuccauucaccccaaaacucggcuccguccaauucucaaccgacacagaaaacgacuucgaaacccaccaaaacacaaaauucaccccaguaggcguuauccaagacggcucaacaacccauagaaacgaaccccaacaaugggucuuacccuccuacuccggacgcaacguccacaacguccaccucgcccccgccgucgcacccacauucccaggcgaacaacuacuauucuuccgcuccacaaugcccggaugcucaggauacccaaacauggaucuagacugccuucucccccaagaauggguacaacacuucuaucaagaagcagccccagcccaauccgacgucgcccuccuacgauucguuaaccccgacaccggacguguccuauucgaaugcaaacuacauaaauccggguacgucaccgucgcccacacaggccaacacgaccucgucauaccucccaacgguuacuuccgauucgauuccuggguaaaccaauuuuacacacucgcaccaaugggaaacggcaccggccgacgccgcgcccucuaa

SEQ ID NO: 37144 - RNA, 1623 nt, Artificial Sequence
  derived and/or modified sequence opt11 from capsid_protein__Norovirus__BAG30923
augaaaauggccagcaacgacgccaacccauccgacggcuccaccgcuaaccucguccccgaagucaacaacgaaguaauggcacuagaaccaguaguaggcgccgccauagccgcccccguugccggacaacaaaacgucauagaccccuggaucagaaacaacuucguucaggcacccggaggcgaauuuaccgucucaccccgcaaugcccccggagaaauccucugguccgcaccccucggucccgaccucaaccccuaccuaucacaccuagcacguauguacaacggcuacgcaggcggauucgaaguacaaguaauccucgccggcaacgccuucacugccggcaaaauaaucuucgccgccguacccccaaacuucccaaccgaaggccuaucccccucccaagucacaauguucccccauaucaucgucgacguccgccaacuagaacccguccucauuccccuccccgacguccgcaacaacuucuaccacuacaaccaauccaacgaccccaccaucaaacuaaucgcaaugcucuacacaccccuccgugcaaacaacgccggagaugacgucuuuaccguaucaugccgcguccucacacgucccucccccgacuucgacuucaucuuccucgucccacccaccgucgaaucccgcacuaaaccauucaccguccccauccuaacuguagaagaaaugacaaacucacguuuccccaucccgcuggaacgccuuuacaccggcccaucauccgcuuucgucguacagccccaaaacggccguugcacaacagacggaguccuccucggaacaacccaacucuccgcagucaacaucugcaccuuucgaggcgacguaacccacaucgccggcucucgcaacuacaccaugaaccucgccucccaaaacuggaacaauuacgaccccaccgaagaaauccccgccccucucgguacacccgacuucgucggaaaaauccaaggcaugcuaacccaaaccacccgaucagacggcucaacccgcggccacaaagccaccguacucaccggaagcgccgauuuugcccccaaauuaggccgcgugcaauucgccaccgacacagacaaugacuucgaauccggucaaaacaccaaauucacacccguuggaguaauacaagacggcucaaccacucaccguaacgaaccacaacaauggguccucccuaauuacuccggccguaccggccacaacguacaucuugcgcccgccguugcaccaaccuauccaggcgaacaacuucuauucuuccgcucaaccaugccuggcugcuccggcuaccccaacauggaccuagacugccuccuaccccaagaauggguccaacacuucuaccaagaggcagccccagcacaaagcgacgucgcccuccuacgcuucguaaaccccgacaccggacgcguacucuucgaaugcaagcuacacaaauccggcuacgucacagucgcacacaccggacaacacgaccuugucaucccaccuaacggcuacuuccgauucgacucauggguuaaucaauucuacacccucgcacccaugggcaacggaacaggacgccggcgcgccguauaa

SEQ ID NO: 37145 - RNA, 1629 nt, Artificial Sequence
  derived and/or modified sequence opt11 from capsid_protein__Norovirus__BAG34630
augaagauggcaucuaacgaugccgcgcccuccacagacggcgccgccggccuuguacccgaaucaaacaacgaggugauggcccucgaaccagucgccggcgcagcccucgccgcccccgucaccggccaaacaaacauaauagaccccuggauacgugccaacuuuguccaggcccccaacggcgaauuuaccgucagcccucgcaacgcacccggagaaguacuacuaaaucuagaacuaggacccgaacuaaaccccuaccuagcgcaccuagcccgaauguacaacggcuacgcaggcggaauggaaguccaaguaaugcuugccggaaacgccuucaccgccggaaaacucgucuucgccgccguuccuccucacuucccagucgaaaaucuaagcccccaacaaaucaccauguucccucacguaaucaucgauguaagaacccucgaacccguccuccucccccucccagacgucaggaacaacuucuuccacuacaaccaaaaggacgaucccaaaaugcgaauaguagccaugcuuuacacacccuuacgcuccaacggcucaggcgacgacguuuucacagucuccugccgaguccucacccgucccagccccgacuucgacuucacauaccucguucccccaaccgucgaauccaaaacaaaacccuucacccuacccauacucacccucggcgaacucucaaacucccgcuucccuguauccauagaccaaauguacacaucccccaacgagguuauaucuguacaaugccaaaauggccgcugcacccuagacggagaacuccaaggcacuacccaacuccaagucuccggcauaugcgccuucaagggcgaagucaccgcccaccuacacgacaacgaccaccuuuacaacgucaccaucacaaaccucaacggcucacccuucgacccaucagaagacauccccgccccacuaggcguucccgauuuccaaggccgcguauucggcguaaucucacaacgcgacaaacaaaacgccgccggccacaacgaacccgccaaccgcggacacgacgcaguuguuccgaccuacacagcacaauacaccccaaaacuaggacaaauccaaaucggcacauggcaaaccgacgacuuaaccgucaaccaacccgucaaguucacgcccgugggccucaacgacaccgaacacuucaaccaaugggucguaccccgauacgcaggcgcacuaaacuuaaacaccaacuuagcucccuccguagcccccgucuuccccggcgaacgccuacucuuuuuccgcagcuacaucccccucaaaggcggcuacggcaaccccgcaauagacugccuacucccacaagaauggguucaacacuucuaccaagaagcagcucccuccauguccgaaguagcccucgugcgcuacaucaaccccgacacaggcagagcacucuucgaagccaaacugcaccgcgccggcuucaugacagucuccuccaacacaucugcuccagucguaguccccgcaaacggauacuuccgcuucgacuccuggguaaaccaauucuacagccuagcacccaugggaaccgguaacggccgcagacgcguucaauaa

SEQ ID NO: 37146 - RNA, 1629 nt, Artificial Sequence
  derived and/or modified sequence opt11 from capsid_protein__Norovirus__BAG34632
augaaaauggccucaaacgacgccgcaccaucaaccgacggcgcagccggccuagucccagaaucaaacaacgaagucauggcgcuagaacccgucgccggagccgcccucgccgccccaguaacaggccaaaccaacaucaucgacccauggauaagagccaauuucguccaagcacccaacggcgaguucaccgucagcccacgcaaugcccccggcgaaguacuucucaaccucgaacucggccccgaacucaaccccuauuuagcccaccucgcccgcauguauaacggauaugccggcgguauggaaguacaagucaugcucgccggcaacgccuucaccgcaggaaaacucgucuuugcagccguacccccacacuuccccgucgaaaaccuaucaccccaacagauaaccauguucccccacgucaucaucgacguacgcacccuagaacccguccuccucccucucccugacguccgaaacaacuucuuucacuacaaccaaaaagacgaccccaaaaugagaauaguugccaugcuuuacacaccccuccgcuccaacggcucaggcgacgacgucuucaccgucuccugccguguccuaacccgaccuucccccgacuucgacuucaccuaccucguaccacccacugucgaauccaaaaccaaacccuucacucuccccauacucacacuaggcgaacucucaaauucaagauuuccagucucaauagaucaaauguuuaccagccccaacgaagucaucucaguucaaugccaaaauggccgcugcacacucgacggagaacuccaaggaaccacccaacugcaaguuucaggcaucugcgucuucaaaggagaagucaccgcccaccuccacgauaacgaccaccuauacaacauaacaaucaccaaccuaaacggaucccccuucgacccauccgaagacguacccgcgccccucggaguccccgacuuccaaggccgcgucuucggcgucaucucccaacgcgacaaucacaacgccucaggccacaaccaacccgccaaccggggccacgacgcaguaguccccaccuacaccgcccaauacacaccaaaacucggccaaauacaaaucggaaccuggcaaacugacgaccuaacagucaaucaacccgucaaauucacacccgucggccugaaugacguagaacauuucaaccaaugggucgucccccgcuacgccggcgcccuaaaccucaacacuaaccuagcaccauccguugcacccgucuuccccggcgaacgccuccucuuuuuccgcucauaccuacccuuaaaaggcggcuacggaaaccccguaauagacugccuacucccacaagaauggguccagcacuucuaucaagaagccgcaccauccauguccgaaguugcccucguacgcuacaucaacccugacacaggacgagccuuauuugaagccaaacuccaccgcgccggcuucaugaccguauccagcaacaccucugcccccguagucguccccgccaauggcuacuuccgcuucgacucaugggucaaccaauucuacucacucgcucccauggggaccggaaacggccgacgccgcauccaauaa

SEQ ID NO: 37147 - RNA, 1629 nt, Artificial Sequence
  derived and/or modified sequence opt11 from capsid_protein__Norovirus__BAG34634
augaaaauggccuccaacgacgccgccccaucaacggacggcgccgccggacucguacccgaauccaauaacgaagucauggcccuagaaccaguagcuggagcagcacuagccgcccccguaacaggccaaaccaacaucauagaccccuggauccgugccaauuuuguacaagcccccaacggcgaauuuaccguaucaccacgaaacgcacccggcgaaguucuucucucacuggaacucggcccagaacucaacccguaccuagcccaccuagcacgcauguacaacggcuacgccggcggcauggaaguccaggucaugcucgcagguaacgcauucacagccggcaaacucgucuucgcugcgguacccccacacuuccccgucgaaaaccucucgccccaacaaauaaccauguucccccacgucauaaucgacguccgcacacuagaacccguacuccuaccgcuccccgauguccgaaacaacuucuuccacuauaaucaaaaagacgaccccaaaaugcgaauaguugccaugcucuacacuccacuccgcucaaacggaucaggcgacgacgucuucaccgucagcugccgaguacucacccgccccucccccgacuucgacuucaccuaucuuguucccccaacagucgaaagcaaaaccaaacccuucacccuacccauccuuacacucggagaacucuccaacucucgauuccccgucuccaucgaccagauguacaccucaccaaacgaagugaucuccguccaaugccaaaacggccgcugcacccucgacggagaacuacaaggcacaacacaacuacaaguauccggcaucugcgccuucaaaggcgaagucaccgcacaccuccacgacaacgaccaucucuacaaugucacaaucaccaaccuaaauggcucuccuuucgacccaagcgaagacauucccgccccacucggagucccugacuuccaaggccgcguauuuggcguuaucucacagcgcgacaaacacaacgcauccggccacaacgaacccgcaaaucgcggacacgacgccguuguacccacauacaccgcacaauacacacccaaacuaggccaaauccaaaucggaaccuggcaaacugaugaccucaccgucaaccaacccgucaaauuuaccccagucggucucaacgacaccgaacacuucaaccaaugggucgucccacgcuacgccggcgcccucaaucuaaacaccaaccucgcacccucugucgcccccgucuuccccggcgaacgccuccucuucuuccgcuccuacaucccccucaaaggcggauacggaaaccccgcaaucgacugccuccucccccaagaauggguucaacauuucuaccaagaagccgcccccuccauguccgaaguggcgcucguccgcuacaucaacccugacaccggacgcgcccucuucgaagcaaaacuccaccgcgcaggcuucaugacaguuuccuccaacacaagcgcacccgucguuguacccgcaaacggcuacuuccgcuucgacuccugggucaaccaauucuacagucucgcccccaugggaaccggaaacggacgacgacgcguccaauaa

SEQ ID NO: 37148 - RNA, 1629 nt, Artificial Sequence
  derived and/or modified sequence opt11 from capsid_protein__Norovirus__BAG34636
augaaaauggccucaaaugacgccgcccccucuaccgacggcgccgcaggacucguccccgaaucuaauaacgaggucauggcacuugaaccugucgcaggcgcggcccucgccgcacccguuaccggccaaaccaacaucaucgaccccuggauccgcgccaacuucguccaagccccaaacggcgaguucaccgucucacccagaaacgccccaggagaaguacuucucaaccucgaacuuggccccgaacuaaaccccuaccuagcccaccucgcacgcauguacaacggcuacgccggcggaauggaaguccaggucauguuagcuggcaacgccuucacugcaggcaaacucgucuucgccgccgucccaccccacuuccccgucgaaaaccucagcccacaacaaaucacuauguuuccccacguaaucaucgacguccgcaccuuagaacccguccuccucccccuacccgacguccgaaauaacuucuuccacuacaaccaaaaagacgaccccaagaugcguaucgucgccaugcucuacacaccccuccgaucuaacggcucaggagacgacgucuucaccguauccugccgcguccuaacccgcccauccccagacuucgacuucaccuaccucguaccacccaccguagaaucaaaaaccaaacccuucacauuaccuauccucacccugggcgaacuauccaacagccgcuucccuguaucuauagaucaaauguucaccucaccaaacgaagucaucucaguccaaugccaaaaugguagaugcacucucgacggcgaacuccaagguuccacccaacuacaaguauccggcaucugcgcauucaaaggugaggucacagcacaccuccacgacaacgaccaccucuacaacauaaccauaacaaaccuaaacggcuccccauucgacccaucagaagauguccccgcuccacucggcguaccagacuuucaaggccgagucuucggagucauaucccaaagagacaaccacaacgccucuggacacaaucaacccgccaaucgcggccacgacgcuguaguccccaccuacacaucccaauacacccccaaauugggucaaauccagaucggcaccuggcaaacugacgacuuaacagucaaccagcccgucaaguucaccccagucggucuaaaugacguagaacacuucaaccaaugggucgucccccgcuacgccggcgcucucaaccucaacacgaaucucgccccuuccguagcccccgucuucccgggagaacgacuacucuuuuuccgauccuaccucccccucaaaggcggcuacgguaaccccgccaucgacugccuccucccccaggaauggguccaacacuuuuaucaagaagcagcacccuccaugucagaagucgcccuaguccguuacaucaaccccgacaccggcagagcccucuucgaagccaaacuccacagggcaggcuucaugaccgucuccuccaacaccuccgcccccgucguaguccccgccaacggcuauuuccgcuuugacucaugggucaaccaauucuacucccucgcccccaugggcaccggcaacggccgccgacgaauccaauaa

SEQ ID NO: 37149 - RNA, 1629 nt, Artificial Sequence
  derived and/or modified sequence opt11 from capsid_protein__Norovirus__BAG34638
augaaaauggcauccaacgaugcagcccccagcaccgacggagccgccggacuugucccagaaucuaacaacgaagucauggcccucgaacccgucgccggagcagcccucgcagcccccgucaccggccaaacuaacauaaucgauccauggauccgagcuaacuucguccaagccccaaacggugaguucaccguuucaccacgcaaugcacccggugaaguccugcucaaccucgaacucggacccgaacucaaccccuaccucgcccaucucgccagaauguacaacggcuacgcaggcggcauggaaguacaaguaaugcuugcuggcaacgcauuuaccgccggaaaacucguuuucgcagccguucccccucacuuuccagucgaaaaccucucuccccagcaaaucacuauguuuccccacgucaucaucgacguccgcacccucgaaccuguccuccugccccuccccgacguccgcaacaacuuuuuccacuacaaccaaaaagacgaccccaaaaugcgaaucgucgccaugcucuacacaccccuacgcuccaacggcucaggugacgacguauucaccgucucaugucgaguccucacccgcccuucacccgauuuugacuucaccuaccucguucccccaaccgucgaauccaaaaccaagccauucacacuucccauccucacacuaggcgaacuuucaaacucucgauuccccgucagcauagaccaaauguacacuucccccaacgaaguaauuuccguccaaugccaaaauggccgcugcacccuagacggagaacuccaaggcacaacccaacuccaagucuccggcauaugcgcauucaaaggagaagucaccgcacaccuccacgacaacgaccaccucuacaacguaacaaucaccaaccucaauggcucacccuucgaccccuccgaagacauccccgcuccacugggcguccccgacuuccaaggcagagucuuuggcgucauaucacaaagagacaaacauaacucccccggccacaacgaaccagcaaaucgcggccacgacgccgucguacccacauauacaucacaauacacuccaaaacuaggccaaauccaaauaggcaccuggcaaacagaugaccucaccguaaaucaaccaguaaaauucacacccgucggccuaaacgacacagaacacuucaaccaauggguagucccacgcuacgccggcgcccucaaucuaaacaccaaucucgccccauccguagcaccagucuuccccggcgaacgucuccuuuucuuccguuccuacauuccacucaaaggcggcuacggcaacccagccauagacugccuccucccacaggaauggguccaacacuucuaccaagaagcugcccccuccaugagcgaagucgcucucguacguuacaucaaccccgacaccggccgcgcccucuucgaagccaaacuccaccgcgccggcuucaugaccgucuccucgaacaccuccgcacccgucguaguacccgccaacgguuacuuccguuucgacuccuggguuaaccaauucuacucccucgccccaaugggaacaggaaacggccgucgccgcguacaauaa

SEQ ID NO: 37150 - RNA, 1629 nt, Artificial Sequence
  derived and/or modified sequence opt11 from capsid_protein__Norovirus__BAG34640
augaaaauggcaucaaacgacgccgcuccuuccaccgacggcgcagccggccuagucccagaauccaacaacgaaguaauggcccucgagcccguugcaggcgccgcucucgccgcccccgucaccggacaaaccaacauaaucgacccauggauccgcgccaacuucguucaagcacccaacggcgaauuuaccgucucgccccgcaacgcccccggagaaguccuccuuaaucuagaacuuggccccgaacucaaccccuaccucgcccaccucgcccgcauguacaacggauacgcuggcggcauggagguccaagucaugcucgccggcaacgccuucacugcaggcaaacucguauucgcagccgucccaccccacuuccccguagagaaccuaucaccccaacaaaucaccauguucccccacgucaucaucgacguccgcacucuagagcccguccuccuaccucuccccgacguccgaaauaacuucuuccacuauaaucaaaaagacgacccaaaaaugcgcaucgucgccaugcuuuacacacccuugcgauccaacggguccggcgacgacguauucaccgucuccugccgaguccucacccgcccaucccccgacuucgacuucaccuaccucguucccccaaccgucgaaucuaaaaccaaacccuucacccuccccauccucacccucggagaacuauccaacucacgcuuccccgucuccaucgaccaaauguauaccucccccaacgaagucauauccguccagugccaaaacggacgcuguacacuugacggagaacuccaaggaacaacacaacuccaggucagcggcaucugcgccuucaaaggagaaguaacugcccaucuucacgacaaugaccaccuauacaacgucaccaucaccaaccuaaacggaucucccuucgacccaucagaagauaucccagcaccccucggcgucccagacuuucagggccgcgucuucggcgucaucucacaacgugacaaacacaacucacccggccacaacgaaccugccaaccgcggccacgacgcagucgucccaaccuacaccucccaauacacccccaaacugggccaaauccaaaucggcacauggcaaaccgacgaccucaccgugaaccaacccgucaaguucacaccagucggccuaaacgacaccgaacauuucaaucaaugggucguaccucgauacgcaggggcacuaaaccucaacaccaaccuggcccccagcgucgcccccgucuuucccggcgaacgccuacuauuuuuccgcuccuacauaccccuaaaaggaggcuacggcaacccugcaaucgacugccuacucccccaagaaugggugcaacacuucuaccaagaagccgcccccuccaugucggaagucgcccuagucagguacaucaaccccgacaccggucgagcacucuucgaagcaaaacuccaccgagccggcuucaugaccgucucuuccaacaccucagcccccgucguaguacccgccaacggcuacuuccgcuucgacuccuggguuaaccaauucuacucccucgcccccaugggcacaggcaacggccgacgacgcguucaauaa

SEQ ID NO: 37151 - RNA, 1629 nt, Artificial Sequence
  derived and/or modified sequence opt11 from capsid_protein__Norovirus__BAG34642
augaaaauggccaguaacgacgccgcucccuccaccgacggcgcagccggucuuguacccgaauccaacaacgaagucauggcucuugaacccgucgccggagcugcacucgccgccccagucaccggccagacaaacaucauagaccccuggauccgagccaacuucguccaagcucccaacggcgaguucaccgucucaccccgaaacgcccccggcgaaguccuacucaaccucgaacuuggcccagaacuaaaccccuacuuagcccaccucgcacgcauguauaauggcuacgcaggcggcauggaaguucaagucaugcuugcuggaaacgcuuucaccgccggcaaacucgucuucgccgccguucccccucacuuucccgucgaaaaccucagcccccaacaaaucacgauguucccccacgucaucauagacgucagaacacucgaaccaguccuacucccucuacccgacgucagaaacaacuucuuccacuacaaccaaaaagacgaccccaaaaugcgcaucguagcgaugcuauacacuccucuccgauccaacggguccggcgacgacguauucacagucuccugcagaguccugacacgcccaucccccgacuucgacuucaccuaucucguaccacccacagucgaauccaaaaccaaacccuuuacccuacccauauuaacccuaggcgaacucuccaacucccgauuucccgucuccaucgaccaaauguacaccucccccaacgaaguuaucuccguacaaugccaaaacggccgcugcacccucgacggugaacuccaaggcacuacucaacuccaaguuuccggcaucugcgccuucaaaggcgaaguaacagcacaccuccacgacaacgaccaccuuuacaauguaaccauaaccaaucuaaauggcuccccauucgaccccucagaagacaucccagccccacucggcguccccgacuuccaaggacgcgucuucggcgucaucucccaacgcgauaaacacaauuccccaggccacaaugaacccgcuaaccgcggccacgacgcggucguccccaccuauaccucacaauauaccccgaaacuaggacaaauccaaaucggcacguggcaaacagaugaucucacuguaaaccaacccgucaaauucacaccagucggccucaacgacaccgagcauuucaaccaaugggucgucccccgcuacgccggugcccucaaccuaaacaccaaccuagcccccuccgucgccccagucuuccccggcgaacgucuccucuucuuccgcucuuacaucccccuaaaaggcggcuacggcaaccccgccaucgacugccuucuaccucaagaauggguccaacacuucuaucaagaagccgcccccuccauguccgaagucgcacucguacgcuacauaaaccccgacaccggccgugcacucuucgaagccaaacuucaccgagccggauucaugacugucucauccaauaccucagcccccguaguuguccccgccaauggauacuuccgcuucgauagcugggucaaccaauucuacucccucgcccccaugggcaccggcaacggccgccgccgcguccaauaa

SEQ ID NO: 37152 - RNA, 1629 nt, Artificial Sequence
  derived and/or modified sequence opt11 from capsid_protein__Norovirus__BAG34644
augaagauggcguccaaugacgcagccccauccaccgacggagccgccggccuaguccccgaaucaaacaacgaagucauggcccuagaaccaguagcaggagccgcacuagccgcccccgugacaggccaaaccaacaucaucgaucccuggauucgagcaaacuuuguccaagcccccaacggcgaguucaccgucucaccacgaaacgcacccggcgaaguccuccucaaccucgaacucggaccagaacucaaccccuaccuagcacaccucgcccgcauguacaacggguacgccggcggaauggaaguacaaguaaugcucgccggcaacgcauucaccgcuggaaagcucguuuucgccgcuguaccaccccacuucccagucgaaaaccucucuccccaacaaaucaccauguucccccacguaaucauagacguccgcacccucgaaccaguccuucucccccuccccgacguacgaaacaacuucuuccacuacaaccaaaaagaugacccuaagaugcggaucgucgccaugcuuuacacaccccuucgcuccaacggcagcggagacgacguauucacggucuccugccguguccuuacccgaccaagccccgacuuugacuucacuuaccuaguaccaccaacagucgaauccaaaaccaaacccuucacccugccaauccucacccuaggcgagcuauccaacucccgcuucccagucuccaucgaccaaauguacacaucaccaaacgaagucaucuccguccaaugucaaaacggucgcugcacccucgacggcgaacuccaaggcacaacccaacuccaagucucaggcaucugcgccuucaaaggcgaagucaccgcacaccuacacgacaacgaucaccuauacaacguaaccaucaccaaccucaacggcuccccuuucgaccccucagaagacauacccgcaccgcucggcguccccgacuuccaagggcgcgucuucggcgucaucucccaacgcgauaaacauaacucaccaggacauaacgaacccgcaaacagaggccacgacgcaguaguccccaccuacacaucccaauacacucccaaacucggccaaauacaaauaggcacauggcaaacagacgaccuaacagucaaccaacccgucaaauucacccccgucggccucaacgacacugaacacuucaaccaauggguugucccccguuacgccggagcccucaaccuaaauacaaaccucgccccauccgucgcccccgucuuccccggugagagacuccucuucuuccgauccuacaucccccuaaaaggcggcuacggcaaccccgccaucgacugccuacucccacaagaauggguacaacacuucuaccaagaggccgccccauccauguccgaaguugcucucguucgcuacauaaacccagacaccggcagagcccucuucgaagccaaacuccaccgcgccggauuuaugacagucuccuccaacaccuccgcacccgucguugucccagcaaacggcuacuuccgcuucgacuccugggucaaccaauucuacucgcuagcccccaugggaaccggcaacggccgccgacguguacaauga

SEQ ID NO: 37153 - RNA, 1629 nt, Artificial Sequence
  derived and/or modified sequence opt11 from capsid_protein__Norovirus__BAG34646
augaaaauggcaucuaacgacgccgcccccucuaccgacggagccgccggccuaguccccgaguccaacaacgaagucauggcccuagaaccugucgccggagccgcccuggccgcccccguuaccggacaaaccaauauuaucgaccccuggauacgagcuaacuucguccaagcacccaacggcgaguucaccguuucaccccgaaacgcacccggggaaguuuuacuaaaccucgaacugggccccgaacuaaaccccuaccuagcccaccucgcccgaauguacaacggcuaugccggcggcauggaagugcaaguuauguuagcaggaaacgccuuuaccgccggcaaacuuguauucgccgccguaccuccccacuuccccgucgaaaaccuaucuccccaacaaaucaccauguucccucacguuauaaucgacguccgcacacuagaacccguccuacucccccuaccagacguaagaaacaauuucuuucacuacaaccaaaaagacgaccccaaaaugagaaucguagcaaugcucuacacaccccucagauccaacggcuccggcgaugacgucuucaccgucuccugccgcguacuaacccgcccuucucccgacuucgacuucaccuaccucguuccacccaccgucgaauccaaaaccaaacccuucacccuccccauccucacccucggcgaacucuccaacagccgauuccccgucuccauagaucaaauguacaccagccccaacgaaguaaucuccguccaaugucaaaacggccgcugcacccucgacggcgaacuacaaggaaccacacaacuccaagucuccggaaucugcgcauucaaaggcgaagucacggcgcaccuacacgacaacgaccaccucuacaacguuaccaucaccaaccucaacggcucccccuucgaccccuccgaagacauacccgcaccccucggaguacccgacuuccaaggucgaguuuuuggcgucauaucccaaagagacaaacacaacucaccaggacacaacgagccagccaaccgaggccacgacgccgucguacccacuuacaccucccaauacacccccaaacuaggacaaauccaaauagguacauggcagaccgacgaccugaccgucaaccaacccgucaaauucacaccagucggacucaacgacacagaacacuucaaccaauggguuguccccagauacgcaggcgcccucaaccuaaacaccaaccucgccccauccgucgcccccgucuuccccggcgaacggcuacucuucuuccgcucguacaucccucucaaaggcggcuacggaaacccagccaucgacugccuacucccgcaagaauggguacaacacuucuaccaagaagccgcccccucaaugucagaagucgcccuaguacgcuacauuaacccggacaccggccgagcccucuucgaagcaaaacuccaucgugccggauucaugaccgucaguuccaacacaucugccccagugguaguucccgcaaacggcuacuuccgauucgacuccugggucaaccaauucuauuccuuagcccccauggguaccgguaacggccggcggcgaguccaauaa

SEQ ID NO: 37154 - RNA, 1629 nt, Artificial Sequence
  derived and/or modified sequence opt11 from capsid_protein__Norovirus__BAG34648
augaaaauggccuccaacgacgccgccccauccacugacggagccgccggacucguccccgaaucaaacaacgaaguaauggcacuugaacccgucgcaggcgccgcccucgccgcccccgucacaggccaaaccaacaucauagaccccuggauaagagcaaacuucguccaagcacccaacggcgaguucaccguauccccacguaacgccccaggcgaaguucuccuaucacucgaacucggacccgaacucaaccccuaccucgcccaccuagcccgcauguacaacggauacgccggcggcauggaaguacaagucaugcucgcaggcaacgccuucacggccggaaagcucguguucgccgccgucccaccccacuuccccguugaaaaccucucaccccaacaaaucacaauguucccccacguaauaauagacguccgcacccuugaaccaguccuccuuccucuccccgacguccgaaacaacuuuuuccacuacaaccaaaaagaugaccccaagaugagaaucgucgcaaugcucuauacaccccuccgcuccaacggcuccggggacgacgucuucaccgucuccugccgaguccucacccgaccuucccccgacuucgacuucaccuaccuagucccacccacugucgaaucuaaaaccaaacccuucacccugcccauacucacccucggcgaauuaucuaacucccgauucccaguuuccaucgaccaaauguacacaucccccaaugaagucauauccguucaaugccagaacggccgaugcacucucgacggugaacuccaaggaucaacccaacuccaagucuccggaaucugcgccuucaaaggcgaagucaccgcccaccuacacgacaacgaccaccuauacaacguaaccauaacuaaccuaaacggcucacccuucgacccauccgaagacaucccagcaccccucgguguccccgacuuccaaggccguguuuucgguguuaucucacaacgcgacaaacacaauagccccggccacaacgaaccagccaaccgcggucacgacgccguagugcccaccuacacaucccaguauacccccaaacucggacaaauacagaucggcacauggcaaaccgacgaccuaaccguaaaucaaccagucaaauuuaccccaguaggccuaaacgacaccgaacacuucaaccagugggucgucccacgcuacgccggcgcccucaaccuaaacacuaaccucgcccccagcgucgcacccgucuuccccggcgaacgccuccucuucuuccgcuccuacauaccacugaaagguggcuacggcaaccccgccaucgacugccuacuaccccaagaauggguccaacacuucuaccaagaagcugcccccuccauguccgaagucgcccuuguacgcuacaucaacccagacaccggacgcgcgcuauucgaagcaaaacuucaccgcgccggcuucaugaccguauccucaaacacaucagcaccagucguagucccugccaacggcuacuuccgcuucgacuccuggguaaaccaauucuacagccuagcacccaugggcaccggcaacggccgccgaagaguacaauaa

SEQ ID NO: 37155 - RNA, 1629 nt, Artificial Sequence
  derived and/or modified sequence opt11 from capsid_protein__Norovirus__BAG34650
augaagauggccuccaacgacgccgcccccuccacugacggcgccgcaggccucguccccgaaaguaacaacgaagucauggcucucgaaccuguagccggagcagcacucgccgccccugucaccggccaaacaaacauaaucgaccccuggauccgugcuaacuucguccaagcccccaacggcgaguucaccguuucgccccgcaacgcucccggcgaagucuuacuaaaccuagaacuuggaccagaauuaaaccccuaccucgcccaccucgcccgcauguacaauggcuacgccggaggaauggaaguccaagucaugcucgcuggcaacgccuucaccgccggcaaacucgucuucgccgcgguaccaccccacuuccccgucgaaaaccucuccccacaacaaaucaccauguucccacacgucauuaucgacguccgcacccuagaacccguccuacuaccacuucccgacgugcgcaacaacuucuuccacuacaaccaaaaagacgaccccaaaaugcgcaucgucgccaugcuuuacaccccucuccgauccaacggcuccggcgacgacguauucaccgucagcugccgcguccucacucggccaagccccgacuucgacuuuaccuaccuagucccacccaccguagaaucaaaaaccaagcccuucacccuaccaauacucacgcucggcgaacuuuccaacagccgcuucccagucuccaucgaccaaauguacacgucccccaacgaagugaucuccguccaaugccaaaacggccgcugcacucucgacggcgaacuacaaggaaccacacaacuacaaguuuccggcaucugugcauucaagggugaaguaaccgcccaccuccacgacaacgaccaccucuacaacgucacaaucacaaaccuuaacggauccccauucgacccaagugaagacaucccagcaccccuaggcguccccgacuuccaaggccgaguuuucggaguaaucucccaacgcgacaaacacaacuccccuggacacaacgaacccgccaaccgaggccacgacgccgucguccccaccuacacaucccaauacaccccaaaauuaggccaaauucaaauaggaacauggcaaaccgacgacuuaaccgucaaucaaccagucaaauucaccccaguaggccucaaugacacugaacacuucaaccaauggguaguaccccgauacgcaggcgcacucaaccucaacaccaaccuugccccaucagucgccccugucuuccccggcgaacgacuccucuucuuccgcuccuacaucccccucaaaggcggauacggcaacccagcaaucgacugccuccuaccccaagaauggguucaacacuucuaccaagaagccgcccccuccaugagcgaagucgccuuaguacgauacaucaacccagauaccggccgcgcccuguucgaagccaaacuucaccgcgccggcuucaugacagucucaucaaacacuuccgcacccgucgucguccccgccaacggauauuuccgauuugacucaugggucaaccaauucuacucccuugcacccaugggaaccgguaacggccgccgacgcguacaguaa

SEQ ID NO: 37156 - RNA, 1629 nt, Artificial Sequence
  derived and/or modified sequence opt11 from capsid_protein__Norovirus__BAG34652
augaaaauggccagcaacgacgcagcacccuccacagauggcgccgcaggcuuaguacccgaaucaaauaacgaagucauggcccuagaacccguugccggcgccgcacuugcagcaccagucacuggacaaaccaacauaauugacccauggauccgcgcaaacuucguacaagccccaaacggggaguucaccgucucuccccgcaacgcaccuggcgaaguccuccucaaccucgaauuaggucccgaacucaaccccuaucuugcacaccucgcacgaauguacaacggauacgccggcggcauggaaguccaagucaugcucgccggcaacgcuuuuaccgccggcaagcuaguuuucgcagcagucccaccccauuuccccguagaaaaccuaagcccccaacaaaucaccauguucccucaugucaucaucgacguccgcacacucgaacccguacuccuaccgcucccggauguucgaaacaacuucuuucacuacaaccaaaaagacgaccccaaaaugcgcauaguagccaugcuauacaccccacuccgcuccaacggcuccggcgacgacguauuuaccgucuccugcagaguccucacccgucccuccccugacuucgacuucacuuaccucgucccuccuaccgucgaaagcaaaaccaaacccuucacacuccccauccuaacacucggcgaacuaucaaacucgcgauuccccgucagcaucgaccaaauguacacuuccccaaacgaagucauauccguccaaugccaaaacggaagaugcacucuagacggcgaacuccaaggcacaacucaacuucaagucuccggaauaugcgccuucaaaggcgaaguaacagcccaccuccacgacaacgaccaccucuacaacgucacuaucaccaaccucaacggcucaccuuucgaccccuccgaagacaucccugcaccccucggaguccccgauuuccaaggccgagucuucggagucauaagucagcgagacaaacacaacucccccggucacaacgaaccugccaaccgcggccacgacgccgucguaccuaccuacacaccacaauacacccccaaacuaggccaaauacaaaucggaaccuggcaaacagacgaccucaccgugaaucaacccgucaaauucacucccguuggucuaaacgacacagaacacuucaaccaaugggucgucccccgcuacgccggcgcccucaaccucaacacaaaccucgcccccucaguagcccccgucuucccaggagaacgucuccuguucuuccgcucuuauaucccacuaaaaggcggcuacgggaacccagcaauagacugccuccucccccaagaauggguccaacacuucuaccaagaagcagccccaucaauauccgaagucgcucuaguccgcuacaucaaccccgacaccggccgagcccucuuugaagccaaacuucaccgcgccggcuucaugacugucucauccaacaccucagccccgguaguugugcccgcgaauggcuacuuucguuucgacuccuggguaaaccaauucuacucacucgccccaaugggcaccggcaacggccgucgacgcguccaauga

SEQ ID NO: 37157 - RNA, 1629 nt, Artificial Sequence
  derived and/or modified sequence opt11 from capsid_protein__Norovirus__BAG34654
augaaaauggcauccaacgacgccgcccccuccaccgacggcgcugccggacucguacccgaaucuaauaacgaaguaauggcacuagaacccguagcaggagcagcccucgccgcccccgucacaggccaaacaaacaucaucgacccauggauaagagccaacuucguccaggcucccaacggcgaguucaccgucucaccccgcaacgcccccggugaaguccuacucaaccucgaacucgguccggaacucaaccccuaccuugcccaccucgcccgaauguacaauggcuacgccggcggcauggaaguccagguaaugcucgccggcaacgcguucaccgccggcaaacucgucuucgccgccgucccgccacacuucccagucgaaaaucuaucuccccaacaaaucaccauguuuccccacgucauaaucgacguacgaacccucgaacccguacuccuaccgcuccccgacguccgaaauaacuucuuccacuacaaccaaaaagacgaccccaaaaugcgcauagucgcaaugcucuacacuccccuaagauccaacggcuccggcgacgacgucuucacugucuccugcagaguccuaacccgaccaagccccgacuuugacuucacauaucuuguaccacccacagucgaauccaaaacuaaacccuucacccuccccauacuaacacucggcgaacucucaaacucccgcuuccccgucucaauugaucagauguacacaagucccaacgaagucauaagcguccaaugccaaaacggacgcugcacacucgacggcgagcuccaaggcaccacacaacuccaagucucaggcaucugcgccuucaaaggcgaagucacagcgcacuuacacgacaacgaccacuuauacaacgucaccauaaccaaccucaacggcucaccauucgacccuuccgaagacauaccagcaccccucggaguacccgauuuucaaggccgcgucuucggcgucaucucccaacgcgacaaacacaacuccccuggccacaacgaauccgcaaaccgaggacacgacgcagucguacccacauacacaucccaauacacccccaaacucggccaaauacaaaucggaaccuggcaaaccgacgaccucacuguaaaccaacccgucaaguucacccccguuggccucaacgacacggaacacuucaaccaaugggucgucccccgcuacgcaggcgcccucaaccucaacaccaaccucgcccccuccgucgcccccguauuccccggcgaacggcuccuauucuuccgcuccuacauaccacucaaagguggauacggaaacccagccaucgauugccuucucccucaagaauggguccaacacuucuaccaagaagccgcccccucaauguccgaaguagcccucguucgcuacaucaaucccgacaccggacgcgcacucuuugaagccaagcuacaccgcgccggauuuaugaccgucuccucaaacaccucagcucccguaguagucccagcgaaugguuacuuccguuucgacuccugggucaaccaauucuacucacucgcuccaauggguaccggcaacggacgacgccgaguucaauaa

SEQ ID NO: 37158 - RNA, 1629 nt, Artificial Sequence
  derived and/or modified sequence opt11 from capsid_protein__Norovirus__BAG34656
augaaaauggcgucgaacgacgccgcaccaucaaccgauggugcugccggucucguccccgaaucaaacaacgaagucauggcccucgaaccugucgcuggagccgcccuagccgcucccguaacgggccaaaccaacauaaucgacccuuggauacgcgcaaacuucguccaagcacccaacggagaguucaccgucuccccacgcaacgcccccggcgaaguccuacucaacuuagaacucggccccgaacuuaaucccuaccucgcccaccuugcgcgcauguacaacggcuacgcuggcgguauggaaguccaaguaaugcuagccggaaacgcauuuaccgccggcaaacuuguauucgccgcuguaccgccccacuuucccguagaaaacuuaagcccccaacaaaucaccauguucccccacguuaucauagacguccgaacccuugaacccguacucuuaccccuacccgacguccgaaacaacuuuuuccacuacaaccaaaaagacgacccaaaaaugcguaucgucgccaugcucuacacaccccuccgcucuaacggcucuggagacgacgucuucaccguauccugccgcguccuaacucgucccucacccgacuucgacuuuacauacuuagucccacccaccguugaaucaaaaaccaaacccuucacccugcccauccuaacccucggcgaacuauccaacucccgcuuccccgucuccaucgaccaaauguacaccucccccaacgaggucaucuccguccaaugucaaaacggacgaugcacacuugacggcgaacuacaaggcaccacgcaacuucaaguauccggcauaugcgccuucaaaggagaagucacagcccaccuacacgacaaugaccaccucuacaacgucaccauuaccaaccuaaacggauccccauucgaccccucagaagacauacccgcaccccucggugugcccgauuuccaaggcagagucuucggcgucaucucccaaagagacaaacacaacucccccggccacaacgaaccagcaaaccgcggccacgacgccgucguacccaccuacaccucccaauacacucccaaacuaggccaaauccaaaucggcacauggcaaaccgacgaccuaaucgucaaccaaccagucaaauucaccccagucggacuuaaugacacagaacacuucaaccaaugggucgucccacgguacgcgggcgcccuaaaccuaaacacaaaccucgccccauccguagcacccgucuucccgggugaacgacuucuauucuuccgauccuacaucccacucaaaggcggcuacggcaaccccgccaucgacugccuacuaccacaagaauggguacaacacuuuuaccaagaagccgcacccucaaugucagaagucgcccucguccgcuacaucaaccccgauacaggucgagcccuauucgaagcuaaacuccaccgagccggauucaugaccguaucauccaacaccuccgccccgguagucgucccagccaacggcuacuuccgauucgacucaugggucaaccaauucuacucacucgcaccuaugggcaccggcaacggaagacgccgcguucaauaa

SEQ ID NO: 37159 - RNA, 1629 nt, Artificial Sequence
  derived and/or modified sequence opt11 from capsid_protein__Norovirus__BAG34658
augaaaauggccuccaacgacgccgcucccucaaccgacggcgcagccggccucguacccgaaucaaacaacgaggucauggcccucgaaccugucgcaggcgccgcgcuggcugcaccaguaacaggacagacuaacaucaucgauccauggauccgcgccaacuuuguccaagccccgaacggcgaguucacagucuccccacgcaacgcacccggcgaaguccuccuaaaccuagaacuaggacccgaacugaaucccuaccuugcccacuuagcccgcauguacaacggauacgccggcggaauggaaguccaagucaugcucgcagguaacgcguucaccgccgggaagcuagucuuugccgcggucccaccacacuucccagucgaaaaccuuagcccccaacaaaucacgauguucccccacgucaucaucgacgugcgcacccuagaaccaguacuucucccccucccagauguccgcaacaacuucuuccacuacaaccaaaaagacgacccuaaaaugcgcauuguagccaugcucuacaccccacuccgcuccaauggaucaggcgacgacguauucaccgucuccugccguguacucacacgcccaucccccgacuucgacuucaccuaccuagucccucccacagucgaaagcaaaaccaaacccuucacccuccccauacuuacccucggcgagcucagcaacucccgauuccccguaagcaucgaccagauguacacaagcccuaacgaagucaucuccguccaaugccaaaacggaagauguacucuugauggcgaacuccaaggaaccacccaacuccaagucuccggcauaugcgcauucaaaggagaaguaacagcacaccuccacgauaacgaccaccucuacaacguaaccaucaccaaccucaacggcucacccuucgaccccucugaggacauccccgcaccccuuggaguacccgacuuucaaggccgcgucuucggcguaauaucucaacgcgauaagcacaacuccccuggccauaacgaacccgccaacagaggccacgacgccgucguacccacguacaccucccaauacacccccaaacucggccaaauccaaaucggcacauggcaaaccgacgaccugaccgucaaccaacccguaaaauucacacccgucggccucaacgacaccgaacacuucaaccaauggguagucccccgcuacgccggcgcucuaaaucucaacaccaaucuggcaccauccguagcccccgucuucccaggcgaacgacuccucuucuuccguuccuacaucccccuaaaaggcggcuacggaaacccagcaaucgacugccuccuuccacaagaauggguccaacacuucuaccaagaagccgcacccuccauguccgaagucgcccucguacgauacaucaaccccgacacaggccgcgcacucuucgaagccaaacuccaccgagccggauucaugacagucagcucgaauaccagcgccccugucguaguacccgcaaacggcuacuuccgcuucgauucaugggucaaccaguucuacucacucgccccaauggguaccggcaacggucgucgccgcguacaauaa

SEQ ID NO: 37160 - RNA, 1629 nt, Artificial Sequence
  derived and/or modified sequence opt11 from capsid_protein__Norovirus__BAG34662
augaaaauggccuccaacgaugcagcccccuccaccgacggagccgcaggccuuguacccgaauccaacuccgaagucauggcccucgaacccgucgccggagcagcccuagcugcucccgucacaggccaaacaaacaucaucgaccccuggauccgcucaaauuucguccaagcccccaacggugaguucaccguaagcccacgcaacgcacccggcgaaguacuccucaaccuugaacucggccccgaacucaaccccuaccuagcacaucucgcccguauguacaacggauacgccggcggaauggaaguacaagucaugcucgcuggcaacgccuucaccgccggcaagcuagucuucgccgcaguaccaccccacuuucccguagaaaaccuaucaccccaacaaaucacuauguucccccacguaaucaucgacguccgaacgcucgaacccgugcuacucccacuccccgacguacgcaacaacuucuuccacuacaaccaaaaagacgacccaaaaaugcgcauagucgcgaugcucuacacaccucucagaaguaacgguucaggagacgacgucuucaccgucucaugccgcguccucacacgcccaucuccagacuucgacuuuaccuaccuaguaccacccaccgucgaauccaaaaccaaacccuuuacacucccaauccucacccucggcgaacuaucaaacucccgcuuccccgucuccaucgaccaaauguacaccagccccaacgaagucaucuccguucaaugccaaaacggccgcuguacccucgacggcgaacuccaaggaaccacccaacuccaagucuccggaaucugcgcauuuaagggcgaagucaccgcacaccuucaaaacgacgaccaccucuacaacaucacuauaacaaaccucaacggauccccauucgaccccuccgaagauauccccgcaccccucggaguccccgacuuccaaggccgagucuucggcgucaucacccaacgcgacaaacaaaacgcaacaggucaaaaccaaccugcaaacagaggccacgacgccgucguccccacauacacugcucaguacaccccaaaacuuggccaaauccaaauaggcaccuggcaaaccgacgaccucaaaguuaaccaacccguaaaguucacgccagucggacucaacgacaccgaacacuucaaccaauggguuguaccucgguacgccggcgcccucaaccucaacacaaaccucgcccccuccgucgccccaguauuucccggcgaaagacuacucuucuucagauccuaccucccacuaaaggguggauacggaaaccccgccauagacugccuccuaccccaagaauggguccaacacuuuuaucaagaagccgcccccagcauguccgaaguagcccuaguucgcuauauaaacccagacacaggccgagcccucuucgaagcaaaacuccaccgugccggcuuuaugaccgucuccucaaacaccuccgcacccguaguaguacccgccaacggcuacuucagauucgacuccuggguaaaccaauucuacucacucgcaccaaugggaaccggaaacggccgccgacgcauacaguaa

SEQ ID NO: 37161 - RNA, 1629 nt, Artificial Sequence
  derived and/or modified sequence opt11 from capsid_protein__Norovirus__BAG34664
augaaaauggcguccaacgacgccgcccccuccacugacggagcagccggccuaguacccgaauccaacaacgaagucauggcacucgaaccagucgccggagcagccuuagcagccccagucacaggacagacaaacauaaucgacccuuggauccgcgccaauuuuguacaagcccccaacggcgaauuuaccgucagcccccgaaacgccccaggagaaguccuccucaaccuagaacuaggcccugaacuaaaccccuaccucgcccaccuagcccgaauguacaacgguuacgccggaggcauggaaguacaaguaaugcucgcagggaacgccuucaccgcaggaaaacucgucuucgccgcagucccaccccacuuccccgucgaaaaccugagcccccaacagaucaccauguucccccacgucaucauagacguacgcacccucgaacccguccuucuacccuuaccagacguccgcaauaacuucuuucacuauaaccaaaaagacgaucccaagaugcgcaucgucgccaugcucuacacaccccuaagguccaacggcuccggcgacgacgucuucaccgucuccugccgcguccuaacccgacccucacccgacuucgacuucacuuaccuaguaccucccacagucgaauccaagaccaaacccuucacucuaccaauauuaacucuaggcgaacuuuccaacucaagguucccagucucaauagaccaaauguacaccucaccuaacgaggucaucuccguccaaugccaaaacggcagaugcacacuagacggagaacuucaaggcacaacacaauuacaagucuccggcaucugcgccuuuaaaggagaaguaaccgcucaccuccacgauaacgaccaccucuauaacaucaccauaaccaaccugaacggcagcccauucgaccccucagaagacacacccgcgccgcuaggcgucccagacuuucaaggccgagucuucggaauaauaucacaacgagacaaacaaaacgccacaggccacaacgaaccagccaaccgaggccacgacgccgucguccccacauacaccgcccaguacacccccaaacucggccaaauccaaauaggaacauggcaaaccgaugaccucaccgucaaccagcccgucaaauucacucccgucggccuaaaugacaccgaacacuucaaccaaugggucgucccacgcuacgccggugcccugaaccucaauaccaaccucgcacccuccgucgcccccgucuuuccaggcgaacgccuccucuucuuccgcucuuacaucccccucaaggguggcuacggaaacccagccaucgacugccuccucccccaagaauggguacaacacuucuaccaagaagcugcccccuccaugagcgaagucgcccucguccgcuacaucaacccggacaccgguagagcacuauucgaagccaaacuccaccgcgccggauucaugaccgucucauccaacaccucagcucccguugucguucccgccaacggauacuuucgcuucgacuccuggguuaaccaauucuacagccuagccccaauggguaccgguaacggccgacgacgcguucaauaa

SEQ ID NO: 37162 - RNA, 1629 nt, Artificial Sequence
  derived and/or modified sequence opt11 from capsid_protein__Norovirus__BAG34666
augaaaauggcuucaaacgaugcagcccccuccaccgacggcgccgccggccuuguccccgaauccaauaacgaagucauggcacucgaacccgucgccggcgccgcccuagcagcccccgucacaggccaaacaaauaucauagauccauggauccgagccaacuucguacaagcaccaaacggcgaauuuaccguauccccacgcaaugcccccggugaaguucuccuuaaccucgaacucggcccugagcuuaacccuuaccucgcacaccucgcccgaauguacaacggauacgccggcggcauggaaguccaagucaugcucgcuggcaacgccuucacagccggaaaacucgucuucgcagccgucccaccccacuuccccguagaaaaccuaucaccccaacaaauaaccauguucccccacgucaucaucgacguucgaacccuagagcccguccuccuuccccuacccgacguacgaaacaacuucuuccacuacaaccaaaaagacgaccccaaaaugcgaaucgucgcaaugcuauauacgccucuccgguccaauggcucuggagacgacguauucaccgucuccugcagaguacuaacccgacccucaccagacuucgacuucacuuaucuuguuccacccaccguagaaucgaaaaccaaaccauucacccuacccauccucacccucggcgaacucagcaacucaagauucccagucucuaucgaccaaauguacaccucacccaacgaaguuauaagcguccaaugccaaaacggccgaugcacucucgacggcgaacuucaaggcaccacccaauuacaagucuccggaaucugugcauucaaaggcgaagucacagcccaccuccaugacaacgaccaccucuacaacguuaccauaaccaaccucaacggcucccccuucgacccgucagaagacauccccgcuccccuaggugugccagacuuccaaggccgcgucuucggcgucauaucccaacgagacaaacacaacucccccggacacaacgaacccgccaaccgcggucacgacgccguaguccccaccuacacaucccaauacacacccaaacuagggcaaauccaaaucggcacauggcagaccgacgaccuaaccgucaaccaacccguuaaauuuaccccaguaggccuaaacgacacagaacacuucaaucaaugggucguaccucgcuacgccggugcccucaaccuaaacaccaaccucgcucccuccguagcacccgucuuccccggcgaacgccuccuauucuuuagaagcuacauaccacucaagggaggauacggcaacccugccauugacugccuccucccacaagaauggguccaacacuuuuaccaagaagccgccccaucaaugucagaagucgcacucguccgauacaucaaccccgacaccgguagagcccuuuucgaagccaaacuacaucgagccgguuucaugaccgucucuuccaacaccuccgcccccguagucguccccgcuaacggcuacuuccgauuugacucauggguuaaccaauucuauuccuuagcccccaugggaaccggcaacggccgacgacgaguccaauaa

SEQ ID NO: 37163 - RNA, 1629 nt, Artificial Sequence
  derived and/or modified sequence opt11 from capsid_protein__Norovirus__BAG34668
augaaaauggccuccaacgacgccgccccauccacugacggagccgccggccuagucccagaaucaaacaacgaagucauggcccucgagcccguagcaggagcugcacucgccgcacccgucaccggacagaccaacauaaucgaccccuggauacgcgcaaacuucguccaagcaccaaacggcgaauuuacagugucuccccgcaacgcucccggagaaguccuccucaaccucgaacuagguccagaacugaacccauaccuagcgcaccuagcccgaauguacaacggauacgccggcggcauggagguacaaguuaugcucgcaggcaacgcauucacagcggguaaacucgucuucgccgcagucccaccccacuuccccgucgaaaaccucucgccccaacaaauaaccauguucccacacgugaucaucgacguccgcauccuggaacccguacuccucccccuccccgacgucagaaacaacuuuuuccauuacaaccaaaaagacgacccaaaaaugcgcaucguagccaugcuauacaccccacuacgauccaacggcuccggagacgacgucuucacgguuuccugccgcguucucacuagacccucccccgacuuugacuuuaccuaccucguaccacccaccgucgaaucaaaaacaaaacccuucacccucccgauccucacccucggagagcuaucaaacucccgcuuccccgucuccaucgaccaaauguacaccuccccaaacgaagucaucuccguccagugucaaaacggccgcugcacccucgacggagagcuccagggaacuacacagcuccaaguuucgggcaucugcgccuucaaaggugaagucaccgcccaccuccacgauaaugaccaucucuacaacgucaccaucaccaaccuaaauggcucaccauucgaccccucagaagauaucccagcccccuuaggagucccagacuuccaaggccgcgucuucggcgucauaagccaacgcgacaagcacaacucucccggccacaacgaacccgccaaccgcggacacgaugcagucgucccaaccuacaccucccaauacacccccaaauuaggccaaauccaaauaggcacuuggcaaacagaugaccucaccguaaaucaacccgucaaauucacccccguuggccuaaacgauaccgagcacuucaaccaauggguagucccaagauacgccggcgcccuuaaccucaacacaaaccuugccccauccgucgcccccgucuuccccggugaacgccuccuauucuuccgcuccuacauaccacucaagggaggcuacggcaacccagccauagauugccuacucccccaagaauggguacaacacuucuaccaagaagcagcacccuccauguccgaagucgcgcugguccgcuauauaaaccccgauaccggccgagcccuuuucgaagccaaacuacaccgcgccggauucaugaccgucucuagcaacacauccgcaccaguagucgucccagcaaacggauacuucagguucgacucauggguaaaccaauucuacucucucgcaccuaugggaaccggcaacggccgacguagaguacaauaa

SEQ ID NO: 37164 - RNA, 1629 nt, Artificial Sequence
  derived and/or modified sequence opt11 from capsid_protein__Norovirus__BAG34670
augaaaauggccucaaacgaugccgcccccuccacagacggugcagccggccuagucccugaauccaauaacgaagucauggcucucgagcccguagccggagcagcucuggccgcacccgucaccggacaaaccaacauaaucgacccauggauacgcgcaaacuucguccaagcaccaaacggagaguucacaguauccccaaggaacgcuccgggcgaaguccuacucucuuuagaacucggucccgaacugaacccauaccucgcacaccuagcccgcauguacaacggauacgcaggaggcauggaaguacaagucauguuagcggguaaugccuucaccgcagguaaacucguauucgccgccgucccaccccacuuccccgucgaaaaccuaucaccccaacaaaucaccauguuuccccacguuaucaucgacguacgaacacuagaacccguccuacucccccuccccgacguccgcaacaacuucuuccacuacaaccagaaagacgaccccaaaaugcgaaucguugccaugcucuacaccccacucagguccaacgguucaggcgacgacgucuucaccgucucgugcagaguacuaacacgcccauccccagacuuugacuucaccuaccuagucccacccacagucgaauccaagacaaaacccuucacacuccccauccuaacccuuggggaacucuccaacucaagauuccccguauccauagaucaaauguacaccuccccaaacgaaguuauauccguccaaugccaaaacggccgaugcacacuagacggcgaacuacaaggcagcacccaacuccaagucuccggcauaugcgcauucaaaggcgaagucaccgcacaccuacacgacaacgaccaccucuacaacguuacuauuacaaaccucaacgguucccccuucgaccccuccgaagacaucccagcuccccucggaguccccgacuuccaaggacgagucuucggcgugauaucccaacgcgacaaacacaacagccccggccacaacgaacccgccaaccgcggacacgacgccgucguacccaccuacacuucacaauacacacccaaacuuggccaaauccaaaucggaacauggcaaaccgacgaccucaccguuaaccaacccgccaaauucacccccgucggucucaacgauacagaacacuuuaaccaaugggucgucccccgcuaugcgggagcacucaaccucaacaccaaccuagcccccucuguagcccccguauucccaggcgaacgccuacucuucuucagguccuacaucccgcugaaaggcggauacggcaaccccgccaucgacugccuucuaccccaagaguggguccaacacuucuaccaagaagccgcccccucuaugucggaaguugcgcucgucagauacaucaaccccgacacaggcagagcccuguucgaagcaaaacuccaccgcgcaggcuuuaugaccguauccucaaacaccuccgcccccgucgucguacccgccaacggauacuuccgcuucgacuccugggucaaccaauucuacucccucgcccccaugggcaccggaaacggccgccgccgaguccaauaa

SEQ ID NO: 37165 - RNA, 1623 nt, Artificial Sequence
  derived and/or modified sequence opt11 from capsid_protein__Norovirus__BAG55289
augaagauggcuuccucagacgcaaaccccucugacggcuccaccgccaaccucguccccgaaguaaacaacgaagucauggcacucgaaccagucguuggcgccgccaucgccgcaccagucgccggucaacaaaacgucauagaccccuggauacgcaacaauuucguccaagcaccagggggugaauuuaccguauccccaagaaacgcccccggugaaauccuuugguccgcgccccuaggaccagaccucaaccccuaccuuucccaccuagcccgcauguacaauggcuacgcaggcggauucgaaguccaagucauccucgcaggcaaugccuucaccgccggcaaaauaauauucgccgccguacccccaaacuuccccaccgaaggccucucccccucacaagucaccauguucccccauauuauagucgacguccgacaacucgaacccguccuaaucccacuaccagacguccguaacaacuucuaucauuacaaccaauccaacgaccccaccauaaaacuuaucgcaaugcucuacacacccuuacgugccaacaacgccggagacgaugucuucaccgucucuugccgcguguuaacccgccccucgcccgacuucgacuucaucuuucuaguaccacccaccgucgaaucacgaaccaaacccuuuuccguccccauacucacgguagaagaaaugaccaacagccgcuuccccaucccccucgaaaagcuauucacaggcccaagcuccgccuucguaguacaaccacaaaacggccguugcaccaccgacggcguccuccucggcaccacccaacuuucccccguaaacaucugcaccuuucgaggagacgucacacacauuaccggaucccgcaacuacacaaugaaccucgccacucaaaacuggaacuccuacgaccccaccgaagaaauaccagcaccccucggcacccccgacuucgucgggaaaauccaaggaguccuaacucaaacaacccgagccgacggcuccacccgcggccauaaagccaccgucuacaccggcuccgccgacuucgcccccaaacucggucgcguccaauucgccacagacaccgacaaugacuucgacgcuaaccaaaauacaaaauucaccccaguaggaguaauacaagacggugacacagcccaccgcaacgaaccccaacaauggguacuccccuccuacuccggccgcaacaaucacaauguacaccucgcuccugccguagcccccacauuccccggcgaacaacuccuauucuuccguuccaccaugcccggaugcuccggauaccccaacauggaccuagacugccuccuaccucaagaauggguccaauacuucuaccaagaagcugcccccgcccaauccgacguagcacuucuucgauucgucaacccugacaccggccgaguacuauucgaaugcaaacuccacaaauccggcuacgucaccgucgcacacaccggacagcacgaucucgucaucccacccaacggauacuuccgcuucgacucaugggucaaccaauucuacacacucgcuccaaugggcaacggcaccggacgacgucgggcccucuaa

SEQ ID NO: 37166 - RNA, 1629 nt, Artificial Sequence
  derived and/or modified sequence opt11 from capsid_protein__Norovirus__BAG68707
augaagauggcuucgaacgacgccgccccauccaccgacggugccgccggccucguccccgaauccaacaacgaagucauggcccucgaaccggucgcaggagccgcccucgccgcacccgucaccggucaaaccaacauaauagaccccuggauccgcgccaacuucguacaagcccccaacggcgaguucacagucuccccacgcaacgccccuggcgaagucuuacucaaucucgaacucggccccgaacucaaccccuaccuagcccaccucgccagaauguacaacggcuaugcaggcggcauggaaguccagguaaugcucgccggaaacgcuuucaccgccgguaaacuugucuucgccgccgucccaccccacuuccccguagaaaaccucucaccccaacaaaucaccauguucccccacguuaucaucgacguacgaacccucgaacccguccuccuaccacucccagacguccgcaacaacuucuuccacuacaaccaaaaagacgaccccaaaaugcgcaucguagcaaugcucuauacuccccuacgcucaaacggauccggagaugacgucuuuacagucaguugccguguacucacccgccccucccccgacuucgacuucacuuaccucgugccaccaaccgucgaauccaaaacaaaacccuucacccuccccauccucacgcuaggcgaacucucuaacucucguuuucccgucucaauagaccaaauguacaccucccccaacgaagucauuucgguccaaugccaaaacggccgcugcacccucgacggagaacuccaaggaaccacccaacuucaagucagcggaaucugcgcuuucaaaggugaagucacagcccaccuccacgacaacgaccaccuauacaauaucaccaucaccaaccuaaacgguucaccauucgaccccuccgaagacauccccgccccacuaggaguacccgauuuucagggccgcgucuuuggaauaaucucacagcgcgacaaacaaaacgccacaggacacaacgaaccggccaaccgaggccacgacgucgucguccccaccuacacagcacaauacacccccaaacucggacagauccaaaucgguacguggcaaaccgacgaccucaccgucaaccaaccagccaaauuuacccccguaggccucaacgacaccgaacacuuuaaccaaugggucguccccagauacgccggcgcccucaaccucaacacaaaccucgcaccauccguagcccccguauuccccggagaacgacuccucuucuuccgcuccuacauaccccucaaaggcggcuacggcaacccagcuaucgacugccuacucccccaagaauggguccagcacuucuaccaagaagcagcucccuccauguccgaaguagcccuaguccgcuacaucaacccugacaccggucgcgcacuauucgaagcgaaacuccaccgggcaggauucaugaccgugucauccaacaccuccgccccugucguaguccccgccaacggcuauuuccgguucgacuccugggucaaccaauucuacucgcuagcaccaauggguacaggcaauggccgccgacgaguucaauaa

SEQ ID NO: 37167 - RNA, 1629 nt, Artificial Sequence
  derived and/or modified sequence opt11 from capsid_protein__Norovirus__BAG68708
augaaaauggcaucaaacgacgccgcaccauccacugacggcgccgccggcuuaguacccgaauccaacaacgaagucauggcccucgaaccagucgccggggccgcacucgcagcaccagucacaggacaaacaaacauaaucgacccuuggauccgagccaauuucguccaagcccccaacggcgaauuuaccguaucaccacgcaacgccccaggcgaaguccuacucaaccucgaacucggccccgaacuaaauccauaccucgcccaccucgcccgcauguacaacggcuacgccgguggcauggaaguacaagucaugcucgccggcaacgccuucaccgccggcaaacucguauucgccgcuguaccaccacauuucccagucgaaaaccucucgccccaacaaaucacaauguuuccacacguaauaaucgacguccguacucucgaaccaguacuacucccccuaccagacguaagaaacaacuucuuccacuacaaccaaaaagacgacuccaagaugcgaaucgucgcaaugcucuacacaccccuccgcucuaauggcagcggcgacgacguuuucaccgucuccugccgcguccuaacccgcccaucacccgacuuugacuucaccuaccucgucccacccaccgucgaauccaaaacaaagcccuucacccuccccauccuuacccucggcgaacucucaaacucacgcuucccaguguccaucgaccaaauguacaccucgccgaacgaagucaucuccguccaaugccaaaacggucgaugcacauuggacggcgaacuucaaggcaccacccaacuucaagucuccggcauaugugcauucaaaggcgaagucacagcccaccuucacgauaacgaccaccucuacaacauaacaaucacaaaucucaacggcucacccuuugaccccucagaagacauaccggcaccccucggaguccccgacuuccaaggacgcguuuucggcauaaucucacaacgcgauaaacagaacgcaaccggccacucagaacccgccaaccgcggccacgacgcaguuguacccacauacaccgcacaauacaccccuaaacucggccaaauucaaaucgggaccuggcaaaccgaugaccucaccgucaaccaaccgguaaaguucacccccgucggccucaacgacaccgaacacuucaaccaauggguagucccucgauacgcaggcgcccucaaccucaacacaaaccucgccccauccguugcccccgucuuccccggagaacgacuccuuuucuuccgcuccuacaucccacuuaaaggcggcuacggcaaccccgccaucgacugccuccucccccaagaauggguccaacacuucuaucaagaagccgcacccucaaugucagaaguagcccuaguacgcuacaucaacccugauaccggccgcgcccuauucgaagcaaaacuacaccgggccggcuuuaugacaguauccuccaacaccucagcccccguaguagcccccgcaaacggcuacuuccgauucgacagcugggucaaccaguucuacucccucgcgccaauggggacaggaaauggccgcagacgcguccaauaa

SEQ ID NO: 37168 - RNA, 1629 nt, Artificial Sequence
  derived and/or modified sequence opt11 from capsid_protein__Norovirus__BAG68709
augaaaauggccuccaacgacgccgcaccauccaccgacggcgccgccgggcucgucccagaauccaacaacgaagucauggcacucgaacccgucgccggcgcagcccuagccgcaccgguaaccggacaaaccaacaucaucgaccccuggauccgcgccaacuucguacaagcacccaacggcgaguucacagugagcccccguaacgccccaggcgaaguccuacucaaccuugaacuaggacccgaacucaaucccuaccucgcccaccucgcccgcauguacaacggcuacgcaggcggaauggaaguacaaguaaugcucgcaggcaacgccuucacagcgggcaaacucgucuucgccgccguacccccacacuuccccgucgaaaaccuauccccacagcaaauaaccauguucccccacgucaucaucgaugucagaacuuuagaacccguccucuuaccccuccccgacguccgaaacaacuucuuccacuacaaccaaaaagacgaccccaaaaugcgcaucguagccaugcucuacacaccccuccgcuccaacgguuccggagacgacgucuucaccgucuccugcagaguccuaacccggcccucccccgacuucgacuucaccuaccucgucccacccaccguagaauccaaaacaaaacccuucacccuaccuauacuuacacugggcgagcuuuccaacucccgcuuccccguaagcaucgaccaaauguacaccucacccaacgaggucauauccguccaaugccaaaacggccgcugcacccuagacggagaacuccaaggcaccacacaacuacaagucagcggcaucugcgcauucaaaggagaagugacagcccaccuccacgacaaugaccaccucuacaacaucaccaucaccaaccucaacggguccccauuugaccccucagaagacaucccggcaccacucggcgucccagacuuucaaggccgagucuucgguaucaucagccaacgcgauaaacagaacgccacaggacacaacgaacccgcaaaucgcggacaugacgcagucguccccacauacaccgcccaguacaccccaaaacuaggacaaauccaaaucggcaccuggcaaaccgaugaccucacagucaaucaaccagucaaauucacgccaguaggccuaaacgacaccgaacacuuuaaccaaugggucgucccacgcuacgccggagcccucaaccuaaacacaaaccuagcacccucgguagcccccguauucccaggcgaacgccuccuauucuuccgcagcuacaucccccucaaaggcggauacggcaaccccgccaucgacugccuccuuccccaagaauggguccaacacuucuaucaagaggccgcccccuccauguccgaaguggcccucgucagauacauaaauccagacaccgggagagcccucuucgaagccaaauuacacagagcaggcuucaugacagucuccuccaacaccucggccccagucgucguccccgcuaauggcuacuuccgcuucgacucauggguuaaccaauuuuacucucuagcccccaugggcaccggcaacggacgccgccgcguccaauag

SEQ ID NO: 37169 - RNA, 1629 nt, Artificial Sequence
  derived and/or modified sequence opt11 from capsid_protein__Norovirus__BAG68711
augaaaauggccucaaacgacgcagcccccucaaccgacggcgccgcaggccuaguucccgaaucaaacaacgaagucauggcccucgaacccguagccggcgccgcacuagccgcacccguaaccggccaaaccaacauuaucgaccccuggauccgugccaauuucguacaagccccuaacggugaguucaccguuagcccacgaaacgcccccggcgaaguccuucuaaaccucgaacuuggucccgaacucaacccauaccucgcccaccucgcccgcauguacaacggcuacgccggcggcauggaaguacaagucaugcucgcaggcaacgccuucacugcaggaaaacucguauucgccgccgucccuccccacuucccaguggaaaaucucuccccacaacaaauuaccauguuuccacacguaauaauagacguccggacccuagagcccguccugcucccccuccccgacgucagaaacaacuucuuccacuacaaccaaaaagacgacccaaaaaugcgcaucgucgccaugcucuacaccccucuucgcucaaacggcuccggagacgacguauucaccguaucgugccgaguucucacccgccccucacccgacuucgacuucaccuacuuagucccacccacaguggaauccaaaaccaaacccuucacccuccccauccucacccucggcgaacucucuaacucacgauuucccgucuccauagaccaaauguacacaucccccaacgaagucauauccguccaaugccaaaauggccggugcacacuagacggcgaacuccaaggcacaacccaacuccaagucucaggcaucugcgcauucaaaggcgaagucacagcccaccuacacgacaacgaccaccucuacaacgucaccaucacgaaccuaaacggcucccccuucgaccccuccgaagacauccccgccccacucgguguucccgacuuccaaggccgcgucuucggaguaaucucacaaagagacaaacacaucgccucuggccauaacgaacccgcaaaucggggacaugacgcaguaguccccacauacaccgcccaguacacacccaaacuaggacaaauccaaauaggaacauggcaaaccgacgaccucaccgucaaccaacccgucaaguuuaccccagucggucuaaacgauaccgaccacuucaaccaaugggucgugccucgauacgccggcgcacuaaaucucaacacaaaccucgcacccagcguagcacccgucuuccccggcgaacgccuccuauucuucagauccuacaucccccuuaagggcggcuacggaaacccagccaucgacugucuucugccccaagaauggguccaacacuucuaucaagaauccgcaccauccauguccgaagucgcucuaguccgauauaucaacccggacaccggccgcgcccucuucgaagcaaaacuccaccgcgcagguuucaugacagucuccucaaacaccuccgccccagucgucguacccgccaacggauacuuccgcuucgacucaugggucaaccaauucuacucacucgcaccaaugggcaccggcaacggacgucgacgcacccaauaa

SEQ ID NO: 37170 - RNA, 1629 nt, Artificial Sequence
  derived and/or modified sequence opt11 from capsid_protein__Norovirus__BAG68712
augaaaauggccagcaacgacgcagcccccuccacagacggcgcagcaggccuaguacccgaaucaaacaacgaagucauggcccucgaaccggucgcaggagccgcucucgccgcaccagucaccggacagacaaacaucaucgacccauggauccgcgccaacuucguacaagcacccaacggcgaguucaccgucagcccccgcaaugcucccggcgaaguacuccuaaaccuagaacucggaccagaacucaaccccuaccuugcccaccuagcacgcauguacaacggcuacgccggcggcauggaaguccagguaaugcuugccggcaacgcauucacagccggaaagcuagucuuugcagccgucccaccccacuuccccgucgaaaaccucagcccccaacaaauaaccauguucccccaugucaucauugacguccgcacacucgaaccgguccuucucccacuccccgauguccgcaacaacuucuuccacuacaaccaaaaagaugaccccaaaaugagaaucguugccaugcucuacaccccacucagaucaaacggauccggcgacgacgucuucacaguuuccugccgcguacuaacacgucccucccccgacuucgacuucacauaccucgucccaccaaccgucgaauccaaaaccaaacccuucacccuccccauacucacacucggcgaacuuuccaacagccgcuucccagucucaaucgaccagauguacacuuccccaaacgaagucaucucaguccaaugccaaaacggucgcugcacccuagacggcgaacuccaaggcaccacucaacuccaagucucaggcaucugcgccuucaaaggagaaguaaccgcacaccuacacgacaacgaccaccucuacaacguaacaaucaccaaccucaacggauccccauucgacccuucugaagacauccccgcuccccuaggcguaccagacuuccaaggccgggucuucggcgucaucucccaacgggacaaacacaacgccucaggccacaacgaaccugccaaccgcggacacgacgcugucgucccuaccuacacagcccaauacaccccaaaacuaggacaaauacaaaucggcacuuggcaaacagacgaccucacggucaaucaaccaguaaaauuuacccccguaggacuaaacgacaccgaacacuucaaccaauggguaguaccuagguacgcaggcgcauuaaaccuaaacaccaaucucgcaccuuccgucgcccccgucuucccuggcgaacgccuacucuucuuccgaagcuacaucccacucaaaggaggguacggcaaccccgcaauagacugccuacucccccaagaauggguccaacacuucuaccaagaagcagcucccuccaugucggaaguagcccucguacgcuacaucaaccccgacaccggacgcgcacuauucgaagcuaaacuacaucgagccggcuucaugaccgucucuuccaacaccuccgcccccgucguagucccugcaaauggcuacuuccgauucgacuccugggucaaccaauucuacucacuugcccccaugggcaccggcaacggccgccgucgcguacaguga

SEQ ID NO: 37171 - RNA, 1629 nt, Artificial Sequence
  derived and/or modified sequence opt11 from capsid_protein__Norovirus__BAG68713
augaaaauggcaucaaacgacgccgccccguccaccgacggagccgccggccuaguccccgaauccaauaacgaaguaauggcccuagaacccguagcaggagccgcccuagccgcacccgucaccggccaaaccaacaucaucgaccccuggauacgagcaaacuucguacaagccccaaacggugaauuuaccgucuccccacgcaacgcgcccggcgaaguucuacuaaaccuagagcuuggaccagaacuaaaccccuaccucgcccaucuagcccggauguacaauggcuacgcaggaggcauggaaguccagguuaugcucgcaggaaacgccuucacggcagguaaacucgucuucgccgccguuccaccccacuuccccgucgaaaaccuaucaccccaacaaaucacuauguucccccacguaaucaucgacguccgaacccuugaacccguccuccucccccuccccgacgucagaaacaacuucuuccacuacaaucaaaaagacgaccccaaaaugcgaauagucgccaugcuuuacacuccccuccgcucaaacggcuccggcgacgacguauucaccgucuccugccgcguacuuacccgccccucacccgacuucgacuucaccuaccucguacccccaacaguugaauccaaaacaaaaccuuucacacucccuauccucacacuaggcgaacuaucaaacucccgcuuccccgucucaaucgaccaaauguacacaucccccaacgaagucaucuccguccaaugucaaaacggccgcugcacccuagacggcgaacuacaaggcacuacccaacuacaagucuccggcauaugcgccuuuaaaggcgaagucacagcccaucuacacgacaacgaccaccuauacaacgucaccauaaccaaccucaacggcucacccuucgaccccucagaagacaucccagcgccccucggcguacccgacuuccaaggccgagucuuuggagucaucagccaacgcgacaaacacaacgccucaggccacaacgaacccgcuaaccgcggccacgacgccgucguccccaccuacacagcccaguacacacccaaacucggacaaauccaaaucggcaccuggcaaaccgacgaccucaccguaaaucaacccguaaaauucaccccagucggccucaaugauaccgaacacuuuaaccaaugggucguaccccgauaugcaggcgcccuaaaccucaacaccaaucucgcccccuccguugccccagucuuccccggcgaacgccuucuauucuuccgcucauacaucccucucaaaggcggcuacggcaacccagccaucgacugccuccuaccacaagaauggguccaacacuucuaccaagaagccgcccccagcaugucagaagucgcacucguccgcuacauaaaccccgacaccggucgcgcacucuucgaagccaaauuacaccgcgcuggcuucaugaccgucuccagcaauacauccgcucccgucguagucccugcaaacggauacuuccgcuucgauuccugggucaaccaauucuacucacucgccccaaugggcaccggcaacggccgccgcagaguccaauag

SEQ ID NO: 37172 - RNA, 1629 nt, Artificial Sequence
  derived and/or modified sequence opt11 from capsid_protein__Norovirus__BAG68714
augaaaauggcauccaacgacgcugcccccuccacagacggcgccgcaggccucguccccgaauccuccaacgaagucauggcccuagaaccaguugccggcgcggcacucgccgcuccagucacaggacaaaccaacaucaucgaccccuggauccgcgcuaacuucguccaagccccaaacggagaauuuacagucuccccucgcaacgcacccggcgaaguccuucucaaccuagaacucggaccugaacucaaccccuaccucgcccaccuagcacgaauguacaacggcuacgccggcggaauggaaguacaagucaugcuagccggaaacgccuucacagccggaaaacuuguauucgccgcaguaccuccccacuuccccgucgaaaaccuaucaccccaacaaaucaccauguucccucacguaauaaucgacguccgcacccucgaacccguucuacuaccccuccccgacguccgcaacaacuucuuccacuacaaccaaaaagaugauccaaaaaugcgaaucgucgcaaugcucuacacccccuuacgcucuaacggcuccggugacgacgucuucacggucuccugccgaguccuaacccguccaucccccgacuucgacuucacauaccuaguaccucccaccgucgaaucaaaaaccaaacccuucacccuaccaauccucacccucggcgaacuuucuaacucccgcuucccaguuuccaucgaccaaauguacaccucuccuaaugaagucaucuccguccaaugucaaaacggucgcugcacacucgauggugaacuccaaggcacaacccaacuucaagucuccggcaucugcgccuucaaaggcgaaguaaccgcccaucuucacgacaacgaccaccuuuacaacguaacaauaacaaaccucaacgguagcccauucgacccauccgaagacauccccgcaccccucggcguccccgacuuccaaggcagagucuucggcguaauaucccaacgcgacaaacacaacgccuccggacacaacgaaccggccaaccgcggccacgacgccgucguaccuaccuacaccgcucaauacacccccaaacucggccaaguccagaucggaacauggcaaacggacgaccucaccguaaaucaaccagucaaauucacacccgucggccugaacgacacagaacacuucaaccaaugggucguaccuagauacgccggagcccucaaccugaacacuaaccucgcccccuccguagcccccgucuuucccggcgaacgacuccucuucuuccgauccuacauaccccuaaaaggcggcuacggcaauccggcaauagacugccuucuaccacaagaauggguacaacacuucuaccaagaagcagccccuucaauguccgaaguugcacuuguacgcuacaucaacccagacacuggccgagcccuauucgaagccaaacuucaccgagccggauucaugaccguauccuccaauacauccgcccccguagucguacccgccaacggauacuuccgauucgacuccugggucaaccaguucuacucccucgcccccaugggaacaggaaacggccgccgccgaguccaauaa

SEQ ID NO: 37173 - RNA, 1629 nt, Artificial Sequence
  derived and/or modified sequence opt11 from capsid_protein__Norovirus__BAG68715
augaaaauggccuccaacgacgccgcccccucaaccgacggcgccgccggccucgucccugaauccaacaacgaaguaauggcccucgaacccguugcaggggccgcacucgccgcccccguaacaggccaaaccaacauaaucgaccccuggauccgagccaacuucguccaagcccccaacggcgaguucacagucucaccccgcaacgcccccggcgaaguccuucucaaccuugaacuaggccccgaacucaacccauaccuugcacacuuagcacgaauguacaacggauacgcaggaggcauggaaguucagguuaugcuugccggaaacgcauucacagcaggcaaacucgucuucgccgccgucccaccccacuuucccgucgagaaccucucaccccaacaaaucaccauguuuccucacgucauaaucgauguacgcacccucgaaccgguacuccucccccucccagacguccgcaacaacuucuuccauuacaaccaaaaagacgacccaaaaaugagaauugucgcaaugcucuacacaccucuacgcucaaacggcuccggcgacgacgucuucaccguguccugccgcguccucacgcgccccucccccgacuucgacuucaccuaccucguacccccaaccguagaaagcaaaaccaaacccuucacccuucccauacuuacacucggcgaacugucaaacucccgcuucccaguaaguaucgaccaaauguacaccuccccaaacgaagucauaucuguacaaugucaaaacggacgcugcacccucgacggcgaacuccagggcacaacucaacuucaagucucagguauuugcgcuuucaaaggugaaguaacagcccacuuacacgacaacgaucaccucuacaacgucaccaucaccaaccugaauggcucccccuucgaccccucugaagacauccccgccccacucggcguccccgacuuccaaggccgcgucuucggcgucauaagccaaagagacaaacacaacucccccggccacaacgaaccugcaaaccgcggccacgacgcugucgucccaacuuauaccgcccaauauacacccaaacucggccaaauccaaaucggcaccuggcaaacugacgaucuuaccgucaaccaacccguaaaauucacucccguuggacucaacgacaccgaacacuucaaccaaugggucguuccccguuacgcgggcgcccucaaccucaacacuaaccucgccccauccgucgccccaguuuuccccggagaacgcuuacucuuuuuccgauccuacaucccccucaagggaggcuauggcaauccugccauugacugccuccucccccaagaauggguacaacacuucuaccaagaagccgcccccucaaugucugagguugcccuaguaagauacaucaaucccgacacaggccgcgcccucuucgaagccaaacuccaccgagcgggcuucaugacuguaagcuccaacaccagcgcacccgucguaguacccgccaacgguuacuuccgcuucgacuccugggucaaccaauucuacucccuagccccaaugggcaccggcaacggccgccgacgcguccaauaa

SEQ ID NO: 37174 - RNA, 1629 nt, Artificial Sequence
  derived and/or modified sequence opt11 from capsid_protein__Norovirus__BAG68716
augaaaauggccuccaacgacgccgcuccaucaacagacggagccgccggccucguccccgaauccaacaacgaaguaauggcacucgaaccagucgccggagccgcucuggcagcaccaguaaccggccaaacaaacaucaucgaccccuggauccgcgccaacuucguccaagccccaaacggagaauuuaccgucucuccccgcaaugcgcccggcgaaguccuccucaacuuagaacucggcccggaacuuaacccauaccucgcccaccuugcccgcauguacaacggauacgccggcggcauggaaguccagguaaugcucgccggcaacgccuucaccgccggcaaauuaguauucgccgcuguaccaccacacuuccccguagaaaaccucucgccccaacaaaucaccauguucccacacgucaucauagacguccgcacucucgaacccguccuccuuccccuccccgauguccgaaacaacuucuuccacuacaaccaaaaagacgaccccaagaugcgcaucguagccaugcucuacaccccucuacgauccaacggauccggcgacgacguauucaccguaucgugccgcguccuuacccgccccuccccagauuucgacuucacuuaccucgucccaccaaccguugaaucaaaaacaaagcccuucacacuucccauccucacacucggcgaacuaucaaauucccgcuuccccguaucuaucgaccaaauguauaccucuccuaacgaagucauaucaguccaaugccaaaacgggcgcugcacccuggacggagaacuccaaggcaccacccaauuacaaguaucuggaauuugcgccuucaaaggagaaguaaccgcccaccuucacgacaaugaccaccucuauaaugucaccauaaccaaccucaauggcucccccuucgacccuuccgaagauauacccgcaccccucggaguccccgacuuucaaggacgcgucuucgguaucaucucccaacgcgacaaacacaauucccccggacacaacgaacccgcaaauagaggucacgacgcagucguucccacauacacagcacaauacacccccaaacucggccaaauccaaaucggcaccuggcaaaccgacgaccucaccgucaaccaacccgucaaguucacccccgucggacugaacgacaccgaacauuucaaccaauggguagucccccgauacgcuggcgcacuaaaccuuaacaccaaccuugcacccuccguagcaccaguauuccccggagaacgccuacucuucuucagaucuuacaucccacucaagggcggcuacggcaaccccgcaaucgacugccuacucccccaagaauggguucaacacuucuaccaagaagccgcccccuccauguccgaagucgcucucguccgauauauaaaucccgacaccggacgagcacuauucgaagccaaauuacaccgagccggcuucaugaccgucucaucaaacacauccgcacccgugguuguacccgccaacggcuacuuccgcuucgacagcugggucaaccaauucuacucacuagcccccauggggaccgguaauggccgccgucgcguacaauaa

SEQ ID NO: 37175 - RNA, 1647 nt, Artificial Sequence
  derived and/or modified sequence opt11 from capsid_protein__Norovirus__BAG68799
augaaaauggcauccaacgacgcagcacccucaaacgacggugcagcaggccucgucccagaaaucaacaacgaagcaauggcucucgaaccagucgccggagcagccauagccgcgccccucaccggccaacagaacauaaucgaccccuggauaaugaacaacuucguacaagcccccggaggugaguucaccgucucucccaggaacuccccuggagaaguccuccucaaccuugaacucggccccgaaauaaaccccuaccucgcccaccucgcacguauguacaacggcuacgcuggcggcuucgaaguacaagucguccucgcaggcaacgccuucaccgcaggcaaaauaauauucgccgcaaucccacccaacuuccccaucgacaaccucuccgccgcccaaauuaccauguguccccacgucauaguagacguccgccaacucgaacccguaaaccucccaaugccagacguacguaacaacuucuuccacuacaaccaaggauccgacucacgucuacgccuaaucgcaaugcucuacacaccccucagagcaaacaacucaggugacgacgucuucacagucuccugucgcguccucacucgucccucaccagauuucuccuucaacuuccugguaccucccacagucgaauccaaaacuaaaccauucucccuacccauccucaccauuucagaaaugucuaacucccgcuuccccguccccaucgacagccuacacacuucaccuacugaaaacaucgucguacaaugccaaaacggacgcguaacucuagacggagaacucaugggaaccacccagcuccuccccucccaaauaugcgcuuuccgaggcguucucacccgcuccacaucacgcgcaagcgaccaagcagacaccgccacaccccgacucuucaacuacuacuggcacauccaacucgacaaccuaaacggcacccccuaugacccagcugaagacauccccggcccccucggcaccccagacuuccgaggcaaagucuucggcgucgccucacaacgcaaccccgacgccaccacucgagcccacgaagccaaaaucgacaccgcaucugggcgcuucacccccaaacuuggcucacucgagauuucaaccgaaucagaugacuucgaccaaaacaaaccaacccgcuuuaccccagucggaauaggaguagaccacgaggaagacuuccaacaauggacacuacccgacuacgccggacaauuuacucacaacaugaaccuagccccagccgucgcucccaacuuccccggagaacaacuccuuuucuuccguucccaacuccccuccuccgguggccguucaaacggcauccucgacugccucguaccccaagaauggguccagcacuucuaccaagaauccgccccaagccaaucgcaagucgcacucguccgcuacauuaaucccgacaccggucgcguccucuucgaagccaaacuccacaaacuaggguucaugaccauugccaaaaacggagacucccccauuacaguucccccuaacggauacuuccgcuucgaaucuugggucaacccauucuacacccucgcacccaugggaacaggaaacggccgccgccgcauucaauaa

SEQ ID NO: 37176 - RNA, 1647 nt, Artificial Sequence
  derived and/or modified sequence opt11 from capsid_protein__Norovirus__BAG68800
augaaaauggccucaaacgacgccgcaccauccaacgacggcgcagccggccuagucccugaaaucaauaacgaagcaauggcccuagaacccgucgccggagcagccaucgccgcaccccucaccggccaacaaaauaucauagacccauggaucaugaauaacuucguacaagcccccgguggagaguucacagucuccccacgcaacucccccggcgaaguccuacuuaaccucgaacucggccccgaaaucaacccauaccucgcccaccuugcccgcauguacaacggcuacgccggcggcuucgaaguacaagucguccucgccggcaacgccuuuaccgcaggaaaaaucaucuucgcugccaucccacccaacuuucccauagauaaccucuccgcugcccaaauaacaaugugcccccacguaaucguggacguccgccaacucgagcccgucaaccuccccaugcccgauguacgaaacaccuucuuccauuacaaccaaggcuccgacucucgccucagacuaaucgccaugcucuacacaccccuacgcgcuaacaacuccggcgacgacgucuucaccguauccugcagaguccuuacaagaccaucccccgacuucuccuucaauuuccuagucccacccacaguagaaucgaaaaccaaacccuucagccucccaauccucacaaucagcgagaugucaaacagccgcuuccccguaccgauagacucccuccacacuucacccaccgaaaacaucguaguacaaugucaaaacggacgaguaacgcucgacggagaacuaaugggaaccacccaacugcucccuucccaaauaugcgcauuccgcgguguccuaacccgaucuacaucacgcgccuccgaccaagcagacacagccaccccacgacucuucgacuacuacuggcacauucagcuagauaaccuuaacggcacaccauacgacccagccgaagacauucccggaccccucggaaccccugacuuccgcggcaaaguauucggcguagccucccaacgcaacccagacaccacaacccgagcccacgaagcaaaaaucgauacagccuccggucgcuucaccccaaaacucggcucucuugaaauaucuaccgaaucagacgacuucgaccaaaacaaaccaacucgcuucaccccagucggaaucggaguagaccacgaagaagacuuccaacaauggacacucccaaacuacgccggccaauucacucacaacaugaaccuagccccagccgucgcccccaacuuccccggugaacaaguccucuucuuccgaagccaacugcccucauccggaggccgauccaauggaauacucgacugccuaguaccccaagaauggguccagcacuucuaccaagaauccgcccccucccaaucucaagucgcccuagucagauacgucaacccagacacaggccgcguccucuucgaagcuaaacuacacaaacuaggauucaugaccaucgcuaggaacggcgacucccccaucaccguaccucccaacggcuacuucagauuugaauccugggucaaccccuucuacacacucgcucccaugggcaccggcaacggacgacgccgaauccaauaa

SEQ ID NO: 37177 - RNA, 1623 nt, Artificial Sequence
  derived and/or modified sequence opt11 from capsid_protein__Norovirus__BAG68801
augaaaauggccuccaacgacgccacccccuccgacggcuccaccgcaaaccuaguacccgaagucaacaacgaagucauggcccucgaacccguaguuggugccgcaaucgccgcccccgucgccggucagcaaaacgucauagaccccuggauccgaaacaacuucguccaagcccccggcggcgaguucaccguaagcccccguaaugcccccggcgaaauccucugguccgcaccacuuggccccgaccucaacccauaccucucccaccucgcccgcauguacaacgguuacgccggcggcuucgaaguccaagucauucucgccggcaacgccuucacugccggcaaaaucaucuucgcagcuguaccacccaacuuccccaccgaaggacucucccccucacaagucaccauguucccccacauaauaguagacguccgccaacucgaacccguccucauuccccugccagacguccgcaauaacuucuaucacuacaaccagagcaacgacccaaccaucaaacucauagcaaugcucuacacaccccuacgagcuaacaacgccggcgaugacgucuucaccgucucuugucguguacucacccgccccucacccgacuucgacuucaucuuccuaguucccccaaccgucgaaucuagaaccaaaccuuucucuguucccauccucaccgucgaagagaugacuaacucccgauucccaaucccccuagaaaaacuuuucacaggcccaucuuccgcauucgucguucaaccccaaaacggccgcugcacaacugacggaguccuccuagguacaacacaacucucaccugucaacaucuguaccuuucguggcgacgucacccacauugcgggcacccaaaacuacaccaugaaccucgccucccaaaacuggaacaacuacgacccaacagaagaaauccccgcuccccuaggaaccccagacuuugucggacgcauacagggagucuuaacacaaaccacccgccgcgacggcuccacccgcggccacaaagccaccguaagcacaggcuccguacauuucacacccaaacugggcuccguccaauucucgacagacacauccaacgacuucgaaaccggccaaaacacccgauucacccccguuggcgucguccaagacggaucaacaacccaccaaaacgaaccgcaacaguggguacucccugacuacucaggccgcgacucccacaacguccauuuagcuccagcgguagcaccaacauuccccggcgaacaauuacuauucuuccgcuccacaaugcccggaugcuccggcuaccccaacaugaaccucgacugccuccucccacaagaauggguccaacacuucuaccaggaguccgcacccgcccaauccgacguagcccuccuucguuucgucaaccccgacacagggcgaguccucuucgaaugcaaacuacauaaauccggcuacguuacagucgcccacacaggacagcacgaccucgucaucccucccaaugguuauuuccgcuucgacuccugggugaaccaauucuacacacucgcacccaugggaaacggcgcuggccgccgccgcgcgcucuaa

SEQ ID NO: 37178 - RNA, 1623 nt, Artificial Sequence
  derived and/or modified sequence opt11 from capsid_protein__Norovirus__BAG68802
augaaaauggccucaaacgacgcaacaccgagcgacggcuccaccgcuaaccuugucccagaagucaauaacgaagucauggcacucgaacccgucgccggcgcagccauagcagcaccagucgccggccaacaaaacguuaucgacccauggauccgcaacaacuuuguccaagccccaggaggcgaguucacaguauccccaagaaacgcucccggcgaaauccuguggucagcaccccuaggacccgaccuaaacccuuaccuaucccaccucgcccgaauguacaacggauacgccggaggcuucgagguccaggucauucucgccggcaacgccuucaccgccggcaaaaucauuuucgccgccguacccccuaacuuccccacagaaggccucuccccaucgcaagucacaauguucccacacaucaucguugacguccgucaacucgaacccguccuaauuccacuccccgacguacgcaacaacuucuaccacuacaaccaaucaaacgaccccaccaucaaacuaauagccaugcuauacaccccacuccgagccaacaacgccggcgaugacgucuucaccguauccugcagaguccucacccgccccucaccugacuucgacuucaucuuccuaguaccacccaccguagaaucccgcacaaaacccuucuccguacccauccuuaccgucgaagaaaugaccaacagccgauuucccauaccgcuagaaaaauuauucaccggucccuccucagcauucgucguccaaccccaaaacggucgaugcaccacagacggcguacuacuaggcacaacccaacucucccccgucaacaucuguacguuccgcggcgacgucacccacauagccaacacccaaaacuacaccaugaaccucgccucccaaaacuggaacaacuacgaccccaccgaagaaauccccgccccacucggcaccccggacuucguaggccgcauccaaggcguccucacccaaacaacaagaggagacggaagcacacgcggucacaaagcuacaguaagcaccggaagcguccacuucacccccaaacuuggcuccguacaauucuccaccgacaccucaaacgaccuagaaaccggacaaaacacacgauucacccccgucggcgucguacaagacggcggaaccacccaccgaaacgaaccacaacaauggguucuccccgauuacucaggacgcgacucccacaacguacaccucgcucccgccguugcccccaccuuccccggcgaacaauuacucuucuuccgcagcaccaugcccggcugcagcggcuacccaaacaugaaccucgacugccuccucccccaagaauggguccaacacuucuaccaagaaucugcccccgcccaauccgacguagcgcuccuccgauucguaaaccccgacacaggacgcguccuuuucgaaugcaaacuacacaaaagcggcuacgucacaguagcacacaccggccaacacgaccuagucaucccaccaaacggauauuucagauucgacucuuggguaaaccaauucuacacacucgcccccaugggaaacggggcgggccgacgccgugcccuauaa

SEQ ID NO: 37179 - RNA, 1623 nt, Artificial Sequence
  derived and/or modified sequence opt11 from capsid_protein__Norovirus__BAG68803
augaaaauggcgucaaacgacgcaaaccccucugauggcuccgccgcaaaccuuguacccgaagucaacaacgaaguuauggcccucgaacccguagucggcgccgccaucgcugcccccguagcaggacagcaaaacgucauagacccuuggauccgcaacaacuucguacaagcccccggaggcgaguucacagucucaccccgcaacgcccccggcgaaauucucuggucugcuccccuuggcccagaccucaaccccuaccucucccaccuagccagaauguacaacggcuaugccggaggcuucgaaguccaaguaauccucgcaggaaacgcauucaccgccggaaagaucaucuucgccgccguacccccuaacuucccaacagaaggacucucacccucucaagucacaauguucccacacauuaucgucgacguccgccagcucgaaccaguacucauaccacuacccgacguacgaaacaacuucuaccacuacaaccaguccaaugacucaaccaucaaacucauagccaugcuauauacaccccuucgugccaacaacgcaggcgaagacguuuucaccgucuccugucgaguccucacccguccaucccccgacuucgacuuuaucuuccuugucccacccaccgucgaaucacgcacaaaacccuucaccguccccauacuaaccgucgaagaaaugaccaacucccgcuuccccaucccccuugaaaaacuauucacuggaccaucaggagcauucgucguccaaccccaaaacggccgcugcacaacagacggaguccuccucggcacaacacaacuaucacccguaaacaucugcacauuccggggcgacguaacccacaucgcaggcucccgcaacuacaccaugaaccucgccucccucaacuggaacaacuacgacccaaccgaagaaauccccgcccccuuaggcacccccgacuucguaggcaaaauccaaggaguccuaacacaaacaacuaaagaagacggcuccacccgcggccacaaagcaacagucuauaccggcucagcccccuucacccccaaacucggauccguccaauucucaaccgacaccgaaaacgacuucgaaacacaccaaaacacaaaauucacccccguaggcgucauacaagacggcucaaccacccaccguaacgaaccacaacaauggguacuaccaucuuacucaggacgcaacguccacaacguccaccuagcacccgcagucgcaccgacauuccccggcgaacaacuccuauucuuccgaucuaccaugcccgguuguuccggcuaccccaacauggaccuagacugccuccuaccccaagaaugggugcaacacuucuaccaagaagcugccccagcccagucagacguagcacuacuucgcuucgucaacccggacaccggccgcguacucuucgaaugcaagcuacauaaauccggauacgucaccguagcccacaccggccaacacgaccucguaauaccaccaaacggcuacuucagauucgacucaugggucaaccaauuuuacacccucgcaccgaugggaaacggcaccggccggcgccgcgcccucuaa

SEQ ID NO: 37180 - RNA, 1623 nt, Artificial Sequence
  derived and/or modified sequence opt11 from capsid_protein__Norovirus__BAG68804
augaaaauggccuccaacgacgccaaccccucagacgggucagcagccaaccucguacccgaagucaacaacgaagucauggcccucgaacccgucguaggagccgccaucgccgcccccgucgcaggccaacagaacgucauagaccccuggauacgaaacaacuucgugcaagccccaggcggcgaauucaccgucucuccccgaaacgcccccggcgaaauacuauggucugccccccuaggccccgaccucaacccauaccucucccaccucgcacgaauguacaacgguuacgccggcggcuucgaaguccaagucauacuagccggcaacgcauucaccgccggcaaaaucaucuucgccgccguuccgcccaacuucccaacagaaggccucucacccucccaagucaccauguucccacauaucaucgucgacguccgccaacuagaacccguacucauaccccuaccggacguccgcaacaacuucuaucauuacaaccaaucaaacgacucaacaaucaaacucauagccaugcuguacaccccccuccgcgccaacaacgccggcgaagacguauucaccguaagcugccgaguacuaacccgccccucacccgacuucgacuucauauuccucguacccccaaccguagaaagccgcacuaaacccuucaccguaccuaucuuaacagucgaagaaaugaccaacucccgcuuccccauuccccucgaaaaacucuucacaggucccuccggugcauucgugguacaaccacaaaacggccgaugcaccaccgauggcguccuccuaggcaccacccaacucucuccagucaauauauguacauuccgcggugaugucacgcacauagccggcucccgcaacuacaccaugaaccuugccucccucaacuggaacaacuacgacccaacagaagaaaucccagcaccacucggaacacccgacuucguaggaaaaauccaaggcguacugacccaaacuaccaagggcgacggcuccacccgcggccacaaagccaccgucuacacuggaucagcuccauucacccccaaacucggcuccguccaguucuccaccgacaccgaaaacgacuucgaaacccaccaaaacaccaaauucacccccgugggcgucauccaagauggcuccacaacacaccgaaacgaaccccagcaauggguccucccaucauacucagggcgcaacguccacaacguccaccucgcaccagccguugcccccaccuuccccggcgaacaacuccucuucuuccguucgaccaugccaggcugcucaggcuaccccaauauggaucucgacugccuccucccccaagaauggguucaacacuucuaccaagaagccgcccccgcccagucagacgucgcacuacuacgauucguuaaccccgacacaggccgcguccuauucgaaugcaaacuucacaaaagcggauaugugaccgucgcccacacaggccaacacgaccucguuaucccccccaacggauacuuccgauucgacucauggguaaaccaauucuacacccuagccccaaugggcaacggcaccggccgccgaagagcuuuauaa

SEQ ID NO: 37181 - RNA, 1623 nt, Artificial Sequence
  derived and/or modified sequence opt11 from capsid_protein__Norovirus__BAG68805
augaaaauggcgucaucagaugcaaaccccuccgacggauccacagcaaaccuaguacccgaagucaacaacgaagucauggcucuagaaccaguugucggcgccgcgauugcagcccccgucgccggccagcagaacguaaucgacccauggauccguaacaacuuuguccaagccccuggaggcgaauuuacaguaucaccccgaaacgcccccggcgaaauccuaugguccgcuccccuaggccccgaccucaaccccuaccucucccaccucgcccgcauguacaacuccuacgccggcggcuucgaaguccaagucauccuugccgguaacgccuucaccgccggcaaaauagucuucgccgcuguuccaccaaacuucccaaccgaaggauuaucucccucucaaguaaccauguucccccacaucaucguugacguacgccaacuagaacccguccuaaucccccuacccgacguccgcaacaacuuuuaccacuacaaccaaucgaacgacccaaccaucaaacucauagcaaugcuauacacuccccuacgugccaacaacgccggagacgacguauucaccgucuccugccgcguccucaccagacccucaccagacuucgacuucaucuuccuagucccacccaccguagaaucccgcaccaaacccuucuccguccccauucuaaccgucgaagaaaugaccaacucgcgauuccccauaccacuagaacgccuauucacaggaccauccucagccuucgucguccagccccaaaacggccgcugcaccaccgacgggguccuccuaggcaccacccagcuauccccugucaacaucugcacauuccgcggcgacgucacccacaucgccggaacccaagaauacaccaugaaccuagccucccagaacuggaacaauuacgaccccacagaagaagucccagcuccucuaggaaccccagacuucaugggcaaaauccaaggcguacucacucaaaccaccagacgcgacggcucaacgcgcggccacaaagccacugucuccaccggcucaguccacuuuaccccaaaacuuggacguauacaauucucaacagauaccuccaacgacuuugaaaccggccagaacaccagauucaccccaguaggaguaguccaagacggcuccaccacccaucaaaacgaaccucaacaauggguacucccaaacuacucaggucgcgacucccauaacguacaccucgcccccgccgucgcacccuccuuccccggagaacaacuccuuuucuuucgcuccaccaugccuggcugcucuggauaccccaauaugaaccucgacugccuacucccccaagaauggguccaacacuucuaccaagaagccgcccccgcacaaagcgacgucgcccuacuccgcuucguuagucccgacacuggccgaguccucuucgaaugcaaacuacacaaaucaggauacguaacggucgcucacacaggccaacacgaccuagucaucccucccaacggauacuuccgcuucgauucgugggucaaucaauuuuauacccuagcccccaugggcaacggcacaggccgccgcagagcccuuuaa

SEQ ID NO: 37182 - RNA, 1623 nt, Artificial Sequence
  derived and/or modified sequence opt11 from capsid_protein__Norovirus__BAG68806
augaaaauggccuccucugacgccaaucccucagacggcuccacagcuaaccucguacccgaaguaaacaacgaagucauggcccuagaacccgucgucggcgccgccauagcagcccccguagccggccaacaaaacguaauagaccccuggauccgaaacaacuucguccaagcccccggcggcgaguucacagucucaccccgaaacgcacccggcgaaauccuuugguccgcuccccucggccccgaucucaacccguaccuaucucaucuagcccgaauguacaacggcuacgccggcggcuucgaaguucaagucauccucgccggcaaugccuucaccgccggaaaaaucguauucgcagccguacccccaaacuuccccacagagggccucucccccucucaagucacuauguucccacacaucaucgucgacguccgacaacuugaacccguucucaucccccuccccgacguacgcaacaacuucuaccacuacaaccaaucuaacgacuccacaaucaaacucaucgccaugcucuauaccccauuaagagccaacaacgccggcgacgauguauucaccgucucaugucgaguacuaacuagaccaucccccgacuuugacuucaucuuccuaguaccucccaccguugaaucccgaacaaaacccuucucggucccuauccucaccguugaagaaaugacuaacucccgcuuccccaucccccucgaaaaacucuucacaggcccaagcucagccuucauaguacaaccucaaaacggccgcugcaccaccgacggcguacuccucggaaccacucaacucucccccgucaacauaugcaccuucagaggcgacguaacccacauugccggcacccaagaauacacaaugaaccucgccagccaaaacuggaacaacuacgacccaaccgaagaaauccccgcaccccuuggaacccccgacuuugucggcaaaauacagggaguacucacccagaccacccgccgagacggaucaacccgaggacacaaagccaccgucucaaccggcuccguccacuucaccccaaaacucgguaggauccaauucuccaccgauacauccaacgacuucgagaccggccaaaacacccguuucacccccguaggcguaguccaagacggaucaacuacccaccagaaugagccccaacaauggguccucccaaacuaccuaggacgagacucgcacaacguccaccucgcaccagcagucgccccauccuuucccggagaacaacuacucuucuuucgcuccaccaugcccggcugcucagguuaccccaacaugaaccuugacugccuucuaccacaagaguggguccaacacuucuaucaagaagccgcccccgcucaauccgauguagcccuccuccguuucguuaacccagauaccggccggguucucuucgagugcaaacuccacaaauccggcuacgucaccgucgcccacaccggccaacacgaccucgucauaccacccaacggcuacuuccguuucgacucauggguaaaucaguucuauacacucgcacccaugggcaacggcaccggacgccgacgcgcccuuuga

SEQ ID NO: 37183 - RNA, 1647 nt, Artificial Sequence
  derived and/or modified sequence opt11 from capsid_protein__Norovirus__BAG68807
augaaaauggccuccuccgaugccacccccucaaaugacggcgccgcaggccucguccccgaaaucaauaaugaggccauggcucucgacccagucgcaggagccgcaaucgcagcaccccuaacaggccaacaaaauaucauagacccauggaucaugaacaauuucguccaagcccccggcggcgaguucacaguaucaccccgaaauuccccaggagaaguccuccucaaccucgaacucggccccgaaaucaaccccuaccucgcccaccucgcccgcauguacaacggauacgccggcggcuucgaaguccaagucguucucgccggcaacgcauucaccgcaggcaaaauaaucuucgccgccauacccccaaacuucccgaucgacaaccucuccgccgcccaaaucaccaugugcccccacguaaucgucgacguaagacaacucgaacccgucaaccuccccaugcccgauguacgcaacaacuucuuccauuacaaccaaggcagcgacucacgacuccgccuuaucgccaugcucuacaccccacucagagcaaacaacagcggagacgacgucuucaccgucucaugccgcguccuuacacgcccuuccccagacuucucauucaacuuccucguacccccaacagucgaaucaaaaaccaagccguucacccucccaauccucaccaucucagaaaugucaaacucacgcuuccccguccccauagacucacuccacacgagccccaccgaaaacauagucguacaaugccaaaacggccgcgucacccuagacggcgaacuaaugggaaccacccaacuccuccccucccaaaucugcgccuuccgaggaguccuuacacgcucaacaucccgcgccucagaccaggcagacaccgccacaccccgccuuuucaacuacuacuggcacauccaacucgacaaccuaaacggaacccccuacgacccagccgaagauaucccggguccacuuggaaccccagauuuccgaggcaaaguauucggagucgccucccaacgcaaccccgacuccaccacacgcgcccacgaagcuaaagucgacaccaccgccggccgcuucacccccaaacucggcucccucgaaaucucaacagaaagcgaugauuucgaucaaaaccaacccaccagauucacccccgucggcauaggcguagaucaugaagcagauuuccaacaauggucacuaccugacuacuccggccaauucacccacaauaugaaccuagccccagccguagccccaaacuuccccggcgaacaacuccucuucuuccggucgcagcucccuucauccggcggccgcucuaauggaaucuuggacugccuugucccccaagaauggguccaacacuucuaccaagagucagcccccgcgcaaacccaaguagcucuaguccgauacguaaaccccgacacuggacgaguccuauucgaagccaaacuccacaaacuaggcuucaugaccaucgccaaaaacggcgauucaccaauaaccguaccacccaacggcuacuuccgauucgaguccugggucaaccccuucuacacucuagcaccaaugggaaccggcaacggccgacgccgcauccaauaa

SEQ ID NO: 37184 - RNA, 1623 nt, Artificial Sequence
  derived and/or modified sequence opt11 from capsid_protein__Norovirus__BAG68808
augaaaauggccuccaacgacgcaaccccuuccgacggcucaaccgccaaccucguccccgaagucaauaacgaaguuauggcauuagaaccaguagucggcgccgccauagcagcccccguugccggccaacaaaacgucaucgacccuuggauccgaaacaacuucguccaagccccaggcggagaguucaccgucucaccccgaaacgccccaggcgaaauccuauggucagcaccccucggaccagaccuaaacccuuaccugucccaccucgcccgcauguacaacggcuacgccggaggcuucgaaguacaagucauacuagccggcaacgccuucaccgccggcaaaaucaucuucgcagccguaccucccaacuuccccaccgaaggccucucccccagccaaguuaccauguucccucacaucauaguugauguacgccagcucgaacccguccuaaucccccuaccagacguucgaaauaacuucuaucacuacaaccaauccaacgaccccaccauaaaacuaauagcuaugcuuuacaccccacuucgcgccaacaacgccggcgacgacgucuucacggacuccugccgcguccucacucgacccucccccgacuucgacuucaucuuccucguaccgcccacaguagaaucccgcacaaaacccuucucuguccccauacucaccgucgaagaaaugaccaacuccagauuccccaucccccuugaaaaacuauucaccggucccucuagcgccuucgucguacagccacaaaacggccgaugcacaaccgacggcguccuccuaggcacaacccagcucucccccgucaacauaugcacuuuccgcggcgacguaacccacauugccggcacucaaaacuacaccaugaaccuggcaucccaaaacuggaacaacuacgauccuaccgaagaaaucccugcuccccucggcacccccgacuucgucgguaaaauccagggaguacuuacacaaaccacccgccgcgacggauccacccgaggccacaaggccaccgucuccacagguucaguacacuucaccccaaaacuaggauccguccaguucucaaccgacaccucuaacgaccuagaaacaggacaaaacacccgauucacccccgucggcgucguacaagacggcagcaccacccaccaaaacgaaccccaacaauggguacuacccgacuacuccggccgcgacucacacaacguccaccucgcucccgcagucgcacccacauucccaggcgaacaacuacucuuuuucagauccacaaugcccgguugcucaggcuaccccaauaugaacuuagacugccuccucccgcaagaauggguccaacacuucuaucaagaauccgcacccgcccaaucagacgucgcccuacuccgcuuugucaaccccgacacgggacgcguccucuucgaauguaaacuccacaaaucuggcuacguuaccguagcccacaccggucaacacgaccuagucauaccucccaacggauacuuucgauucgacuccugggucaaccaauucuauacacucgcccccaugggcaacggcgccggcagacgucgagcucucuaa

SEQ ID NO: 37185 - RNA, 1623 nt, Artificial Sequence
  derived and/or modified sequence opt11 from capsid_protein__Norovirus__BAG68809
augaagauggccucaaacgacgcaaccccaagcgauggcucuaccgcaaaccuaguaccagaaguuaacaacgaaguaauggcucucgaacccgucgucggagcagccaucgccgcccccgucgccggccaacaaaacgucaucgaccccuggauaagaaacaacuucguccaagcccccggcggcgaguucaccguaagcccccgaaacgccccgggcgaaauccucugguccgcuccccuaggccccgaccuaaaccccuaucuaucccaccuagcgcgcauguacaacggcuacgcaggaggcuucgaaguccagguaauccucgcaggcaacgccuucaccgcaggcaagaucaucuucgcugcagucccgccaaacuucccaaccgaaggacucuccccuucccaagucaccauguucccccacaucaucgucgacguccgacaacucgaacccguccucaucccccuaccagacguccgcaacaacuuuuaccacuauaaccagagcaacgaccccacuaucaaacuaaucgccaugcucuacacuccccuacgugcaaacaacgcaggcgacgacguauucaccgacuccugcagaguacucacccgccccucccccgauuuugacuucaucuuccucguaccacccaccgucgaaucccgcaccaaacccuucuccguaccaauacuaaccguagaagaaaugaccaacucacgcuuucccaucccccuugaaaaacucuucaccggaccuuccucggccuucgucguccaaccccaaaacggccgaugcaccaccgacggcguccuccuaggcacaacccaacucucccccgucaacaucuguaccuuuagaggcgacgucacccacaucgccggcacccaaaacuacacaaugaaccucgccucacaaaacuggaacaacuacgaccccaccgaagaaauccccgccccucucggcacaccagacuucgugggcaagauacaaggcguacucacccaaaccacaagaggcgacggcuccacacgaggacauaaagcaacggucuccaccggaagcguccacuucacucccaaacugggcuccguccaauucucaaccgacaccucuaacgaccucgagaccggacaaaacacucgauucacgcccgucggagucguccaagacggaagcacaacccaccaaaacgaaccacagcaauggguccuccccaacuacagcgguagagacucccacaacguacaccuagcacccgccgucgcccccacauuucccggcgaacaacuccuauucuuucguuccacaaugccaggaugcuccggcuacccaaacaugaaccucgacugccuccuaccucaagaauggguucaacacuucuaccaagaaucagcccccgcacaauccgacgucgcucuacuacgcuucguaaaccccgacaccggacgcguccucuuugaaugcaaacuucacaaauccggcuacgucacagucgcacacacaggccaacacgaccucgucauaccaccaaacggauacuuccgcuuugacagcuggguaaaccaauucuacacccuagcgcccaugggaaauggcgcaggccgccgcagagcccuauaa

SEQ ID NO: 37186 - RNA, 1623 nt, Artificial Sequence
  derived and/or modified sequence opt11 from capsid_protein__Norovirus__BAG68810
augaaaauggccucuucugaugcgaaccccuccgacgguagcaccgcaaaccucguaccagaagucaacaacgaaguaauggcccuagagccagucgucggcgcagcaauagcugccccugucgccggccaacaaaacgucaucgaccccuggauacgaaacaauuucguccaagcccccggaggcgaguucaccguuucaccccgaaacgccccuggagaaauacuaugguccgcaccccuaggccccgaccuaaacccauaccuaucacaccuagcccgaauguacaacuccuacgccggcggcuucgaaguccaaguaauucuugcaggcaacgccuucaccgccggaaaaaucaucuucgccgcaguacccccaaacuucccgaccgaaggacuaucacccucccaagucaccauguucccccacauuaucgucgacguccgccagcucgaaccaguccuaauaccacucccagacguccgcaacaacuucuaccauuauaaccaauccaacgacccaaccaucaaacucaucgccaugcuauacacaccccuccgcgccaacaacgccggcgaugacguuuucaccgucuccugccgaguccucaccagaccaucaccagacuucgacuucauauuccuagucccacccaccgucgagucacguaccaaacccuucucagucccaauuuuaacagucgaagaaaugacaaacucccgcuuccccaucccucuagaaaaacuuuucacaggccccucauccgccuucguaguacaaccccaaaauggccgcugcaccaccgacggcguacuccuaggcaccacccaacucucccccgucaauaucuguaccuuccgaggagacgucacccacaucgcuggcacccaagaauauacuaugaaccuagcaucccagaacuggaacaacuacgacccaaccgaagaaauccccgcaccccucggcacacccgacuucguaggcaaaauucaaggcguccuaacccaaacaacccgacgcgacggcagcacccgaggacacaaggccacaguguccaccggcuccguucacuucaccccuaaacuaggccgaauccaauucuccaccgacaccagcaacgacuuugaaacuggccaaaacacccgcuucacacccguaggagucguccaagacggcuccaccacccaucaaaacgaaccccaacaauggguacuccccaacuauuccggucgcgacggccacaacguacaccucgcacccgccgucgcacccucauucccaggcgaacaacuccuauucuuccgcuccacgaugccaggcugcuccggcuaccccaacaugaaucucgacugccuccuaccccaagaauggguccagcacuucuaccaagaagcugcacccgcccaaagcgacgucgcccuucuccgcuucguaaacccagacacaggacgcguccuauucgaaugcaaacuccacaaauccggcuacgucaccgucgcccacaccggccaacacgaccuagucaucccacccaacggauacuuccgcuucgauuccuggguuaaccaauucuacacacuugcccccaugggcaacggcaccggccgccggcgagcccuuuaa

SEQ ID NO: 37187 - RNA, 1623 nt, Artificial Sequence
  derived and/or modified sequence opt11 from capsid_protein__Norovirus__BAG68811
augaaaauggccuccucagacgccaaccccagcgacggaucgacagcgaacuuaguacccgaagucaacaacgaagucauggcccucgaaccaguaguaggagcagccauagcagcccccgucgccggccaacaaaacgucauagaccccuggauccgaaacaacuucguccaagcccccggcggagaguucaccguuagcccacgcaaugccccaggcgaaauccucuggucagcgccucuaggaccagaccuaaaccccuaccucucacaccuagcccgaauguauaacuccuacgccggcggguucgaaguacaaguaauccuagccggaaacgccuucacagccggcaaaaucaucuuugcggccguuccacccaacuucccuacagaaggacuuuccccaucacaagucacuauguucccccacaucaucgucgacguccgacaacucgagccaguccuaaucccacucccagacguccgcaacaacuucuaccacuacaaccaauccaacgacccuaccauuaagcucaucgcgaugcuuuacacaccccuccgggccaacaaugccggcgacgacguauucaccgucucuugucgcguccucacccgcccaagcccagacuucgacuucauuuuccuagucccacccaccguugaaucacgcacaaaacccuucucaguacccauccucaccgucgaagaaaugacaaacucccgcuuccccaucccccuagaaaaacucuucaccggcccuuccuccgccuucguagugcaaccccagaacggucgcugcaccaccgacggaguccuccucggcacuacccaacucucccccgucaauaucuguacauuccgaggcgacgucacccacaucgcaaacacccaagaauacaccaugaaccucgccucccaaaacuggaacaacuacgaccccacagaagaaaucccagcaccacuaggaaccccagacuucgucggcaaaauacaaggaguccuaacccagaccacacgccgcgacggcucuacucgcggacacaaagccacagucuccaccggcucaguucacuucacaccaaaacucggccgcauacaauucuccacugacaccucuaacgacuucgaaaccggccaaaacacacgcuucacccccgucggggucguccaagacggcuccaccacccaccaaaacgaaccacaacaauggguccuccccaacuacucaggaggggacggccacaacguacaccucgcucccgccgucgccccuucuuuccccggcgaacaacuucucuucuucagauccacaaugcccggcugcucaggcuacccuaacaugaaccuagacugccuccucccccaggaauggguccaacauuucuaccaagaagccgcacccgcccaaucugacguugcccuucuccguuuuguaaacccagacaccggcagaguacuauucgaaugcaaguugcacaaaucaggcuacgucacuguagcacacaccggccaacacgaccuaguuauaccgcccaacggguacuuccgauucgacuccuggguuaaccaauucuacacacucgcaccaaugggaaacggcacuggccgacgccgugcccucuaa

SEQ ID NO: 37188 - RNA, 1623 nt, Artificial Sequence
  derived and/or modified sequence opt11 from capsid_protein__Norovirus__BAG68812
augaaaauggccucauccgacgcaaaccccuccgacggauccacagccaaccuaguccccgaagucaacaacgaagucauggcacucgaacccgucgucggcgcagccaucgccgcacccgucgccggacaacaaaaugucaucgaccccuggauccgcaacaacuucguucaggcccccggaggcgaauuuaccgucagcccccgcaacgccccgggcgaaauacucugguccgcgccccucggccccgaccucaacccuuaccucucccaccucgcccgcauguacaacuccuacgccggcgguuucgaaguccagguaauacucgccggcaacgcuuuuaccgccggcaaaaucauauucgcagccguacccccaaacuucccuaccgaaggccucucacccucccaagucacaauguucccacacauaauagucgacguccgccaacucgaacccguucuaaucccacucccggacguacgcaacaacuucuaccacuacaaccaaucaaacgaccccacaauaaaacucaucgccaugcucuacacuccccuacgagcuaacaacgcuggagacgacgucuuuacaguauccugccgaguacucacucgccccucgcccgacuucgacuucauauuccucgucccacccacagucgaaucacgcaccaaacccuucucgguacccauccucaccguagaagaaaugaccaauucacgguucccuaucccccucgaaaaacucuuuaccggcccaucaucagcauucgucguccagccacaaaacggccgauguaccacugacggcguccuucuaggcaccacacaacuaucccccgucaacaucuguaccuuccgcggcgacgucacacacaucgccggcacccaagaauacaccaugaaccuugccucccaaaacuggaacaacuacgaucccacugaagaaaucccagcaccacuaggcacaccagacuucguaggcaaaauucaaggcguccuuacucaaaccacccgcagagacggcucaacacgaggacacaaagcaaccguauccacagguuccguccacuucaccccaaaacuuggacgcauccaauucucgaccgacaccucgaacgauuucgaaaccggccagaacacccgcuuuacuccugucggcgucguucaagacgggagcaccacccaccaaaacgaaccacaacaauggguacucccaaacuacucaggccgcgacucacacaauguccaccuagcucccgccguugccccuucauuccccggagagcaacuacucuucuuccgcuccaccaugcccggaugcuccggauacccuaacaugaaccucgacugccuacucccccaagaauggguccaacacuucuaccaagaagccgccccugcccaaucagacguugcacuccuccgcuucguaaacccagauacuggucgcguccucuucgaaugcaaacuacacaaauccggcuacgucacaguagcacacacuggccaacacgacuuagucaucccucccaacggcuacuuucgcuucgacuccuggguaaaccaauucuauacacuagcucccaugggcaacggcacaggccggcgacgcgcccucuaa

SEQ ID NO: 37189 - RNA, 1623 nt, Artificial Sequence
  derived and/or modified sequence opt11 from capsid_protein__Norovirus__BAG68813
augaaaauggccuccuccgacgcaaauccuucugacggcucaaccgcaaaucuagucccagaagucaacaacgaaguuauggcccuugaacccgucgucggagccgccaucgccgcacccguugccggccaacaaaacgucaucgaccccuggaucagaaacaacuuuguacaagcaccaggcggagaguucaccgucucaccccgcaacgcaccaggcgaaauccuuugguccgcaccccucggccccgaccucaaccccuaccucucacaccuaucacguauguauaacuccuacgcaggcggauucgaaguccaaguaauccuagcuggaaacgcauucaccgcaggaaaaaucauauucgcagccgugcccccaaacuuucccaucgaaggccucucucccucccaagucacuauguucccccacauaaucgucgauguucgccaacuagaaccagugcuaauaccccuacccgacguccgaaacaacuucuaccacuauaaccaauccaacgaccccaccaucaaacuuaucgccaugcucuacacaccccuccgcgcaaacaacgccggugacgacgucuucaccguuuccugccgcguacucacacgucccucccccgacuucgacuucaucuuccucguacccccaaccgucgagucacgcaccaaaccuuucuccgucccuauucuaacaguagaagaaaugaccaacagccgauucccaaccccaguagaaaaacuuuucaccggccccuccagcgccuucaucguccaaccacaaaacggccgcuguacaaucgauggcguacuccuaggaaccacccaacucucacccguuaauauuugcacauuucgcggagacgucacccacaucgccggcacccaagaauacaccaugaaccucgcgucacagaacuggaauaacuacgaccccaccgaagagaucccugcuccccucggaacccccgacuucgucggcaaaauccaagguguccuaacccaaaccacaagacgugauggcuccacccgcggacacaaagccaccguaucaacaggcuccguacacuucacccccaaacuaggucgaauccaauuuucaaccgauacauccaacgacuucgaaacccgacaaaacacccgcuucacaccugucggcgucauacaagacggaucaaccacacaucagaacgaaccccaacaauggguccuccccaacuacuccggacgcgacucccacaacguccaccucgccccagccgucgccccauccuucccaggcgaacaacuccucuucuuccgcuccaccaugcccggcugcuccggcuaccccaacaugaaccuagacugccuccucccccaagaauggguccaacacuucuaccaagaagccgccccugcccaauccgacguggcccuccuacgauucgucaaccccgauacaggacgcgucauguucgaaugcaaacuccacaaauccggcuacauaacagucgcccacaccggccaacacgaccucgucaucccacccaacggcuacuuccgcuucgacgcauggguuaaccaauucuacacccucgcccccaugggaaacggaacaggccgccgcagagcccuauag

SEQ ID NO: 37190 - RNA, 1647 nt, Artificial Sequence
  derived and/or modified sequence opt11 from capsid_protein__Norovirus__BAG68814
augaaaauggccucuaacgacgccgcccccucaaacgacggagcugccggccucguaccugaaaucaacaacgaagcaauggcccucgagccaguagccggagcagccauagccgcaccccucaccggccaacaaaacauaauagaccccuggauuaugaauaacuuuguucaagcccccggaggcgaguucaccgucuccccucgaaacuccccuggcgaaguccuccucaaccuagaacuaggccccgaaauaaaccccuaccucgcccaccucgcccgcauguacaacggauacgccggcggcuucgaaguccaagucguccuagcagggaacgccuucaccgcuggcaaaaucaucuucgcagccauacccccaaacuuccccaucgacaaucucuccgccgcccaaaucacaaugugcccccacgucaucgucgacguccgccaacuagaacccgucaaccucccuaugcccgacguccguaauaacuucuuccacuacaaccagggcuccgacucccgccuucgccugaucgcuaugcucuacacaccucuccgagccaacaacuccggcgacgacguauucaccgucucgugccguguuuuaacucgacccucuccugacuucuccuucaacuuccucgucccacccacaguagaguccaaaacuaaacccuuuuccuuacccauacucacgauauccgaaaugucaaacucccgcuuucccguucccaucgacucccuccacacuucccccaccgaaaacauagucguacaaugccaaaacggccgagucacacucgacggcgaacucauggguacuacucaacuccuccccucucaaaucugcgccuuccgcggcguccuaacucgcuccaccagccgcgccucagaccaagcagacaccgccacaccccgccuuuuuaacuauuacuggcauauacaacucgacaaccucaacggaacccccuacgaccccgccgaagacauccccggcccccucggcaccccugacuuccguggcaagguauucggcguagccucucaacgcaaccccgacacuaccacacgagcccaugaagccaaaaucgacaccaccuccggacgauucacccccaaacucgguucccucgaaaucuccaccgaauccgacgacuucgaccaaaacaaaccaacccgcuucacaccugucggcauaggcgucgaccgagaagucgacuuccaacaaugggcacuccccgacuaugccggucaauucacccauaacaugaaccucgccccugccguagcucccaauuuccccggugaacaacuacuauucuuccgcucccaacuccccucaucaggcggccgauccaauggcauccucgacugccucguaccacaggaauggguccaacauuucuaccaagaauccgcuccaucccaaucacaagucgcccuaguccgcuacauuaaccccgacaccggccgaguccucuucgaagccaaacuucacaaacucggcuucaugaccauagccaaaaacggcgacuccccuaucaccguaccacccaauggguacuuccgcuucgaaucauggguaaauccauuuuauacacuagcaccaaugggcaccggcaacggucgccgacgcauacaauga

SEQ ID NO: 37191 - RNA, 1647 nt, Artificial Sequence
  derived and/or modified sequence opt11 from capsid_protein__Norovirus__BAG68815
augaaaauggccucgaacgacgccgcccccuccaacgacggcgccgccggccucguccccgaaauaaacaacgaagccauggcccucgaacccguugcaggcgccgccaucgccgcaccccuuacaggccaacaaaacaucauagaccccuggauaaugaacaacuucguccaagcaccaggcggcgaauuuacuguaucacccagaaacucacccggcgaaguccuacucaaccucgaacucggaccagaaauaaaccccuaccucgcacaccuagcacgaauguauaacgguuacgcugggggcuucgaaguccaagucguccuagccggcaacgcuuucaccgccggcaaaaucaucuucgccgcaauaccucccaacuuccccaucgacaaucucucggccgcccaaaucaccaugugcccccacguaaucgucgacguacgccaauuagaacccguaaaccucccaaugccugacguccgaaacaacuucuuucauuacaaucagggguccgacucccgccuccgucucauagcaaugcucuacacaccccuccgagcaaacaacuccggcgacgaugucuucaccgucucaugccgaguccuaaccaggccaucacccgacuucucuuucaacuuccuugucccucccaccgucgaaucaaaaacaaaacccuucucucuucccauccucacaaucuccgaaaugucaaacagccgcuuucccgucccaaucgacucccuacacaccucccccacagaaaacauagucguccaaugccaaaacggccgagucacccuugacggcgaacuuaugggcacaacccaacuccuaccaucacaaaucugugccuuccgcggcguccucacccgcuccaccagccgugccuccgaccaagcagacaccgcaacaccccgccucuucaacuacuauuggcacauacaacucgacaacuuaaacggcacccccuacgaccccgccgaagacauccccggaccccucggcaccccagacuuccgcggcaaagucuucggaguagccucccaacgaaacccagacaccaccacacgcgcucacgaagccaaaauagacacaaccagcggccgcuucacacccaaacucggaucacuggaaauauccaccgaauccgacgacuucgaccaaaacaaaccaacccgauucacccccgucgguauaggcgucgaccacgaagucgacuuccaacaaugggcucucccagacuacgccggccaauucacccacaacaugaaccucgcucccgccgucgcucccaacuuccccggcgaacaauuacuauucuuccgcucccaacuacccucuucaggaggacgcuccaacggcauucuagacugccucguaccccaagaauggguccaacacuucuaccaagaauccgcccccucacagucccaaguagcccucguacgcuacauuaaccccgauaccggccgcguacucuucgaagccaaacuacacaaacucggauuuaugaccauugccaaaaacggcgacucccccaucacuguuccucccaacggcuacuuccgauucgaaucuugggucaaucccuucuacacgcucgcccccaugggcacaggaaacggccgucgcagaauccaauag

SEQ ID NO: 37192 - RNA, 1623 nt, Artificial Sequence
  derived and/or modified sequence opt11 from capsid_protein__Norovirus__BAG68816
augaaaauggccagcucagacgcuaaccccuccgacggcucaaccgcuaaccucguccccgaagucaacaacgaagucauggcccucgaacccgucgucggggccgccaucgccgcacccgucgccggccagcaaaacgucaucgacccguggauacgcaauaacuucguccaagccccuggaggagaguucaccguaucuccucgcaacgcacccggagaaauucuuuggucugcaccacuuggccccgacuuaaaucccuaccucucacaccucgcucgcauguauaacggcuacgccggcggcuucgaaguccaaguaauccucgccggaaacgcguucacagccggcaaaauuaucuucgccgccguacccccaaacuucccuacagaaggccucucucccucccaaguaaccauguucccacacaugaucguagacguacgccaacucgaacccguccuaaucccccuacccgacguccgaaacaacuucuaccacuacaaccagucaaacgaccccaccaucaaacucaucgccaugcuauacaccccacuucgagcaaacaaugcaggagacgacgucuucacagucuccugccgcguccucacccgcccaucacccgacuucgacuucauauuccuagucccgccaaccguugaaucccgcaccaaacccuuuucaguacccauccucaccgucgaagaaaugacaaacucccgcuucccaauaccccuugaaaaacucuuuaccggcccaagcuccgccuucguaguacaaccccagaacggacgcugcacaacagacgggguacuacuuggcaccacccaacucuccccagucaauaucugcaccuuccgcggugacgucacccacaucgcaggcacccaagaauacacaaugaaccucgccucgcaaaacuggaacaacuacgaccccacagaagaaauccccgccccacucggaacaccagacuucgucggaaagauccaaggaguacuuacccaaaccacacgcggcgacggcuccacucguggacacaaagccacuguuucaacaggaucaguccacuucacaccuaaacucggccgaauccaguucucgaccgacaccucuaacgauuucgaaaccggccaaaacacccgcuucaccccagucggagucguccaagacggaucuaccacccaucaaaacgaaccccagcaauggguucucccaaacuacuccggccgcgacucccauaacguacaccucgccccugcagucgccccauccuuccccggagaacaacuccuauucuuucgcuccaccaugccaggcugcuccggcuaccccaacaugaaccuagacugccuccucccccaagaauggguacaacacuucuaccaggaggcagccccugcucaaucugacgucgcccuccuccgcuucgugaaccccgacacaggacgcguacucuuugaaugcaaacuccacaaaucuggauacguuaccgucgcgcacacaggccaacacgaccuaguaauuccucccaacgguuacuuccgauucgacuccugggucaaccaauucuacacacucgcccccaugggcaauggaacuggacgccgccgcgcucucuaa

SEQ ID NO: 37193 - RNA, 1626 nt, Artificial Sequence
  derived and/or modified sequence opt11 from capsid_protein__Norovirus__BAH04374
augcgaaugagugauggggcagcaccaaaagccaacggcucagaagccuccggccaagaccucgucccaaccgcagucgaacaagccguccccauccaaccaguagccggagccgcacucgccgcacccgccgccggccaaaucaaccagaucgaccccuggauauuccaaaacuucguccaaugcccccucggcgaguucuccaucucaccccgcaacaccccaggcgaaauacuauucgaccucgcccucggaccaggacucaacccuuacuuagcccaucuuuccgccauguacaccggcugggucggaaacauggaaguccaacucguccucgccggcaacgccuucaccgcaggcaaaguuguuguagcccuaguuccaccauacuucccaaaaggcucacucaccacagcacaaauaaccugcuucccccaugucaugugcgacguucgaacccucgaaccuauccaacucccccuccuugacguacgacgcguacucuggcacgccacccaagaccaagaagaauccaugcgccucgucugcaugcuguacacaccccuccgcaccaauucccccggagacgaauccuucgucguuuccggccgccuccuuuccaaacccgccgcagacuucaacuucguauaccucaccccacccaucgaacgcaccaucuaccgcauggucgaccuaccgguccuccaacccagacuaugcacccacgcccgcuggcccgcucccaucuacggccuccucgucgacccaucauuaccauccaacccacaauggcagaacggccgcguucacguggacgguacccuucuuggcaccacacccgucucgggcagcugggucagcugcuucgccgcagaagccgccuacgaguuccaauccggcaccggagaaguagcaaccuuuacccucaucgaacaagacggcucagcuuacgucccaggagaccgcgcagccccuuuaggauaccccgacuucuccggccaacucgaaauugaaguccaaaccgaaacaacaaagaaaggagaaaaauuaaaaguaaccacuuucgaaaugauacucggccccaccaccaacgucgaccaaguccccuaccaaggucgggucuacgccucccuaacagccgccgcuagccuagaccucgucgacggccgaguaagagcagucccaagaucagucuacggauuccaggacgucgugcccgaauacaacgacggccuccuaguaccacuugcaccacccaucggccccuuccuucccggugaagugcuacuucguuuccgcaccuacaugcgacaaauagacucaaccgaugcagccgccgaagccauugacugcgcccucccacaagaauuugucuccugguucgcaucuaacgccuucacaguccaauccgaagcccuacuccuacguuaccgcaacacauuaaccggacaacuccucuucgaaugcaaacuauauuccgaagguuacaucgcccucuccuacuccggcuccggcccacucaccuucccaacagacggcuucuucgaaguagucuccugggucccccguuuauaucaacucgccucagucggcucccucgccaccggacgcacccuaaaacaauaa

SEQ ID NO: 37194 - RNA, 1626 nt, Artificial Sequence
  derived and/or modified sequence opt11 from capsid_protein__Norovirus__BAH04377
augagaauguccgacggcgccgcacccaaagccaacggcucagaagccuccggacaagaccucgucccaacagccgucgaacaagccguaccaauccaaccugucgccggugccgcacucgcagcuccagccgccggccaaauaaaccaaaucgaccccuggaucuuccaaaacuucguucaaugcccacuaggcgaauuuucaauaagcccccgaaacaccccuggcgaaauccucuucgacuuagcccuaggccccggacuuaacccauaccuugcccaccuuuccgcaauguacaccggauggguaggcaacauggaagugcagcuaguccucgcuggcaacgccuucaccgccggcaaagucgucguagcccucgucccacccuacuuccccaaagguucacugaccacagcccaaaucacaugcuucccccacgucaugugcgacgugcgcacccucgaaccgauccaacucccccuccuagacguacgacgcguccuauggcaugccacccaagaccaagaagaauccaugcgccuuguuugcaugcuauacacaccccuccgcacaaacagccccggagacgaauccuucgucgucuccggccgccuccucuccaaacccgccgccgacuucaacuucgucuaccuaaccccacccauugaacgaaccauauaucguaugguagaccucccaguccuccaaccucgccucugcacccaugcccgauggcccgcucccaucuacggacugcuagucgauccaucucuacccuccaauccccaauggcaaaacggccgaguccaugucgacggcacucuacuaggcacuacaccugucucaggcucaugggucucuugcuucgccgccgaagccgccuacgaauuucaauccggcaucggugaaguagccaccuucaccuuaaucgaacaagacggcucagcauacgucccaggcgacagagccgcaccccucggcuauccagacuucucagggcaauuagaaaucgaaguccaaacugaaacaaccaagaaaggcgaaaaacucaaaguaaccaccuucgaaaugauacucgguccaaccacuaacgucgaccaagugcccuaccaaggacgggucuacgccucccucaccgccgccgcaucacucgaccuaguagacggaagaguccgagccgucccuagaucuguguacggcuuccaagauguugucccagaauacaacgacggucuccuugucccucucgccccacccaucggccccuuccugcccggcgaaguccuacucagauuccgcaccuacaugcgacagaucgacuccaccgacgccgccgccgaagcaaucgacugcgcccucccccaagaauuugucuccugguucgcuuccaacgcauucaccguccaauccgaagcacuccuccuacgcuaccgaaacacccuuacaggacaacuacucuucgaaugcaaacuauacagcgaaggcuacaucgcccucuccuacucaggcucaggcccucucaccuucccuacagauggcuucuucgaagucgucucaugggucccccgccuauaccagcucgcaucagucggaucccuagcaaccggccgaacacuuaaacaauga

SEQ ID NO: 37195 - RNA, 1623 nt, Artificial Sequence
  derived and/or modified sequence opt11 from capsid_protein__Norovirus__BAH29786
augaaaauggcauccucggacgccaaccccuccgacggauccacagcaaaccuuguccccgaggucaacaacgaagucauggcccucgaacccgucguaggugccgccaucgccgcccccguagccggacaacaaaacgucaucgaccccuggauccgaaacaacuuuguccaggccccuggaggcgaguucaccguaucccccagaaacgcccccggagaaauccucuggucagcuccccuaggcccagaucucaaccccuaccucucccaccucgcccgaauguacaacggauacgccggaggcuucgaaguccaagucauccuggccggaaaugcauucacagcaggcaaaauuauauucgccgccguaccaccgaacuucccaaccgaaggcuuaucaccaucacaagucaccauguuuccccacauaauugucgacguucgccaacuagaacccguccuuaucccccuccccgacguacgaaacaacuucuaucacuauaaccaaucaaaugaucccaccauaaaacucauagccaugcucuacacgccccuccgagccaacaacgccggagacgacguauucaccguaucgugccgaguccucacacgccccucccccgacuucgacuucauauuccucguaccaccaacagucgaauccaggaccaaaccauucucaguucccauacucaccgucgaagaaaugaccaacagccgcuuccccauaccccuagaaaaacuauucaccggaccaucuucggcauucgucguccaaccacaaaacggcagaugcaccaccgacggcguacuacuaggcaccacccaacucucacccgucaacaucugcaccuuccgaggagacgucacccacauaacaggcucacgcaacuacacaaugaaucucgccacccaaaacuggaacucuuacgacccaacagaagaaauccccgcaccccuaggcacccccgauuucgucgguaaaauccaaggaguccucacccaaaccaccagagccgacggcagcacccgcggacacaaggccacagucuacaccggcuccgccgacuucgcccccaaacuaggccgcguccaauucgccaccgacacagacaaugauuucgacgcaaaccaaaacaccaaauucaccccugucggcgucauccaagacggcgacaccgcccaccgaaacgaaccacaacaauggguacuaccaucauacagcggccgaaacucacacaacguacaccuggcccccacaguagcccccaccuuuccaggagagcagcuauuauucuuccgaucaaccaugcccggcugcucuggcuaccccaacauggaccucgacugccuacuaccgcaagaauggguccaauacuucuaccaagaagccgcgcccgcccaauccgacguagcgcuccuccgcuucgucaacccugacaccggccgcguccuauucgaaugcaaacuacacaaaucaggcuacgucaccguagcacacaccggccaacaugaccucgucauaccacccaacggcuacuucagauucgacuccuggguaaaccaauucuacacccuagcacccaugggcaauggcacaggccgccgacgcgcgcucuaa

SEQ ID NO: 37196 - RNA, 1623 nt, Artificial Sequence
  derived and/or modified sequence opt11 from capsid_protein__Norovirus__BAH30707
augaaaauggcauccaaugaugccacccccucugacggauccacagcaaaccuaguccccgaagucaacaaugaaguaauggcccuggaaccuguugucggcgccgccauagcagcccccgucgccggccaacaaaacguuauugacccuuggauacgaaacaacuuuguccaagccccuggcggcgaguucaccguuucaccccgaaacgcacccggcgaaauccucuggucugcaccccuuggccccgaccugaacccuuaccuuucccaccucgcccgaauguacaacggcuacgccggcggauucgaaguacaaguaauccuagccggcaacgcauucaccgccggcaaaaucaucuucgcugcagucccaccaaacuuccccacagaaggccucucaccaucccaagucacaauguucccccacaucaucgucgacguccgccaacuugaaccaguccuuauaccacuccccgacgugcgaaacaacuucuaccacuacaaccaaucuaaugaccccacaauaaaacucaucgccaugcuguacacuccccuccgcgccaacaaugccggugacgacgucuucacaguauccugccgcguccuaacccguccaucaccagacuucgacuucaucuuccucguuccacccaccgucgaaucccgcaccaagccauucuccgucccaauccucaccgucgaagaaaugaccaacuccagauucccuauaccccuagaaaaacucuucaccggcccauccagcgccuucgucguccaaccacaaaauggccgcugcaccaccgauggaguccuccucggcacaacccaacucucccccguaaacaucugcaccuuccgaggcgacgugacccacaucucaggaucccgcaacuacacaaugaaccucgcaacccaaaacuggaacuccuaugaccccacagaggaaauccccgccccacucggcacccccgacuucguaggcaaaauucaaggcguccuuacccaaacaacccgcgccgacggauccacacgcggccacaaagccaccguauacacaggauccgccgacuucgcccccaaauuaggacgaguccaauucgccaccgacaccgacaacgacuucgaugccaaccaaaacacgaaauucacccccgucggcgucauccaagacgguaacaccgcacaccgaaacgaaccccaacaaugggucuuacccuccuauuccggcagaaacucucacaacguccaccuagcccccgccgucgccccaacauuccccggugagcaacuacucuucuuccgaucaaccaugccagguugcucaggcuaccccaacauggaccucgauugucuccucccccaagaauggguccaauauuucuaccaagaagccgcccccgcccaauccgacgucgcacuccuacgcuucguaaacccugacacuggaagaguccuuuucgaguguaagcuccacaagagcggcuacgucacaguagcccacaccggacaacacgaccuagucauacccccaaacggcuauuuccguuuugacuccugggucaaucaauucuauacccuagcuccaauggguaauggcacaggccgccgacgagcacucuga

SEQ ID NO: 37197 - RNA, 1653 nt, Artificial Sequence
  derived and/or modified sequence opt11 from capsid_protein__Norovirus__BAL40869
augaagauggcauccaacgacgccgccccaucuaacgacggagccgccaaccuaguaccugaagccaacaacgaagugauggcccucgaacccgucguaggcgccucaaucgccgccccagucguaggccaacaaaacaucaucgaccccuggaucagagaaaacuucguacaggccccacaaggcgaguucacugucucaccccgcaacagucccggagaaaugcuccucaaucucgaacucggacccgaacucaaccccuaccucucucacuuaagccguauguacaacggcuacgcaggaggcaugcaaguccaagucguccucgcaggaaacgccuuuaccgccggcaaaaucaucuucgccgccgugcccccacacuuccccgucgacaacauauccgcagcacaaaucaccaugugcccgcacgucauaguagacguaagacaacucgagcccguccuccuccccuuaccagacauccggaaccgauucuuccauuacaaccaagaaaacacaccccgcaugcgccucgucgccaugcucuauaccccacuuagagccaacuccggcgaggacgucuucaccguaucuugccgaguccucacccgacccgcacccgacuucgaguuuaccuuccugguacccccuacugucgaaagcaaaaccaaaccauuuacucuaccaauccucacccuaggcgaacuaucaaacucccgauuuccugccgcaauagacaugcucuacacagaccccaacgaauccaucguaguacaaccccaaaacggacgcugcacacuagacggcacacuucagggcacaacccaacucguccccacccaaaucugcgcguuccgaggcaccuuaauaucccaaacagcacgcgccguugacuccacagacucuccccaacgcgccagagaccacccccuucacguccaagucaaaaaccucgacggcacacaguacgacccuaccgacgacauccccgcgguccuaggagccauagacuucaagggcaccgucuucggaguagcaucccaacgcgacguaucaggcacacaagaacaaggccacuacgccacacgcgcccacgaagcccacaucgacaccacagaccccaaauacgccccaaaacuaggcacaauccucaucaaaagcgagucccccgacuucaacacuaaccaacccaucagauucacccccgucggcaugggagacaacaacuggcgccaaugggaacuccccgacuacagcggacgccucacccucaacaugaaccucgcccccgcaguauccccaucauuccccggcgaaagaauccucuucuuccgaucaaucgucccauccgccggcggauacggcuccggcuacaucgacugccuaaucccccaagaauggguccaacacuuuuaccaagaagcagcccccucacaauccgcugucgcccucguucguuacgucaacccagacaccggccgcaacauauuugaagccaaacuccaucgcgaagguuuccucaccgucgccaacucuggcaacaaccccaucguggucccacccaacggcuacuucagauucgaagcaugggucaaccaauucuacaccuuagccccaaugggaucuggccaaggccgccgcagagcccaauaa

SEQ ID NO: 37198 - RNA, 1644 nt, Artificial Sequence
  derived and/or modified sequence opt11 from capsid_protein__Norovirus__BAL40870
augaaaauggcaucguccgacgccgcacccagcaacgacggcgcagcuaaccucguccccgaagcuaacaaugaagucauggcccucgagcccgucguuggcgccuccaucgcggcccccguagucggacaacaaaacaucaucgacccuuggaucagagaaaacuucguacaagcaccccaaggcgaguucaccgucagcccccguaacuccccuggagaaaugcuccucaaucucgaacuuggccccgaacucaaccccuaccuaucgcaccucucccgcauguacaacggcuacgccggcggcaugcaaguacaaguaguacuagcaggcaacgccuucaccgccggcaaaaucaucuucgccgccgucccaccccacuucccaguugaaaacauaucagcagcacaaauaaccaugugcccacacguaauagucgacguccgccaguuagaacccguacuccucccacuacccgauauacgaaaccgauucuuccacuacaaccaagaaaacacccccagaaugcgccuaguugccaugcuauacacgccccucagagcuaacaguggagaagacguauucacugucucaugccgcguacuaacccgccccgcccccgacuucgaguucaccuuccuugugccacccacuguagaguccaagacaaaacccuucacucuaccaauccucacccucggagaacucagcaacucaagauuccccgccccaaucgacaugcucuacacagaccccaacgaaggcaucgucguacaaccacaaaacggccgaugcacacucgacggcacacuacaaggcaccacucaacuuguaccaacacaaaucugugcauuucgagguacccucaucggccaaaccucaagaucauccgacucgacagacuccgcaccccgacgccgcgaucacccacuacacguucaacucaaaaaucucgacggcacacaauacgaccccaccgacgaaguccccgccguccuaggcgccauagacuucaaaggaaccguauucggcguagccucccaacgcgacguaagcggccaacaaguaggcgcaacacgcgcacacgaaguccacauaaacacaaccgacccccgauacacaccaaaacucggcuccauccuaaugcacucggaaucagacgacuucgucacaggccaaccagucagauucacuccaaucggaaugggagacaaugacuggcaccaaugggaacuccccgauuacuccggacaccucacccuaaacaugaaccucgccccugccguagcacccgccuucccgggagaacgaauccucuucuuccgcucaauagugccgucugccggcggcuacggcuccggccaaauagacugccuaauaccccaagaauggguccaacauuucuaccaagaagccgcacccucgcaaucagcgguagcacuaauaagauacgucaaccccgacaccggacgcaacaucuucgaggccaaacuccaccgcgaaggauucaucaccguagcaaacuccggcaacaaccccaucgucgccccacccaacggcuacuuccgauuugaagccugggucaaccaauucuauacccuaacacccauggguaccggccagggccgccgccgcaaccaguag

SEQ ID NO: 37199 - RNA, 1644 nt, Artificial Sequence
  derived and/or modified sequence opt11 from capsid_protein__Norovirus__BAL40871
augaaaauggcuuccaaugacgccgcccccuccaacgauggugccgccaaccucguaccagaagccaacaacgaagucauggcccucgaacccgucgucggagccuccauagccgcaccaguagugggccaacagaacaucaucgacccauggauucgagaaaacuuuguccaggcaccccaaggagaguucaccgucuccccucgcaacuccccaggcgaaaugcuccuaaaccucgaacucggucccgaacucaaccccuaccucagccaccucucccgcauguacaacggcuacgccggaggcaugcagguacaagucguccucgccggcaacgccuucaccgcaggcaaaaucauauucgccgcaguacccccacacuuuccugucgaaaacaucucugcugcccaaauuacaauguguccccacgucauuguagauguacgucaacuagaaccaguacuccuaccacuccccgauauccgaaaccgauucuuccacuacaaccaagaaaacaccccacgcaugcgccucgucgccaugcucuacacaccccuccgagccaacuccggagacgacgucuucacggucucgugucgaguccucacccgccccgcaccugacuuugaguucacauuccucgucccgcccacagucgaauccaagaccaaacccuucacccuacccauccugacacucggagaacucucaaauuccagauuccccgccccaaucgacaugcuauacaccgaccccaacgaaggaaucgucguccaaccccaaaauggccgcugcacccucgacggcacccuccaaggcacaacccaacucguacccacccaaaucugcgccuuccgaggcacacucaucggacaaaccucccgcuccuccgacuccaccgacuccgcaccccgacgucgcgaccacccgcuccacguccaacugaaaaaccuagacggaacccaauacgacccaacagacgaaguacccgccguccuaggagcaauugacuucaaaggcaccguauucggcguagcaucccaacgcgacgucucaggccaacaagucggagccacucgagcacacgaaguccacaucaacaccacagacccccgcuacacaccaaaacuaggcuccauccucaugcauucagaaucagacgacuucguaacaggccaaccagucagauucacuccaauaggcaugggggacaaugacuggcaccaaugggaacuaccugacuacucaggccaccuaacccucaacaugaaccuugcaccagccguggccccagccuucccaggagaacgaauacucuucuuccgcuccauggucccauccgccggaggguacggcucuggccaaaucgacugccucaucccccaagaauggguccaacacuucuaccaagaagcagcccccucccaauccgccguagcccucauccguuacgucaaccccgacaccggccgcaacauauucgaagccaaacugcaccgcgaaggcuucaucacagucgccaacucuggaaacaaccccaucgucguuccucccaacggauacuucagauucgaagcgugggucaaccaauucuacacccuaacccccaugggcaccggacaaggccgacgccgcaaccaauag

SEQ ID NO: 37200 - RNA, 1644 nt, Artificial Sequence
  derived and/or modified sequence opt11 from capsid_protein__Norovirus__BAL40872
augaaaauggccagcaacgacgccgcucccucaaacgauggugccgccaaccuaguccccgaagccaacaacgaaguaauggcccucgaacccguaguaggagccucgaucgccgcccccgucgucggacagcaaaacauaaucgaucccuggauccgcgaaaacuucguccaagcaccccaaggcgaguucaccgucuccccucgcaacucccccggcgaaaugcuccuuaaccuagaacuuggccccgagcucaaucccuaccucucacaccuaucccgcauguacaacggcuacgcaggcggaaugcaaguccaaguugugcucgcaggcaacgcauucacagcuggcaaaaucauauucgccgccguaccuccccacuucccagucgaaaauauuuccgccgcacaaaucaccaugugcccccacgucaucgucgacguccgacaacucgaacccguccuccucccucucccagauauacgaaaccgcuucuuccacuacaaccaggaagacacuccccgcaugcgccuuguagccaugcucuacaccccucuccgagcuaacucuggagaagacgucuucaccgucuccugccgcguacuaacccgucccgcccccgauuucgaguucaccuuucucguaccuccaaccguugaaucaaaaaccaagccauucacccuccccauacucacccuaggugaacuaagcaacucccgcuuccccgcccccaucgacaugcuuuauaccgacccgaacgaaaccaucguaguccaaccacaaaacggccgauguacccuugauggaacacuacaaggaacuacacaacucguuccaacccaaaucugcucauuccgaggaacccucaucagccagacaucacgaucggccgacuccacugacucagcaccccgcguacgcaaccauccccuccacguccaacucaaaaaucuagacggcacccccuacgauccaaccgacgaaguccccgccguacuaggagccaucgauuucaaaggcaccgucuucggcgucgcaucucaacgaaacaccacaggaaacagcgucggcgccacccgcgcccacgaaguacacaucgacacaacuaacccccgcuacacgccaaaacuaggauccguccuaaugaacuccgaaucaucugacuucgacgacggacaacccaccuguuuuacuccgaucggcaugggagccgacgacuggcaccagugggaacugcccgaauacucaggacaccucacacuaaacaugaaccucgcccccgccgucgcacccgcauuccccggcgaacgaauacucuucuuccgcuccgucguaccauccgccgguggcuacggauccggccaaaucgacugccucauaccccaagaguggguccaacacuucuaccaagaagccgcccccagccaauccgcagucgcccucauacgcuacguaaaccccgacacaggccgaaacauauuugaagccaaacuccaccgcgaaggcuucaucaccguagccaauuccggcaacaacccuaucgucguucccccuaacggcuacuuccgcuuugaagcauggguaaaccaauucuacacccuaacacccaugggaacaggacagggcagacgacgggugcaauaa

SEQ ID NO: 37201 - RNA, 1644 nt, Artificial Sequence
  derived and/or modified sequence opt11 from capsid_protein__Norovirus__BAL40873
augaaaauggccuccaacgacgcagccccauccaacgacggagccgcaaaccuugucccugaagcaaacaacgaaguaauggcacuugaacccguagccggcgccucaaucgcagccccaguagucggccaacaaaacaucaucgaccccuggauacgcgaaaauuucguccaagcgccccaaggcgaguucaccgucuccccacgcaauagcccaggcgaaaugcuauuaaaccucgaacucggcccagaacuaaaccccuaccucucccaccucucaagaauguauaacggauacgcuggcggaaugcaaguccaagucguacuugccggcaacgcauucaccgcaggaaaaaucauauucgccgcagugcccccacacuuccccguagaaaacaucuccgccgcacaaaucaccaugugcccccacguaaucgucgacgucagacaacucgaacccguccuccucccccuccccgacaucagaaacagauucuuccacuacaaccaagaagacacaccccgcaugcgccucguagcaaugcucuacacaccucuaagagcaaacucgggcgaggacgucuuuacagucucaugccggguccucaccagaccugcucccgacuuugaguucacauuccucguaccacccacggucgaguccaaaaccaaacccuucaccuuacccauacucacacucggcgaacucagcaacucccgcuuccccgccccaaucgacaugcuguacacagaccccaacgaaacaaucgucguccaaccgcaaaauggacgcugcacccucgauggcacccuucaaggcaccacccaacucguccccacccaaaucuguucauuccgcggaacacuuaucucccagacuucccguucagcagacagcacagacuccgccccgcgcguacguaaccacccccuccacguacaacucaaaaaccuagacggcacccccuacgaccccaccgaugaaguccccgccguccucggcgccaucgacuucaaaggaacaguauucggcguagccucacagcggaauaccacuggcaacuccguaggcgcgacacgagcucacgaaguucacauagacaccacaaacccaagauacacaccaaaacuaggaucgguccucaugcacucagaaucauccgauuucgacgacggccaaccaaucucuuucacuccaaucggcaugggcgccgacgacuggcaccaaugggaacuacccgaauacuccggccaccuaacccucaacaugaaccuagcccccgcggucgcacccgcauuccccggcgaacgaauccucuucuuuagaucagucguaccguccgccggaggcuacgguagcggccaaaucgacugccucaucccccaagaauggguacaacacuucuaccaagaagcggccccaucccaauccgccgucgcccucguacgauacguuaaccccgacacuggccgcaacaucuucgaagcaaaacuucacagagaagguuuccugaccgucgccaacagcgggaacaaccccauagucguaccacccaacggauacuuccgauucgaagccugggucaaccaguucuacaccuuaacccccaugggcacaggccagggacgccgccgcguccaauag

SEQ ID NO: 37202 - RNA, 1626 nt, Artificial Sequence
  derived and/or modified sequence opt11 from capsid_protein__Norovirus__BAL60900
augcgcaugucagacggcgcagcgccaaaagccaacggcucugaagccuccggacaggaucucguacucaccgccgucgaacaggccguaccaauacaacccguagcgggcgccgccuuagccgcacccgcagccggacaaaucaaccaaauagaccccuggauauuccaaaacuuuguacaaugcccacucggagaguucuccaucucaccucgcaacacccccggagaaauacuauucgaccucgcccuaggcccaggacucaaccccuaccucgcacaccucuccgccauguacacaggcugggucggcaacauggaaguccaacucguucuagccgguaacgcuuucaccgcaggcaaagucguagucgcccucguaccgcccuauuuccccaagggaucccuuacgaccgcccaaauaaccugcuuuccccacgucaugugugacguccgcaccuuagaacccauccaacucccccuccucgacguccgcagaguccucuggcacgccacacaagaccaagaagaauccaugcgccucguuugcauguuauacacgccccuccgcaccaacuccccaggagacgaaucauucgucgucuccggccgacuccucaguaaaccggcagcugacuucaacuucguauaccuaaccccacccauagaacggaccaucuaccgcaugguggacuuacccguccuccaaccccgacuaugcacccacgcccguuggccagccccgguauacggccuccucgucgacccaucccuaccaucaaacccacaauggcaaaacggacgcguccacgucgacggaacacucuuagguaccacacccgucuccggcuccugggucuccugcuucgcggcugaagccgccuacgaauuucaaagcgguaccggagaaguagccaccuucacccuaauagaacaagauggcuccgcauacguccccggcgaaagagccgcaccccucggcuacccagacuuuucaggccagcucgaaaucgaaguccaaaccgagacaacuaaacgcggcgagaaacucaaagucacaaccuucgaaaugauccucggacccacuacuaacgucgaccaagcccccuaucaaggccgagucuacgccucccucucagccgcagcaucacuugaccucguagacggcagaguccgcgccgucccccgauccaucuacggcuuccaagacgucauacccgaguacaacgacggccuacucguaccacuagccccacccauaggacccuuccuaccaggugaaguacuccuccguuuccgaacauacaugagacaagucgacuccucagacgccgcugccgaagccaucgacugcgcacucccccaagaguucgucucgugguucgcauccaacggauucacgguccaauccgaagcccuucuauuacgcuaccgcaacacacuuaccggccaacuccuauucgaaugcaaacucuauucagaaggauacaucgcacucucauacucaggcucaggacccuuaacuuuccccaccgacggauucuucgagguagucuccuggguaccccgccucuaccaacucgccagcgucggaagccuugugaccggccgcacccucaaacaauaa

SEQ ID NO: 37203 - RNA, 1623 nt, Artificial Sequence
  derived and/or modified sequence opt11 from capsid_protein__Norovirus__BAQ55211
augaaaauggccucaaacgacgccagccccucagacggcuccaccgccaaccucguacccgaagucaacaacgaaguaauggcucuagaacccgucgucggcgcagccauagccgccccgguugccggccaacaaaacguaaucgaccccuggauccgaaauaacuuuguccaagcccccgguggcgaauuuacagucucuccacgcaacgcccccggagaaauacucuggucagcaccccucggccccgaccucaaccccuaccucucccaccuagcccgaauguacaacggcuacgcaggcggcuucgagguccaagucauccuagccggcaaugcauucaccgccggaaaaaucaucuucgccgccguaccacccaacuuccccacagaaggucucuccccaagccaaguaacaauguucccccacaucauugucgacguccgccaacuagaaccaguucucaucccacugcccgacguccguaacaacuucuaccacuacaaccaaucuaacgacuccaccaucaaacuaaucgccauguuauacacgccccuccgagcaaacaacgccggugacgacgucuucaccgucuccugccgcguccuaacccgaccaucacccgacuucgacuuuaucuuccucgucccacccaccgucgaguccagaaccaaacccuucaccguccccauacucaccguagaagaaaugacaaacucccgguuccccauaccccuugaaaaacucuuuaccggccccagcuccgccuucgucguccaaccacaaaacggucgcugcaccacagacggaguucuccuaggcaccacacaacucuccccugucaacauaugcaccuuccgcggcgacguaacacacauacccggcaccucaaccuaccgaaugaaccucgcaucccaaaauuggaauaacuacgacccaaccgaagaaauacccgcaccccucgguacccccgacuucgucgguaagauccaaggcaugcucacacaaacaaccaaaggcgacggcuccacccgaggccacaaagccacugucucuaccggcuccguugauuucacccccaaacucggauccguacaauucgccaccgacaccgacaacgacuucgaaacgggccaaaacacccgauucacuccaguuggcgucauacaagacggcuccggagcacaccgaaacgaaccccaacaauggguccuacccaacuacuccggcagaaccguacauaacguccaccuagccccagccgucgcccccacauucccaggcgaacaacuacuauucuuucgcuccacgaugccuggcugcuccggcuaccccaacauggaccucgauugcuuacuaccccaagaauggguccaacacuucuaccaagaagccgcccccgcccaaucugacguagcccuucuacgauucguaaacccagacaccggccgcguucuauucgaaugcaaacuccacaaaaccggauacgucaccguagcucauaccggacaacacgaccucgucaucccucccaacggauauuucagauucgacagcuggguuaaccaauucuacacccucgcccccaugggcaacggcgcaggccgacgucgcgcucuauaa

SEQ ID NO: 37204 - RNA, 1623 nt, Artificial Sequence
  derived and/or modified sequence opt11 from capsid_protein__Norovirus__BAQ55212
augaaaauggccuccaacgacgccuccccguccgacggcuccaccgccaacuuaguccccgaagucaacaacgaagucauggcacucgaacccguugugggcgcagcaauugcugcucccgucgccggacagcaaaacguuauagaccccuggaucagaaacaacuucguccaagcaccaggaggcgaguucaccguauccccacgaaacgcccccggcgaaauccucuggucagcaccacuaggcccggaccucaacccuuaccuaucccaccucgcccguauguacaacggguacgcaggaggcuucgaaguccaagucauccucgcaggcaacgccuucaccgccggaaaaaucaucuucgcagccgucccacccaacuuccccaccgaaggacuuuccccaagccaagucacaauguucccccacauaaucguagauguucgccaauuagaaccuguccuuauaccccuaccugacguaagaaacaacuucuaccacuacaaccagucgaacgacuccacuauuaaacucaucgccaugcuauacacaccccuacgugccaacaacgccggugacgacgucuucaccguaucaugccgcguccucaccagacccuccccagacuucgauuucauauuucucgugccacccaccguagaaucccgcacaaagcccuucacaguccccauccucacaguugaagaaaugaccaacucccgauuccccaucccccucgaaaaacucuucacaggccccuccucagccuucguuguacaaccccaaaacggccgcugcaccacagacggaguccuccucggaacaacccaacuauccccaguaaacauaugcacauuccgcggagacgucacucacauaccuucaacccgaacauaccgaaugaaccuugcaagccaaaacuggaacaacuacgaccccaccgaagaaaucccagcuccccucggcaccccagacuucguaggcaaaauacaaggaaugcucacccaaacaaccaaaggcgacggcucuacccgaggccacaaagccaccgucucaaccggcagcguagacuucacacccaaacucggcucaguccaauucgcaacugacaccgacaacgacuucgaaaccggccaaaacacgcgcuucacccccgucggcgucauccaagacggcucauccgcacaccgcaaugaaccacaacaauggguucuacccgacuacucaggacgaaccguacacaacguccaccuagcccccgccgucgcccccacauuccccggcgaacaacugcuauuuuuccgcuccaccaugcccggaugcagcggauaccccaacauggaucuagacugcuuacuaccacaggaauggguccagcacuucuaccaagaagccgcuccagcacagucagacgucgcccuccuccgauucgucaaccccgacacuggucgcguccuauuugaaugcaaacuccacaaaacuggcuacgucacggucgcccacaccggccaacacgaccuagucauacccccaaacggcuauuuccgauucgauagcuggguaaaccaauucuacacacucgccccaaugggcaacggagccggacgacgccgcgcacucuag

SEQ ID NO: 37205 - RNA, 1620 nt, Artificial Sequence
  derived and/or modified sequence opt11 from capsid_protein__Norovirus__BAQ55213
augaagauggccucaaacgacgcaucccccagcgacggaagcaccgcaaaccucguacccgaagucaacaacgaagucauggcguuagaacccguuguaggcgccgccaucgccgccccagucgcuggccaacagaacgucaucgaccccuggauccgcaauaacuucguacaagccccuggcggagaguucaccgucuccccgcgcaaugcaccaggcgaaauccucugguccgcgccucuaggccccgaccucaacccauaccuuucccaccuggcacguauguacaacggcuacgccggcggcuucgaaguacaggugauccuagccggcaacgcguucacugccggcaaaauaauauucgcugccguuccacccaacuuccccaccgaaggacucucacccucucaagucaccauguucccccacaucaucguugacguccgccaacuagaaccuguccuaaucccacuccccgauguacgaaacaacuucuaccacuacaaccaaucaaacgacuccaccaucaaacuuaucgccaugcucuacaccccacuacgcgccaacaacgccggcgacgacguuuucaccgucucaugccgcguccuaacccgaccaagccccgacuucgacuucauauucuuaguaccacccacagucgaaucccguacaaaaccauucaccgucccuauacucaccguugaagaaaugaccaacucucgcuucccgauaccccucgaaaaacucuucacaggacccuccucugcauucgucguacaaccccaaaacggucgaugcacaaccgacgguguacuccucggcacaacccaacuuucgccuguaaacauaugcaccuuccgcggcgacguaacacacaucuccggcaccuccaccuaccgcaugaaccuugccagccaaaacuggaacaacuacgaccccaccgaagaaauccccgcaccacuaggcacuccagacuucgucggcaaaauccaaggcaugcucacacagacaaccaaaggcgacggaagcaccagaggccacaaagccacagucuccaccggcucagucgacuucacacccaaacucggcagcguacaauucgacaccgacaccaacaaugaccuugaaacaggccaaaacacccgauucaccccaguaggcgucauccaagacggaucagcccaccgcaacgaaccccaacaauggguacuacccgacuacuccggacgaaccguacacaauguucaccuugcucccgccgucgccccaacauuccccggcgaacaacuccucuucuuccgaucaacaaugccaggcugcuccggcuaccccaacauggaccucgacugccuccucccccaagaauggguacaacacuucuaccaagaagccgcccccgcccaguccgacguagcccucuuacgcuucgucaaccccgacacaggccgcguacuauucgaaugcaaacuucacaaaaccggcuauguuaccguagcccacacaggccagcacgaccucgucaucccacccaacggcuacuuccgcuucgacuccuggguaaaccaguucuacacccucgcccccaugggcaacggagccggccgccgccgcgcccuauaa

SEQ ID NO: 37206 - RNA, 1623 nt, Artificial Sequence
  derived and/or modified sequence opt11 from capsid_protein__Norovirus__BAQ55214
augaaaauggcauccaacgacgccucccccucagacggcuccaccgcaaaccuggucccagaagucaacaaugaaguaauggcacucgagcccgucgucggagccgccauagcagcccccgucgccggccaacaaaacgucaucgacccauggaucagaaacaacuucguacaagcccccggcggcgaguucaccguauccccgcgcaacgcaccaggagaaauccucuggucugcaccccucggacccgaccucaaccccuaccucucccaccuagcccgcauguacaacggcuacgccggaggauucgaaguccaaguaauacuagccggcaaugcauucaccgcuggcaaaauuaucuucgcagccguacccccuaacuucccaacugaaggacucuccccaagccaagucacaauguucccacacauaaucgucgacguccgccaacuugaacccgucuuaaucccucuccccgacguccgcaacaacuuuuaucacuacaaccaauccaacgacuccaccaucaaacucauagcaaugcuauacacgccccuccgcgcgaauaacgcgggagacgacgucuucaccgucuccugccgaguucucacccgccccucccccgacuucgacuucaucuuccuugucccaccaacaguagaaucacgcaccaaaccauucaccguccccauacuaaccgucgaagaaaugacuaacuccagauuccccauccccuuagaaaaacucuucaccggcccaucaucagccuucguaguacagccccaaaacggccgaugcaccaccgacggaguauuacucggcaccacccaacuaucccccgucaacaucuguaccuuccgcggcgacguaacacacaucucaggcaccagcacguaccgaaugaaccuagcaucccaaaacuggaacaacuacgacccaacagaagaaauaccagcaccccucggcaccccagacuucguaggaaagauacagggcaugcucacccaaaccacaaaaggugacggcuccacacgcggacauaaagccaccgucucaacaggcuccgucgacuucacccccaaacucggcagcguccaauucgccacugacaccgacaaugacuucgaaaccggccaaaacacacguuucacccccgucggcguaauacaagacggaucaggcgcccaucgcaacgaaccccaacaauggguccuccccgacuacuccggcaaaacaguccauaacguccaccucgccccagcaguagccccuaccuuccccggugaacaauuacuauucuuccgcucuaccaugcccggaugcuccggauaccccaacauggaccucgauugccuccucccgcaagaauggguccaacacuucuaccaagaggccgcccccgcacaauccgacgucgcccuccuccgauucgucaacccagacaccggcagaguccucuuugaaugcaaacuccacaaaaccggcuacguaaccgucgcccacaccggacaacacgaccuaguaauaccaccaaacggcuacuucagguucgacuccuggguaaaccaauucuacacucucgccccaaugggcaacggcgcaggccgcagacgagcccucuaa

SEQ ID NO: 37207 - RNA, 1620 nt, Artificial Sequence
  derived and/or modified sequence opt11 from capsid_protein__Norovirus__BAQ55215
augaaaauggccuccaacgacgcgucccccuccgacgguuccaccgccaaccucguccccgaaguaaacaaugaaguaauggcccuagaaccugucguaggcgccgccaucgcagccccagucgcuggacaacaaaacgucaucgaccccuggauccgcaacaacuucguucaggcacccggaggcgaauuuacaguaucuccacgaaacgcccccggagaaauacucugguccgcaccacuuggcccagaccucaaccccuaccucucccaccucgcacguauguacaacggcuaugccggcggcuucgaaguccaagucauccuagccggaaacgccuucaccgccggcaaaaucaucuucgccgccguaccaccuaacuuccccacagaaggccucucccccucccagguaacaauguucccccacauaaucguggacguccgccaacuagagcccguccuuaucccacucccagauguccgcaacaacuucuaccacuacaaccaauccaacgacucgacaaucaaacuaaucgccaugcucuacacgcccuuacgcgccaacaacgccggcgacgacgucuucacaguuucaugccgcguauuaacacgccccagccccgacuucgacuucaucuuccucguacccccaaccgucgaaucaagaaccaaacccuucaccguccccauccucaccgucgaagaaaugaccaacucacgcuuccccaucccccucgaaaaacuauucacaggaccauccuccgccuucgucguacaaccccagaacggccgaugcaccaccgacggcguacuucucggaaccacccaacuauccccagucaacaucugcacauuccgcggcgacguaacacacauccccgggacacgaacauaccgaaugaaucuagcuagccagaacuggaacaacuacgacccaaccgaagaaauaccugcaccccuaggaacccccgacuucguggguaaaauccaaggcaugcucacccaaacaaccaagggagacggcuccacccgcggccacaaagccacaguaucuaccggcucagucgacuuuaccccaaagcuaggcuccgugcaauucgacacugacacaaacaacgaccuagaaaccgggcagaacaccagauucacccccgugggcgucauccaagacggcucagcccaccgcaacgaaccacaacaauggguccuaccagacuacuccggacgcacaguccauaacgugcaccucgccccagccgucgccccaacuuuccccggcgaacaacuucuauucuuuagauccaccaugcccggaugcuccggcuaccccaacauggaucuagacugccuccucccccaagaauggguccaacacuucuaccaagaagccgccccugcacaaucggacguagcccuucuccgcuucgucaaccccgacaccggccgcguacuauucgaaugcaaacuccacaaaacaggcuacgucacaguagcacacacaggccaacacgaccucgucauuccacccaacggcuacuuccgcuucgacucuugggucaaccaauucuauacccucgcacccaugggaaacggcgcuggacgccgccgcgcccucuaa

SEQ ID NO: 37208 - RNA, 1620 nt, Artificial Sequence
  derived and/or modified sequence opt11 from capsid_protein__Norovirus__BAQ55216
augaaaauggcuucaaacgaugccuccccaucagacggcuccacagccaaccucguccccgaaguaaacaacgaagucauggcccucgaaccaguaguaggcgccgccaucgccgcccccgucgcaggucaacaaaacgucauugaccccuggauccgcaacaacuucguccaagcccccggcggcgaguucacaguuucaccccgaaacgcacccggcgaaauacucuggucagcuccccuaggccccgaccucaacccauaucuaucacaccucgcccgcauguacaacgguuacgccggcggauucgaaguccaagucauccucgcuggcaacgcauucaccgccgguaaaaucaucuucgccgccguacccccaaacuucccaacugaaggccucucgcccucacaaauaaccauguucccccacauaaucgucgacguccgccaacuagaaccaguacucaucccccuacccgacguccgcaauaacuucuaccacuacaaccaauccaacgacuccaccauaaaacucaucgccaugcucuauacaccccuuagagccaacaacgcaggcgacgacgucuucaccgucucuugccgcguccuaacccgucccucccccgacuucgacuucaucuuccucguaccacccaccgucgaaucacgaacuaaacccuucacaguccccauccuuacugucgaagaaaugacaaacucccgcuuucccauaccccucgaaaaacuguuuaccggccccuccuccgcuuucgucguucagccccaaaacggccgcugcaccaccgacggcguacuuuuaggcacaacacaacucagcccugucaacauaugcacauuucgcggcgacgucacucacauaccaggcacccgcaccuaccgaaugaaccuagccucccagaacuggaacaauuacgacccgaccgaagaaauaccugccccucuaggaacaccagauuucgucggcaaaauucaaggcaugcucacacaaaccaccaaaggcgacggcuccacacgaggccacaaagcaacuguguccaccggcucgguagacuucacacccaaacuaggaucuguccaauucgacacagacacaaacaacgaccucgagaccggacaaaacacccgcuucacaccagucggcgucauccaagacgguucagcccaccgaaaugaaccccaacaauggguacuucccgacuauuccggacgcaccguccacaauguacaccuugccccggccguagccccaaccuuccccggcgaacaacuccucuucuuccgaucaaccaugcccggcugcucuggcuaccccaacauggaccucgacugccuccucccccaagaauggguccaacacuucuaccaagaagcagcacccgcacaauccgacgucgcccuccuaagauucgucaaucccgacacuggccguguccucuuugaaugcaagcuccacaaaacuggcuacgucacaguagcccacaccggccaacacgaccucgucaucccacccaacggcuacuuccgcuucgacuccugggucaaccaauucuacacccucgcacccaugggcaauggcgccggccgacgucgcgcccuuuga

SEQ ID NO: 37209 - RNA, 1620 nt, Artificial Sequence
  derived and/or modified sequence opt11 from capsid_protein__Norovirus__BAQ55217
augaaaauggccagcaaugacgcuucacccuccgacgguuccaccgccaaucuaguccccgaagucaacaacgaagucauggcccuugaacccgucguaggcgccgcaauugcagcacccgucgccggucaacaaaacgucaucgacccauggauccgaaacaacuucguccaagcacccggcggugaauuuacaguauccccacgaaacgcccccggugaaaucuuauggucggccccacuaggccccgaccucaacccauaccucagccaucucgcucgcauguacaaugguuaugcaggcgguuucgaaguccaagucauccucgcaggcaacgccuucacggccgguaaaauaaucuucgccgccgucccacccaacuucccaaccgaaggacuuuccccaucucaagucaccauguucccucacauuauugucgacguccgccaacucgaacccguccucaucccccuccccgacguccgcaacaacuucuaccauuacaaccaaucuaacgacucuaccauuaaacuuaucgcaaugcuauacacaccccuccgagccaacaacgccggcgacgaugucuucaccgucuccugccguguccucacacgccccucccccgacuucgacuucaucuuccucguacccccaaccgucgaaucccgcaccaaaccauucacaguuccgauccucaccgucgaagaaaugaccaacucccgcuucccaaucccacucgaaaaacucuucaccggcccgucaucagccuucguaguccaaccccaaaacggccgcugcaccacagacgguguacuccuaggaaccacacaacuaucacccguaaacauuuguaccuuccgcggcgacgucacacacaucuccggcacacacacauaccgcaugaaccucgcaucccaaaauuggaauaacuacgacccuacagaagaaauccccgcuccccucggcacccccgacuucgucggaaaaauacagggcaugcucacccaaaccacuaagggcgacggcuccacccgaggucauaaagccacggucuccacuggcucagucgacuucacccccaaacucggcucaguccaauucgccacagacaccaacaacgauuucgaaaccggccagaacacacgauucaccccagucggcguaauccaagacggauccgcccacaggaacgaaccccaacaauggguccuccccgauuacuccggaaaaacgguacacaauguacaccucgccccagcaguugcacccaccuuccccggagaacaauuacucuucuuccgcuccaccaugcccggcuguuccggcuacccaaacauggaccuagacugccuacuaccacaagaauggguucaacacuucuaccaagaagcagcaccagcccaauccgacgucgcccuccuccgauucgucaaccccgacacaggccguguccuuuuugaaugcaaacuccacaaaaccggauaugucaccgucgcccauacaggccaacacgaccuaguaaucccacccaacggauacuuucgcuucgacuccuggguaaaccaauucuacacccucgcacccaugggcaacggcgccggccgccgucgcgcccucuaa

SEQ ID NO: 37210 - RNA, 1623 nt, Artificial Sequence
  derived and/or modified sequence opt11 from capsid_protein__Norovirus__BAQ55218
augaaaauggccuccaacgacgccucccccuccgacggaucuaccgccaaucuaguucccgaagucaacaacgaagucauggcccuagaaccugucgucggcgccgccaucgccgcccccgucgccggccaacaaaacguuaucgaccccuggauacgcaauaacuucguccaagcaccuggaggcgaguucaccguuucaccccggaacgcccccggcgaaauccuuugguccgccccacugggccccgaccucaacccguaccucucccacuuagcccgaauguacaauggauacgccggcggcuucgaaguccaagucauauuagccggcaaugccuuuacagcaggaaaaaucaucuucgccgccgucccacccaacuuccccaccgaaggacuaucccccucccaagucacuauguuuccacacauaaucgucgacguacgccaacucgaacccguccucauaccccucccagacguccguaacaacuucuaccacuacaaccaaucuaacgacuccacaauaaaacucaucgccaugcuauacacuccccugcgagcaaacaaugccggcgacgacgucuuuacugucucaugcagaguccucaccagaccaucccccgacuucgauuucaucuuccuaguaccgccaacugucgaaucacgcacgaaacccuucaccgucccaauccucaccguagaagaaaugacaaacucacgauucccaaucccacucgaaaaacucuucaccggccccagcuccgccuucgucguccaaccccagaacggacgcugcaccacugacggcguccuccuaggcacaacccaacucucccccgucaacaucugcaccuuccgcggagacgucacacacaucccaaacacccacacauaccgcaugaaccuagccucccaaaacuggaauaacuacgauccaacugaagaaauccccgcaccccuagguacccccgauuucgucggcaaaauccagggcaugcucacccaaaccacaaaaggcgacggaucaaccaggggccacaaagccaccguaucaacagguaguguagacuuuacacccaaacuuggcagcgugcaauucaccaccgauaccgacaacgacuucgaaacaggucaaaacacucgcuuuacacccgucggugucauucaagacggcaacggagcccaccgcaacgaaccucaacaauggguacuccccgauuacuccggaggcaccguacacaauguccaccuagcacccgccgucgcccccaccuuccccggcgaacaacuccucuucuuccggucaacuaugccaggcugcuccggcuacccaaacauggaccuagacugccuccucccccaagaauggguucagcacuucuaccaagaagccgcccccgcccaaagcgacguagcucuacucagauucgucaaccccgacaccggccggguccucuucgaaugcaaacuacacaaaaccggauacgucaccgucgcccacacaggacaacacgaccucguaaucccacccaacggcuacuuccgcuucgacuccuggguaaaccaauucuacacccucgcccccaugggaaauggcgcaggacgaagacgcgcccuuuaa

SEQ ID NO: 37211 - RNA, 1623 nt, Artificial Sequence
  derived and/or modified sequence opt11 from capsid_protein__Norovirus__BAR47396
augaaaauggcaucuaacgacgcaaaccccuccgacggguccgcagcaaaccucguaccagaagucaacaacgaagucauggcccucgaacccgugguaggagcagcaaucgcagcccccguagccggccaacagaacgucaucgaccccuggauucgcaauaacuucguccaagcccccgguggcgaguucaccguaagcccccgcaacgcccccggcgaaauccucugguccgcaccccucgguccagaccucaacccauaccucucacaccuagccagaauguacaacggcuacgcaggaggcuucgaaguacaagucauccucgcuggcaacgcuuucaccgccggcaaaaucaucuucgcagccgucccacccaacuuccccaccgaagggcucuccccaagccaaguaaccauguucccacauaucaucgucgauguacgccaacuagaaccaguacucauuccccuccccgacguucguaacaacuucuaccacuacaaucaauccaaugacucaacaauaaaacucauugccaugcuuuacacaccacuccgcgcaaacaacgcaggcgaagaugucuucaccguaucuugccgcguccuaacacgcccuuccccagauuucgauuucaucuuccuaguuccuccaaccguagaaucacgcacaaaacccuucacugucccuauacucaccgucgaagaaaugaccaacucccgcuuccccaucccucucgaaaaacucuucaccggcccauccggcgccuuugucguccaaccccaaaacggccgcugcaccacugacggcguccuacucggcaccacccaacuauccccuguaaacaucugcaccuuccgcggcgacgucacacacauagcaggcuccagaaacuacacuaugaaccucgccucccugaacuggaacaauuaugacccuaccgaagaaauaccagcgccccuaggaacccccgacuuugucggaaaaauccaaggcguccuaacucaaacaaccaaaggagacggcucuacacguggccacaaagccaccauauacacaggcuccgccccauucacucccaaacuuggcuccgugcaguucucaaccgacacagaaaacgacuucgaaacacaccaaaacaccaaguucacccccgucggcgucauccaagacggcagcaccacccaccgcaacgaaccccagcaauggguccuaccauccuacucaggacgcaacguccacaacguacaccuagcccccgccguagcccccacuuucccuggagaacaacucuuauucuuccgcagcaccaugccaggcugcucuggcuacccaaacauggaccucgacugccuacuaccccaagaguggguccaacauuucuaccaagaagccgcucccgcccaauccgaugucgcccuccuccgcuucguaaaccccgacaccggacgaguccucuucgaaugcaaacuacacaaaucuggcuacguaacaguggcccauaccggacaacacgaccucgucaucccacccaauggcuacuuccgauucgacucauggguaaaccaauucuacacuuuagcccccaugggcaacggcaccggccgccgucgcgcacucuaa

SEQ ID NO: 37212 - RNA, 1623 nt, Artificial Sequence
  derived and/or modified sequence opt11 from capsid_protein__Norovirus__BAR47397
augaaaauggcaagcaacgacgccaaccccuccgacggcucagccgccaaccucguccccgaagucaacaacgaagugauggcccucgaacccgucgucggagccgccaucgcagccccaguagccggacaacaaaacgucauagacccauggauacgcaacaacuucguccaagccccuggaggugaguucacaguaucuccacgaaaugcuccaggcgaaauacuaugguccgcuccccucggaccagaccuuaaccccuaccuaagccaccuagcccgaauguauaacgguuacgcgggcggcuucgagguccaaguuauccuagcaggcaacgcauucaccgccggcaagauaaucuucgccgcugucccgcccaacuuccccaccgaaggccucucccccucccaaguaacuauguucccccacauaaucgucgacguccgucagcucgaacccguacuuaucccccuacccgacguucgaaacaacuucuaccacuacaaccaaagcaacgauuccacuaucaagcucauagccaugcuauacacaccccuccgcgcaaacaacgcaggagaagacgucuucaccgucucaugccgaguccuuaccagacccucacccgacuuugacuucaucuuccucgucccaccaaccguagaaucucgcaccaaaccauucaccguaccaauccucacuguagaggaaaugacaaacucccgauucccuauccccuuagaaaaacucuucacaggccccuccagcgccuucgucguccaaccacaaaacggccgcugcaccacagacggaguccuacucggaacaacccaacuaucaccaguaaacaucugcaccuuccgcggcgauguuacccacaucgccggcucccgcaacuacaccaugaaccuagccucccuaaacuggaacaacuacgaccccaccgaagaaauccccgccccacucggcacaccagacuucguaggcaaaauccaagguguccuaacccagaccacaaaaggagacggaagcacacgcggacacaaagcaacagucuacacaggcuccgcccccuucacaccaaaacuaggcucuguccaauuuuccaccgauacagaaaacgacuucgagacacaccaaaauacaaaauucacccccgucggcguaauacaagacggaagcaccacccaccguaaugaaccacaacaauggguccuccccuccuacuccggacgcaacgcccacaacguacaccucgcacccgcagucgcccccaccuucccaggcgaacaacuccucuucuuccgcucgaccaugcccgguugcucaggcuaccccaacauggaccuagacugccuccucccccaagaauggguacaacacuucuaccaagaagccgcccccgcccaauccgacguagcccuucugcgcuucgucaaccccgacacggggagaguccuauucgaaugcaagcuacacaaaucuggauacgucacaguagcucacaccggccagcacgaccuagucaucccucccaacggcuacuuccgcuucgacucuugggucaaccaauucuacacacucgcacccaugggaaauggaaccggccgacgacgagcucuuuaa

SEQ ID NO: 37213 - RNA, 1623 nt, Artificial Sequence
  derived and/or modified sequence opt11 from capsid_protein__Norovirus__BAR47398
augaaaauggcauccaacgacgcaucccccucagacgguagcgcagccaaccucgugcccgaagucaacaacgaagucauggcucucgaacccgucguaggcgccgcaauagccgcgccaguagccggccaacaaaacgucauugacccauggauccgcaacaacuucguccaagcccccggcggagaguucacagucucuccccggaacgcgccaggagaaauacuguggucagcaccccuagggcccgaccuaaaccccuaccuaucccaccucgcccgcauguauaacggcuacgccggaggauuugaaguccaaguaauacucgcaggcaacgccuucacagccggcaaaaucauauucgcggcgguacccccaaacuucccaacagaaggccucucccccucccaagucaccauguucccgcacaucauugucgauguccgccaacucgaacccguccucaucccccuacccgacguucgcaacaacuucuaccacuauaaccaaucaaaugacucuacaaucaaacucaucgccaugcuauacaccccucuccgcgccaacaacgcuggagaagacgucuucaccgucucaugccgcguccuaacccgucccucccccgauuucgacuucauauuccuagucccaccaaccgucgaaucccgcaccaaacccuucaccguccccauacuaaccguagaagaaaugacaaacucccgcuucccgauccccuuagaaaaacucuuuaccggacccucuggcgcauucgucguccagccccaaaacggccgcugcaccacagacgguguccuacuaggaacaacccaauuauccccagucaacaucugcaccuuccgcggagacgugacccacaucgcuggcucgcgcaacuacacuaugaaccucgccgcccuaaacuggaacaacuacgacccaacagaagaaaucccugccccucuaggcacaccagacuucgucggcaaaauucaaggcguacucacucaaaccaccaaagccgacggcucaacacgcggacauaaagcaaccguauacacaggaagcgccgacuucacccccaaacuaggcuccguccaauuuagcaccgacaccgaaaacgacuuugaaacgcaccaaaacaccaaauucacuccagucggagucauccaagacggcucaaccacacauagaaacgaaccgcaacaguggguccuuccuucuuacucaggccgaaacguacacaacguacaccuagcccccgcagucgcgcccaccuucccaggcgaacaacuccuauucuuucgcucaacaaugcccggcugcucaggcuacccaaacauggaccucgacugccuucuuccccaagaauggguccaacacuucuaccaagaagcugcccccgcucaaucugacgucgcacuucuccgauucgucaaccccgaccaaggcaggguccucuucgaaugcaaacuacacaaaucaggauacguaacagucgcacacaccggccaacacgaccucguaauaccacccaauggcuacuuccgcuucgauuccugggucaaccaauucuacacacucgcccccaugggaaacggcacuggccgccgcagagcacucuaa

SEQ ID NO: 37214 - RNA, 1623 nt, Artificial Sequence
  derived and/or modified sequence opt11 from capsid_protein__Norovirus__BAR47400
augaaaauggcuucaaacgacgccaaccccuccgacggaucugccgccaaccuaguccccgaagucaacaacgaagucauggcccuagaacccgucguuggcgcugcaaucgccgcccccgucgccggacaaaccaacgucaucgaccccuggauccgcaacaacuucguccaggcucccggaggagaauuuaccgucuccccucgaaaugcaccaggcgaaauccucugguccgcaccacucggaccagaccucaaccccuaucuaagccaccucgcucgcauguacaacggcuacgccggcggcuucgagguacaaguaauccucgcaggaaacgcauucaccgcuggcaaaaucauauuugccgccguaccacccaacuuccccacagaaggccucuccccaucccaagucacaauguucccccacaucauaguagacguccgccaacucgaacccguucuaaucccccuccccgaugucagaaacaacuucuaccauuacaaccaauccaacgacucuacaauaaaacucauagccaugcucuauaccccacuccgagccaacaacgcaggcgaagacgucuucaccgucucaugccgaguacucacccgccccucccccgacuucgacuucauauuccucguucccccuacagucgaaucccguaccaaaccauucaccguaccuauccuaaccgucgaagaaaugaccaacucccgcuuucccaucccacucgaaaaacucuucaccggacccuccggcgccuucguaguccaaccccaaaacggccgcuguaccaccgacggcguccuccucggcacaacccaauuauccccagucaacauauguaccuuccgcggcgacgugacccacauagcaggcucccgcaacuacaccaugaaccuggccucccucaauuggaacaacuaugaccccaccgaagaaaucccagcaccccuagguacccccgacuucgucggaaaaauccagggaguacuaacucaaacuaccaaaggcgauggcucaacccgcggccacaaagccacagucuacaccggguccgcccccuuuacacccaaacucggcuccguccaauucuccaccgacacugaaaacgacuucgaagcccaccagaacacuaaauucacacccguaggagucauccaagacggaucaaccacacaccgcaacgaaccccaacaguggguccuacccuccuacuccggacgaaacguacaaaacguucaccuugcccccgcuguagccccgaccuuccccggagaacaacuacucuucuucagauccacaaugcccgguugcagcggcuaccccaacauggaccucgacugccuucucccccaagaauggguacaacacuuuuaccaagaagccgccccagcccaaucagacguagcucuacuccgguucguaaacccugacaccggccgagucuuauucgaaugcaaacuccacaaaucaggcuacgucaccguugcccacaccggccaacacgaccuaguaaucccacccaacggcuacuuccgcuucgacuccuggguuaaccaauucuacacccucgcacccaugggcaacggcaccggacgacgccgagcacuauaa

SEQ ID NO: 37215 - RNA, 1623 nt, Artificial Sequence
  derived and/or modified sequence opt11 from capsid_protein__Norovirus__BAR47401
augaaaauggcaucaaacgacgccaaccccagcgacggcuccgccgccaaccuaguccccgaaguaaauaacgaagucauggcccuagaaccugucgucggcgcagcuaucgcagccccagucgcaggacaacaaaacgucaucgacccauggauacgcaacaacuucguacaagcccccggcggcgaguucacaguuuccccacgcaacgcaccaggcgaaauccuauggucugcuccacuaggcccagaucucaacccauacuuaucccaccucgcacgaauguacaacggcuacgcuggcggcuucgaaguccaagucauacucgcaggcaacgccuucacugcaggaaaaauaauauucgcagccgugcccccgaacuuccccaccgaaggccucuccccuucacaaguaaccauguucccccauaucaucgucgacguacgacaacuagagcccguccucauaccccuccccgauguccgcaacaacuucuaccacuacaaccaaagcaacgacucaacuaucaaacucaucgcuaugcucuacaccccucuaagagcaaacaaugccggagaagacguauucaccgugucuugccgcguccucacccgcccaucaccagacuucgacuucauauuccugguacccccaaccguagaauccagaaccaaaccauucaccguaccaacacucacugucgaagaaaugacaaacucccgcuuccccauccccuuagaaaaacucuucaccggcccaucaucugcauuugucguccaaccccaaaacggccgcugcaccaccgacggcguacuucuuggaaccacccaacuauccccagucaacauaugcaccuucagaggggacgucacccacaucgcuggcucgcgcgacuacaccaugaaccuggcaucccuaaauuggaacaacuacgaccccaccgaagaaauccccgccccucucggcacacccgacuucgucggcaaaauacaaggcguccucacccagacaacaaaaggugacggcuccacucgcggccacaaagccaccgucuacaccggcucagcccccuucacacccaaacuugguucugucagauucucaaccgacaccgagaacgacuucgaaacccaccaaaacacaaaauucacacccguuggcgucauccaagacggauccacuacccaccgaaacgaaccccaacaauggguacuacccagcuacuccggacgagacguacacaacguacaccuugcacccgccguagccccuaccuucccaggcgaacaacuccucuucuucagauccaccaugcccgguugcucaggcuacccuaacauggaccucgauugccuccuaccccaagaauggguccaacacuuuuaccaagaagccgcuccugcacaaucagacguagcacuacuacgauucguaaaccccgacaccggccgcguacuauucgaaugcaaacuccacaaauccggcuacgucaccguugcacacaccggccaacacgaccucguuaucccucccaacggauauuuccgguucgacuccuggguuaaccaguucuacacccucgcccccauggggaacggcaccggacgacgucgcgcccucuaa

SEQ ID NO: 37216 - RNA, 1623 nt, Artificial Sequence
  derived and/or modified sequence opt11 from capsid_protein__Norovirus__BAR47403
augaagauggcgagcaacgacgccaacccauccgacggauccgcagcaaaccucguccccgaaguaaacaaugaaguaauggcacucgaaccagucguaggcgccgccauagcagcaccagucgccggccaacaaaacgucauugacccauggauacgaaacaacuucguacaagcccccggcggugaguucacaguaucaccccgcaacgcccccggagaaauacuuugguccgcaccuuuaggccccgaccucaaccccuaccuaucccaccuagcccgaauguacaacggauacgccggaggauucgaaguccaaguaauacucgccggaaacgccuucacagccggcaaaaucauauucgccgcugucccacccaacuuccccaccgaaggucucucccccucccaaguaaccauguucccccacaucauaguggacguccgccaacuggaacccguccucaucccacuacccgacguccgcaacaacuucuaccacuacaaccaauccaacgacucuacgaucaaacucaucgccaugcuuuacacaccccuaagagccaacaacgccggcgaagacgucuucaccgucagcugccguguacuaacccgacccucacccgacuucgacuucaucuuccuagucccacccaccguagaauccagaaccaaacccuucaccguccccauccuaacaguagaagaaaugaccaacucccgauuccccaucccccucgaaaaacuauucaccggccccuccucagcauucgucguacaaccucaaaacggcagaugcaccaccgacggaguucuccucggcaccacccaacuaucacccguuaacaucugcaccuuccgcggugacguaacacacauagcagguucacgcaacuauaccaugaaccuagcaucccucaacuggaacaacuaugaccccacagaagaaauucccgcuccccuaggcacaccagauuucgucgggaaaauucaaggaguacuaacccaaaccacuaaaggagacggcucaacucgcggccacaaagcgacgauuuacacaggcuccgcccccuucacccccaaacucggcucaguccaauucucgaccgacaccgaaaaugacuucgaaacacaccaaaacacaaaguucaccccaguaggcgucauccaagacggagggaccacccaccguaacgaaccccaacaauggguucucccaucauacucaggccgagacguccccaacguacaccuagcccccgccgucgcaccuaccuuucccggagaacaacuccucuucuucagauccaccaugccuggcugcuccggcuaccccaacauggaccuagacugccuccucccacaagaauggguacaacacuucuaccaagaagccgcccccgcccaaucagacgucgcccuacuacgcuucguuaaccccgauaccggccgcguccucuucgaaugcaaacuacacaaaucaggauacgucaccguagcccacaccggccaacacgaccucguaaucccucccaacggcuacuucagauucgacuccuggguuaaucaauucuacacccucgcuccaaugggcaauggcacaggucgacgccgagcacuuuaa

SEQ ID NO: 37217 - RNA, 1623 nt, Artificial Sequence
  derived and/or modified sequence opt11 from capsid_protein__Norovirus__BAR47404
augaaaauggccuccaacgacgcaaacccauccgacgguuccgccgccaacuuaguccccgaaguaaacaacgaagucauggcccucgaacccgucgugggugcagcaaucgccgcaccggucgccggccaacaaaacgucaucgacccuuggauucgcaauaauuucguucaagccccgggcggagaguucaccgucucgccccgcaacgcaccuggagaaauucuaugguccgcuccacucggccccgaucuaaaccccuaccucucccacuuagcacgaauguacaacggauacgcaggcggcuucgaaguucaaguaauccucgcaggaaacgccuucaccgccggcaaaaucaucuucgccgccguuccuccaaacuucccaaccgaaggucuaucccccucccaagucaccauguucccacacauuauaguagacguccgccaacucgaacccguccuuaucccccuccccgacguccgcaacaacuucuaccacuacaaccaaucaaacgacuccacaauuaaauuaauagccaugcuguacacaccacuccgagccaacaacgcuggagaagacgucuucaccgucucaugccgcguccucacacgcccaucccccgacuucgacuucauauuccuugucccacccacagucgaaucacguacaaagcccuucaccguccccauccucacaguagaagaaaugacaaacucacgauuccccaucccccucgaaaaacuauucaccggccccucguccgcauucgucguccagccccaaaauggccgcugcacaaccgacggcguccuacucggaaccacccaacuaucacccguaaacauaugcaccuuccgaggcgacgucacccacaucgccggaucccgcaacuacaccaugaaccucgccucccuuaacuggaacaacuacgaccccacagaagaaauacccgccccucucgggacccccgacuucgucggcaaaauccaaggaguccucacacaaaccaccaaaggcgacggauccacacgcggacacaaagccacagucuacaccggauccgccccuuucaccccaaaacucggcuccgugcaauucuccaccgacacugaaaacgacuucgaaacccaccaaaacaccaaauucacucccgucggugucauacaagacggcggcaccacacaccgcaacgaaccucaacaauggguacuacccuccuauucuggccgcaaugucccuaacguccaccucgcacccgccguggcccccacauuccccggagaacaacuccuauucuuucgcucaaccaugcccggcugcuccggauacccaaauauggaccucgauugccuacucccccaagaauggguacaacacuucuaccaagaagccgcccccgcccaaucagacguggcccugcuacgauucgucaaccccgacaccggccgaguacucuucgaaugcaaacuacacaaauccggcuacguaaccguagcacacacaggccaacacgaccucgucaucccuccaaacggauacuuccgauucgacuccugggucaaccaauucuacacacuagcccccaugggcaacggcacaggccgccgucgagcacuauaa

SEQ ID NO: 37218 - RNA, 1623 nt, Artificial Sequence
  derived and/or modified sequence opt11 from capsid_protein__Norovirus__BAR47405
augaaaauggccucauccgacgccaaccccucagacggcagcgcugcaaaccucguacccgaagucaauaaugaagucauggcccuagagcccgucguaggcgccgccauagcagcacccgucgccggacaacaaaacguaauugaccccuggauacgcaacaauuuuguccaagcccccggcggcgaguucacagucuccccacgaaacgcaccuggcgaaauccucugguccgcuccccuuggucccgaccuaaaccccuaccuaucccaccuggcccgaauguacaacgguuacgccggaggauucgaaguacaggucauccuagcaggcaaugccuucacagccggaaaaauaaucuucgcugccgucccaccuaacuucccuaccgaaggccuguccccaucccaaguaaccauguucccccacauaaucguugacguacgccaacucgagcccguucucaucccccuccccgacguacgaaauaacuucuaucacuacaaccaaucaaacgacuccacaaucaagcucauagccaugcuauacaccccacuccgagccaacaacgccggugaagacgucuucaccguuuccugucgugucuuaacccgcccaucacccgacuuugacuucauuuuccucguuccacccacaguagaaucccgcaccaaacccuucacaguaccaauccucaccguugaagaaaugacaaacucccgauuccccaucccacuagaaaaacucuucaccggcccauccagcgccuucguaguacaaccccaaaacggacgaugcacaaccgacggcguacuacucggcaccacacaacucucaccuguaaacauauguacuuuccgcggcgacguaacgcacaucgccggaucccgcaacuacaccaugaaucuagccucccuaaauuggaacaacuacgaccccacugaagaaauccccgccccucucggaaccccagacuucguaggcaaaauacaaggcaugcuuacccaaacaaccaaaggagacggauccacccgaggccacaaagcuacaguauacacagguuccacacccuucacccccaaacucggauccguccaauucucuaccgacaccgaaaacgacuucgaaacacaccaaaacaccaaauucaccccgguuggcgucauccaggacggcucaacaacccaccgcaacgaaccccaacaauggguccuacccuccuauuccggccguaacguccccaacguacaccucgccccugcagucgcccccaccuuccccggugaacaacuucucuuuuuccgaucuaccaugcccggcugcuccggcuaccccaacauggaucucgacugccuccucccgcaagaauggguccaacacuucuaucaagaagccgccccugcccaaucagacgucgccuuacuccgcuucgucaaccccgacacuggccgcguccucuucgaaugcaaacuccacaaaaguggcuacgucacagucgcacacaccggacaacacgaccuaguaaucccacccaacggauacuuccgauucgacuccugggucaaccaauucuacacccuagcccccaugggcaauggcacuggccgucgacgcgcccuauaa

SEQ ID NO: 37219 - RNA, 1623 nt, Artificial Sequence
  derived and/or modified sequence opt11 from capsid_protein__Norovirus__BAR47406
augaaaauggccagcaacgacgccaacccuagcgacgguucagcagcaaaccucgucccagaagucaacaacgaggucauggcccucgaacccguuguaggcgccgcaaucgcagccccugucgccggacaacaaaacguaauugaccccuggauaagaaauaacuucguccaagcacccggcggagaguucacagucucaccccgcaacgcccccggcgaaauccuaugguccgccccgcucggccccgaccucaaccccuaccucucacaccuagcucgaauguacaacggcuacgcgggaggcuucgaaguccaagucauacuagccggcaaugccuucacagccgguaaaaucauauucgcagccguuccacccaacuuccccaccgaaggcuuaucccccucccaagucaccauguucccccacaucaucguagacguacgccaacucgaacccguccucauaccacuaccagacguacgcaacaacuucuaccauuacaaccaauccaacgacuccaccaucaaacuuaucgccaugcuguacacaccccuaagagcaaacaacgccggcgaagacgucuucacaguaucaugcagaguccucacucguccaagcccagacuuugacuucaucuuccucguaccucccacaguagaaucccgaacaaaacccuucaccguccccauacucaccgucgaagaaaugacaaacagucgauuccccauaccccuagaaaaacuuuucacaggucccucauccgcauucgucguccaaccacagaacggacggugcaccaccgacggcguccuacucggaaccacccaacucucacccguaaacaucugcacauuccgcggggacgucacccacaucgcaggcucacgaaacuacacaaugaaccuggcaucacucaacuggaacaacuacgaccccacagaggaaauaccugcaccgcucggaacuccagacuucguuggcaaaauccaaggaguacucacucaaacaacaaaaggcgacggcucaacccgcggccacaaagcuaccguauacacuggaucagcacccuucaccccaaaacucggcuccguacaauucggcaccgacaccgagaacgacuucgaaacccaccaaaacacaaaauucacccccgucggcgucauccaagacggcggaaccacccaccgcaacgaaccacaacaauggguacucccaucauacucaggccgcaacguccccaacguccaccuugccccagcugucgccccaacauuccccggagaacaacuccuauucuucagauccaccaugcccggcugcuccgguuaccccaacauggaucucgacugccugcucccccaagaguggguccagcauuucuaccaagaggccgcccccgcccaguccgacgucgcucuccuacgauucguaaacccagacaccggacgcguacuauucgaaugcaaacuccacaaauccggcuacgucacaguagcccacaccggccaacacgaucuagucaucccaccaaacgguuacuuccguuuugacuccugggucaaccaauucuacacacucgcuccaaugggcaacggcacagguagacgcagagcccucuaa

SEQ ID NO: 37220 - RNA, 1623 nt, Artificial Sequence
  derived and/or modified sequence opt11 from capsid_protein__Norovirus__BAR47407
augaaaauggcauccuccgacgccaaccccagcgacggauccgcagccaaccucgucccagaagucaacaacgaagucauggcccuagaacccgucguaggcgccgccaucgccgcccccgucgccggccaacagaacguaaucgacccauggauccguaacaacuucguacaggcuccuggaggagaguucaccgucucuccacgcaacgccccgggcgaaauccucuggucagcaccccuaggccccgaccuaaaccccuaccucucccaccucgcacgcauguauaacggcuacgccggcggauuugaaguccaagucauacucgcuggcaacgcauucaccgcaggcaaaaucaucuucgcagcaguuccacccaacuuccccacagaaggccuaucacccucccaagucacaauguucccccacaucauagucgacgugcgccaacuagaacccguacucauaccccuucccgacguacgcaacaacuucuaccacuacaaccaaagcaaugacucaacaaucaaacugaucgccaugcuauacacaccccuacgcgccaauaacgcaggagaagaugucuucaccgucuccugccgcguccucacccgcccaucccccgacuucgauuucauuuuccucgucccgcccaccguagaaucccgcaccaaacccuucacuguccccauccucacagucgaagaaaugaccaacucuagauuccccauaccccucgaaaaacuauucaccggccccuccagcgcauucgucguccaaccccaaaacggacgcugcaccaccgacggcguucuccucggcaccacccaacucucaccaguaaacaucugcacauuccgcggagacgucacccauauagcaggcagcggaaacuacaccaugaaccuggcaagcguuaacuggaacaacuacgaccccaccgaagaaaucccugccccacucggcacccccgacuuugucgguaaaauucaaggcaugcucacacaaacuaccaaaggcgacggauccacucguggacacaaagccaccgucuacaccggcucagcgcccuucacccccaagcuaggcuccguccaauucucaaccgacaccgaaaacgacuucgagacccaccaaaacaccaaauucaccccaguaggaguuauccaagacggcaacaccacacaccgcaacgaaccacaacaauggguccuacccucauauuccggucgcaacguccccaacguccaccucgccccugccgucgcacccaccuucccuggagaacaacuccuauucuuccgaucaacaaugccuggcugcuccggcuaccccaacauggaccuagauugccuacuaccccaagaauggguacaacacuucuaccaagaagcagcacccgcccaauccgacguagcacuacuccguuucgucaaccccgacaccggacgcguauuauucgaaugcaaacuccacaaauccggcuacgucaccgucgcccauaccggccaacacgaccuugucauaccaccuaacggauacuuccgcuuugacuccuggguaaaccaauucuacacccucgcccccaugggcaacggcaccggccgccgcagagcccuguaa

SEQ ID NO: 37221 - RNA, 1623 nt, Artificial Sequence
  derived and/or modified sequence opt11 from capsid_protein__Norovirus__BAR47408
augaaaauggccuccaacgacgccaaccccuccgacggaucagccgccaaccucguacccgaagucaacaacgagguaauggcccucgaacccguggucggagccgcaaucgcagcccccguagccggacaacagaacguaaucgaccccuggaucaaaaauaacuucguccaagcccccggcggcgaguucaccguuucccccagaaacgcccccggcgaaauccucuggucagcuccccucggacccgaccuaaacccuuaccuuucccaccucgcccgaauguacaacggcuacgccggcggcuucgaaguccaagucauccucgccggcaacgcauucaccgccgguaaaaucaucuucgcagccguaccacccaacuuccccacugaaggcuuaucaccuucccaagucacaauguucccacauaucaucgucgacguaaggcaacuagaaccaguccuaauaccccuccccgacguacgcaacaacuucuaccacuauaaccaauccaaugacuccacaaucaaacugaucgcaaugcuuuacaccccacuacgcgcaaauaacgcaggcgaggacgucuucaccguaucaugccgcguccuaacacgaccaucccccgacuucgacuucauauuccucguucccccuacagucgaaucccgcaccaaacccuucaccguccccauccucaccgucgaagaaaugacaaacuccagauuccccaucccccucgaaaaacucuucacaggucccuccggcgccuucguaguacaaccccaaaacggccgcugcaccacagacggcguccuccucggcaccacccaacucucaccggucaacauaugcacguuccgcggcgacgucacccacaucgccggcagccgaaacuacaccaugaaucucgcagcccuaaacuggaacaacuacgaccccacugaagaaauaccugccccacuaggcacccccgacuucgucggcaagauccaaggaguccuaacccaaacaacuaaaggagacggcuccacccgcggccacaaagccaccguauacacuggauccgccgacuuuacucccaaacucggcucaguccaauucucaacagauaccgaaaaugacuucgaaacccaccaaaacaccaaauucacaccagucggaguaauccaagacgguuccaccacccaccgcaaugagccccaacaauggguucuccccagcuacuccggucgcaacguccacaacguacaccucgcccccgcagucgcacccacguuuccaggggaacaauuacucuucuuccgcuccaccaugcccgguugcuccggcuaccccaacauggaccuugacugccuccucccccaggaauggguccagcacuucuaccaagaggccgcaccagcccaaucagacgucgcacuacuccguuucgucaacccugacaccggccgcguccuauucgaaugcaaacuacacaaaucaggauacguuaccguagcccacaccggccaacacgaccucgucauacccccaaacggcuacuuccgcuucgacuccuggguuaaccaguucuacacacucgcccccaugggcaacggcacaggacgacgacgcgcucuauaa

SEQ ID NO: 37222 - RNA, 1623 nt, Artificial Sequence
  derived and/or modified sequence opt11 from capsid_protein__Norovirus__BAR47410
augaaaauggccucaaacgaugccaaucccucggacggauccgccgccaaccucguccccgaagucaacaaugaagucauggcccuagaaccaguaguaggcgcugccaucgccgccccagucgcaggacaacaaaacguaaucgauccguggauccgcaacaacuucguccaagccccgggaggcgaauuuaccgucuccccucgcaacgcuccuggcgaaauacugugguccgcaccccuagggccugaccucaaucccuaccugucccaccuagcccguauguauaacggcuacgcaggaggcuucgaaguacaagucauccucgccggaaacgccuucaccgcuggaaaaaucaucuucgccgcaguaccucccaacuuccccaccgaaggucuaucacccucccaaguaaccauguucccccacaucaucguugacguucgacaacuagaacccguccuaauaccccucccugauguccgaaacaacuucuaucacuauaaccaaucgaacgacuccacaaucaaacuaauagcuaugcuuuacacaccccuacgagccaacaacgccggcgaagacgucuucaccgucucaugccgcgugcuaacccgccccuccccugauuucgacuucaucuuucucguucccccuacagucgaaucucgcaccaaacccuucacugucccaauacucaccgucgaggaaaugaccaacucccgcuuccccaucccccucgaaaaacucuucacaggaccauccucugccuucguaguacaaccccaaaacggccgcugcaccaccgacggaguacuacuaggcaccacacaacucucccccguaaacaucugcaccuuccgaggcgacguaacccacaucgcagguucacgaaauuacaccaugaaccucgccucccucaauuggaacaacuacgacccaaccgaagaaauccccgcaccccucggaaccccugacuucgucgguaagauacaaggcaugcuaacccaaacuaccaaaggagacggcagcacccgcggacacaaagcaacugucuacaccggguccgcccccuuuaccccuaaacucggcuccguacaauucgaaacagacaccgaaaacgauuucgaaacccaccaaaacacaaaauucacccccgucggcguaauccaagacggcggaacgacccaccgcaacgaaccccaacaauggguucuacccuccuacucaggccgaaacguacccaacguucaccucgcuccugccguugcuccaaccuuccccggcgaacaacuccucuucuuucgauccacaaugcccgguugcagcggcuaccccaacauggaucuagacugccuccucccccaagaauggguucaacacuuuuaccaagaagcagccccagcacagagcgacgucgcacuccuccgauucgucaaccccgacaccggucgaguacucuuugaaugcaagcuccacaaguccggcuacguaaccgucgcccacacaggccaacaugaccucguuauacccccuaacggguacuuccgauucgacuccuggguaaaucaauuuuacacccucgcccccaugggcaacggcacaggccgacgccgcgcccucuaa

SEQ ID NO: 37223 - RNA, 1623 nt, Artificial Sequence
  derived and/or modified sequence opt11 from capsid_protein__Norovirus__BAR47412
augaagauggcaucuucugacgcaaacccuuccgacggcuccgcagccaaccucguacccgaagucaacaacgaagucauggcccucgaacccguaguuggcgcugccauagccgccccagucgcaggccaacaaaacgucaucgacccuuggauccgcaacaacuucguccaggcacccggcggcgaauuuaccgucucaccacgaaacgcccccggcgaaauccuauggucugcuccccuaggccccgaccuaaacccauaccucucccaccucgcacgaauguacaacggauacgccggcggcuuugaaguacaagucauccucgcaggcaacgccuucaccgccggaaaagucauauucgccgcagucccacccaacuuccccacagaaggccuaucccccucccaagucaccauguucccacauauugucgucgacguacgccaacucgaacccguccucauaccccuccccgacguccggaacaacuucuaccacuacaaccaaagcaacgaccccacaaucaaacuuauugcaaugcucuacaccccacuacgcgcaaacaacgccggcgacgacgucuucaccgucuccugccgcguccuuacccgucccuccccagacuucgacuucauauuccuugucccgcccacagucgaauccagaacaaaacccuucucaguccccguucuuaccgucgaagagaugaccaacucccgcuuccccaucccccuagaaaagcucuuuaccggucccucuagcgcauucgucguacagccccaaaacggccgaugcacuacugauggcguacuccuaggaaccacccaacucucucccguaaacaucugcaccuucagaggcgacguuacccacauuacaggcucucgaaacuacacaaugaaccucgccucacaaaacuggaacaacuacgaccccaccgaggaaauacccgcaccccuaggcacaccagacuucguuggaaaaauacaaggaguccuaacacaaacaacccgaacugacggcuccacccgcggccacaaagcaacagucuacacaggcuccgcagacuucgccccuaagcucggacgcauccaauucgaaaccgacaccgaccacgacuucgaagccaaccaaaacaccaaauucaccccaguaggcguaauccaagacggcggcaccacccacagaaacgaaccccaacaauggguucuucccuccuacucaggacggaacacccacaacguccaccuagcacccgccguagcccccaccuuccccggagaacaacuccucuucuuccgguccacaaugccuggcuguuccggcuaccccaauauggaccucgauugccuccuaccccaagaauggguccaauauuucuaccaagaagcagcacccgcccaauccgacguagcccuccuccgcuuuguaaacccagacaccggccgcguccucuucgaguguaaacuccacaaaucaggcuacguaaccgucgcccacaccggacaacacgaccuagucaucccacccaacggauacuuccgauucgacucguggguaaaccaauucuacacccuagcucccaugggaaacgggacaggacgccgccggguugcauaa

SEQ ID NO: 37224 - RNA, 1623 nt, Artificial Sequence
  derived and/or modified sequence opt11 from capsid_protein__Norovirus__BAR47413
augaaaauggccucauccgacgccaacccaucugacggaucagcagcaaaucucguccccgaagucaacaacgaagucauggcacuagaaccaguaguaggcgcagccauagccgcacccguagcuggccaacaaaacgucaucgaccccuggauccgcaacaacuuuguucaagcacccggcggcgaguucacagucuccccucguaacgcccccggcgaaauucucuggucagcaccccucggcccugaccuuaaccccuaccuaucgcacuuagcccgcauguacaacggauacgcaggcggauucgaaguccaagucauccuagcaggcaacgccuuuaccgccggcaaagucauauucgcugccguacccccuaacuucccaaccgaaggccucucccccucccaggucacaauguucccccacaucguugucgacgucagacaacucgaaccaguacucauaccccugcccgacgucagaaacaacuucuaccacuacaaccaauccaacgaccccacaaucaaacucauagccaugcuauacacaccccuccgcgcaaacaacgccggcgacgacgucuucaccguaucaugccgaguccucacccgccccucacccgacuuugacuucaucuuccuaguaccacccaccguagaauccagaaccaaacccuucuccguccccguccuaaccguugaagaaaugaccaacucccgauuccccaucccccuagaaaaacucuucaccgggcccuccucagccuucgucguccaaccucaaaacggccgcugcacgacggacggcguucuccuaggcaccacccaacuaagccccgucaacaucugcaccuuccgcggcgacgucacccacaucacaggaucccguaacuacaccaugaaccucgcaucccaaaacuggaacaacuacgaccccaccgaggaaauaccggcaccccucggcacaccugacuucguaggcaaaauacaaggaguacuaacccaaaccacccggaccgacggcucaacccgcggccacaaagccaccguauacacaggaucagccgacuuugccccaaaacucggcagaauacaauucgaaaccgacaccgaccacgauuucgaagccaaccaaaacacaaaauucacccccgucggcgugauacaggauggcggcacaacacaccgaaacgaaccccaacaauggaugcuccccucuuacuccggccgaaacacccacaacguccaccucgcccccgccgucgcacccaccuuccccggagaacaacuccucuucuuccgcucaaccaugccaggaugcucaggcuacccaaacauggaccuugacugccuccucccacaagaauggguacaauacuucuaccaagaagcugcacccgcccaauccgacguagcccuccuccgcuucguaaaccccgacaccggacgcguguuauucgaaugcaaacuccacaagucaggcuacgucaccgucgcccacaccggacaacacgaccuggucauacccccaaacggcuacuuccgcuucgauucauggguaaaccaauucuacacccucgcaccaauggggaacggaaccggccgccgccgcguagccuaa

SEQ ID NO: 37225 - RNA, 1623 nt, Artificial Sequence
  derived and/or modified sequence opt11 from capsid_protein__Norovirus__BAR47414
augaaaauggcauccuccgacgccaauccauccgacggcuccgccgccaaucuagucccagaagucaacaacgaagucauggcacucgaaccuguggucggagccgcaaucgccgcccccgucgccggacaacaaaacgucaucgacccuuggauacgcaauaacuucguccaagcccccggcggcgaguucaccguaucaccccgcaacgcccccggagaaauccuaugguccgcaccccugggccccgaccucaacccauaccucucccaccucgcccguauguacaacggcuacgcuggaggcuucgaaguacaagucauucuagcaggaaacgccuucaccgcuggaaaagucaucuucgccgccgucccacccaacuuccccaccgaaggccuaucccccucccaagucaccauguucccccacauaguagucgacguccgccaacucgaacccguccuaauaccccuccccgacguaagaaacaacuucuaccacuacaaccagucaaacgaccccacaauaaaacucaucgcuaugcuauacacaccccuccgagcaaacaaugcaggcgacgacgucuuuaccguuuccugucgaguccucacccgccccucacccgauuucgacuucauuuuccuuguacccccuaccgucgaaagccgcaccaaacccuucuccgucccaguccucaccgucgaagaaaugaccaacucccguuuccccaucccucucgaaaaacucuucaccggccccucaagcgccuuugucguccaaccacaaaacggccgcuguaccaccgacggcguccuacucggcaccacccaacuuagccccgucaauauaugcaccuuccgcggcgacgucacucacaucaccggaagucgaaacuacacaaugaaccucgccagccaaaacuggaacaacuacgaccccacagaagaaaucccggcaccccuaggcaccccugauuucgucggcaaaauccaaggaguccucacucaaaccacccgaaccgacggcuccacacgaggccacaaagccaccgucuacacaggcucagcagacuucgcaccuaaacuaggccggauccaauucgaaaccgacacagaucacgacuucgaagccaaccaaaacacaaaauucacacccgucggaguuauacaagacggcggcaccacccaccgcaaugaaccacaacaauggaugcuaccaucauacuccggccgcaacacccacaacguucaccuagcccccgccguagcccccacauuccccggcgaacaacuacuguucuuccgaucaaccaugcccggcugcuccggcuacccaaacauggaccucgacugccuacuaccucaagaauggguccaguacuucuaccaagaagccgcccccgcucaauccgacgucgcacuacuacgcuucguaaacccagacaccggccguguccuguucgaaugcaaacuucacaaguccggcuacgucacagucgcccacaccggccaacacgaccucgucauuccaccaaacggauacuucagauucgacuccuggguuaaccaauucuacacccucgccccaaugggcaacggcaccggacgucgacgaguggcuuaa

SEQ ID NO: 37226 - RNA, 1623 nt, Artificial Sequence
  derived and/or modified sequence opt11 from capsid_protein__Norovirus__BAR47415
augaaaauggccagcuccgacgcuaaccccuccgacggcucagccgcaaaccuaguacccgaaguaaacaacgaaguaauggcccucgaacccguagucggagccgccauagcugcccccgucgccggacaacaaaauguuauagaccccuggauacgcaacaacuucgugcaggccccuggcggcgaguucaccgucucaccccguaacgcaccgggcgaaauccuaugguccgcaccccucggcccagaccuuaaucccuaccuaucccaccucgccagaauguacaacggcuacgccggaggcuucgaaguccaagugauccuagccggcaacgccuucacugcaggaaaaguaaucuucgccgcagucccucccaacuuccccacagaaggccucucccccucccaaguaaccauguuuccccacaucgucgucgacguucgacagcucgaaccuguacucaucccccuccccgacguacgaaacaacuucuaucacuacaaccaauccaaugacccaacaauaaaacucaucgccaugcucuacacaccccuccgcgccaacaacgccggggacgacguauuuaccgucuccugccgaguucugacccgccccucccccgacuucgauuucaucuuccuuguacccccaacagucgaaucccgcaccaaaccauuuuccguccccguccucaccgucgaagaaaugacaaacucacgcuucccuaucccccuggaaaaacuauucaccggcccaucauccgcuuucgucguacaaccccaaaacggccgaugcaccaccgacgguguccuccucggaaccacccaacucucccccguaaacauaugcacauuccgcggagacgucacccacaucaccggcucccgcaacuacacaaugaaccucgccagccaaaacuggaacaacuacgaccccaccgaagaaauacccgcuccccucggaacaccagauuuuguaggcaagauacaaggcguacuaacccaaaccacccgcacagacggcagcacacgcggccacaaagccaccgucuacacuggcucagccgacuucgcuccaaaacuuggacgcauccaguucgagaccgacaccgaccacgacuucgaagccaaccaaaacaccaaauucaccccugucggaguaauacaagacggcgggaccacccaccgcaacgaaccccaacaauggaugcuccccucauacucuggccgcaacacacacaacguucaccucgcccccgcuguagccccaacauuuccuggcgaacaacuccucuucuuccgcuccacaaugccuggcugcucaggauaccccaacauggacuuagauugcuuacucccccaagaauggguacaauacuucuaccaagaagccgccccugcccaauccgacguagcacuccuccgcuucguaaaccccgacaccggccgcguccuauucgaaugcaaacuccacaaaagcgguuaugucaccgucgcccacacagggcaacacgaccuaguaaucccucccaacggauacuuccgcuucgacagcuggguaaaccaauucuacacucucgcccccaugggaaacggcacaggccgacgacgcguagccuaa

SEQ ID NO: 37227 - RNA, 1623 nt, Artificial Sequence
  derived and/or modified sequence opt11 from capsid_protein__Norovirus__BAR47417
augaaaauggccuccucagacgcaaacccaucagacggauccgccgccaaccucgucccagaaguaaacaacgaagucauggcucuggaaccaguagucggagccgcgauagccgcacccgucgcaggccaacaaaacgucaucgaccccuggauacgcaauaacuucguccaagcccccggaggcgaauuuaccguuagcccccgcaaugcccccggcgaaauacugugguccgccccacucggcccagaccugaaccccuaccugucccaccuagcacguauguacaacggcuacgcaggaggauucgaaguccaagucauccucgcagguaacgccuucacagccggcaaaguaaucuucgccgccguacccccuaacuucccuaccgaaggacuaucccccucccaagucacuauguucccccacaucgucgucgacguccgccaauuagaacccguccucaucccccuacccgacguccgaaacaacuucuaccacuacaaccaaucaaacgaccccaccaucaaacucaucgccaugcuauacacgccccuacgcgccaacaacgccggugacgacguauucaccgucuccugcagagugcuuacccgucccucccccgauuuugacuucauuuuccuggugcccccaaccguugaaucccgcacaaaaccauucuccguacccguccugaccguagaagaaaugaccaacucccgcuuccccauuccccucgaaaaacucuucaccggucccucauccgcauucgucguccaaccccaaaauggccgaugcacaacagacggcguccuucucggcacaacccaauuauccccagucaacaucugcaccuuccgcggcgacgucacccacaucacaggauccagaaacuacacaaugaaucuagccucccaaaacuggaacaacuacgaccccacagaagaaauccccgcacccuuagguacccccgacuucgucggaaaaauccaaggcguccucacccaaacaacccgaacagacggcagcacccgcggccacaaagcaaccgucuauaccggauccgcagacuucgcccccaaacucggacguguccaauucgaaacagacaccgaccacgacuucgaagcaaaccaaaacaccaaauucacacccguaggcguaauccaggacggauccaccacacaccgcaaugaaccacaacaauggguccuaccauccuacucaggcagaaacacccacaacguccaccuugcaccagccgucgcccccacauuccccggagaacaacuccuuuucuuucgcucaacaaugcccggcugcuccggcuaccccaauauggaccuagacugccuccuaccacaggaauggguacaauacuucuaucaagaagcggcccccgcccaaucagaugucgcucuccuaagguucgugaauccugacaccggccgaguccucuucgaaugcaaacuccacaaaucaggcuacguaaccgucgcccacaccggacaacacgaucuagugauaccacccaacggauacuuccgcuucgacuccugggucaaccaauucuacacacucgccccaauggguaacggcaccggacgccgucgugccgucuaa

SEQ ID NO: 37228 - RNA, 1623 nt, Artificial Sequence
  derived and/or modified sequence opt11 from capsid_protein__Norovirus__BAR47418
augaaaauggcuuccuccgacgccaaucccccagauggauccgcagcaaacuuaguacccgaaguaaacaacgaaguaauggcccuagaaccaguaguaggcgcagccaucgccgcccccgucgccggacaacaaaacgucaucgacccuuggauccguaacaacuucguucaagcccccggcggcgaguucaccgucucgccacgcaaugccccaggcgaaauccucuggucugccccacucggccccgaccucaaccccuaccucucucaccuugcccgcauguacaacggauacgccggaggcuucgaaguccaagucauacuagccggcaaugccuucaccgcaggcaaagucauauucgccgccguuccacccaacuuccccacagaaggucucucccccagccaaguuacaauguuuccccacaucguuguagacguucgccaacucgaacccgucuuaaucccccucccugacguccguaacaacuucuaccacuauaaccagucaaacgaccccaccauaaaacucauugccaugcuauacaccccacuccgcgcuaacaacgccggagacgacgucuucaccgucucaugcagaguccucacucgcccuagccccgacuucgacuucaucuuccucgucccacccaccgucgaaucccgcacaaaacccuucuccguaccaguucuaaccgucgaagaaaugaccaacucacgcuuccccauaccccucgaaaaacuauucacgggccccucguccgcauucgucguccagccccaaaacggccgcugcaccaccgacggcguacuacuaggcaccacccaacuaagcccagucaacaucugcaccuucagaggugacguuacacacauaaccgggucccacaacuacacaaugaacuuagcaucccaaaacuggaauaacuacgauccaaccgaagaaauaccagcaccccuaggcaccccagacuucgucggaaaaauccaaggcguccucacccaaaccacccgcaccgacggcucaacccgaggccacaaagccacagucuacaccggcagcgccgauuucgcuccaaaacucggccgaguccaauucgaaaccgacaccaaccacgacuucgaagcaaaccaaaacaccaaauucacuccuguaggagucauacaagacggcggaacaacccaccguaacgaaccccaacaauggguccuacccucauacuccggacguaacacccacaacguacaccuagcacccgcaguggccccgaccuuccccggagaacaacuucuauucuuccgaucuaccaugcccggcugcuccggcuacccaaacauggauuuagacugccuccuuccacaagaauggguccaauacuucuaccaagaagccgcccccgcacaauccgacgucgcccuccucagauucguaaaccccgacaccggcagaguacucuucgaaugcaaacuccacaaaagcggcuacgucaccguagcacacacaggacaacacgaccucguaauaccacccaacggcuacuuucgcuucgacucgugggucaaccaauucuauacauuagcccccaugggcaacggcaccggccgccgccgagcaguauaa

SEQ ID NO: 37229 - RNA, 1623 nt, Artificial Sequence
  derived and/or modified sequence opt11 from capsid_protein__Norovirus__BAR47421
augaaaauggccuccucagacgccaaccccuccgacggcuccgcagccaaccucgucccagaagucaacaacgaagucauggcacucgaaccagucgucggugccgccauagccgccccaguagcaggccaacaaaaugucauagaccccuggauccgcaacaacuucguucaagcccccggcggagaguucaccgucucaccccgcaacgcaccaggagaaauacucugguccgcaccccuaggccccgauuuaaaucccuaccucucccaccucgcccgcauguacaacggcuacgccggcggcuucgaaguccaagucauccuugccggcaacgcauucaccgccgggaaaguuaucuucgcggccguaccacccaauuuccccaccgaaggccucagcccuucacaaguaacaauguucccccacaucguagucgacguccggcaguuggaacccguccuaaucccacuccccgauguccgaaacaauuucuaccacuacaaccaaucaaacgaccccaccaucaaacucauagccaugcuuuacaccccacuccgcgcaaacaacgcaggagacgacguguucacagucuccugccgcguccucacccgccccucccccgacuucgacuucaucuuucucgucccacccacagucgaaucccgaacuaaacccuucucaguccccguucuaaccgucgaagagaugacaaacagccgauuccccauaccccuagaaaaacuauucacaggcccuucaagcgccuucgucguccaaccacaaaauggacgcugcaccacagacggcgugcuacuagguaccacccagcuaucacccgugaacauaugcaccuuccguggcgacgucacccacaucaccggcucccgcaauuacacaaugaaccucgccucacaaaacugguccaacuacgaccccaccgaagagauccccgcaccccucggaacccccgacuuugucgguaaaauccaaggaguccucacucaaaccacacgaacagacggcuccaccagaggucacaaggccacuguauauaccggcucagccgauuucgcccccaaacuaggccgcguccaauucgaaacugacaccgaccacgacuucgaagccaaccaaaacaccaaauucacacccgucggcgugauacaagacggcggcacaacccaccgaaacgaaccucaacaauggguucuuccauccuacucaggucgaaacacccacaacguccaccuagcacccgcaguagcccccaccuuccccggcgaacaacuucuauucuuccgcucgaccaugccuggcugcuccggauacccaaacauggaccucgacugccuccucccacaagaauggguccaauacuucuaccaagaagccgcacccgcucaauccgacgucgcacuacuccgcuucgucaaucccgacaccggcagaguccucuucgaaugcaaacuccacaaauccggauacgucacuguagcccacacaggacaacaugaccugguuauaccacccaacggauacuuccgcuucgacucaugggucaaccaguucuacacacuagcacccaugggcaacggcaccggccgccgucgagcagucuaa

SEQ ID NO: 37230 - RNA, 1623 nt, Artificial Sequence
  derived and/or modified sequence opt11 from capsid_protein__Norovirus__BAR47422
augaaaauggccuccagcgacgccaaccccuccgacggcuccgcagcaaaccuagucccagaagucaacaacgaaguaauggcccucgaacccguagucggcgcugccaucgccgcacccgucgccggccaacaaaacguaauagacccauggauaagaaacaauuucguccaagccccaggcggcgaguucacagucucuccccgcaaugccccaggcgaaauccucugguccgcaccacuuggccccgacuuaaacccuuaccucucccaccucgcccgcauguacaacggcuacgcaggaggcuucgaaguucaggucauccucgccggcaacgccuucaccgcaggcaaagucauauucgccgccguacccccaaacuucccaaccgaaggucucucccccucccaagucaccauguucccccauaucgucgucgacguacgccaacucgaacccguccucauaccacucccagacguacgcaauaacuuuuaccacuacaaucaauccaacgaccccacaauaaaacucaucgccauguuguauacaccccugcgcgcaaacaacgccggcgaugacguauuuaccguuuccugccgaguccuuacacgccccucccccgacuucgacuucaucuuccuaguuccucccaccgucgaaucacgaaccaaacccuucuccgucccuguccuuacugucgaagaaaugacuaacucccgcuucccaaucccacuagaaaaacuauucaccggccccuccucagcauucguaguccaaccacaaaacggccgcugcacaacagacggcguacuccucggcaccacccaacuauccccaguuaauauaugcaccuuccgcggagacgucacccacaucaccggcucacgcaacuacaccaugaaccucgccucucaaaacugguccaacuacgaccccaccgaagaaauccccgccccucuaggcacccccgacuucgucggcaaaauacaaggcguccuuacccaaaccacacgaaccgacggaagcacccgaggacacaaagccacaguauacaccggcuccgccgacuucgcccccaaacucggucgcguccaauucgaaaccgacaccgaccgcgacuucgaagcuaaccagaacaccaaauucacccccguaggcgucauccaagacggaggcacaacacaccgaaacgaaccccaacaauggguccuccccucuuacucgggccgaaacacccccaacguccaccuugcaccagccguagcccccacauucccaggcgaacaauuacuauuuuuccgcuccaccaugcccggaugcucaggauaccccaacauggaucucgacugccuccucccccaagaauggguccaauacuuuuaccaggaagccgcacccgcccaauccgacgucgcacuacuccgcuucguuaacccagacaccggccgcguccuauucgaaugcaaacuccacaaauccggauacgucaccguagcccacaccggccaacacgaccuagucaucccacccaacggcuacuuccgcuucgacuccuggguaaaccaauucuacacccuagcccccaugggcaacggcacaggccgucgacgagccuuauag

SEQ ID NO: 37231 - RNA, 1623 nt, Artificial Sequence
  derived and/or modified sequence opt11 from capsid_protein__Norovirus__BAR47423
augaaaauggccucauccgacgccaaccccagcgacggcuccgccgccaaucuuguccccgaaguaaacaacgaagucauggcccuugaacccgucgucggcgccgcaaucgccgcccccguugccggccaacaaaacguaaucgaccccuggauuagaaacaacuucguccaagcuccagguggcgaguucaccguuuccccacggaacgccccaggcgaaauccucuggucagcaccccucggccccgaucucaauccauaccuuucccaccuagccagaauguacaacggcuacgcuggaggcuucgaaguacaaguaauucuagccggaaacgccuucaccgccggaaaaguaaucuucgcagcaguaccacccaacuucccuaccgaaggccuaucccccucucaaguaacaauguuuccccacaucguagucgacgucagacaacuggaacccguccuaaucccucucccggacguccgcaacaacuucuaccacuacaaucaaucgaaugaccccacgaucaaacugaucgccaugcuauacacaccccuccgcgccaauaacgccggcgacgacgucuucaccgucucaugccgaguccucacccgacccucccccgacuucgacuucaucuuccuagucccacccacagucgaaucacgcacaaaacccuuuucugucccaguacuaacagucgaagaaaugaccaacagucgcuuccccauaccacuagaaaaacucuucacggguccuucaagcgcuuucguaguccaaccacaaaacggacgaugcaccacagacgguguccuccuaggcaccacccaacucucaccaguuaacaucuguacauuccgcggcgacgucacccacaucacaggcucccguaacuacaccaugaaccuagccucucaaaacuggaacaauuacgaccccacagaagaaauccccgcaccccuaggaacucccgacuucguuggaaaaauccaaggcguccuuacacaaaccacccgaacagacggcuccacucgaggccacaaagccacggucuacaccggcucagccgacuucgcccccaaacucggccgcguccaauuugaaacugacacggaccgcgacuucgaagccaaccaaaacacaaaauucacccccgucggagucauccaagacggcggaacaacucaccgcaacgaaccacaacaauggguucuacccuccuacucaggcagaaacacccccaacguacaccuugcccccgccguagcccccaccuuccccggcgaacaacuacucuucuuucgcagcaccaugcccggcugcucaggcuacccgaacauggaccucgacugccuacucccccaagaauggguccaauacuucuaccaagaagcagcaccagcacaauccgacguagcccuacuucgcuucguaaaccccgacacaggacgaguucucuucgaaugcaaacuacacaaauccggauacgccaccguagcccacaccggccaacacgaccuaguaaucccacccaacggcuacuuucgcuucgacuccuggguaaaccaauucuacacccuagcccccaugggcaacggcacaggaagacgucgcgcgcucuaa

SEQ ID NO: 37232 - RNA, 1623 nt, Artificial Sequence
  derived and/or modified sequence opt11 from capsid_protein__Norovirus__BAR47424
augaaaauggccuccucagacgccaaucccagcgacggcucggcugccaaccucguaccagaaguuaacaacgaagucauggcccuagaacccgucgucggcgcagccaucgccgcaccggucgcaggacaacaaaacgucaucgaccccuggauacgaaacaacuucguccaagccccuggaggagaauuuaccgucucaccacgcaaugcccccggcgaaaucuuaugguccgcaccccuaggccccgaucucaaccccuaccucucccacuuagcccgaauguacaacggauacgccggcggcuucgaaguacaagucauccucgcaggcaacgcauucaccgcaggcaaagucauauucgcugccguacccccaaauuucccaaccgaaggccuuucccccucacagguaaccauguucccgcacaucguagucgacgucaggcaacucgaaccgguccucaucccccuacccgacgucagaaacaacuucuaccacuacaaccaaucaaacgaccccaccaucaaacucaucgccaugcuuuacacaccccuacgugccaacaacgcuggcgacgacgucuucaccgucucaugccgcguccucacccguccuuccccagacuucgacuucaucuuccuagucccacccaccgucgaaucccgcaccaaaccauucagcguacccguccucacugucgaagaaaugaccaauucccgcuucccuaucccccucgaaaaacucuucacaggccccuccucugcauucgucguccaaccacaaaacggacggugcacaacagacggcguccuccuaggcaccacacaacucagccccgucaacauauguaccuucagaggagacgucacccacaucaccggaucacgcaacuacaccaugaaccucgcaucccaaaacuggaacaauuacgacccaacggaagaaauaccugcaccccucggcacccccgacuuugucggcaaaauacaagguguacuaacccaaacaaccagaacagacggaucaacccgcggucacaaagcaaccguauacacuggcucugcagacuuugcaccaaaacuaggucgaguacaauucgagaccgacaccgaccacgacuucgaagcaaaccaaaauacaaaguucacccccgucggaguaauucaggacggcgggaccacccaccgcaacgaaccccaacaauggguccucccauccuacagcggcagaaacacccacaacguccaccuagccccagccguagccccuacauucccaggugaacaacuacucuucuuucgcagcacaaugcccggcugcucaggauaccccaacauggaccucgacugccuccucccacaagaauggguccaguacuucuaccaagaagccgcaccagcccaaucagacgucgcccuucuccgcuucgucaaccccgacaccggcagaguacucuucgaaugcaaacuccacaaauccggcuacgucaccguagcucacaccggccaacacgaccucgucauacccccaaacgguuacuuccgcuucgacuccugggucaaccaauuuuacacccuagcaccaaugggcaacggcaccggacgcagacgcgccgucuga

SEQ ID NO: 37233 - RNA, 1623 nt, Artificial Sequence
  derived and/or modified sequence opt11 from capsid_protein__Norovirus__BAR47426
augaaaauggccuccuccgacgccucccccucugacggcucagccgccaaccuaguacccgaaguuaacaacgaagucauggcacuagaacccguugucggcgcagcaaucgcagccccugucgccggccaacaaaacgucaucgaucccuggauccgaaauaacuucguacaagcccccggcggggaauuuacagucucaccucgcaacgcccccggcgaaauccucuggucugccccacuaggacccgaccucaaccccuaccucucacaucucgcacgcauguacaacggcuaugccggcggauucgaaguccaggucauucucgccggaaacgccuucacugcaggcaaagucauauucgcagccgucccacccaacuucccaaccgaagggcucucccccucacaaguaaccauguucccacacauagucguagacguacgacaacucgaacccguacuaauuccccuacccgauguccgaaacaacuucuaucacuacaaccaauccaacgaccccaccauaaaacucauugcuaugcucuacacaccccuccgugccaacaacgcaggagacgaugucuucaccguauccugccgcguccucacacgccccucccccgauuucgacuuuaucuuccuaguaccaccaacagucgaaucccguacaaaacccuucucuguccccguccuaaccgucgaagaaaugaccaauucccgcuuccccaucccccucgaaaaacucuucacaggccccuccagcgcauucgucguccaaccgcaaaacggacgcugcaccacagacggcguccugcucggcaccacccaacucuccccagucaacaucugcacuuuccgcggcgacgucacccacaucaccggcucucgcaacuacaccaugaaccucgcuagccaaaacuggucaaauuacgaccccaccgaagaaaucccagcuccccucggcacccccgacuucgucggaaaaauacaaggcguccucacccaaacaacacgcacagacggcuccacgcgcgggcacaaagccaccgucuauaccggcucagcagacuucgcccccaaacuaggccgaguucaauucgaaaccgacaccgaccacgauuucgaagccaaccaaaacaccaaauucacccccgucggcguaauccaggacgguggcaccacgcaccgcaacgaaccucaacaguggguccuccccuccuacucuggacgcaauacccccaacguacaccuugcacccgccgucgccccuaccuucccuggagaacaacuccucuucuuuaggucaaccaugcccggcugcuccggcuacccaaacauggaccuugacugccucuuaccucaagaauggguccaauacuucuaucaagaagccgccccagcccaaucagacgucgcccuccucagauucguuaaccccgacacaggccgcguccuauucgaaugcaaacuucacaaaucuggauaugucaccgucgcccacaccggucaacacgaccucgugaucccacccaacggcuacuuccgcuucgacucgugggucaaccaauucuacacacucgcuccaaugggcaauggcaccggacgacgccgagcccucuga

SEQ ID NO: 37234 - RNA, 1623 nt, Artificial Sequence
  derived and/or modified sequence opt11 from capsid_protein__Norovirus__BAS53731
augaaaauggccuccaaugacgccaacccaucagacggaucugcagccaaccucgucccagaagucaacaacgaagucauggcccucgaaccagucgucggcgccgccaucgccgcccccguagcaggacaacaaaacgucauagaccccuggauccgaaacaacuucguucaagcacccggaggugaguucaccguuuccccacgcaaugcccccggagaaauccucuggucagccccacuaggacccgaccuaaaccccuaccucucccaccucgcccgaauguacaacggauacgcaggaggguucgaaguccaagucauccucgccgguaaugccuucacagcaggcaaaaucauuuucgccgcagucccacccaacuucccuaccgaaggucuuucaccaagccaagucacaauguucccacacaucaucguagacguuagacaacucgaaccaguucucaucccucuccccgacguacgaaacaacuucuaccacuauaaccaaucuaacgacucuaccauuaaacuaaucgcaaugcuuuacacaccccuacgcgccaacaacgccggcgaagaugucuuuaccgucucaugccguguccugacccggcccucaccagacuucgacuucaucuuccucguaccaccaaccguggaaucacgcacaaaaccauucaccguaccuauacucaccguugaagaaaugaccaacucccgauuccccaucccccucgaaaaacucuucaccggucccuccuccgcauucgucguccaaccacaaaacggacgaugcaccaccgacggcguccuccuaggcaccacccaacucucccccguuaacaucugcaccuucagaggcgaugucacccacaucgcaggaucccgcaacuacaccaugaaccucgccucacucaacuggaacaacuacgaccccaccgaagaaauaccagcgccccucgguaccccugacuucguaggcaaaauccaaggcguacucacacaaacaacaaaaggcgacggcuccacccgcggccacaaagccacagucuacacaggauccgcccccuucacccccaaacucggcuccguccaauucucaaccgacacagagaacgacuucgaaacccaccaaaauacaaaauucacccccguaggagugauccaagacggcggaacaacccaccgcaacgaaccccaacaauggguccuuccgucauacuccggacgcaacgucccaaacgugcaccucgccccagcagucgccccaacauuccccggcgaacaacuacuuuucuuccgcagcacaaugccuggcugcucaggcuaccccaauauggaccuagacugccuacuuccacaagaauggguccaacacuucuaccaagaagccgccccagcccaauccgacguagcccuucuacgcuucgucaaccccgacaccggaagaguacuauucgaauguaaacuccacaaauccggcuacgucaccguagcccacaccggccagcacgaccucguaauacccccaaacggcuacuuccgcuucgacagcugggucaaccaauucuacacccuagcaccaaugggcaacggcacuggccgccgccgcgcccucuaa

SEQ ID NO: 37235 - RNA, 1623 nt, Artificial Sequence
  derived and/or modified sequence opt11 from capsid_protein__Norovirus__BAS53732
augaagauggccuccaacgaugccaaccccucagacggcuccgccgccaaccuaguuccagaagucaacaacgaagucauggcccucgaaccagucgucggcgcagcuaucgccgccccagucgccggccaacaaaacgucaucgaucccuggauccgcaacaacuucguucaggcccccggcggcgaguucaccgucucaccccgcaacgccccaggcgaaauccuaugguccgcgccccucggacccgaccuaaaccccuaccuaucccaccuagcccgaauguacaacggcuacgccggcggcuucgaaguacaaguaauccucgccggaaacgccuucacugccggcaagauaaucuucgccgccguucccccaaacuucccaaccgaaggccuaucaccaucccaagucaccauguucccccacaucaucguagacguccgccaacuagaacccguccucaucccccuacccgacguacgcaacaacuucuaccacuacaaucaauccaaugacuccacaauaaaacucauagccaugcuauacacaccccuccgagccaacaacgccggagacgacguauucaccgucagcugccgcguacucacccgaccaucccccgacuucgacuucauauuccuagugcccccaaccgucgaauccagagccaagcccuucaccguacccauccucacagucgaagaaaugaccaacucccgcuuccccauuccccuugaaaaacuauucaccggccccucaucagccuucgucguccaaccucagaacgggcgcugcaccacugacggcguacuccugggcacgacccaacuuagccccgucaauaucugcacauuccguggcgacgucacccacaucgcagguuccagaaacuacaccaugaaccuggccucccucaacuggaauaacuacgaccccaccgaagaaauaccugccccacucggaacccccgacuucgucgguaaaauccaaggcguccucacccaaacaacaaaaggagacggauccacccgcggacacaaagcaaccguauacacaggcuccgcagacuucaccccaaaacucggcucaguccaauucggcaccgacaccgaaaacgacuucgaaacacaccaaaacaccaaauucacccccgucggcguaauacaagacggcggaacaacacaucgcaacgaaccccaacaauggguacuccccucuuacucaggccgcaacguccacaacguccaccuagcuccugccgucgcccccaauuuuccgggagaacaacucuuauucuuccgaucaacaaugcccggaugcagcggcuacccaaacauggaccucgacugccuccucccacaagaauggguucaacacuucuaccaagaagcagccccggcccaauccgacguagcccuccuccguuucguaaaccccgauaccggccgaguccucuucgaaugcaaacuacacaaauccgguuacgucacugucgcccacacaggccaacacgacuuagucauucccccaaacggauacuuccgcuucgacuccugggucaaccaauucuacacacuagcacccaugggaaacggaacaggccgcagacgagcacucuaa

SEQ ID NO: 37236 - RNA, 1623 nt, Artificial Sequence
  derived and/or modified sequence opt11 from capsid_protein__Norovirus__BAS53733
augaaaauggccagcaacgacgcaaaccccucggacggcuccgccgcuaaccucguucccgaaguaaacaacgaaguaauggcucucgaaccugucgucggggccgccaucgcagcaccagucgcuggccaacaaaauguaauagaccccuggauacgcaacaacuucguacaagcccccggcggagaauuuaccgucucacccagaaacgcucccggcgaaauacuuugguccgcuccacuaggaccagacuuaaaucccuaccucucacaccucgccaggauguacaauggcuacgccggcggauucgaaguacaagucauccuagccggaaacgccuuuacagccggcaaaauaauuuucgccgcagucccacccaacuucccgaucgaaggacucucccccucccaaguuaccauguucccacacaucaucguagacguucgacaacuagaacccguccucaucccccuacccgacguccgcaacaacuucuaccauuacaaccaauccaacgauagcacaaucaaacucaucgcaaugcuauacacaccccuacgagccaacaacgccggagacgacgucuucaccgucuccugccgaguccuaaccagaccauccccugacuucgacuucaucuuccuggucccgccaaccguugaaucccgcaccaaacccuucaccguccccauccucaccgucgaagaaaugacaaacucgcgauuccccaucccccuagaaaaacucuucaccggccccucgucugccuucgucguccaaccccaaaacggccgcugcacaaccgacggaguccuucucggcacaacccaacucucacccgucaauauaugcaccuucagaggugacgucacccacauagccggcucccgaaacuacaccaugaaccuagccuccuugucauggaacaacuacgacccaacugaagaaauucccgcuccacuuggcacccccgauuucguuggaaaaauccaaggaguccucacacaaaccaccaaaggagacgguuccacaagaggacacaaagccaccgucuacaccggauccgccccauucaccccgaaacuaggcuccguacaauuuuccacagacacugaaaacgacuucgaaacccaccaaaacaccaaauucacacccgucggagucauccaagacggcggcacuacccaccguaacgaaccacaacaguggguccuccccucauacuccggccgcaacguccccaauguccaccucgcccccgccgucgcaccaaccuuccccggcgaacaacuccucuucuuccgcagcaccaugcccggcugcuccggcuaccccaacauggaccucgacugccuccucccccaagaauggguacaacacuucuaucaagaagccgcaccagcacaaucagacgucgcccuccuacguuucguaaaccccgacaccggccgaguccucuucgaaugcaaacugcacaaaucuggauacgucacaguagcacauaccggccagcacgaccuagucauaccacccaacggauacuuccgauucgauucaugggucaaccaauucuauacucucgcgcccaugggcaacggcacuggacgacggcgcgcccucuaa

SEQ ID NO: 37237 - RNA, 1623 nt, Artificial Sequence
  derived and/or modified sequence opt11 from capsid_protein__Norovirus__BAS53734
augaaaauggccucaaacgacgcaaaccccucagacggcuccgccgcgaaccucguucccgaagucaacaacgaagucauggcccuugaaccagucguaggcgcagccaucgcggcccccgucgccggacaacaaaacgucaucgaccccuggauccgaaacaacuucguccaggcaccaggaggugaauuuaccguuagcccccgaaacgccccuggcgaaauccuauggucugcaccccuaggcccagaucucaaccccuaccucucacaccuagcccguauguacaacggcuacgccggcggcuucgaaguacaaguaauccuagcaggaaacgccuucaccgccggcaaaaucaucuucgccgccguuccucccaacuucccaaccgaaggacucuccccaucccaagucaccauguucccacacaucaucgucgacguccgccaacucgaacccguccugaucccuuuaccagacguccgcaacaacuucuaccacuacaaccagucaaaugacuccacaaucaaacucaucgccaugcucuacacuccccuccgagccaacaacgccggcgacgacgucuucacaguuagcugccgcguacugacacgccccucccccgacuucgacuucauauuccucgucccucccaccguagaaagcagaaccaaacccuucaccguccccauacugacagucgaagaaaugacaaacucacgcuucccuaucccacuagaaaaacucuucaccggacccuccuccgcauucgucguccagccccaaaacggacgcugcaccaccgaugguguacuccucggcacaacccaacuuagccccgucaacaucugcacauuucgcggcgacguaacacacaucgcuggcucacgcaauuacacuaugaaccuggccucccuaaacuggaacaacuacgacccaacugaagaaaucccagccccacucggcaccccagacuuugucggaaaaauacaaggaguacucacccaaaccacaaaaggcgacgguuccacucgcggacacaaagcaaccguuuacaccggcucugccgacuucacccccaaauuaggcucaguccaauucggaaccgacacagaaaacgacuucgaaacccaccaaaacacaaaauucaccccagucggagucauucaagacggauccacaacccacagaaacgaaccacagcaauggguccucccaucauacuccggccgcaauguccacaacguacaccucgcacccgcagucgcccccaacuucccaggagaacaauuccuauucuuccgcucaaccaugccaggcugcuccggcuauccuaacauggaucuagacugucuacucccucaagaauggguccaacacuucuaccaagaagcugccccugcucaaucagacgucgcacuccugcgcuucgucaacccggacacaggccggguccucuucgaaugcaaacuccacaaauccggcuacgucaccguagcccacaccgggcaacacgaccucgucauacccccaaacggcuacuuccgcuucgacagcuggguaaaccaauucuacacccucgcccccaugggcaauggaaccggccgccgcagagcccuuuaa

SEQ ID NO: 37238 - RNA, 1623 nt, Artificial Sequence
  derived and/or modified sequence opt11 from capsid_protein__Norovirus__BAS53945
augaaaauggcauccucugacgcgaaccccucggauggaucagcagccaaccucguccccgaaguaaauaacgaaguuauggcccucgaacccgucgucggcgcagccaucgcugccccaguagcuggacaacaaaacgucaucgaccccuggauccgaaacaacuucguccaagcccccggcggcgaguucaccguaucaccacgaaacgcccccggugaaaucuuauggagcgccccucuaggacccgaccucaaccccuacuuaucucaccucgccagaauguauaaugguuacgccggcggcuucgaaguccaagucauacuagccggcaaugcauucacagcaggcaaaaucauauucgccgcaguaccacccaacuuccccaccgaaggccucucccccucacaggucaccauguucccccacaucaucgucgacguccgccaacuugaacccguccuaauccccuuacccgacguacgaaacaacuucuaccacuacaaucaauccaaugauuccaccaucaaacucauagcaaugcucuacacuccccuacgagccaacaacgccggcgaagacguauucaccguauccugccgcguacuaaccacccccucucccgacuucgacuucaucuuccuagucccgccuaccgucgaaucucgcaccaaacccuucaccguacccauacuuacugucgaagaaaugaccaacucucgcuucccaaucccccucgaaaaacuauucaccggacccuccuccgcauucguuguacaaccacaaaacggccgaugcacaacugauggcguccuccucggcaccacccaacucucccccgucaacaucugcaccuuucgcggcgacgucacccauauugcggguucccgaaacuacaccaugaacuuagccagccuaaacuggaacaacuacgaccccaccgaagaaauccccgcaccccucggaaccccagacuucguaggcaaaauccaaggcaugcuaacacaaacuaccaaaggagacggcucaacccgcgggcacaaagccaccguauacaccggcuccgccccuuucaccccaaaacuagguuccguccaauuuuccacagacacggaaaacgacuucgaaacccaccaaaacaccaaauucacccccgugggcgucauacaagacggcaacacuacacaccgcaacgaaccccaacaauggguccuaccaucuuacucuggccgcaacguccccaacguccaccucgcccccgccguagccccaaccuuccccggcgaacaacuccucuucuuccgaucuaccaugcccggaugcuccggcuaccccaacauggaccuagacugccuccucccccaagaauggguccaacacuucuaucaagaagccgcccccgcacaaucagacgucgcccuccuacgauucguuaaccccgacaccggccgaguucuuuucgaaugcaaacuucauaaauccggauacguuaccgucgcacacaccggccaacacgaccugguaaucccacccaacggcuacuucagauucgacucaugggucaaucaauucuacacacuggcacccaugggaaacggcaccggccgccgccgcgcacucuaa

SEQ ID NO: 37239 - RNA, 1632 nt, Artificial Sequence
  derived and/or modified sequence opt11 from capsid_protein__Norovirus__CAK22261
augaugauggccuccaaagacgccucccccucugccgacggagccaauggagccggccagcuaguaccagaaguuaacaacgccgaacccuuaccccucgacccaguugcaggcgcuagcaccgccuuagccacagccggacaagucaacaugaucgacccauggaucuucaacaacuucguacaagcuccccaaggcgaguucacaaucucccccaauaacacacccggcgacauacuauucgaccuccaacuuggaccccaccucaauccauuccuagcccaccucucacaaauguacaacggaugggucggcaacaugcggguccgcguuauccucgccgguaacgccuucaccgccggaaaggucaucgucugcugcgucccgcccgguuuccaaaguagaacccucuccauagcucaagccacccucuucccccacauaaucgcagacgucagaacccuagaacccaucgaaaucccccuagaagacguccgcaacacccucuaccacacaaacgacaaucagcccacaaugcgccuccuaugcaugcuauacacaccccugcguaccggcggcggauccggcggaaccgacgccuucgucgucgccggccgcguacucaccuguccaucaucagacuucaacuuccucuuccuaguacccccaacagucgaacagaaaacacgcccauucuccguccccaacaucccucuucaacuccucuccaacucucgcguacccaaccucauccaaucaaugguccucucacccgaccaagcccaaaacguacaauuccaaaacggccgcugcaccaccgacggccaacuccucggaaccaccccugucagcguaucccaaauccucaaauuccgagguaaaguauccgccggaucacgcgucaucaaccucacagaacucgacgguucccccuuccuugccuucgaagccccagcccccacaggcuuccccgaccucgggaccuccgacuggcacgucgaaaugucccucaacuccaacucccaaucuuccggcaaccccauccuccuacgcgacauccaaccaaauucauccgacuuuguuccccaccucggcucagucgccguuaccaccgccaucgacguagcaggcgacuacacuggcaccauacaauggacaucccaacccucaaacgucacccccgucccugacgucaacuucuggaccaucccacaauacggcucuaaccucgccgaagcaucucaacucgcccccgucgucuaucccccaggcuucggcgaggccauagucuacuucaugucacccauacccggcccaaacaccgcccacaaacccaaccugguccccugucuacuaccccaagaauuugucacccacuucgucagcgaacaagcccccucaaugggcgaagcugccuugguacacuacguugacccagacacaaaccgaaaccuaggcgaauuuaaacuguaccccgaaggauucauaaccugcguacccaacggcaccgguccacaacaacucccacucaacggcguuuucgucuucgccuccugggucucacgauucuaccagcucaaacccgucggcacugcauccuccgcacguggacgacuaggagucagacgauaa

SEQ ID NO: 37240 - RNA, 1671 nt, Artificial Sequence
  derived and/or modified sequence opt11 from capsid_protein__Norovirus__CAR95870
augaaaauggccucauccgaugccgccccauccaccgacggcgcgggcaaccuaguccccgaaucccagcaagaaguccucccucuugcccccgucgcuggagccgcccucgccgcccccgucguaggacagaccaacaucauagacccauggaucaaagaaaacuucguccaggccccacaaggggaauucacaguaagccccaaaaacucccccggcgaaauucucguuaaccucgaacucggaccaaaacucaacccauaccuggaccaccucuccaggauguacaacagcuaugccggcggcaucgacgucaugguaguucucgccggaaacgccuucacugccggcaaaguccuuaucgccgcaaucccacccaacuuccccgucgaaggcgucuccgccucccaagccacacaguucccacacgucauaauagacguccggacucuagacccuguccgacuaccccuccccgacgucagaagcacauuuuuccauuacacgaacgacaccgaaccaaaaaugcgccucgucaucuggcuguacaccccacuaaggacaaacggcuccggcgacgacuccuucacgguaucaggacgcauccuaacccgccccucacaagauuucgaauucgcauuccuaaucccccccaccgucgaaaccaaaacuacccccuucuccgucccaggcuucucuguccaagaaauguccaacucacgcuggcccgcagcuauauccgccauggucguacgcggcaacgaaccccaagucguccaauuccaaaacggccgcgcccaccucgacggcaugcuucucggaaccaccccggucucccccaacuacaucgccuccuacagagguaucagcacuggaaacucacgcucagccuccuccgaagcagaugaacgcgcaguaggcuccuucgaugucuggguccgccugcaagaaccagacggccaacccuacgacaucuucggcaagcaaccagcccccaucggaacacccgauuucaaagcagucaucguaggcuucgccgcccgcccccucaccuccggcuccuacgccaacgaagccuacgucaacaccaccgccagcgacuacgcccccgccaccggaaacaugcgauucaccguaagaaacggcggcacaggccacaucucagcuaacaaauacugggaauucaaaucauucggcgucgaaggcgaacgucacaccaacauccaauaccaagaauaugaacuaccagacuacucaggacaagucgcaagcaaccacaaucuagcaccaccagucgccccaagaaugcccggcgaaucacugcucuuauuccagucaaacaugcccgucugggacgacggccacggcgaaagcacacccaaaaaaauccauugccuccucccccaagaauucauaggccacuucuucgacaaacaagcacccagucucggagacgccgcccuacuccgcuaugucaaccaagaaaccaaccgcguccucuucgaaugcaagcuauaccgcgacgguuacaucacagucgcugccucaucaggccuccucgacuuuccacucgacggauucuucagauucgauuccugggucuccucguucuacauccuaucccccgucggcuccggacaaggccgcagaggacgcguccgauuccaauaa

SEQ ID NO: 37241 - RNA, 1623 nt, Artificial Sequence
  derived and/or modified sequence opt11 from capsid_protein_VP1__Norovirus__ADB27914
augaaaauggccucuaacgacgcuaaucccuccgauggaucagccgccaaccuagucccagaagucaacaacgaaguaauggcacucgaaccuguaguuggcgccgccaucgccgcucccgucgcaggucaacaaaacguuaucgaccccuggauccgcaacaacuucguccaagccccgggcggcgaguucaccguuucaccccgaaacgcccccggugaaauccucugguccgcaccccucggccccgaccugaaccccuaccuaucccacuuagcccgcauguacaacggcuacgccgguggcuuugaaguccaaguaauccucgccgguaaugccuucaccgcuggaaagauaaucuucgccgcagucccacccaacuuccccaccgaaggucucucccccucccaagucaccauguucccacacauuaucguagacguccgccaacucgaacccguacuaaucccacuccccgacguacgcaacaacuucuaccacuacaaccagucaaaugacucaaccauaaagcuaaucgcuaugcuauacacaccacuccgcgcaaacaacgccggagacgacgucuucaccguaucaugccgaguccucacccgcccaucccccgacuucgauuucaucuuccucguuccacccaccgucgaaucacgcacaaaacccuucaccguccccauccucaccguagaagaaaugaccaacucccgcuuccccaucccacuagaaaaacucuucaccggccccuccuccgcuuucgucguccaaccccaaaacggucgcugcaccaccgacggaguccuccuaggcaccacccaacuaucccccgucaacauaugcacguuccgcggcgacgucacccacaucgccggcucaagaaauuauacaaugaaccuagccucacucaacuggaacaacuacgaccccaccgaagaaauccccgcuccccucggcacacccgauuucguuggaaagauacaaggcguacugacccaaacaaccaaaggugacggcucaacacgcggccacaaagccacuguauacacaggcagcgccgacuucacaccuaaacuuggcuccguacaauucggaaccgacaccgaaaacgacuucgaaacccaccaaaacaccaaauucaccccagucgguguaauccaagacgggagcaccacacaucgaaacgaaccucaacaauggguccuccccuccuauucaggccgcaacguacacaacguccaccuagccccagccguggcccccaacuuucccggcgaacaacuccuauucuuccgauccaccaugccaggcugcuccggcuaccccaacauggaccucgauugccuacucccacaagaauggguacaacacuuuuaccaagaagccgcacccgcccaauccgacgucgcccuacuccgcuucguuaacccagacacgggcagaguccucuucgaaugcaaacuacacaaauccggcuacgucacaguagcccacaccggacagcaugaccuaguaaucccucccaacggcuacuuccgauucgacaguuggguuaaccaauucuacacccuagcccccaugggaaaugguacuggccgacgacgcgcacucuag

SEQ ID NO: 37242 - RNA, 1623 nt, Artificial Sequence
  derived and/or modified sequence opt11 from capsid_protein_VP1__Norovirus__ADI45809
augaaaauggccuccuccgacgccaauccaagcgauggaucaaccgccaaccuaguacccgaagucaacaacgaaguaauggcccuagaaccagucgucggagccgcaaucgccgcaccaguagcuggccaacaaaacgucaucgaccccuggauccguaacaacuucguacaagcacccggaggcgaauuuaccguuucgccccguaacgcccccggagaaauccucugguccgcaccccuaggacccgaccucaacccauaccucucucaccuagcccgaauguacaacgguuacgccggcggcuucgaaguacaagucauacuggccggcaacgccuucaccgcaggcaaaaucauuuuugcagcgguaccucccaacuuccccaccgaaggccuaucccccucccaagucaccauguucccccacauaaucgucgacguccgacagcuagaaccaguccuuaucccccucccagacguucgaaacaacuucuaccacuacaaccaauccaaugaccccaccaucaaacucaucgcaauguuauacacaccucuccgagccaacaacgccggcgacgauguauucaccgucagcugccgcguccucacucgucccucccccgacuucgacuucaucuucuuaguacccccuaccgucgaaucacgcacuaaaccuuucuccgucccgauacucacagucgaagaaaugacgaacucacgcuuuccaauaccccuugaaaaacucuucacaggccccuccuccgcauucguaguccaaccgcaaaacggccgcugcaccacagacggcguccuccuaggcaccacccaacuaucccccgucaauaucugcaccuucagaggcgaugucacccacaucaccggcucucgcaacuacacuaugaaccuagcuacccagaauuggaacuccuaugaccccaccgaagaaaucccugcgccccuuggcaccccggacuucguaggaaaaauacaaggaguccucacacaaaccacccgcgccgacggcuccacccgcggccacaaagccaccgucuacaccggaagcgccgacuucaccccaaaacugggccgcguccaauucgccaccgacaccgacaacgacuucgacgccaaccaaaacaccaaauuuacacccguuggugucauccaagacggcaacacugcccaucguaacgaaccccaacaauggguccuacccucauacucaggccgcaacucccacaacguccaccuugcccccgcagucgcaccuaccuucccaggcgaacaacuacucuucuucagauccacaaugccaggaugcuccggauacccaaacauggaccucgauugucuucucccacaagaauggguccaguacuucuaccaagaagccgcccccgcucaauccgacgucgcgcuccuccgauucgucaacccagauaccggccgaguccucuucgaauguaaacuccacaaauccggcuacgucacaguagcucacacuggccagcacgaccuagucaucccucccaauggcuacuuccgauucgauuccuggguaaaccaauucuauacccucgcccccaugggaaacggcaccggccgccgccgagcccuuuaa

SEQ ID NO: 37243 - RNA, 1623 nt, Artificial Sequence
  derived and/or modified sequence opt11 from capsid_protein_VP1__Norovirus__ADI45810
augaaaauggccuccucugacgcaaaccccucagacggauccaccgccaacuuaguaccagaagucaacaacgaagucauggcccucgaaccugucgucggugccgcaaucgcagcccccguagcaggccaacaaaacguaaucgaccccuggauccgcaacaacuucguccaagcaccuggcggcgaguucaccgucuccccacgcaacgcccccggcgaaauccuauggucugcaccccucggccccgaccucaaccccuaccucucucaccucgcccgcauguauaauggcuacgcuggcggcuucgaaguccaagucauccuugcaggaaacgccuucaccgcagguaaaauaaucuucgccgcaguaccacccaauuucccaaccgaaggccuuucccccucccaaguaacaauguucccccacauaauaguugacguccgccaacucgaaccaguccuaauuccauuaccagacguccgcaacaauuucuaccacuacaaccagucuaacgacccaaccaucaaacuaaucgcaaugcucuacacaccacuacgagcaaacaacgcgggcgacgacgucuucaccgucuccugccgaguccugacccgcccaucaccagacuucgacuucaucuuccucgucccaccaaccgucgaaucacgaacaaaaccauucuccguccccauccucacagucgaagagaugacaaacucccgcuuccccaucccccuugaaaaacucuucaccggucccagcucagcauucgucguccaaccccaaaacggccgcugcacaacagacggcguacuacuaggcacaacccaacuuucacccguaaacaucugcaccuuucgaggcgacguaacccacaucacaggaucgcgcaauuacaccaugaaccucgcaacccaaaacuggaacuccuacgaccccaccgaagaaaucccagcaccacuaggaacaccugacuuugugggaaaaauccaaggaguccucacccaaaccacccgcgccgacggauccacccguggccacaaagcuacaguauacaccggcucagcagacuucgcucccaaacuaggccgcguacaguucgccacagacaccgacaacgacuucgacgccaaccaaaacaccaaauucacacccgucggcguaauccaagacggagacaccgcacaccgcaacgaaccccaacaauggguacuccccagcuacuccggccgcaacucacacaacguucaccuagcccccgccgucgcccccacuuuccccggcgaacaacucuuauuuuuccgauccaccaugccaggauguucaggauaccccaacauggaucuagacugccuccucccacaagaauggguacaauacuucuaccaagaagccgcacccgcccaauccgacgucgcccuucuucgcuucgucaaccccgacacuggccgaguacuauucgaaugcaaacuacacaaaucuggauacgucaccgucgcccacaccggccaacacgaccuugucaucccacccaacggcuacuuccgcuucgauuccuggguaaaccaauucuacacccucgcuccaaugggcaacggcacuggccgccgacgagcccuauga

SEQ ID NO: 37244 - RNA, 1623 nt, Artificial Sequence
  derived and/or modified sequence opt11 from capsid_protein_VP1__Norovirus__ADI45813
augaaaauggccagcuccgacgcuaaccccagcgacgguuccacagccaacuuagucccagaagugaacaacgaagucauggcccucgaaccagucgucggcgccgcaauagccgccccaguugccggccaacaaaacgucaucgaucccuggauccgaaacaacuucguccaggcccccggcggcgaguucacagucucuccccgaaaugcccccggagagauccuauggagcgcaccccucggacccgaccuaaacccauaccucucacaccucgccagaauguacaacggcuaugcaggcgguuucgaaguacaaguaauccucgccggcaacgcauucaccgcagguaaaaucauuuucgcagcuguaccacccaacuucccaaccgaaggccugucucccucccaagucacaauguucccccacaucaucguagacguucgccaacucgaaccaguacucaucccccuacccgacguucgcaacaacuucuaccacuacaaccaauccaacgaccccacaaucaaacugauagcaaugcucuacacaccccuacgugccaauaaugcaggagacgacgucuucaccgucuccugcagaguauuaaccagaccauccccagacuuugacuucauauuccucguaccgccaaccguugaaucccgcaccaaacccuucuccguaccaauccucacagucgaagaaaugaccaacucacgauuccccaucccacuagaaaaacucuucacaggccccuccucagcguucgucguccaaccccaaaacggacgcugcaccaccgacgggguccuccucggcacaacccaacuaucccccgucaacaucugcacuuucagaggggacgucacccacaucgccggaucccggaacuacaccaugaaccuagcaacccaaaacuggaacuccuacgaucccaccgaagaaauccccgcaccucucggcaccccagacuuugucgguaaaauacaaggcguccucacccaaaccacccgugcagacggcucuacacgcggccacaaagccaccguuuacacaggcuccgcagacuucgcccccaaacuaggccgcguacaauucgccacagacaccgacaacgacuucgacgccaaccaaaacaccaaguucacccccguaggcgucauccaggacggagacaccgcccaccguaacgaaccacaacaauggguccuaccauccuauaguggaagaaacucacacaacguccaccucgcacccgccguagcccccaccuuccccggcgaacaacuccucuucuuccgauccaccaugcccggaugcucaggcuacccuaacauggacuuagacugucuacucccacaagaauggguccaauauuuuuaccaagaggccgcccccgcccaauccgacgucgcccuccuucgauuuguaaacccagacacgggccgcguccucuucgaaugcaaacuacacaaaucugguuacgugaccgucgcacacaccggacaacacgaccucgucaucccaccaaacggcuacuuccguuucgauucuugggucaaccaauucuacaccuuagcccccaugggcaacggcaccggccgccgccgcgcccuauaa

SEQ ID NO: 37245 - RNA, 1608 nt, Artificial Sequence
  derived and/or modified sequence opt11 from capsid_protein_VP1__Norovirus__ADT70684
augaaaauggcauccaaugaugccgccccaucgaaugacggcgccgccggccuuguaccagaagucaacaaugaaacaauggcacucgaaccagucgccggcgcauccauagcagcaccccuaaccggccaaaacaacgucaucgacccauggauccgccucaacuucguacaagcaccgaacggcgaguucacaguaagcccccgcaacuccccaggcgaaguccuacucaaccucgaacuaggacccgaacuaaaccccuaccucgcccaccucucacgaauguacaauggcuacgcaggcggcguagagguacaaguccuacucgccggcaacgcauucaccgccggcaaacucgucuucgccgccgucccaccccacuucccacuagaaaacaucagccccggccaaauaaccauguucccacacgucauaauugacguccgaacccucgaaccagucuuacucccacugccagacguaagaaacaacuucuuccacuacaaccagcaaaacgaaccccgcaugcgccucgucgccaugcuuuacacaccgcuacguucaaacggcucaggugacgacgucuuuaccguauccugcagaguccucacacgccccaguccagacuucgacuucaacuaucucgucccacccaccguagaauccaaaaccaaacccuucacccucccuauacucaccaucggcgaacuaaccaauucacgcuucccagucccgauagacgaacuauacaccucccccaacgaaucacucgucguccaaccacaaaacggccgcugcgcccuagacggugaacuccaaggcaccacccaacuccugcccaccgcuaucugcuccuuucgaggccgaauaaaucaaaaagucagcggcgaaaaccacgucuggaacaugcaagucaccaacauaaacgggacacccuucgacccaacugaagacguaccagcaccccuuggaaccccugacuuuuccggcaaacucuucggcguccuaucccaacgagaccacgacaacgccugcaggucacacgacgccguaaucgccaccaacucagcaaaguucacacccaaacugggcgcuauucaaaucggcaccugggaacaagacgauguccacauaaaccagcccaccaaguucaccccugucggacuauucgaaagcgaaggcuucaaccaauggacccuucccaacuacuccggagcacuuacacucaacaugggccuagccccacccguagcacccacauuccccggcgaacaaauccucuucuuucgaucccacaucccccuaaaaggcggcgucgcagaccccgucaucgacugccuccucccacaagaauggauccaacaccuguaucaagaaucagccccaucccaaacagacguagcucuaauccgauucaccaacccagacacaggucgaguacuauucgaagccaaacuacaccgcuccggcuauaucaccgucgcaaauaccggaucacgacccauugucguaccugccaacggcuacuuccgcuucgacuccugggucaaccaauucuacucccucgcacccaugggaacaggcaacgggcggcgccgcgugcaauaa

SEQ ID NO: 37246 - RNA, 1608 nt, Artificial Sequence
  derived and/or modified sequence opt11 from capsid_protein_VP1__Norovirus__ADZ24003
augaaaauggccucaaacgaugccgccccuuccaacgacggagcugcgggccuagucccagaagucaacaacgaaaccauggcacuagaaccagucgccggagccagcaucgccgcaccccucacaggccaaaauaauguaaucgaucccuggauccgccuaaacuucguccaagccccuaauggcgaguucacagucucuccccguaacuccccaggggaaguccuccucaaccucgaacucggucccgaacucaacccauaucucgcacaucucucccgcauguacaacggcuaugccggcggcgucgaaguacaaguccuauuagccggcaacgccuucacagccggaaaauuagucuucgccgcaguaccuccccacuucccccuagaaaacauaagcccaggucaaaucaccauguucccccacguaaucaucgacguccggacacucgaacccguccuccuaccccuaccagacguccguaacaauuucuuccacuacaaccaacaaaacgaaccccgcaugaggcuaguagcaaugcucuacacgccccuacgcuccaacggcuccggagacgacgucuucaccguaucaugccgcguccucacccgcccauccccagacuucgacuucaacuaccucguaccacccaccgucgaaagcaaaacaaaacccuucacccuccccauccuuaccaucggugaacucaccaacucccgauucccagucccuauagacgaacucuacacaucacccaacgaaucacucgucguccaaccccaaaacggccgcugcgcgcuagacggcgaacuccaaggaaccacacaacuccugcccaccgcaauaugcucauuccggggccgcauaaaccaaaaaguauccggcgaaaaccacguguggaacaugcaagucaccaacaucgacggcacccccuucgaccccaccgaagacgucccagcuccccucggcaccccagacuucucaggaaaauuauucggcguacugucgcaacgagaucaugacaacgccugcaggucccacgacgcagucaucgccaccaauuccgccaaauucacacccaaacucggcgcaauacaaauuggcacaugggaacaggacgacguacauauaaaccaaccuaccaaauucaccccagucggcuuauuugaaucagaaggauucaaccaauggacccuccccaauuacucaggcgcccucacccuaaacaugggacucgcacccccagucgcccccacauucccaggagaacaaauccucuucuuccgcucacacaucccccucaaaggaggcgucgccgacccaguuaucgacugccuccucccucaagaauggauacaacaucucuaccaagaauccgcccccucacaaaccgacgucgccuugauccgguucaccaaccccgacaccggacgcguacuuuuugaagccaaacugcaccgcucaggcuacaucaccgucgccaacacaggcucaagacccaucgucguacccgccaacggauacuuccgcuucgacuccugggucaaccaauucuacucacucgccccaauggggaccggcaauggccgacgacgaguccaauaa

SEQ ID NO: 37247 - RNA, 1623 nt, Artificial Sequence
  derived and/or modified sequence opt11 from capsid_protein_VP1__Norovirus__AFI08234
augaaaauggcauccaacgacgcaaaccccucugauggcuccgccgcaaaucucguacccgaaguaagcaaugaaguaauggcucuugaacccguaguaggcgccgccaucgcagcuccagucgcaggucaacaaaacgucauugaccccuggauccgcaacaacuucguacaagcacccggcggcgaguucaccgucuccccucgcaacgccccaggcgaaauacucuggagcgcaccccuaggccccgaccucaaccccuaccugucacaccuagcccgaauguacaacggauacgccggcggcuucgaagugcaagucauacuugcaggcaacgccuucaccgccggcaagaucaucuuugccgcugucccacccaacuuccccaccgaaggccucucaccuucccaggucaccauguucccacacaucauagucgacguccgacaacucgaaccuguauuaaucccacugcccgacguccgcaacaacuucuaccacuauaaccaaaccaacgacuccaccauaaaacuuaucgccaugcucuacacuccccuccgcgccaacaacgccggugaagacgucuucaccguuuccugucgcguacucacccgacccagcccagacuucgacuucaucuuccucguucccccuaccgucgaaucccgcaccaaaccauucaccguccccauucuaacugucgaagaaaugacaaacucccgcuuuccaaucccccucgaaaaacucuucacaggucccuccggugccuucguuguacaaccccaaaacggccgcugcacaacagauggcguccuuuuagguacaacacaacuaucacccgucaacaucugcaccuuccgcggcgacaucacccacauagccggcagcagagacuacaccaugaaccuugccucacucaacuggaacaacuaugaccccacugaagaaauccccgcaccccucggcacacccgacuucgucggcaaaauacaaggcguacuaacacaaacaacgaaacgagacggaucaacacgcggccacaaagccaccgucuacaccggcuccgccccuuuuaccccaaaacuaggcuccguccgcuucucuacagacaccgaaaacgauuucgagacacaccaaaacacuaaauucacacccgucggaguaauacaagacggcucaaccacccaccgaaacgaaccacaacaauggguacucccauccuacuccggacgcgacguccacaacguccaccuagcucccgccguagcccccaccuuccccggcgaacaacuccucuucuuucgcuccaccaugcccggcugcuccggcuaccccaacauggaucucgacugccuacucccccaagaguggguccaacacuucuaccaagaagccgcccccgcacaaucagacgucgcacuccuccgcuucgucaaccccgacacaggccgcguacucuucgaaugcaagcuccacaagucaggcuacgucaccgucgcccacaccggccaacacgaccuagucauuccgcccaacggauacuuccgauucgauuccuggguuaaccaauucuauacacuagcacccaugggcaauggcaccggccggagacgcgcacucuaa

SEQ ID NO: 37248 - RNA, 1623 nt, Artificial Sequence
  derived and/or modified sequence opt11 from capsid_protein_VP1__Norovirus__AFI08237
augaaaauggccuccaacgacgcaaacccaucagacggcucagccgccaaccuagucccagaggucuccaacgaaguaauggcccucgaaccagugguaggcgccgccaucgccgcccccgucgccggacaacaaaacguuaucgaccccuggauccggaacaacuucguccaagcccccggcggcgaguucaccgucucuccccguaacgcccccggcgaaauccucuggucagccccacuaggaccugaccucaacccauaucuuucccaccucgcccgaauguacaacgguuacgcuggcgguuucgaaguacaaguuauccuugcaggcaacgccuucaccgcgggcaaaaucaucuucgccgcagucccacccaacuuucccacagaaggauuaagccccucccaagucaccauguuuccccacaucaucgucgacguccgacaacuugaacccguacucaucccccucccagacguacgcaacaacuucuaccacuauaaccaaacaaacgacuccaccaucaaacucaucgcaaugcucuacacaccccuacgagccaacaacgccggcgaagacgucuucaccgucuccugcagaguacuaacccgacccucccccgacuucgacuucauuuuccucgucccacccaccgucgaaucccggacaaaaccauucaccgucccuauccuaaccgucgaagaaaugaccaacucccgcuuccccauaccacuugaaaagcuguucaccggacccucaggugcauucgugguccaaccacaaaacggccgaugcacaacagacggaguacuccucggcacaacucaacuaucgccuguaaacaucugcaccuuccgcggagacguaacacacaucgccggaucccgcaacuacacgaugaaccucgccucccuaaacuggaacaacuacgacccaacugaagaaaucccugccccucugggaacucccgacuucgucggaaaaauacaagguguccucacacaaacaacaaaaggagacgggagcaccagaggccacaaggccaccgucuacaccggauccgcuccuuucacaccaaaacuaggcuccguccaauucucaaccgacacagaaaacgauuucgaaacccaccaaaauaccaaauucacucccguaggagucauccaagacggcggaaccacccaccgaaacgaaccacaacaauggguacucccauccuacucaggccgcgacguacacaacguccaccuugcccccgccgucgccccaaccuuccccggagaacaacuccucuucuuccgcuccaccaugccagggugcuccggcuauccaaacauggaccucgacugccuacuuccccaagaauggguccaacacuucuaccaagaggccgcacccgcacaaagcgacgucgcccuccuacgauucgucaaccccgacaccggucgcguccucuucgaaugcaaacuacacaaauccggcuacgucaccgucgcccacacaggucaacacgaccuaguaaucccacccaacggcuacuuccgauucgacuccugggucaaccaauucuacacacucgcacccaugggcaacggaaccggccgucgacgagcacucuaa

SEQ ID NO: 37249 - RNA, 1623 nt, Artificial Sequence
  derived and/or modified sequence opt11 from capsid_protein_VP1__Norovirus__AFI08243
augaaaauggccucaaacgacgccaaccccucggacggauccgccgcaaaccuuguacccgaagucuccaacgaagucauggcccucgagcccgucgucggcgcagcaaucgcugcacccgucgccggccaacaaaacgucaucgaccccuggauccgcaacaacuucguacaggccccaggcggcgaguucacgguaucaccccgcaacgcccccggagaaauccucugguccgcaccccuaggcccggaccucaaccccuaccuaucgcaccuagcccgaauguacaacggauacgcaggaggauucgaaguccaagucauacucgcaggaaacgccuuuaccgccggcaaaaucaucuucgccgcagucccuccaaacuuucccaccgaaggacucagccccagccaagucaccauguucccccacaucaucgucgacguccgccaacuagaacccguacucaucccccuacccgacguccgcaacaacuucuaucacuacaaccaaaccaacgacucaaccauaaaacucaucgccaugcuuuacaccccacucagagcaaacaacgcuggcgaagacguauucaccgucagcugcagaguccucacccgccccagcccagacuucgauuucauauuccuugucccucccaccgucgaaucccgcaccaaacccuucaccguacccauccucacaguagaagaaaugaccaacucccgguuuccaaucccauuagaaaaacuauucacaggcccaucuggcgccuucgucguacagccccaaaacggccgaugcacaaccgacggcguccuacuagguacaacccaacucucgcccgucaacauaugcaccuuccgcggcgacgucacacacaucgccgguuccagaaacuacaccaugaaccucgccucccucaacuggaauaacuacgacccaacagaagaaauacccgcaccccucggcacacccgacuucgucggcaaaauccaaggcguccucacccaaaccacaaaaggcgauggauccacacgcggacacaaagccaccgucuacaccggaucagccccguucaccccaaaacucggcuccguacaauucuccacagacacagagaaugauuucgaaacacaccaaaacaccaaauuuacaccagucggcguaauacaagacggcggcaccacccaccgcaacgaaccccaacaaugggcucugcccuccuacucuggcagagacguucacaacguccaccucgccccugcaguagcaccaaccuuccccggagaacaauuacuauucuucagaucaaccaugccaggcugcucuggcuacccaaacauggaucucgacugccuccuaccucaagaauggguccaacacuucuaccaagaagcagcuccagcacaguccgacgucgcacuccuaagauucgucaaccccgacaccggccgcguccucuucgaaugcaaacuccacaaauccggauacgucaccgucgcccauaccggacaacacgaccuaguaaucccacccaauggauacuuccgcuuugacuccuggguaaaccaguucuacacccuagcccccaugggcaacggaacaggacgcagacgugcacucuag

SEQ ID NO: 37250 - RNA, 1593 nt, Artificial Sequence
  derived and/or modified sequence opt11 from capsid_protein_VP1__Norovirus__AFJ38516
augaugauggcuuccaaagacgccaccuccucuguugacggcgcaucuggcgccggccagcuaguccccgaggucaacgccucagacccacuagcaauggacccaguagccggcucaucaaccgccguugcaaccgccggccaaguaaaccccaucgacccauggaucaucaauaacuucguacaagccccgcaaggagaauuuaccauuuccccaaacaacacacccggcgacguucuauucgaccucucacuaggcccacaccuaaacccauuccucuuacaucuaucccaaauguacaacggaugggucggaaacaugcgcguccgaauaaugcuugcaggaaacgcauucaccgccggcaaaauuaucgucagcuguaucccacccggcuucggcucccacaaccucaccauagcacaggccacccuuuucccucacgucauugccgacguccgcacgcucgaucccaucgaaguaccccuagaagacguccguaacguucucuuccacaacaacgaccgcaaccaacaaacuaugcgucucguaugcaugcucuacaccccucuccgcacaggaggcggcaccggcgacuccuucgucgucgccggccgcgucaugaccugccccucaccagacuucaacuuccuauuucuugucccacccaccgucgaacagaaaacccgucccuucacccuccccaaccuaccccucuccucucuaucaaacucccgagcaccccuacccaucuccuccaugggcaucucacccgacaacguccaauccguacaauuccaaaacggccgaugcacacucgacggacgucuagucggcaccacccccguaucccucucacacgucgccaaaauacgcggaaccucaaacggcacaguuaucaaccucacagaacucgacgggacccccuuucaccccuucgaaggacccgcccccaucggcuuccccgaccuagguggcugcgacuggcacaucaacaugacacaauucggccacucaucccaaacacaauacgacgucgauacuacaccagacaccuucguaccccaccuaggaucaauacaagccaacggcauaggcucagguaacuacgucggaguccuauccuggaucucacccccuucccacccaucaggaucacaaguagacuuauggaaaauccccaacuacggauccuccaucacugaagccacccaccucgcccccucugucuacccacccggauuuggcgaaguccucgucuucuucauguccaaaaugccuggccccggcgccuacaaccucccuugccuccucccccaagaauacauaucccaucucgcauccgaacaagcccccaccguuggagaagccgcccuacuccacuaugucgaccccgacaccggcaggaaccuaggcgaauuuaaagcauacccugacggcuuccuuaccugcguacccaauggcgcaagcuccggaccacaacaacuccccauaaacggcgucuucguauuuguuuccuggguuucucgcuucuaccaacuuaagcccguaggaaccgccuccucagcccgcggccgccuuggucuccgccgcuaa

SEQ ID NO: 37251 - RNA, 1620 nt, Artificial Sequence
  derived and/or modified sequence opt11 from capsid_protein_VP1__Norovirus__AFJ38519
augaaaauggccuccucugacgccaaucccuccgauggcagcgccgccaaccuagucccagaagucaacaacgaagucauggcccuugaacccguggucggcgccgccauagcagcccccgucgccggccaacaaaacaucaucgaccccuggauacgaaacaacuucguccaagcaccaggaggcgaguucaccguaagcccccgaaacgcaccaggcgaaauacucugguccgcaccucuaggccccgaccuuaaccccuaccuaucccaccugucccgcauguacaacggcuacgccggcggcuucgaagugcaaguuauacucgcagguaacgccuucacugccggcaaaguaaucuucgcagccgucccacccaauuuucccaccgaaggacucuccccaucccaaguaacaauguucccccacaucauagucgaugucagacaacucgaacccguauuaauaccccuccccgacguucgcaacaacuucuaccacuacaaccaagcccacgauucuacccuaaaacucauagcaaugcucuacacaccccuccgagcaaacaacgccggugacgacgucuucacugucuccugccgcguccuaacccgcccaucacccgacuucgacuucauauuccucgucccacccaccguugaaucacguacaaaacccuucaccguaccaauacuaaccguugaagaaauguccaacucccgcuucccaauaccacuagaaaaacuauauaccggccccuccuccgcauucgucguucaaccacaaaauggccgcugcaccacugacgguguccuccucggcacaacccaacuauccgccguuaacauaugcaacuuccgaggcgacgucacccgaguaggcaucagccacgacuacaccaugaaucucgucucccaaaacuggaacaacuacgaccccaccgaagaaauaccugcaccccucggaacaccugauuucgucggaaagauccaaggucuccucacacaaaccacacgagcugacggcagcacacgagcccacaaagccacagucuccacaggcuccguacacuucacacccaaacuagguucaguccaauucacuaccgacacaaacaacgacuuccaaaccggccaaaauaccaaauucaccccagucggcguaauccaagacggugaccaccaccaaaacgaaccacaacaauggguccuacccaacuacuccggaaccuccggccacaacguacaccuagcccccgccgucgcccccaccuuccccggcgaacaauuacuauucuucagaucaacuaugccuggaugcuccggcuauccaaacaugaaccucgacugccugcuaccccaagaauggguacuccacuucuaccaagaagcugcccccgcccaaucggacgucgcacuccuccgauucgucaaccccgacaccggcagaguccucuuugaaugcaaacuccacaaaucgggauacaucaccguagcccacacaggcccauacgaccucguaaucccacccaacggauacuuccgcuucgacuccugggucaaccaauucuauacccucgcucccaugggaaacgguaccggucgacgccgcgcccuauga

SEQ ID NO: 37252 - RNA, 1623 nt, Artificial Sequence
  derived and/or modified sequence opt11 from capsid_protein_VP1__Norovirus__AFW15937
augaagauggcaucuaacgacgccaacccaucagacggcuccgcagcaaaccugguccccgaggucaacaacgaagucauggcccuagaacccguagucggcgccgcaaucgcagccccagucgccggacaacaaaacgucauagaccccuggauaagaaacaacuucguccaagcccccggcggagaguucaccgucuccccacgaaacgccccgggcgaaauccuauggucagccccacuaggcccggaccucaauccuuaccuuucacaccuugcaagaauguacaacggcuacgccggcggcuucgaaguacaaguaauccucgcuggcaacgcauucaccgcaggaaaaauaauauucgccgccgucccacccaacuuccccacagaagggcucucccccucacaagucaccauguucccucacauaaucgucgacguccgccaacuggagccaguccucauaccacucccagacguccgaaacaacuucuaccacuacaaccaaagcaaugacucgacaaucaaacuaaucgccaugcuauacacaccccuccgagcaaacaacgcaggggaagacgucuucaccgucuccugccgaguacuuacccgacccuccccagacuuugacuucauauuccuggucccacccaccgucgaaagccguaccaaacccuucaccguccccauacucaccgucgaagaaaugacuaauucccgauuccccaucccccuagaaaaacucuucacaggacccuccuccgccuucgucguccagccccagaacggucgcugcaccacagacggcguccuccucggaacaacacaacucucacccgucaacauuugcacauuccgaggcgacgucacccacaucgcaggcucacguaacuacaccaugaaccuugccagcuuaaacuggaauaacuacgacccuacagaagaaauccccgccccacuuggcacccccgacuucguaggaaagauccaaggcguacuaacccaaacaacaaaaggcgacggauccacccgaggccacaaagccacagucuacacaggauccgcacccuucaccccaaaacuuggcucaguccaauucuccaccgacaccgaaaacgacuucgaaacacaccaaaacacaaaauucacacccgucggcguaauccaagacggaucaacuacccaccgaaacgaaccccaacaauggguccuccccaguuacucaggccgcaacguacaaaacguccaccucgccccagcagucgcaccaacauuuccaggcgaacaacuccuauucuuccgcucaaccaugcccggcugcuccggcuacccaaacauggaccucgacugccuccuaccccaagaauggguccagcacuucuaccaagaagcugcgcccgcccagagcgacgucgcccuccucagauucguaaaccccgacaccggcagaguucucuucgaaugcaaacuccacaaguccggcuacguaaccguagcccacacaggacaacacgaccucguaaucccacccaauggcuacuuccgauucgacucaugggucaaccaauucuacacccuagcuccaaugggaaacggcaccggacgccgccgcgcccucuaa

SEQ ID NO: 37253 - RNA, 1623 nt, Artificial Sequence
  derived and/or modified sequence opt11 from capsid_protein_VP1__Norovirus__AFW15939
augaaaauggccucaaacgacgccaaccccuccgacggcagcgcugccaaccuagucccugaaguaaacaaugaaguaauggcccuggaaccaguugucggcgccgccauagccgcacccgucgcgggccaacaaaacgucaucgacccauggauaagaaacaacuucguccaagccccaggcggagaguucaccguuucaccccgcaacgcccccggcgaaauacuaugguccgcgccccucggccccgaccucaaccccuaccucucccaccucgccagaauguacaacggcuacgccggaggcuucgaaguccaagucauccucgcaggcaacgcuuucaccgccggcaaaauuauuuucgccgcagucccacccaacuuccccaccgaaggacuuucacccucucaagucaccauguucccccacauuaucguagauguccgccaacucgaacccguccuaauuccccugcccgacguacgcaacaacuucuaccacuacaaccaaagcaacgauucaaccauaaaacuaaucgccaugcuguacacaccacuacgagcaaacaacgcaggcgaagacgucuucaccgucagcugccgaguucuaacccgaccguccccagacuucgacuucaucuuccuagucccacccacagucgaaucuaaaaccaagcccuuuacuguaccuauucucaccgucgaagaaaugaccaacucccgcuucccaauuccccucgaaaaacucuucacaggccccuccuccgccuucgucguccaaccccaaaacgggcgaugcaccaccgacggcguacuacuaggaacaacacaacucucccccgucaacaucuguaccuuccgcggcgacgucacccacaucgcuggcucccgcaauuacaccaugaaccuagccucccuaaacuggaacaacuacgaccccaccgaagaaauccccgccccacucggcacccccgacuuugucggcaaaauccaaggaguacuaacccaaaccaccaaaggagauggcucaacacgcggccacaaagcaaccgucuacaccggcagcgcaccauucaccccgaaacucggcucaguccaauucucuaccgacaccgaaaaugacuucgaaacacaucaaaacaccaaauucacaccagucggcguaauccaagacggcuccacaacccaccgaaacgaaccccaacaauggguccuccccuccuacagcggucgcaacgcccaaaacguacaccucgcccccgcugucgccccaaccuucccaggggaacaacuacuuuucuucagauccaccaugcccggcugcucagguuaccccaacauggaccucgacugccuccucccccaagaauggguccaacacuucuaucaagaagcagcccccgcccaaucagacguagcucuccuacguuucguuaaccccgacacaggaagaguccucuucgaaugcaaacuccacaaaucgggcuacgucaccguagcccacaccggacaacacgaccucguaaucccuccaaacgguuacuuccgcuucgauucauggguaaaccaauucuacacgcuagccccaaugggaaacggaacaggucgccgccgcgcccucuaa

SEQ ID NO: 37254 - RNA, 1623 nt, Artificial Sequence
  derived and/or modified sequence opt11 from capsid_protein_VP1__Norovirus__AFW15942
augaaaauggccuccaacgacgccaaccccagcgacgguucagcggccaaccuuguccccgaagucaacaacgaaguaauggcccucgaacccgucgugggagcugccauagcagcccccguagccggccaacaaaacgucauagaccccuggauccgcaacaacuucguucaagcgcccggcggugaguucacgguuucaccaagaaacgcaccaggcgaaauccuuugguccgcgccccucggacccgaucucaacccauaccucucacaccucgcccgaauguacaacggauacgccggaggcuucgaaguccaagucauacuagccggcaacgccuucacagccggcaaaaucaucuucgcagccgucccaccuaacuucccuacagaaggccucagcccuucccaagucacaauguucccccauauaaucgucgacguccgccaacuagaaccaguccucauaccccuccccgacguccgcaacaacuucuaccacuacaaccaauccaacgacuccaccaucaaacuuaucgccaugcuauacaccccacucagagccaacaacgccggagaagacgucuucaccgucucaugucgagucuuaacacgaccauccccagacuucgacuucauauuccucguaccacccaccguugaaucucgcaccaaacccuucaccgucccaauacuuaccgucgaagaaaugacuaauagccgcuucccgauccccuuagaaaaacuauucacaggacccucuucugcauucgucgugcaaccacaaaacggacgaugcaccacagacggcguacuacucggaacaacccaacucucgccaguaaacaucugcaccuuccgcggcgacguaacacacauagccggcucacgcaauuacacaaugaaccucgccucccucaacuggaacaacuacgaccccaccgaagagauaccagcaccccucggcaccccagacuucgucggaaaaauccagggcguccucacacaaaccaccaaaggcgacggauccacccgcggacacaaagccaccguauacaccggcucugccccauucacccccaaacucggcuccguccaauucuccaccgacacagaaaacgacuucgaaacccaccaaaacaccaaauucaccccuguaggagugauccaagacggaggcaccacccaucgcaacgagccacaacaauggguccugcccuccuacagcggcagaaacguccccaacguacaccucgccccagcagucgcccccacauuccccggcgagcaacuccucuucuuccgaucaacuaugcccggcugcuccgguuacccuaacauggaccuggacugccuucuuccccaagaauggguccaacauuucuaccaagaagcagcccccgcucaauccgacguagcacucuuacgauucguaaacccggacaccggacgcguccucuucgaaugcaagcuccacaaauccggauacgucaccgucgcacauaccggccaacacgaccuaguaauacccccaaaugguuacuuccgauucgacuccuggguaaaccaauucuacacacuagcccccaugggcaacggcaccggccgucgacgugcacucuaa

SEQ ID NO: 37255 - RNA, 1623 nt, Artificial Sequence
  derived and/or modified sequence opt11 from capsid_protein_VP1__Norovirus__AFW15943
augaaaauggccuccuccgacgcaaaccccuccgacggcuccaccgccaaucucguccccgaaguaaacaacgaagucauggcccucgaaccagucguuggugcagccaucgcagcccccgucgcaggccaacaaaacgucauagaccccuggaucagaaauaacuucguucaagcccccggcggcgaguucacagucucgccccggaacgcccccggagaaauacuuugguccgcaccccuuggccccgaccuaaaccccuaccucucccaccucgcccgcauguacaacggcuacgccggcggauucgaaguccaggucauucucgcuggcaacgccuucaccgccggcaaaauaauuuucgcagcuguaccaccgaacuucccgacugaaggccucucacccucacaagucacuauguucccgcacauuaucguagacguacgacaacuugaacccguccucaucccccuccccgacguccgcaacaacuucuaccacuacaaccagucaaacgacucuacaaucaaacucauagcaaugcucuacacaccccuuagagccaacaacgccggugacgacgucuucaccguauccugccgcguccucacccgucccucacccgacuuugacuucauauuccucgucccacccaccgucgaaucccgcaccaaacccuuuuccguccccguccucacaguagaagaaaugacaaacucacgauuccccaucccccuagaaaaacucuuuacaggccccuccagcgcuuucgucguccagccccaaaacggccguugcaccaccgacggcguccuccucggcaccacccaacuaagcccaguaaacaucugcaccuuccgaggcgacgugacacauauccccggaucacgcaacuacaccaugaaccucgccucacaaaauugguccuccuacgaccccaccgaagaaauccccgccccacucggaacaccugacuucgucggcaaaauccaaggcguccucacucaaaccacacgcacaaacggcagcacacgcggccacaaagcuaccgucuacaccggauccgccgacuucuccccaaaacuuggaagaguccaguucgcuacagacacagacaacgacuucgaaaccaaccaaaacacaaaauucaccccagucggcgucauccaagacggcuccacaacuccccgcaacgaaccccaacaguggguccuccccuccuacuccggacgcaacauccauaacguacaccuagcuccagcaguagcccccaccuuccccggcgaacaacuccuuuucuuccgcucuaccaugcccggcugcucuggauaccccaauauggaucuagacugccuucucccucaagaguggguacaauacuuuuaccaagaagccgcccccgcccaaagcgacgucgcgcuccuaagauucguaaaccccgacacaggccgaguucuauucgaaugcaaacuacacaaaagcggauacguaaccguagcccacaccggacaacacgaccuaguaaucccacccaauggcuauuuccgcuucgacucuuggguaaaccaauucuacacccuagcccccaugggaaacggcacaggccgacgacgagcccuguaa

SEQ ID NO: 37256 - RNA, 1623 nt, Artificial Sequence
  derived and/or modified sequence opt11 from capsid_protein_VP1__Norovirus__AFW15946
augaagauggcauccuccgacgcaaacccauccgacggcucaaccgccaaccucguucccgaagucaacaacgaaguuauggcccucgaacccguugucggcgcagccaucgcggcacccguggccggccaacaaaacgucaucgaucccuggauccguaacaacuucguccaagccccugguggagaguucaccgucuccccacgcaaugcccccggugaaauccucugguccgcuccccucggcccagaccucaaccccuaccuuucccaccucgcacgcauguacaacggcuacgccggcggauucgaaguacaagucauccucgcaggcaacgcauuuacagccggaaaaauaaucuucgccgccgucccuccuaacuuccccaccgaaggacucucccccucccaaguuaccauguucccccacaucaucgucgacguccgucaacuagaaccaguccuuauaccauuacccgacguccgaaacaacuucuaccacuauaaccaaagcaacgauuccacgauaaaacuaauagccaugcucuacacuccccuccgcgccaacaacgcuggagacgacgucuuuacagucuccugccgcguccuaacccgccccucucccgacuucgacuucauauuucucguuccaccaacaguagaaucccgcacaaaaccauucucgguacccguccucaccgucgaagaaaugaccaacucccgcuucccgaucccccuagaaaaacucuucaccggccccuccuccgcauucgucguccaaccccaaaacggucgaugcacgaccgauggcguccuccuugguaccacccaacucucacccguaaacauauguacauuccgaggcgacgucacccacauucccgguucucgaaacuacacaaugaaccucgcaucucaaaacuggaacaguuacgaccccacugaagaaaucccagcuccccucggcacucccgacuucguagggaaaauccaaggcguacuaacccaaaccacccgcacaaacggcucaacccgaggucacaaggcaaccgucuacaccggaucagccgacuucucacccaaacucggcagaguccaauucgccaccgacaccgacaacgacuucgaaaccaaccaaaacacaaaauucacacccgucggcgucauccaagacggauccacaaccccacgcaacgaaccacaacaaugggucuuacccuccuacucaggucgaaacauccacaacguccaccuugcgcccgcagucgccccaaccuuccccggcgaacagcuacucuucuuccgcucaaccaugcccggcugcuccgguuacccaaacauggaccuagacugccuacuaccccaagaauggguacaauacuucuaccaagaagccgcaccagcacaaucagacgucgcccuccuacgcuucgucaacccagacacaggacgaguccucuucgaaugcaaacuccacaaaucugguuacguuacagucgcccacacuggacaacacgaccucgucaucccacccaacggauacuuucgcuucgacuccugggucaaccaauucuacacacucgcccccaugggcaacggcaccggccgccgcagagcccuauga

SEQ ID NO: 37257 - RNA, 1647 nt, Artificial Sequence
  derived and/or modified sequence opt11 from capsid_protein_VP1__Norovirus__AFX71656
augaaaauggccucuaacgacgcugcccccuccaacgauggagccgcaggucucgucccagaaaucaacaacgaagccauggcccucgaacccguagcaggcgccgccaucgccgcuccacucaccggccaacaaaacauaauagaccccuggauaaugaacaacuuuguccaagccccaggcggcgaguucacugucucaccacgcaacucccccggcgaaguccuacucaaccucgaacucggacccgaaaucaaccccuaccuagcucaccuggcccgcauguacaacggcuacgccgguggcuucgaaguccaagucguacucgccggcaacgccuucaccgcaggcaaagucaucuucgccgccaucccacccaacuuccccaucgacaaccuaucugcagcccaaaucaccaugugcccccacgucauagucgacgucagacaacucgaaccaauaaacuuacccaugcccgacguucgaaacaacuucuuccacuacaaccaaggcucagacuccagacucagacucauagcaaugcucuacacaccccuccgcgcaaacaacucaggcgacgacguauucaccguaucaugccguguacucacaaggcccucacccgacuucuccuucaacuuccucguacccccuaccgucgaaucaaaaacaaagccauucacucuccccauacucaccauauccgaaaugucaaacagccgauuccccguccccaucgacucccuacauaccucacccaccgaaaacaucguaguacagugccaaaacggccgaguaacacuugacggcgaacuaaugggcaccacccaacuucuaccaucccaaaucugcgccuuccgcggaacacuaacccgcuccaccucaagagcauccgaccaggccgauacugccaccccacgccuauucaacuacuauuggcacauccaacuugacaaccucaauggaacccccuacgacccugcagaagacauccccgcaccacuagguacgcccgacuuccgcggcaaaguauucggcguagcuucccaacgaaacccagacuccacuacacgagcccacgaagccaaagucgacaccaccuccggccgauucacgccaaaacucggcucccuagaaaucucaaccgaauccgacgacuucgaccccaaccaaccuacccgauucaccccaguaggcaucggcgucgacaacgaagccgacuuccaacaauggagccuucccgacuauuccggacaauucacccacaacaugaaccucgccccagcaguugcccccaacuuccccggcgagcaacuacucuucuuccgcagccaacuccccucuucagguggacgcuccaacggaauccuugacugccucgucccccaagaauggguccaacacuucuaccaagaauccgcaccagcccaaacccagguugcacucguccgcuacgucaaccccgauacaggcagaguucuauucgaagcaaaacuccacaaacucgguuucaugacaaucgccaaaaacggagauucgccaauaaccguaccacccaacggauacuuccgauucgaauccuggguaaaccccuuuuacacccuagcccccaugggcacuggcaacggacgccgucgcauccaauaa

SEQ ID NO: 37258 - RNA, 1629 nt, Artificial Sequence
  derived and/or modified sequence opt11 from capsid_protein_VP1__Norovirus__AFX71659
augaaaauggccucaaacgacgccgcccccuccacagacggcgcggcgggccucguccccgaaucaaacuccgaaguaauggcccucgaacccgucgcaggcgccgcccuagccgcaccaguaaccggccaaacuaacauaauagaccccuggauccgagcaaacuucguccaggccccaaauggagaguucaccgugucuccccgcaacgcccccggagaaguccuucucaaucucgaacuuggccccgaauuaaaccccuaccucgcccaccucgcccgcauguacaacggcuacgccggcggaauggaaguccaagucaugcucgccggcaacgcauucacagccggaaaacucgucuucgccgcaguuccaccccacuuccccgucgaaaaccuaucaccccaacaaauaacuauguuuccccacgucaucaucgauguccgcacucucgaaccgguccuacuaccacuccccgacguccgcaacaacuucuuccacuacaaccaaaaagacgaucccaaaaugcgaaucgucgcaaugcuauacaccccacuccgguccaacggcuccggcgacgacgucuucacaguuucauguagagucuuaacacgccccucacccgacuucgacuuuaccuaccucgucccacccacaguagaauccaaaaccaaacccuucacccuaccuauccuuacacuuggagaacucagcaacucccgauuccccguaucaauagaccaaauguacacaucacccaacgaagucauuagcgugcaaugccaaaacggccgaugcacacuagauggcgaacuccaaggcacuacacagcuccaagucuccggcauaugcgccuucaaaggcgaagucaccgcccaccuucaagacaacgaccaccuuuacaacaucaccaucacaaaccucaacggcucaccauucgacccuagcgaagacauacccgcaccccucggaguaccagacuuucagggcagggucuucggcgucaucacacaaagagacaaacaaaacgccgccggacaaucacaaccugccaacagaggccacgaugcaguugucccuaccuacacggcacaauacacccccaaacuaggccaaguccaaaucggcacguggcaaaccgacgaucucaaagucaaccagcccgucaaguucaccccagucggccuuaacgacaccgaacauuuuaaccaguggguaguacccagauacgccggcgcauuaaaccuaaacaccaaccuagccccaucaguggcaccuguauuuccaggcgaacgacuccucuucuuccgcuccuaccuuccccucaagggcggauacgggaacccggccaucgacugccuacugccacaagaauggguucaacacuucuaccaagaagcagcccccuccaugucagaagucgcccucguacgcuacaucaaccccgacacaggacgcgcccuguucgaagccaaacuacaccgggccggcuuuaugaccgucuccuccaacaccucugcccccgucgucguaccagcaaacggcuacuuccgcuucgacucaugggucaaccaauucuauucacuagcucccaugggcaccggaaacggccgaagacgcauccaauag

SEQ ID NO: 37259 - RNA, 1623 nt, Artificial Sequence
  derived and/or modified sequence opt11 from capsid_protein_VP1__Norovirus__AFX81124
augaaaauggccuccaacgacgccaaccccuccgacggcuccgccgcaaaucucguccccgaaguaaguaacgaagucauggcccucgaacccgucgugggcgcagccauagcugccccaguugcuggccaacaaaacgucauugaccccuggauccgcaacaacuucguacaagcaccaggcggcgaauuuacugucuccccacgcaacgcacccggugaaauacucuggucagccccucuaggccccgaccucaacccauaccuaucacaucucgcccgcauguacaacggcuacgccggcggauucgaaguacaagucauucucgcaggaaacgcauucaccgcaggaaaaauaaucuucgcagccguaccacccaauuuccccaccgaaggccuaagccccucccaagucacuauguucccccauaucaucgucgacguucgccaacucgaacccguccuaauaccccuccccgacguccgcaacaacuucuaccacuacaaccagacaaacgacuccaccaucaaacucaucgccaugcucuacacaccacuacgcgcaaacaaugccggcgaagacgucuucaccguaucaugucgcguccucacaagaccuucaccagacuucgacuucaucuuccucgucccacccaccguugaauccagaaccaaacccuucaccguccccauccuuacaguagaagaaaugaccaacucacgcuuccccaucccacuugaaaaacuauucacaggacccuccggcgcuuucguagugcaaccccaaaacggccgcugcacaacagacggcguccuccucggcaccacucaacuaucuccagucaacaucugcacauuccgcggggacguaacccacaucgcaggcucccgcgacuacaccaugaaccucgcuuccuuaaacuggaauaacuacgacccaacagaagaaaucccagcaccacucggcacccccgacuucgucggcaaaauccaagguguacucacccaaaccacgaaaggcgacggauccacccguggacacaaagccaccgucuacaccggcuccgcccccuucacccccaaauuaggcuccguccaauucucaacagacaccgaaaacgacuucgaaacccaccaaaacaccaaauuuacccccgucggagucauacaagacggcggcaccacacacagaaacgaaccccaacaauggguacuacccucauacuccggccgcgacguccacaacguacaccuggcccccgccgucgccccgaccuucccaggagaacaacuccucuucuucagauccaccaugcccggcugcuccggguauccaaacauggaccuugacugccuccucccccaagaauggguacaacacuucuaccaagaagcagcacccgcucaaucagacguagcccuacuacgauucgucaacccugauaccggccgaguccuauuugaauguaaacuccacaaaucaggcuacguaacagucgcacauaccggccaacaugaccucgucaucccacccaacgguuacuuccgcuucgacuccugggucaaccaauucuacacccucgcacccaugggcaacgguaccggacgccgccgagcccucuaa

SEQ ID NO: 37260 - RNA, 1623 nt, Artificial Sequence
  derived and/or modified sequence opt11 from capsid_protein_VP1__Norovirus__AFX81133
augaagauggccucaaacgacgccaaccccuccgacggauccgcagcaaaccucguuccagaagucagcaacgaagucauggcuuuagaacccguagucggagcagccaucgccgcccccgucgcaggccaacaaaauguaaucgaccccuggauccgcaacaacuucguccaagcccccggaggcgaguucacagucucaccccgaaacgcacccggcgaaauccuaugguccgccccacugggcccggaccuuaaucccuaccucucacaccuggccagaauguacaacggauacgcaggcgguuucgaaguccaagucauccuagccggaaacgcauucacagccggcaaaaucaucuucgcagccguacccccaaacuuccccaccgaaggacucucacccucacaagucacuauguucccccacauaaucguagacguccgccagcucgaacccguacuaaucccccucccagacguccgcaacaacuucuaccacuacaaccaaaccaacgacucgaccaucaaacugaucgccaugcucuacacaccccuacgcgcuaacaacgccggcgaagacgucuucaccgucuccuguagaguccucacccgacccucacccgacuucgacuucaucuuccucguaccucccaccgucgaaucccgaaccaaacccuucacuguaccaauacucaccguagaagaaaugaccaacucucgcuucccuaucccacucgaaaaacucuucaccggccccuccggcgccuucguuguccaaccccaaaacgguagaugcaccaccgacgguguccuccuaggaaccacccaacuaucaccagucaacaucugcaccuuccgcggcgacguaacccacauagcgggcucacgcaacuacaccaugaaccucgcaucacuaaacuggaacaacuacgaucccaccgaagaaauccccgcaccacuaggaacccccgacuuugucggcaaaauccaagguguccuaacucaaaccaccaaaggagacggauccacaagaggccacaaagccacagucuacaccgggagcgccccauucaccccaaaacuuggcucuguacaauucucuaccgacaccgaaaacgauuucgaaacacaccaaaacaccaaauucacccccgucggcguaauccaagacggaucgacuacccaccgcaaugaaccucaacaauggguucugccauccuacuccggcagagacguccacaacguccaccucgcccccgcaguagcccccacauucccuggugaacaacuccuuuucuuucgauccaccaugcccggcugcuccggauaccccaacauggaucuagacugccugcucccccaagaauggguacaacacuucuaccaagaggcagccccggcacaaucagacgucgcccuccuacgcuucgucaacccugacacaggccgcguacuauucgaaugcaagcuacacaaaucaggauacgucaccgucgcucacaccggccagcacgaccucguaaucccucccaacggauacuuccgauuugacucauggguaaaucaauucuacacccucgcacccaugggcaacggcaccggcagacgacgcgcucuauag

SEQ ID NO: 37261 - RNA, 1623 nt, Artificial Sequence
  derived and/or modified sequence opt11 from capsid_protein_VP1__Norovirus__AFX81151
augaaaauggcauccaaugacgccaacccaagcgacggcucagccgcaaaccucguaccagaagucucaaacgaaguaauggcacucgagccagucgucggcgcugcaaucgcugcccccgucgcaggccaacaaaacguaaucgaccccuggauccgaaacaauuucguccaagcccccggcggagaguucaccgucucccccagaaacgcucccggcgaaauccuaugguccgcuccccucggccccgaccucaaccccuaccucucccaccucgcaagaauguacaacggauacgcaggagguuucgaaguacaagucauccucgcaggcaacgccuucaccgccggaaagauaaucuucgccgccguuccacccaacuuccccacagaaggccuaucacccucccaagucaccauguucccgcacauaaucgucgacguccgccagcuagaacccguccuaauccccuuacccgacguacguaauaacuucuaccacuacaaccaaaccaacgacagcaccauaaaacuaaucgccaugcuauacacaccccuacgagccaacaacgcaggagaagacgucuucaccguguccugccgcguccuaacccggccaucacccgacuucgacuucaucuuccuugucccacccaccgucgaaucucgaaccaaacccuucaccgugcccaucuuaaccgucgaagaaaugaccaacagccgcuucccaauaccgcucgaaaaauuauucacaggacccuccggcgcuuucgucguccaaccccaaaacggacguugcaccacagacggaguccuccucggcaccacccaacuuuccccggucaacaucugcacauuccguggcgacgucacccacaucgccggcucccgcaacuacaccaugaaccucgcaucccucaacuggaacaacuacgaucccaccgaagaaaucccagcaccccuagggacccccgacuucgucggcaaaauccaaggcguccuuacacaaaccacgaaaggcgacggcuccacccgcggccacaaagccaccguauacaccggcagcgcacccuucaccccaaaacucggcucaguccaauucucaaccgacaccgagaacgacuucgaaacccaccaaaacacaaaauucacccccgucggcguaauccaagacggaggcaccacacacagaaaugaaccucagcaauggguucuccccuccuacagcggccgcgacguucacaacguccaccucgcccccgccguagccccaaccuuccccggggaacaacuacucuucuuccgcucuacaaugcccggcuguuccggcuacccaaacauggacuuagacugccuccuaccccaagaaugggugcagcacuucuaccaagaagcugcaccagcccaaucagacgucgcccuccucagauucguaaacccugacacaggacgcguccucuucgaaugcaagcucuacaaaucaggcuacgucaccgucgcacacaccggucaacacgaccuuguaauacccccaaacggcuauuuccgauuugacagcugggucaaccaauucuacacgcuagcccccaugggaaauggaaccggaagacgacgagcucucuaa

SEQ ID NO: 37262 - RNA, 1623 nt, Artificial Sequence
  derived and/or modified sequence opt11 from capsid_protein_VP1__Norovirus__AFX81160
augaaaauggcccccaacgacgcuaaccccagcgacggauccgccgccaaccuagucccagaaguauccaacgaagucauggcacucgaacccgucgucggcgccgccauugcagcccccguagccggccaacaaaacguaaucgaccccuggauacgcaacaacuucguacaagcucccggaggcgaguucacagucagcccccguaacgcacccggagaaauacuuuggggcgcaccccuaggcccagaccuaaaccccuacuuaucccaccucgcacguauguacaacgguuacgccggcggcuucgaaguucaagucauacucgccggaaacgccuucaccgccggcaagauaauuuucgcugccguaccucccaauuucccaacugaaggccuuucccccucucaagucaccauguucccacacauuauuguagacguccgucaacuugaacccguucuaauaccucuacccgacguccgcaacaauuucuaccacuacaaccagaccaaugacuccacaaucaaacuaauagccaugcucuacaccccacuccgagccaacaacgccggcgaggacgucuuuaccguaucuugccgcguccucacucgcccuucccccgacuucgauuucauuuuccucgucccacccacuguagaaucucggaccaaacccuucacaguccccauccuaacaguagaagaaaugaccaacucccgcuuccccauaccuuuagaaaaacucuuuaccggccccuccggcgccuucgucguacaaccccaaaacggccgcugcaccacagauggcguccuccucggcaccacucagcucucacccgucaacauaugcacauuccggggugauguaacccacaucgccgguucacguaacuacaccaugaaccucgcaucccucaacuggaacaacuacgacccaaccgaagaaauccccgcaccacuugguacaccagacuucgucggcaaaauccaaggcguccucacccaaacaacaaaaggcgacgguuccacccgcggucauaaagcaaccguauacaccggcuccgcccccuucacccccaaacuaggcuccguccaauucuccaccgacacagaaaacgauuuugaaacacaccaaaacaccaaauucaccccagucggcgucauccaagacggcggcacaacucacagaaacgagccacaacaauggguccuacccucauacagcggccgcgauguccacaacguucaccucgcccccgcagucgcccccaccuucccaggagaacaacuccuauucuuccgcagcaccaugcccggauguucuggcuacccaaacauggaccucgacugccuacucccccaagaguggguacaacacuucuaccaagaagccgcacccgcacaaucagacguagcccuccuucgauucgucaaccccgacaccggccggguacucuucgaauguaaacuccacaaaucuggcuacgucacugucgcccacaacggccaacacgaccucgucaucccacccaacggauacuuccgcuucgacuccuggguaaaccaguuuuacacacuugcccccaugggcaacggcaccggacgcagacgagcacucuaa

SEQ ID NO: 37263 - RNA, 1623 nt, Artificial Sequence
  derived and/or modified sequence opt11 from capsid_protein_VP1__Norovirus__AFX81175
augaaaauggcauccaacgacgccaacccauccgauggaucugcugccaaccuagucccagaagucucaaacgaagucauggcccuagaaccuguuguaggagccgccaucgcagccccagucgcaggccaacaaaauguaauugaccccuggauacgcaacaacuucguacaagcaccuggaggagaguucaccgucucaccacgcaacgcacccggagaaauccucugguccgcuccccucggcccagaccucaaccccuaccucucccaccucgcccgcauguacaacggauacgccggaggcuucgaaguacaaguaauacucgccggcaaugccuucaccgccggcaaaauaaucuuugcagccguacccccaaacuuuccuaccgaaggccuaucaccaucacaagucaccauguucccccacaucaucgucgacguccgccaacucgaacccguccuuauaccccucccugacguccgcaauaacuucuaccacuacaaccaaaccaacgacccgacaauaaaacucaucgccaugcucuacacucccuugcgcgcuaacaacgccggcgaagacgucuucacugucucaugccgcguccucacucgccccucccccgauuucgacuucaucuuccucgucccacccaccguugaaucccgcacuaaacccuucacaguucccauccuaaccgucgaagaaaugaccaacucacgauuccccaucccccuagaaaaacucuucacaggacccucaggugccuucgucguccaaccccaaaacggacgcugcacgacagacggaguccuccucggcaccacacaacucucacccguaaacaucuguacuuucagaggcgacguaacucacaucgccgguucccgaaacuacaccaugaaccucgcaucacuuaacuggaauaauuacgacccaacagaagaaauccccgcaccccucggaacuccagacuucgucggcaaaauccaaggcguccuuacccaaaccaccaaaggcgacggaucaacccguggacacaaagccaccguauauaccgguucagcccccuucacaccuaaacuaggauccguccaauucucuaccgacacagaaaacgacuuugaaacccaccagaacacaaaauucacccccguaggcguuauacaagauggggguaccacccaccgcaacgaaccucaacaauggguacuacccucauauucaggccgagacguccacaacguccaccuagcccccgcaguagccccaaccuuccccggagaacaacuacucuucuuccgcucaacaaugccugguugcucaggcuacccuaacauggaccuagacugccuccucccccaggaauggguccagcacuucuaccaagaagccgccccagcccaaucagacgucgcccuacuacguuucgucaaccccgacaccggacgaguacucuucgaaugcaaacuccacaaauccgguuacguaaccgucgcccacaccggccagcacgaccucguaaucccaccuaacggcuauuuccgcuucgacagcugggucaaccaauucuacacacucgcgcccaugggaaacggaacaggccgacguagagcccucuaa

SEQ ID NO: 37264 - RNA, 1623 nt, Artificial Sequence
  derived and/or modified sequence opt11 from capsid_protein_VP1__Norovirus__AFX81184
augaaaauggcaucaaacgacgccaaccccucugauggcucugccgcuaaucucgucccagaagucuccaacgaagucauggcacuagaaccuguagucggcgcagccaucgccgcacccgucgccggccaacaaaacguaaucgaccccuggaucagaaacaacuucguacaagccccuggcggcgaguucaccgucucaccuagaaacgccccaggcgaaauccucuggucagcuccccuaggccccgaccucaaccccuaccuaucccaccucgcccgaauguacaacggauacgccggcggcuuugaaguccgcgucauacucgccggcaaugccuuuaccgccggcaaaauuaucuucgccgccgucccacccaacuuucccaccgaaggccuaucacccucccaaguaaccauguucccccacauaaucguagacguccgccaacuagaaccugucuuaaucccccuacccgacguacgcaauaacuucuaccacuacaaccaaaccaacgacucaaccaucaaacucauagcgaugcucuacacaccccuccgagcaaacaaugcaggcgaagacgucuucaccguuagcugccgcguccucacacgccccuccccagacuucgacuucaucuuccuagucccacccacaguagaaucccgcaccaaacccuuuacggucccaauccucaccgucgaagagaugaccaacucccgcuuccccaucccacucgaaaaacuauucaccgguccauccggagccuucguuguucaaccccagaacggacgaugcaccaccgauggcguucuccuuggcacaacccaacugagccccguaaacaucugcacuuuccgcggggacguaacacacaucgcgggcucacgcaacuacaccaugaaccucgcaucccucaauuggaacaauuacgaccccaccgaagaaaucccagcuccccucggcaccccugacuucgucggaaaaauccaaggaguacucacucaaaccacaaaaggcgacggcagcacacgaggccacaaagccaccgucuacacuggcuccgcaccauucacccccaaacucggauccguacaauucucaaccgacaccgaaaacgacuucgaaacccaccaaaacaccaaauucacccccguuggcguaauccaagacggcggcaccacacaccgcaacgaaccacaacaguggguacucccaucauacuccggaagagacguccacaacguccaccucgcccccgccgucgcccccaccuuccccggcgaacaacuccucuucuucagaagcacaaugccagguugcucaggcuaccccaauauggaccucgacugucuucucccccaagaauggguccagcacuucuaccaagaagccgcccccgcacaaucugacguagcacuccuccgauucgucaaccccgacaccggccgcguacucuucgaaugcaaacuacacaaauccggauacguuacugucgcacacacaggccaacacgaccucgucauucccccaaacggcuacuucagauuugacagcuggguaaaccaauucuacacccuagcuccaaugggcaacggaacaggacgccgcagagcccuauga

SEQ ID NO: 37265 - RNA, 1623 nt, Artificial Sequence
  derived and/or modified sequence opt11 from capsid_protein_VP1__Norovirus__AFX81187
augaaaauggccucaaacgacgccaacccuucagacggcucagccgccaaccucgucccagaagucuccaacgaagucauggcccuugaacccgucguuggcgcugccaucgcagcccccguugccggccaacaaaacgucaucgaccccuggauacgcaacaacuucguccaagcaccaggaggcgaguucacaguaucaccucgaaacgcucccggcgaaauccucugguccgcaccccucggccccgaccuuaacccauaccucucacaccucgcccguauguacaacggcuacgccggcggauucgaaguccaaguaauucuagccggaaacgccuucacagccggcaaaauaauauucgccgcagugcccccaaacuuccccaccgaaggucugucucccucucaaguaaccauguucccccacaucauagucgacguccgacaacucgaaccaguacucaucccacuaccagacguaagaaacaacuucuaccacuacaaccaaacuaaugacuccacaauaaaacuuaucgccaugcuauacacucccuuaagagccaacaacgcuggcgaagacguauucaccguaagcugucgaguccucacacgcccauccccagacuucgacuucaucuuccuaguaccacccacaguagaaucccgcaccaagcccuucaccguaccaauacuaaccguggaagaaaugaccaacucucgcuucccaaucccccuagaaaaacucuucaccggcccauccggcgccuucgucguacaaccccaaaacggccgcugcaccacagacggcguacuucuuggcaccacacaacucucccccgucaacaucugcgccuuccgcggagacgucacacacaucgcgggcucccgcaacuacaccaugaaccucgcuucccucaacuggaacaauuacgaccccacagaggaaauuccagcgccccucggcaccccugacuucgucggcaaaauccaaggcguccucacacaaacaaccaaaggugacgguucaacccgaggccauaaagccaccguauauacaggcucugcuccauucacccccaaacucggcuccguccaauucuccaccgacaccgaaaacgauuucgaaacccaccaaaauaccaaauucaccccaguaggcgugauccaagacggaggaaccacccaccguaacgaaccacaacaauggguccuacccucauacucaggccgagacgugcacaacguccaucucgcccccgccguagcacccacauuucccggcgaacaacuacucuucuuccguucuacgaugcccggcugcucaggauaccccaacauggaucuagacugccuccucccccaagaaugggugcagcacuucuaccaagaagccgcucccgcacaauccgacgucgcucuacuccgcuucgucaacccugacacaggacgcguccuauucgaaugcaagcuccacaaaucaggauacgucacagucgcccacacuggucaacacgaccuagucauacccccaaacggcuacuuccgcuucgacuccuggguaaaccaauucuacacccuugcaccaaugggaaacggcacaggacgccgcagagcacucuaa

SEQ ID NO: 37266 - RNA, 1623 nt, Artificial Sequence
  derived and/or modified sequence opt11 from capsid_protein_VP1__Norovirus__AFX81217
augaagauggccagcaacgacgcaaaccccaccgacggcuccgccgccaaucucguccccgaggucagcaacgaagucauggcccuagagcccgucgucggagccgccaucgcagcccccgucgccggccaacaaaacgucauagacccauggauccgcaauaacuucguacaagcacccggaggcgaguucaccgucucaccccguaacgcccccggcgaaauccucuggucagcuccccuaggacccgaccucaaccccuaccuaucccaccucgcccgcauguacaacggcuacgccggcggcuucgaaguccaaguaauccucgccggcaacgccuuuacagcgggaaaaauuauuuucgccgccgucccacccaacuuccccaccgaaggccuaucaccaucacaaguaaccauguucccacacauaaucguagauguccgccagcuagaaccuguacucaucccucucccagacguccgaaacaacuucuaccacuacaaccagaccaaugacucuaccauaaaacuaauagcuaugcucuacacaccacuccgcgcuaacaacgccggcgaagacgucuucaccgucucaugccgcguucuaacucgccccucccccgacuuugacuucaucuuccuaguaccacccaccgucgaaucucgcaccaaacccuucacuguccccauucucaccgucgaagaaaugacaaacucccgcuuccccauaccccucgaaaaacuuuucaccgguccauccggagccuuugugguccaaccccaaaacggccgaugcaccaccgacggaguccuccucggaacuacccagcucucccccgucaacaucugcaccuuucgcggcgacgucacacacaucgccggcucccgaaacuauaccaugaaccuagccucccuuaacuggaauaacuaugaccccacugaagaaauccccgccccacucggcacucccgacuucguaggaaagauucaaggcguccucacccaaaccaccaaaggugacggcucaaccagaggccacaaggcaaccguauacaccggauccgcacccuucacacccaaacuaggcucuguacaauucuccaccgauaccgaaaacgacuucgaaacccaccaaaacaccaaguucacccccguuggcguuauacaagacggcggaaccacacaccgcaacgaaccucaacaauggguccuucccuccuacuccggccgcgacguccauaacguacaccucgcacccgccgucgcaccaaccuucccuggcgagcaacuccuauucuuucgcucaacuaugcccggcugcucaggcuacccuaacauggaccuugacugccuacuuccucaagaauggguccaacacuucuaccaagaggccgcccccgcccaauccgacgucgcccuccuacgguucguuaacccagacacaggccgcguccucuucgaaugcaaacuccacaaaagcggcuaugucaccguagcacacaccggccaacacgaccucguaaucccacccaauggcuauuuccgcuucgauuccugggucaaccaauucuacacccucgcccccaugggaaacggcacgggccgacgccgagcccuauaa

SEQ ID NO: 37267 - RNA, 1623 nt, Artificial Sequence
  derived and/or modified sequence opt11 from capsid_protein_VP1__Norovirus__AFX81220
augaaaauggcuucuaacgacgccaaccccucagacggauccgccgccaaccucguuccagaagucuccaacgaaguaauggcccuugaaccggucgccggcgccgccaucgccgccccaguugcaggccagcagaaugucauagacccauggauccgaaacaauuucguccaagcccccgguggcgaguucaccgucucaccacguaaugcaccaggagaaauccucugguccgcaccccucggccccgaccuaaaccccuaccuaucccaccucgcccgcauguacaacggauacgccgggggauucgaaguacagguaauucucgccggcaacgccuuuacugccggcaaaaucauuuucgcugccgucccacccaacuuccccacagaaggccugucccccucccaggucacaauguucccacacaucauagucgacgucagacagcucgaaccuguccuaaucccacucccagacguccgcaacaacuucuaccacuacaaccaaaccaacgacuccacaaucaaacucaucgccaugcuauacaccccucuacgugcgaacaacgccggcgaagacgucuucaccguaucaugccgcguucuaaccagacccagccccgacuucgacuucaucuuccuagucccacccaccgucgaaucccgaacaaaacccuucaccguccccauucuaacagucgaagaaaugaccaacucucgauuccccaucccccucgaaaaacuauucaccggccccuccggcgcauucgucguccaaccgcaaaacggcagaugcacaaccgacggcguccuacucggcaccacucaacucucccccgucaacaucugcacauuccgcggcgacgucacccacaucgccggcagccgaaauuacacaaugaaccuagcaagccuaaacuggaacaacuacgacccaaccgaagaaauccccgcaccccuaggcacaccugacuucguaggcaaaauucaaggaguccucacccaaacaacaaaaggugacggauccacucgaggacacaaagccacuguauacaccggcuccgcccccuucacccccaaacucgguuccguccaauucucaaccgacaccgaaaacgacuucgaaacccaccaaaacacuaaauucaccccagucggcgucauccaagacggcggcaccacccaccguaacgaaccccaacaguggguucuacccucauacucaggccgcgacguccacaacguacaccucgcucccgccgucgcaccuaccuuccccggcgaacaacuacucuucuuccgcuccaccaugcccggaugcuccggcuacccaaauauggaccucgacugccuacucccccaggaauggguucaacacuucuaccaggaagccgcaccagcacaaucagaugucgcucuccuacguuucguaaaucccgacacaggccgaguccucuucgaaugcaaacuccacaaauccggauacguaacagucgcccacaccggucaacaugaccuugucaucccacccaacgguuacuuccgcuucgacucaugggucaaccaguuuuacacccuagcccccaugggcaacggaaccggacgccguagagcacucuaa

SEQ ID NO: 37268 - RNA, 1623 nt, Artificial Sequence
  derived and/or modified sequence opt11 from capsid_protein_VP1__Norovirus__AFX81223
augaaaauggcaucaaaugacgcaaauccguccgacggcucugccgccaaccuaguuccagaagucuccaacgaagucauggcccucgaaccagucguuggugccgccaucgcagcccccgucgcuggccaacaaaacgucaucgacccauggauacgaaacaacuucguccaagcacccggaggcgaguucaccgucucaccccgcaacgcccccggcgaaauacuuugguccgcuccccucggaccagaccucaaccccuaccuuagccacuuagccagaauguacaacgguuacgccggaggcuucgaaguccaaguuauccuagccggaaacgccuucaccgccggcaaaaucaucuucgcugccgucccaccuaacuuccccacugaaggucucuccccaucccagguuaccauguucccccacaucaucgucgacguacgccaacucgaaccuguccuuauaccacuaccagacguccgcaacaacuucuaccacuacaaccaaaccaacgacuccaccauaaaacucaucgccauguuauacacaccacuccgggccaacaacgccggagaagacgucuucaccguaucaugccgcguccucacacgacccucucccgacuucgacuucaucuuccuuguacccccuacugucgaaucacgcaccaaacccuucaccgucccaauacuaaccgucgaagaaaugacuaacucccguuucccaauuccccucgaaaaacucuucaccggacccucaggcgcauuuguuguccaaccccagaacgggcgcugcaccacagacggcguccuccuaggaaccacccaacucuccccugucaacaucugcaccuuucgaggagacgucacacacaucgccggcuccagaaauuacaccaugaaccucgccucacucaacuggaauaauuacgaccccaccgaagaaauucccgccccacucggaaccccagacuucguagguaaaauccaagggguccuaacccaaacaacaaaagaagacggcuccacacgcggccacaaagccacaguauacaccggcucugcaccauucacacccaaacucggcucaguccaauuuuccacagacaccgaaaaugacuucgaaacccaccaaaauaccaaauuuacccccguaggcgucauccaggacggcggcaccacccaccgaaacgaaccacaacaauggguacuaccaagcuacuccggccgcgauguccacaacguccaccuugcucccgcaguugcccccacauuccccggcgaacaaauccucuucuuccguucaacaaugcccggaugcuccggcuacccaaacauggacuuagauugccuccugccacaagaauggguccaacacuucuaccaagaagccgcaccagcccaauccgacgucgcccuccuccgcuucgucaaccccgacaccggccgcguccucuucgaaugcaaacuacacaaauccggcuauguaaccguagcgcacaccggacagcaugaccucgucaucccucccaacggcuacuuccgcuucgacucgugggucaaccaauucuacacccuagcacccaugggcaauggcaccggccgccgccgagcccuauaa

SEQ ID NO: 37269 - RNA, 1623 nt, Artificial Sequence
  derived and/or modified sequence opt11 from capsid_protein_VP1__Norovirus__AFX81235
augaaaauggccuccucagacgcaaaccccuccgacggcuccaccgccaacuuagucccagaaguaaacaacgaagucauggcccuugaacccguaguaggagccgccaucgcugccccagucgcaggccaacaaaacgucaucgacccauggauccgcaacaacuucguccaagcccccggcggcgaguucacaguauccccucgcaacgccccaggcgaaauccucugguccgccccucuuggcccagaccuaaacccauaccuuagccaccucgcucgaauguacaacggauacgccggcggguucgaaguccaagugauacuugcaggaaacgccuucacugcaggcaaaaucauauucgccgccguaccaccuaacuuccccacagaaggccuaucccccucucaagucacaauguucccccacaucaucgucgacguccgccaacuagaacccguccuuaucccauuacccgacguccggaacaauuucuaccacuacaaccaauccaacgacccaacuauuaaacucaucgcaaugcucuacacaccccuccgcgccaacaaugccggagacgacguauucaccguaagcugccgcguacuaacccgacccucccccgacuucgacuucaucuuccuagugcccccaaccgucgaaucccgcaccaaacccuucucaguaccgguacucacaguagaggaaaugacaaacucacgcuuccccaucccccucgaaaagcuauucacuggccccucuagcgccuucgucguccagccccagaacggccgcugcaccacagacggcguccuccucggaaccacccaacucucccccgucaacaucugcaccuuccgcggcgacgucacccacauaucuggaucgcguaacuacacaaugaaccuagcaucccaaaacuggaacuccuacgauccaacugaagaaauacccgccccacucggcaccccagacuucgucggaaaaauccaaggcguccuuacccagaccacaagaacaaacggauccacccgcggucacaaagcaaccgucuacacaggaucagcugacuucagcccuaaacuuggccgaguccaguucgcuacagacaccgacaacgacuucgaaacuaaccaaaacaccaaauucacacccgugggcgucauccaagacggcucuacgaccccucgcaacgaaccccaacaauggguacuacccuccuacuccggccgcaacauacacaacguacaccucgcccccgccgucgccccaaccuuccccggcgaacaacuacucuucuuucgcagcacaaugcccggcugcuccggauaucccaacauggaccucgacugccuccucccccaagaauggguccaauacuucuaucaagaagcggcgccagcccaauccgacgucgcccuccucagauucgucaaccccgacaccggcagaguacucuucgaauguaaacuacacaaauccggcuacgucaccguagcacacacaggacaacacgaccucgucaucccgccaaacggcuacuuccgauucgacucauggguaaaccaauucuacacccucgcaccaaugggcaacggcaccggccguagacgagcccucuaa

SEQ ID NO: 37270 - RNA, 1623 nt, Artificial Sequence
  derived and/or modified sequence opt11 from capsid_protein_VP1__Norovirus__AFX81259
augaaaauggccuccaacgacgccaacccaagcgacggcuccgcugccaaccuaguccccgaaguaucaaacgaaguaauggcacuagaacccgucguaggcgcugcaaucgcagcccccguagccggacaacaaaaugucaucgacccauggauccgaaauaacuucguccaagcaccaggcggagaguucacagucucuccccgaaacgcccccggcgaaauccucugguccgcaccccucggcccagaccucaaccccuaccuuucccaccuagcccgcauguacaacggcuacgccggcggcuucgaaguccaaguaauacuagccggcaacgccuucacugccggaaaaauaaucuuugcagcgguaccucccaacuucccaaccgaaggccuuagccccucgcaagucaccauguuuccacacaucaucgucgacgucagacagcucgaacccguccucauuccccucccagacguccgaaacaacuucuaccacuacaaccaaacuaacgacucgaccauaaaacuuauagcaaugcucuacacaccccuucgcgcaaacaacgcaggcgaagacguauucaccguauccugccgcguuuuaacgcgcccauccccagacuuugacuucaucuuccucgucccacccaccgucgaaucacgcaccaaacccuucaccguccccauacuaacaguagaagaaaugaccaauucacgcuucccaaucccccucgaaaaacucuuuaccggcccaucaggcgcauucgucguccaaccccaaaacggccgcugcaccacagacggcguccugcucggaacuacacaacuaucaccaguaaacauaugcacauuccgcggagacgucacccacaucgcaggcucuagaaacuacaccaugaaccuagccucacuaaacuggaacaacuacgaccccaccgaagaaauccccgcuccccucggaacuccugacuucgugggcaagauccaaggaguacucacacaaaccacaaaaggagacggauccacccgcggccacaaagccacagucuacacaggaucugcccccuucacccccaaacucggcuccguacaauucucaacugacaccgaaaacgacuucgaaacccaccaaaacaccaaauucacccccgucggaguaauccaagacggcggcaccacucaucgcaacgaaccccaacaauggguacuaccaucauacuccggucgggacguccauaacguccaccucgcccccgccgucgcccccaccuuccccggcgaacaacuucuuuucuuccgcuccaccaugccaggaugcuccggcuacccaaacauggaccuagacugccuccuaccacaagaguggguucaacauuucuaccaagaagccgcccccgcacaaagcgacguagcccuccuucgcuucgucaaccccgacaccggacgcguacucuucgaaugcaaacuccacaaaccuggauacgucaccguagcacacacaggccaacacgaccuagucaucccacccaacggauacuuccgcuucgacuccugggucaaccaauuuuacacacuugcccccaugggaaacggcaccggccgccgacgcgcccucuga

SEQ ID NO: 37271 - RNA, 1623 nt, Artificial Sequence
  derived and/or modified sequence opt11 from capsid_protein_VP1__Norovirus__AFX81280
augaaaauggccuccaacgaugcuaaucccuccgacggcuccgccgcuaaccuaguccccgaagucuccaaugaggugauggcccuagaacccgucguuggagccgccaucgccgccccaguugcaggccaacaaaacguaaucgaccccuggauccgcaacaacuucguacaagccccaggcggcgaguucaccguaucaccccgaaacgccccgggcgaaauauuguggggcgcccccuugggacccgaucucaacccuuaccucucccaccuagcccguauguacaacggcuacgccggugguuuugaaguccaagugauacuagccgggaacgcauucacugcaggcaaaaucauauucgcugcaguacccccuaacuuccccacagaaggccucucccccucucaagucaccauguucccacacauuaucgucgacguccgccaacucgaacccguccuaaucccccucccagacguccgcaacaacuucuaccacuacaaccagaccaacgacuccaccauuaaacuaaucgccaugcucuacacaccccuuagagccaauaacgccggcgaagacguauuuaccgucuccugccgaguacucacccgaccauccccagacuucgacuucauauuccucguaccacccaccguagaaucccgcacaaaacccuuuaccguccccauacuuaccgucgaggaaaugaccaacucccgcuuccccaucccccucgaaaaacuauucaccggcccaucaggcgccuucgucguccaaccccaaaacggccgcugcaccaccgacggaguccuacuagggaccacccaacucagccccgucaacaucugcaccuuccgcggcgacgucacacacauagccggcucgcgcaacuacacaaugaaccuagccucccuaaacuggaacaacuaugaccccaccgaagaaaucccagcaccacucggcacacccgacuucgucgguaaaauccaaggcguccuaacccaaaccacuaaaggcgacggcuccacccgcggccacaaagcaaccguauauaccggcuccgcucccuucaccccaaaacucggcucaguccaauucagcacagacaccgaaaacgacuucgagacacaucaaaacaccaaauucacccccgucggcgucauccaagacggaggaacgacccaccguaacgaaccccagcaauggguccuccccuccuauuccggcagagacguccacaacguccaccucgcaccagccguagcacccacuuuccccggcgaacaacuacuauucuuccguuccaccaugccaggaugcuccggcuaccccaacauggaccucgacugccuacuaccccaagaauggguucaacacuucuaccaagaagccgcccccgcccaaagcgacgucgcauuacuaagauucguaaaccccgacaccggccggguacuauucgaaugcaaacuccacaaaagcggcuacgucaccgucgcucacaacggacagcacgaccucgucauacccccaaauggauacuucagauucgauucuugggucaaucaauucuauacucuagccccuauggggaacggaaccggcagacgacgcgcacuguaa

SEQ ID NO: 37272 - RNA, 1623 nt, Artificial Sequence
  derived and/or modified sequence opt11 from capsid_protein_VP1__Norovirus__AFX81286
augaaaauggcaucaaaugacgcaaaccccuccgacggcuccgccgcuaaccucguccccgaagucucaaacgaagucauggcccucgagcccguagucggcgccgcaaucgccgcaccagucgcaggucaacaaaacgucaucgacccuuggauccgaaacaacuucguccaagccccaggaggagaguucacagucuccccacgcaaugccccaggagaaauccuaugguccgcaccccucggccccgaccucaaucccuaccuuucacaccucgcccgcauguacaacggcuacgcuggaggcuucgaaguacaagucauccucgccggcaacgcauucacagccggaaaaauuauauucgccgcuguacccccuaacuuccccaccgaaggacucagccccucccaagucaccauguucccccacaucaucgucgacguacgccaacucgaacccguucucaucccccucccagacguaagaaacaacuucuaccacuacaaccaaacaaacgacucuaccaucaaacuaaucgccaugcuauacacuccacuccgagccaacaacgcuggcgaagacgucuucaccgucucaugccgaguccucacccgccccuccccugacuucgacuucaucuuccucgucccaccaacagucgaaucucgcacaaaaccuuucaccguacccauccuaacggucgaagaaaugaccaacucaagauuccccaucccccucgaaaaacucuucacaggccccuccggcgcuuucguuguucaaccccaaaacggacgaugcaccacagacggcguccuccuaggcaccacacaacucuccccugucaacauaugcacauuccgcggagacgucacccacauagccggcucccgcaacuacaccaugaaccucgccagccuaaacuggaacaacuacgacccgaccgaagaaauccccgcuccccuaggcaccccugacuucgucggcaaaauccaaggcguacuaacccaaacaacaaaaggcgacggcuccacacguggacacaaagccaccgucuacacaggauccgccccuuucacccccaaacucggcucaguccaauucuccaccgauaccgaaaacgacuucgaaacccaucaaaacacaaaauucacccccgucggagucauccaagacggcggcaccacucaucgaaaugaaccccaacaaugggugcucccauccuauucaggccgagacguacacaacguccaccucgcccccgcggucgcccccaccuuccccggcgaacaacuucucuucuuccgcagcaccaugccgggaugcucgggcuacccuaacauggaccucgacugccuccucccccaagaauggguacagcacuucuaccaagaagcagcccccgcccaguccgacgccgcccuacuuagauuugucaacccagacaccggacgaguccuauuugaaugcaaacuacacaaauccggauacgucaccguugcacauacuggacaacacgaccuaguuauaccacccaacggauacuuucgcuucgauuccugggucaaccaauucuacacccucgcccccaugggcaacgguaccggccgcagacgcgcccucuaa

SEQ ID NO: 37273 - RNA, 1623 nt, Artificial Sequence
  derived and/or modified sequence opt11 from capsid_protein_VP1__Norovirus__AFX81310
augaaaauggccuccaaugacgcaaacccuuccgacggcuccgccgcgaaccuaguccccgaagucucaaacgaaguaauggcccucgaaccugucguaggugccgcaauagccgcccccgucgccggccaacaaaacgucauugaccccuggauuagaaacaacuucguacaagcccccggcggcgaguucaccgucucaccacguaacgcacccggagaaauacuauggucagcaccccucgguccagaccuaaacccauaccucucccaccuagcccgcauguacaacgguuacgccggaggcuucgaaguacaagucauccuagccggcaaugccuucaccgccggcaagaucaucuucgccgccguuccuccaaacuuccccaccgaaggccucuccccaagucaggucaccauguucccccacauaaucgucgacguccgccaacucgaacccguccucauuccccuuccagacguccgaaacaacuucuaccacuacaaccaaaccaacgacuccacuaucaaacucaucgcaaugcuauacacuccccuccgcgcaaacaacgcgggugaagaugucuuuaccgucucuugccguguccuaacacgccccucaccagacuucgacuucauauuccucgucccaccaacagucgaaucuagaacaaaacccuucaccguaccaauccucaccgucgaagaaaugaccaacucccgcuuccccauaccccuugagaaacuuuucaccggacccucuggagccuucgucguccaaccacaaaacggccgaugcaccaccgacggcguccuccuuggaacaacccaacuaucucccguaaacauaugcaccuuccgcggcgacgucacacacaucgcaggcucccgcaacuauaccaugaaccucgcaucccuuaacuggaacaacuacgaucccaccgaagaaauccccgccccacuaggcacacccgacuucgucggcaaaauacagggcguacuaacccaaacaaccaaggaagacggcuccacacgcggccacaaagccacaguauacaccggauccgcccccuucacccccaaacucgguucaguccaauucuccacagacaccgaaaacgacuucgaaacccaccaaaacacaaaauucacccccgucggcgucauacaagacggcggcaccacccaccgaaacgaaccacaacaauggguccuccccucuuacucgggcagagacguccauaacguccaccucgcgcccgccguugcccccaccuucccaggugaacaacuacucuucuuccgauccaccaugcccggcugcuccggcuaccccaacauggaccucgacugccuccucccccaggaauggguucaacacuucuaccaagaagcagccccagcccaguccgacgucgcucuacuccgcuucgucaaccccgauacaggucgaguccucuuugagugcaaacuucacaaauccggcuauguaacuguagcccauaccggccaacacgaccuaguaauacccccaaacggcuauuuccgcuucgacuccuggguaaaccaauucuacacccucgcacccaugggcaacgggacuggccgccgacgagcacuauaa

SEQ ID NO: 37274 - RNA, 1623 nt, Artificial Sequence
  derived and/or modified sequence opt11 from capsid_protein_VP1__Norovirus__AGE89469
augaaaauggcauccaacgacgccaacccaagcgacggauccgcagccaaucuaguccccgaagucucaaacgaagucauggcccucgaaccggucgucggagccgcaauagccgcaccagucgcuggccaacaaaacgucauugacccauggauccgcaacaacuucguacaagccccaggcggagaguucaccguaucaccaagaaacgcaccgggcgaaauccuaugguccgcaccccucggccccgaccucaaccccuauuuaucccaccucgccagaauguacaacggcuacgcaggcggcuucgaaguccgaguaauccucgccggcaacgccuucaccgccggcaaaaucaucuucgccgcagucccucccaacuuccccacggaaggcuuaucccccucccaaguaaccauguucccccacauaaucguugacguccgucaacuagaacccguccuaaucccccuccccgacguacgcaacaauuucuaccacuacaaccaaaccaacgacucaacaaucaaacuuaucgccaugcuauacacaccccuccgcgccaacaacgcaggagaagacguauucaccguauccugucguguccuaacaaggcccagccccgacuucgacuucaucuuccuuguaccacccaccguugaaucccgaacaaaacccuucaccguucccauccucaccgucgaggaaaugaccaacagccgcuuucccaucccccucgaaaaacuauucaccggccccagcggcgccuucgucguacaaccccaaaacggccgcugcaccacagacgggguccuccuaggaacaacacaacucagcccuguaaacaucuguaccuuccgcggcgacgucacccacaucgccggcucccgcaacuacacaaugaaccucgcaucacuaaacuggaacaacuaugaucccaccgaagaaauccccgcaccacuaggcacacccgauuucgucggcaaaauccaaggaguccucacccaaaccaccaaaggcgacgguuccacacgcggccacaaagccaccgucuacacaggcucugcccccuucaccccaaaacuaggcagcguccaauucucgacugauaccgaaaacgacuucgaaauucaccaaaacaccaaauucacaccaguaggcgucauccaggacggcggaaccacccaccgcaacgaaccucaacaauggguacuccccucuuacagcggacgcgacguccacaacgugcaccucgccccagccgucgcccccaccuucccaggggagcaacuccuauucuuccgcuccaccaugcccggaugcucaggcuacccaaauauggaccuagacugccugcucccccaagaauggguccaacacuucuaccaagaagcagcccccgcccaaucugaugucgcccuacuccgauucguaaacccagacacuggaagaguccucuucgaaugcaaacuacaccgcucgggcuacguaacagucgcccacacaggccaacacgaccuagucaucccaccaaacggcuacuuccgcuucgacucuuggguaaaccaauucuacacccucgcacccaugggcaacggcacaggccgccgccgcgcacuauaa

SEQ ID NO: 37275 - RNA, 1623 nt, Artificial Sequence
  derived and/or modified sequence opt11 from capsid_protein_VP1__Norovirus__AGE89484
augaaaauggccuccaacgacgccaacccaucagacggauccgccgcaaacuuagucccagaagugucaaacgaagucauggcccucgaacccguugucggcgcagcuaucgcagccccagucgccggacaacaaaacgucaucgaccccuggaucagaaacaacuucguacaagcacccggcggagaguucacagucucaccccgcaacgcccccggcgaaauccucugguccgcaccccuaggccccgaccuaaaccccuaccucucccaccuugcccgcauguacaauggcuacgccggaggcuucgaaguacaagucauccuagccggaaacgcauuuaccgccggcaaaaucaucuucgccgccgucccacccaacuuccccacagaaggccuauccccaucccaaguaaccauguucccccacauuauagucgacguccgacaacuagaacccguccugaucccccuaccagacguccgcaacaacuucuaccacuacaaccagacaaacgacuccaccaucaaacuaaucgcaaugcuauacaccccacuucgcgccaacaacgccggcgaagacgucuucacuguuucaugccgcguacucaccagaccaucaccagacuucgacuuuauauuccucguaccacccacaguagaauccagaaccaaacccuucaccgucccaauccucaccgucgaagaaaugaccaacucacgcuucccaaucccucuggaaaaacuuuucacuggacccagcggggccuuugucguucaaccccaaaacggacgcugcacaacugacggcgucuuacucggcacaacucagcuaucacccguuaacaucugcacauuccgcggcgacgucacccacaucgcaggcagccgcaacuacaccaugaaccuagcaucaaucaacuggaacaacuacgacccgaccgaagagauaccagcgccccucgggacucccgacuucgucggcaaaauccagggcguccuaacucaaacaaccaaaggcgacggcuccacccgcggccacaaagccacugucuacaccggaucugccccauucaccccuaaacucggcucugugcaauucucgaccgauaccgaaaacgacuucgaaacccaccaaaacaccaaauucacacccgucggaguuauccaagauggcggcaccacacaccgaaacgaaccucaacaauggguccucccaagcuacucaggccgugacguccacaacguccaccucgcccccgccguagcacccaccuucccaggcgaacaacuacuauucuucagaucaacaaugccaggcuguuccggcuaccccaacauggaccuugacugccuccuaccacaagaauggguccaacauuucuaccaagaagcagcaccagcacaguccgacgcagcacuccuucgcuucgucaaccccgauaccgggcgcguccuauucgaaugcaaacuccacaaaucuggcuacgucaccguagcgcacacuggacaacacgaccucguaaucccacccaacggcuacuuccgcuucgacucaugggucaaccaauucuacacucucgcccccaugggaaacggcaccggaagacgacgagcccuguaa

SEQ ID NO: 37276 - RNA, 1623 nt, Artificial Sequence
  derived and/or modified sequence opt11 from capsid_protein_VP1__Norovirus__AGE89487
augaaaauggcaucaaacgacgccaaccccucagacggauccgccgccaaccuaguaccagaagucaacaacgaaguaauggcacucgaaccaguagugggagccgcuaucgccgcccccgucgccggccaacaaaacguaauagaccccuggauacgaaacaacuucguccaggcccccggcggcgaauuuaccgucucaccacguaacgccccaggagaaauccucugguccgccccucuagggcccgaucuuaacccauaccucucccaccuagcacgaauguacaacgguuacgcaggaggcuucgaaguccaagucauccucgccggcaacgcauucacugccggcaaaaucaucuucgccgcagucccucccaacuucccuacagaaggccugucccccucccaagucaccauguucccccacaucaucgucgacguccgacaacucgaacccguccugaucccccuaccagacguccgcaauaacuucuaccacuacaaccaauccaacgacuccaccaucaaacuaauagccaugcucuauacaccacuuagagcaaacaacgcgggcgaagacgucuucaccgucuccugccgaguacucacucgacccucccccgacuucgacuuuauauuccuaguacccccaaccgucgaaagccgcacaaaacccuuuaccguccccauacuaaccguggaagaaaugaccaacucaagauuucccaucccacuagaaaaacucuucaccggccccagcggcgccuucgucguacaaccccaaaacggaagguguaccaccgacggcguacuacuugguacgacccaacucucacccgucaacauaugcacauucagaggcgacgucacccacaucgcuggcucccgcaauuacaccaugaaccucgccucguuaaacuggaacaacuacgaccccacagaagaaaucccugcgccccucggaacucccgacuucgucggaaaaauccaaggcguccucacgcaaacaaccaaaggcgacggcuccacgcgcggccacaaagccaccgucuacaccggcuccgccccauucacacccaaacuagguuccguacaauucuccaccgacaccgaaaacgacuucgaagcccaccagaacacaaaauucacacccgucggcgucauucaagacggaggaaccacgcaccgcaaugaaccccaacaauggguccuccccucauacuccggccgcgacguccacaacguacaccucgccccggccgucgcucccaccuuccccggcgaacaacucuuauucuuccgcagcaccaugcccggaugcuccggcuaccccaacauggacuuagacuguuuacuaccacaagaauggguccaacacuucuaccaagaagcagccccagcacaaucagacgucgcccuccucagauucgucaacccggauaccggccgcguccucuucgaaugcaaacuacacaaaucgggauacgucacaguagcccacaccggacaacacgaccucgucauaccacccaacggcuacuuccguuucgauuccugggucaaccaauucuacacucuugccccaaugggcaacggcaccggccgccgccgcgcccucuaa

SEQ ID NO: 37277 - RNA, 1623 nt, Artificial Sequence
  derived and/or modified sequence opt11 from capsid_protein_VP1__Norovirus__AGE89619
augaaaauggcaucaaaugacgcaaaccccagcgacggcuccgccgccaaccucguccccgaaguaucgaacgaagucauggcccucgaaccggucgucggagccgccaucgccgcacccguagccggccaacaaaacgucaucgaccccuggauccgcaacaacuucguccaagcccccggcggcgaguucaccguaucuccccgcaacgcccccggcgaaauacuaugguccgccccucuuggccccgaccucaaccccuaccucucccaucucgcccgaauguacaacggcuacgcaggcggcuucgaaguccaaguaauccuagccgguaacgcauucaccgccggaaaaauaaucuucgccgccguaccuccuaauuuccccacagaaggacucucccccucacaggucaccauguucccccacaucaucguggacgucaggcaacucgaacccguccucaucccacuccccgacguccgcaauaacuucuaccauuacaaccagaccaacgacucaaccauuaaacuaauagcaauguuauacacgccccuccgcgcaaauaacgccggcgaagaugucuuuaccgucuccugccgcguccucacccgacccucccccgacuuugacuucaucuuccuagucccacccaccgucgaaucacgcacaaaaccguucaccguccccauccuaacaguagaagaaaugacaaacucccgcuucccuaucccccucgaaaaacuauucaccggcccaucaggcgccuucgucguccaaccacaaaacggucguugcaccaccgacggcguccuccuagguaccacacaacucuccccagucaacaucuguacauuccgaggcgacguuacacacaucgccggcucccgcaacuauaccaugaaccuagcaucacucaacuggaacaauuacgacccuacagaagaaauacccgcaccucuuggaacacccgacuucgucggcaaaauccaaggaguacucacccaaacuacaaaaggcgacggcuccacccgcggccacaaagccaccgucuacaccgguucugcccccuucacccccaaacucggauccguucaauucucgaccgauacagaagacgacuucgaaacacaccaaaacaccaaauucaccccagucggcgucauccaagacgguggaacaacccaccgcaacgaaccccaacaauggguccuaccaucauacucaggacgagacguccacaacguacaccucgcaccagccgucgcccccaccuuccccggcgaacaacuccucuucuuccgcuccaccaugcccggaugcuccggauaccccaacauggaccucgacugucuacuaccucaagaauggguccaacacuucuaccaagaagcagcccccgcacaauccgacguagcccuccuacgauucguuaaccccgacaccggucgaguacucuuugaaugcaaacuccacaaaagcggauacguuaccguagcucacacaggacaacacgaccuuguaaucccuccuaauggguacuuccgcuucgacuccugggucaaccaauucuacacccucgcccccaugggcaauggcaccggacgacgccgagcccuauag

SEQ ID NO: 37278 - RNA, 1623 nt, Artificial Sequence
  derived and/or modified sequence opt11 from capsid_protein_VP1__Norovirus__AGE89670
augaaaauggccuccaacgacgcaaacccaucagacggcuccgcagccaaccucguccccgaagucucaaacgaaguaauggcccucgaacccgugguuggugccgcaaucgccgcccccgucgcaggacaacaaaacgucaucgaccccuggauacgaaacaacuucguccaagcccccggcggcgaauuuacagucuccccacgcaacgcuccaggagaaauccuaugguccgcaccgcucggccccgacuugaacccuuaccugucccaccucgcccgcauguacaacggcuaugccggcggcuuugaaguccaagucauucucgccggcaacgccuucaccgccggcaaaaucauauucgcagccguuccucccaacuuccccaccgaaggacucucccccucccaagucaccauguucccacacauuaucgucgacguccgucaacucgaacccguccuaaucccccucccagacguccgaaacaacuucuaccacuacaaucaaaccaacgaccccacuaucaaacuaauagccaugcucuacacuccccuacgcgcaaacaacgccggcgaagacgucuucaccgucuccugcagaguccucacccgccccucaccagauuucgacuucaucuuucuuguacccccuaccguugaaucacgcaccaaacccuucaccguacccauccuaaccgucgaagaaaugaccaacagccgcuuccccaucccccucgaaaaacucuucaccggccccagcggcgcuuucgucguccaaccacaaaauggacgcugcaccaccgacggcguccugcuuggaacaacccaacucucccccguuaacauaugcaccuuccgaggagacguaacccacauagcaggaucccgagacuacaccaugaaccuagccucccucaacuggaacaacuacgacccaacggaagaaauaccugcuccccuuggcacgcccgauuucgucggcaagauccaaggcguacucacacaaacaacccgaggagauggcuccaccagaggccacaaagccaccgucuauaccggcuccgcaccauucgcccccaaauuaggaucuguccaauucuccacagacaccgaaaaugauuucgaaacccaucaaaacaccaaauucacuccugucggcgucauccaagacggcggaacaacccaccgcaacgaaccccaacaauggguacucccuucauacagcggacgcgacguacacaacguccaucucgccccggcagucgcaccaaccuuccccggcgagcaacuccucuuuuuccgcuccaccaugcccgguugcuccggcuacccaaacauggaccuagacugucuacucccucaagaauggguacaacacuucuaccaagaggcagcccccgcacaaagcgacgucgcccuccuacgcuucguaaacccugacacaggccgcguccucuucgaauguaaacuccacaaguccggauacgucaccgucgcccacacaggacaacacgaccucgucauacccccaaacgguuacuuccguuucgacucauggguaaaccaauucuacacacuagcaccgaugggcaacgguaccggccgcagacgggcacucuaa

SEQ ID NO: 37279 - RNA, 1623 nt, Artificial Sequence
  derived and/or modified sequence opt11 from capsid_protein_VP1__Norovirus__AGE99596
augaaaauggccuccaacgaugccaaccccucagacggcuccgccgcuaaccucguaccagaaguaaacaacgaagucauggcacucgaacccguagucggcgccgcaaucgccgcacccguagccggccaacaaaacguaaucgaccccuggauccgcagcaacuucguccaagcccccggcggcgaguucaccguuucgccacgcaacgccccgggagaaauucucugguccgccccacuaggacccgaccuaaaccccuaucucucccaccucgcccgcauguacaacggcuacgcaggcggauucgaaguccaaaugauccucgcaggaaacgccuucacagccggcaaaauuaucuucgccgccguuccgcccaacuuccccaccgaaggacucagccccucacaggucacaauguucccccacauaauagucgacguccgccaacuagaacccguccuaauuccccuacccgauguacgcaacaauuucuaccacuauaaccaauccaacgacccaacaaucaaacuuauagccaugcucuacacuccccuccgcgccaacaaugcaggcgaugauguauuuaccgucucaugccgcguccuuacacgccccucccccgacuucgacuucaucuuccucgucccacccaccgucgaaucccgaaccaaacccuucaccguccccguccucacagucgaagaaaugacuaauucccgcuuccccauaccccucgaaaaacuauucaccggccccucgagcgccuuugucguccaaccucaaaacggacggugcaccacagacggaguacuacucgguacaacccaacuaucccccgucaacaucugcacuuuccgcggcgacguaacccacauagccggcucccgaaacuacaccaugaaccuagcaagccucaacuggaacaacuacgacccaacagaagaaauccccgcaccccucggcacccccgacuucgucggcaaaauccaaggaguacuuacacaaaccacaaaaggcgacggcuccaccagaggccacaaagccacugucuacaccggcuccgccgacuucacgcccaaacuaggcuccguccaauucggcaccgacacugacaacgacuucgaaacccaccaaaacacucgcuucacccccgucggcgucauccaagacggcgcaacaacccacagaaacgaaccccagcaauggguccuccccuccuacuccggaagaaacguacacaauguacaccuagcucccgcgguagccccuaacuuccccggcgaacagcuucuauucuuccgcucuacaaugcccgguugcucaggcuaccccaacauggacuuagauugccuacucccccaagaauggguccaacacuucuaccaagaagcugcgccagcccaauccgacguagcacuccuaagauucguuaacccggacaccggccgaguacucuucgaauguaaacuacacaaaucuggauacguaacuguagcccacacaggacaacacgaccucgucaucccaccuaacggcuacuuccgcuucgauuccugggucaaccaauucuacacacuagcccccaugggaaacggcaccggacgacgccgugcacucuaa

SEQ ID NO: 37280 - RNA, 1653 nt, Artificial Sequence
  derived and/or modified sequence opt11 from capsid_protein_VP1__Norovirus__AGE99599
augaaaauggcauccaacgacgccgccccauccaacgacggugccgccaaccucguacccgaagccaacaacgaagucauggcccucgagccaguaguaggagcaucaauagcagcccccguaguaggccaacagaauauaaucgaucccuggauccgcgaaaacuuuguccaagcaccccaaggcgaauuuaccgucucuccccgaaacuccccaggcgaaaugcuccucaaccuagaacucggccccgaacuuaacccuuaccucucacaccuaucccgaauguacaacggauacgccggcggcaugcaaguacaaguaguccucgccggcaacgccuucaccgcgggcaaaaucauauucgccgccgugccuccacacuuucccguagaaaacauaucagccgcccaaaucacaaugugcccccacgucaucguagacguaagacagcucgaacccguccuacuuccccugcccgacauccgcaacagguucuuccacuacaaucaggagucuacaccccgcaugcgccuaaucgccaugcuuuacacaccccuacgagccaacuccggcgaagacgucuucaccgucucuugccgcguccuaacccgcccugcacccgacuucgaguucaccuuccuaguaccaccaaccguugaaagcaaaaccaaaccguucacccucccaauccucacccuaggcgaacuauccaacuccagauuccccgccgcaaucgacaugcuguacacugaccccaacgaaucaaucgucguccaaccacaaaacggccgaugcacccucgacggaacccuccaaggcacaacccagcuaguacccacccaaaucugcgccuuccgugguacgcucaucucacaaacugcucgcgcagccgacagcaccgacucaccacaacgcgcccgagaucacccacuacacguccaaguuaaaaaccuggauggaacacaauacgaccccacagacgacauccccgccguacucggcgccaucgacuucaaaggcacaguguucggcgucgccagccaacgcgacguauccggacaacaagaacaaggccacuacgcaacacgcgcccacgaagcccacaucgacaccacagacccaaaauaugcaccuaaacucggcaccauacucaucaaauccgaaagcaacgacuucaccaccaaccaacccauccgauucaccccagucggcaugggagacaacaacuggcgacaaugggaacucccugacuacuccggacgccuaacccuaaacaugaaccuugccccagcaguaagccccucauuccccggcgaaagaauacucuucuuccguuccauaguccccucagccggcggcuucgggucagguuacauugacugccugauaccucaagaauggguccaacacuucuaccaagaagccgcccccucccaauccgccguagcucuagugcgauacguaaaccccgacaccggccguaacauauucgaagccaaacugcacagagagggcuuccucaccguagccaacuccggcaacaacccaaucgucgucccacccaacggcuacuuccgauucgaagccuggguaaaccaauucuacaccuuagccccuaugggcuccggccaaggccgccgacgcgcccaauag

SEQ ID NO: 37281 - RNA, 1620 nt, Artificial Sequence
  derived and/or modified sequence opt11 from capsid_protein_VP1__Norovirus__AGE99612
augaaaauggccuccucagacgccaacccuuccgacggcucgucagccaaccuggucccagaagucaauaacgaaguaauggcacuagaaccaguaguuggagccgccauagcugcuccaguagcaggacaacagaacaucaucgaucccuggauacgcaacaacuucguucaggcucccggcggcgaauucaccgucucaccacgaaacgcccccggggaaauacucuggagcgcgccucuaucccccgaccucaacccauaucucucccaucuuucccgcauguacaauggcuacgcaggcggcuucgaaguccaagucauacucgccggcaacgcauucaccgcuggcaaaauugucuucgcagcaguaccccccaacuuccccaccgaaggccucagcccuucgcaaguuacaauguucccccacaucaucgucgauguccgccagcucgaacccguucucaucccccuccccgacguucgcaacaacuucuaccacuacaaccaagcaaacgacuccacccuaaaacuaaucgccaugcuauacacaccccucagagcuaacaacgccggcgacgacguuuucaccgucucaugcagaguccucacucgucccucgcccgauuucgacuucaucuuccucgucccccccacaguagaaucccgcaccaaaccguucaccguacccguacucaccgucgaagaaaugaccaauucacgcuuccccaucccacuagaacgccucuucaccggcccauccacugccuucgucguccaaccccaaaacggacgcugcacgaccgacggcguucuacucggaacuacccaacucucagccgucaacaucuguaacuuccgcggagaagucaaccacaucgcaggcacacacgacuacaccaugcgccucaccucacaaaacuggaacaacuacgacccgacagaagaaauaccagcaccccuaggaacccccgacuucgucggacgaauucaaggcguccucacccaaacuacccguuccgacggaucaacccggucucacaaagcaacuguuucaacaggcuccguccacuucacacccaaacucggcuccguccaauucacaaccgacacaaccaacgaccucaacgccggccaaaacacaaaauucacuccuguuggcguugaacaaaccuccggagaucaccaauccgaaccucaacaauggacacuaccaaacuauuccggaacacccaaccauaacguccaccucgcaccagcagucgcccccaccuuccccggcgaacaauuacucuucuucagauccacccuccccggcugcggagguuacccuaacaugaaccuagauugccuacucccccaagaaugggugcuccacuucuaccaagaagccgcccccgcucaauccgacgucgcccuacuacgcuucgucaaccccgacacaggccgaguuuuauucgaauguaaacuccaccgcuccgguuucaucacagucgcacacuccggcucccacgaccucguaaucccuccuaauggcuacuuccgauucgacuccugggucaaccaauucuacacucucgccccaaugggcaacggcagcggccgccgcagagucgucuaa

SEQ ID NO: 37282 - RNA, 1647 nt, Artificial Sequence
  derived and/or modified sequence opt11 from capsid_protein_VP1__Norovirus__AGI17609
augaaaauggccucaaacgacgccgcucccuccaacgauggcgccgccggucuaguucccgaaauaaacaacgaagcaauggcccuagaaccggucgucggagccgcuaucgccgcuccccucaccggacaacaaaauauaaucgaccccuggauaaugaacaacuucguacaagcccccggcggcgaauuuacagucucaccccgaaacucccccggcgaaguccuacuaaaccucgaacuaggaccugaaaucaaccccuaccucgcccaccuagcacguauguacaacggcuacgccgguggcuuugaaguccaaguaguccucgcaggaaacgcguucaccgccggcaaaguaaucuucgcggccauacccccaaacuuccccaucgacaaccucucugcagcccaaaucaccaugugcccccacgucaucgucgacguacgacaauuagagcccaucaaccuacccaugccagacguccgcaacaacuucuuucauuacaaucaaggauccgacucccgccuccgccucaucgccaugcuauauacaccccuacgagccaacaacuccggcgacgacgucuucaccguuucaugccgaguccucacacgacccucuccagauuucucuuucaacuuccucguacccccuacagucgaauccaaaaucaagcccuucacccuccccauccuaacuaucucggagauguccaacucccgcuucccagucccuaucgacucucuacacacaucccccaccgaaaauaucgucguccaaugccaaaacggccgaguaacacucgauggcgaacuaaugggcaccacccaacuccuccccucacaaaucugcgccuuccggggcacacucacccgcucuacuucccgcgcauccgaccaagccgacacggccacaccccgcuuauucaacuacuacuggcauauacaacucgacaaccucaacggcaccccauacgacccagccgaagacauaccagcacccuuagguacccccgauuuccgcggaaaagucuucggcguugccucccagcgcaaccccgacagcaccacccgcgcccacgaagcaaaaguagauaccaccuccggccguuucacuccuaaacucggcucgcucgaaaucucaacagaauccggcgacuucgaccccaaccaaccaaccagauucacacccgucggaauagggguagacaacgaagccgacuuccaacaauggucucuccccgacuauuccggccaauuuacccacaacaugcaccuagcacccgcagucgcccccaacuuucccggugaacaacuccucuucuuccgcucccaauuacccuccuccggcggacgcucaaacggaauccucgacugccuaguaccacaagaguggguccaacacuucuaccaagaaagcgcucccgcacaaacucaagucgcccucguccgcuacguaaaccccgacaccggccguguacuguucgaagcaaaacuccacaaacucggcuucaugaccaucgccaaaaacggugacucccccaucaccgucccaccgaacggcuacuuccgcuucgaauccugggucaacccauuuuacacccuagcacccaugggaaccggaaacggaagacgacgcauccaguaa

SEQ ID NO: 37283 - RNA, 1593 nt, Artificial Sequence
  derived and/or modified sequence opt11 from capsid_protein_VP1__Norovirus__AGM33211
augaugauggccucaaaagacgcaaccucaucuguugacggcgccuccggagcuggccaacucguacccgaaguaaacgcaucugaccccuuagcuauggaucccgucgcaggcagcucaacagcagucgccaccgccggccaagucaaccccaucgaccccuggaucauaaacaacuucguccaggcaccccaaggcgaauuuaccauauccccaaacaacacacccggcgacguccucuucgaccucucccuaggaccacaccuuaaucccuuccuccuccaccucucacaaauguacaacggcuggguuggcaacaugcgcguaaggaucaugcucgccggaaacgccuucacagccggcaaaauaauagucuccugcaucccaccaggcuucggcucccacaaccuuacaauagcccaagcaacccucuucccacacgucauagcagacguccgcacacuagacccaauagaaguaccccucgaagacguccguaacguacuauuccacaauaacgaccgcaaccaacaaacaaugcgccucgucugcauguuauacacaccccuucgcaccgguggcggcaccggcgacucauucgucgucgccggacgugucaugaccugccccuccccagacuucaacuuccuauuccuaguacccccaaccgucgaacagaaaacccgcccauucacacucccaaaccucccccucucaucccuaucuaacucacgagcuccccuccccauauccuccaugggaauaucacccgacaacguacaaucuguacaauuccaaaacggccgaugcacucucgacggccgccucgucggcaccacccccgucucacuaucccacgucgccaaaauccgaggcacuucaaauggaaccguaauaaaucucacagaacuagauggaaccccauuccaccccuuugaaggccccgcccccauaggcuuccccgaccuuggcggaugcgauuggcacaucaacaugacccaauucggacacaguucgcaaacccaauacgauguaaacaccacuccugacaccuucgucccccacuugggcaguauacaagccaacggcaucggcucaggcaauuacguuggaguacucuccuggaucuccccacccucacaccccuccggaagccagguagaccucuggaaaauccccaacuacggauccuccauaaccgaagccacccaccucgcccccuccgucuacccucccggcuucggcgaaguacucgucuucuucauguccaaaaugcccggccccggcgccuacaaccuucccugccuacucccccaagaauacaucucacaccucgccucugaacaagcccccaccgucggcgaagccgcccuucuccacuacgucgacccagacaccggacgaaaccucggcgaauuuaaagccuacccagacggcuuccucacaugcguccccaacggcgcgucaucuggaccacaacaacuacccaucaacgguguauucgucuucgucagcugggucucacgcuucuaccagcucaaacccguugggacagcaucaucagcccgcggacgacuuggucuccgcagauaa

SEQ ID NO: 37284 - RNA, 1593 nt, Artificial Sequence
  derived and/or modified sequence opt11 from capsid_protein_VP1__Norovirus__AGM33223
augaugauggccucaaaagacgccacaucaucaguagacggcgccuccggcgccggccaacucguuccugaagucaacgccuccgacccccucgccauggaucccgucgccggcuccuccaccgccguagcaaccgcuggccaagucaacccuaucgacccuuggaucaucaacaacuucguacaagccccacaaggagaauuuaccaucucacccaacaacaccccuggcgacguacuauucgaccucucacucggcccacaucuuaaucccuuccuccuacaccucucacaaauguacaacggaugggucggcaacaugagaguccggaucaugcucgccggcaacgccuucaccgcaggaaaaaucauagucucaugcaucccucccggcuucggcucacacaaccucaccauugcccaagccacccucuucccccacgucaucgcagacguccgcacacucgaccccauugaaguaccccuagaagauguccggaacguccuauuccacaacaacgaccgcaaccaacaaacaaugcgccuugucugcaugcucuacacuccccuccgaaccggcgguggcaccggagacuccuucguaguggcaggacgcguaaugaccugcccauccccagacuucaacuuucucuuccuuguuccaccaacugucgaacaaaagacccgcccauucacacucccaaaccuaccccugagcucgcuaucaaacucccgcgcaccacuccccaucucuucgaugggcaucucacccgacaacguccaauccguccaauuucaaaacggccguugcacucuagacggccgccucgucggaaccacccccgucucacucucacacgucgcaaaaauacgcggcaccucgaacggaaccguaaucaaccucaccgaacuagacggcaccccauuccacccguuugaaggccccgcccccauuggcuuccccgaccuaggcgguugcgacuggcacaucaacaugacccaauucggccacucuucccaaacucaauacgacgucgacaccaccccagacaccuucgucccucaccuaggcucuauccaagccaacggcaucggcuccggaaacuacgucggcguucucucauggaucagucccccuuccagaccguccggcucacaaguagaccucuggaaaaucccaaacuacggauccuccaucacggaagccacccaccucgcaccauccguauaucccccuggcuuuggcgaaguccuggucuucuucauguccaaaaugcccggcccaggcgcauacaaccuccccugccugcucccccaagaauacauaucccaccucgcuuccgaacaagcccccaccgucggcgaagcagcccuccuccacuacgucgacccagauaccggccgcaauuuaggugaguucaaagccuaccccgacggcuuccuaaccugcguacccaacggcgccuccucaggcccccaacaacuccccauaaacggaguguucgucuucgucuccugggucucccguuuuuaccaacucaagccagucggcaccgccucuucugcccgaggacgccucggccuccgacgguaa

SEQ ID NO: 37285 - RNA, 1623 nt, Artificial Sequence
  derived and/or modified sequence opt11 from capsid_protein_VP1__Norovirus__AGT17839
augaaaauggcauccaacgacgccaacccaucagacggauccgccgcaaaccucguacccgaagugaacaacgaagucauggcccucgagccagucgucggagcagccaucgccgcacccgucgcgggacaacaaaacgucaucgacccauggauaagaaacaacuuuguccaagcccccggaggcgaguucaccgucucgccccgcaacgcccccggcgaaauccucugguccgccccucucggcccagaccucaaucccuaccucucccaccucgccagaauguacaacggauacgccggcggauucgaaguacaagucauacucgccggcaacgcauucacagcaggcaaaaucaucuucgcagcagucccacccaacuuccccaccgaaggccucucccccucacaagucacaauguucccccacaucaucgucgacguacgacaauuagaacccguccugaucccccuacccgacguccguaacaacuucuaucacuacaaccaauccaacgauuccacgauaaaacucauagccaugcucuacacaccccuacgagcaaacaacgcaggcgacgacgucuucaccgucucuugucgaguccucacacgccccucacccgacuuugacuucaucuuccucgucccacccacaguagaaucccgaacuaaacccuucucuguccccauccuaaccgucgaagaaaugacaaacucccgauuccccauaccccucgaaaaacucuucaccggccccuccucuacauucgucguacaaccccagaacggccgaugcaccacagacggcguccuacuaggaacaacccaacuaucaccugucaacaucugcaccuuuagaggagaugucacccacaucaccggcucacgcaacuauacaaugaaccucgcaucccaaaacuggaacuccuacgaccccaccgaagaaauaccugcgccccuagguacccccgacuuugucggaaaaauacaaggcguacucacacaaacaacucgcaccgacggauccacccgaggccauaaagccaccguauacaccggauccgcggacuucuccccaaaacuaggccgcguucaauucgcaaccgacaccgacaacgacuucgacacaaaccaaaacacaaaauucacucccguuggcgucauacaagauggcggaacuacccaccgcaacgaaccccaacaauggguccuacccuccuauucaggccgcaacacccacaacguccacuuagcccccgccgucgcacccaccuucccaggagaacaacuacucuucuuccgcagcacaaugcccggauccuccggauaucccaacauggaccucgauugccucuuaccgcaagaauggguccaauacuuuuaccaagaagccgccccugcacaaucagacgucgcacuccuccgguucguaaaccccgacaccggaagaguccuauucgaauguaaacuccacaaauccgguuacgugaccgucgcccacaccggccaacacgaccucguaaucccacccaacggcuacuuccgauucgacagcugggucaaccaauucuacacucucgcccccauggguaacgggacuggccgccgccgcgcagucuaa

SEQ ID NO: 37286 - RNA, 1617 nt, Artificial Sequence
  derived and/or modified sequence opt11 from capsid_protein_VP1__Norovirus__AGX85910
augaaaauggcuucuucagacgccaacccauccgacggcuccaccgccaaccucguccccgaagcaaacaacgaagucauggcccuggaaccggucguaggugcagccaucgcugcacccguagccggacaacaaaacgucaucgacccauggauucgcaacaacuucguacaagcacccggcggcgaguucaccgucucaccccgcaaugcacccggcgaaguccuuuggagcgcgccccuaggccccgaccucaacccguaccucucacaccucgcccgcauguacaacggcuacgccggaggauucgaaguccaagucauccuagcaggcaacgccuucgccgccggcaaaaucaucuuugcagccgucccacccaacuucucuaccgaaggucucucacccucucaaguaacaauguuuccccaccuaaucguugacguccgacaacucgaacccgucaugaucccucuccccgacauccgcaacaacuucuaccacuacaaccaauccaacgaccccacaaucaaacuaaucgccaugcucuauaccccucuccgagccaacaacguuggcgacgacguauucacagucucaugccgcguccucacacgaccaagcccagacuucgacuuuauauuccucguacccccaacagucgaaagcaaaaccaaccccuucagcguaccaauccuaacuaucgaggaaaugacaaacucccguuucccaaucccucuagaaaaacuauucaccggccccuccuccgcacucgucguccaaccccaaaauggccgcugcacaaccgacggcguacuacucggcacgacucaacucucccccgucaacauauguacauuccgcggcgacgucacccacacaacaaagacacacaccuaucaaaugaaccuagcagcccaaaacuggaacagcuacgaccccaccgaagagauccccgcuccccucggcacacccgauuuuguaggcaaaauccaaggcguacucacacaaacgaccaaagaaaacggcucaacccgagcccacaaagccaccguuuacacaggaaccgucgaguucacccccaaacucggccgcauacaacucuucaccgauaccgacaacgaccucgaagcgaaccaaaacaccaaauucacaccugucggcgucauccaggacggcgaccaccaaaaugaaccacagcaauggguacuacccuccuacucgggccgaaacaaccacaacguccaccuagcacccgcuguagccccuacauucccaggugaacaacuccuauucuuucguucuaccaugccaggcugcuccggcuacccaaacaugaaccucgacugccuacucccccaggaauggguccaauacuucuaccaagaagcagcccccgcccaauccgacgucgcgcuccuacgguucguaaacccagacacaggccguguccuauucgaaugcaaacuacacaaaucaggcuacgucaccguugcacacaccggccaccacgaucuagucaucccgcccaacggcuacuuccgcuucgacuccugggucagccccuucuacacccuagcacccaugggaaacggcaccggccguagacgcgcacucuaa

SEQ ID NO: 37287 - RNA, 1623 nt, Artificial Sequence
  derived and/or modified sequence opt11 from capsid_protein_VP1__Norovirus__AHI59162
augaaaauggccuccuccgacgccaauccaucugacggcucgacagcaaaccuaguccccgaaguaaacaacgaaguaauggcucuagaaccagucguaggcgccgccauagccgcccccgucgccggccaacaaaaugucaucgacccuuggauccgaaacaacuucguccaagcacccggcggcgaguucaccguuucuccccgcaacgcaccuggcgaaauacucugguccgcuccccucggucccgaccucaaccccuaucuaucacacuuagcccgcauguacaacggcuacgccggcggguucgaaguccaagucauccucgcaggaaacgcuuucacugccggcaaaauaauuuucgcugccgucccgcccaacuuccccacagaaggucucucccccucacaggucaccauguucccccacaucaucgucgacguccgacaacuagaaccaguacuuaucccccucccagacguccgcaacaauuucuaccacuacaaccaauccaacgacuccacaaucaaacucauugccaugcucuacacuccccuccgcgcuaacaacgccggagacgacguuuuuacagucuccugccguguccucacccgccccagcccugacuucgacuuuaucuuccucguuccacccacaguggaaucccgaaccaaaccauucuccguaccaauucuaaccguagaagaaaugacaaacagccgcuuccccauaccccucgaaaaacucuucaccggccccuccucagcauucgucguacaaccccaaaacggacgcugcaccaccgacggcguccuccucggaaccacccagcucucccccgucaacaucuguaccuuucgcggcgacguuacccacauccccggaucacacaacuacacuaugaaccucgccucccaaaacuggaacuccuacgaccccaccgaagaaauccccgccccacucggaacccccgacuucgucggcaaaauacaaggcguccuuacucaaacuacaagcacuaacggcucaacgcgcggccacaaagcuaccgucuacaccggcucugcugacuucucacccaaacucggccgaguccaauucgccacugacacaaacaacgacuucgaaacaaaccaaaacacaaaauucaccccagucggcguaauccaagacggaucaaccacaccccguaacgaaccccagcaaugggugcuccccucauacuccggcagaaacauccacaacguccaccucgcccccgcugucgcacccaccuuucccggcgaacaacuccucuucuuucgcucuaccaugcccggcugcucuggcuaccccaacauggaucucgacugccucuuaccccaagaauggguacaauacuucuaccaagaagcagccccugcacaauccgacgucgccuuacuccgcuucgucaacccagacaccggccgaguccucuucgaauguaagcuccacaaaucaggauacgucaccgucgcucacaccggccaacaugaucucgucaucccacccaaugguuauuucagguucgauuccuggguaaaccaauucuacacacuagccccuaugggaaacggcaccggccgccgccgcgcacuguaa

SEQ ID NO: 37288 - RNA, 1620 nt, Artificial Sequence
  derived and/or modified sequence opt11 from capsid_protein_VP1__Norovirus__AHI59165
augaaaauggcuaguaaugacgcaucccccagcgacggaucaaccgccaaccuaguccccgaaguuaacaacgaagucauggcccucgaacccguagucggagccgcaaucgccgcccccgucgcaggccaacagaacgucauagaccccuggauacguaacaacuucguccaagcacccggaggcgaguucacaguaucgccccgcaacgcccccggugaaauacuuugguccgcaccccucgggcccgaccucaaccccuaccucucccaccucgcccgaauguacaacggauacgcuggcgguuucgaaguccaaguaauccucgccgguaacgccuucacugcaggcaaaaucaucuucgccgccgucccucccaacuucccaaccgaaggacuaucaccaucccaggucaccauguucccacacaucaucguugacguccgccaacuagaacccguucucaucccgcuccccgacguacgcaacaacuucuaccacuauaaucaauccaacgacuccaccaucaagcucaucgccaugcucuacacuccacuacgagcaaacaacgcaggggacgacgucuucacagucucaugccgaguacucacccgucccuccccagauuucgacuucaucuuucucgucccacccaccguugaaucccggaccaaacccuucaccguacccauacucacaguagaagaaaugucaaacucccgauuccccaucccccucgaaaaacuauauacuggccccucaucugccuucgucguccaaccacagaacggccgcugcacuacugacggaguccuacucggcacaacccagcucucagccgucaacaucugcaccuuccgaggcgacgucacccauaucgcaggcucacacgacuacaccaugaaccucgccucccaaaacuggaacaacuacgaccccacagaagaaaucccggcaccccuaggcacaccagacuuugucggaaaaauccagggcaugcuaacccaaaccacacgcgaagacggcuccacaagagcccacaaagcaaccgucucaacaggcuccguacauuucaccccaaaauuaggcuccguccaauauaccaccgacaccaacaacgacuuccaaacaggccaaaacaccaaguucaccccagucggcgucauccaagacggcaauaaccaccaaaacgaaccacaacaauggguucuccccaacuacuccggccgaaccggucacaacguccaccucgcccccgccguagccccaacauuccccggugaacaauuacucuucuuccguuccaccaugcccggcugcuccggcuacccaaacaugaaccuugacugccuccucccccaagaauggguccaacacuucuaccaagaagccgccccagcccaguccgaugucgcucuacuccgcuucguaaaccccgauaccggccgcguccucuucgaauguaaacuccacaaaucaggauacgugaccguagcacauacaggcccccacgaucucgucaucccgcccaacggguacuucagauucgacuccuggguaaaccaauucuacacauuagcccccaugggcaacggagccggucgccgacgcguccuauag

SEQ ID NO: 37289 - RNA, 1623 nt, Artificial Sequence
  derived and/or modified sequence opt11 from capsid_protein_VP1__Norovirus__AHX22044
augaaaauggccuccucggacgccaacccaagcgacggcucaacagccaaccucguccccgaaguuaacaacgaagucauggcccucgaacccguaguaggcgcugcuaucgcagcccccgucgcaggccaacaaaaugucauagaccccuggauccgaaacaauuucguccaagccccaggcggcgaguucaccgucucaccccgcaaugcccccggcgaaauccuaugguccgcuccccuugguccugaucugaacccuuaccuaucacaccuugcccguauguacaacggauacgccggcggcuucgaaguccaagucauucuagccggcaaugcuuucaccgccggcaaaaucaucuucgcagcugucccacccaacuucccaacagaaggccucagcccaucgcaaguuacaauguucccacacaucauaguagacguacgccagcuagaacccguccuaaucccccuccccgacguccgaaacaacuucuaccacuacaaccaaucaaacgacuccaccaucaaacuaaucgcuaugcucuacacaccccuacgcgcaaacaacgccggcgacgaugucuucaccgucucaugccgcguccucacccgcccaucucccgacuucgacuucaucuuccucgucccaccaaccguugaaucccgcaccaaacccuucuccguccccguccucaccgucgaagaaaugacaaacucacgcuuccccauaccccucgaaaaacucuucacuggccccuccuccgccuucguaguccaaccccaaaauggccgaugcacuacagacggcguccuccucggcaccacacaacucucccccguaaacauaugcaccuuucgaggggacgucauacacauuuccggaucacgaaacuacaccaugaaccucgccucccaaaacuggaacucuuaugaccccaccgaagaaauccccgcaccccucggcacccccgacuuugucggaaaaauccaaggaguccucacacaaaccacccgaaccgacggcuccacucgcggacacaaggcaacuguauacaccggcuccgcagacuucucaccaaaacuuggccgcguccaauucgcaaccgacacagacaacgauuucguaaccaaucaaaacaccaaauucacucccgucggcguuauccaggacggcucaacaaccccacgcaacgaaccccaacaauggguccucccaagcuauagcggccguaacacccacaacguacacuuggccccagcggucgcccccaccuuccccggcgaacaacuccucuucuuccgauccaccaugcccggcugcucaggauacccuaacauggaccucgacugccuccugccccaagaauggguccaauacuucuaccaagaagcagccccagcgcaauccgacguagcccuccuccgauucgucaaccccgacacuggccgcguccuuuucgaaugcaaacuccacaaauccggcuacguaacagucgcccacaccggacaacacgaccucgucauacccccaaacggcuacuuccgcuucgacaguugggucaaccaauuuuacacacucgccccuauggggaacggaacaggacgccgccgagcccuauaa

SEQ ID NO: 37290 - RNA, 1623 nt, Artificial Sequence
  derived and/or modified sequence opt11 from capsid_protein_VP1__Norovirus__AII02587
augaaaauggccuccaacgacgccaaccccuccgacggaucugccgcaaaccucguccccgaagucaacaacgaaguaauggcccucgaaccagucgucggagccgcuauugccgcuccagucgccggacaacaaaacgucaucgauccauggauacgaaacaauuucguccaagccccaggaggcgaguucaccguuucgccccgaaacgcacccggugaaauccucugguccgcaccccugggcccagaccuaaaccccuaccucucccaccuagcccgcauguacaacggauacgccggcggcuucgaaguacaagucauucucgccggcaaugccuucacagccggcaaaaucaucuuugccgccguuccucccaacuucccaaccgaaggcuuaucaccaucccaagucacaauguucccccacaucauuguagacguacgccaacuugaaccuguacuaauaccacuacccgacguccguaacaacuucuaccacuacaaccaauccaacgacuccacuaucaaauuaaucgccaugcucuacacgccccuccgugccaacaacgccggagaagacguuuucaccgucuccugccgcgugcucacccgcccaucucccgacuucgacuucaucuuucucguacccccaaccgucgaaucacgaacaaaaccauucaccguaccaauucuuaccgucgaagaaaugaccaacucccgauuccccauacccuuagaaaaacucuucacaggccccuccggcgccuucaucguccaaccccagaacggccgcugcaccacugacggcguccuacucggcaccacccaacucucccccguaaacauuugcacauuccgcggcgacguaacccacaucgccggcucccgaaauuacacaaugaaccucgccucccucaacuggaacaacuacgaccccacagaagaaauccccgccccucuaggcaccccugacuucguaggaaagauccaagguguccuaacccaaacaaccaaaggagacggauccacgcgcggccacaaagccacuguauacaccggcuccgcaccauucacaccaaaacuagguucuguccaauucuccacugacacagaaaacgacuucgaagcccaccaaaauaccaaauucacccccguaggagucauccaagacggaggaacaacacaccguaaugaaccccaacaauggguuuuacccuccuacuccggacgugauguccacaacguccaccucgccccagccguugccccaacauucccaggagaacaacuacuauucuuccgcucuaccaugcccggcugcucaggcuaccccaacauggaccucgacugccuccucccacaagaauggguccaacacuucuaccaagaagcagcccccgcccaauccgacgucgcccuucuacgauucgucaaccccgacacuggcaggguucuuuucgaaugcaaacuccacaaauccggauacgucacaguugcccacaccggccagcacgaccucguaauaccaccaaacgguuacuucagauucgacuccugggucaaccaauucuacacccuugccccuaugggcaacggcacaggacgccgacgcgcacuuuaa

SEQ ID NO: 37291 - RNA, 1647 nt, Artificial Sequence
  derived and/or modified sequence opt11 from capsid_protein_VP1__Norovirus__AII02617
augaaaauggcauccaacgacgccgcacccuccaacgacggcgccgccggucuaguaccagaaauaaacuccgaagccauggcucuagaaccggucgccggagccgcaaucgcagcaccccucaccggucaacaaaacauaauagacccauggaucaugaacaacuucguacaagccccaggcggcgaguucaccguuucaccucgaaacuccccaggagaaguccuccucaaccuagaacuaggucccgaaauaaacccuuaccucgcccaccucgcacguauguacaacggauacgcaggaggauucgaaguccaaguaguccuugcuggaaacgccuucaccgcaggcaaaaucauauuugccgcuauaccacccaacuuccccaucgacaaccuuuccgccgcacaaauaacaaugugcccacaugucaucgucgacguccgccaacucgaacccgucaaccuccccaugccagacguccgcaacaacuuuuuccacuacaaccaaggcucagacucccgauuacgacuaaucgcaaugcucuacacuccacucagagccaacaacuccggcgacgacguauucaccgucuccugccgaguccucacccgccccucaccagacuucucauucaacuuccucgucccacccaccgucgaauccaaaacaaaacccuucucccuccccauccucacaauaagcgaaaugucaaacucacgcuuccccguccccauagacucacuacacacaagccccaccgaaaauaucguaguacaaugccaaaacggccgcgucacacuagacggcgaacucaugggcaccacccaacuccuccccucucaaaucugcgccuuccguggcaugcuaacucgcucaaccucacgcgcuuccgaccaagcagacaccgcaacaccccgccucuucaauuacuacuggcacauccaacuagacaaccucaacggaacaccauacgaccccgccgaagauauccccggaccccuugguaccccugacuuccgcgggaaggucuuuggcguugccucccaacgcaacccugacgccacuacccgagcucacgaagccaaaaucgacaccacaucaggacgcuucacaccaaaacucggcucccucgaaaucucuaccgaaucaggcgauuucgaccaaaaccaaccaacuagauucacacccguaggcauaggcgucgaccacgaagccgacuuccaacaauggacucuaccagacuacgcaggacaauucacccacaacaugaaccuagcccccgccguagcccccaacuucccgggagaacaacuccucuucuuccgaucccagcuacccuccuccggcggccgcuccaacggaauacucgacugccucguaccccaagaauggguacaacauuucuaccaagaaucagcccccucucaaacacaaguagcucucguccgauacgucaaccccgacacaggcagaguacucuuugaagcuaaacuccacaaacuaggcuucaugaccaucgccaaaucaggagacucuccaaucacagugccgcccaacggauacuuccgauucgaauccugggucaaccccuucuacacccucgcccccaugggaacaggaaacggucgucgccguauccaauaa

SEQ ID NO: 37292 - RNA, 1647 nt, Artificial Sequence
  derived and/or modified sequence opt11 from capsid_protein_VP1__Norovirus__AIS24556
augaaaauggcuuccaacgacgccgcaccauccaacgacggagcugccggacucguaccagaaauuaacaacgaagcaauggcacucgaccccguggcaggagcagccaucgccgccccucucaccggccaacaaaacaucaucgaccccuggaucaugaacaacuucguacaagcacccggcggcgaguucacaguaagcccccggaacucccccggcgaaguccuacucaaccucgaacucggcccagagaucaaccccuaccuagcccaucuagcucguauguacaacggauacgcaggaggauuugaaguccaagucguccuagccggcaacgccuucaccgccggcaaagucauauucgcagcuaucccacccaacuucccaaccgacaaccuauccgccgcacaaaucaccaugugcccacacgucaucguagacguccgacaacucgagccaaucaaucucccaaugcccgacguacgcaacaacuuuuuccauuacaaccaaggcuccgacucccgccuccgccucaucgccaugcuauacacuccacuucgagccaacaacuccggcgacgaugucuucaccgucucuugccgcguacucaccagacccuccccugacuucucauucaacuuccuaguacccccaaccgucgaaucaaaaacaaaaccauucacccuccccauacucacuaucuccgaaauguccaacucacguuucccaguccccauagacucacuucacacuuccccuaccgacaauauagucguacaaugccaaaacggccgcgugacacuagacggagaauuaaugggcaccacccagcuacuuccaucacaaaucugcgccuuccgaggcguccucaccagaucaacaucccgcgcauccgaccaagccgacgcagcuacuccccgccucuucaacuacuacuggcacauccaacuagacaaucugaauggcaccccguaugacccagccgaagacaucccagcuccacuaggcacacccgacuucagaggcaaaguauucggagucgccucacaacgcaaucccgauucaaccacucgagcccacgaagccaaagucgacacaaccucuggucgauucacccccaaacucggcucccuagagaucuccacagaauccggcgacuucgaccagaaccaacccacacgauuuaccccaguggguaucggcgucgacaacgaagccgacuuccaacaauggacccucccagacuacucaggacaauucacccacaacaugaaccucgcucccgcaguagccccuaacuuccccggagaacaacuucuuuucuuccgaucccaacucccauccuccggaggacgaagcaacggaauccucgacugccucgucccccaagaauggguacaacacuucuaccaggaaucagcacccgcccaaacacaggucgcacucguccgcuacgucaaccccgacaccggcagaguacucuuugaagcuaaacuccacaaacucggcuacaugaccauagcaaaauccggcgacuccccaaucacaguaccacccaacggcuacuuccgcuucgaaucuugggucaaccccuucuacacccuggccccuauggggaccggcaacggccgucgccgcauacaauaa

SEQ ID NO: 37293 - RNA, 1623 nt, Artificial Sequence
  derived and/or modified sequence opt11 from capsid_protein_VP1__Norovirus__BAI49908
augaaaauggcaagcaacgacgccuccccauccgauggcuccaccgcaaaccuagucccagaaguuaacaaugaagucauggcccucgaacccguaguaggcgccgccauagcagcacccgucgcaggccaacaaaacguaauagaccccuggauccguaacaacuucguccaagcaccaggcggcgaauuuaccguaucuccccguaacgcacccggcgaaauacugugguccgccccacuaggccccgaccucaacccauaccuuucccaccucgcacgaauguacaacggauacgccggcggauucgaaguccaagucauacucgccgguaacgccuucacugccggcaaaauaaucuucgccgccgucccacccaauuuccccaccgaaggccucucacccucccagguaaccauguucccacacaucauugucgacguacgucaacucgaaccaguccucaucccccuacccgacguacguaacaacuucuaccacuacaaccaaucaaacgacucaaccauaaaacuuaucgccaugcuauacaccccgcuacgcgccaacaacgccggugacgacgucuucaccgucuccugccgaguccucacccgccccuccccugauuucgacuucauauuccucguaccacccaccgucgaaucccgcaccaaaccauucaccguccccauuuuaaccguagaagaaaugaccaacucacgcuucccaauaccccuggaaaaacucuucaccggccccuccuccgcuuucgucguccaaccccaaaacggccgcugcaccaccgacggaguccuccucggaaccacacaacucucaccagucaauauuugcaccuuccgcggcgacgucacccacaucccaggaaccagaacauaccgcaugaaccuugcaucccaaaacuggaacaacuacgauccaaccgaagaaaucccggcaccccucggaaccccggacuucguuggcaaaauccaaggcaugcuaacccaaaccaccaaaggagacggcaguacccgaggccacaaagcaacugucuccaccggaucaguggauuucacccccaaacuaggcuccguccaauucgccaccgacacugacaacgacuucgaaaccggccaaaacacacgauucacccccgucggcgucauccaagacggcuccucugcccaccgaaacgaaccccaacaauggguacuaccagacuacucuggccguacaguccacaacguccaccucgcaccagcuguagcccccaccuuccccggcgaacaacuacucuucuuccguuccaccaugccagguugcucagguuaccccaacauggaccuagacugccuacucccacaagaauggguacaacacuucuaccaagaagccgcaccagcacaauccgacgucgcccuccuccgguucguaaauccagacaccggccgcguccuuuucgaaugcaaacuccacaaaaccggcuacguuaccgucgcccauaccggccagcacgaccuaguaaucccucccaacggcuacuuccgauucgacuccugggucaaccaauucuacacccuagcacccaugggcaacggggccggccgaagacgagcacucuaa

SEQ ID NO: 37294 - RNA, 1623 nt, Artificial Sequence
  derived and/or modified sequence opt11 from capsid_protein_VP1__Norovirus__BAI49913
augaaaauggcaagcaacgacgcuucccccuccgacggcucaaccgcaaaccucguccccgaagucaacaacgaagucauggcccuagagccugucgucggugccgccaucgcggcaccaguagcaggucaacaaaaugucaucgaccccuggauccgaaacaacuucguccaagcccccggaggcgaauuuaccguaucaccccggaacgcccccggagagauacuaugguccgcaccccuaggacccgaccuaaaucccuaccuaucacaccucgcccgcauguacaacggcuaugccggcgguuuugaaguccaaguaauccucgccggaaacgccuucaccgcuggcaaaaucauauucgccgccguucccccaaacuuccccacagaaggccuuucgccaucccaaguaaccauguucccacacaucauagucgacguccgacaacuagaaccgguccuaaucccccucccagacgucagaaacaacuucuaccacuacaaccaauccaacgacucuacaaucaagcugaucgccaugcucuacacaccccuccgagcuaauaacgcuggagacgacgucuucaccgucuccugccgcguccucacacgccccucccccgacuucgauuuuaucuuccucgucccacccaccguagaaucaagaacaaaacccuucaccguacccauccucacagucgaagaaaugacaaacucccgcuuccccauuccacucgaaaaacucuucaccggccccucaucugcauucgucguucaaccccaaaacggacgcugcaccacagacggaguccuucuaggcaccacccaacuuucccccgucaacaucugcaccuuccgaggcgacguuacccacauucccggcacccgcaccuaccguaugaaccucgcgagccaaaacuggaacaacuacgaccccaccgaagaaauaccugcaccccuuggcacaccagacuucgucggaaaaauacaagguaugcucacccaaaccacaaaaggcgacggcuccacgcguggccacaaggccaccgucucuaccggcucagucgacuucacccccaaacucggaucuguccaauuugccaccgacaccgacaacgacuucgaaaccggacaaaacacccgcuucacacccguaggcguaauccaggacggcucauccacccaccgcaacgaaccccagcaauggguccucccggacuacucaggccgaaccguccacaacguccaccucgccccagccgucgcucccaccuucccaggagaacaacuccuuuucuuccgauccaccaugcccggcugcucgggcuaccccaacauggaccucgacugccuacucccucaagaguggguccaacacuucuaucaagaagccgcacccucccaauccgacguugcacugcuccgcuucguuaaccccgacacaggccgcguccucuucgaaugcaagcuccacaaagcaggauacgucaccgucgcccacacaggccaacacgaccucguaauaccacccaauggauacuuccgcuucgauucauggguaaaucaauucuacacacuagcccccaugggaaacggcgccggacgacgacgagcccuauaa

SEQ ID NO: 37295 - RNA, 1623 nt, Artificial Sequence
  derived and/or modified sequence opt11 from capsid_protein_VP1__Norovirus__BAI49922
augaaaauggcgucaaacgacgccaacccuuccgacggcucagccgccaaccuaguaccagaaguaaacaacgaagucauggcacucgaacccgucgucggggccgccauugccgcccccguagcaggacagaccaacguuaucgacccauggauccgcaacaacuuuguccaagcccccggcggcgaguucacagucucuccccgcaacgccccaggcgaaauacucuggucagcaccccuaggaccagaccuuaaucccuaucucucacaucucgcacgcauguacaacggauacgccggcggauucgaaguacaaguaauccuagccggcaacgccuuuacagccgguaaaaucauauucgcugccgucccacccaauuuccccaccgaaggccucucccccucacaagucaccauguucccccacaucauagucgacguccgacaacucgaaccgguccuaaucccccugccagacguacgaaacaacuucuaccacuacaaccaaucaaacgacucaacaaucaaacuuaucgccaugcucuacacuccccuucgcgcaaauaacgccggcgaagacgucuucaccgucuccugcaggguucucacucgaccaucccccgacuucgacuucaucuuccucguaccacccaccguagaaucacgcaccaaacccuucacaguacccauccucacagucgaagaaaugaccaacucccgcuuccccauaccccucgaaaaacucuucaccggccccucuggagcauucgucguccaaccccaaaacggacgauguacgacugacggaguacuccucgguaccacacaacucagucccguaaacauaugcaccuuccgcggagaugucacucacaucgccggcuccagaaacuacaccaugaaccucgccucccucaacuggaacaacuaugaccccaccgaagaaauccccgcaccccugggaacccccgacuucgucggcaaaauccaagguguccucacccaaacaaccaagggcgacggcucaacccggggccacaaagccacugucuacacaggauccgcccccuucacccccaaacucggcuccguacaauucuccaccgacaccgaaaacgauuucgaaacccaccaaaacaccaaauuuacccccgucggcgucauccaagacggcuccaccacccacagaaacgagccccaacaguggguccuccccuccuacucaggccgcaacguacacaauguccaccuagccccagccguagcucccacauucccaggcgaacaacuccuguucuucagauccacaaugccuggcugcuccgguuacccaaacauggaccucgacugccuacucccacaagaauggguacaacauuucuaccaagaagccgcccccgcccaaucugacgucgcccuacuccgcuucgucaauccugacaccggacgcguccucuucgaaugcaaacuacacaaauccggcuacgucaccgucgcccacacaggucaacacgaucucgucaucccaccaaacggauacuucagauucgauucuuggguaaaccaauucuacacacucgcccccaugggaaacggaaccggccgucgacgagcccuuuaa

SEQ ID NO: 37296 - RNA, 1608 nt, Artificial Sequence
  derived and/or modified sequence opt11 from capsid_protein_VP1__Norovirus__BAJ25074
augaaaauggcaagcaacgacgccaaccccuccuccgacgguuccgccaaccuaguuccugaaauauccaaugaagucauggcccuagaacccguagcgggcgccgcaauagcagccccagucgccggccaacaaaacaucaucgaccccuggauucgcaacaacuucguacaagcaccaggaggagaguucacagugucaccgcguaacgccccaggcgaaguucuccuaaaccuacccuuauccccagacauaaacccauaccuugcccaccuaucccgaauguacaauggcuacgcaggaggaguagaagucgaaguaguacucgcuggcaacgccuucaccgccggcaaaauaaucuuugcagccgucccacccaacuuuccacccgaaaaucucucccccucccaaauuaccaugcuaccccacaucauaguagacguaagacaacuagaacccguccgcauaccccuccccgauguacgcaauaacuucuaucacuacucacgagaaaacgacuccacacugcgacucauagccaugcucuacacaccccuacgagccaacaaugcaggcgacgaugucuucaccgucuccugccgaguccucacccgccccucccccgacuucgacuucauauuccuugucccgcccaccgucgaaucaaaaucaaaacccuucaccauacccaugcuaaccaucgaagaaaugaccaauucccgcuuccccgcaccccucgaacucaugacgaccggcccgucccacgacaucgucguacaaccacaaaacggccgcuguaccauugacggcguacuccuaggcaccacacagcucuccccugugaacaucugcucacuccggggaguucccaccaagcgcaccaacggcaaugauaacugcuucguacaacuugaaaaccccaacgggucagccuacgaccccaccgaagacaucccagccguccucggauccccagacuuuguaggagaacuuuacggaacaaucacccaacgaucgagcgauaacucaacacgcgcccacccuuucacucuaaacacaggcucgccccgcuacacacccaaaaucggcuccguagacauacgcguaacugacguauccgaccuccaagaccacgaccccgucaaacucacccccgucggacucagcggagaccgcggcuccauccaccaauggcaacuacccaacuacuccggagucgccacccacaacaugcaccucgcacccuccguagccccacuauuccccggcgaacaaauccucuucuuccgcuccacaguaccuggcugcggcggcuaccccaacuccaauauugacugccucauaccccaagaauggguccaacauuucuaccaagaaggcgcccccgcccgcacugacguagcccuacucagguucauaaaccccgacaccggcagaguccucuucgaaugcaaacuacacaagcacggcuucaucaccgucgccuacuccggcaaccacgaccucgucaugccacccaacggcuacuuccgcuucgaauccugggucaaccaauuccacacccucgcccccaugggcacaggauccggccgaagacgcauccaauaa

SEQ ID NO: 37297 - RNA, 1617 nt, Artificial Sequence
  derived and/or modified sequence opt11 from capsid_protein_VP1__Norovirus__BAP33934
augaaaauggccucuaacgaugcggccccauccaacgacggugccgccggccucguaccagaaggaaacaacgagacacuaccgcucgaaccuguagccggagccgccaucgccgcacccgucacaggccaaaacaacaucaucgaccccuggauccgcaccaacuuuguacaagcccccaacggcgaguucacuguaucaccccgcaauuccccaggggaaauccuccucaaccucgaacucggccccgaccuaaaccccuaccuagcccaccuaucccgcauguacaacggcuacgccggcggggucgaaguccaaguucuacuagcaggcaacgccuucaccgccggcaaaauucucuucgccgcagucccucccaacuuccccguagaguuccucucucccgcacaaauaaccaugcuaccccaccucaucgucgacguucgcacucucgaacccaucaugaucccccuaccagacguccgcaacaccuucuuccacuacaacaaccaaccaaacucacgaaugcgccucgucgccaugcuauacacaccccuccgcucaaauggcuccggagacgacgucuucaccguauccugccgcgugcucacccgacccacccccgacuuugaguucaccuaccucgucccacccagcguagaaucaaaaacaaaacccuucucacuucccauacuaacccucuccgaacuaaccaacagccgcuuccccguccccaucgacucacuauucaccgcccaaaacaacguccuacaaguccaaugucaaaacggcagaugcacacucgacggcgaacuucaaggaaccacccaacuauuacccuccggcaucugcgccuuccgcggccggguaaccgccgaaaccgaccaucgagacaaauggcacaugcaauuacaaaaucucaacggaaccaccuacgaccccacagacgacguuccagcaccacucggcacacccgacuucaaaggcgucgucuucggcguagcaucccaaaggaacguuggcaacgacgcaccaggcuccacacgugcacacgaagccgucaucuccacauacucaccccaauucguccccaaacucggcuccgucaacuuccgcucaaacgacaacgacuuccaacuccaacccaccaaauucacaccagucggcaucaacgacgacggcgaccacccuuuucgacaaugggaacuacccgacuacucuggccuccugacccuaaacaugaaccuagcucccccaguggcccccaacuuccccggcgaacaacucuuauucuuccgaucauucguaccuugcagcggcggcuacaaccaaggcauagucgacugccuaaucccacaggaauggauccaacacuucuaccaagaaagcgcacccucacaaucagacguagcccuaauacgcuacgucaacccagacacaggucgaacccucuucgaagcaaaauuacaucgaucaggcuauaucacaguagcgcacuccggagacuacccucucgucgugccagcgaauggcuacuuccgcuucgacuccugggucaaccaauucuacagccucgcucccaugggaaccggcaacggccgcagacgcgcacaauaa

SEQ ID NO: 37298 - RNA, 1623 nt, Artificial Sequence
  derived and/or modified sequence opt11 from major_capsid_protein__Norovirus__ABQ63283
augaagauggccuccucugacgccaacccuucagacggcuccaccgcaaaccuaguccccgaagucaacaacgaaguaauggcccucgaacccgucgucggugccgccauagccgcacccguagccggccaacaaaacguaaucgacccauggauacgaaauaacuucguccaagccccaggcggcgaguucacagucuccccacgaaaugcccccggcgaaauccucuggucagccccguuaggucccgaccuaaaccccuaccuaucucacuuagcacguauguacaacggcuacgccggaggcuucgaaguucaaguaauccucgccggcaacgcauucacagccggaaaaauaguauucgcagcuguaccaccaaacuuucccaccgaaggccucucacccagucaaguuaccauguucccacacaucauagucgacguccgucaacuggaacccguacucauaccccucccugacguacgcaacaacuucuaucauuacaaccaauccaacgaccccaccauuaaacuaaucgccaugcucuacacaccucuccgagcaaacaacgccggagaagaugucuucaccguaagcugccgcguucucacccgccccucaccugacuucgacuucauuuuucucguaccacccaccguagagucacgcacaaaacccuucucuguacccauccuuaccgucgaagaaaugacaaacucccgcuuccccaucccccuagaaaaacucuucaccggccccuccucuacuaucgucguacaaccucaaaacggccgcugcaccaccgacggaguccuacuaggcaccacccaacuauccccaguaaacaucugcaccuuucgcggcgacgucacccacaucgcaggcacacaagaauacacaaugaaccucgccagccaaaacuggaacaacuacgaccccaccgaagaaauacccgcaccacucggaacucccgacuucgucggcaaaauccaaggcguccuaacccaaacuacacgccgcgacgguucaacccgaggccacaaagccacagucuccacaggauccguaaacuucaccccuaaacuaggccgcauccaguucucuacagacaccuccaacgacuucgaaaccggucaauccacccgcuucaccccagucggcgucguccaagacggcuccaccacccaccaaaacgagccacaacaauggguccucccagacuacucuggccgcgacucccacaacguccaccucgcucccgccguugcccccuccuucccaggagagcagcuccuuuucuuccguucuacuaugcccggcugcuccggcuacccaaacaugaaccucgacugccuccucccacaagaauggguccaacacuucuaccaagaagccgcacccgcccaaucagacgucgcacuacuccgcuucgucaacccagacacaggacguguccucuucgaaugcaaacuacacaaauccggcuacgucacagucgcacauaccggacaacacgaccucguaauacccccgaacggauauuuccgcuucgacuccuggguaaaccaauucuacacccucgcccccaugggcaacggcaccggccgccgccgagcccuauaa

SEQ ID NO: 37299 - RNA, 1623 nt, Artificial Sequence
  derived and/or modified sequence opt11 from major_capsid_protein__Norovirus__ABV55634
augaaaauggcauccaacgaugccaaccccuccgacgguuccgccgcaaaccucguccccgaagucaacaacgaagucauggcccuugaacccguuguuggcgcagcaaucgcugcccccguugccggccaacaaaacgucaucgacccauggauacgaaacaacuucguucaagcccccggaggcgaauuuaccguuucuccacgaaacgcuccaggcgaaauacucugguccgcaccccucggacccgaccuaaacccauaccucucccaccucgcccggauguacaacggcuacgccggcgguuucgaaguccaagucauauuagccggcaaugcuuucacagcaggcaaaauaaucuucgccgccgucccgcccaacuuccccaccgaaggucucucccccucccaagucacgauguucccccacauaaucguagacguccgccaacuagaacccguucucaucccccuuccagacgucagaaacaacuucuaccacuacaaccaauccaacgacuccacgaucaaacuaaucgcuaugcuuuacacuccacuacgcgcaaacaacgccggagaagacguauucacugucuccugccgcguacuaacccgccccagcccagacuucgacuucaucuuccucguacccccaaccguagaaagucguacaaaaccuuucacugucccaauccucacagucgaagaaaugaccaacucccgauucccaauaccacucgaaaaacuauucaccggaccauccggugcuuucguuguccaaccccaaaacggcagaugcaccaccgaugggguccugcuaggcacaacacaacucuccccagugaacaucugcaccuuucgcggcgacgucacccacaucgccggaucccgcaauuacaccaugaaccucgccucccucaaguggaacaaauacgaccccacagaagaaauccccgccccgcucggcacccccgauuucgucggcaaaauccaaggcguccuaacccaaaccaccaagggcgacggaagcaccagaggccauaaagccacaauauacacgggcuccgccccauucacccccaaacucggcucaguccaguucuccaccgacacagaaaacgacuucgaaacccaccaaaacaccaaauucacacccgucggcguaacacaagacggcagcacaacccaccgcaacgaaccccaacaauggguucuaccaagcuacucuggccgaaacguccacaacguccaccucgccccagcagucgcccccacauuccccggagaacaacuacucuucuuccgcagcaccaugccaggcugcucggguuaccccaacauggaccuggacugccuccucccccaagaauggguccaacacuucuaccaggaagcagcacccgcccaauccgacgucgcucuacuccgcuucgucaacccugacaccggccgcguacucuucgaaugcaaguuacacaaauccggauacgucaccgucgcgcacaccggccaacacgaccucguaauacccccaaacggcuacuuccgcuucgacuccugggucaaccaauucuacacacuagcacccaugggaaauggaacaggccgccgccgagcccucuaa

SEQ ID NO: 37300 - RNA, 1623 nt, Artificial Sequence
  derived and/or modified sequence opt11 from major_capsid_protein__Norovirus__ACV41093
augaaaauggccuccaacgacgccaaccccucugacggcucaaccgccaaucucguccccgaagucaacaacgaagucauggcacucgaacccgucgucggcgccgccaucgcagcacccgucgccggacaacaaaaugucauagaccccuggauccgcaacaacuucguacaagcacccggcggcgaguucacaguaucccccagaaaugcuccaggcgaaauccucuggagcgccccacuaggacccgaccuaaaucccuaccuuagccaccuagcccgcauguacaaugguuacgcaggcggauucgaaguccaagucauacucgcaggaaacgccuucaccgcaggcaaaaucauauucgcggccguaccacccaauuuccccacggaaggccucucaccaucacaaguuaccauguucccucacaucauaguagacguccgacaacuagaacccguacucaucccccuccccgacgucagaaacaacuucuaccacuauaaccaauccaacgaccccaccauaaaacucauugccaugcuauacacaccccuccgcgccaacaacgccggagacgacguauucaccgucuccugccgcguauuaacacgccccagcccagacuucgacuucauauuccucgucccucccacaguagaaucacggaccaaacccuucacaguacccauccucaccguggaggaaaugacaaacucaagauuccccaucccacucgaacgccucuacaccggcccauccuccgcauucguaguccaaccccaaaacggccguugcacaacagacggcguccuccuaggaaccacacaacuguccgcagucaacaucuguaccuuccgcggcgaugugacccacaucgccggcucgcgcaauuacaccaugaaccuagccucucaaaacugguccaacuacgaccccacagaagaaauacccgcacccuuaggcacccccgacuucgucggaaaaauccaagguaugcucacccaaacaaccggcagagacggcagcacccgaggacacaaggccaccguccucaccggcucagcagacuucgcccccaaacucggccgaguccaauucgcuaccgacaccgacaacgauuucgaauccggagaaaacacaaaauucaccccgguaggcgucauccaagacggcucaaccacacaccgcaacgaaccucaacaauggguccuccccaacuacuccggaagaacaggccacaacguccaccuagcccccgcagucgcccccaccuaccccggagaacaacuacucuucuuccgcucaacgaugcccggcugcuccggcuaucccaacauggaccuagacugccuacugccacaggaauggguacgccacuucuaccaagaagccgcccccgcgcaaucagacgucgcccugcuacgcuucgucaaccccgacaccggccgcguacucuucgaaugcaaacuacacaaacccggcuacgucaccguagcccacaccggucaacacgaccuugucaucccacccaacggauacuuccgauucgacuccuggguaaaccaauucuauacccuagcucccaugggcaacggaaccggucgccgacgcgcccucuaa

SEQ ID NO: 37301 - RNA, 1635 nt, Artificial Sequence
  derived and/or modified sequence opt11 from major_capsid_protein__Norovirus__ACV41096
augaugauggcaucaaaagaugccacccccuccgccgacggcgccacuggcgccggccaacucgucccagaaguuaauaccgcagaccccaucccaauagaccccguagcuggcucauccacagcccuagccaccgccggccaaguaaaccuuaucgaccccuggaucauaaacaacuucguacaagcaccccaaggcgaauuuaccauuucaccaaacaacacccccggcgacguacucuucgaccuccaacuaggaccacaccuuaaucccuuccucucccaccuuucacaaauguacaacggcuggguaggaaacaugcgcguccgggucguacucgccggcaacgcauucaccgccggcaaagucauaauaugcuguguuccaccaggcuuccaaucccgaacccucucaaucgcccaggccacacucuucccccacguuaucgccgauguacggacccucgacccagucgaaguuccacucgaagacguccgcaacguccuguaccacaacaacgacacucaacccacaaugagacuccucugcaugcucuacacaccccuccgcaccggaggagccucuggcggcaccgauucuuucguagucgcaggccgaguccuuaccugcccaggccccgacuucaacuuccucuuccuagucccucccaccgucgaacagaaaacacgccccuucacaguccccaacauaccccucaaguaucuuucaaacucccgcaucccaaaucccaucgaaggcaugucccuauccccagaccaaacacaaaacguccaauuccaaaacggccgaugcaccaucgacggccaaccucucggaacaaccccggucucuguaucacaacucuguaaauuccguggucgaaucacaucaggacaacgaguccuuaaccuaacugaacuagacggcucccccuucauggccuucgccgccccugcccccgcuggcuuccccgaccuaggcuccugcgacuggcacaucgaaaugucgaaaaucccgaacucaucuacccaaaacaacccaaucguagucaacucaguaaaaccuaauagccaacaauucgucccacaccucuccucaaucacccucgacgacaacgucucuuccggcggagacuacauuggcaccauccaauggaccucaccucccucugacucuggaggcgcuaacaccaacuucuggaaaauccccgacuacgguuccucucucgccgaagcaucccaacucgcccccgccgucuaucccccaggcuucaacgaagucaucgucuacuuuauggccucuaucccuggccccaaccaauccggcucccccaaccugguccccugccuccucccccaggaauacauaacccacuucaucucagaacaagccccaauccaaggagaagccgcgcuacuacacuacgucgaccccgacaccaaccgcaaccucggagaauuuaaacucuauccaggcggcuaccuaaccugcguacccaacagcuccucaacuggcccccaacaacucccccucgacggcguauucguauucgccucuugggucucccgcuucuaccaacuaaagcccguuggcaccgcuggccccgcccgcggucgacuuggagucagacgauaa

SEQ ID NO: 37302 - RNA, 1743 nt, Artificial Sequence
  derived and/or modified sequence opt11 from major_capsid_protein__Norovirus__ACV88130
augaaaauggccuccaacgacgcaaccgcccccagccaagacggagcagccaaccucgucccagaaucccaacacgaaguccuugcccucgaaccaguggccggcgcagcccuagccgcacccgucgccggacaauucaacgcuaucgaccccuggaucaaacaaaacuucguccaagccccagccggcgaauucaccgucuccccucgaaacgcccccggcgaaauacucauggaccucgaacuagggcccgaacucucucccuuccuugcccaccuugcacaaauguacaacgccuacgccgggggaauggaagugcaaauaauucucgccggcaacgcauucacagcagggaaaaucaucgucugcgcaguaccacccaacuuccccccugaccgccucucugcaucccaagccacaaacuucccgcacgucaucauggacguccgaacccucgaacccgucauccucccgcuccccgacgugcgagccggcuuuuuccacuauaaccaacuacgcgagccccgcaugcgacucauggcccuacucuacaccccccuccgcgccaacggaacuggcgacgacgccuucaccgucucaugccguguacucacacgacccaugcaagacuucgaauucauguuccuaguccccccaacagucgaaucccgagucacccccuucuccguucccacuuacccagucguagaaaugacaaacucacgauggcccgccaggauuucuggcaugcacgucaacgcuaaccaaacccucgccguccaauuccaaaacggccgcugcacucuugacggucaacuaaugggcacaacacaacuaugcgcugcagacgucugucgaaugcgaggacgcuacaccuccacucgcgcggaccuagccggagucgaccacacugaccaaggccccucacucggagccggacccuccaaugacccagucucggucccagaagccaggucccaaacccguacgucagucucagcacaccuucaacucgaagaacucaacggacaacccuaugaagucuacggcgaacaacccgccccccucggcacaccugacuuuugcugccgacucaugggcgaacuaguacgacucccaucaaccucccccgcggcccaaucccgauuccgagaugccuucuucgacaccuacggagcacucuucgcacccgccguuggcuccaccacuuucaccgucaauaacuccuccaccucagacuuugccaacggucaacccuucgaguuccuccccauaggaguagaaauuggcaacuccgcacaauaugacgaauucgcccuccccuccuacaacggugccauaggcgaaaacagacaccucgccccaguagccgccccuggcuuccccggcgaaaacauaguauucuucucguccaaccuccccgucugggauuccacuucagcucaaaacaaccgacgcaucuccugccuacuccccaacgaauucguacaacacuucuacgaccuccaagcccccucccaauccgacguagcacuacuccgauacguccaccccgaaagcggccgaguccucuucgaaugcaaacucuaccgcgacggauuccucacaguaaacggcgccucucuugccgaauucccaguuaacggauacuuccgcuucgacuccugggucaaccaauucuucacccuaagcccugucgguaccgguucaggccgaagcggcagaagucgaaacgcacaauaa

SEQ ID NO: 37303 - RNA, 1623 nt, Artificial Sequence
  derived and/or modified sequence opt11 from major_capsid_protein__Norovirus__ACW19927
augaaaauggccagcaacgacgccaaccccuccgacggcagcgccgccaaccuaguaccagaagucaacaacgaagucauggcccuugagcccguagucggagccgcuaucgccgcccccgucgccggccaacaaaacgucauagacccauggauccgaaacaauuucguccaagcccccggcggcgaauuuacagucucaccccgcaacgcccccggcgaaauccucugguccgcaccccucggaccagaccucaaccccuaccucucccaccuagcccgcauguacaacggcuacgccggcggauuugaaguccaagucauacucgccgguaacgccuuuaccgccggcaaaauaauauucgcugccguucccccgaacuuucccaccgagggcuuauccccgucacaagucacaauguucccccacaucaucgucgacguccgacaacucgaacccguacuaaucccccuccccgacguccgaaacaacuucuaccacuauaaccaaucaaacgacuccaccauaaaacuuauagccaugcucuacacaccccuucgugccaacaacgccggcgaagacguauucaccguuuccugccgcguccucacccgccccucuccagacuuugacuuuauauuccucgugcccccaacuguagaaucccggaccaaaccauucaccguucccauucuuacaguagaagaaaugaccaacagccgcuuccccaucccccucgaaaaauuauucaccggucccucaggcgcauucgucguccagccacaaaacggacgcugcaccacagauggcguccuccucggcacaacccaacuaucaccagucaacauaugcaccuuccgcggagacgucacacauaucgcaggaucccguaacuacacuaugaaccucgccgcccucaacuggaacaacuacgacccaaccgaagaaauccccgccccacuaggcacccccgacuuugucggcaaaauacaagguguccuaacucaaaccaccaaaggcgacggauccaccagaggccacaaggcaacagucuacacaggcucagccgacuucacccccaaacucggcuccguccaauucuccacugacaccgaaaacgacuucgaaacacaccaaaacacuaaauucacccccgucggcguaauccaggacggcuccaccacccaccgaaacgaaccccaacaauggguacucccaucauacuccggccgcaacguucacaacguacaccuagcccccgccgucgcccccaccuuccccggcgaacaacuccuuuucuuccgcuccaccaugccaggcugcuccggcuaucccaacauggaccuagauugccuccuaccacaagaauggguccaacacuucuaccaagaagccgccccggcccaguccgauguagcccucuuacgcuucgucaacccagacacuggacguguccuauucgaaugcaaacuucacaaauccggcuauguaacuguagcccacacagggcaacacgaccucguaaucccuccaaacggauacuuccgauucgacuccuggguaaaccaauucuacacccucgcaccaaugggcaacggaaccggccgccgccgagcucuuuaa

SEQ ID NO: 37304 - RNA, 1623 nt, Artificial Sequence
  derived and/or modified sequence opt11 from major_capsid_protein__Norovirus__ACX31885
augaaaauggccucaaacgacgccaacccuuccgacggaagcacagcgaaucuuguaccagaaguaaacaacgaagucauggcccuagaaccuguagucggcgccgccaucgccgcucccgucgcaggccaacaaaacgucaucgauccauggauccgaaacaacuuuguccaagcuccggguggcgaguucaccgucucaccacgcaacgcccccggagaaauccuauggucagcaccccucggcccugaucucaacccauaccuuucccaucucgcacguauguacaacggcuaugcaggaggauucgaaguccaagucauucucgccgguaacgcauucaccgcaggaaaaauaauauucgcugccguacccccaaacuuccccacagaaggccucucaccaucacaagucacaauguucccccacaucauagucgacguccgccaacuagaacccguacuuaucccccuaccagacguucgcaauaauuucuaccacuacaaccaauccaacgaccccacuaucaagcucaucgccaugcucuacaccccacuccgagccaacaaugccggagacgaugucuucaccguauccugccgcguacuaacccgccccucaccugacuucgacuucauauuccucguacccccuacggucgaaucacgcaccaaacccuucacagucccaauccucaccguagaagaaaugaccaauucccgauucccaauaccccucgaacgacucuauaccggacccucaucugccuucgucguacaaccacaaaacggccgcugcaccacagacggaguccuucucggcacaacacaacucucagccgucaacaucugcaccuuccggggcgacguuacccacauagccggaucccgcaacuacaccaugaaccucgccucccaaaacuggaacaacuacgaccccaccgaagagaucccagcaccccucgguacuccagacuucgucggcaaaauccaaggcaugcuaacucaaaccacacgcuccgauggaucaacccgaggccacaaagccacuguacuuaccggcuccgccgacuucgcccccaaacucggccgaguccaauucgccaccgacaccgacaacgacuucgaauccggccaaaacaccaaauucaccccagucggcguaauacaagacggauccaccacacaucgaaacgaaccccaacaauggguacuacccaacuacucaggccgcacaggccacaacguccaccucgcccccgccgucgcacccaccuaccccggcgaacaacuacuauucuuccgcucaacaaugccaggcugcucaggauacccaaacauggaccucgacugccuccucccccaagaauggguccaacacuucuaccaagaagccgcacccgcccaauccgacguagccuuacuccgcuucgucaaccccgacaccggacgaguacucuucgaaugcaaacuacacaaaucaggauauguuaccgucgcccacaccggacaacacgaccuagucauacccccaaacggcuacuucagauucgacuccugggucaaccaauuuuauacucucgcacccaugggcaacggcaccggccgacgccgagcccuuuag

SEQ ID NO: 37305 - RNA, 1623 nt, Artificial Sequence
  derived and/or modified sequence opt11 from major_capsid_protein__Norovirus__ACX31887
augaaaauggcauccaacgacgccaacccauccgaugguuccgcagcaaaccucgucccagaaguaaacaacgaaguaauggcacuugaacccgucgucggagccgccauagccgcccccgucgcaggucagcagaacguaauagacccauggauccgcaacaacuucguccaagccccaggaggagaguucacggucucuccacgaaacgcuccaggagaaauccucuggagcgcaccccucggacccgaccucaaccccuaccucucccaccuagcccgcauguacaacggcuacgccggcggauucgaaguccaagucauccuagccggaaacgccuucaccgccggcaaaauaaucuucgccgcugugccaccaaacuuucccacugaaggccucuccccuucccaagucaccauguucccacacaucaucguagacguccgucaacucgaaccaguccuaaucccucuaccugacguccguaauaacuucuaucacuacaaccaaucaaacgacuccaccaucaaacucauugccaugcuauacacaccccuccgcgcuaacaacgcaggcgaagacgucuucaccguauccugccgcguccucacccgacccucccccgacuucgacuucaucuuucucgucccaccaaccgucgaaucacguaccaaacccuucacaguacccauccucaccguagaagaaaugacuaauagucguuucccaaucccacuagaaaaacuauucacuggacccucuuccgccuucguaguacaaccgcagaacggccgauguaccacagacggaguccuacucgguacaacacagcuuagcccagucaacaucugcacauucagaggcgacgucacucacauagcaggcuccagaaacuacaccaugaaccuggccucccucaacuggaauaacuacgacccaacagaagaaauacccgcaccccuaggcacacccgacuucgucggaaaaauccaaggcguacucacacaaacuaccaaaggagauggcagcacacgcggacacaaagccaccgucuacaccggcucagcccccuucacacccaagcucggaucaguccaauucucgaccgacaccgaaaaugauuucgaaacccaccaaaacaccaaauucaccccagucggagucauacaagacggcggcaccacacaccgaaacgaaccccaacaaugggucuuaccaaacuacagcggacgcaacguaccaaacguacaccucgccccagccgucgccccaaccuucccaggagaacagcuccucuucuuccgcuccacaaugccuggcuguuccgguuacccuaacauggaccucgacugccuccucccccaagaauggguacaacauuucuaccaagaagccgcccccgcccaauccgacgucgcccuccuccgcuucgucaauccugacaccggccgcguacuauucgaaugcaaacuccauaaaucaggcuacgucaccgucgcccauaccggacaacacgaccuagucaucccaagcaacggcuacuuccguuucgacucaugggucaaccaauucuacacacuagcccccaugggcaacggcaccggacgccgccgcgcccuuuaa

SEQ ID NO: 37306 - RNA, 1623 nt, Artificial Sequence
  derived and/or modified sequence opt11 from major_capsid_protein__Norovirus__ACX31891
augaaaauggcguccuccgacgcuagcccuuccgacggcucagcagccaaccucguaccugaagucaacaacgaaguaauggcacucgaacccgucgucggcgccgcaauagcugccccagucgcaggccaacaaaacaucauagaccccuggauccgcaacaacuucguucaagccccuggcggcgaguucaccguaucgccccgcaacgcaccaggcgaaauucucugguccgcuccccuaggcccugaccucaaccccuaccucucccaccucucccgaauguacaacggcuacgccggaggcuucgaagugcaagucauccucgcuggcaaugccuucacagccggcaaagucaucuucgcagccgucccacccaacuuucccaccgaaggacuaucccccucacaagucacuauguucccccacaucaucgucgacgucagacaacuagaacccguccucaucccccucccagacguccguaacaacuucuaccacuacaaccaaaccaacgaccccacaaucaaacuaaucgccaugcuauacaccccacuacgcgccaacaacgccggcgacgaugucuucaccguuuccugccgcguccucacccgcccaucacccgacuucgacuucaucuuccuagucccacccacagucgaaucaagaaccaaacccuucaccguccccauccucacagucgaagaaaugaccaacucccgcuuccccauccccuuagaacgacuauacaccgguccuuccuccgcuuuuguaguucaaccacaaaauggccgcugcaccaccgacggcguccuccuaggcaccacacaacuaucagccguaaacaucuguaccuucagaggcgacgucacacacauaaccggaucucgcaacuacacuaugaaucuagcaagccaaaacuggaauaacuaugaccccaccgaagaaauccccgcgccucuaggaaccccggacuuugucgggaaaauccaaggaaugcuaacccagacaacccguggcgacggcagcacccgcggacacaaagcuaccguauacacaggcuccgccgacuucgcccccaaacuuggccguguccaauucgcaaccgacacagacaaugacuucgaauccaaccaaaacacaaaauucacccccgucggcgucauccaagacggcaacaccacccaccaaaacgaaccacaacaauggguccucccgggcuacuccgguagagacggacacaacguacaccuagcaccagcagucgccccaacauaccccggcgaacaacuccucuucuuccgaagcacaaugcccggcugcuccggcuaucccaacaugaacuuagauugccuacucccucaagaauggguucaacacuucuaccaggaggcagcaccagcacaauccgaagucgcccuccuccgcuucguaaacccagacaccggccgaguucuauucgaaugcaaacuccacaaauccggauacgucacugucgcccacacaggucaacacgaccucguaaucccacccaacggauacuuccguuucgacuccugggucaaccaauucuauacccuggcacccaugggcaacggugccggccgcagacgcgcccuauaa

SEQ ID NO: 37307 - RNA, 1623 nt, Artificial Sequence
  derived and/or modified sequence opt11 from major_capsid_protein__Norovirus__ACZ37232
augaaaauggccuccaacgacgcagcccccuccaacgacggcgcagccggccucgucccugagaucaacaaugaaguaaugccccucgaacccgucgcuggagcaucacucgccacuccagucgucggacagcaaaacaucaucgaccccuggauccgaaacaacuucgugcaagcaccagcuggcgaguucacaguauccccacgcaacucccccggcgaaauccuccuagaccuagaacucggccccgagcuuaaccccuaccucgcccacuuagcacgcauguacaacggucacgcaggcggcauggaaguccaaauaguccucgcuggcaacgcauucaccgcaggcaaaaucaucuucgccgcuaucccacccggcuuccccuacgaaaaccucucacccagccaaauaaccaugugcccccacgucaucaucgacguacgacaacucgagcccguccuacuccccaugccagacauacguaacaacuucuuccauuauaaccaaggcaacgacccaaaacuacgccuagucgcuaugcuauacacaccacucagagccaacaacuccggagacgacgucuucacaguaucuugccgcguccucacaaaaccaucccccgacuucgaauuuaccuuucucguacccccgaccgucgaauccaaaacuaaacaauucacacuaccaauucucaaaaucagugaaaugaccaacucccgauuccccguccccgucgaaaugauguacaccgcgcgcaacgaaaaccaagucguccaaccccaaaacggacgcguuacccucgacggagaacuacuugggaccacaccccuccucgccgucaacauaugcaaauucaaaggagaagucauagcaaagaacggagauguacgcagcuaccgaauggacauggaaauaaccaacaccgacggcacccccauagaccccaccgaggacaccccaggcccaaucggcucccccgacuuccaagguauccuuuucggcgucgccucccaacgcaacaccaacgaacccaacccagcaacccgagcucacgaagccaacaucaacaccggcggcgaccaauacgcccccaaacucgcccaagucaaguucuucuccgaaucucaagacuucgaaguacaccaacccaccgucuucaccccugucggagucgccggagacacuucccaccccuuccgacaauggguacucccccguuacgguggccaccuaaccaauaacacacaccuagcccccgccgucgcaccccucuuccccggugaacaaauccucuucuuccgcucgcaaauaccauccucaggcggacaugaacuaggcuacauggacugccuagucccccaagaauggguccaacacuucuaccaagaagccgcaacagcucaaucugaagucgcacucauccgcuucaucaacccggacaccggccgaguccucuucgaagcaaagcugcacaaacaaggcuucaucacugucgcccacacuggggauaaccccaucgucaugccacccaacggcuacuuccgauucgaagcauggguaaaccaguucuacucucucgcccccgucgggaccggcaacggccgccgccgaauccaguaa

SEQ ID NO: 37308 - RNA, 1623 nt, Artificial Sequence
  derived and/or modified sequence opt11 from major_capsid_protein__Norovirus__ADD10375
augaaaauggccuccuccgacgccaaccccucagacggcuccacagccaaccucguccccgaagucaacaacgaagucauggcgcucgaacccgucguaggugcugcuaucgccgccccaguagcaggccaacaaaacguaaucgacccauggauucgcaacaacuucguacaagcccccggcggcgaauuuaccguaucucccagaaacgccccaggcgaaauacuaugguccgcuccccuuggacccgaccucaaccccuaccucucacaucucgccagaauguacaacggauacgcuggcggcuucgaaguccaaguaauuuuagccggaaacgccuucaccgccggcaaaaucauuuucgccgcugucccacccaacuuccccacagaaggacucucucccucccaaguaaccauguucccccacaucaucgucgacguccgccaacucgaacccguacucaucccccuucccgacguccgcaacaacuucuaccacuacaaccaauccaacgacuccaccaucaaacucauugcaaugcucuacacaccccuccgcgccaacaacgcaggcgacgacgucuucaccgucucuugccgcguccucacccgacccucccccgacuucgacuucaucuuccucgucccaccaaccgucgaaucacgcaccaagccuuucuccgucccaguccucaccgucgaagaaaugacaaacucccgauucccuaucccacucgaaaaacucuucacaggcccauccucagccuucguagugcaaccccaaaacggaagaugcaccaccgacggcguccuuuuaggaaccacccaacucagcccagucaacaucugcacauuccguggugacgucacccacauccccggaucacgcaacuacacaaugaaccucgcaucacaaaacuggaacuccuacgaucccaccgaagaaaucccagcuccccuagguacccccgacuucguaggaaaaauacagggaguacuaacacaaacaaccagaaccaacggcagcacccgaggacacaaagccacagucuacaccggcuccgccgacuucucacccaaacuaggaagaguccaauucgcaaccgacaccgacaacgacuucgagacaaaccaaaauaccaaauucaccccagucggagucauccaagacggcagcacuacaccccgcaaugaaccccaacaauggguacuacccuccuacuccggucgcaacauccacaacguccaccucgcacccgccgucgccccuacauucccuggagaacaacuucuuuucuuucgaucaaccaugcccggcugcucuggauaccccaacauggaucuagacugccuccucccccaagaauggguccaauauuucuaccaagaagcagcaccagcccaauccgacgucgcgcuccuccgauucgucaacccagacaccggccgaguuuuauuugagugcaaacuacacaaaucuggcuaugucaccguagcucacaccggacaacacgaccucgucauaccacccaacggcuacuucagauucgacuccugggucaaccaauucuacacccucgcccccaugggcaacggcaccggacgccgccgcgcacuguga

SEQ ID NO: 37309 - RNA, 1623 nt, Artificial Sequence
  derived and/or modified sequence opt11 from major_capsid_protein__Norovirus__ADO85552
augaaaauggccuccucagacgcuaaccccucggacggcagcacagcaaaccuagucccggaagucaacaacgaaguuauggcucucgagcccguugucggcgccgcauccgccgcccccgucgcugggcaacaaaacgucauagacccuuggauccgaaacaacuucguccaagcacccggcggugaguucaccgaaucccccaccaacgcacccggcgaaauccucugguccgcaccccuaggccccgaccuaaaccccuaucuaucccaccucgcccgcauguacaacggcuacgccggcgguuuugaaguacaagucauucuagccggcaacgcauuuacagccggcaagauuaucuucgccgcaguacccccgaauuuccccaccgaaggacucucccccucacaagucaccauguucccacacauaauaguugacguccgucaacucgaacccguccucaucccacuaccugacguccgcaacaacuucuaccacuacaaccaaagcaacgaucccaccaucaaacuuaucgcuaugcuuuacacaccccuacgugcaaacaaugcaggagacgacgucuucaccguuagcugccgaguccucacacgcccaucccccgacuucgacuucaucuuccucguucccgccacagucgaaucccgaaccaaacccuucucuguccccguccuuaccguagaagagaugaccaacucacgcuucccaaucccccucgaaaagcuauuuaccggacccucauccgccuucguaguccaaccacaaaacggacgcuguaccacagacggcguccuccucggcaccacacaacucaguccugucaacaucugcacuuuccgcggcgacgucacccacaucccuggcucccgcaacuacaccaugaaccucgccagccaaaacuggaacucauacgacccaaccgaagaaauacccgcaccagucggcacuccagacuucguuggaaaaauacaaggcguccucacccagaccaccagaacuaacggcucaacccgcggccacaaagccacaguuuacaccggaucagccgacuucucacccaaacuaggacgcguccaauucgccaccgacacagacaacgacuucgaaacaaaccaaaacaccaaauuuacaccagucggagucauccaagacggauccacaacuccccgcaaugaaccgcaacaauggguccuucccucuuacuccggucguaacauccacaacguacaccucgcacccgccgucgccccuaccuuucccggagaacaacuccucuucuuccgcuccacuaugccaggcugcucaggauacccaaacauggaccucgacugccuccuaccccaagaauggguccaauacuucuaccaagaggccgcccccgcucaaucagacgucgcccuucuccgguucgucaacccugacaccggccgcguccucuucgaaugcaaacuacacaaauccggcuacgucaccgucgcccacaccggccaacacgaucucgucauuccuccaaauggauacuucagauuugauucuugggucaaccaauuuuacacucuagcacccaugggaaacggcacaggccgccgacgcgcacucuaa

SEQ ID NO: 37310 - RNA, 1623 nt, Artificial Sequence
  derived and/or modified sequence opt11 from major_capsid_protein__Norovirus__ADQ43779
augaaaauggccucuaacgacgccuccccauccgacggauccgccgcuaaccucgucccagaagucaacaacgaagucauggcacucgaaccagucgucggcgcugcgauagccgcucccgucgccggccaacaaaacgucaucgaccccuggauccgaaacaacuucguccaagcccccggcggcgaguucaccguaucuccccgaaaugcaccaggcgaaauccucuggucagcacccuuaggccccgaucucaacccauaccucagccaccucgccagaauguacaacggauacgcgggcggauucgaagugcaagucauacucgccggcaacgccuucaccgcaggcaaaaucaucuuugccgccgucccacccaacuucccaacggaaggccucagccccucucaagucaccauguucccacacauaaucguagacguccgacaacucgaacccguccucauaccccucccagacguccgcaacaacuucuaucauuacaaccaaagcaacgacucuaccauaaaacucaucgccaugcucuacaccccgcuacgcgccaacaaugcaggagaagacguauucaccguaagcugccgcguacuaacccgccccuccccagacuucgacuuuauauuccucgucccacccaccguagaaucacgcacaaagcccuuuaccgucccuaucuuaaccguagaagaaaugacuaauucaagauucccaaucccacucgaaaaacucuucaccgguccuuccucugccuucguaguacagccccagaacggccgaugcaccacagacggcguccuacugggcaccacccaacugagccccgucaacaucugcaccuuccgcggagacguuacacacaucgccggcucccgaaacuacacaaugaaccuagccucacuaaacuggaacaacuacgacccaaccgaagaaauccccgccccacucgguaccccugacuucgucggaaaaauccaaggcguccucacccaaaccacaaaaggcgacggcucaacccgaggucacaaagcaaccgucuacaccggcucagccccauucacacccaaacuaggcucaguccaauucuccaccgacaccgagaacgacuucgagacccaccaaaacacgaaauucaccccaguaggagugauccaggacggaggcaccacccaccgcaacgaaccccaacaaugggcccuccccuccuacucaggccgaaacguacaaaacguacaccucgcuccagcuguagcccccaccuuccccggagaacaacuccuauucuuucgcuccacaaugcccgguugcuccggcuaccccaacauggaccucgacugccuccuuccccaggaauggguccaacauuucuaccaagaagccgcccccgcccaauccgacguagcacugcuacgauucgucaacccugacacaggucgaguccucuucgagugcaagcuacacaaaucuggauacguaacagucgcacacacgggacagcacgaucuaguuaucccacccaacggauacuucagauucgacuccuggguaaaccaauucuacacacucgcgcccaugggcaacgguaccggccgacgcagggcucucuga

SEQ ID NO: 37311 - RNA, 1623 nt, Artificial Sequence
  derived and/or modified sequence opt11 from major_capsid_protein__Norovirus__ADQ43781
augaaaauggcauccucagacgccaaccccuccgacggaucgaccgcuaaccucgucccagaaguaaacaacgaagucauggcacucgaacccguagucggagcagccaucgcagcaccaguagccggccaacaaaacgucaucgacccauggauccgaaacaacuucguccaagcccccggcggcgaguucacggucagcccccgcaacgcccccggcgaaauccuaugguccgcuccacucggccccgaccucaaccccuacuuaucccaccuagcaagaauguacaacggauacgcgggcggauucgaaguacaggucauccucgcugguaacgccuucacagccggcaaaauaaucuucgccgcagucccacccaacuuccccacagaaggccuaucacccucacaagucaccauguucccccacaucaucgucgacguccgccaacucgaacccguacucaucccccucccagacguccgaaacaacuucuaucacuauaaccaguccaacgaccccacuaucaaacucauagccaugcucuacacuccacuccgcgccaauaacgcaggcgacgacguauucaccguauccugucgcguacucacccgacccucccccgacuucgacuucaucuuccuuguucccccaaccguagaauccagaaccaaacccuucucagucccgguacucaccguagaagaaaugaccaacuccagauucccaaucccucucgaaaaacuguucaccggccccuccuccgcauucguaguccaaccccaaaauggccgcuguacuacagacggcguccuccuaggcacuacacaacucuccccugucaacauauguaccuuccgaggcgacguaacccacaucccaggcucccgcaacuacacaaugaaccucgccucccagaacuggaacuccuacgaccccacugaagaaaucccggccccacuuggcacccccgacuucgucggcaagauccaaggcguccucacccaaaccacacgcaccaacggauccacacgcggccacaaagcaaccguauacaccggcucggccgacuucuccccaaaacucggccgcguccaauucgccacugacacagacaacgacuucgaaaccaaccaaaauaccaaauucaccccugucggcgucauucaggacggcuccaccacuccacgcaaugaaccacaacaauggguccuaccauccuacucaggccgaaacauccacaacguacaccucgcaccagccgucgcaccaaccuucccaggugaacaacuacuguucuuccgcucuacaaugcccggcugcucaggcuaccccaacauggaccucgauugccuucucccacaagaauggguucaguacuucuaucaagaggcagccccagcccaaucagacguggcacuccuccgauuugucaaccccgacacuggccgcguacucuucgaaugcaaacuccacaaauccggcuacguaaccguagcucacacaggacagcacgacuuaguaaucccacccaacggcuacuuccgcuucgacuccugggucaaucaauuuuacacccucgcccccaugggcaacggcaccggccgccgacgcgcccucuaa

SEQ ID NO: 37312 - RNA, 1623 nt, Artificial Sequence
  derived and/or modified sequence opt11 from major_capsid_protein__Norovirus__ADQ43783
augaaaauggccuccuccgacgcuaaccccucagauggcagcacggccaaccucgugcccgaagucaacaacgaaguaauggcccuagaacccgucguaggcgccgccauagccgcccccguugcuggccaacaaaacguaaucgaccccuggauucgaaacaacuucguacaagcccccggcggcgaauuuaccgucagcccccgaaacgcacccggcgaaauccuuuggucagcaccccugggucccgaccucaacccauaucucucgcaccuagcccgaauguacaauggcuaugccggcggcuucgaaguccaaguaauccuagccggcaacgcuuucaccgccggaaaaaucauauucgccgccgucccacccaacuuucccacagaagggcucucaccaucccaaguaaccauguucccacacaucauaguagacguccgccaacucgaacccguccucauaccucuccccgacguacgaaauaacuucuaccacuacaaccaauccaacgaccccaccauaaaacuaaucgccaugcucuacaccccacuacgcgccaacaacgccggagacgacgucuucacaguuucaugccgcguacucaccagacccuccccagacuucgacuuuaucuuccucguaccucccacagucgaaagccgaaccaaaccguucuccguucccauccucaccgucgaagaaaugaccaacucccgguuccccauuccccucgaaaaacuguucacaggccccuccucagccuucgucguccaaccccaaaacggccgcugcaccacggacggaguccuccuaggcaccacccaacucucccccgucaacauaugcacuuuccguggugacguaacccacauaaccggcucccgcaacuacaccaugaaccucgcuacacaaaacuggaacucauacgaccccacagaagaaauccccgcaccacugggaacucccgacuucgucggaaaaauccaagguguacucacccaaaccacacgagccgacggcuccacccgaggccacaaggccaccgucuacaccggcuccgccgacuucgcccccaaacuaggccgcguccaauucgccacagauacagacaacgacuuugacgccaaucaaaacaccaaauucacacccguuggagucauccaagacggcgacacagcccaccgcaacgaaccccagcaauggguccuccccuccuacuccggccgcaacucacacaauguccaccuagcccccgccgucgcaccaaccuucccaggcgaacaacugcuuuucuuccgcucaacaaugcccggauguuccgguuacccaaacauggaccuagacugccuucucccccaagaauggguccaauauuucuaucaagaagcagcacccgcccaauccgacgucgcccuacuccgcuucguaaaccccgacacaggccgcguccucuucgaaugcaaacugcacaaaucagguuacguaaccguagcccacaccggacaacacgaccuagugauaccacccaacggcuacuuccgauucgacucgugggucaaucaauucuacacccuagcacccaugggcaacgguacaggacgccgccgagcccuauaa

SEQ ID NO: 37313 - RNA, 1623 nt, Artificial Sequence
  derived and/or modified sequence opt11 from major_capsid_protein__Norovirus__ADV37805
augaaaauggccucguccgacgcuaaccccucagacggcucaaccgccaaucucguccccgaagucaacaacgaaguaauggcccucgaacccgucguaggcgccgccaucgccgcucccgucgccggacaacaaaacgucaucgaccccuggauacgcaacaacuucguccaggcccccggcggcgaguucaccgucucaccccgaaacgcccccggcgaaauccuaugguccgcuccacucggcccugaccucaaccccuaccuuucccaccucgcacgaauguacaacggauacgccggcggcuucgaaguccaagucauucucgccggaaacgccuucacggccggcaaaaucauauuugccgcagucccacccaacuuccccacagaaggacucucacccucgcaagucaccauguucccccacaucaucgucgacgucagacaacucgaacccguucucauaccccuuccagacguccgaaacaacuucuaccauuacaaucaaucuaacgacccaaccaucaaacucauugccaugcuauacacaccccuccgcgccaacaacgccggagacgacguauucaccgucucaugucgaguucucacccgccccucaccagacuuugacuucaucuuccuugucccacccaccgucgagucccgaaccaaacccuucucuguccccauacucaccgucgaagaaaugaccaacagccgauucccuauaccccuagaaaagcuauucaccggaccuucauccgccuucgucguacaaccccaaaacggacguugcacaaccgacggcguccuccucggaacaacccaacuaucacccguuaacauaugcaccuuccgaggugacguaacccacaucacuggcucacgcaacuauaccaugaaucucgccacucaaaacuggaacuccuacgacccaaccgaagaaauccccgcaccccucgguacccccgacuuuguaggcaaaauccaaggcguccucacacaaaccacccgcgcagacggcuccacccgaggccacaaagccacaguauacaccggcucagccgacuuugcacccaaacuuggccgcguacaauucgccacagacacugacaaugacuucgacgcaaaccaaaauaccaaauucacgccaguuggcguuauacaggacggcgauacagcccaccgcaacgaaccccaacaauggguacuccccuccuacuccggccgcaacucccacaacguccaccuggccccagccgucgccccuaccuuuccuggcgagcaacuccuauucuuccgcuccaccaugcccggcugcagcggcuaccccaacauggaccucgacugccuccucccucaagaauggguucaguacuucuaccaagaagcagcuccugcacaauccgacgucgcccuccuacguuucgucaacccugacaccggccgcguacucuucgaaugcaaacuacacaaguccggauacgucaccgucgcccacaccggacaacaugaccuaguaauacccccaaacggauacuuucguuucgacucaugggucaaccaauucuacacacucgcccccaugggcaacggcacuggaagacgacgcgcccucuag

SEQ ID NO: 37314 - RNA, 1623 nt, Artificial Sequence
  derived and/or modified sequence opt11 from major_capsid_protein__Norovirus__ADV37807
augaaaauggccucuucagacgccaacccuucagacggcucuacagcaaaccucguacccgaaguaaacaaugaaguaauggcccuagaaccagucguaggcgcggccaucgcagccccaguagccggccaacaaaacgucaucgaccccuggaucagaaacaauuucguacaagccccuggcggcgaguucacaguaucaccccgaaacgcaccaggagaaauucuaugguccgccccacugggccccgaccucaaccccuaccucucccaccuagcucgaauguauaacggcuacgccggaggcuucgaaguccaaguuauacuagcuggaaacgcauuuaccgccggcaaaaucaucuucgccgccgucccaccaaacuuucccacagaaggccuaucgcccucccaagucaccauguucccccacauaaucguugacguccgccaacuagaaccagucuuaaucccacuccccgacgucagaaacaacuucuaccacuacaaccaauccaacgacccgacaaucaaacucaucgcuaugcucuacacaccccucagagccaacaacgcaggcgacgacgucuucaccguauccugccgcguacucacaagaccauccccagacuucgacuucauauuccuaguaccacccaccgucgaaucacgaacaaaacccuucuccguacccauccuuacugucgaagaaaugaccaacucacguuuccccaucccccucgaaaaacuauucacaggccccuccuccgcauuugucguccaaccccaaaacggccgaugcacaacagacggcguacuccuaggaaccacccaacuaucacccguuaacaucugcaccuuccgcggcgacgucacccauauaacaggaucccgcaacuauaccaugaaccuugcaacccaaaacuggaacucauacgaccccaccgaggaaauccccgcaccccuaggaacccccgacuucgucggcaaaauucaaggcguccucacucaaaccacccgcgccgacggcuccacccggggccacaaagccacagucuacacaggaagcgccgacuucgccccgaagcucggccguguucaauucgccacagacaccgauaacgacuucgacgccaaccaaaacaccaaauucacccccguaggaguaauacaggacggagacacagcacaccgaaacgaaccccaacaauggguacuacccagcuacuccggccguaacagccacaacguucaccucgccccagccgucgccccaacauuccccggcgagcaacuccucuucuuccgcuccaccaugcccggcugcuccggcuaucccaacauggaccucgacugccuccucccacaagaauggguucaauauuucuaccaagaagccgcccccgcccaauccgauguagcacuacuacgcuucgugaaccccgacacuggucgaguacuauucgaaugcaaacuccacaaaucaggauacguuaccguagcccauaccggccaacacgaccucgucauacccccaaacggcuauuuccgcuucgacuccugggucaaccaauucuacacccuagcgcccaugggcaacggcaccggccgccgacgcgcgcuauag

SEQ ID NO: 37315 - RNA, 1623 nt, Artificial Sequence
  derived and/or modified sequence opt11 from major_capsid_protein__Norovirus__ADV37809
augaaaauggcuuccucugacgccaaccccucagaugguucaaccgccaaccuaguccccgaagucaacaacgaaguaauggcccucgaacccguuguaggugcagccaucgccgcaccagucgccggacaacaaaauguaauagacccauggauccgcaacaauuucguucaagcacccggcggcgaauuuaccguuucuccccgcaacgcuccuggcgaaauccuauggucugcaccccucggccccgaucuaaaccccuaccuaucccaccuugccagaauguacaacggauacgcuggaggcuucgaaguccaagucauccuugcuggcaacgccuucaccgccggcaaaaucauauucgccgccguacccccaaacuuccccacagaaggccucucccccucucaagucacaauguucccccacauaaucgucgauguccgccaauuagaacccguccuaaucccccuuccagacguccgcaacaacuucuaucacuacaaccaauccaacgacccaaccaucaaacuaauugccaugcucuauacaccccuccgcgccaacaacgcuggugacgacgucuucaccgucuccugcagaguccuaaccagaccuucucccgacuucgacuucaucuuccuugucccaccuacagucgaaucccgcacaaaaccguucuccgucccuauccucacuguagaagaaaugaccaauucccgauucccaaucccucuagaaaaacuauucacaggucccucauccgccuucgucguucaaccccaaaacggccgcugcaccaccgacgguguccuacucggcacaacacaacucucucccgucaacaucugcacuuucagaggcgaugucacacacaucaccggcucccgaaacuacacaaugaaccucgccacacaaaacuggaacuccuacgaucccaccgaagaaauccccgcuccccuaggaacccccgacuucgucggcaaaauccaaggcguccucacccaaacaacccgcgccgauggauccacccgaggucacaaagcuacaguguacacaggcucagccgacuucgcccccaaacucggccguguccaauucgccacagacacagacaacgacuucgaugcgaaccaaaacaccaaauucaccccugucggaguaauccaagacggcgacacugcccaccgcaacgaaccccaacaauggguccucccaucauacuccggccgcaacucccacaacguacacuuagcccccgccguggcacccaccuuccccggugaacaacuccuauucuuccgauccaccaugcccggaugcuccggcuaccccaacauggaccucgacugccuacuaccccaagaauggguccaauacuucuaccaagaagccgcuccagcucaauccgacguugcccucuuacgcuucgucaaccccgacaccggccgcguccucuucgaaugcaaacuacacaaauccggcuacgucacagucgcccacaccggccaacacgaccucgucaucccucccaacggauacuuucgauucgacuccuggguuaaccaauucuacacccucgcaccaaugggcaacggcaccggcagacgccgcgcccucuga

SEQ ID NO: 37316 - RNA, 1623 nt, Artificial Sequence
  derived and/or modified sequence opt11 from major_capsid_protein__Norovirus__ADV37813
augaaaauggccucuucagacgccaacccuuccgauggcucgacagccaaccucguacccgaagucaacaacgaaguuauggcccuugaaccagucgucggcgccgccauagccgcacccgucgccggacagcaaaacgucaucgacccauggauacgcaacaauuucguucaagccccaggcggcgaguucaccgucuccccucggaacgcccccggcgaaauacucuggucagcaccccuaggccccgaccucaacccuuaccucucccaccuggcccgaauguacaacggcuaugccggaggcuucgaaguccaagucauccucgccggcaacgccuuuaccgccggcaaaaucauauucgccgcaguaccucccaacuuccccaccgaaggcuuaucacccucccaagucaccauguuuccccacaucaucgucgacguccgucaacucgaacccguacucauaccccuaccagacguucgcaacaacuucuaccacuacaaccaaagcaacgaccccacaauaaaacucaucgcaaugcucuacacuccccuucgagcaaacaacgcaggcgaugacgucuucaccgucucaugccgcguccucaccagacccuccccagacuucgacuuuauauuccucgugcccccuaccgucgaaucuagaaccaaacccuucucaguaccaguacucaccguagaggaaaugaccaacucccgcuuccccaucccccucgaaaaacucuucaccggaccaaguagcgccuucgucguacaaccccaaaacggacguugcaccaccgacggaguccuccucggcaccacccaacucucccccgucaacaucugcacauucagaggcgacguaacacacauucccggcucuagaaauuacacaaugaacuuagcaucccaaaacuggaacuccuacgaccccacugaagaaauaccagccccacucggcacccccgacuucgucggcaagauucaagguguccucacccaaaccacccgcaccaacggcuccacccgcggacacaaagccaccguauacacuggcuccgccgacuucucucccaaacuaggucgcguccaauucgccaccgacaccgacaacgaccucgaaacaaaucaaaacacaaaauucaccccugucggcgucauccaggacggcuccacaaccccacgcaacgaaccccagcaauggguccuccccucauacucaggccgaaauauccauaacguccaccucgcccccgccguagcaccaaccuucccaggcgaacagcuccucuuuuuccguucuaccaugcccggauguuccggcuaccccaauauggaccuugacugccuacuaccccaagaauggguucaauacuucuaccaagaagccgcccccgcacaguccgacguagcccuccuccgcuucgucaaucccgauaccggccgcguacuauucgaaugcaaacuccacaaaucaggcuacgucacugucgcccacacaggucaacaugaccucgucaucccuccaaacggcuacuuccgcuucgacucauggguaaaccaauucuacacccucgcccccaugggcaauggcacaggcagacgccgcgcccucuaa

SEQ ID NO: 37317 - RNA, 1623 nt, Artificial Sequence
  derived and/or modified sequence opt11 from major_capsid_protein__Norovirus__ADV37917
augaaaauggcuagcuccgacacaaaaacauccgacggcuccaccgccaaccugguucccgaagucaacaacgaagucauggcccucgaacccguaguuggcgccgcaauagccgccccagucgccggccaacaaaacgucauugaccccuggauccgcaacaacuucguccaagcccccgguggagaauuuaccgucucaccccgaaacgcccccggagagauccucugguccgcaccccucggcccagaccucaaccccuaccuaucccaccucgcccgcauguacaacggcuacgcaggaggcuucgaaguacaggucauauuagccggaaacgccuucaccgccggcaaaaucaucuucgccgccguuccacccaacuuucccacugaaggccucucacccucacaaguaacaauguucccccacauaaucgucgacguccgacagcucgaacccguccucauaccccucccagacgucagaaacaacuucuaccacuacaaccaaagcaacgaccccaccauuaaacucaucgcaaugcucuauacaccccuccgcgccaacaaugccggcgacgacgucuucaccguuucaugcagaguccuuacccgcccaagccccgacuuugacuucaucuuccuagugcccccaacagucgaaucccgcaccaaacccuucuccguccccauccucaccgucgaagaaaugaccaacucccguuuccccaucccccucgaaaaacucuucaccggccccagcuccgcauucguaguacaaccucaaaacggccguugcacuaucgacggcguucuccucgguaccacccaacuuucaccaguaaacaucuguaccuuccgcggagacgucacccacaucaccggaucccgaaacuacaccaugaaccucgccacccaaaacuggaacuccuacgacccaaccgaagaaauaccagccccacucggaacccccgacuucgucggcaaaauccaaggaguccuaacacaaacaacacgcgccgacggcuccacucgcggccacaaagccacuguuuacacgggauccgccgacuucgcccccaaacuaggacgaguccaguucgcgacugacaccgacaaugacuucgaugccaaccaaaacaccaaauucacccccgucggaguaauccaagacggaaacaccgcccaccgcaacgaaccacaacaguggguccuacccucauacucagggcgcaacagccacaauguucaucuagcccccgcagucgcccccaccuucccaggcgaacaauuacuuuucuuuagaucaaccaugcccggcugcuccggcuaccccaacauggaccucgauugccuccucccccaagaauggguccaauacuucuaccaagaagcagcaccagcucaaucugacgucgcccuccuccgcuucgucaaccccgauacaggccgaguccucuucgaguguaaacuccacaagucuggauauguuacggucgcacacaccggacaacacgaccucguaauuccacccaacggauauuuccgcuucgacagcuggguaaaucaauuuuacacccucgcccccaugggcaacggaacuggacgucgcagagcccuguaa

SEQ ID NO: 37318 - RNA, 1623 nt, Artificial Sequence
  derived and/or modified sequence opt11 from major_capsid_protein__Norovirus__ADV37919
augaaaauggccuccuccgacgccaaccccagcgacggaucaaccgccaacuuagucccugaaguaaacaacgaagucauggcccuugaacccgucgucggcgccgcuauagcugcacccgucgccggccaacaaaacgucauagacccuuggauacguaauaacuucguccaagcccccggcggagaguucaccgucagcccacgaaacgccccaggugaaauacuuugguccgcaccccucggccccgaccucaacccauaccucucccaccuagcccgaauguauaacggcuacgccggcggauucgaaguccaagucaucuuagccggcaacgcuuucaccgccggaaaaauaauauucgcagccguaccacccaacuuucccaccgaaggacuuucccccucacagguaaccauguucccacacauaaucguagacguacgccagcucgaacccguucucaucccacuccccgacguacguaauaacuucuaccacuauaaccaaagcaaugaucccaccaucaaacuaaucgccaugcucuacacaccccuacgugcaaacaacgccggcgacgaugucuucacaguaucgugccgcguccucacccgcccuuccccagacuucgacuucaucuuccucguaccgcccaccgucgaaucacguacaaaacccuuuagcguccccauccuaaccguugaagaaaugacaaacucccgcuuccccauaccacuagaaaaacucuucaccggcccauccagcgccuucgugguccaaccccaaaacggccgaugcacaaucgacggcguccuccucggcacaacccaacucuccccagucaacauuuguacuuuccgcggagacguuacccacaucaccggaucacgaaacuacaccaugaaccucgcaacccaaaacuggaacucauacgaccccacagaggaaauccccgcaccacucgguacaccagacuucgucggcaaaauccaaggaguccucacccaaacaaccagagccgacggcuccacgcgaggccacaaggccacuguauacaccggcagcgccgacuucgccccaaaacucggccgaguccaauuugccaccgacaccgacaaugacuucgacgccaaucaaaacaccaaauucacccccgucggcgucauacaagacgguaauacagcccacagaaacgagccccaacaauggguccuccccucauacuccggccgcaacucccacaacguccaccucgccccagccguagccccaaccuuccccggcgaacagcuccuauucuuucgcuccaccaugccaggcugcuccggcuaccccaacauggaccucgacugccuacucccccaagaauggguccaauauuucuaccaagaagccgcuccagcccaaucggacgucgcccuccuccgcuucgucaaucccgacacaggccguguccuauucgaaugcaaacuccacaaaucugguuacguaacagucgcucacaccggccaacacgaccucgucaucccaccaaacggauauuuccgguucgacuccugggucaaccaauucuacacccuagcccccaugggaaacggcaccggacgccgccgcgcacuauag

SEQ ID NO: 37319 - RNA, 1608 nt, Artificial Sequence
  derived and/or modified sequence opt11 from major_capsid_protein__Norovirus__AEI83469
augaaaauggcauccaacgaugccgcaccgucuaacgacggagccgccggacuuguccccgaagucaacaacgaaaccauggcccuagaaccaguagcaggagcguccaucgccgcaccauuaacaggccagaacaacgucaucgaccccuggauccgccucaacuucguacaagcccccaacggcgaauuuacaguauccccucgaaacucgcccggcgaaguacuacuaaaccucgaacuaggcccagaacuaaacccuuaccuagcccaccucucaagaauguacaacggguacgccggcggcguagaaguacaaguucuacucgccggcaacgccuucaccgccggcaaacuugucuucgccgccgucccaccccacuucccccucgaaaacaucucucccggccagaucaccauguucccccacgucaucauagacguacgcacccuagaacccguccuacuuccacuccccgacguacgaaacaacuucuuccacuacaaucaacaaaacgaacccagaaugcgauugguugcuauguuauacaccccucuacgcuccaacggcucuggagacgacgucuucaccgucucgugccgcguccuaaccagaccaucacccgacuucgacuucaacuaccuuguaccacccaccguugaaucaaaaaccaaacccuucacccuacccauacucacuaucggagaacucaccaacucucgcuuccccguccccaucgacgaacucuacaccagccccaacgaaucccucgucguccaaccccaaaacggccgcugcgcacuagacggcgaacuccaaggcacaacucaacuacuccccacagccauaugcucuuucagaggccgcauaaaccaaaaagucuccggugaaaaccacguauggaacaugcaagucacuaacaucaacggcaccccauucgacccaaccgaagacguccccgcaccccucggcacccccgauuucuccggcaaacuuuuuggcguacucucacaacgcgaccacgacaacgccugccgcucucacgacgccgucauugccaccaauucugcuaaauucacccccaaacucggagccauccaaaucggcacuugggaagaagacgacguacacauaaaccaacccacuaaauucacccccgucggccuauucgaaucagaaggcuucaaccaauggacgcuccccaacuacuccggagcccuaacccuuaacaugggucuugccccacccgucgcacccaccuuccccggcgaacaaauccucuuuuuccgcucccauaucucacuuaaaggcggcguagcagaccccgucaucgacugccuccuuccccaagaauggauacaacaccuauaccaagaauccgccccuucccaaacagacguagcccucaucagauucaccaaccccgacaccggccgcgucuuauucgaagccaaacuucaucgcucugguuacaucaccgucgccaacaccggaucgcgccccauugucguccccgccaacggcuauuuccgcuucgauuccugggucaaccaauucuacucccucgccccuaugggcaccggcaacggccgacgccgcguccaauga

SEQ ID NO: 37320 - RNA, 1644 nt, Artificial Sequence
  derived and/or modified sequence opt11 from major_capsid_protein__Norovirus__AEP04093
augaaaauggccucuaacgaugccgcccccucaaccgacggcucagcgggacucguccccgaaguaaacaacgaaaccauggcgcucgaacccgucgugggcgcaccccucgcagcacccgucgcuggccaacacaacauaauagaccccuggauaaaaaugaacuucguccaagcaccaaacggcgaauuuacagucucacccagaaacgcacccggcgaaauacuccucgaccucgaacucggcccagaccucaacccauaccucucccaccucgcucguauguacaacggcuaugccggaggcauggaaguacaagucguccucgccggcaacgcuuucaccgccggcaaaauaaucuucgcggccguaccuccaaacuuccccgccgaaaaccucagcgccgcccaagucaccaugugcccccacguuaucguagacguccgccaacucgaacccguaaugcucccaaugcccgacauccgcaacaaacucuuccacuauaaccaagucgaugaccccaaacuccgacuccucgcuuaccucuacacaccccuccgcgccaacaacgccggcgacgacgucuucaccgucagcugccgcguucucacacgcccaacccccgacuucgaguucauguuccuaguaccacccaccgucgaauccaaaaccaaacccuucucacuccccucccuuacucucgacgaauugucaaacagccgauucccugccccaaucguccaacuuuacacaaacccccaugacaaccucgucguacaaccacaaaacggacgaugcaccaucgacggauuacuacaaggaaccacacaacucgucuccugcaacguaugcagcuuccggggcaccaucggcgacggccaaccagcuucucacucagaagaagaaauuaugcccauggcauucaacauacaacgagaacucaugcuugaaaaccucgacggcuccccguacgacccaaccgaugacauuccagcuguccuagguucccccgacuuucaaggggucaucuucggcauccuaucccaaagaaacggcgacggccaaacccgagcccacgaagccaaagucgacacccgcgccgcccgcuucgcccccaaacuuggcuucguaguggccaccgucgaauccacugacuuccacgccaaccaaccaucacgcuuuaccccagucggccucggcggcgacggcaaccaagauuucgcacaguggaaccuccccaccuacgggggcgcccuaaccaacaacaccaaccuagccccacccguaaugcccgucuacccaggcgaacaacuccucuucuuccgcucccagcucccauccucaggaggcgucgucggcggcuggcucgacugucuacucccacaagaauggguccaacacuucuuccaagaaagcgccaccucacaaucagacguagcacucguccgcuacaucaaccccacaaccggccgcguccucuucgaagcaaaacuacacaaacaaggcuuccucacggucgcagccucaggcuccuacccccucgucguucccgccgacggcuacuuccgcuucgaaucaugggucaaccaauucuauacccucgccccaaugggaaacggcucuggccgccguagaacucgcuaa

SEQ ID NO: 37321 - RNA, 1620 nt, Artificial Sequence
  derived and/or modified sequence opt11 from major_capsid_protein__Norovirus__AEQ77282
augaugauggccuccaaagacgcucccucaaacauggacggcacaucuggcgccggccaacuuguccccgaagucaacgccgccgaaccccucccccuugaacccguagucggcgccgccacugccgcagccaccgccggccaagucaaccucaucgacccauggaucaugaacaacuucguccaagcuccugaaggagaauucaccaucucccccaacaacacacccggcgacauacucuucgaccuccaccuaggcccccaccucaacccauuccuccaacaccuaucccaaauguacaacggauggguaggaaacaugcgcguccgcgucaugcucgccggcaacgcauucaccgcgggaaaaauaaucaucugcugcgucccacccggauucgcaucacaaaacaucucuaucggacaagcaacaauguucccccacgucauagcugacgucagaguccuggaacccauugaaauaccccuugacgacguccgaaacguccuauuucauacaaacgaaaaccgcccuacuaugcgccuauuaugcaugcuguacaccccccucagagccggcggagcauccuccggcacugacccguucgucauagcaggccgaguuuugaccugcccaucuccagacuucaacuuccucuucuuagucccccccuccguugaacaaaaaacacgacaacucaccgucccuaacauaccccucaacaacuuagccaacucucgcguacccgccaugaucaacaaaaugacagucuccaccgaccaaaaucaagucguccaguuccaaaacggccgcugcacccucgaaggccaacuccucggcacaacacccgucuccgccucccaagucgcccgcauacgaggaaaagucuucuccacugcuuccggcaaaggacuaaaccuaaccgaacuagauggaacuccauaucacgccuucgaaagccccgccccacuaggauuccccgacaucggcgccugcgacuggcacguuuccacauucaaagucgaccaaaaccuaucuggcgaccccaugucccgacucgacgucaaacaaaacgcccccuucgcuccccaccucggcagcauagaauucacaucagaccaagaccccaccggcgaccaacuaggcacccucgccugggugagccccucgaccucaggcgcccgcgucgaccccuggaaaauacccuccuacggcuccacagucacugaauccacacaccucgcuccaccaaucuuccccccaggauucggcgaagccaucguauacuucauguccgacuuccccaucgucuccggcaacaccgcccaaguacccugcaccuuaccccaagaauucguaucucacuucguagaacaacaagccccuguccgcggcgaagcugcccuccuucacuacgucgaccccgacacccaccgcaaccuaggagaauucaaacucuaccccgauggauuuaucaccugcguacccaacacaggcgguggaccccaaaaccuaccuaccaacggggucuucgucuucuccuccugggucucacgcuauuaccaacuaaaaccagucggcaccgccgggcccgcccgccgacuaggcguccgccguguuuag

SEQ ID NO: 37322 - RNA, 1608 nt, Artificial Sequence
  derived and/or modified sequence opt11 from major_capsid_protein__Norovirus__AFA55174
augaaaauggcauccaacgacgcagcccccuccaacgacggagcagcuggccucguccccgaagucaacaacgaaaccauggcccuggagccagucgccggcgccuccaucgccgcaccccucacaggacaaaacaacgucauagacccauggauacgcaugaacuucguccaagcccccaacggagaguucaccgucucaccccgcaacuccccuggugaaguccuacucaaccuagaacucggucccgaacuaaacccauuccucgcccaccuuucccgcauguacaacggcuacgccggcggcgucgaaguccaaguacuccucgccggcaacgccuucaccgccggcaaacucguauucgccgccauacccccacacuucccccuugaaaaccucucccccggucaaauuaccauguucccccaugucauaauagacguccgaacccucgaacccguccuccucccccuccccgacguacgcaacaacuucuuccacuacaaccaacaacccgaacccagaaugcgccucguggccaugcucuacacuccccuucgaagcaacggcucuggagacgacgucuucaccgucucaugccgaguucucacucgccccuccccagacuucgacuucaauuaccuaguaccacccaccguugaaucaaaaaccaaacccuucacacucccaauccuaacuauaggcgaacucuccaacucuagguuccccguucccaucgacgaacucuauacaucccccaacgaaggcguagucguacaaccucaaaauggccguuccacccucgauggcgaacuacucggcaccacccagcuaguacccuccaauauuugcgcccuucgcggacgaaucaacgcccaaguccccgacgaccaccaccaguggaaccuccaagucaccaaugccaacggcacauccuucgacccuacagaagacguacccgccccacucggcacuccugacuuccuagccaacaucuacggcgucacaucucaacgaaaccccgacaauaccugccgcgcacacgacggaguacucgcaaccuggucccccaaauucaccccuaaacuuggcucaguaguccucggcaccugggaagaauccgaccucgaucucaaccaaccaacccgauucacccccguaggccucuacgacaccggccauuucgaccaauggguccuucccaacuacucuggccgccucacacucaacaugaaccuagcccccuccgucgcaccccucuuccccggcgaacaaauccucuucuuccgcucacacauaccccucaaaggcggaaccuccaacggcgccaucgacugucugcuaccgcaagaauggauccaacacuucuaccaagaauccgcccccucaccaacagacgucgcucucauucgauacacaaaccccgacaccggccguguccucuucgaggccaagcuacaccgucaaggcuucauaacagucgccaacucaggcagccgcccuauuguagucccaccaaacggcuacuuucgcuucgacucuugggucaaccaauuuuacucccucgcccccauggguaccggcaacggacgacgccgaguccaauga

SEQ ID NO: 37323 - RNA, 1629 nt, Artificial Sequence
  derived and/or modified sequence opt11 from major_capsid_protein__Norovirus__AFC89656
augaaaauggcgucuaacgacgcagcaccauccaacgacggcgcagccucccuuguaccagaagccaucaaugaaacaaugccccucgaaccaguagcuggcgccuccaucgccgcccccgucgccggucaaacaaauaucaucgaccccuggauccgaacaaacuucguccaagcuccaaacggagaauuuaccguaucaccccgaaacucaccaggggaaauccuccucaaccuagaacucggccccgaccucaacccuuaccucgcacaccucucccgcauguacaacggguacgccggcggagucgaaguacaaguacuacuugcaggcaacgccuucacagccggcaaaauacucuucgccgccauaccaccaaacuuucccguugacaugaucagccccgcacaaaucaccaugcuaccacaccucaucgucgacguccgcacccuagaacccaucaugaucccccuucccgacguccgcaauguguucuaccacuucaacaaccaaccccaaccaagaaugcgccuagucgccaugcucuacacuccccuccgauccaacggaucaggcgacgacguauucaccguaucgugcagaguacuaacccgccccaccccagacuucgaguucaucuaccuaguaccacccuccgucgaauccaaaaccaaacccuucacccuaccaauccucaccauaagugaacuaaccaacucccgcuucccuauuucaaucgaacagcuauacaccgcccccaacgaaaacaacgucguccaaugccaaaacggccgaugcacucuagacggcgaacugcaaggcaccacccaacuccuaucgucagccgucugcagcuaccgaggccgaaccgucgccaacucaggugacaacugggaccaaaacguccuccaacucacauaccccuccggcgccucauacgacccaacagacgaaguccccgcaccccuaggaacgcaagacuucuccggcauacuauacggaguccucacccaagacaacgucagagaaaacaccggagaagccaaaaacgccaaaggcguauacauauccacaacuuccggaaaauucacccccaaaaucggguccaucggccuccacuccaucaccgaagacgucagaccaaaccaacaaucacgcuucacaccuguaggagucgcacaaaacgaaaauaccccauuccaacaauggguccucccgcacuaugcaggcgcccuagcucucaacacaaaccuagcccccgccgucgcaccaaccuuccccggcgaacaacuccucuucuuccgcucccgcguacccugcguccaaggccuacaaggacaagacgccuucaucgacugccuccucccacaagaaugggucaaccauuucuaccaagaagccgcccccucccaagcggacgucgcucucaucagauacguaaaccccgauacaggucgaacccucuucgaagccaaacuccaccgcucgggcuuuaucaccguaucacacacuggcgcauacccacucgucgucccacccaacggacacuuccgauucgacagcugggucaaccaauucuacucccuugcacccaugggcacagguaacggacgccgaagaguucaauaa

SEQ ID NO: 37324 - RNA, 1617 nt, Artificial Sequence
  derived and/or modified sequence opt11 from major_capsid_protein__Norovirus__AFC89659
augaugauggcauccaaagacgccccaucaaacauggacggaaccuccggugccggccagcuaguucccgaagucaacaccgcagaaccccucccccuagaacccgucguaggcgccgccaccgccgcugccaccgccggacaagucaaccucaucgaccccuggaucaugaacaauuucguacaagcccccgaaggcgaauuuaccaucuccccaaacaacacccccggagacauccuauucgaccuccgcuuaggcccccaucucaaccccuuccuacuccaccucucccaaauguacaacggaugggucggcaacaugcguaucaggguaaugcucgccggcaacgcauucucagcgggaaaaauaaucaucugcugcguaccaccuggguucgaaagccaaaacaucucaaucggccaagccaccauguucccacacguaauagccgacguccgaguccucgaacccaucgaaauccccuuagacgacguucgaaacguacuauaccacacgaacgaaaaccgcccaaccaugcgccuccuaugcaugcucuauacuccacuacgcgcaggcggcgccuccucuggcacagaccccuucgucauagccggacgaguccuaaccugccccgcacccgacuucaacuuccucuuccucgucccaccauccgucgaacagaaaacccgccaacuuaccauccccaacaucccccuaaacaaccucgccaacucacgcguccccgccaugauaaacaaaauggcugucuccgccgaccaaaaccaaguaguucaauuccaaaacggccgauguacccuugaaggccaacuccucggaacaacccccguaagcgcaaaucaagucgcgcgcauacgaggcaaagucuucagcaccaacuccggcaccggccuaaaccucaccgaaacagacggcacccccuaucacgccuucgaauccccagcaccccucggcuuccccgacaucggagacugcgauuggcaugucuacgcuuucaaagucaaccaaaauaccggcgacccgauguaccgacucgacaucacacaaggcaacuccuucgcaccccaccuaggcucaauugaauuuaccucugaccaacaucccuccggagaccaacuuggcacccuaacguggaucuccccacucaauaacgccucccgcguugaucccuggaaaauccccucuuacggcuccacccucaccgaauccacgaaccucgccccucccauauucccacccggcuucggcgaagccauagucuacuucaugucagacuuccccaucgucuccggcaacacaacacaaaucccaugcacccuuccacaagaauuuauaucuagcuucguagaacaacaggccccuauccgcggcgaagccgcccuccuucacuacgucgacccagacacccaccgcaaccucggcgaguucaaacucuaccccgacggauucauaaccugcguucccaacaccggaggcggcccccagaaccuacccuccaacggaguuuucaucuucucuucgugggucucacgcuacuaccaacuaaaaccagucggaacagccggccccgcccgcagacucggaguaagacguaucuaa

SEQ ID NO: 37325 - RNA, 1647 nt, Artificial Sequence
  derived and/or modified sequence opt11 from major_capsid_protein__Norovirus__AFC89662
augaaaauggccucaaacgacgccacccccucaaacgacggcgccgccggccucgucccagaaauaaacaacgaagcaauggcccucgacccggucgccggcgccgcaaucgcagcaccacuaacaggccaacaaaacaucauugacccuuggauaaugaacaacuucgugcaagcccccggcggcgaguucaccgucuccccacgcaacucucccggcgaaguccuacucaaccuagaacucggccccgaaauaaacccauaccucgcccaccucgcccgcauguacaacggcuacgcaggcggcuucgaaguccaggucgucuuagcuggcaacgccuucacagcaggcaaaauaaucuuugcugccaucccacccaacuuccccaccgacaacuuauccgccgcacaaaucacuauguguccccacguuauaguagauguacgccaacucgaaccugucaaccuccccaugcccgacguacgcaacaacuucuuccacuacaaccaaggaucggacucacgacuacgauuaaucgccaugcucuauacuccccuccgagcaaacaacagcggcgacgacgucuucacggucuccugccgcguccuuacucggcccuccccugacuucagcuucaacuuccucgucccacccaccgucgaaucaaagaccaaacccuuuacucuucccauccuuacaaucucagaaauguccaacucccgcuucccagugccaaucgacucccuccauaccucucccacagaaaacaucgucguccaaugucagaacggacgcgucacccucgacggcgaacucaugggcaccacacaacuccucccaucccaaaucugcgccuucagggguguccuaacccgauccaccucccgcgcuucugaccaagccgacacugccacaccccgccuauucaacuacuacuggcacauccaacucgacaaccuaaacggcaccccauacgaccccgccgaagacaucccaggaccccucggcaccccugacuuccgaggcaaaaucuucggcguagccucgcaaagaaaccccgacucaaccacccgcgcccacgaagcaaaagucgacaccaccgccggacgauucaccccuaaacuuggaucacucgaaaucuccacugaauccggcgacuucgaccagaaccagccuacacgcuuuaccccagucggaauaggcgucgacaacgaagccgacuuccaacaauggucacuccccgacuacuccggacaauucacacacaacaugaaccucgccccagcuguugcacccaacuucccaggcgaacaacuacucuucuuccgcagucaacuccccuccucuggaggccgcuccaacggaauacuagacugccuagucccgcaagaguggguccaacacuucuaccaagaauccgccccagcccaaacccaggucgcccucguccgcuacgucaacccagacaccggccgcgucuuauucgaagcuaaacuccacaaacuaggauucaugacaauagccaaaaacggcgauuccccuauaacaguuccacccaacggauacuuccgauucgaaucaugggucaaucccuucuauacccucgcaccuaugggaaccggaaacggccgacgccgcauccaguaa

SEQ ID NO: 37326 - RNA, 1620 nt, Artificial Sequence
  derived and/or modified sequence opt11 from major_capsid_protein__Norovirus__AFC89665
augaagauggccuccaacgacgccgcacccucaaacgacggcgcuaccggccucguaccagaaaucaacaccgaaacccucccgcuugaaccuguugccggagccgccaucgcugcacccguaaccggccaaaacaacaucauagacccauggauacgaaacaacuucguccaagccccaaacggcgaguucacagucucuccccgcaacucgccaggcgaaauccucaugaaccuagaacuaggcccagaccuaaauccauaccucgcccaccuaucccgcauguacaacggcuacgccggcggcgucgaagugcaaguccuucucgccggaaacgccuucacugccggcaaaaucuuauucgccgcagucccaccaaacuuccccgucgacaugcuaucaccagcacaaaucaccaugcucccacaccucaucgucgacguacgcacccuugaacccaucaugauaccccuccccgacguccgcaacgucuucuaccacuucaauaaccaaccagcccccagaaugcgacuggucgccaugcucuacacaccucuacgcucaaacggcuccggagacgacgucuucacaguuuccugccgaguccucacccgcccaacccccgacuucgaguucaccuaccuaguaccacccucagucgaaucuaaaacaaaaccauucacccuccccauucuaacaaucggagaacuaaccaacucccgauucccagccccaaucgaccaacuauacaccucccccaacgccgacguagucguccaaccccaaaacggacgaugcacccucgacggcgaacuccaaggcacuacccaacuacuaacaacagccaucugcuccuaccgaggcaugaccuccaaccccacuuccgacuacugggacgaucacuuacuccaccuaguccaccccaauggcgccacauacgaccccaccgaagauguccccgcacccuucggcacucaagacuuccgcggcauccucuacggcaugcucacacaaaacccccgcaccuccggagacgaagccgccaacagccacggaaucuacauaucauccaccuccgaaaaauucacccccaaacuaggcaccauaggccuccaccaaguccaaggcgacaucgcaagcaaccaacaguccaaauucacaccaguaggcaucgccgucaacggcaacacccccuucagacaaugggagcuccccaacuauuccggagcccucacccuuaacaccaaccucgcccccgccgucggucccaacuucccaggcgagcaaauucuauucuuucgcucaaacguccccaguguccaaggcggccaacccaucgaaauagacugucuaauaccccaagaauggguaucacacuucuaccaagaauccgccccaucccaaucagacguagcccuaguccgcuacgucaacccagauaccggccgaaccauauucgaagccaaacuccaccgacaaggauucaucacaaucgcagcuacagguuccaaccccguagucgucccacccaacggcuacuuccgauucgacuccugggucaaccaauucuacgcccucgccccuaugggcaccggcaacgggcgucgccgcguacaauaa

SEQ ID NO: 37327 - RNA, 1623 nt, Artificial Sequence
  derived and/or modified sequence opt11 from major_capsid_protein__Norovirus__AFC89667
augaaaauggccuccaacgacgcuaaccccucagacggcucugccgccaaccucgucccagaagucaacaacgaagucauggcacuagaacccguugugggcgcagccaucgccgcgcccguagcaggccaacaaaacguaaucgaccccuggauccgaaacaacuucguccaagcccccggcggcgaguucaccgucucaccucgcaacgcccccggagaaauccucuggagugcaccccucggccccgaccucaauccauaccuaucucaccuugcccgcauguacaacgguuacgccggcggcuucgaaguacaagucauccuugcaggcaacgccuucaccgccggcaaaaucauuuucgccgccgucccuccaaacuuccccacagaaggccuaagccccucccaaguaacuauguuuccacacaucauagucgacguuagacaacucgaacccguccucaucccacuccccgacguacgaaacaacuuuuaccacuauaaccaauccaacgacuccaccaucaaacucaucgccaugcucuacacaccacuaagagccaacaacgcaggagaagacgucuucaccgucuccugccgcguacucacccguccauccccagacuucgacuucaucuuccuggucccacccaccgucgaaucacgcaccaaacccuucacaguccccauacucacugucgaggaaaugaccaacucccgcuuucccauuccacuagaaaaacucuucaccggcccaucaggcgccuucgugguacaaccgcaaaacggucgcugcaccacagacggaguacuccucggaaccacccaacucucucccgucaauaucugcaccuuccguggcgacguuacccacaucgcaggcucacgaaacuacacaaugaaccuagccucccuaaacuggaacaacuacgacccaaccgaagaaauacccgcuccccuaggcaccccagacuucgucggcaaaauacaaggaguccucacacaaaccacaaaaggagacggcuccacccgaggucauaaagccacagucuacaccggcuccgcccccuucacacccaaacuuggcagcguccaauucucaacagacaccgaaaacgacuucgaaacccaccaaaacacaaaauucacccccgucggcgucauccaggacggcuccacaacacaccgaaacgaaccccaacaauggguccuccccucauacuccggcagaaacguccacaacguccaccucgccccagccgucgcucccaccuucccaggagaacaacuccucuucuuccgcucuacuaugcccggcugcagcggcuaccccaacauggaccuagacugccuacuaccccaggaauggguccaacacuucuaccaagaagccgcaccagcucaaagugacgucgcacuccucagauucgucaaccccgacaccggccgcgucuuauucgaaugcaagcuccacaaguccggcuacgucacaguagcccacaccggucaacacgaccuggucauaccaccuaacggcuacuuccgcuucgacucaugggucaaccaauucuacacccuagcacccaugggcaacggaacagggcgacgccgagcccuauaa

SEQ ID NO: 37328 - RNA, 1626 nt, Artificial Sequence
  derived and/or modified sequence opt11 from major_capsid_protein__Norovirus__AFD62272
augcgcauguccgacggcgccgcccccaaagccaacggcagcgaggccuccggacaagaccuaguucccaccgccgucgaacaagcaguaccuauccaacccgucgccggugcagcccucgccgcacccgcagcaggucaaauaaaccaaaucgacccauggaucuuccaaaauuucguacaaugccccuuaggcgaguucucaauuagcccccgcaacacccccggcgaaaucuuauucgaucucgcacuuggccccggucucaacccauaccucgcccaccucuccgcuauguauacaggaugggucggaaacauggaaguacaacucguacucgccggcaacgcauucaccgcuggcaaagucguagucgcccuaguacccccuuacuucccaaaaggcucacuaacaaccgcccaaauaaccugcuucccccacgucaugugcgauguccgcacccucgaacccauucaacuuccccugcuagacguccgccgaguccucuggcacgcaacccaggaccaagaagaaagcaugcgccuaguaugcaugcucuacacaccccuccgcacuaacuccccaggcgacgaauccuucgucguaucaggccgacuacucucgaaacccgcagcugacuucaacuucgucuaccucaccccacccauugaacguaccaucuaccgcauggucgaucuccccguacuucaaccccgccucugcacucacgcccgcuggcccgcacccgucuacggacuacucgucgaccccucucuacccucaaacccacaauggcaaaacggccgaguccacgucgacggcacacuucucgguaccaccccagucuccggauccugggucagcugcuucgccgccgaagccgccuacgaguuccaaagcggaaccggccaagucgccaccuuuacaaugaucgaacaagacggcuccgccuacguccccggagaucgcgccgcaccucucgguuaccccgacuacuccggacaacuggaaaucgaaguccagaccgaaaccacaaaagccggcgacaagcuaaaagucaccaccuucgaaaugauccucggcccaaccacuaacgucgaccaagcacccuaccaaggacgagccuacgcuucccucaccgccgcagccucacucgaucuugucgacggccguguccgugcaguaccccgauccaucuacucauuccaagacguccuccccgaauacaacgacggccuccuagugccccuagccccaccccucggucccuuccuccccggagaaguccuucuccgcuuccguacauauaugcgccaacuggacacugcagacgccgccgcacagccaaucgacugcgcucuaccucaggaguucgucuccugguuugccuccaacucguucaccguacaauccgacgcccuccuugugagauaccgcaacacacuaacagggcaacuacuauuugaagccaaacucuacuccgaaggauacaucgccgucagcuacuccggcuccggaccccugaccuucccugccgauggcuucuucgaagucgucucuugggucccacgccuauuccaacucgccucagucgguucacuggccaccggccgcacccucaaacaauaa

SEQ ID NO: 37329 - RNA, 1620 nt, Artificial Sequence
  derived and/or modified sequence opt11 from major_capsid_protein__Norovirus__AFJ04707
augaaaauggcguccaacgaugcgucccccuccgacggcucaacggcuaaccucgucccagaaguaaacaacgaagucauggcauuagaacccguaguaggcgccgcuaucgccgcccccguagccggacaacaaaacgucaucgaccccuggauccggaacaacuuuguccaagcccccggcggcgaguucacaguaucaccaagaaacgcaccaggagaaauacuaugguccgcaccacuaggccccgaccuaaacccuuaccuaucacaccuagcccgcauguacaacggauacgccgggggcuucgaaguccaagucauucuagcaggcaacgcauucaccgcaggcaaaaucauauucgcagccguaccucccaacuuccccacagaaggucucucucccucacaaguaaccauguucccccacaucaucguagaugugcgccaacucgaacccguccuuaucccccuccccgacguccgcaacaacuucuaccacuacaaccaauccaacgacagcacuaucaaacucauagccaugcucuacacaccccuccgcgcaaacaacgccggagacgauguauucaccguuuccugccggguacuaacccgccccucccccgacuucgacuucaucuuccuagucccaccaaccgucgaaucccgcacaaaaccauucaccgucccaauacuaaccguagaagaaaugucaaacucacgcuucccaaucccccucgaaaaacuauacacaggucccagcucugcauucgucguccaaccucaaaauggacgcugcacuaccgacggcguccuccuuggcacaacacaauuauccgccgucaacauuugcaccuuccgaggcgauauuacucacaucgccggaucccaugacuacaccaugaaccucgccucccaaaacugguccaauuacgaccccaccgaagaaauaccugcuccccucggcacccccgacuucguaggcaaaauacaaggcauguuaacccaaaccaccagagaagacggaucgacucgagcucacaaagccaccguauccacaggguccguccacuucacccccaaacuuggcuccguccaauacacuacagacacuaacaacgacuuccaaacaggccaaaacaccaaauuuaccccugucggagucauccaagacggcggaaaccaccagaacgaaccucaacaauggguucuccccaacuacucaggacgaacaggacacaacguccaucuagcgcccgcugucgcccccacauuccccggagaacaacuccuguucuuccgcuccacuaugccaggcugcucaggguaccccaacaugaaucucgacugccuacuaccucaagaauggguacaacacuucuaccaagaagccgcccccgcccaguccgacgucgcccuacugcgcuucgucaacccagacacaggccgcguccuauucgaaugcaaacuccacaaaucaggcuacguaaccguagcacacaccggcccacacgaccuagucaucccacccaacggauacuuccgcuucgacuccugggucaaccaauucuacacacucgcccccaugggcaacggugcaggccgccgucgcgcacucuaa

SEQ ID NO: 37330 - RNA, 1623 nt, Artificial Sequence
  derived and/or modified sequence opt11 from major_capsid_protein__Norovirus__AFJ04708
augaaaauggcaucuaacgacgccaaccccagcgacggcucaaccgccaaucucguacccgaagucaacaacgaaguaauggcacucgaaccagucguaggagccgcuaucgccgccccagucgccggccagcaaaacgucaucgaccccuggauccgcaacaacuucguccaggccccaggcggagaguucacagucagcccccgcaacgccccaggcgaaauccuauggucugcuccccuuggacccgaccucaauccuuaccucucccaccucgcccgcauguacaacggauacgccggcggcuucgaaguacaagucauccuagcaggcaaugccuucaccgccggcaaaaucaucuucgccgcagugccacccaacuucccaaccgaaggucucuccccaucacaagucacaauguuuccccacauaaucgucgacgucagacagcucgaaccaguccucauaccacugcccgacguccgaaacaacuucuaccacuauaaccaauccaacgacccaacaaucaagcucauagccaugcuauacacgccccuccgcgccaacaacgccggcgaagacgucuucaccguuagcugccgcguacucacccgccccucaccagauuucgacuucaucuuccucguaccacccacugucgaaucccgaacuaaaccauucacaguaccaauccuuaccguagaagaaaugacaaacucccgcuucccaauaccccuagaaaaacucuucacaggacccucuggcgccuucguaguccaaccccaaaauggaagaugcaccacagacggaguucuccucggcaccacccaacuaucaccagucaacauaugcaccuuucgcggcgacguaacacacauagccggaacacauaacuacaccaugaaccucgcaagccaaaacuggaacaacuaugacccgacagaagaaauccccgccccacuaggcacccccgacuucgucggacgaauccaaggaaugcuaacccaaacuacccgcggagacggaucuacccgaggccacaaagccacaguauccaccggagacguccacuucacccccaaacucggaagcauccaauucaacaccgacaccaacaacgacuucgaaaccggccaaaauacaaaauucacaccaguaggcgucguucaagacggcaauggcgcccaccaaaacgaaccccaacaauggguccucccauccuacucaggacgcacaggacauaacguucaccucgcccccgccgucgcccccaccuucccaggagaacaacuacuuuucuuccgaagcacaaugcccggaugcuccggcuacccaaacaugaaccucgacugccuccuaccacaagaauggguacaacacuucuaccaagaagccgccccagcacaauccgacgucgcccuacucagauuugucaaccccgacaccggccgcguccucuucgaaugcaaacuccacaaaucaggcuacguuaccgucgcccacaccggacaacacgaccuaguaaucccucccaacggauacuucagauucgacuccugggucaaccaguuuuacacccucgccccaaugggaaacggcaccggccgccgccgcgcgcuauaa

SEQ ID NO: 37331 - RNA, 1623 nt, Artificial Sequence
  derived and/or modified sequence opt11 from major_capsid_protein__Norovirus__AFJ04709
augaaaauggccucuaaugacgccaaccccagcgaugguuccgccgccaaccuaguccccgaaguaaacaacgaagucauggcccucgaacccgucgucggcgcagccaucgccgcccccgucgcaggccaacaaaacguaaucgaccccuggauccgcaauaacuucguccaagccccaggaggcgaauuuaccgucagcccccgaaacgccccaggcgaaauccuuugguccgcuccccucggacccgaccuaaaccccuaccuaucccaccucgcacgcauguacaauggcuacgcaggcggauucgaaguccaagucauacucgccggaaacgccuucaccgccggcaaaaucaucuucgcugcagucccacccaacuuccccaccgaaggccuaucaccaucgcaagucaccauguucccacacauuaucgucgacguccgucaacucgaacccguacucaucccccucccugacguccguaacaauuucuaccacuacaaccagucaaacgacagcacaauaaaacuaaucgccaugcuuuacacuccacuccgcgcaaacaacgccggagaagacguuuucaccguauccugccgcguacuaacacgcccauccccugacuucgacuucaucuuccucguucccccaacagucgaaucccgcaccaaaccauucacaguaccuauacucaccgucgaagaaaugaccaacucacgcuuuccaaucccucuugaaaaacuuuucacaggcccauccggcgcauucguuguccaaccccagaacggccgcugcacuaccgacggaguacuacugggcaccacccaacucucccccgucaauaucugcacauuccguggugaugucacccacauagccggcucccgcaacuacacaaugaaucucgcgucacucaacuggaacaacuacgacccaacugaagaaaucccugcaccccucggcacacccgacuucgucggcaaaauacaaggcguacuuacacaaacaaccaaaggcgauggcucaacccgcggccacaaagcaaccgucuacaccgguucagcucccuucacuccaaaacuagguucaguucaauucucaacagacacugaaaacgacuucgaaacccaccaaaacaccaaguucaccccugucggcguaauccaagacggcuccaccacccaccgcaacgaaccccaacaauggguacugcccucauauucaggacgaaacguccacaacguacaccucgcacccgccgucgccccaaccuuuccaggcgaacagcuccuuuucuucagauccaccaugccugggugcuccggcuaucccaacauggaccucgauugccuccucccccaagaguggguccagcacuucuaccaagaagcggcuccagcacaaucagacgucgcccuucuucguuucgucaaccccgacacgggccgaguccuguucgaaugcaaacuccacaaaagcggcuacgucacagucgcacacaccggccaacaugaccuugugaucccacccaauggauacuuccgcuucgauuccugggucaaucaauucuacacacuagcgcccaugggcaacggaaccgguggccgacgcgcacucuga

SEQ ID NO: 37332 - RNA, 1623 nt, Artificial Sequence
  derived and/or modified sequence opt11 from major_capsid_protein__Norovirus__AFP89593
augaaaauggcaagcaacgacgcaaacccaucagacggaucaaccgcaaaccucgucccagaagucaacaacgaagucauggcacucgaacccgucgucggcgccgccaucgcagccccaguugccggacaacaaaacgucauagaccccuggauacgaaacaacuucguccaagcacccggcggcgaguucaccgucagcccccguaacgcaccaggagaaauacuauggucagcaccccuugggcccgaccuaaaccccuaucuaucccaccucgcccgaauguacaacucauacgccggcggcuucgaaguacaagucauacucgcaggcaacgccuucaccgccggcaaaauaaucuucgccgccguacccccaaacuuccccaccgaaggccucagccccucucaagucacaauguucccccacaucaucguugacguccgccagcucgaacccgugcucaucccccuuccagacguacgcaacaacuuuuaccacuacaaccaauccaacgacccaaccaucaaacuaaucgcaaugcuauacacaccccuucgcgcaaacaacgccggugaagacgucuucaccgucuccugccgaguccucacccgaccaucgccagacuuugacuucaucuuccucgucccaccaaccguagaauccagaaccaaacccuucaccgucccuauccuaaccgucgaagaaaugacaaacagcagauuccccauaccccuggaaaaacucuucaccggcccuuccggcgcauucgucguacaaccccaaaacggccgcugcaccacugacggaguccuauuaggcaccacucaacuauccccaguaaauauaugcaccuuccgcggcgauguaacccacauagcaggcacccacaacuacacaaugaaccuagcaucacaaaacuggaacaacuacgacccaaccgaagaaauccccgcuccccucggcacaccagacuucgucgggcgcauacaaggcaugcuaacacaaacuacacgaggagacggcucaacccgcggccacaaagccaccgucagcaccggagacguccacuucaccccuaaacuaggcucuauccaauucaacaccgacacaaacaacgacuucgaaacuggacaaaacaccaaauucacccccguaggagugauccaagauggcaauggaacacaccaaaacgaaccacaacaauggguacuccccagcuacucaggacgaacaggacacaacguacaccuggccccagccguagcacccacauuccccggcgaacaacuacuauuuuuccgaucgaccaugcccggaugcuccggcuacccaaacaugaaccuagacugccuccuuccacaagaauggguccaacacuucuaucaagaagccgcaccagcccaaucggacguagcacuccuccgauucguaaacccagacaccggccgcguacucuucgaaugcaaacuccacaaaucaggauacguaacgguggcacacaccggccagcaugaccucgucaucccacccaacggcuauuuccgcuucgacucauggguaaaccaguucuauacccuagcccccaugggcaacggcaccggccgacgacgaguacuauaa

SEQ ID NO: 37333 - RNA, 1623 nt, Artificial Sequence
  derived and/or modified sequence opt11 from major_capsid_protein__Norovirus__AFU55686
augaaaauggccucaaacgacgcaaaccccucagacggaucuaccgccaaccucguccccgaagucaacaacgaaguaauggcccucgaaccugucgucggcgccgccaucgcggcccccguagccggccaacaaaacguaaucgacccauggauccgaaacaacuuuguccaagcaccaggcggagaguucacagucucaccccgcaacgcacccggcgaaauccuaugguccgcaccccucggccccgaccucaaccccuaccucucccacuuagcccgaauguacaacggauacgcuggaggcuucgaaguacaagucauacucgccggaaacgccuucaccgccggcaaaaucaucuucgccgcagucccuccaaacuuccccacggaaggacuaucuccaucccaaguaacaauguucccacacauaauuguagauguacgccaacucgaacccguacuaaucccccuccccgacguccgcaacaacuucuaucacuauaaccaaucaaacgacccaaccauaaaacuaaucgcaaugcucuacacuccccuccgcgcaaacaacgccggcgaagaugucuucacugucaguugccgcguccuaacacgucccucacccgacuucgacuucaucuuccugguuccacccaccgucgaaucacgaacuaaacccuucaccguccccauacucacaguagaagaaaugaccaacucccgcuuccccauaccgcuggaaaaacucuucacuggacccucaggcgccuucguuguccaaccccaaaacggcagaugcacaacagacggcguccuccucggcaccacccaacucagcccggucaacauauguaccuuccgaggcgacguaacccacaucgcagguacacacaacuacaccaugaaccucgccucacaaaacuggaacaacuacgaucccaccgaagaaauacccgcaccccuaggcacccccgauuucgucggccgcauccaaggcaugcuuacccaaaccacucgcggagacggcuccacucgcggucacaaggccacugucucuaccggagacguccacuucacccccaaacucggcuccauccaauucaacacagacaccaacaacgacuucgaagccggccaaaacaccaaauucacccccgauggaguuguccaagacggcaacggcacccaccaaaacgaaccccaacaauggguccuacccagcuacagcggccgcacaggccacaacguacaccuugcaccagccaucgcccccacauuccccggcgaacaacuccuguucuuccgcuccaccaugcccggcugcuccggcuacccuaacaugaaccuagacugccuacuaccacaagaauggguccaacacuucuaccaagaagccgcacccgcacaaucagacguagcccuccuacgauucgucaaccccgacaccggccgaguccuuuucgaaugcaaacuccacaaaucagguuacgucaccgucgcccacacaggccaacacgaccuagucauacccccaaacggcuacuuccgauucgacuccugggucaaucaauucuacacacucgcccccaugggcaacggcaccggaagacgacgagcccuauag

SEQ ID NO: 37334 - RNA, 1623 nt, Artificial Sequence
  derived and/or modified sequence opt11 from major_capsid_protein__Norovirus__AFU55689
augaaaauggcauccaacgacgcaacccccagcgacggcucgacagccaaccucguacccgaaguaaacaacgaagucauggcccucgaacccgucgucggcgccgcaaucgccgcccccgucgccggccaacaaaacguaaucgacccuuggauccgaaauaacuucguacaagcucccggcggagaguucaccgucucaccccgaaacgcccccggagaaauucuaugguccgccccacucggcccagaccucaaccccuaccuaucccaccuagcgcgaauguacaacggauacgcuggcggcuuugaaguacaggucauccuagccggaaacgcauucaccgccggaaaaaucaucuucgcugccgugcccccuaacuucccaacagaaggacuauccccuucccaaguaacaauguucccccauauuauaguagacguccgacaacucgaacccguacugauuccccuccccgacguacgcaacaacuucuaccacuacaaccaaucuaacgaccccaccaucaaacucaucgccaugcuuuauacaccccuacgagccaacaacgccggcgacgacguauucaccguauccugccgcguccuaacccgccccucccccgacuucgacuuuaucuuccucguaccacccacagucgaaucgcgaaccaagcccuucuccguccccauccucaccgucgaggaaaugaccaacucgcgcuucccgaucccccucgaaaaacucuucaccgggccuuccucggccuucgucguccaaccacaaaacggcagaugcaccacagacggaguccuucucggcacaacccaacucucccccgucaacauaugcaccuuucgcggcgacguaacacacaucgcuggcacccaaaacuacaccaugaaccuagcaucccaaaacuggaacaacuaugacccuacagaagaaaucccagccccucuaggcgcaccagacuucgucggaaaaauccaaggcguccucacccaaaccacccgaggcgacggcagcacacgcggacacaaagccacaguauccacaggcagcguccacuucaccccaaaacucgguuccguccaguucagcacagacaccuccaacgaccucgaaaccggccaaaacacccguuucacccccguaggugucguccaagacggcucaacaacacaccaaaacgaaccacaacaauggguacuucccaacuacuccggcagagacucccacaacguccaccuagcacccgcagucgcccccaccuuccccggcgaacaacuccucuucuuucguucuacaaugcccgguugcucuggauaccccaacaugaaccucgacugccuacucccccaagaauggguacaacacuucuaucaagaaagcgcucccgcccaguccgacguugcccuucucagauucgucaacccugacacaggccgggucuuauucgaaugcaaacuccauaaauccggcuaugucaccguagcccacaccggucaacacgaccucguaauacccccaaacggcuacuuccgauuugauucaugggucaaccaauuuuacacacucgccccaaugggcaacggcgccggacgacgccgagcccucuaa

SEQ ID NO: 37335 - RNA, 1623 nt, Artificial Sequence
  derived and/or modified sequence opt11 from major_capsid_protein__Norovirus__AFU55692
augaaaauggcaagcaacgacgcuacgcccuccgacggcucaaccgcaaaccuaguacccgaagucaacaacgaagucauggcacucgaacccguagucggcgccgccauagcagcccccgucgccggccaacaaaaugucauugacccauggauccgcaacaacuucguacaagcccccgguggagaauuuacugucucaccccguaacgcccccggcgaaauccucuggucagcaccgcuaggaccagaccuaaaccccuaccucucccaccucgcucgaauguacaacggcuacgccggcggcuucgaaguccaagucauccucgccggaaacgccuucacagccggcaagaucaucuucgccgccguaccacccaacuuccccacugaaggccuuuccccaucacaagucaccauguucccccacauuaucgucgacguccgucagcucgaacccguacugauaccccucccagacguacgaaacaacuucuaccacuacaaccaauccaacgacccaaccaucaaacucauagcaaugcuauacacuccccuacgcgccaacaacgcaggcgacgacgucuucacaguauccugcagaguccuaacccgcccauccccagacuucgauuucaucuuccuaguaccucccaccgucgaaucccgcaccaaacccuucuccguccccauccucaccgucgaagaaaugacuaauagccgcuuccccauaccacucgaaaagcuauucaccggccccuccuccgccuucguaguccaaccccaaaacggccgcugcaccacagacgguguccuacuaggcaccacucaacucucaccagucaacaucugcacauuccgcggcgacguaacacacaucgccggcacacaaaacuacacaaugaaccucgccucccaaaacuggaacaacuacgaucccaccgaagaaauccccgcgccuuuaggcacccccgacuuugucggcaaaauccaaggaguccuuacucaaaccacccgacgcgauggaucaacccgaggccacaaagcaacggucuccaccgguuccguccacuucacacccaaacugggcucaguacaauuuuccaccgacaccuccaacgacuucgaaacaggacaaaacacuagauucacacccgucggcgucguacaagacggcuccaccacccaccaaaacgaaccacaacaauggguucuccccgacuacuccggccgcgauucccacaacguccaccuagcaccagccguugcccccacuuucccaggagaacaacuacuguucuuccgcucaaccaugcccggcugcuccggcuaccccaacaugaaccucgauugccuucuaccccaagaauggguucaacacuucuaccaagaaucagcaccagcccaaagcgacgucgcccuccuacgauucguuaacccagacaccggaagaguccuauuugaauguaaacuacacaaacccgguuacgucaccgucgcccacacaggucaacacgaccucguaauacccccaaacggauacuuccgcuucgacuccuggguaaaccaauucuacacacucgccccaaugggaaacggcgccggccgccgccgugcucuuuaa

SEQ ID NO: 37336 - RNA, 1623 nt, Artificial Sequence
  derived and/or modified sequence opt11 from major_capsid_protein__Norovirus__AFU55695
augaaaauggccucgaacgacgcaaaccccuccgacggcucagccgccaaccucguccccgaaguaaacaaugaaguaauggcccucgaacccgucgucggggccgccaucgccgcccccgucgcaggacaacaaaacgucauagacccauggauccgcaacaacuucguccaagcccccggcggcgaguucaccgucucgccccgcaacgcccccggagaaauccucuggucugcaccccucggccccgaccuaaacccguaccucucccaccuugcccgaauguacaacggcuacgcugguggauucgaagugcaagucauccucgcaggcaaugcauucacagccggcaaaaucaucuucgcagccguacccccaaacuuucccaccgaaggacuaucacccucccaagucacgauguuuccacacaucaucgucgacgucaggcaacucgaacccguccuaauaccacucccagacguacgaaacaacuucuaccacuauaaccaaucaaacgauuccaccaucaaacuaauagcaaugcucuauacaccccuacgcgcaaacaacgccggcgaagacguauuuaccgucuccugccgcguucucacacgcccauccccugacuucgacuucaucuuccuagucccaccaacagucgaauccagaaccaaacccuucacaguacccauacuaacaguagaagaaaugaccaacucccgcuuccccaucccccuagaaaaacuuuucaccggccccucauccgcuuucgucguccagccccaaaacggccgcugcaccacagacggcguccuccucggcacaacccaacucucacccgucaacaucugcaccuuccgcggagacgucacccacauagccggaucccgcaacuacaccaugaaucuggcgagccuaaacuggaacaacuaugaucccacagaagaaauacccgccccacuagguaccccagacuucgucggcaaaauccaaggaguccucacccaaaccaccaaaggcgacggauccacccgaggccauaaagcuaccguguacaccggcucugcccccuucacccccaaacuuggcuccguccaauucuccacggacaccgaaaacgacuucgaaacacaccaaaacaccaaauucacacccgucggcgucauacaagacggaagcaccacucaccgcaacgaaccccaacaauggguucuccccucauauagcggccgaaacgugcacaacguacaccuagcccccgcaguugcacccacauucccaggcgaacagcuacuuuucuuccgcuccaccaugcccggaugcucaggauaccccaacauggaccuugacugccuccucccccaagaauggguucaacacuucuaccaagaagcagcacccgcacaauccgacguagcccuacuaagguuugucaaccccgauacaggacgcguccucuuugaaugcaaacuacacaaaucaggauacguuacagucgcccacaccggacaacacgaccucgucauuccacccaacggcuacuuccgcuucgacuccuggguaaaccaauucuacacccucgcacccaugggcaauggcaccggccgucgucgagcccucuaa

SEQ ID NO: 37337 - RNA, 1623 nt, Artificial Sequence
  derived and/or modified sequence opt11 from major_capsid_protein__Norovirus__AFU55698
augaaaauggccucauccgacgccaacccaucagacggcuccaccgccaaccucguacccgaagucaacaacgaagucauggcucuagaacccgucgucggcgccgccaucgcagccccagucgccggccaacaaaacgucaucgaccccuggauccgaaacaacuucguacaagcccccggcggcgaguucacagucucaccccgaaacgcacccggcgaaauccugugguccgcaccccucggacccgaccucaaccccuaccuaucucaccucgcccgcauguacaacuccuacgcaggaggguucgaaguccaagucauccucgccggaaacgccuuuaccgcuggcaaaauaaucuuugcagcggucccacccaacuuccccaccgaaggccucucccccucacaagucacaauguucccccacauaauaguagacguccgccaacucgaacccguccucauaccccugcccgacguccgcaacaauuucuaccacuacaaccaaucaaacgacccuaccauaaaacuaaucgccaugcucuauacuccgcucggcgccaacaacgcuggagacgacgucuucacagucucuugucgcgucuuaacccgaccuuccccugacuucgauuucaucuuccuugucccaccaaccgucgaaucccgcaccaaaccuuucucuguccccauccucaccguagaagaaaugaccaacucucgauucccaaucccacuugaaaaacucuuuacuggccccuccuccgccuucgucguccagccccaaaacggacgcugcacaaccgacggcguacuacuuggcaccacccaacuaucccccguaaacaucugcaccuuucgcggcgacgucacacacaucgccgguacacaagaauacacaaugaaccucgccagccaaaacuggaacaacuacgaccccaccgaagaaauccccgcaccccucggaacccccgacuucguaggaaaaauacaaggcguuuuaacccaaacaacacggagagacggcuccacgcgcggccauaaagccacaguauccaccggcuccguccacuucaccccuaaacuuggucgcauccaauucuccaccgacaccagcaacgacuuugaaaccggucaaaacacacgcuucaccccugucggaguuguacaagacggauccacaacccaccaaaaugaaccucaacaauggguacuccccaauuacuccggacgcgacagccacaacguacaccucgcccccgccgucgcucccucauuccccggagaacaauuacucuucuuccgcuccaccaugcccggcugcucaggcuaccccaacaugaacuuagacugccuacucccccaagaauggguccaacacuucuaccaggaagccgcucccgcccaauccgacguagcacuccuacgauucguaaaccccgacaccggcagaguacuuuucgaaugcaaacuacacaaguccggcuauguuaccgucgcccacaccggccaacacgaccucguaauuccacccaauggcuacuuccguuucgacucauggguaaaccaauuuuacacccucgcccccaugggaaacggaaccggccgccgacgagcccuauaa

SEQ ID NO: 37338 - RNA, 1623 nt, Artificial Sequence
  derived and/or modified sequence opt11 from major_capsid_protein__Norovirus__AFU55701
augaaaauggccuccuccgacgccaaccccucagacggaucaaccgccaaccuaguccccgagguaaacaacgaggucauggcccucgaaccagucguaggagcugcaaucgccgcccccguagccggccaacaaaacguaauagaccccuggaucagaaacaacuuuguccaagccccaggaggcgaguucaccgucuccccgcgaaacgccccaggagaaauccucuggucagcaccccuaggccccgaccucaaucccuaccucagccaccucgcccguauguauaacucuuacgccgguggcuucgaaguacaagucauccuagccggcaacgccuuuaccgccggcaaaaucaucuucgccgccguucccccgaacuucccaaccgaaggccuuucacccucccaagucaccauguucccccacaucauugucgacgucaggcaacucgaacccguccuaauaccgcuucccgacguucgcaacaacuucuaccacuauaaccaauccaacgaccccacaauaaaacuaauugcaaugcucuacacgccccuaagagcuaacaacgccggagacgacgucuucaccgucucgugccgaguccucacccggcccuccccagauuucgacuucaucuuucucguacccccaaccgucgaauccagaaccaaacccuucuccguuccaauccuaacagucgaagaaaugacaaacucaagauuccccaucccccucgaaaaacucuucaccggcccuagcucagccuucguagugcaaccccaaaacggccguugcacaaccgacggaguccuccuaggcacaacccaacucucaccaguaaacaucugcacauuucgaggagacgucacccauaucgcaggcacccaagaguacacaaugaaccucgccucacaaaacuggaauaacuacgaccccaccgaggaaauccccgccccacucggcacaccggacuucgucggcaaaauccaaggcguacuuacucaaaccaccagacgcgauggaucuacacgcggacacaaagcaaccgucagcaccggcuccguacacuucaccccaaaacucggacgcauucaauuuucuaccgacacauccaacgacuucgaaaccggccaaaacacacguuucacaccagucggagucguccaagacggcuccaccacacaccaaaacgaaccacaacaauggguccuacccaacuacucaggccgcgacucccauaacguccaccuugcccccgcugucgcccccucguuccccggagaacaacuccuauucuuccgcuccaccaugcccggcugcucaggcuacccaaacaugaaccucgacugccuccuuccccaagaguggguacaacauuucuaccaagaagcagcucccgcccaauccgacgucgcacuccuccgauucguaaaccccgacaccggccgcguacuauucgaaugcaaacuucacaaauccggcuacgucaccgucgcccacacuggccaacacgaccucguaauaccacccaacggauacuuccgauucgacucauggguaaaucaauucuacacacuagcccccaugggcaacggcacaggacgacgucgcgcucuauaa

SEQ ID NO: 37339 - RNA, 1623 nt, Artificial Sequence
  derived and/or modified sequence opt11 from major_capsid_protein__Norovirus__AFU55704
augaagauggccuccaacgaugccaaccccuccgacggcucagccgccaaccuagucccagaaguaaauaacgaagucauggcacucgaaccaguggucggagcggccaucgccgcacccgucgccggccaacaaaacgucaucgaccccuggauucgcaacaacuucguccaagccccaggcggagaguucacaguuucaccccgcaacgcaccaggagaaauccuaugguccgcaccacuaggcccagaccucaaccccuaucucucacacuuggcccgcauguacaacggauacgccgguggcuucgaaguacaagugauacuggccggcaacgcauuuacagcaggcaaaaucauauuugccgcaguacccccgaacuucccaaccgaaggccuuucccccucccaagucacaauguucccccacaucaucguugacguaagacaacuagaacccguccucaucccuuugcccgacguccgaaauaacuucuaccacuacaaccaauccaacgacuccacaauuaaacuaaucgccaugcucuauacaccccuccgcgccaacaacgccggcgaagacgucuucaccgucuccugccgaguacuaacccgcccaucacccgauuucgauuucaucuuccucgucccaccaaccguagaauccagaaccaaaccauucaccguacccauccuaacagucgaagaaaugaccaacucucgcuuccccauuccacuagaaaaacuauucaccggcccaucaagcgccuucgucguacaaccucagaacggccgcugcaccacagacggaguacuacuuggcaccacccaacuaucccccgucaauaucugcaccuuccgcggagacgucacccauauagcugggucccgcaacuacacaaugaacuuagccucccucaauuggaacaacuacgaccccaccgaagaaaucccugcuccccucggaacccccgacuucguugguaaaauccaaggcguccuaacccagaccacaaaaggugacggcuccacccgcggacacaaagccacagucuacaccggcuccgccccguucacccccaaacuaggcucgguccaauucuccacagacaccgaaaacgauuucgaaacccaccaaaacacaaaauucacacccguuggagucauccaagacggcggcaccacccaccgaaacgaaccccaacaaugggucuuacccuccuauuccggacgaaacguccacaacguccaccucgcccccgccguagcccccaccuucccaggcgagcaacuccucuuuuuccgcuccaccaugccggguugcuccggcuacccaaacauggaccucgacugccucuuaccacaagaaugggugcaacacuucuaccaagaagcugcucccgcccaauccgacgucgcccugcuccgcuucgucaauccagacaccggccgaguacuauuugaaugcaaacuucauaaaagcggauacgucaccgucgcccacaccggccagcacgaccucgucauaccacccaacggcuacuuccgcuucgacuccugggucaaccaauuuuacacacucgccccuaugggcaacggaacaggccgcagacgagcucuauaa

SEQ ID NO: 37340 - RNA, 1623 nt, Artificial Sequence
  derived and/or modified sequence opt11 from major_capsid_protein__Norovirus__AFU55707
augaaaauggccuccaacgacgcaaacccuuccgaugguuccgcggcuaacuuaguccccgaaguaaacaacgaagucauggcccucgaaccuguagucggugccgccaucgccgcuccagucgccggccaacaaaacgucaucgacccauggauccgaaacaacuucguccaagcacccggcggcgaauuuacuguaaguccccgaaacgcacccggagaaauccuguggucggccccucucggccccgaucuaaacccauaccuuucacaccucgcaagaauguacaacggcuacgccggcggcuucgaaguacaagucauacucgccggcaaugcauucaccgcaggaaaaaucauauucgccgccgucccacccaacuuccccaccgaaggccucucccccucccaagucaccauguucccccacauaaucgucgacguacgccaacucgaaccaguccuaauaccccuccccgacguacgaaacaacuucuaccacuacaaccaauccaaugacucuaccauuaaacucauagccaugcuuuacaccccacugcgagccaacaacgcaggcgaagacguauuuaccgucuccugccgcguacuuaccagaccuagcccagacuucgacuucaucuuccucguuccaccuacagucgaaucccgcacaaaaccguucaccgucccgaucuuaacaguugaagaaaugaccaacucccgcuuuccaaucccccuagaaaaacucuucaccggccccuccucagcauucgucguccaaccccaaaacggccgcugcacuacugacggaguccucuuaggaacaacccaacuuagccccgucaacaucugcaccuuccgcggggacgucacccacauugccggaagccggaacuacaccaugaaccucgccucccuaaacuggaacaauuacgaccccacagaagaaaucccugcuccacucggcacccccgacuucguaggcaaaauccaaggcguccuaacccaaaccacugaaggcgacggauccacccgcggacacaaggccaccgucuauacaggcucugcccccuucaccccaaaacucggcuccguccaauucuccaccgacacugaaaacgacuucgaaacccaccaaaacaccaaauucaccccagucggcgucauccaagacggauccacuacccaccgaaacgaaccccagcaauggguucuuccauccuacuccggacgcaacguucacaacguccaccucgcccccgcugucgcaccgaccuuccccggcgaacaacuacuauucuucagauccaccaugcccggaugcucaggcuacccaaacauggaccucgacugccuucuaccccaagaauggguucaacacuucuaccaagaagcggcccccgcccaauccgacgucgcccuacuccgcuucguaaacccagacaccggccgcguccucuucgaaugcaaacuacacaaaagcggauacgucacugucgcccacacuggccagcacgaccucgucaucccacccaacggcuacuuccguuucgacuccugggucaaccaauucuacacccuagcccccaugggcaacggcacuggccgccgccgagcccucuaa

SEQ ID NO: 37341 - RNA, 1623 nt, Artificial Sequence
  derived and/or modified sequence opt11 from major_capsid_protein__Norovirus__AFU55710
augaaaauggcuuccaaugacgcuaacccauccgacggaucugccgcuaaccuuguccccgaaguuaacaaugaagucauggcacucgaacccgucgucggcgccgccauagccgcaccagucgccggacaacaaaacgucaucgaccccuggauccgcaacaacuucguacaagcccccggcggcgaguucaccgucuccccacgaaacgccccuggagaaauacucuggucagccccacucggacccgaccucaacccuuacuuaucacaccucgcccgaauguacaacggcuacgccggcggauucgaaguccaggucauccuggccggaaacgccuucacagcgggcaagauuaucuucgcagccgucccacccaauuucccaaccgaaggacuaucccccucccagguuaccauguucccacacauaauaguagacguacgccaacucgaaccaguacuuaucccacuacccgacguccguaacaacuucuaccacuacaaccaaucuaacgacuccacaaucaaacucaucgccaugcucuauacaccccuuagagcaaacaacgccggagacgacgucuucaccgucagcugccgaguccucacccgaccaagccccgauuucgacuucaucuuccucgucccuccgaccgucgaaucccgcaccaagcccuucaccgucccuauccuaaccgucgaagaaaugacuaacucgcgcuucccaauuccccuagaaaaacuuuucacaggccccucaucagccuucguuguccagccucaaaacggccgcugcaccacggacggaguccuccucggcaccacccaacuauccccagucaacaucuguaccuuccgcggagaugucacucacaucgccggaucccguaacuacaccaugaaccuagccucccucaacuggaacaacuacgaccccaccgaagagauccccgcaccacucggcacccccgacuucguaggcaaaauccaaggcguccuaacccagaccacaaaaggcgacggcagcacacgcggccacaaagcgacagucuauacaggauccgccgacuuuaccccaaaauuaggcuccguucaauucgcaaccgacacagaaaacgacuucgaaacccaccaaaacacaaaauuuacccccguaggcguaauacaagacggcuccaccacccaccgcaacgaaccccaacaauggguccuacccuccuacuccggacgaaacguccacaacguccaccucgcccccgccguagcacccaacuuccccggcgaacaacuccucuucuuccgcuccaccaugccaggcugcucaggcuaucccaacauggaccucgacugccuccuuccccaagaauggguccaacauuucuaccaagaagcagcacccgcccaauccgacguagcucuccuccgauucguaaaccccgauacaggacguguccuuuucgaaugcaagcuccacaagucaggcuacgucaccgucgcccacaccggccaacacgaucuugucaucccacccaacggcuacuuccgcuucgacuccuggguaaaccaauucuacacacuagcccccaugggcaacggaaccggacgccgcagagcacuauag

SEQ ID NO: 37342 - RNA, 1623 nt, Artificial Sequence
  derived and/or modified sequence opt11 from major_capsid_protein__Norovirus__AFU55713
augaaaauggcauccaacgacgccacacccuccgacggaucuaccgcaaaccucguccccgaagucaauaaugaagucauggcucucgaacccgucguaggagccgccaucgccgcgccuguggcaggccaacagaacgucauagaccccuggauccgcaacaacuucguacaagcccccggcggcgaguucaccguaagcccgcgaaacgcccccggcgaaauccucugguccgcuccacucggacccgaccucaacccauaccucagccaccucgcacguauguauaacggauaugccggcggcuucgaaguccaaguaauccuagccggcaacgcauucacagcaggcaaaauaauauucgccgccgucccaccaaacuucccaaccgaaggccuaucucccucccaagucacuauguucccccacaucauagucgacguccgacagcucgaacccguacucauaccgcuuccagacguacgaaacaacuucuaccacuacaaccaaagcaacgacccuaccauuaaauuaauugccaugcucuacacaccccuccgagccaacaacgccggcgacgacguauucaccgucucaugccguguccuaacccgaccaagcccagacuucgacuucauauuccuagucccacccaccgucgaaucccgaaccaaacccuucucaguacccauccucaccgucgaagaaaugaccaacucccgauucccaauacccuuagaaaaacucuucacaggcccuucaagcgcauucgucguccaaccccaaaacgguagaugcaccaccgacggaguccucuuaggaacaacccaacucucgcccgucaacaucugcacuuuccgcggagacgucacccacaucaccggaagccgcaacuacacaaugaaccucgccacccaaaacuggaacuccuacgaccccaccgaagagauacccgcuccccucggcaccccagacuucgucggcaaaauccaaggcgucuugacucaaacaacccgcgccgacggaucgacucgcggccacaaagccaccgucuacaccggcucugcggacuucgcacccaaacucggccgcguacaauucgcgaccgacacagacaacgauuucgacgccaaccaaaacaccaaauucacacccguuggcguaauccaagacggcgauaccgcccaccgcaacgaaccccaacaauggguacuaccaucauacuccggccgcaacucacacaacguccaccucgcaccagccgucgccccuaccuucccaggugaacaacuccucuucuucagaucaacuaugcccggaugcucaggcuacccuaacauggaccuagacugccuacucccccaagaauggguccaauacuuuuaccaagaagccgcaccggcucaaucugacguagcccuccuccgauucgucaacccagacaccggacgcguucucuucgaaugcaaacuccacaaaucaggcuacgucaccgucgcccacacaggccaacacgaccuagucauuccucccaacggauacuuccgcuucgacucauggguaaaccaauucuacacccucgcucccaugggcaacggcacaggaagacgccgcgcccuauaa

SEQ ID NO: 37343 - RNA, 1623 nt, Artificial Sequence
  derived and/or modified sequence opt11 from major_capsid_protein__Norovirus__AFU55716
augaaaauggccagcaacgaugccaacccauccgacggcagcgccgccaaccucguucccgaaguaaacaaugaggucauggcccuugaaccaguuguaggcgccgcaaucgccgccccagucgccggccaacaaaacguaauagaccccuggauacgcaacaacuucguacaagcaccaggcggcgaguucaccgucuccccacgaaacgccccaggcgaaauccucugguccgccccacucggccccgaccuaaaccccuaccucucacaccucgccagaauguacaacggauacgcgggagguuucgaaguacaagucauccuagccggcaacgccuucaccgcaggcaaaauaauauucgcagccguacccccaaacuucccuaccgaaggccuuucccccucccaagucaccauguucccccauaucaucgucgacgucagacaacuagagccaguccucaucccccuccccgacguacgcaacaacuucuaccacuacaaccaaagcaacgacuccacaaucaaacuaaucgcaaugcucuacacuccccuacgcgcuaacaacgccggcgaagacguauucaccguaagcugccgcguccuuaccagacccucacccgauuucgacuuuaucuuccucguacccccaaccgucgaauccagaaccaaaccauucacagucccuauccucacagucgaagaaaugaccaacucacgcuuucccauuccccuagaaaaacucuucaccgggccuucuuccgcauuugucguccaaccccaaaacggccgaugcaccacugacgguguucuucucggcaccacccaacucagccccgucaacaucugcaccuuccgaggcgacgucacccacauagcuggaucccgcaacuacaccaugaaccuagccagccuaaacuggaacaacuacgacccuacagaagaaauccccgcaccccucggcacccccgacuucgucggaaaaauacagggcguacucacccaaaccaccaaaggcgacggaucaacccgcggccacaaagccaccguauacaccggcagcgccccauucacacccaaacucggcucuguccaauuuuccaccgacaccgaaaacgacuucgagacccaccagaacaccaaauucacccccgucggaguuauccaagacggaggaacaacccaccgcaacgaaccacaacaauggguacucccuucuuacuccggacgcaacguacagaacguccaccuagcuccggcugucgcccccaccuucccaggcgaacaacuacucuucuuucgcuccaccaugccaggaugcuccggauaccccaacauggaccucgacugccuccucccccaagaauggguccaacauuucuaccaagaagcagcccccgcccaauccgacguagcccuccucagauucgucaaccccgacaccggcaggguccuauuugaaugcaaacuucacaaaucaggcuauguaaccgucgcacacacaggacaacaugaccuaauaauacccccaaauggauacuuccgauucgacuccugggucaaccaauucuacacccuagcacccaugggcaauggaacaggccgccgacgagcccuauaa

SEQ ID NO: 37344 - RNA, 1623 nt, Artificial Sequence
  derived and/or modified sequence opt11 from major_capsid_protein__Norovirus__AFU55719
augaaaauggccuccaaugacgcuaaccccucagacggcuccgccgcuaaccucguccccgaaguuaacaacgaagucauggcccuagaaccagucgucggugccgcgauugcagccccagucgccggccaacaaaaugucauugaccccuggaucagaaauaacuucguccaagccccaggcggcgaguucaccgucucaccccgcaacgcccccggcgaaauacuaugguccgcuccccucggucccgaccugaauccauaucucucccaccucgcccgcauguauaaugguuacgcaggcggcuucgaaguccaagucauccuagccggcaacgcuuucacugccggcaaaaucauauucgcagccgucccucccaacuuccccacagaaggccuauccccaucacaagucacaauguucccacauauuauagucgauguccgccaacuugaaccaguccuaauaccacuccccgacgugcgcaauaacuucuaccacuacaaccaaucaaacgacucuaccaucaaacuaauagccaugcuauacacaccacuccgcgcgaacaacgccggcgacgacgucuucacuguauccugucgcguacucacccgcccaucacccgauuucgacuucaucuuccucgucccacccacaguugaaucccgcaccaaacccuucaccgucccuauccucaccgucgaagaaaugaccaacucccgauuccccaucccccucgaaaaacuuuucacgggcccaucaagcgcauucgucguacaaccccagaacggccgcugcacaacggacgguguccuacucgguaccacccaacucucacccguaaacauaugcaccuuccgcggagacgucacacacaucgccggaucccgaaacuacaccaugaaccucgccucccuaaacuggaacaacuacgacccuaccgaagaaauaccagcuccccucggaacacccgacuucguuggcaaaauccaaggcguccuaacacaaaccacaaaaggagacggcuccacacgcggccacaaagcaacagucuacaccggcuccgccgacuucaccccaaaacuuggcuccguccaauucggaacagacaccgaaaacgacuucgaaacccaccaaaauacaaaauucacccccgucggcgucauacaagacggcucaaccacacaccgaaaugaaccccaacaauggguccuaccguccuacucaggccggaacguccacaacguccaccucgcccccgccgucgcccccaacuuccccggcgaacaacuccucuucuuccgcuccaccaugccaggcugcuccggcuaccccaacauggaccuagacugccuacuaccacaagaauggguacaacacuucuaucaagaagcagcucccgcccaaucugacgucgcccuucuucgauucgucaaccccgacaccggacgaguccucuucgaaugcaaacuccacaaauccggauacgugaccguagcacacacaggccaacacgaccucguuaucccuccaaacggcuacuuccgauucgacuccugggugaaccaauucuauacccucgcacccaugggcaacggaacgggccgccgacgagcacuuuaa

SEQ ID NO: 37345 - RNA, 1623 nt, Artificial Sequence
  derived and/or modified sequence opt11 from major_capsid_protein__Norovirus__AFU55722
augaagauggccucauccgacgccaacccauccgaugguuccacagccaaucucguccccgaagucaacaaugaagucauggcacucgaacccguaguuggagccgcaauagccgcacccguagccggccagcaaaaugucaucgaucccuggauccgcaacaacuuugugcaagccccaggcggcgaguucaccgucucaccccguaacgcccccggcgaaauccucugguccgcccccuuaggacccgaccuaaaucccuaccucucacaccucgcccgcauguauaacggcuacgcaggagguuucgaaguccaaguaauauuagccggaaacgccuucacagcaggcaaaauaauauucgccgccguacccccaaacuuccccacagaaggccucucccccucgcaagucaccauguuuccucacauaaucguagacguccgacaacucgaacccguacucaucccccucccagacgugcguaacaacuucuaccacuacaaccaauccaacgacuccacuauuaaacucaucgcaaugcucuacacuccacuccgcgcaaacaacgcaggcgaugacgucuucaccgucuccugccgcguccucacccgucccucccccgacuucgacuucaucuuccucguacccccuacagucgaaucacgcacuaaacccuucuccguccccguccuuacagucgaagaaaugaccaauucgagauuucccaucccucucgaaaaacuauucaccggcccauccuccgcauucguaguccaaccacaaaacggucgauguaccaccgacggcguccuacuaggcacaacccaacuaucccccguaaacaucugcaccuuccggggcgaugucacccacauacccggcucccgcaacuacacaaugaaccucgcaucccaaaauuggaacuccuacgaccccaccgaagaaauccccgcuccccucggcacccccgacuucgucggcaaaauacaaggaguacucacacaaaccacacgaaccaauggaagcacccgaggacacaaagccaccguauacaccggguccgccgacuucucccccaaacucggccgcguccaauucgcaaccgacaccgacaaugacuucgaaaccaaccaaaacacaaaauucacacccgucggcgucauccaagacggauccacuacaccccgaaacgaaccccaacaauggguccuccccagcuacuccggccgcaacauccacaacguccaccucgcacccgccgucgcccccaccuuccccggcgaacaacucuuauucuucagaucaaccaugcccggaugcucaggcuacccaaauauggaucucgacugccuccucccccaagaauggguccaauauuucuaccaagaagccgcacccgcccaaucugacgucgcucuccuccgauucgucaaccccgacaccggaagaguccuauucgaaugcaagcuccacaaauccggcuacguaacaguugcccacaccggccaacacgaccucguaaucccacccaacggcuacuuccgcuucgauucuuggguaaaccaauucuacacccuugcccccaugggcaacggcacaggacgccgccgagcccucuaa

SEQ ID NO: 37346 - RNA, 1623 nt, Artificial Sequence
  derived and/or modified sequence opt11 from major_capsid_protein__Norovirus__AFU55725
augaaaauggccuccuccgacgccaaccccuccgacggcuccaccgcuaaccucguccccgaagucaauaacgaagucauggcccuagaaccaguaguaggcgccgccaucgccgcucccguagccggacaacaaaauguaaucgacccauggauucguaacaacuuuguccaagcaccaggcggagaguucacagucucuccaagaaacgcacccggcgaaauacucuggucagccccucuaggccccgacuuaaaccccuaccucucccaccucgcccgcauguauaacggcuacgccggcgguuucgaaguccaaguaauccucgcagguaacgccuucacugccggaaaaaucaucuuuuccgcagucccaccaaauuuuccaaccgaaggccucagccccucacaaguaaccauguucccucacauuaucgucgacguccgccaacuagaacccguccucaucccccugcccgacguacgcaacaacuucuaucacuacaaccaaucaaacgaccccaccauaaaacuaauagcuaugcuauacacaccacuccgcgcaaacaacgccggugacgacgucuucaccgucucaugccgcguacuaacccgacccucucccgacuuugacuucaucuuccuaguacccccaacagucgaauccagaaccaaacccuucuccguaccaauccuuacagucgaagagaugaccaauucucgcuuccccauuccccucgagaaacucuucaccggccccucuuccacauucgucguccaaccccaaaacggcagaugcaccacagacggaguccuccuaggaaccacccaacuauccccugucaacauuugcaccuuccgcggugacguaacucacauaacuggaucccgcaacuacaccaugaaccucgccucccaaaacuggaacuccuacgaccccaccgaagaaauccccgcaccccuuggcaccccagacuucguaggcaaaauccagggaguccuaacucagacaacccgaaccgacggcuccacacguggacacaaagcaacaguuuacaccggcucugcagaauuuucacccaaacucggccgaguacaauucgcuaccgacacagacaacgacuucgacgccaaccaaaacacaaaguuuaccccaguaggcguaauccaagacggcggaaccacccaccguaacgaaccccaacaauggguucuaccuuccuacuccggccgcaacacccacaacguucaccuugccccugcagucgcaccaaccuuccccggcgaacaacuacucuucuuccgcuccaccaugccaggcugcuccggcuacccaaauauggaccucgacugccuacuaccacaagaauggguccaacacuucuaccaagaagcagcuccagcccaaagcgacgucgcccuucuacgauucguaaaccccgacacgggucgaguccucuucgaaugcaaacuccacaaaucgggcuacguaaccgucgcacacacuggacaacacgaccuagucauaccacccaacggcuacuuccgcuucgacuccugggucaaccaauucuacacacuagcccccaugggcaacggcaccggccgccgacgcgcucucuga

SEQ ID NO: 37347 - RNA, 1623 nt, Artificial Sequence
  derived and/or modified sequence opt11 from major_capsid_protein__Norovirus__AFU55728
augaaaauggccuccuccgacgccaacccuagcgacgguuccaccgcuaaccuuguucccgaagucaacaacgaaguaauggcacucgaacccguugucggcgccgccaucgccgcccccgucgcaggccaacaaaacgucauagaccccuggauacgcaacaacuucguccaagcccccggcggcgaguucacagucucaccccgaaacgcccccggcgaaauccucugguccgcacccuuaggccccgaccuaaacccuuaccucucccaccucgcacgcauguacaacgguuacgccgguggcuucgaaguccaaguuauccucgcuggcaacgccuucaccgccggaaaaaucaucuucgcagccgucccacccaacuucccaaccgaagggcuauccccaucccaagucaccauguucccccacaucaucgucgacguucgacaacucgaaccaguucucauuccuuuaccagacguucgcaacaacuucuaccacuacaaccaauccaacgacccaaccauuaagcucaucgcaaugcuauauacgccacuaagagcaaacaaugcaggcgacgacgucuucacagucuccugccgaguacucacccggcccucucccgacuucgacuucauauuucucguaccaccaaccguugaaucacgcaccaaacccuucucaguaccaguccuaacaguggaagaaaugaccaacucccgcuucccaaucccccucgaaaaacuauucaccggcccuuccucagccuuugucguacaaccccagaacggccgcugcacaaccgacggcguccuucuagguaccacacaacuuucucccgucaacauaugcaccuuccgcggugacgucacccacauccccggcucacacaauuacaccaugaaccucgccagccagaacuggaacucauacgaucccaccgaagaaauccccgcuccccuagggacuccagacuuugucggcaaaauacaaggcguccucacccaaaccacccgaacuaacggcuccacccgaggacacaaagcaaccgucuacacuggaucagccgacuucucccccaaacucggccgcguccaguucgcaacggacacgaauaacgacuucgaaaccaaucaaaacaccaaauucacccccguaggagucauccaagauggcuccaccacuccccgcaacgaaccucaacaauggguucucccuucauacuccggucgcaacacccacaacguacaccucgcccccgccguagcacccaccuuccccggcgaacaacuucuuuucuuccgcuccacaaugcccggaugcuccggauaucccaacauggaccucgacugucuacucccacaagaauggguccaauacuucuaccaagaagccgccccagcccaaucagacguagcccuacuacgauucgucaacccugacaccggacgcguccuguucgaaugcaaacuacacaaauccggauacgucaccgucgcccacacuggccaacacgaucuaguaaucccucccaacggcuacuuucgauucgacucgugggucaaccaguucuacacucucgcacccaugggaaauggaacaggccgccgucgagcccuauaa

SEQ ID NO: 37348 - RNA, 1623 nt, Artificial Sequence
  derived and/or modified sequence opt11 from major_capsid_protein__Norovirus__AFU55731
augaaaauggccucuagcgacgcaaaucccuccgauggcucuacugccaaccucguccccgaagucaacaaugaaguaauggcccuugaacccgucgucggugcugcaaucgcagccccagucgccggccaacaaaacgucaucgaccccuggauacggaauaacuucguccaagcaccaggcggcgaauuuacaguuucaccacgcaacgcacccggcgagauccuauggagcgcaccacuaggaccagaccucaaccccuaccucucccaccucgcacgcauguacaacggcuacgccggcggcuucgaaguccaaguuauucucgccggcaacgcauucaccgcaggcaaaauuauauucgcagcagucccucccaauuuucccaccgaaggacucucccccucacaagucaccauguucccccacauaaucgucgacguucgccaacuugaaccuguucucauaccccucccagacguucgcaacaacuucuaccacuacaaccaaagcaaugacccaaccauuaaacucaucgccaugcucuacacaccccuccgagccaacaacgcaggcgacgacgucuucacagucucaugccgaguccucacacgccccucacccgauuucgacuucauauuccuaguaccaccaaccgucgaaucucggaccaaacccuucucuguucccguacucaccgucgaagaaaugacaaacucacgauucccaaucccacucgaaaaauuauucaccggacccucuucagccuucgucguacaaccccaaaacggacgaugcaccaccgacggaguccuccucggcacaacacaacuuucccccguaaacaucugcaccuuccgaggcgacgucacacacauccccggcucacacaacuacaccaugaaucuugcaucccaaaacuggaacagcuacgaccccaccgaagagguucccgcaccccuaggcacccccgacuucgucggaaaaauccaaggcguacucacccaaaccacacgcaccaacggcagcacccgcggucacaaagccaccguuuauacaggcucagcugacuucuccccaaaauuaggccguguccaauuugccacagacaccaacaacgacuuugaaacaaaccagaacaccaaauucacccccguaggcgucauccaagacggcuccaccacaccccgaaacgaaccacaacaauggguccuaccuucguacucaggccgaaacacccacaacguccaccucgccccugccgucgcccccacguucccaggcgaacaacuacucuucuuucgcuccaccaugccaggcugcucaggcuaccccaacauggaccuagacugccuccuuccucaggaauggguccaauacuucuaccaagaagcagccccugcccaauccgacguagcucuccuccgcuucgucaacccagacacuggacgcguauuauucgaauguaaauuacacaaaucaggcuacgucacagucgcacacaccggccaacacgaccucgucauaccacccaacggcuacuuucgcuucgacagcugggucaaccaauucuacacccuugcccccaugggcaacggcaccggacgccgccgagcccucuaa

SEQ ID NO: 37349 - RNA, 1623 nt, Artificial Sequence
  derived and/or modified sequence opt11 from major_capsid_protein__Norovirus__AFU55734
augaaaauggccuccucagacgcaaaccccucagacggcucaacagcaaaccucguccccgaaguuaacaacgaaguaauggcccuagaacccgucgucggagccgcgaucgccgcccccguagcaggacaacaaaacguaaucgaccccuggauccgaaacaacuucguucaagcacccggcggcgaauuuaccgugagcccccgcaaugcccccggcgaaauauuauggucugcaccccucggacccgaccucaacccauaccucucucaccuagcccgcauguacaacggcuacgccggaggauucgaaguucaaguaauccucgccggcaacgccuucaccgccggcaaaaucaucuucgcagccgucccacccaacuuccccaccgaaggacuaucccccucccaaguuacaauguucccccacaucaucgucgacguacgccaacuagaaccaguccuuaucccacuccccgacguccgaaacaacuucuaccacuacaaccaaagcaacgauccaaccaucaaacuaauagcaaugcucuacacaccccuccgggccaacaacgccggagacgacgucuucaccgucucaugccgcguccuaacacgcccuuccccugacuucgacuucaucuuccucguaccacccaccguagaaucccgcaccaaacccuucucgguccccguccucacugucgaagaaaugacaaacucccgcuuccccauaccccucgaaaaacuuuucaccggacccucaucagccuucguaguacaaccccagaauggacgcugcaccacagauggcguacuccucggcacaacacagcucucacccgucaacauaugcacauuccgcggcgacgucacccacauccccggcucccgcaacuacacuaugaaccuagccucacaaaacuggaacaguuacgaccccaccgaagaaauccccgcuccccuuggaacuccagacuucgucggcaaaauccaaggcguacucacccaaaccacacgcacaaacggcucuacucgcggccacaaagccaccgucuacacaggauccgccgacuucucccccaaacuaggacgcguacaguucgccaccgacaccgauaacgacuucgaaaccaaccaaaacaccaaauucacucccguaggcgucauacaggacggcuccacaacaccucgaaacgaaccucaacaauggguccuccccagcuauuccggacgcaacauccacaacguccaccucgcacccgccgucgcaccaaccuucccaggcgaacaacuucucuucuuucgcuccaccaugcccgguugcuccggauaccccaacauggaucucgacugcuuacuuccccaagaauggguccaguauuucuaccaagaagccgcacccgcacaauccgacgucgcacuccuaagauucguaaaccccgacacaggccgaguccucuucgaaugcaaacuacacaaaagcggcuacgucaccgucgcccacacaggccaacacgaccucgugaucccucccaauggauacuuccgcuucgacagcuggguaaaccaauucuacacccuagcccccaugggcaacgguacuggacgaagacgagcccuuuaa

SEQ ID NO: 37350 - RNA, 1623 nt, Artificial Sequence
  derived and/or modified sequence opt11 from major_capsid_protein__Norovirus__AFU55737
augaaaauggccucauccgacgccaauccaucugacggcucaaccgcaaaccucguacccgaaguuaacaacgaagucauggcacuagaacccguuguaggcgccgcuaucgcagccccuguagccggacaacaaaacgucaucgaccccuggauaagaaacaacuucguccaagcccccggcggcgaauuuaccguaagcccccgaaaugcaccuggagaaauacuaugguccgcaccccuaggccccgaccucaaccccuaccucucgcaccucgcccgcauguacaacggcuacgcaggcggauucgaaguccaagucauacuggcaggcaacgccuucaccgcuggaaaaaucauauucgccgccguaccaccaaauuuccccaccgaaggucucuccccaucgcaagucacaauguucccacacaucaucguagacguccgccaacucgaacccguccuuaucccacuccccgauguccgcaacaacuucuaccacuacaaccaauccaaugaccccaccaucaaauuaaucgccaugcuguauacuccccuccgagccaacaaugcaggagacgacgucuucaccgucucaugccgcguccuaacccgccccuccccugacuucgacuucaucuucuuagucccaccaaccguugaaucccgcaccaaaccauucucagucccaguccucacuguggaagaaaugacgaacuccagauuuccaauuccacucgaaaaacucuucaccggaccaucauccgccuucgucguccaaccacaaaauggaagaugcaccaccgauggcguccuccucggaaccacucaacuaucacccgucaacaucugcaccuucagaggagacgucacacacauccccggcucccgaaacuacaccaugaaccucgccucccaaaacuggaacuccuacgacccaaccgaagaaauccccgccccacuaggcacccccgacuucgucggcaaaauccaaggaguacucacccaaacaacacgcaccaacggcuccacucgcggccacaaagccaccgucuacacuggauccgccgacuucucccccaaacucggacguguccaauucgccacagacacagacaacgacuucgaaaccaaccaaaauaccaaguucacccccgucggagucauccaagacggaucaacuaccccacgcaacgaaccacaacaguggguucuccccuccuacaguggacgaaacauacauaauguccaccucgcccccgcaguugcucccacauucccaggcgaacaacuccuuuucuuccgcuccacuaugcccggcugcuccggcuaccccaacauggaucucgacugccuccucccccaagaauggguucaauacuucuaccaagaagcagcaccagcccaaucagacgucgcccuccuccgcuucguuaaccccgauaccggccgcguccucuucgaaugcaaacuccacaaauccggauacgucacaguagcccacacaggucaacaugaccucgucaucccucccaacggauacuuccgcuucgacuccugggucaaccaauucuacacacucgcccccaugggcaacgguaccggucgccgucgcgcacucuaa

SEQ ID NO: 37351 - RNA, 1623 nt, Artificial Sequence
  derived and/or modified sequence opt11 from major_capsid_protein__Norovirus__AFU92659
augaaaauggcaucuaacgacgcaaccccuucagauggcuccaccgccaaccuuguccccgaagucaacaaugaaguaauggcccucgaacccgucguaggcgccgccauagcggcccccgucgccggccaacaaaacguuaucgacccauggauccgcaacaacuucguccaagcaccaggaggcgaguucacagucucaccacgcaacgcccccggcgaaauccuaugguccgcaccccuaggucccgaccucaacccauaccucucccaccuagcccgcauguauaacggcuacgccggcgguuucgaagugcaagucauccucgcaggcaacgcauucaccgccggcaaaauuaucuucgccgccguaccacccaacuuccccaccgaaggacucucccccucacaagucacaauguucccacacauaaucguagacguccggcaacuggaaccgguacuaaucccccuccccgacguccgcaacaacuucuaccacuacaaccaauccaacgacuccaccaucaaacucaucccaaugcucuacaccccacuccgugcuaacaacgcaggcgacgacgucuucaccguuucaugccgcguccucacucgccccuccccagauuuugacuucauuuuucugguaccucccacuguagaauccagaaccaagcccuucucagucccaauccucaccgucgaagaaaugaccaacucacgcuucccaauaccccucgaaaaacuguucacuggcccaucauccgccuucgucguccaaccccaaaacggccgcugcaccacugacggcguacuccucggcaccacccaacuaagcccagucaacaucugcaccuuccgcggugaugucacccacaucgccgguacccaauccuacacaaugaaccuugcaucacaaaacuggaauaacuacgacccaaccgaagagauaccugcaccccuaggcacccccgacuucgucggcaaaauccaaggcguauuaacacagaccacacgcggagacgguuccacacgaggucacaaggccaccgucuccaccggcuccguccacuuuacaccuaaacucggcuccguacaguucucaaccgacacaucuaacgacuucgagaccggccaaaacacucgcuucacacccgucggagucguccaagacgguuccacuacccaccaaaacgaaccccaacaauggguacucccaaacuacuccggccgcgacucccacaacguacaucucgcccccgccguagcccccaccuuucccggugaacagcuccucuucuuccgguccaccaugccaggcugcucaggauacccaaacaugaaccucgacugccuccuuccccaagaauggguccaacacuucuaccaagaauccgcccccgcccaaucagacgucgcacuacucagauucgucaaccccgacaccggacgaguccucuucgaauguaaacuccacaaauccggauacgucaccgucgcccacacuggccagcacgaccuagucaucccacccaacgguuacuuccgcuuugacucaugggucaaccaauucuacacgcucgcucccaugggcaacggcgccggccgacgccgagcccucuga

SEQ ID NO: 37352 - RNA, 1623 nt, Artificial Sequence
  derived and/or modified sequence opt11 from major_capsid_protein__Norovirus__AFU92660
augaaaauggccuccaacgaugcccacccaucagacggcucaacagccaaccucguacccgaagucaacaacgaaguaauggcucucgaacccgucgucggcgcagcaaucgccgcacccgucgccggccaacaaaacguaauagacccauggauccgaaauaacuuuguccaagccccaggcggagaguucacaguaucaccccgcaacgccccaggcgaaauacucuggucugccccacuuggccccgaccucaaccccuaccucucucaucuggcaagaauguacaacggcuacgccggcggcuucgaaguacaaaccauccucgccggcaacgcauucaccgccggcaaaaucauauucgccgccgucccacccaacuucccaaccgaagggcuauccccuucccaagucaccauguucccacacauaaucgucgauguccgacaacucgaacccguucuuaucccccuccccgacguccgcaauaacuucuaccacuauaaccagagcaacgaccccaccaucaaauuaaucgccaugcucuacacaccccuacgcgcaaacaacgccggcgacgacgucuucaccgucagcugccgcguccucacacgccccucaccagacuucgacuucaucuuccucguacccccuacagucgaaucgcgcaccaaaccauucaccguaccaauacuaaccguagaagaaaugaccaacucucgauucccaaucccccucgaaaaacuauucaccggccccucauccgccuucgucguucaaccgcaaaacggccgcugcaccaccgacggcguccuccuuggcacaacacaacuauccccagucaauauaugcaccuuccgcggcgacguuacccacaucgccgguacacacaacuacaccaugaaccucgcuucccaaaacuggaacaacuacgaucccacagaagaaauccccgcuccccucggcaccccugacuucgucggacgcauccaaggaaugcuaacccagaccacccgaggcgacgguagcacacgcggccauaaagccacaguauccaccggcgacguccacuucacccccaaacuaggcuccauccaauucaauaccgacaccaacaaugacuucgaaaccggacaaaacaccaaguucacaccagucggcgucguccaagacgggaacggaacgcaccaaaacgaaccccaacaauggguacuccccagcuacagcggccguaccggccacaacguucaccucgcccccgccgucgcccccacauuucccggcgaacaacuauuauucuuccgcuccacuaugccaggcugcucaggcuacccuaacaugaaccucgauugccuacuuccccaagaguggguacaacacuucuaccaggaggcagcaccagcucaaagcgacgucgcccuccuccgauucgucaacccugacacaggccgcguccuauucgaaugcaaacuccacaaauccggcuacgucaccgucgcccacaccggacaacacgaccucguaauuccaccaaacggcuacuuccgauucgacucaugggucaaccaauucuacacccucgccccaaugggaaacggcacaggacgccggcgcgcccuauga

SEQ ID NO: 37353 - RNA, 1623 nt, Artificial Sequence
  derived and/or modified sequence opt11 from major_capsid_protein__Norovirus__AFU92661
augaagauggcauccaacgacgcaacacccuccgacggaucaacagccaaccugguccccgaaguuaacaacgaaguaauggcacucgaaccuguagucggcgccgccaucgcagcccccguagccggucaacaaaacgucaucgaccccuggauccgcaacaacuucguccaagccccaggcggcgaguucacaguuucaccccgaaacgccccaggcgaaauccuaugccacgcaccccuaggacccgaccucaaccccuaccuaucucaccucgcccgcauguauaacggauacgccggaggcuucgaaguccaagucauccuagccggcaaugccuucaccgcagguaaaaucaucuucgccgcagucccacccaacuuccccaccgaaggacucucgccuagccaagucaccauguucccccacaucaucguagacguccgucaacucgaacccguccucaucccccuccccgacguccgcaacaacuucuaccacuacaaccaauccaacgacccaaccaucaaacucaucgcaaugcucuacacaccccuccgcgcgaacaacgcuggcgacgacgucuucaccguauccugccgcguacucacccgccccagccccgacuucgacuucaucuuucuagucccacccacugucgaaucacgcaccaaacccuuuuccguccccauuuuaacagucgaagaaaugacaaacucccgauuucccaucccccucgaaaaacucuucaccgguccaucuagcgccuucguaguacaaccccaaaacggucgcuguacaacagacggcguccuccucggaacaacccaacuuucccccgucaauauaugcacuuuccgcggggacguaacacacauagccggcacccaaaauuacaccaugaaucuagcaucccaaaacuggaacaacuacgacccaacagaagaaaucccagccccucugggcacucccgacuucgucggacgcauccaaggaguccucacacaaaccacccgccgugauggauccacacgaggccacaaagccacccucucaacaggauccguccauuucacaccgaaacuaggcucaguccaauucuccaccgacaccucuaaugacuucgaaaccggccaaaacacaagauuuaccccaguaggcguuguccaagauggcuccacaacccaccaaaacgagccccaacaauggguacuccccaauuacucaggacgcgacagccacaacguacaucuugccccagccgucgcccccaccuucccuggcgaacaacuacucuucuuccgaagcaccaugcccggaugcuccggcuacccaaacaugaaccucgacugccuccuaccacaagaauggguccaacacuucuaccaagaauccgcccccgcccaauccgauguugcccuccucagauucguaaaccccgacacaggcagaguucuuuucgaauguaaacuccacaaaucuggcuacgucaccguagcccacaccggccaacacgaccuaguuaucccacccaauggcuacuuccgcuucgacuccuggguaaaccaauucuacacacuagcccccaugggcaacggcgccggacggcgccgagcccucuga

SEQ ID NO: 37354 - RNA, 1623 nt, Artificial Sequence
  derived and/or modified sequence opt11 from major_capsid_protein__Norovirus__AFU92662
augaaaauggccuccaacgacgccacccccucagacggauccacugcuaaccuagucccagaagucaacaacgaagucauggcccuagaaccagucguuggugcagccauagccgcccccguagccggccaacaaaacgucaucgaccccuggauacgcaacaacuucguccaggccccaggcggugaguucaccguauccccacgaaacgcccccggagaaauccuauggcacgcaccccuaggacccgaccuaaaucccuaccucucacaccuugcucgcauguacaacgguuacgccggcggcuucgaaguccaaguuaucuuagccggcaacgcauucaccgcaggcaaaauaaucuucgcagccguaccacccaacuucccaaccgaaggucuaucccccucccaggucaccauguucccccauauaauagucgacguacgccaacucgaaccuguccucaucccccuccccgacgucaggaacaacuucuaccacuacaaccaauccaaugaccccacaaucaaacucauugccaugcuauacaccccacuccgagccaacaaugccggcgacgacgucuuuacaguuucuugucgagucuuaaccagacccucccccgacuucgacuucauauuccucguaccacccacaguugaauccagaacaaaacccuucuccguccccauccucacuguagaagaaaugaccaacucccguuuucccaucccccuagaaaaacucuucaccggccccucuucggcauucguaguccaaccacaaaacggccgcuguaccaccgacgguguacuccucggcaccacccaacucucgccugucaacauaugcaccuucagaggagacguaacacacaucgcaggcacccaaaacuacaccaugaaucucgccucccaaaacuggaauaacuacgacccaaccgaagaaauaccagccccucuaggcacaccugacuuugucggcaagauccaaggcguccuaacccagaccacccgacgcgacggcuccacacguggacacaaagccaccgucuccaccggcucuauccacuucacccccaaacucggcuccguccaauuuuccacugacaccucaaacgacuucgaaaccggccaaaacacucgauucacacccgucggagucguccaagauggcucaaccacccaccaaaacgaaccccaacaauggguccucccuaacuacucaggccgcgacucacacaacguacaccuagcacccgccgucgcccccacauuccccggcgaacaacuccucuucuucagauccaccaugccgggcugcuccggauaccccaacaugaaucucgacugccuucuaccccaagaauggguacaacacuucuaccaagaauccgccccagcccaauccgacgucgccuuacugagauucguuaaccccgacacuggccgcguccucuucgaaugcaaacuacauaagucuggguacguaacagucgcacacaccggccaacacgaccuaguuauaccacccaacggcuacuuccgcuucgacucaugggucaaccaauucuacacacuugcaccaaugggaaacggugccggccgccgccgcgcccucuaa

SEQ ID NO: 37355 - RNA, 1623 nt, Artificial Sequence
  derived and/or modified sequence opt11 from major_capsid_protein__Norovirus__AFU92663
augaaaauggccagcaacgaugccacccccagcgacggaucaacugcaaaccuagucccagaagucaacaacgaagucauggcccucgaacccgucgucggcgcagccaucgccgcccccguagccggccaacaaaacgucaucgaccccuggauaagaaauaacuucguccaagccccaggaggcgaguucaccguuucaccccgcaacgccccaggagaaauucuuugguccgcaccccucggcccagaccucaauccauaccucucccaccucucacgaauguacaacggcuacgccgguggcuucgaaguccaaguaauccucgcuggcaacgcuuuuacagccgguaaaaucaucuucgcggccgugccacccaacuuccccacagaaggacuaucccccucucaggucaccauguucccccacaucauaguagacguccgccaacuagaacccguucuuauaccccucccagauguccgcaacaacuucuaccacuacaaccaauccaacgaccccaccaucaaacucaucgccaugcuuuacacaccccuucgagccaauaaugcuggcgacgacguauucaccguauccugccgaguccucacacgccccuccccagacuucgacuucauauuccucguacccccgaccgucgaaucuagaaccaagcccuucuccguaccaauacuaacagucgaagagaugaccaacagccgcuuccccaucccccuagaaaaacuauucaccggcccaucuagcgccuucguaguacaaccucaaaacggccgaugcacuacugacggcguccuacucgguacaacgcaacucucccccguaaacauauguaccuuccgcggcaacgucaccaauauagcuggaucgcaaaccuacaccaugaaccucgcaagccaaaacuggaacaacuacgaccccacagaagaaauccccgcaccauuaggcaccccagacuucgucggacgcauccagggcguccucacccaaacaacucgaggcgacgguuccacacgcggacacaaagccaccgucuccacaggcuccgccuacuucacccccaaacugggcucaguccaauucucaacugacaccucgaccgauuucgaaacaggccaaaacacccgcuucacccccguuggcgucguacaagacggaucaaccacacacaaaaacgaaccccaacaauggguccuccccuccuauucaggaagagauucacacaacguccaccucgcccccgccguugcaccuaccuuccccggagaacaaauccuuuucuuccgcagcaccaugcccggaugcucaggguaccccaacauggaccucgacugccuccucccacaagaauggguacaacacuucuaccaagaaucagcucccgcacaauccgacgucgcacuccuccgauucgucaaccccgacaccggacgcguccucuucgaaugcaaacuucacaaaucaggcuacgucacggucgcccacaccggccagcacgaccuagucauaccacccaaugguuacuuccgcuucgacucaugggucaaccaauucuacacacuagcacccaugggaaacggcgcaggccgaagacgagcccuauaa

SEQ ID NO: 37356 - RNA, 1623 nt, Artificial Sequence
  derived and/or modified sequence opt11 from major_capsid_protein__Norovirus__AFU92664
augaaaauggccagcaacgacgccaaucccagcgacggcuccgccgcacaccucguccccgaagucaacaacgaagucauggcccuagaaccuguaguuggcgccgcaaucgccgcccccgucgccggccaacaaaacguuaucgaccccuggauacgcaauaacuucguacaagccccaggcggcgaguucaccguaucucccagaaacgcacccggagaaauccuaugguccgcaccccucggcccugaccuaaacccauaccuaucacaccuagcacgcauguacaacggauacgccggcggcuucgaaguacaagucauccucgcaggcaacgccuucaccgccggcaaaaucaucuucgccgccgucccaccaaacuuccccacugaaggccucucccccucacaaguaacuauguucccacacaucaucguagacguccgacaacucgaaccgguccucaucccccuucccgacguccgaaacaacuucuaccacuacaaccaaagcaacgacuccaccaucaaacucaucgccaugcuauacacgccccuccgcgccaacaacgcaggcgaagacgucuucaccgucuccugccgaguccucacacgcccuagcccagacuucgacuucaucuuucuuguucccccaacugucgaaucacgcaccaaaccuuucacaguccccauccuaacagucgaagaaaugacaaacucucgguuccccaucccccucgaaaaacucuuuaccggacccucaggagccuucguaguccaaccccaaaacggccgcugcacaacugacggcguccuucucggcacaacacaacucuccccaguuaacauaugcaccuuccgcggcgacgucacccacauugccggcucccgcaacuacaccaugaaccuugcaucccugaacuggaacaacuacgaccccaccgaggaaauccccgccccacucggcacacccgacuuugucgggaaaauccaaggagucuuaacccaaaccaccaaaggagacggcuccacucgcggccacaaggcaacuguauacaccggaucagcccccuucaccccaaaacuaggcuccguacaauucagcaccgacaccgaaaacgauuucgagacccaccaaaauaccaaauucaccccagucggugucauccaagacggcucaaccacccaucgaaacgaaccucaacaaugggugcucccaagcuacuccggccguaacguccacaacguccaucuagcacccgccguagcccccacuuuccccggcgaacagcuccucuucuuccgcuccaccaugccaggcugcuccggcuacccaaacauggaccucgacugcuuacucccucaagaauggguccaacacuucuaccaagaagcagcaccagcgcaauccgaugucgcacuccuaagauucguaaaccccgacaccggccgaguacucuucgaaugcaaacuccauaaauccggcuacgucaccgucgcgcacaccggacaacacgaucucguaauaccacccaacggcuacuuccgauuugacuccugggucaaccaauucuacacccuagcacccaugggcaacgguaccggccgacgucgcgcccuauaa

SEQ ID NO: 37357 - RNA, 1623 nt, Artificial Sequence
  derived and/or modified sequence opt11 from major_capsid_protein__Norovirus__AFU92666
augaaaauggccucaaacgacgccaaccccucagacggaucagccgcaaaccucgucccagaagucaacaacgaggucauggcccuagaacccgucgucggcgcagccaucgcagccccuguagccggacaacaaaacgucauugacccuuggauccgcaacaacuucguccaggcacccggcggagaauuuaccgucucuccccgcaacgcccccggugaaauucugugguccgcaccuuuaggcccagaccucaacccauaccucucccaccucgcacgaauguacaacggcuacgccgguggauucgaaguccaggucauccuagcaggcaacgccuucacagcaggcaaaaucaucuucgccgccgugccacccaacuuccccaccgaaggacucucccccucccaaguaacaauguuuccccacauuaucguagauguucgacaacucgaacccguacucaucccccucccugacguccgaaacaacuucuaccacuacaaccaaucaaacgauuccaccaucaaacucaucgcuaugcuuuacacaccccuccgagccaauaacgccggcgaagacgucuucaccgucuccugucgaguacucacccgccccucccucgacuucgacuucauauuucucguuccacccaccguagaaucacgcacuaaacccuucacaguacccauccuaaccguugaagaaaugacaaacucccgcuuucccaucccacucgaaaaacucuucacuggccccuccggcgccuucgucguccaaccccagaauggccgcugcaccaccgacggcgucuuacuaggaaccacccaacuauccccugucaauauaugcacauuccgaggcgacgucacccacauagcaggaucccguaacuacaccaugaaucuugcgucccucaacuggaacaacuacgacccaaccgaagaaacaccagcaccccucggcacucccgacuuugucgguaaaauacaaggcguacuaacccaaacaacaaaaggagacggcucaacucgcggacacaaagccaccguauacacuggaucagcccccuucaccccuaaacucggcucuguccaauucuccaccgacacagaaaacgacuucgagacccaucaaaacacaaaguucaccccggucggcgucauacaagacggcggaacaacccacaggaaugaaccccaacaauggguccucccauccuacuccggccgcaacguacacaacguccaccuagcccccgccguugcaccgacauuucccggugagcaacuccuauucuuccgcuccaccaugcccggcugcuccggcuaccccaauauggaccucgacugccuccuuccccaagaauggguccaacacuucuaccaagaagccgcucccgcccaaucagacguggcccuacuccgcuuugucaaccccgacaccggacgcguacuauucgaaugcaaacuccacaaaucgggcuacguaacuguagcccacaccggacaacacgaccucguaaucccaccaaacggcuacuuccgauucgacucaugggucaaccaauucuacacccuugcacccaugggaaacggaaccggccgucgacgugcacuauaa

SEQ ID NO: 37358 - RNA, 1623 nt, Artificial Sequence
  derived and/or modified sequence opt11 from major_capsid_protein__Norovirus__AFU92667
augaaaauggcauccaacgacgccacccccucagacggcgucgccgcccaccucguccccgaaguaaacaacgaagucauggcccucgaacccgucgucggcgcagcaaucgccgcacccgucgcaggacaacaaaacgucaucgacccauggauucgaaacaauuucguccaagcuccagguggcgaauuuaccguauccccacgaaacgcuccaggugaaauccucuggucagcaccccucggacccgaccuaaacccuuaucuaucccaccuagcccgaauguacaacggcuacgccggcggauucgaaguccaggucauccucgccggaaacgccuuuacagccggaaaaaucaucuucgcagccguaccucccaacuuccccaccgaaggccuaucccccucucaagucaccauguucccacacaucauugucgacguccgccaacucgaaccaguccucaucccucuccccgauguacgcaacaacuuuuaccauuacaaccaauccaacgacucuacuauaaaacucaucgccaugcuuuacacaccccuccgugccaacaacgcuggugaagacgucuucacaguaucaugccgcgugcucacucguccauccccagacuucgacuucaucuuccuaguaccacccacagucgaaucacgaacaaaaccuuucacagucccaauccuaacaguagaagaaaugaccaacagccgauucccuaucccgcuugaaaaacucuucaccgggcccuccggagcuuucgucguccaaccacaaaauggucguugcacuacagacgguguacuccuaggcaccacacaacucucccccgucaacauaugcacauuccgaggcgaugucacccacaucgccggcucccgaaauuacaccaugaaucuugccucucucaacuggaacaacuacgaccccaccgaagagauccccgcccccuuaggaacccccgacuucgucggcaaaauccaaggcguccucacccaaaccacaaaaggagacgguuccacccgaggccacaaggccaccgucuacaccggcuccgccccuuucaccccuaaacucggaucuguccaauucuccaccgacaccgagaacgacuuugaaacccaccaaaauaccaaauucacccccgucggcguaauccaagacggcggcaccacccaccgaaaugaaccccagcaauggguccuccccuccuacagcggcagaaacguccacaacguccaccucgcccccgccgucgccccuaccuuccccggagaacaacuucucuucuuccgcucaacaaugcccgguugcuccggcuaccccaacauggaccuagacugccuccucccucaagaauggguucaacacuucuaucaagaagccgcacccgcacaauccgacguagcccuccuccgcuucgugaacccugacaccggccgaguacucuucgaaugcaaacuacacaagucaggauacgucacagucgcccacaccggccaacacgaccuaguaaucccucccaauggcuacuuccgcuucgacucuuggguuaaccaguucuacacccuagcucccaugggaaacggcacaggacgccgccgcgcacucuaa

SEQ ID NO: 37359 - RNA, 1623 nt, Artificial Sequence
  derived and/or modified sequence opt11 from major_capsid_protein__Norovirus__AFU92668
augaagauggcuucaaacgauguaaccccauccgacggcucggccgccaaccucguaccagaagucaacaacgaaguaauggcccucgaacccguaguuggugccgcaauugcugccccugucgcuggucaacaaaacgucaucgacccauggauacgcaacaacuuuguccaagcaccaggcggggaguucaccgucucccccagaaacgccccuggcgaaauccuauggucagccccacuaggccccgaccucaaccccuaccuaucccaccucgcccgcauguauaacggcuacgcaggcggauucgaaguccaaguaauacuugccggcaacgccuucaccgcggguaagaucauuuuugccgcagucccaccgaacuuuccaaccgaaggacuuucaccaucccaggucaccauguucccccacauaaucguagacguacgccaacucgaaccuguacuaaucccucugcccgacguccggaacaacuucuaccacuacaaccaauccaacgacucaacaaucaaauuaaucgcuaugcuauacacaccccuccgagccaacaacgccggcgaagacgucuuuacaguaucaugccgcguucucacccgccccuccccagacuucgacuucaucuuccucgucccaccgaccgucgaaucucgaaccaagcccuucaccgucccaauccucaccgucgaagaaaugacaaacucacgcuuccccaucccccucgaaaaacuauucaccggcccauccggagccuucgucguccaaccucaaaacggacgaugcaccaccgacgguguccuacucggcaccacacaacuauccccugucaacauaugcacauuccgaggagacguaacccacauugcagguagccgcaacuacaccaugaaucuagccucccucaauuggaacaauuacgacccaacagaagaaauaccagcgccccucggaaccccagacuucgucggcaaaauacaaggaguccucacccaaacuaccaaaggagacggcucaaccagaggccacaaggccaccgucuacacaggcagcgcccccuucacacccaaacuaggcuccguacaauucucaaccgacaccgaaaaugacuuugaaacccaccaaaacaccaaauuuacccccgucggcgucauacaagacggaggaacaacccaccguaaugaaccccaacaauggguccucccgucauacucaggacgcaacguccacaauguacaccucgccccagcugucgcccccacauucccuggagaacaacuccuauucuuccgcuccacuaugcccggaugcucaggauaccccaacauggaccucgacugcuuacucccccaagaguggguccaacacuucuaucaagaagccgcccccgcacaauccgacguugcccuacuccgcuucgucaaccccgacaccggacgcguccuauucgaaugcaaacuccacaaauccggcuacgucacagucgcacacaccggacaacacgaccucgucaucccaccaaacggcuacuuccguuucgacucgugggucaaccaauucuacacacucgcccccaugggcaacggcaccggacgccgacgcgcacuuuaa

SEQ ID NO: 37360 - RNA, 1623 nt, Artificial Sequence
  derived and/or modified sequence opt11 from major_capsid_protein__Norovirus__AFU92669
augaaaauggcaucaaacgacgccaaccccuccgacggcucugcagcaaaccucguccccgagguaaacaacgagguaauggcccuggaacccgucguaggcgccgcaaucgccgcccccgucgcaggccaacaaaacgucauagaccccuggauccgcaacaacuucguacaggcaccaggcggcgaguucaccgucucgccccgcaacgcccccggcgaaauccucugguccgcacccuuaggcccggaccuaaacccuuacuuaucccaccucgcccgcauguacaacgguuaugccggcggcuucgaaguacaaguaauccuagccggcaaugcguucaccgccggcaaaauaaucuuugccgccguaccacccaacuucccaaccgagggacuaucccccucccaagucaccauguucccucacauuauagucgacguccgccaacucgaacccguccucaucccccuaccagacguacgcaacaacuucuaccacuacaaccaauccaacgacuccaccauaaaauuaaucgccaugcuauacacaccacuacgcgccaacaacgcaggagaagacguauucaccguaucauguagaguccucacgcgcccuucccccgacuucgacuucaucuuccuagucccacccacaguagaaucccgaaccaaaccauucaccguaccuaucuuaacagucgaggaaaugacuaacucccgcuuccccaucccucucgaaaaacuauucaccggccccuccggcgcauucgucguccaaccccaaaauggcagauguacaaccgacggcguacuccuugggaccacccaacucucccccgucaacaucuguacauuccgaggcgacguuacccacaucgccggcucucguaacuacacuaugaaccuagccucccuaaacuggaacaacuacgacccaaccgaagagauacccgcuccccuaggcacccccgacuucguaggcaaaauccaaggaguacucacgcaaacaacaaaaggugacggcuccacucgaggccacaaagccaccguguacacaggaucggcgcccuucacccccaaacuaggauccguccaauucucaacagacaccgaaaaugauuucgaaacccaccaaaacacuaaauucacccccgucggugucauccaagacggcggaacuacccacagaaacgaaccacaacaauggguacuccccuccuacuccggacgaaacguacacaauguucaccuagcccccgccguagccccaaccuuccccggcgaacaacuacuauuuuuccgcuccacgaugcccgguugcucaggcuacccaaacauggaccucgacugccuccucccacaagaauggguccaacacuucuaccaagaagccgcucccgcccaauccgacgucgcacuccuccgcuucgucaacccagacaccggccgcguccuauucgaaugcaaacuacauaaauccggcuacgucaccgucgcccacacaggacaacacgaccuagucauaccaccaaacggcuauuuccgcuucgacagcugggucaaccaauucuacacacucgcacccaugggaaacggaacaggacgacgccgcgccuuauaa

SEQ ID NO: 37361 - RNA, 1623 nt, Artificial Sequence
  derived and/or modified sequence opt11 from major_capsid_protein__Norovirus__AFU92670
augaaaauggccagcaaugacgccaaccccucugauggcucagcagcaaaccucguccccgaagucaacaacgaaguaauggcccucgaacccgucgucggagcagccauagccgcacccguagccggacaacaaaacguuauagacccuuggauucgaaacaacuucguacaggcgcccggcggcgaguucaccguaucaccccgcaacgcaccaggcgaaauacucuggcgcgcaccccuaggccccgaccugaacccauaccucucccaccucgcacgcauguacaacggcuacgccggcggauucgaaguccaaguaauccucgccggcaacgccuuuacagccgguaaaaucaucuuugcggccguuccgccuaacuuccccaccgaaggccucucccccucacaagucacuauguucccccacaucaucguagacguccgccaauuagaaccgguccuaauccccuuacccgauguccgcaacaacuucuaccacuacaaccagucaaacgacuccacaauuaaacuuaucgcuaugcuuuacaccccacuccgcgccaacaacgccggugaagacguuuucacggucagcugcagaguccucacccgcccauccccagacuucgacuucauuuuucucguacccccaacagucgaaucuaggaccaagccauucaccguccccauccucaccguagaagaaaugaccaacucccgauuccccauaccccuagaaaaacucuucaccggucccuccuccgccuucgucguccaaccacaaaacggccgcugcaccacagacggcguuuuacucggcacaacacaacucucaccaguaaauaucugcaccuucagaggagacgucacacacaucgcagguuccagaaacuauaccaugaacuuagcaucccucaacuggaauaacuacgaccccaccgaagaaguacccgcaccccuaggcaccccagacuucgucggaaaaauccaaggcguccucacccaaacaaccaagggcgacggcuccacccgcggccacaaagccaccgucuacaccggcuccgcacccuucacaccaaaacucggauccguccaauucagcaccgacaccgaaaacgacuucgaaacccaccaaaacaccaaguucacgccugucggggucauccaagacggcucaaccacccaucgaaaugaaccccaacaauggguccuaccauccuacucuggccgcaacguacacaacguccaccuagcccccgccgucgcacccacauuccccggagaacaacuacuuuucuuccgcuccaccaugcccggcugcagcggcuaccccaacauggaccucgacugucuccucccccaagaauggguccaacacuucuaccaagaagcggccccagcacaaucagacgucgcucuccuacgcuucgucaacccagacacaggccgcguccucuucgaaugcaaacuacacaaaagcggcuacgucaccguagcacacaccggucaacacgaccuaguaaucccacccaauggguacuuccguuucgacagcuggguaaaccaauucuacacccuagcacccaugggcaacggcacuggacgccgccgcgcccucuag

SEQ ID NO: 37362 - RNA, 1623 nt, Artificial Sequence
  derived and/or modified sequence opt11 from major_capsid_protein__Norovirus__AFU92671
augaaaauggccuccuccgaugccaacccaucagacggcucaaccgcuaaccugguacccgaaguaaauaacgaagucauggcucuagaacccguagucggcgccgccaucgcagcacccgucgcuggccaacaaaacgucaucgaccccuggauccgcaacaacuucguccaggccccagguggcgaguucaccguuucacccagaaacgcccccggcgaaauccuuuggucagccccguuaggaccagaccucaaccccuaccuaucacaccucgcccgcauguacaauggcuacgccggcggauuugaaguccaagucauacucgccggcaacgccuucaccgccggaaaaaucauauucgcagcagucccacccaacuuucccaccgaaggacucucccccucccaggucacaauguucccacauaucauagucgacgucagacaacucgaaccaguccuaaucccccuccccgacguacgaaacaacuucuaccacuacaaccaauccaacgaccccacaauaaaacuaaucgccaugcucuacacuccccugcgcgcaaacaacgcaggcgacgacgucuucaccguaucaugucgaguccucacccgcccaucucccgacuucgauuucaucuuccucgucccacccaccgucgaaucccgcaccaaacccuucagcgucccuauccuaacagucgaagaaaugaccaacucccgcuuucccauaccacucgaacgccuauucaccggccccuccucagccuuuguaguccaaccccagaacggacguugcaccacagacggcgugcuucuuggcaccacccaacucagcccagucaacaucuguaccuucagaggcgacguaacccacauagccggcacucaagaauauaccaugaaccucgcaucucaaaacuggaacaacuacgaccccacagaagaaauaccagcaccccucggcacccccgacuucgucggcaaaauccaaggaguccuuacccaaacuacucgacgcgacggauccacuagaggccacaaagccaccguauccaccggcucaguacacuuuacccccaaacuuggacguauccaauucuccacagacaccuccaacgacuucgaaaccggccaaaauacccgcuucaccccuguuggcgucguccaagacggaucaaccacccaccaaaaugagccccaacaauggguccuccccgacuauuccggccgcgacagccacaacguacacuuagccccagcuguagccccuucuuucccaggcgaacaacuacuauuuuuccgauccaccaugccaggcugcuccggcuaccccaacaugaaccuggacugucuccucccccaagaauggguacaacacuucuaccaagaggccgcccccgcccaauccgaugucgcacuacuacgcuucgucaacccagacacuggccgcguccuauucgaaugcaaacuacacaaaagcgguuaugucaccguagcccacaccgggcaacacgaccucguaaucccacccaacggcuacuuccgauucgacuccuggguaaaccaauucuacacccuagcccccaugggaaauggcaccggccggcgccgagccuuauaa

SEQ ID NO: 37363 - RNA, 1623 nt, Artificial Sequence
  derived and/or modified sequence opt11 from major_capsid_protein__Norovirus__AFU92672
augaaaauggccuccaacgacgcaaaccccuccgacggauccgccgccaaccucguacccgaagucaacaacgaagucauggcccuagaacccgucguuggcgcagccauagcggccccagucgcaggccaacaaaacguaaucgaccccuggauaagaaacaacuucguccaagcccccggcggagaauuuaccguaucaccccgcaacgcccccggcgaaauuuuaugguccgcuccccucggcccagaccucaaccccuaccuaucucaccuagcccgaauguacaacggcuacgccggcggauucgaaguccaaguaauccucgcagguaacgcauucaccgcaggcaaaaucauauucgccgcuguaccacccaacuuccccacagaaggccuaucacccucgcaagucacaauguucccccacauaaucgucgacguccgacagcucgaacccguucucauaccccucccugacguacguaacaacuuuuaccacuacaaccaauccaacgacuccaccaucaaacucaucgccauguuauacacaccccuucgcgccaacaacgccggcgaagacguauucaccgucuccugccgaguacucacccgcccaucccccgacuucgacuucauauuccuagucccaccaaccgucgaaucccgcacaaaacccuuuaccguaccaauccucacagucgaagaaaugacaaacucccgcuuccccaucccacucgaaaaacuuuucaccggcccaucgggcgccuucgucguacaaccccaaaacggccgcugcaccacugacggcguccuacucggcacuacacaacucagcccagucaacaucugcacguuccgcggcgacguuacccacaucgcgggaucccgaaacuacaccaugaaucucgcaucccucaacuggaacaacuacgacccuaccgaagaaacccccgcaccccuuggcacgcccgacuucgucgguaaaauacaaggcguccuaacccaaacaacuaaaggcgacggguccacaagaggacacaaagccaccgucuacacgggcuccgcccccuucaccccaaaacucggauccguacaauucucuaccgacaccgaaaacgacuucgaaacccaucagaacaccaaauucacccccguaggcgucauccaagacggcggcaccacacaccgcaacgaaccgcaacaguggguacucccaucauacucaggccgcaacguccacaacguccaccucgcccccgcagucgcccccaccuuucccggcgaacagcuccuguucuucaggucuaccaugcccggaugcucaggauaccccaacauggaccucgauugccuccucccccaggaaugggugcaacacuucuaucaagaagccgcacccgcccaauccgacguagcacuccucagauucgucaacccugacaccggacguguucucuucgaaugcaaacuccacaaauccgguuacgucaccguagcgcacacaggacagcacgaccucguuaucccacccaacggauacuuccgcuucgacagcugggucaaccaauucuacacauuagcccccaugggaaauggcacaggucgccgacgcgcacuauga

SEQ ID NO: 37364 - RNA, 1623 nt, Artificial Sequence
  derived and/or modified sequence opt11 from major_capsid_protein__Norovirus__AFU92673
augaagauggccuccaaugacgcaaaccccuccgacggcucugccgccaaccuaguccccgaagucaacaacgaaguaauggcccucgaacccgucgucggcgcagcaaucgcugccccggucgcaggacagcaaaacgucaucgacccauggauccgcaacaacuucguccaagcccccggcggagaguucacagucucgccucguaaugccccaggagaaauacuguggagcgcaccccucggccccgaccuaaaccccuaccucucucaccucgcccgcauguacaacgguuacgccggcggcuucgaaguacaaguuauccucgccggcaacgccuucaccgccggcaagauaaucuucgccgccgucccacccaacuuccccacagaaggacucucacccucacaaguuacaauguucccacacaucaucgucgacguacgacaacuagaacccguccuaauaccccucccagauguccgaaacaacuucuaccauuacaaccaauccaaugacucuacaauaaaacucauagccaugcucuacaccccacuaagagccaacaacgccggcgaagauguauucaccgucuccugcagaguacucacccggcccucacccgacuucgacuuuaucuuccuagucccacccaccgucgaaucccgcacaaaaccauucaccguaccaauacuuacuguugaagaaaugaccaacucccgauuccccauuccacuagaaaaacucuucaccggcccauccggcgcuuucgcaguccaaccgcaaaacggccguugcacaaccgacggcguccuucucgguacaacccaacuuucgcccgucaacaucuguaccuuccgaggcgacgucacucacaucgccgguucacgcaacuacacaaugaaccucgccucccucaacuggaauaacuacgaccccacugaagaaauuccagccccacucggcacccccgacuucgucggcaaaauccaaggaguacucacccaaacuacaaaaggcgacggcuccacacgaggacacaaagcaaccgucuacacaggaagcgcccccuucacccccaaacucggauccguacaauucucaaccgacaccgaaaacgacuucgaaacacaccaaaacacuaaauucacccccguaggcgucauacaagacggaggcacaacccaccgaaacgaaccacaacaauggguucuccccuccuauaguggccguaacguacacaacguccaucucgcccccgcaguagcccccaccuuccccggagaacaacuacucuucuuccgaucaaccaugcccggcugcuccgguuacccaaacauggaccucgauugccuccuaccccaagaauggguacaacacuucuaccaagaagccgcaccagcccagucagaugucgcccuucuucgcuucguaaacccagauaccggccgaguacucuucgaaugcaaacuacacaaauccggauacgcaaccgucgcccacaccggucaacacgaccuagucaucccacccaacggcuacuuccgcuucgauuccuggguaaaccaguuuuacacccuagcuccaauggggaacgggaccggccgacgacgcgcccucuaa

SEQ ID NO: 37365 - RNA, 1623 nt, Artificial Sequence
  derived and/or modified sequence opt11 from major_capsid_protein__Norovirus__AFU92674
augaaaauggccucaaaugacgcacacccuuccgacgguuccgccgccaaucuaguccccgaagucaacaacgaagucauggcccucgaacccguagucggcgcugccaucgccgcccccgucgccggucaacagaacgucaucgaccccuggauccgaaacaacuuuguacaagccccaggcggugaguucaccgucucaccucgaaacgcaccaggcgaaauccuuugguccgccccacuaggccccgaccucaaccccuaccucucccaccucgcccgaauguacaauggcuacgccggaggcuucgaaguccaagucauccuagccggcaacgccuucaccgcaggcaaaaucauuuucgccgccguucccccaaacuuccccaccgaaggucuaucaccaucacaagucaccauguucccacacaucauagucgacguccgccagcuagaacccguccuaaucccccuccccgacguacguaacaacuucuaccacuauaaccaauccaaugauuccacaaucaagcucaucgccaugcuauauacuccacuacgagcaaacaacgcaggcgaagacgucuuuacagucucaugccgcguccuuacacgccccucucccgacuuugacuucaucuuccuagucccacccacggucgaaucccguacaaaacccuucacaguccccauccucaccguagaagaaaugaccaacucccguuuccccauaccccucgaaaaauuauucaccggccccuccggcgcuuucgucguccaaccccaaaacggacgcugcaccaccgacggaguacuuuuaggcaccacccaacuuucccccguaaauaucugcaccuucagaggugacgucacacacauagcaggcucccgcaacuacaccaugaaccuugccucccucaacuggacaaacuacgaccccaccgaagaaauccccgcaccucucggcacccccgacuucgucggcaaaauccaaggcguccucacgcaaacaaccaaaggagacggcucaacuagaggccacaaagcaaccgucuacaccggcucagcaccauucacucccaaauuaggcuccguccaauucucaaccgacacagaaaacgacuucgaaacccaccaaaacaccaaauucacaccaguaggcgucauccaagacgguggcacuacacacagaaacgaaccacaacaauggguacuacccuccuacucaggccguaauguacacaacguccaccuagcaccagccgucgcccccacauuccccggagaacaacuacucuucuuccgcuccacaaugccaggaugcucaggcuacccgaacauggaccuagacugccuucuuccacaggaauggguccaacacuuuuaccaagaagcagcacccgcacaauccgacgucgcccuacuucgauucguuaaccccgacacaggccgcguccucuucgagugcaaacuccacaaguccggauacgucacuguagcacacacuggccaacacgaccuuguaauacccccaaacggcuacuuucgcuucgacucaugggucaaccaguucuacacacuagcccccauggguaacgggaccggacgcagacgcgcacuauga

SEQ ID NO: 37366 - RNA, 1623 nt, Artificial Sequence
  derived and/or modified sequence opt11 from major_capsid_protein__Norovirus__AFU92676
augaaaauggccuccucagaugcacauccguccgacggcuccaccgccaaccuaguacccgaagucaauaacgaagucauggcccucgagcccguagugggcgccgccauugccgcccccguagccggccaacaaaaugucauugaccccuggauccguaacaacuucguccaagcuccaggcggagaguucacugucucaccacgaaaugcuccaggcgaaauccuuuggucagcaccacugggaccagaccuaaaucccuaccuaucccaucucgcacgcauguacaacucuuacgcaggcggcuucgaaguacaaguaauccucgcuggcaacgccuuuaccgcaggcaaaauuaucuucgccgcagucccuccaaauuuccccaccgaaggucuguccccuucccaagucacaauguucccucacauaaucguagacguccgacaacuagaaccaguucucauaccacuuccugacguucgaaauaacuucuaccacuauaaccaaucgaacgaccccaccaucaaacucauagcuaugcuuuacaccccucuccgcgccaauaacgcaggcgacgacguauucacuguaucaugccgcguccucacacgcccaucccccgauuucgacuucaucuuccucgucccucccacaguagaaucucgcacaaaaccauucucugucccuauccuaacagucgaagaaaugaccaacucaagauucccuaucccccucgaaaaacucuucaccggaccaucaucagccuucgucguccaaccacaaaacggccgaugcaccaccgacggaguccugcucggcaccacccaacuaucccccgucaacaucugcaccuuccgcggcgacguuacacacauagcgggcacccaagaauacacuaugaaccucgccucacaaaacuggaacaacuacgacccuaccgaagaaauccccgcuccccuaggcacccccgacuucgucggaaaaauccaaggcgucuuaacccaaaccaccucucgugacggcucaacccgcggccacaaagcuacagucucaaccggcuccguacacuucaccccaaaacucggccgcguccaauucuccaccgacaccagcaacgacuucgaaaccggccaaaacacacgauucacaccugucggcguaguccaagacggcuccaccacacaccaaaacgaaccacaacaauggguccugcccaacuacuccggccgugacucccacaacguccaccuugcccccgccgucgccccguccuucccaggcgaacaacuccucuucuuccgcucaaccaugcccgguugcuccgguuaccccaacaugaaccucgauugucuacuaccccaagaauggguccaacacuucuaucaagaagcugccccggcucaauccgacguugcacuccuuagauucgucaacccagacaccggccguguccuuuuugaaugcaaacuccauaaaucuggcuacguaaccguagcacacacaggccaacaugaccucguaaucccacccaacggcuacuuccgcuuugauucauggguaaaccaauucuacacccuagcacccauggguaaugguaccggccgccgcagggcacuuuga

SEQ ID NO: 37367 - RNA, 1623 nt, Artificial Sequence
  derived and/or modified sequence opt11 from major_capsid_protein__Norovirus__AFU92677
augaaaauggccucuaacgacgcccaccccucagacggcucugccgcaaaccuaguccccgaagucaacaacgaaguuauggcccuagaaccagucguaggagccgccaucgcugccccagucgcuggacaacaaaacgucaucgacccauggauccgcaacaacuucguccaagcccccggcggcgaauuuacagucagcccacgcaacgcaccuggcgaaauccuauggucagccccucucggacccgaccuaaaccccuauuuaucacaccucgcccgcauguacaacggauacgcaggaggcuuugaaguccaagucauucucgccggcaacgccuucaccgccggcaaaaucaucuucgccgccgucccucccaacuuccccacagaaggacucucacccucccaaguaaccauguucccacacaucaucgucgacguacgacaacuagaaccaguccucaucccccuccccgauguacgaaacaacuucuaccacuacaaccaaagcaacgauuccaccaucaaacucauagcuaugcuauacacuccccuccgagcaaauaacgccggcgaggacguauucaccgucagcugccgcguccucacccgaccauccccagacuucgacuuuaucuuucuugucccacccaccguagaaucccgcacaaaacccuuuaccguucccauccucaccgucgaagaaaugaccaacucccgauuccccaucccccucgaaaaacuuuucaccggcccaucaggcgccuucguaguccaaccccaaaacgguagaugcaccacagauggcgugcuccuugggacaacccaacucagcccagucaacaucugcacauuccgcggugacgucacccacauagcaggcucacgcaacuacaccaugaaccucgccucccucaacuggaacaacuacgacccuacagaagagaucccugccccucuaggcaccccagacuucguaggcaaaauccaaggcguccuaacacaaaccaccaagggcgacggcucaacccgaggacacaaggccacagucuacacuggcuccgcccccuucacccccaaacuagguuccguccaauucuccacagacaccgaaaacgacuucgaaacccaccaaaacaccaaguucaccccagucggagucauucaagacggcggcacaacacaccgcaaugaaccccaacaguggguccuccccagcuacuccggccgcaacguccacaacguacaccuagccccggccgucgcccccaccuucccuggagaacagcuacuuuucuuccgauccacaaugccaggcuguucaggcuaccccaacauggaucucgacugccuccuaccccaagaauggguacaacacuucuaccaagaggcagcacccgcccagucagacgucgcacuacuccgcuucgucaaucccgacacaggacgcguccucuucgaaugcaaacuccauaaauccggauacgucaccguagcccacacuggccaacacgaccucgucaucccaccuaauggauacuuccgcuuugacuccuggguaaaccaauucuacacccucgcccccaugggcaaugggaccggacgacgccgcgcccucuaa

SEQ ID NO: 37368 - RNA, 1623 nt, Artificial Sequence
  derived and/or modified sequence opt11 from major_capsid_protein__Norovirus__AFU92678
augaagauggccuccaacgacgccaaccccuccgacggcucagccgccaaccuaguucccgaaguaaacaacgaggucauggcccucgaacccgucguaggcgccgccauugcugccccaguagcuggacagcaaaacgucauagaccccuggauacgaaacaacuuuguccaagcccccggcggagaguucaccgucagccccagaaacgcccccggugaaauccuaugguccgccccucucggacccgaccucaaccccuaccuaucacaccucgcaagaauguacaauggcuacgcaggcggcuucgaaguccaagucauucucgccggaaaugccuucaccgccggcaaaauaaucuucgcagcagucccaccuaacuuccccacagaaggccucuccccaucacaagucaccauguucccccacaucaucgucgacguucgccaacucgaacccguccucaucccccuccccgacguccgcaacaacuuuuaccacuacaaccaaucaaaugacucaaccauuaaacuaauagccaugcuguacaccccucuacgagcaaacaacgccggagaagacgucuucacagucuccugccgcguacuuacccgacccucccccgacuuugacuucaucuuucucguaccacccacaguugaaucgcgcaccaaacccuucacaguaccaauccuaaccgucgaagaaaugacuaacucucgcuuccccauaccccuggaaaaacucuucacaggcccaucgggcgccuucguuguacaaccccaaaacggccgcugcaccacagacggaguccuccuaggcacaacccaacuauccccagucaacaucugcacauuccgaggcgacguuacccacaucgcagguucacgcaacuacacaaugaaccuagccucccucaacuggaacaacuacgaccccacagaagaaauaccagcuccucucggaacacccgacuucguaggcaaaauccaaggcguucucacccagaccaccaaaggcgacggcuccacucgaggccacaaagcaaccgucuacaccggcuccgcaccguucacccccaaacuaggcuccguacaauucuccaccgauaccgaaaacgacuucgaaacacaccaaaacaccaaauucacaccagucggcguaauccaagacggcggaaccacccaccgcaacgaaccccaacaguggguccuuccaagcuacuccggccgcaacguacauaauguacaccuggcccccgccguagcgcccaccuuucccggcgaacaacuccucuuuuuccgauccacaaugcccggcugcuccggcuaccccaacauggaccuagacugccuccuaccucaagagugggugcaacacuucuaccaagaagccgcaccagcacaauacgacguagcccuacuccgguucguaaaccccgacaccggacgaguacuauucgaaugcaaacuccacaaauccggcuacgucaccguagcacacaccggccaacacgaccucgucauaccacccaacggauauuuccgcuuugacuccugggucaaucaauucuacacacuagcccccaugggcaacggcaccggucgccgccgcgcccuauaa

SEQ ID NO: 37369 - RNA, 1623 nt, Artificial Sequence
  derived and/or modified sequence opt11 from major_capsid_protein__Norovirus__AFU92679
augaaaauggcauccaacgacgcaaaccccuccgacggcucagcagcaaaccucguccccgaagucaacaacgaagucauggcacuagaaccugucgucggcgcugcaauugccgcaccaguggccggucaacaaaacguaaucgauccguggauacgcaacaacuucguacaggcccccggcggggaauuuacagucucaccgcguaacgcccccggggaaauccucuggagcgcuccccuaggccccgaucucaaccccuaccucucccaccucgcccgcauguacaacggcuacgcaggaggcuucgaaguccaggucauacuggccggcaacgccuucacagcugguaaaaucaucuucgccgcuguacccccaaacuuccccaccgaaggccuguccccgucacaagucaccauguucccacacaucaucguugacguccgacaacuagaacccguacuuauaccccuacccgacguacgcaacaacuucuaccacuacaaucaaucaaacgauagcaccaucaaacuuauagccauguuauacacccccuuacgcgccaacaacgcaggcgaagacgucuucacagucuccugccggguccucacccgccccucaccugaguucgacuucauuuuccucguaccacccaccgucgaaucccgcacaaaacccuucaccgucccaauccuaaccgucgaagaaaugaccaacuccagauucccaaucccucuagaaaaauuauucacaggaccaucaggagccuucguaguccaaccucaaaacggacgcugcaccaccgacggcguccuccucggcacaacccaacucucacccgucaacaucugcacauuucgcggcgacguaacacacaucgccggcucccgcaacuacacaaugaaccuggcuucgcucaacuggaacaacuacgacccuaccgaagaaauccccgcaccccuaggcacacccgacuucgucggcaaaauccaaggcguacucacccaaaccaccaaaggggacggaucaacccguggacacaaagccaccgucuacaccggcucugcacccuucaccccgaaacuuggaucaguccaauucucaaccgacaccgaaaacgacuucgaaacacaccaaaacaccaaauucacaccagucggcgucauccaagauggaggcaccacacaccgcaacgaaccacaacaauggguccuacccuccuauuccggccgaaacguccacaacguacaccucgcccccgcgguagcccccacauuccccggcgaacaacuccucuucuuccgcaguaccaugcccggaugcucuggcuacccaaacauggaccucgacugccuacucccacaagaauggguccaacauuucuaccaagaagccgcccccgcccaauccgacgucgcacuccuacgcuucguaaacccagacaccggccgcguccuauuugaaugcaaauuacacaagucaggcuacgucacugucgcccacaccggccaacacgaccucgucauaccaccaaacggauacuuccgcuucgacuccuggguuaaccaauucuacacccuugcccccaugggcaacggaaccggccgacgccgagcccuguaa

SEQ ID NO: 37370 - RNA, 1623 nt, Artificial Sequence
  derived and/or modified sequence opt11 from major_capsid_protein__Norovirus__AFU92680
augaaaauggccucgaacgacgccaacccuuccgacggcuccgccgccaaccucguccccgaaguaaacaacgaagucauggcccuugaaccagucgucggcgcagcaaucgccgcaccagucgccggccaacaaaacguaaucgaccccuggauacgaaacaacuucguccaagccccgggaggugaauuuaccgucucuccccgaaaugcacccggagaaauccuuugguccgcaccccucggcccagaccucaaccccuaucuaucucaccuugcccgcauguauaacgguuacgccgggggcuucgaaguccaagucauccucgccggcaacgcauucacagccggaaaaaucaucuucgccgcaguacccccaaacuuccccacagaaggacuaagccccagucaagucaccauguucccgcacaucauagucgacguccgccaacucgaacccguccucauaccccuccccgacguccgcaacaacuucuaccauuacaaccaauccaacgacuccaccaucaaacuaaucgccaugcucuacaccccacuccgugccaacaacgccggcgaagacgucuucaccgucucaugccgcguucucaccagaccauccccugacuucgauuucauauucuuagucccacccacagucgaaucccguaccaaacccuucaccguacccauccucaccguagaagaaaugacaaacucccgcuucccaaucccacuagaaaaacucuucaccggacccuccggagccuucgucguccagccucaaaacggacgaugcaccaccgacggugucuuacucggaacuacccaguuauccccaguaaacaucuguaccuuccgcggcgauguaacccacauagccggcucccguaacuacacgaugaaccucgccucccucaacuggaacaacuacgacccaacagaagaaaucccugccccucucggcacccccgacuucguaggcaaaauacagggaguacuuacacaaacuaccaaaggagacgguucgacucgcggccacaaagcaaccguauacacaggcuccgcccccuuuacacccaaacucggcuccguccaauucuccaccgacaccgaaaacgacuucgaaacccaccaaaacaccaaauucacccccgucggcguaauccaagacggcggcacaacccaucgcaacgaaccgcaacaauggguacuccccuccuacuccggccgcaacguccacaacguacaccuagccccagccgucgcacccacauuccccggagaacaacuccucuucuuccgcuccaccaugcccggauguucaggcuacccaaacauggaucuagacugccuccuuccccaagaauggguccaacacuucuaccaagaagccgcacccgcccaauccgauguugcccuacuacgcuucguuaaucccgacacuggacguguccucuucgaaugcaaacuacacaaguccgguuauguaaccguagcccacaccggccaacacgaccucguaaucccacccaacggauauuuucgcuucgauucauggguaaaccaauucuacacccuugccccaaugggcaacggcacaggcagacgacgagcccucuaa

SEQ ID NO: 37371 - RNA, 1623 nt, Artificial Sequence
  derived and/or modified sequence opt11 from major_capsid_protein__Norovirus__AFU92681
augaagauggcauccaacgacgccaacccaucugacggcucggcagccaaccuuguccccgaagucaacaacgaagucauggcccuagagcccgucgucggcgcugccaucgcugcccccgucgcuggccaacaaaacguaaucgaccccuggauccgcaacaacuucguccaagcacccggcggcgaguucacugucucuccccguaacgcccccggagaaauacucugguccgcaccccuuggaccagacuuaaaccccuaccuaucccaccuagcccggauguacaacggcuacgcuggcggauucgaaguacaagucauccucgcuggcaacgcuuucaccgccggcaaaaucaucuucgcggccgucccucccaacuuccccacagaaggccuaucccccucccaagugaccauguucccccacaucauuguagacguuaggcaacuugaaccaguccucaucccccuacccgacguacgcaacaauuucuaccacuacaaccaauccaacgacagcaccauaaaacucaucgccaugcucuacacuccccucagagcaaacaacgcuggcgaagacgucuucaccgucuccugccgaguccuaacccgccccucccccgacuucgacuuuaucuuccucguaccacccaccgucgaaucccgcacuaaaccauucacaguacccauacucacgguagaagaaaugacaaacucacgcuuucccauaccacucgaaaaacucuucacaggccccuccuccgccuucgucguccaaccacaaaacgguagaugcaccacagacgggguccuccucggcacuacccaacucucccccguaaacaucugcacuuuccgcggcgacgucacccacaucgccggcucccgcaacuauacaaugaaucuagcuucacucaacuggaacaacuacgaccccaccgaagaaaucccagccccauuagguaccccagacuucgucggcaaaauccaaggcguccuaacccaaaccaccaagggagacggcuccacccgcggacacaaagccaccguauacaccggcucugcccccuuuacaccaaagcuaggcuccguccaauucucaaccgacaccgaaaacgauuucgaaacccaccaaaacacaaaguuuaccccagucggcgucauccaagacggcuccacaacacaucgcaaugaaccccaacaaugggugcuccccucauacagcggacgaaacguccacaacguacacuuagcgcccgcugucgcacccacuuuccccggagaacaacuccucuucuuccgaucaaccaugcccgguugcucuggcuacccaaacauggaccucgacugccuccucccccaagaguggguccaacacuucuaccaagaggccgcccccgcccaauccgaugucgcccuccuccgcuucguuaaccccgacacgggccgaguucuguucgaaugcaaacuacacaaaucaggauacgucacagucgcccacaccggacaacacgaccuaguaauacccccaaacggcuacuuccgauucgacuccuggguaaaccaauucuacacucuagccccaaugggcaacggaaccggcagacgcagagcacucuaa

SEQ ID NO: 37372 - RNA, 1623 nt, Artificial Sequence
  derived and/or modified sequence opt11 from major_capsid_protein__Norovirus__AFU92682
augaaaauggccuccaaugaugccaaccccuccgacggauccgccgccaaccucguccccgaaguuaacaacgaaguaauggcucucgaaccagucgucggcgccgccauugcugcgcccgucgccggccaacaaaacguuaucgaccccuggauccgcaacaacuucguccaagccccuggcggcgaguucaccgucucuccccguaacgcccccggcgaaauccucugguccgcaccccuuggaccagaccucaacccauaccucucccaccuagccagaauguacaauggcuacgccggaggauuugaaguucaagucauucuagcaggcaaugccuucacugccggcaaaaucaucuucgccgcagucccacccaacuuccccaccgaaggccuaucaccgucucaggugaccauguucccccacaucaucgucgacguccgacaacucgaacccguccucaucccccuucccgacguccgaaacaacuuuuaccauuacaaccaauccaaugacuccaccaucaaacuaauagccaugcuauacacaccccuccgcgccaauaacgcaggagaagacgucuucaccguauccugucgcguccuaacccgccccuccccugacuucgauuucaucuuccucgucccacccaccgucgaaucacgcaccaaacccuucaccguccccauacucaccgucgaagaaaugaccaacucgagauuccccauaccucucgaaaaacucuucaccggcccuuccuccgccuucgucguacaaccccaaaacggcagaugcacuaccgacggcguccuacucggaaccacacaacucuccccaguuaacaucugcaccuuccgcggcgacgucacccacaucgccggaucccgcaacuacacuaugaaccuagccucacuuaacuggaacaauuacgaccccacagaagaaauccccgcaccccucggaaccccagacuucguuggaaaaauacaagguguacucacccaaacgacaaaaggcgacggcuccacacgaggccacaaagccacagucuacaccggcuccgcccccuucaccccaaaacucggauccguacaauucuccacugacaccgaaaacgacuucgaaacccaccaaaacacaaaauucacccccgucgguguaauccaagacggauccaccacacaccgaaacgaaccccaacaauggguccuccccuccuacucaggucgcaacguacauaacguacaccucgcccccgcggucgcccccacauucccaggagaacaacuacuauucuucagguccacaaugcccggcugcagcggcuaccccaacauggaccuagacugccuccucccacaagaauggguccaacacuucuaccaagaagccgccccagcacaauccgacgucgcacuccuacgcuucgucaaucccgacaccggccgcguccuuuucgaaugcaaacuacacaaauccggcuacgucaccgucgcccauaccggacaacacgaccuugugaucccucccaacggcuacuuccgauucgacuccuggguaaaccaauucuacacacucgcccccaugggaaacggcaccggacgacgacgagcccuauaa

SEQ ID NO: 37373 - RNA, 1623 nt, Artificial Sequence
  derived and/or modified sequence opt11 from major_capsid_protein__Norovirus__AFU92684
augaaaauggccucaaacgacgccaaccccuccgacgggucagccgccaaccuagucccagaagucaacaacgaagucauggcccuugaacccguagucggggcggccaucgcagcacccguagccggacaacagaacgucauagaccccuggauacgcaacaacuucguccaagcccccgguggcgaguucacaguaucaccccgcaacgcccccggcgaaauccuaugguccgccccacucggacccgaccuaaacccauaccucucgcaccucgcacguauguacaacggcuacgcaggcggcuuugaaguacaagucauccucgccggaaacgccuucacugcaggcaagaucaucuuugccgccguaccacccaacuuccccaccgaaggccucucccccagucaagucaccauguucccccauaucaucgucgacguccgccaacucgaaccaguacucaucccccuccccgacguccgcaacaacuucuaccacuacaaccaauccaacgauuccaccaucaaacucauagccaugcucuacacaccccuucgcgcgaauaaugccggagaagacgucuucaccgucuccugccgcguacucacccgacccucuccugacuucgacuucauauuccuugucccacccaccgucgaaucacgcaccaaacccuucaccgucccaauccucaccgucgaagaaaugaccaacucccgcuuccccauaccccuggaaaaacucuucaccggacccuccggcgccuucguaguccaaccacaaaacggccgaugcaccacagacggaguccuacuagguaccacacaacucucccccgucaauauaugcacauuccggggcgacgucacacacauagcaggaucccgaaacuacaccaugaaccucgccgcccucaacuggaacaacuacgacccaacagaagaaaucccagcaccacucggaacccccgacuucguuggaaaaauucaagggguccucacccagacaaccaaaggagacggcuccacacgcggccacaaagcgacugucuauacaggcucagcggacuucacucccaaacucggaucaguccaauucuccaccgacaccgaaaacgacuucgaaacacaccaaaauaccaaauuuaccccagucggcgucauacaagacggcuccaccacacaccgcaacgagccacagcaauggguacuccccuccuacagcggacgaaacguccacaacguccaccuggccccagccguugcacccacauuccccggcgaacaacuccucuucuuccgcuccaccaugcccggcugcagcggcuaccccaacauggaccucgauugucuacucccccaagaauggguccaacacuucuaccaagaagcagccccagcccaaucugacgucgcccuccuccguuucguaaaccccgacaccggacgaguacucuucgaaugcaaacuacauaagucuggauacguaacagucgcacacaccggacaacacgaucucgucauuccaccaaacggauacuuccguuucgacagcugggucaaccaauucuacacccucgcucccaugggcaacggcaccggccgacgccgcgcccuauaa

SEQ ID NO: 37374 - RNA, 1623 nt, Artificial Sequence
  derived and/or modified sequence opt11 from major_capsid_protein__Norovirus__AFU92685
augaaaauggcaucguccgacgcuaaccccuccgacgguucuaccgccaaccuaguccccgaagucaacaaugaaguuauggcucucgaaccaguagucggagccgcaaucgcagccccugucgccggccaacaaaacgucaucgacccauggauccgcaacaacuucguccaagcucccggcggugaguucaccguuucacccagaaacgccccuggcgaaauccuauggucagcaccccuaggccccgaccuaaacccguaccuaucccaccucgcucgaauguacaacggauacgcaggcggcuucgaaguucaaguaauacucgccggcaacgcauucacugccggcaaaaucauauucgccgcagucccacccaacuucccaaccgaaggucuaucacccucccaaguuacaauguucccccacauuaucguggauguucgccaacuggaaccgguacuaaucccgcuccccgacguccgcaacaacuucuaccacuacaaccaaucaaacgaccccacgaucaaacucauagcgauguuauacacaccgcuccgagccaacaacgcaggcgacgacgucuucacagucucaugucgaguacucacccgccccucacccgacuucgacuucaucuuccuugucccacccacagucgaaucacgcacaaaacccuucuccguaccaauauuaacaguagaagaaaugacaaacucucguuuccccaucccacuugaacggcuauucaccggaccauccucugccuuugucguacagccccaaaacggccgcuguaccaccgacggcguccuccucggcacaacccaacucucccccgucaacaucugcaccuuccguggcgacgucgcacacaucgccggcacccaagaauacaccaugaaccuagccucccaaaacuggaacaacuacgacccaacugaagaaauccccgcaccccuuggaacccccgacuucgucggcaaaauccaaggcguucucacccaaacaacccgucgcgauggcucuacacguggccacaaagccaccgucucaaccggauccgugcacuucaccccuaaacuaggucgcauccaauucucaacugauaccuccaacgauuucgaaacaggacaaaauacccgcuucacccccgucggcgucguccaagacggcggaaccacacaccaaaaugaaccacaacaauggguccuccccgacuacucaggacgcgacucccacaacguacaccucgccccugcugucgcacccucauuuccaggcgaacagcuccucuucuuccgcuccaccaugccuggcugcuccggcuaccccaacaugaaucuagauugccuccucccccaagaauggguucaacacuucuaccaagaagcagccccagcccagucagacgucgcacuccuacgcuucguaaaccccgacaccggccgaguccuuuucgaguguaaacuccacaaauccggcuacgucacaguagcccacaccggccaacacgaccucgucauacccccaaacggcuacuuccgcuucgauuccugggucaaccaguucuacacacuagcccccaugggcaauggcaccggccgccgccgcgcgcuauaa

SEQ ID NO: 37375 - RNA, 1623 nt, Artificial Sequence
  derived and/or modified sequence opt11 from major_capsid_protein__Norovirus__AFU92686
augaaaauggccucuaaugacgcccaccccuccgacggcagcgccgcgacccuuguccccaaagucaacaacgaaguaauggccuuagaacccguagucggcgccgccaucgccgcgcccguagccggccaacaaaacgucaucgaucccuggauccgaaacaacuucguccaagccccaggcggugaguucaccgucucgccacgaaacgcccccggcgaaauccucugguccgccccacucggccccgaccuuaauccuuaccuaucucaccucgccagaauguacaacggauacgccggcggcuucgaacuccacguacuucuagcaggcaacgcauucaccgcuggcaaaaucauaauugccgccgucccacccaacuuccccacagaaggccugucccccucucaaguaacuauguucccccacaucauagucgacguccgacaacucgaacccguacuaauaccacucccagauguccgaaacaacuucuaccacuauaaucaauccaacgacuccaccaucaaacucaucgcaaugcucuacacaccccuacgcgcaaacaacgcgggugaagacgucuucaccguauccugcagaguccucacccgccccucaccggacuucgacuucauauuccucgucccacccacuguggaaagccgcacaaaacccuucaccguccccauccucaccgucgaagaaaugaccaacucaagauuccccauaccacuugaaaaacuauucaccggcccuuccggugccuucgucguccaaccacaaaacggccgaugcacaacagacggcguccuccucggcaccacccaacucuccccuguaaacauuugcaucuuuagaggcgacgucacccacaucgccggaucucgaaacuauaccaugaaccucgccgcccucaacuggaacaacuacgaccccacagaagaaauccccgcaccccuaggcacccccgacuucguaggcaagauccaaggcguccuuacccaaaccacaaagggagacggcagcacacgcggccacaaagccaccgucuacaccggauccgccgacuucacccccaaacuaggcuccguacaauuuagcaccgacaccgaaaacgauuucgagacccaccaaaacaccaaguucacccccguagguguaauccaagacggauccaccacucaccgcaacgaaccccaacaauggguccucccaagcuacucgggacgcaacguacacaacguccaccuagcccccgccgucgcccccacauuccccggagaacaacuccuuuucuuccgcuccaccaugcccggcugcucaggcuaccccaacauggaccuagacugccuacucccccaagaauggguccaacacuucuaccaagaagccgccccagcccaauccgacguggcacuacucagauucguaaaucccgacacaggccgcguccuuuucgagugcaaacugcacaaauccggcuacguaacaguagcacacacaggacaacacgaccucguuauacccccaaauggauacuuccgcuucgacucaugggucaaccaauucuacacacucgcccccaugggcaacggaaccggccgacgacgcgcccuauaa

SEQ ID NO: 37376 - RNA, 1623 nt, Artificial Sequence
  derived and/or modified sequence opt11 from major_capsid_protein__Norovirus__AFU92687
augaaaauggcauccaacgacccaaaccccuccgaugguuccgccgcaaaccucguucccgaagucaacaacgaagugauggcccucgagccagucgucggugcagccaucgcagcgccuguagccggccaacaaaacgucaucgaccccuggauccgcaacaacuucguccaagcacccggcggcgaguucacagucucaccccgcaacgcccccggagaaauccucuggagugcaccccucggccccgaccucaaccccuaccucucucacuuagcccgcauguacaacggcuacgcaggcggcuucgaaguccaaguaauacucgcaggaaacgcauucaccgcaggcaaaauaauauucgccgccguaccacccaacuuccccaccgaaggacuuuccccaucacaagucacaauguucccucacaucauagucgacguaagacaacuagaaccaguccucaucccccucccugacguccgaaacaauuucuaccacuacaaccaaucaaacgacuccacuaucaaacucauagcaaugcuauacacaccccuuagagccaacaacgccggcgaagacguuuuuaccgucuccugccgcguacucaccaggcccucccccgacuucgacuucaucuuccucgucccucccacugucgaaucccgcacuaaacccuucaccguccccaucuuaaccgucgaagaaaugacuaacucccgcuuccccauaccccucgaaaaacucuucaccggucccuccggugcuuucgucguacaaccacaaaacggccguugcaccaccgacggaguacuacuaggaaccacacaacuaucgcccgucaacaucuguacauuccgcggagacguuacacacauugccggaacacgcaacuacacaaugaaccuagccagcuuaaacuggaacaacuacgaccccaccgaagaaaucccagcaccccucggcaccccugacuucguaggcaaaauccaaggaguucuaacacaaacaaccaaaggagacggcuccacaagaggacacaaagccacaguauacaccggaagcgccccguucacccccaaacucggcuccguccaauucuccacagacaccgaaaacgacuuugaaacacaccaaaacacaaaauucacaccgguaggcgucauccaagacggcggaaccacccaccgaaacgaaccccaacaauggguacuacccucauacucaggccgaaacguacacaacguccaucucgcacccgccguagccccaaccuuccccggagaacaacuccuuuucuuccguucaacaaugcccggcugcucuggcuacccaaacauggaccuagacugccuccucccccaggaauggguccaacacuucuaccaagaagccgcuccagcacaaucagacgucgcccuaaugcgguucgucaaccccgacacaggccgaguccuauucgaaugcaaacuucacaaauccggcuacgucaccgucgcacacacaggacagcaugaucuagugauacccccaaacggcuacuuccgcuucgauagcugggucaaucaauucuacacccucgcccccaugggcaacgguaccggccgccgccgagcacuauaa

SEQ ID NO: 37377 - RNA, 1623 nt, Artificial Sequence
  derived and/or modified sequence opt11 from major_capsid_protein__Norovirus__AFU92688
augaaaauggcauccaacgacgcccaccccucagacggaucagccgccaaccucguccccgaaguaaacaaugaagucauggcacuagaacccguggucggcgcagccaucgccgcccccguugcaggccaacaaaacgucaucgaccccuggauccgaaacaacuucgugcaagcaccaggaggagaguucacugucucucccagaaacgccccaggagaaauccucugguccgcaccccuuggaccagaccugaaccccuaccucucccaccucgcccgcauguacaacggauacgcaggcggauucgaaguccaagucauccuagcaggcaacgcauucaccgccggcaaaaucaucuucgcagcaguacccccaaacuucccaacugaaggacucagccccucacaagucaccauguucccacacaucaucgucgacguccgacaacuagaaccgguccucaucccccucccagauguucgcaauaacuucuaccacuacaaccaaaguaacgacuccaccaucaaacucauagcaaugcuauacacaccccuccgcgcaaacaacgccggcgaagacguauucaccguuagcugccgcguccucacccgacccuccccagacuucgauuucaucuuccucgucccucccacagucgaaucccgcacuaagccuuucaccguaccaauacucaccguagaagaaaugaccaacucgcgcuucccuauaccacucgaaaaacucuucaccggccccucaggcgccuucgucguccaaccccaaaacggccgcugcaccaccgacggcguacuccucggcacaacccaacucuccccaguaaacaucugcaccuuccgcggugacgucacacauauagccggcacccgcaauuauaccaugaaccucgcuucacucaacuggaacaacuacgacccuacagaggaaauaccagcaccccucggucccccagacuucguaggcaagauucagggcguccucacacaaaccacaaaaggcgacggcuccacccgcggccacaaagcaacuguauacacuggcucagcccccuucacucccaaacuaggcucaguucaauucuccaccgauaccgaaaacgauuucgaaacccaccaaaacaccaaauucacccccgucggcguaauccaagacggaggcaccacacaccgaaacgagccccaacaauggguccuaccguccuacuccggacgaaacguccacaacguacaucucgcccccgccgucgcacccacauuccccggcgaacaacuccuauucuuccgauccaccaugccagggugcuccggcuacccaaacauggaccuagacugccuucuaccgcaagaguggguacaacacuucuaccaagaagcagcccccgcacaguccgacgucgcacucaugcgauucgucaaucccgacaccggccguguccucuucgaaugcaaacuccacaaaucaggauacgucaccguagcccacaccggccaacacgaccuugucaucccacccaacgguuacuuccgcuucgacuccuggguaaaccaauucuacacacuggcccccaugggaaacggcacgggcagacgccgagcccuuuaa

SEQ ID NO: 37378 - RNA, 1623 nt, Artificial Sequence
  derived and/or modified sequence opt11 from major_capsid_protein__Norovirus__AFU92689
augaaaauggcauccaacgaugccaaccccuccgacggcagcgccgccaaccuuguccccgaagugaacaacgaagucauggcccucgaacccgucgucggcgcagccauagccgcacccgucgccggacaacaaaacguaauagacccauggauccgaaacaacuucguccaagcaccaggaggcgaguucacaguaucaccccgcaaugccccaggcgaaauccuaugguccgcaccccucggccccgaccucaauccauaccucucucaccuagcccgcauguacaacggcuacgccggcggauucgaaguccaagucauccuugccggaaacgccuucaccgccggcaagaucaucuucgccgccguucccccaaacuuccccacagaaggccuauccccuucccaaguaaccauguucccacacauaaucgucgacguccggcaacuugaacccguucuaaucccccuccccgacguucgcaacaacuucuaccacuacaaccaaagcaacgacucaacaaucaaacuaaucgccauguuauacacaccacuccgcgcaaauaacgccggcgaagacguuuucaccguauccugccgaguccucacccgucccucaccagauuucgacuuuaucuuucuugucccacccaccgucgaaucccgcaccaaacccuucaccgucccaauccucaccguagaagaaaugaccaacucucgcuuccccaucccccuagaaaaacucuucacgggcccauccggcgccuucgucguccaaccccaaaacggccgaugcaccaccgacggcguccuccucggcaccacacaacuuuccccaguaaacaucugcacauuccgaggcgacguaacccacaucgcaggcacacgcaacuauacaaugaaccuagcaucgcuaaacuggaacaauuacgacccaacugaagaaauucccgccccucucggcacccccgacuucguaggcaaaauccaaggcguccucacacaaaccaccaaaggcgacggcuccacccgcggacacaaagccaccguauacaccggauccgccccauucaccccuaagcuaggaucaguccaauucuccaccgacacggaaaaugacuucgaaacccaccaaaacaccaaauucacacccgucggugucauccaagacggcggcaccacccaccgcaaugaaccacaacaauggguccuccccucguacaguggacggaacguccacaacguccaccucgcgcccgccgucgcacccacauuucccggcgaacaacuccuauucuuccguuccaccaugccugguugcucgggauaccccaacauggaucuagauugccuccucccacaagaauggguccaacacuucuaucaagaagcagccccugcccaaagcgacgucgcccucaugcgauucgucaacccagacacuggcagaguacuuuucgaaugcaaacuucacaaguccggauaugucaccgucgcccacacgggacaacacgaccuaguuauaccucccaacggauacuuccgauucgacucaugggucaaccaauucuacacccucgcacccaugggcaacggcaccggccgcagacgagcccuuuaa

SEQ ID NO: 37379 - RNA, 1623 nt, Artificial Sequence
  derived and/or modified sequence opt11 from major_capsid_protein__Norovirus__AFU92690
augaaaauggccagcaacgacgccaaucccuccgacgguucagcagccaaccucgucccagaaguaaauaacgaagucauggcccucgagcccguaguaggcgcagccaucgcagcacccgucgcaggacaacaaaacguaauagaccccuggauccguaacaacuucguccaagcacccggaggugaguucacagucucaccccgcaacgcaccuggcgaaauacucugguccgcaccccugggccccgaccucaacccauaccucucccaccuagcccgaauguacaacggauacgccggcggauucgaaguccaagucauccuagccgggaacgcauucaccgccggaaaaaucaucuucgccgccguacccccaaacuucccaacugaaggucucucccccucccaagucaccauguucccccacaucauagucgacguccgccagcucgaaccaguccucaucccccuccccgacguacgaaacaacuucuaccacuacaaccaaucaaacgauucuaccaucaaacuuauagcaaugcuuuacaccccacuccgcgcaaacaacgccggcgaagacguguucaccguaucaugccgaguccucacaaggccaucacccgacuucgacuucaucuuccuaguuccgcccaccguagaaagccguaccaaacccuucaccguccccauacuaacuguagaagaaaugaccaacucuagauuccccauuccccucgaaaaacucuucacaggccccuccggagccuucgucguacaaccccaaaacggacgcuguaccaccgacggcgugcuccucggcaccacccagcucucccccguaaacauauguacauuccgcggcgauguaacccacaucgccggcacccgcaacuacaccaugaaccucgccucccucaacuggaacaacuaugaccccaccgaagaaauucccgccccucucggcacacccgacuucgucggaaaaauucagggaguccucacacagaccacaaaaggagacggcucaacccgcggccacaaagccacagucuacacaggauccgcccccuuuacaccuaaacuaggcucuguccaauucuccaccgacacagaaaacgacuucgaaacccaccagaacaccaaauucacacccgucggcgucauccaagauggcggcaccacacaccgcaacgaaccucaacaauggguccuuccaagcuacuccggcaggaacguccacaacguccaucuagccccagccguggcccccaccuuccccggcgaacaacuacucuucuucagauccacgaugcccggcugcuccgguuaccccaacauggaccucgacugucuccuaccccaagaguggguccaacacuucuaccaagaagccgcacccgcccaaucugacgucgcacucaugcgcuuugucaacccagacaccggacgaguacuuuucgaaugcaaacugcauaaauccggauacguuaccguagcucacacgggccaacacgaucucguaaucccacccaacggauacuuccgcuucgacuccugggucaaccaauucuacacacucgcacccaugggcaacggcacaggccgacgccgagcccucuaa

SEQ ID NO: 37380 - RNA, 1623 nt, Artificial Sequence
  derived and/or modified sequence opt11 from major_capsid_protein__Norovirus__AFU92691
augaaaauggccucaaacgacgcaaacccaagcgacggcuccgccgccaaccuaguuccugaagucaacaacgaagucauggcucuagaaccuguagucggagccgcaaucgccgcccccgucgccggccaacaaaacgucaucgaccccuggauccgcaauaacuucguacaagcacccggcggagaguucacaguuucaccccgaaacgcccccggggaaauccucugguccgcaccccucggccccgaccucaacccauaccucucccaccuagcccgcauguauaacggauaugccggcggcuucgaaguacaagucauacuagccgguaacgcauucaccgccggcaaaaucaucuucgccgccguuccacccaacuuccccaccgaaggccucagcccuucccaagucaccauguucccucacaucauaguagacguccgccagcucgaaccgguacuuaucccccucccagacguacgaaacaacuucuaccacuacaaccaauccaacgacuccacaaucaaacucaucgccaugcucuauacaccccuccgcgccaacaacgccggcgaagacgucuucaccgucucaugccgcguacuaacccgccccucaccugacuucgacuucaucuuccucgucccacccaccguugaaucccgcaccaaacccuucacaguccccauccucaccgucgaagaaaugaccaacucccgauuccccauaccccucgagaaacucuuuacuggccccuccggcgccuucgucguccaaccccaaaacggacgaugcaccacugacggaguacucuuagggaccacccaacucucaccagucaacaucugcaccuuccgcggcgacgucacccauaucgcaggcacccgcaacuacacaaugaaccucgccucccuaaacuggaacaacuacgaccccaccgaggaaauuccagcuccccucggaacacccgacuuugucggaaaaauccaagggguccucacacaaaccaccaaaggagacggcucaacacgcggacacaaagcaaccgucuacaccggaucagcacccuucaccccaaaacucggcuccguacaguucucaaccgacaccgaaaacgacuucgaaacccaccaaaacaccaaauucacuccagucggcgucauacaagacggcggcaccacccacagaaacgaaccccaacaauggguccuccccucauacuccggcagaaacguccacaacguacaccucgcucccgcaguagcucccaccuuucccggcgaacaacuucucuucuuucgauccaccaugcccggcugcuccggauaccccaacauggaccuugacugccuacucccacaggaguggguccaacacuucuaccaagaagccgcccccgcccaauccgacgucgcccuaaugcgauucguuaaccccgacaccggccguguacucuucgaauguaaacuccacaaaucaggauaugucacugucgcucacaccggacaacaugaccucgucauacccccaaacgguuacuucagauucgauuccugggucaaccaauucuacacccuagcucccaugggcaacggaacagggcgccgccgcgcacuauga

SEQ ID NO: 37381 - RNA, 1623 nt, Artificial Sequence
  derived and/or modified sequence opt11 from major_capsid_protein__Norovirus__AFU92692
augaaaauggccucaaaugacgccaaccccuccgacggcuccgcagccaaccucguccccgaagucaacaacgaagucauggcccucgaaccagucgucggcgccgcaaucgccgccccaguagccggccagcaaaacgucaucgaccccuggauacgcaacaacuucguucaagcucccggcggcgaauuuacggugagcccacgaaacgcucccggagaaauccucugguccgccccacucggcccagaccucaacccauaccucucccaccucgcccgcauguacaacggcuacgcuggaggcuucgaaguccaggucauauuagccggaaacgcuuucacugccggaaaaaucaucuucgccgcaguacccccaaacuuccccacagaaggccucucucccucgcaagucaccauguucccacacauaaucgucgaugucagacaacucgaaccaguccuuauaccacuccccgacguccgcaacaacuucuaccacuacaaccaauccaacgacuccaccaucaagcucaucgccaugcuauacacccccuuacgcgcaaauaaugcaggcgaagacgucuucacugucuccugccguguccucacccgaccuagccccgauuucgacuucaucuuccucguuccacccacuguagaaucccgcaccaaacccuucaccguccccauccucacaguugaagaaaugaccaacucucgauuccccaucccacuagaaaaacucuucacaggaccauccggcgccuuugucguccaaccccaaaacgguagaugcaccaccgacggcguccuucucggcaccacccaacuaucacccgucaacauuugcaccuuucgaggagacguaacccauaucgccggcucucgcaacuacacaaugaaccucgccgcacuaaacuggaacaacuacgaccccaccgaagaaauacccgcuccccucggcacccccgacuucgucggcaaaauccaaggaguacucacccaaaccacgaaaggcgacgggucaacccgaggacacaaagccaccguauacacaggauccgccgacuucacacccaaacuaggaucuguacaguucuccaccgacacugaaaacgacuucgaaacacaccaaaacaccaaauucacccccgucggugucauccaagacggcuccaccacccaccgcaacgaaccccaacaauggguccucccaucauacucaggccgaaacguccauaacguucaccuagcccccgcagucgcccccaccuuccccggagaacaacuccuuuucuuccgcucaacaaugccagggugcuccggcuaccccaacauggaccucgacugccuccucccacaagaauggguccaacacuucuaccaggaagccgcccccgcacaaagugacgucgcccuacuccgcuucguuaaccccgacaccggccgcguccuauucgaaugcaaacuccacaaaucaggauacgucacagucgcacacaccggccaacacgaccuagugaucccaccaaacggcuauuuccgcuucgacucguggguaaaccaauucuacacccucgcucccaugggcaacgguaccggacgccgacgagcucucuga

SEQ ID NO: 37382 - RNA, 1623 nt, Artificial Sequence
  derived and/or modified sequence opt11 from major_capsid_protein__Norovirus__AFU92693
augaaaauggccaguaacgacgccaacccauccgacggauccgccgccaaccucgucccagaaguaaauaacgaaguaauggcacuagaacccgucgucggcgccgcaaucgccgcaccaguagcaggccaacagaacgucaucgacccguggaucagauccaacuucguccaggcccccggaggugaauuuacaguguccccacgcaacgcccccggcgaaauccucuggucagcaccacucggacccgaccuaaacccuuaccuaucccaccuagcaagaauguacaacggguacgccggaggauucgagguccaaguaauccucgccggcaacgccuucaccgccggcaagauuaucuucgccgccgucccucccaacuuccccacagaaggccucucaccaucccaaguuacaauguucccacacaucaucgucgacguacgccaacucgaacccguccucauaccacucccagacguccgaaacaacuucuaccacuacaaccaaucaaacgacuccaccaucaaacucauagcaaugcucuacacaccccuacgugcaaauaacgccggcgaagacguauucaccguaucuugcagaguucucacccgcccaagcccagacuucgauuucauuuuccuaguaccucccaccguggaaagucgaacaaaacccuucaccgucccaauccugaccgucgaagaaaugacaaacucucgcuuccccaucccccuagaaaaacuauucaccggacccuccucagcauucgucguccaaccccaaaacggccgcugcaccacugacggcguacuacuaggcaccacacaacuaagccccgucaacaucugcaccuuccgcggagacguuacacauaucgcagguucgcgcaacuacacuaugaaccucgcuucucucaacuggaacaacuacgacccaacagaagaaauaccagcaccccuagggacacccgacuucgucggcaaaauccaaggaguccucacccaaaccacgaaaggagacggcuccacccgcggccacaaagccacagucuauaccggauccgccccauucacacccaaacugggcuccguacaauucuccaccgauaccgaaaacgacuucgaaacccaccaaaacacaaaauucacacccguaggagucauacaggacggcggcacaacccaucgcaacgaaccccaacaauggguccuccccaguuacuccggacgcaacgucccaaacguccaccucgccccugccguggcccccacauuccccggagagcaacuccucuucuuccgcucaacaaugcccgggugcucaggauaccccaacauggaccucgacugccuccucccccaagaauggguccaacacuucuaccaagaagccgcccccgcccaauccgacguagcccuccuacgauucgucaaccccgacaccggccguguccuuuucgaaugcaaacuacauaaaucaggauacgucaccguugcacacaccggccagcacgacuuaguaauacccccaaacggcuacuuccgcuucgauagcuggguaaaccaauucuacacacuagcccccaugggaaacggcaccggcagacgacgcgcccuauaa

SEQ ID NO: 37383 - RNA, 1623 nt, Artificial Sequence
  derived and/or modified sequence opt11 from major_capsid_protein__Norovirus__AFU92694
augaagauggccagcuccgacgccaaucccuccgauggcuccaccgcaaaccuagucccugaagucaauaacgaagucauggcacucgaacccgucgucggagcagccaucgcugcaccugucgccggucaacaaaauguaaucgaccccuggauacgcaacaacuucguccaagcccccggaggcgaguucacagucuccccacgaaacgcucccggagaaauccucugguccgccccucucggccccgaccucaacccauaccucucacaccuagcacgcauguacaacggauaugccgguggcuucgaaguccaagucauccucgccggaaacgccuucacugccggcaaaaucaucuucgcagcaguucccccaaacuuccccaccgaaggacucucaccuucacaagucaccauguucccucacauaaucgucgacguccgccaauuagaacccguccucaucccccuacccgacguccguaacaacuucuaccacuacaaccaauccaaugaccccacaauaaaacucaucgcaaugcucuauacaccccuccgcgccaacaacgccggagacgacgucuucaccguuuccugucgcguccucaccagaccauccccugacuucgauuucauuuuccuaguaccacccaccgucgaaucacgcaccaaacccuucuccguucccauccucaccguagaagaaaugacaaacucccguuuccccaucccacuugagaaacucuucacaggccccuccuccgcauucgucguacaaccccaaaacggccguugcaccaccgacggcguccuccucggcacuacacaacucuccccagucaacaucugcaccuuccgcggggaugucacccacaucaccggcucccgcaauuacacaaugaaccucgccacucaaaacuggaacucauacgaccccacagaagaaaucccagcuccacuaggaacccccgacuucgucggaaaaauccaaggcguacucacccagacaacacgcgcggacgguuccacccgaggccacaaagccaccgucuacaccggaucagccgacuucgcacccaaacucggcagaguccaauuugcaacagacaccgacaacgacuucgaugcaaaccaaaacacaaaauucacccccgucggcguaauacaagacggcgacacagcccaccgaaacgaaccacaacaauggguccuucccuccuacuccggacgcaauucccacaacguccaccucgcacccgccguagcaccgaccuucccaggcgaacaacuccucuucuuccgcuccacuaugcccggauguucaggauacccuaacauggaccucgacugucuacucccacaagaauggguccaguacuucuaccaagaagccgcccccgcucaaagcgacgucgcccuacuccgauucgugaaccccgacaccggucgcguccuuuucgaaugcaaacuccacaaguccgguuacgucaccgucgcacacacaggccaacacgaccucgucaucccucccaacggcuacuuucgcuucgacucuugggucaaccaguucuacacccuagcuccuaugggaaacgguacaggccgucgccgcgcccucuaa

SEQ ID NO: 37384 - RNA, 1623 nt, Artificial Sequence
  derived and/or modified sequence opt11 from major_capsid_protein__Norovirus__AFU92695
augaaaauggcaagcaacgacgccaacccuucagacggcucagccgccaaccucguccccgaagugaauaacgaaguaauggcucucgaacccguagucggcgcugccaucgcagccccugucgccggacaacaaaacguuaucgacccauggaucagaaacaacuucguccaagcuccaggcggcgaguucaccgucagcccacgcaaugccccuggcgaaauccucugguccgcgccccucggccccgaccuaaaucccuaccucagccaccucgcccgaauguacaacgguuacgccggcggguuugaaguccaagucauccucgccggcaaugcauucaccgccggaaaaauaaucuucgccgccguacccccaaauuuucccacagaaggacuaucccccucccaagucaccauguucccacacaucaucguagacguacgccaacuggaaccaguccucauccccuuaccugacguccgaaacaacuucuaccacuacaaccaauccaacgacagcaccauaaaacucauagcaaugcuauacacaccucuacgagccaacaacgccggagaagacgucuucacuguauccugccgcguccuuacacgccccagccccgacuucgacuucaucuuccuaguacccccgaccgucgagucccgaaccaaaccauucaccguccccauccucaccguagaagaaaugacaaacagccgcuuucccaucccccuagaaaaacuauucaccgguccauccucugcauuuguaguacaaccccaaaacggaagaugcacaaccgacggcguccuucuugguacaacucaacucucaccgguaaacaucugcaccuucagaggcgacgucacccacauugccggcagccgcaacuacaccaugaaccucgcgucacuuaauuggaauaacuacgacccaacugaagaaauccccgccccacucggaacccccgacuuugucggcaaaauccaaggcguccuaacccaaacaacaaaaggcgacggcuccacccgcggccauaaagccaccguauacacagguucugcccccuucaccccaaaacuaggcucaguccaauucagcacugacaccgaaaaugacuucgaaacucaccaaaauaccaaauucaccccagucggaguuauacaagacggcggcacaacccaccguaacgaaccgcaacaauggguacuaccauccuacucaggccgcaaugucccuaacguacaccucgcccccgcaguagcacccacuuuccccggagaacaacuacuauucuuccgcuccacaaugcccggcugcuccggcuaccccaacauggaccucgacugccuccucccccaagaauggguccaacacuucuaucaggaagccgcacccgcccaauccgacguagcccuccuccgcuucgucaaccccgacaccggacguguacuauucgaaugcaaacuccacaaaucaggauacgucacaguagcacacacuggccagcacgaucucguaaucccacccaacggcuacuuccguuucgacagcuggguaaaccaauuuuacacacuagcccccaugggaaacgggacaggaagacgccgugcacucuaa

SEQ ID NO: 37385 - RNA, 1623 nt, Artificial Sequence
  derived and/or modified sequence opt11 from major_capsid_protein__Norovirus__AFU92696
augaagauggccucaaacgacgccaaccccagugacggcuccgccgccaaccucguccccgaagucaacaacgaagucauggcacucgagcccgucgucggcgccgccaucgccgcacccgucgcaggacaacaaaacgugauagacccguggauacgaaacaacuucguccaagcccccggaggagaguucaccguuagcccgcgaaacgccccaggcgaaaucuuaugguccgcaccccucggucccgaccucaaucccuaccuaucccaccucgccagaauguauaacggauaugccggcggauucgagguccaagucauacucgcaggcaacgccuuuacagccggcaaaauaaucuucgccgccguacccccaaacuuccccacagaaggccucucccccucccaagucaccauguucccacacauaaucgucgacguccgccaacuagaaccuguccucauuccccuaccagacguucguaacaacuucuaccacuauaaccaaucuaacgacucaacaaucaaacuaaucgcaaugcuauacacuccccuccgcgccaacaacgccggcgaagacgucuucaccguauccugccgaguucucacccgcccaagcccagacuucgacuucauauuccucgucccucccaccgucgaaucccgcaccaaacccuucacaguccccauccucacagucgaagaaaugacuaacucacgauuccccaucccccuagaaaaacuauucaccggaccaucaucagccuucguaguccaaccccaaaacggucgaugcaccaccgacggaguccuacucggaaccacccaacucucccccguaaacaucugcaccuuccgaggcgacguuacccacauagccggaucaagaaacuacaccaugaaccucgccucccuaaacuggaacaacuacgacccaacugaagaaaucccagcaccccucggcacccccgacuucguuggcaaaauccaaggcguucucacccaaaccaccaaaggcgacggauccaccagaggccacaaagccaccgucuacaccggcagugcccccuucaccccgaaacucggcuccguccaauucucaacagauaccgaaaacgacuucgagacacaccaaaauaccaaguucaccccaguuggcgucauccaagacggcggcaccacccacagaaacgaaccccaacaguggguccuuccauccuacuccggacguaacguccaaaacguacaccucgcacccgccguagcccccaccuuccccggcgaacaacuccuuuucuuccgcuccacaaugccuggcugcuccggcuaccccaacauggaucucgacugccuacucccccaagaauggguacaacacuucuaccaagaagccgccccagcccaauccgacgucgcccuccuccgauucguuaacccagacaccggccgaguccuuuucgaaugcaaacuccacaaauccggauacgucacagucgcccacaccggccaacacgaccuagucaucccacccaacggauacuuccgauucgacuccugggucaaucaauuuuacacccucgcgcccaugggaaacggcaccggcagacgccgcgcacuauaa

SEQ ID NO: 37386 - RNA, 1623 nt, Artificial Sequence
  derived and/or modified sequence opt11 from major_capsid_protein__Norovirus__AFU92697
augaaaauggcauccaacgacgcaaacccuuccgacggcuccgccgccaaccuaguccccgaagucaacaacgaagucauggcccucgaacccgucguuggcgccgccaucgccgcccccguagcgggucaacaaaacgucaucgacccauggauucgcaacaacuucguccaagccccgggaggcgaguucaccgucucccccagaaacgccccaggugaaauacucuggucggcaccccucgguccagaccucaacccuuaccuuucacaccuagcccgcauguacaauggcuacgccggaggcuucgaaguccaagucauccucgcaggaaacgccuucacagcaggaaaaaucauauucgcagccgucccaccaaacuuccccacagaaggacucucacccagucaagucaccauguucccccacauaaucguugacguccgccaacucgaaccaguccucaucccacuacccgacguacguaacaauuucuaucacuacaaccaauccaacgacucuacuaucaaacucaucgcuaugcuauacacaccacuaagagcuaacaacgccggggaagacguguucaccguaucaugucgaguccucacaagacccucucccgacuucgacuucaucuuccucgucccacccaccgucgaaucccgcaccaaacccuucaccguccccauccuaacagucgaagaaaugaccaacuccagauuucccaucccacucgaaaaacucuucacaggccccagcuccgccuucguaguccagccacaaaacggccgcugcaccaccgacggcguccuacuagggacaacucaacucucccccgucaacauuuguacuuuucgaggcgacguaacacacaucgcuggcucacgcaauuacacuaugaaccuagcaucacucaacuggaauaacuacgaccccacagaagaaauccccgccccacucggcacccccgacuucgucggcaaaauacaaggcguccucacacaaaccaccaaaggcgacggcucaacccgaggccacaaagccacugucuauaccggcucugccccuuucacccccaaacucggaucuguacaauucuccaccgacaccgaaaacgauuucgaaacccaccaaaacaccaaauucaccccagucggcgucauccaagacggaggaaccacacaccgaaacgaaccgcaacaauggguacucccuagcuacuccggccgcaaugucccaaacguccacuuagcacccgcagucgcccccaccuuucccggagaacaacuccuauucuucagauccacaaugcccggcugcucaggcuaccccaacauggaccuagacugccuucucccccaagaauggguccaacacuucuaucaagaagccgccccagcccaauccgauguagccuuacugcgcuucgucaaccccgacaccggccgcguacucuucgaaugcaaacuacacaagucuggauacgucaccgucgcccacaccggacaacacgaccuagucauucccccaaacggauacuucagauucgacuccugggucaaucaauucuacacccuagcaccuauggguaacgguacuggccgccgcagagcccuauga

SEQ ID NO: 37387 - RNA, 1623 nt, Artificial Sequence
  derived and/or modified sequence opt11 from major_capsid_protein__Norovirus__AFU92698
augaaaauggccuccaacgacgcaaacccauccgacggcuccgcagcuaaccuaguccccgaagucaacaacgaagucauggcacuagagcccguagucggcgccgccaucgccgcccccgucgccggccagcaaaacgucaucgaccccuggauacggaacaacuucguccaagcccccggcggagaauuuaccgucucaccccgcaacgccccuggcgaaauacuaugguccgccccacucggucccgaccucaacccauaccuuucccaccuagcuagaauguacaacggcuacgccggagguuucgaaguacaagucauccuagcagguaaugccuucaccgccggcaagaucaucuucgcagcaguaccacccaacuuccccaccgaaggacuuagccccucccaagucaccauguucccacacaucaucgucgacguccgccaacuagaacccgugcucauaccccuacccgacguccgcaacaacuucuaccacuacaaccaaucaaacgacuccaccaucaaacucaucgcuaugcuauacacaccccuucgagcaaacaacgcaggcgaagacgucuucaccguauccugccgcguucucacacgccccucaccagacuucgacuucauauuccuaguacccccaacugucgaaucccgcacaaaaccauucacagucccuauacuaacugucgaagaaaugacuaacucacgcuucccgauaccacucgaaaaacuuuucacuggccccucaggcgcuuucguuguccaaccccaaaacggccgcuguaccacugacggcguacugcucggaaccacgcaacucucaccagucaacaucugcaccuuccgcggcgacgucacccacauagcuggcucccgcaacuacaccaugaaucucgccucccucaacuggaacaacuacgaccccaccgaagagauccccgcuccccuaggcacccccgacuucgucggaaaaauucaaggaguacucacccaaaccaccaaaggcgacggcuccacccggggacacaaagccaccguauacaccggcuccgcccccuucacccccaaacucggauccguccaauucuccacagacaccgaaaacgacuuugaaacacaccaaaacaccaaauuuaccccugucggcgucauccaagacgguucuacaacacaccgaaacgaaccacaacaauggguccuucccuccuacucuggccguaacguccauaauguccaccuugcucccgccgucgcccccaccuuccccggugaacaacuccucuucuuccgauccacaaugcccggcugcucgggcuaucccaacauggaccucgacugccucuuaccgcaggaauggguacaacacuucuaucaagaagccgcacccgcccaaagcgacgucgcacuccuccgauucgucaaccccgacaccggucgcguauuauucgaaugcaagcuccacaaauccggcuacguuaccguagcucacacaggccaacacgaccuagucauacccccuaacggauacuuccgcuucgacuccuggguaaaucaauucuacacccucgcacccaugggaaacggaaccggccgucgucgcgcccucuaa

SEQ ID NO: 37388 - RNA, 1623 nt, Artificial Sequence
  derived and/or modified sequence opt11 from major_capsid_protein__Norovirus__AFU92699
augaaaauggccucaaaugacgcgaaccccucagacggcucggccgcaaaccucguccccgaagucaacaaugaagucauggcccucgagcccguugucggcgccgcaaucgccgccccugucgccggccaacagaacgucauagaccccuggauccgcaacaacuucguacaagcuccgggaggagaguucacaguaucgccacgcaacgccccaggcgaaauccucuggucagcaccccuaggacccgaccucaaccccuaccuaucucaccuagcccgaauguacaacggcuacgccgguggcuuugaaguccaagucauccucgccggcaacgccuucaccgccggaaaaauaauauucgcagccgucccuccuaacuuccccaccgaaggccucucccccucccaagucacaauguucccacauauaauacucgauguccgccaacucgaacccguccucauaccauuaccagacguacguaauaacuucuaccacuacaaccaaaguaacgacuccaccaucaaacucaucgcaaugcucuacacaccgcuccgcgccaacaaugcaggcgaagacgucuuuaccgucucaugccgcguccucacccgcccaucccccgacuucgacuucaucuuucuaguaccgccaacagucgaaucucguacgaaacccuucaccgugccgauauuaaccgucgaagaaaugaccaacucccgauuucccaucccccuugaaaaacuauucacgggcccaucaggagccuucgucguccaaccacaaaacggucgcugcaccaccgacggcguccuccucggcacaacucaacucucacccguaaauaucugcacauuccgaggagacgucacacacaucgccggcucucgcaauuacacuaugaaccuagcaucacucaacuggaacaacuacgaccccaccgaagaaauccccgcaccccuuggcacccccgacuuugucggcaaaauacaaggcguacuaacacaaacaaccaagggcgacggcuccacccgaggccacaaagccaccgucuacaccggcagcgcacccuucacccccaaacuaggcucaguccaauucuccacagacacagaaaacgauuucgaaacccaucaaaacacaaaauucacccccgucggcgucauccaagacggauccacaacaagacgcaacgaaccacaacaguggguccucccauccuacuccggcagaaacgcacacaacguccaccuagcccccgccgucgccccaacauuuccaggagaacaacuucuauucuuucguucaacaaugcccggcugcucaggcuacccuaacauggaccuagacugccuucucccccaagaauggguccaacacuucuaccaagaagccgcacccgcucaauccgacgucgcccuucuccgauucgucaaccccgacaccggccguguccucuucgaaugcaaacuucacaagucaggcuacgucacaguagcccacaccggacaacacgaccucguaauaccacccaacggauacuucagauuugacuccuggguuaaccaauucuacacccucgcccccaugggaaacgguaccggccgucgccgcgcccucuaa

SEQ ID NO: 37389 - RNA, 1623 nt, Artificial Sequence
  derived and/or modified sequence opt11 from major_capsid_protein__Norovirus__AFU92700
augaaaauggcuuccaacgacgcuagcccauccgacggaucagccgcaaaccucguccccgaaguaaauaacgaaguuauggcccuagaacccguugucggcgccgccaucgccgcccccgucgccggccaacaaaacgucaucgacccauggauacgcaacaacuucguccaagcccccggcggcgaguucacugugucaccccgaaacgccccuggcgagauccucuggucagccccacuagggcccgaccucaaucccuaccucucccaucuagcccguauguacaacggauacgccggcggcuucgaaguacaagucauccucgccgguaacgccuucacagccggcaaaaucauauucgcagccguacccccuaacuuccccacugaaggccucucacccucacaagucaccauguucccccacaucaucgucgacguccgccagcucgaacccguccucaucccccuacccgauguccgcaacaauuucuaccacuacaaccaauccaacgacuccaccauuaagcucaucgcaaugcucuacaccccucuacgcgccaacaacgccggagaagacgucuucacugucucaugcagaguccucacacgccccuccccagauuucgacuucauuuuccucgucccucccacgguagaaucacgcaccaaaccauucaccgucccaauacucacagucgaagaaaugacaaacucccgcuuccccaucccccucgaaaaacuauucacaggccccucauccgccuucgucguucaaccccaaaacggccgcugcacaacagacggcguccuucuaggcacuacccaacucagcccugucaacaucugcaccuuccgaggagacguaacccacaucgccggcucccgagacuacacaaugaaucucgcaucccuaaacuggaacaacuaugaccccaccgaagaaauccccgcaccccucggaaccccagauuuugucggcaaaauacaaggcguccuaacacaaaccaccaaaggagacgguuccacacgaggccacaaagccaccguauacaccggaagcgccccauucaccccaaaacuaggcuccguccaauucucaacagacaccgagaacgacuucgaaacacaccaaaacaccaaauucacccccgucggagucauacaggacggcuccacaacccacagaaaugaaccccaacaauggguacuccccuccuacagcggccgaaacguacagaacguucauuuagccccagcagucgccccaaccuuccccggcgaacaacuacucuucuuccgaucuaccaugccaggaugcuccggauaccccaacauggaccuagacugccuccucccccaagaauggguccaacacuucuaccaagaagccgcccccgcccaauccgacgucgcccuucuccgcuucgucaacccagacaccgguagaguccucuuugaaugcaaacuccacaaauccggauacgucaccgucgcccacaccggacagcacgaccuaguuauacccccaaacggauauuuccgcuucgacucaugggucaaccaauuuuacacccucgcccccaugggcaauggcaccggcagacgcagagcccucuaa

SEQ ID NO: 37390 - RNA, 1623 nt, Artificial Sequence
  derived and/or modified sequence opt11 from major_capsid_protein__Norovirus__AFU92701
augaaaauggcuuccaacgacgcaaaccccuccgacggcuccgccgcaaaccucguccccgaaguaaacaaugaggucauggcacuagaacccgucgucggagcagccaucgcugccccaguagcaggccaacaaaacgucaucgaccccuggauccgaaacaacuucguccaagccccaggcggcgaguucaccguauccccacgcaacgcaccaggcgaaauucuuuggagcgcaccccucggccccgaccucaaccccuaccucucccaccuagcccggauguacaacggcuacgccggcggcuucgaaguccaagucauccucgccggcaacgccuucacggccggcaaaauuaucuucgccgcagucccgcccaacuuccccacugaagggcugucacccucccaaguaaccauguucccccacauaauagucgacguccgccaacuagaaccaguccucaucccccuccccgacgucagaaacaacuucuaccacuacaaccaaucuaacgacuccacaaucaaacucaucgcaaugcucuacaccccacuacgagccaacaacgccggagaagacgucuucaccgucucaugccgcguccuaacccgccccucccccgacuucgacuucaucuuccucguaccacccacagucgaaucacgaacaaaacccuuuacagucccaauacucacagucgaagaaaugacuaacucucgcuucccuaucccacucgaaaaacucuucaccggucccucaucugcauucgucgugcaaccccaaaauggccguugcaccaccgacggaguacuuuuaggcaccacccagcucagcccagucaacaucugcacauuccgcggcgauguaacccacauugcaggcucacgcaacuacaccaugaaccucgcaucacucaacuggaacaacuacgaccccacagaagaaauccccgcaccccucggcacaccagacuucgucggaaaaauccaaggcguccucacccaaaccaccaaaggagacggcucuacucgcggccacaaagccaccgucuacacugguuccgccccuuucacaccaaaacucggauccguccaauucucaaccgacacagaaaacgacuucgaaacccaccaaaacacaaaauucacccccgucggcgucauacaggacggcggcaccacacaccgaaacgaaccccagcaauggguccuccccaguuacucaggucgcaacguuccaaacguacaccucgcccccgccguagccccaaccuuccccggagaacaacuccucuucuucagauccacaaugccgggcugcucuggcuaccccaacauggaccucgauugccuccuaccccaagaauggguccaacacuucuaccaagaggccgcaccagcccaauccgacguagcccugcuccgcuucgucaacccagacaccggucgcguccucuucgaaugcaaacuccacaagucaggcuacguaaccguagcgcacaccggccaacacgaccuagucauacccccaaacggcuacuuccguuucgacucaugggucaaccaauucuauacucuagccccaaugggcaacgguaccggccgccgccgagcccuauaa

SEQ ID NO: 37391 - RNA, 1623 nt, Artificial Sequence
  derived and/or modified sequence opt11 from major_capsid_protein__Norovirus__AFU92702
augaaaauggccuccucugacgcaaacccauccgacggcuccacagccaaccuugugccugagguaaacaacgaagucauggccuuagaacccguuguaggcgcagcaaucgccgccccugucgccggccaacagaaugucaucgacccauggauccgcaacaacuucguccaagccccaggaggcgaguucaccguaucaccccgcaacgcacccggcgaaauccucugguccgcaccccuagguccugaccucaacccauaccucucccaccuagcccgcauguacaacggcuacgccggcggauucgaaguccaagucauccucgccggaaacgcauuuaccgccggaaaaaucaucuucgccgcuguacccccaaacuuucccaccgaaggccuaucccccagccaagucaccauguuuccccacaucaucguagacguccgacaacucgaacccgucuuaaucccccuccccgauguccgcaacaacuucuaccacuacaaccaauccaaugaccccaccauaaaacuuauugcuaugcucuacaccccacucagagccaacaaugccggcgacgacgucuucacuguauccugccgaguacuaacacgacccagccccgacuucgacuucaucuuccuaguucccccaaccgucgaaucacgaaccaaacccuucagcguacccauccucaccgucgaagaaaugacaaacucccgcuuucccauaccauuagaaaaacucuucacaggacccuccuccgcauucguuguccaaccacaaaacggacgaugcacuaccgacggaguccuccuagguacaacacaacuuucacccgucaacaucugcaccuuccgcggugauguaacccacauuacaggcucccgcaacuauaccaugaaccucgcaacccaaaacuggaacuccuacgacccaacugaagaaauccccgccccacuuggcacccccgacuuugucggcaaaauccaaggcguccuuacacaaaccacccgcgcagacggauccaccagaggacacaaagcaaccguuuacaccggauccgcugacuucgcacccaaacucggacgaguccaauucgccaccgacacggacaaugacuucgacgcaaaucaaaacaccaaauucaccccagucggagucauccaagacggcgacaccgcccaccgaaacgagccccaacaauggguucuacccucauacagcggacgaaacucccacaacguccaccuagcucccgcagucgcacccacauuucccggcgaacaacuccucuucuuccgaucaaccaugcccggaugcucaggauacccaaacauggaccucgacugccuccuaccccaagaauggguacaauacuucuaccaagaagcagcccccgcccaauccgacguagcccuacuacgcuuuguaaaccccgauaccggccgcguccuuuucgaaugcaaacuccacaaaucaggauacguaaccgucgcacacacgggacaacaugaucuagucauacccccaaacggauacuuucgauucgacucguggguaaaccaauucuacacacuggcacccaugggaaacggcaccggccgccgccgcgcccucuaa

SEQ ID NO: 37392 - RNA, 1623 nt, Artificial Sequence
  derived and/or modified sequence opt11 from major_capsid_protein__Norovirus__AFU92703
augaaaauggccuccaacgacgccaacccaucagacggcucagcagccaaccuuguccccgagguuaacaacgaagucauggcacuagaacccguagucggagccgcaauagccgcccccgucgccggccaacagaacgucaucgaccccuggauacguaacaacuucguccaggcccccggcggcgaauuuaccguuucaccccgcaacgcccccggagaaauccucugguccgccccucuuggcccggaccuaaaccccuaccucucccaccuagcccgcauguacaacggguacgccggcggcuucgaaguccaggucauccuagcaggcaacgcauucaccgccggcaaaaucaucuucgccgccgucccucccaacuuccccacagaaggccuaucccccucccaagucacgauguucccccacaucauagucgacgugcgccagcuagaaccaguacuaauaccccuuccagacguucgcaacaacuucuaccacuacaaccaauccaaugacucuacaauaaaacucaucgccaugcucuauacaccccuucgagccaacaacgcaggcgaagacgucuuuaccguaucaugccguguccucacccgaccuucacccgacuucgacuucaucuuccucgucccucccaccgucgaaucccguacaaaacccuucaccguccccauccuuaccgucgaagaaaugaccaacagccgauuccccaucccacuagaaaaacuuuucaccggacccuccuccgccuucgucguacaaccacaaaacggucgauguaccaccgacggcguccuacuaggaaccacccaacuaucacccgucaacaucugcacauuccgaggagacgucacccacaucgcaggcucccgcaacuacaccaugaaccuagccucccucaacuggaacaacuacgaccccaccgaagaaaucccagcaccccucggcacucccgacuucguaggaaaaauucaaggcaugcucacacaaaccaccaaaggcgacggcucuacucgcggccacaaagccacaguuuacaccggauccgccccauucacacccaaacuaggcucuguacaauucucaaccgacaccgaaaacgacuucgaaacccaccaaaacacaaaauucaccccagucggcguaauccaagacggcuccaccacccaccgaaacgaaccccagcaauggguccuccccuccuauuccggacgcaacguccagaacguccaccuagcacccgccguagcaccaacauuuccaggcgaacaacuacucuucuuccgauccaccaugcccgguugcuccggauacccuaacauggaccucgacugcuuacucccccaagaauggguccaacacuuuuaucaagaagcagccccagcccaauccgacgucgcccuucuaagguucguaaacccugacacaggacgcguccucuucgaaugcaaacuccauaaauccggauacgucaccgucgcucacacaggacaacaugaccucguuauucccccaaacggauauuuucgcuuugacuccugggucaaucaauucuacacccuagcccccaugggcaauggaaccgggcgccgccgugcgcucuaa

SEQ ID NO: 37393 - RNA, 1623 nt, Artificial Sequence
  derived and/or modified sequence opt11 from major_capsid_protein__Norovirus__AFU92704
augaagauggccucauccgacgccaaccccucagacggauccaccgcacaccucguccccgaagucaacaacgaagucauggcucuagaaccuguagucggcgcagcaauagccgcaccagucgccggccaacaaaacgucaucgaccccuggauccgcaacaacuucguacaagcccccgguggcgaauuuaccgucucaccccgaaacgcccccggagaaauccucuggucagcuccccuuggacccgaccucaaccccuaucuaucccaccuagcccgaauguacaacgguuacgccggaggauucgaaguccaagucauccuagcaggcaacgccuuuacagccggcaaaaucaucuucgccgccguaccaccaaacuuucccaccgaaggacuuucacccucccaagucaccauguucccccacaucaucguagacguccgccaacucgaaccagucuuaaucccccuacccgacguacgcaacaacuucuaccacuacaaucaauccaacgaccccacaaucaaacuaaucgccaugcucuacacccccuuacgagcgaauaacgcgggugacgacguauucaccguaucaugucgaguacucacccgacccucccccgacuucgacuucauauuccuaguaccacccaccguagaaucucgcaccaaacccuucucaguccccguccuaaccguagaggaaaugaccaacucgagauuccccaucccccuagaaaaauuauucaccggaccaucauccgcauucguaguacaaccccaaaacggacgcugcacaaccgacggcguacuacuuggcaccacccaacuaagccccgucaacaucugcaccuuccgaggagacgucacccacauaccaggaagucgaaacuacacuaugaaccucgccucacaaaauuggaacuccuacgaccccacugaagaaauccccgcccccuugggaacacccgacuucgucggcaaaauccaaggcguccucacccaaaccacccguaccaacggcuccacccgaggccacaaagccaccguauacaccggcucugcagacuucucucccaaacuaggacgcguacaauucgccaccgacacugacaaugauuucgaaaccaaccaaaacacaaaauucacccccgucggcgucauccaagacggcuccaccacaccccgcaaugaaccccaacaauggguccuaccaagcuacucaggccgcaacauccacaacguccaccucgccccagcagucgcaccaaccuuccccggagaacaacuccucuucuuccgcucaaccaugccaggcugcucuggcuacccaaacauggaccuugacugccuccuaccccaagaauggguacaauauuucuaccaagaagccgccccagcacaauccgacgucgcacuccuacgcuucgugaaccccgacaccggccgcguucucuucgaaugcaaacuccacaaaagcggcuacgucaccguagcccacaccggccaacacgaccucguaauaccacccaacggcuacuuccgauucgacucauggguuaaucaauucuacacacuagcacccaugggaaacggcaccggccgccgccgcgcccucuaa

SEQ ID NO: 37394 - RNA, 1623 nt, Artificial Sequence
  derived and/or modified sequence opt11 from major_capsid_protein__Norovirus__AFU92705
augaaaauggcauccaacgacgccaaccccuccgacggcagugccgccaaccucguacccgaggucaacaacgaagucauggcccuagagcccgucgugggagcagccaucgcagccccaguagccggucaacaaaaugucaucgacccauggauccgcaacaacuucguacaagcacccggaggcgaauuuaccgucucaccccgcaacgcucccggcgaaauacucugguccgccccacucggccccgaccuaaacccauaccucucccaccucgccagaauguauaacgguuacgcaggaggauuugaaguccaggucauucuagccggaaacgccuucacagccggcaaaauaaucuucgccgcagucccacccaacuuuccaacagaaggccucagccccagccaaguaaccauguucccccacaucauagucgacguacgacaacucgaacccgucuuaaucccccucccugacguacgcaauaauuucuaccacuacaaccaauccaacgacagcaccauuaaacuaaucgccaugcucuauaccccucucagagcaaacaacgccggcgaagacguuuucacgguaucaugccgcguacucacacgaccaucacccgacuucgacuucauuuuccucguaccacccacagucgaaucacgaaccaaaccauuuacgguccccauccucacagucgaagaaaugacuaacucccgauucccgauuccccucgaaaaacuauucacaggcccauccggagcuuucgucguccaaccucaaaacggccgaugcaccacagacggcguacuacucggcacaacccaacuaucaccagucaacaucugcaccuuccgcggcgacgucacccacauagccggcucacgcaacuacaccaugaaccuagccucacuaaacuggaacaacuacgaccccacugaggaaauccccgcaccacuugguacccccgacuucgucggcaaaauacagggcguacucacccaaaccacaaagggagacggcuccacacgcggacacaaagccacagucuauaccggcuccgcccccuucacccccaaacuaggcuccguucaauucuccacggacacagaaaacgacuucgaaacccaccaaaacaccaaauucacuccaguaggggucauccaagacggauccaccacccaccgcaacgaaccccaacaauggguccuccccuccuacuccggacguaacguccacaacguacaccucgcccccgcagucgcccccacauucccaggagaacaacuccucuucuuccgaucaaccaugcccggaugcuccggcuaccccaacauggaccucgacugccuccucccccaagaauggguacaacacuucuaccaagaagcggcccccgcacaauccgacgucgcucuauuacgauucguaaacccugacacaggccgcguacuauuugaaugcaaacuacacaaaucaggauacgucacugucgcccacaccggucaacacgaccuaguaauacccccuaacggauacuuccgcuucgacucaugggugaaucaauucuacaccuuagcccccaugggaaacggcacuggccgccgccgagcacuauaa

SEQ ID NO: 37395 - RNA, 1623 nt, Artificial Sequence
  derived and/or modified sequence opt11 from major_capsid_protein__Norovirus__AFU92706
augaaaauggccucaucagacgcaaaccccucugacggcuccacagcuaaccuaguacccgaagucaacaacgaagucauggcccucgaacccguaguaggcgccgccaucgccgcaccaguagccggccaacaaaacgucaucgaucccuggauucgcaacaacuucguacaagccccaggcggugaguucacagucucaccucgcaacgcccccggcgaaauacuaugguccgcaccccuaggccccgaccuaaacccauaccuaucccaccucgcccgaauguacaacggauacgccggcggcuucgaaguccaaguaauacucgcaggaaacgccuucaccgcaggcaaaauaaucuucgccgcaguucccccaaacuucccaaccgaaggacucuccccgucgcaaguaacaauguucccccacaucaucguagacguccgucaacuagaacccguccucaucccccugcccgacguacgcaacaacuucuaccacuauaaccaauccaacgaccccaccaucaaacucaucgccaugcucuacaccccucuaagagcgaacaacgcaggcgacgacgucuucaccgucaguugccgcguacucacacgcccaucccccgacuuugacuucauuuucuuaguacccccaaccguagaaucaaggacaaaacccuucuccgucccaguacuaacagucgaagaaaugacaaacucccgauucccuaucccccucgaaaaacucuucacuggcccauccuccgccuucguuguccaaccucaaaacggccgcuguaccaccgacggcguacuucucggcaccacccaacuaucccccgugaacaucugcaccuuucgcggcgacgucacucacauccccggaucccgcaacuacacuaugaaccucgcaucccagaacuggaacuccuacgaccccaccgaagaaauaccagcuccccuaggcacacccgauuuugucggcaaaauccaaggcguacuaacccaaaccacacgcacgaacggcuccacacgaggccacaaggccacgguauacaccgguucggccgacuuuucaccaaaacuaggccgcguccaauucgccaccgacaccgacaacgacuucgaaaccaaccaaaacacgaaguuuaccccagucggcgucauccaagacggcucaaccacuccacguaacgaaccucaacaauggguccuccccagcuacuccggccgcaacauccacaacguacaccucgcacccgcaguagcccccaccuuccccggagaacaacuccucuucuuccgcuccaccaugccuggcugcucaggcuaccccaacauggaccucgacuguuuacucccccaagaauggguacaauacuucuaccaagaggccgcccccgcccaauccgaugucgcacuacuaagauucgucaacccagacacaggccgcguacucuucgaaugcaaacuccacaaaucuggcuaugucacagucgcccacacaggccaacacgaccucgucauacccccaaacggcuacuuccgcuucgacucaugggucaaccaauucuacacucucgccccaaugggcaacggaaccggccgccgccgugcccucuaa

SEQ ID NO: 37396 - RNA, 1623 nt, Artificial Sequence
  derived and/or modified sequence opt11 from major_capsid_protein__Norovirus__AFU92707
augaaaauggcaucuucagacgccaauccauccgauggcuccaccgcaaaccucguccccgaagucaacaacgaagucauggcacuagagcccgucguaggagccgcaaucgccgcccccguagccggccaacaaaacgucauagaucccuggauccgaaauaacuucguacaggcccccggcggcgaguucaccguaucaccccgcaacgcucccggagaaauccucugguccgcaccccucggccccgaccucaauccauaccucucucaucuagcccgaauguauaacggauacgccggcggauucgaaguccaaguaauccucgccggcaacgccuucacagccggaaaaauaaucuuugccgcugucccucccaacuuccccaccgaagggcucucccccucgcaaguaaccauguucccacacaucaucgucgacguccgccaacucgaacccguccucaucccccugccugacguacgaaacaacuucuaucacuauaaucaauccaacgauccaaccaucaaacuaaucgccaugcucuauacaccccucagagcgaacaacgccggugacgacgucuucaccguauccugccgcguccucacacgccccucccccgacuucgacuucauauuccucguaccacccaccguagaaucacgaaccaaaccauucuccguacccguucuaaccgucgaagaaaugaccaacucacgcuuccccaucccauuagaaaaacuauucacaggcccuucuucagccuucguuguccaaccccaaaacggccgcugcaccaccgacggcgugcuacucggcaccacacaacucagucccgucaacaucuguacuuuccgcggcgacgucacccacauccccggcucccguaacuacaccaugaaccucgccagccaaaacuggaacuccuacgacccaaccgaagaaauccccgcuccucucgggaccccagacuucgucggaaaaauccaaggcguccucacccaaacaacccgaaccaacggcuccacacgcggccacaaagccaccguauauaccgguuccgccgacuucucccccaaacucggccgcgucgaguucgcuacagauacagacaacgacuucgaaacuaaccaaaacaccaaauucacccccgucggugucauccaagacggcucaaccaccccucgcaacgaaccucaacaauggguccuaccaagcuacuccggacguaacauccacaacguccaccuugcccccgcgguagcgccuacuuuucccggcgaacaacuccucuucuuccgcuccacaaugcccggcuguuccggcuaccccaacauggaccucgacugccuacucccccaggaauggguacaauacuucuaccaggaagcagcaccagcccaaucugacguagcccugcuccgauuugucaaccccgauacuggcagaguacucuucgaaugcaaacuccacaaaucuggcuaugucaccguagcccacaccggacaacacgaccucgucaucccacccaacggauacuuccgcuucgacucaugggucaaccaauucuacacacucgcacccauggguaacggcacagggaggcgccgcgcacuauaa

SEQ ID NO: 37397 - RNA, 1623 nt, Artificial Sequence
  derived and/or modified sequence opt11 from major_capsid_protein__Norovirus__AFU92708
augaaaauggcuuccaacgacgccaaccccuccgacggcucggcugccaaccuagucccugaagucaacaacgaggucauggcacucgaaccagucgucggcgcugcaauagccgcaccagucgccggacaacaaaaugucauagauccauggauucgcaacaacuucguccaagcucccggcggcgaguucaccgucucuccccgcaacgcccccggagaaauccucugguccgccccucuaggccccgaucucaacccauaccuaagccaucuagcccguauguacaacggauacgccgguggcuucgaaguacaagucauacucgccggcaacgccuucaccgcagguaaaauuauauucgccgccgucccaccaaacuuccccaccgaaggccucucccccucucaaguuacaauguucccccacauaaucgucgacguacgacaacuggaacccguauuaauaccccuccccgacguccggaacaacuucuaccacuacaaccaauccaacgacuccaccaucaaacucauugccaugcucuacacaccacuccgcgccaacaacgcaggagaagauguauucaccguauccugcagaguccucacucgccccucacccgauuucgacuucauauuccuagucccucccaccgucgaaucccgcaccaaacccuucaccguccccauccucaccguugaagaaaugaccaacucccgguuccccauaccccuagaaaaacucuucacgggccccucaggcgcauucguuguccaaccacaaaacggccgcugcaccaccgacggcguccuucuuggcaccacccaacucuccccuguaaacauaugcaccuuccgcggagacgucacacacaucgccgggucuagaaauuacaccaugaacuuagccgcccucaacuggaauaacuacgacccuacagaagaaaucccagcaccccucggcacacccgacuucgucggaaaaauccagggcguacucacccaaaccaccaaaggcgacggauccaccagaggucacaaagccaccguauacaccggcuccgcagacuucacaccaaaacuaggcuccguacaauucucaaccgauaccgaaaaugacuucgaaacucaccaaaacacaaaauucaccccagucggcgucauacaagacggauccaccacacaccgcaacgaaccccaacaauggguacuccccuccuacucuggccgaaacguccacaacguacaucuagcccccgccgucgcccccacauuccccggcgaacaacuucucuucuucagauccaccaugcccggcugcuccggcuaccccaacaugaaccuugacugccugauaccucaagaauggguacaacacuucuaccaagaagccgcccccgcccaaucugacguugcacuccuacgcuucguuaacccagauacuggccgcguccucuucgaaugcaaacuucacaaauccggcuacguaacagucgcccacaccggacaacacgaccuagucaucccgcccaauggcuacuuccgcuucgacuccugggucaaccaauucuacacucuagcccccaugggaaacggagccggccgcagacgcgcgcucuaa

SEQ ID NO: 37398 - RNA, 1623 nt, Artificial Sequence
  derived and/or modified sequence opt11 from major_capsid_protein__Norovirus__AFU92709
augaaaauggccuccuccgacgccaaccccucugacggcucaaccgcaaaccucgucccagaaguaaacaaugaggucauggcccucgaacccguagucggcgccgccaucgcugcccccgucgccggacagcaaaacguaauagaccccuggauccgcaacaauuucguccaagcgccaggcggagaauuuacaguauccccacgcaacgcacccggagaaauccucugguccgccccacucggcccagaucugaacccauaccucucucaccuagcacgaauguauaacggcuacgccggcggcuucgaaguacaaguaauucucgccggcaacgccuuuaccgccgguaaaauaauauucgccgccgucccacccaacuucccaacagaaggccuaucccccucccaaguaaccauguucccacacaucaucgucgacguccgccaacuagaaccaguccucaucccacuuccugacguccgaaacaacuucuaccacuacaaccaauccaacgacccaaccauaaagcucaucgcuaugcuauacaccccacuacgagccaacaacgccggcgaugacgucuucacagucagcugccgaguccucacccgcccaucccccgacuucgacuucauauuccucguuccucccaccgucgaaucccgaaccaaaccuuucuccguccccguccucaccguagaggaaaugacaaacucacgcuucccaaucccccucgaaaaacuauucaccggucccuccuccgcauucgucguccaaccccaaaauggacgaugcaccaccgacgggguccuccuagggaccacccaacuuucccccgucaacauaugcacuuuucgcggcgacgucacccacauccccggaucaagaaacuacacaaugaaccucgccagccaaaauuggaacuccuacgaccccaccgaagaaauccccgcaccccucggcacaccagacuuugucggaaaaauccaaggcguccuaacccagaccacccgcaccaacggauccacccgaggccacaaagccaccgucuauaccggauccgcugacuucucacccaaacucggccgcguccaauucgcaaccgacaccgauaacgauuucgaaacuaaccaaaacaccaaauucacccccguaggcguuauccaagacggcuccaccacaccccgcaacgaaccccaacaauggguccuacccucauacucggggcgcaauauccacaacguacaccuagccccugccguagcccccaccuucccaggcgaacaacuccucuucuuuagaucaacaaugccaggcugcucaggcuaccccaacauggaccucgacugccuccuaccccaagaauggguccaauauuuuuaccaagaagccgcccccgcacaauccgacgucgcucuccuacgcuucguaaaccccgacaccggccgcguccucuucgaaugcaaacuccacaagucuggauacguuaccgucgcucacacuggccaacacgaccuagucaucccacccaacggauacuucagauucgacucaugggucaaccaauucuacacccuugcacccaugggcaacggcaccggcagacgccgcgcccucuaa

SEQ ID NO: 37399 - RNA, 1623 nt, Artificial Sequence
  derived and/or modified sequence opt11 from major_capsid_protein__Norovirus__AFU92710
augaaaauggccuccucagacgcaaaucccuccgacggcuccaccgccaaccucguccccgaagucaacaacgaagucauggcucuagaaccagucgucggugccgcuaucgcagcacccgucgcaggccaacaaaacgucaucgaccccuggauacgcaacaacuucguucaagccccaggcggcgaguucacagucuccccucgcaacgccccuggcgaaauccuuugguccgcaccccuaggaccugaccucaacccauaucucucacaccuagcccgcauguacaacggcuacgccggaggcuucgaaguccaagucauccuagccggaaacgccuucaccgcagguaaaauuaucuucgccgccgucccacccaacuuccccacagaaggacucucacccucccaaguuaccauguucccccacaucauagucgacgugcgucaguuagaacccguacucauuccccuccccgacguccgcaacaacuucuaccacuacaaccaauccaacgaccccaccaucaaacuaaucgccaugcuuuacacaccccuacgcgccaauaacgccggcgacgaugucuuuaccguaucaugccgcguacucacacgccccucccccgacuucgacuucaucuuccucguucccccuaccguugaaucaagaaccaaacccuucuccguuccuguccucacagucgaagaaaugacuaauucccgcuuccccaucccacuagaaaaacucuucaccggccccucauccgcauucguaguccaaccucagaacggccguugcaccaccgacggcguccuucuaggcaccacacaacuaucccccgucaacaucugcaccuuccgaggcgacguuacccacauacccgggucccgcaacuacacaaugaaccuagccucacaaaacuggaacucauacgacccaaccgaagaaauacccgcaccccucggaacccccgacuucgucgguaagauacaaggagugcucacccaaaccacccgcaccaacggcuccacccgaggccacaaagccaccguauacaccggcucagccgacuucuccccaaaacucggcaggguacaauucgccacagacaccgacaacgacuucgaaaccaaccaaaauacaaaauucacccccguuggagucauacaagacgguagcaccacaccccgaaacgaaccacaacaauggguacugccuuccuacuccggccgcaacauccauaacguccaccucgccccugccgucgccccaaccuuccccggcgaacaacuacucuucuuccgcucaacaaugcccgguuguuccggcuaccccaacauggaccucgacugccuacucccccaagaauggguacaauacuucuaccaagaagccgcucccgcccagucugacguagcccuacuacgcuucgucaaccccgacacaggucgcguccuauucgaaugcaagcuacacaaaucuggauacgucacagucgcacacacaggacaacaugaccucgucaucccucccaacgguuacuuccguuucgacucaugggucaaccaauucuacacacucgcucccaugggcaacgguaccggccgccgccgagcccucuaa

SEQ ID NO: 37400 - RNA, 1623 nt, Artificial Sequence
  derived and/or modified sequence opt11 from major_capsid_protein__Norovirus__AFU92711
augaaaauggccucaucugacgcuaaccccagcgacggaucuaccgccaaccuuguccccgaaguaaacaacgaagucauggcacuagaaccaguagucggcgccgcaauagccgccccugucgcgggccaacaaaacgucauugaccccuggauccgcaauaacuucguccaagccccuggcggcgaguucaccgucucaccacgaaacgcccccggcgaaauauuguggucagccccacucggccccgaccucaaccccuaccucucccaccucgcccgcauguacaacggcuacgcaggcggcuucgaaguucaaguuauacucgcagguaaugccuucaccgccggaaagaucauauucgccgccgucccacccaacuuccccaccgaaggccucuccccuucccaagucaccauguucccacauaucaucguagacguccgccaacuagaacccguacucauaccccuaccagacguccguaacaacuucuaccacuacaaccaaagcaacgaucccacaauuaaacucaucgccaugcucuacacaccccuacgagcaaacaacgccggagacgacguuuucacaguauccugccgaguccucacucgcccaucccccgacuuugacuuuaucuuccuagugcccccuaccgucgaaucccgcacaaagcccuucucagucccaguccuaaccgucgaggaaaugacuaauucacgauuccccauaccucucgagaaacucuucacuggcccuuccuccgccuucgucguacaaccccaaaacggucgcugcacgaccgacggcguccuacucggaacaacccaacucagccccgucaacaucugcaccuuccgcggagacgucacacacaucccaggcucccgaaacuacaccaugaaccucgccagccaaaacuggaacucguacgaucccaccgaagagauaccagcaccccuaggaacccccgacuucgucggaaaaauacaaggcguccucacacaaaccacacgcaccaacggauccacccgaggccacaaagccaccgucuacaccggcuccgcugacuucucacccaaacuaggccgaguccaauuugccaccgacacagacaacgauuucgagaccaaccaaaauaccaaauucacccccguuggcgucauccaagacggaagcaccacaccccgcaaugaaccacaacaguggguccuccccuccuacucgggccgaaacauccacaacguacaccucgcccccgccguugcccccacauuucccggagaacaacuccucuucuuucgcucuacaaugccgggaugcuccggauacccaaacauggaccucgacugccuccucccacaagaauggguucaauacuucuaccaagaggcugcccccgcccaguccgacgucgcauuacuacgauucgucaauccagacacuggccgcguccuauuugaaugcaaacuccacaaguccggcuacgucaccguagcccacacaggccaacacgaccuuguaaucccucccaacggauacuuuagauucgacuccuggguaaaccaauuuuacacgcuagcgcccaugggaaacggcacuggccgacgccgagcccuauaa

SEQ ID NO: 37401 - RNA, 1623 nt, Artificial Sequence
  derived and/or modified sequence opt11 from major_capsid_protein__Norovirus__AFU92712
augaaaauggccucaaaugacgcuaaccccuccgaaggauccgccgccaaccucgucccagaaguaaacaacgaaguuauggcacucgaacccgucgucggcgccgccaucgccgcccccguugccggccaacaaaacguaaucgaccccuggauacgaaacaacuucguccaagcuccuggcggcgaguucaccgucucaccccgcaaugcacccggaaccauccgcugguccgcaccacuaggccccgaccucaacccauaucucucacaccucgcucgcauguacaacggcuacgcaggcggcuucgaaguccaagucauccuagccggcaacgcauucaccgcaggcaaaauaauauucgcugcaguacccccaaacuuccccacugaaggccuaucacccucccaagucaccauguucccacacaucauuguugacguccgacagcuagaacccguacuuaucccccucccagauguccgcaacaacuucuaccacuacaaccaauccaaugauucaacaaucaaacuuauugccaugcucuauacaccccuccgggccaacaacgcaggcgaagacgucuucaccgucuccugccgcguacucacccgcccaucgcccgacuucgacuucaucuuccuugucccaccuaccgucgaaucacgcaccaaaccauucaccguccccauccucaccgucgaagaaaugaccaacucucgauucuccaucccacucgaaaaacucuucaccggccccuccggcgccuuugucguucaaccacaaaacggcagaugcaccacagacggcguccuccuaggcacaacccagcucagcccagucaacaucugcacauucagaggcgacgucacccacaucgcugggucccgaaacuacaccaugaaucucgccgcccucaacuggaacaauuacgauccaacugaagaaauccccgccccacuaggcaccccagacuucgugggcaaaauucaaggcguucucacccaaaccaccaaaggagacggcucaacccgaggccacaaagccacugucuauacaggauccgcugacuucaccccaaaacucggcuccguccaauucucaaccgacacagaaaacgacuucgaaucccaucaaaacaccaaauucaccccugucggaguuauccaagacggcagcacaacccaccggaacgaaccacaacaauggguacucccaagcuacuccggccgcaacguucacaacguccaccuagcaccggccguugcccccacauuccccggugaacaacuacuauucuuccgauccaccaugccaggaugcuccggcuaccccaacauggaccuagauugccucaucccccaagaauggguccaacacuucuaucaagaagccgcccccgcccaauccgacgucgcucuccuccguuucgucaacccagacaccggacgcguacucuucgaaugcaaacuacacaaaucagguuacgucaccgucgcccacacuggucaacacgaccugguaaucccacccaauggauacuuuagauucgacaguugggucaaccaauucuacacccucgcaccuauggguaacggcgccggucgccgccgcgcccucuaa

SEQ ID NO: 37402 - RNA, 1623 nt, Artificial Sequence
  derived and/or modified sequence opt11 from major_capsid_protein__Norovirus__AFU92713
augaaaauggccucgucagacgccaaccccuccgacggauccacagccaaccuaguccccgaagucaacaacgaagucauggcacucgaaccaguagucggcgcagccauagcagcccccgucgccggccaacaaaacgucaucgaccccuggaucagauccaacuucgugcaagcaccuggcggcgaguucacaguaagcccucgcaacgcacccggagaaauacuguggucugccccacuagggccggaccuaaacccauaccuuucccaccuugcaagaauguacaacggauacgccggcggcuucgaaguccaagucauccucgccggcaacgcauucaccgccggaaaaauaaucuucgccgccguuccacccaacuuccccaccgaaggccucucccccucccaagucaccauguucccccacauaaucgucgacguucgccaacucgaaccaguccuaaucccccuuccagacguccgcaacaauuucuaccacuacaaccaaucgaacgaccccaccaucaaacuaaucgccaugcucuacacaccccuacgagcaaacaacgccggcgacgacgucuucacugucucaugccgcguucuaacccgaccaucccccgacuuugacuucaucuuucucgucccucccacaguagaaucccgcacaaaacccuucuccgucccaguacuuacugucgaagaaaugacaaacucgcgcuucuccaucccacucgaaaaacuauucacaggccccuccuccgccuucgucguccaaccacaaaacggccgaugcacaacagacggagucuuacucggcaccacacaacucagccccgucaauaucugcacguuccgaggcgaugucacacacaucccagguucacgcaacuacaccaugaaccuugccucccagaauuggaacuccuacgaccccaccgaagaaauccccgcgccucucggaacccccgacuucgucggaaaaauccaaggaguucucacacagaccacccgcacaaacggcuccaccagaggacacaaagccaccgucuacacaggcuccgccgacuucucccccaaacucggccgcguccaauuugcaaccgacacagacaacgacuucgaaaccaaccaaaacacaaaauucacccccgucggcguaauacaagacggcucaacaacaccccgcaacgaaccccaacaauggguccuccccuccuacagcggacgcaacauccacaacguccaccucgccccagccguagcucccaccuuccccggagaacaacuacuauucuuccgcuccaccaugcccggcugcagcggauaccccaacauggaccuagacugccuacuuccacaagaauggguacaauacuucuaccaagaagccgcccccgcacaauccgacgucgcccuccuccguuucgucaaucccgacaccggcagaguacucuucgaaugcaaacuacacaaaucuggauacgucaccgucgcccacaccggccaacacgaccucgucauaccucccaacgguuauuuccgcuucgacuccugggucaaccaauucuacacacuugcccccaugggcaacggaacaggacggcgccgcgcccuguaa

SEQ ID NO: 37403 - RNA, 1623 nt, Artificial Sequence
  derived and/or modified sequence opt11 from major_capsid_protein__Norovirus__AFU92714
augaaaauggcuuccucugacgccaaccccagcgacggcuccaccgccaaccucguuccagaaguuaacaacgaagucauggcccuagaaccagucguaggcgccgccaucgccgcccccgucgcaggccaacaaaaugucaucgacccauggauacgcaacaacuucguccaagcaccaggcggcgaguucacaguuagcccacgcaacgccccaggcgaaauauuauggagcgcaccccucggccccgaccucaacccauaccucucccaccucgcccgcauguacaacggauacgccggcgguuucgaaguacaaguaauccuagcaggaaacgcuuuuaccgccgguaaaaucaucuucgccgccgucccacccaacuuccccacagaaggccucucccccucacaagucaccauguucccccacauuauaguagacguccgacaacuagagccaguacuuauaccccuacccgacguacgaaauaacuucuaccacuacaaccaauccaacgacccuaccaucaaacuaauugcaauguuauacacuccccuccgcgccaacaacgccggcgaugacguuuucaccgucuccugucgaguacucacccgccccucaccugacuucgacuucaucuuccuagucccacccaccgucgaaagccgaacuaaacccuucuccguccccguacuaaccgucgaagagaugaccaacucacgauuccccaucccccuagaaaaacucuucaccggacccuccucagcauucguaguccaaccccaaaacggccgcugcaccacggacggcgucuuacuuggcaccacacaauuaucccccgucaacaucugcacauuccgcggagaugucacacacauccccggcucccgaaacuacacuaugaaccucgccucgcaaaacuggaacucauacgaccccaccgaagagauccccgcaccccucggcacgcccgacuucgucggcaaaauccaaggcguccucacucagacaacacgcacaaauggcagcacccgcggccauaaagccaccgucuacaccgguuccgccgacuucucacccaaacuaggcagaguccaauucgccaccgacaccgacaaugacuucgaaaccaaccaaaacacaaaauucacuccagucggcgucauacaagacggcucaaccaccccacgaaacgaaccccaacaauggguccucccauccuacuccggccgcaacauccacaacguacaccuagccccagccgucgcccccaccuuccccggcgaacaauuacuuuucuuccgcucaaccaugcccggcugcuccggauaccccaacauggaccucgauugccuucucccacaagaauggguucaauacuucuaccaagaagccgcccccgcacaauccgacgucgcccuccuccgauucgucaacccugacaccggccgcguccucuucgaaugcaagcuccacaaaucaggauauguaacugucgcacacacaggucaacacgaccucgucauacccccaaacggcuacuuccgcuuugacuccugggucaaccaauucuauacccuugccccaaugggcaacggcacaggcagacgccgcgcccuauaa

SEQ ID NO: 37404 - RNA, 1623 nt, Artificial Sequence
  derived and/or modified sequence opt11 from major_capsid_protein__Norovirus__AFU92715
augaaaauggccuccuccgacgccaaccccuccgauggcuccaccgcaaaucucgugccagagguaaacaacgaagucauggcccucgaacccguugucggagcugccaucgccgccccagucgcuggacaacaaaacguuaucgaccccuggauccguaacaacuucguccaagcaccagggggagaguucaccgucucaccccgcaacgccccaggcgaaaucuuaugguccgcaccccucggccccgacuuaaaccccuaccucucccaccucgcccguauguacaacgguuacgccggaggcuucgaaguccaaguuauccuagccggcaacgccuucacagccggcaagauaaucuucgcagccgucccaccaaacuuccccaccgaaggccucagccccucacaaguaaccauguucccacacaucaucgucgacguucgccaacucgaaccaguccuaauaccccucccagacguccgaaacaacuucuaccacuacaaccaaucaaaugaccccaccaucaaacuuauagccaugcucuacaccccgcuccgcgcaaacaacgccggugacgacgucuucaccgucuccugucgcguucuaacaagacccucccccgacuucgauuucaucuuccucgugccaccuaccgucgaaucccgcaccaaaccauucuccguucccguccucaccgucgaagaaaugaccaacagccgauucucaauaccccucgaaaaacuauucaccggacccucgucagcauuuguaguacaaccccaaaacggccgcugcaccacugacggcguacuacuaggaacaacccaacucucacccgucaacauaugcaccuuccgaggcgacgucacacacaucccgggcucccgaaacuauacaaugaaccuagccucacaaaacuggaacucuuacgacccaaccgaagaaaucccagcaccccuaggaacccccgacuuuguaggcaaaauccaaggcguccuuacccaaaccacacgcacaaacggcucaacaagaggccacaaagccaccgucuacaccggaucagccgacuucucgcccaaacucggccgcguccaauucgcaaccgacacagauaacgacuucgaaaccaaccaaaauaccaaauucaccccagucggagucauccaagacggcuccaccacccccagaaacgaaccucaacaauggguacucccaagcuacuccggccgcaacauccacaacguccaccucgcccccgcagucgccccaacauucccaggcgaacagcuccucuucuuccgcuccaccaugcccggaugcagcggauaucccaauauggaucucgacugccuccucccccaagaauggguccaauauuucuaccaagaggccgcgccagcccaauccgacgucgcccuucuccgauucguuaaccccgacacgggccgcguccuuuucgaaugcaaacuucacaaaucaggcuauguaaccguagcccacacaggacaacacgaccucgugaucccaccuaacggcuacuuccgauucgacucauggguaaaccaauucuacacacucgccccaaugggcaacggaacaggccgccgccgagccuuauaa

SEQ ID NO: 37405 - RNA, 1623 nt, Artificial Sequence
  derived and/or modified sequence opt11 from major_capsid_protein__Norovirus__AFU92717
augaaaauggccucauccgaccccaaccccucagacggcuccaccgcaaaccucguacccgaaguaaacaacgaagucauggcacuagaaccagucgucggcgccgcaaucgcagcccccguagccggccaacaaaacgucauagaccccuggauuaggaacaauuucguacaagccccaggcggcgaguucaccguaucuccccgcaacgcaccuggagaaauccucugguccgcaccccuuggccccgaccuaaacccauaucucucccaucuugcccgaauguacaauggcuacgccggcggauucgaaguccaagucauccucgccggcaacgcuuucacugcaggaaaaauaaucuuugccgccguaccacccaacuuccccaccgaaggccuaucuccaucccaagucacaauguucccacacaucaucgucgacguccgccaacucgaacccguccuaauaccacuacccgacguacgcaacaacuucuaccacuacaaccaauccaacgacucaaaacuaaaacuccgaccaaugcuauacaccccacuucgagcaaacaacgccggugacgacgucuucaccguauccugccgcguacuaacccgccccucucccgauuucgacuucaucuuccuggucccacccaccgucgaaucacgaacaaaacccuucagcguaccaguccuuacagucgaagaaaugaccaacucccgauuccccaucccccuagaaaaacucuucaccggaccguccuccgcguucgucguacaaccccaaaacggacgcugcacaaccgacgguguccugcuaggaaccacccaacucucccccgucaacauaugcaccuuccgcggcgacgucacacacauaccaggcucccgcaacuacaccaugaaccucgccucucaaaacuggaacucauacgacccaaccgaagaaauccccgccccacucggaaccccagacuucguaggcaaaauacaaggaguccucacucaaaccacgcgcaccaacggcucaacccgaggccacaaagccacagucuauaccggcucagcagacuucucaccuaaacucggccgcguacaauucgccacugacacggacaacgacuucgaaacuaaccaaaacaccaaauucacccccguaggcgucauacaagauggaucuacaaccccacgcaaugaaccccaacaauggguccuaccuucauauuccggccgcaacauccauaacguucaccuagcccccgccgucgccccaaccuuccccggcgaacagcuacucuucuuccgcucaacaaugcccgguugcuccggauaccccaacauggaccuugacugccuccuuccccaagaauggguacaauacuucuaccaagaagcagcccccgcacaaucagacguagcccuucuccgcuucguaaauccagauaccggccgaguacucuucgaaugcaaacuccacaaaucaggcuacgugaccgucgcgcacaccggccaacacgacuuaguaauaccucccaacggcuacuuccgauucgacaguugggucaaccaauucuacacacucgcacccaugggcaacggaacaggacgccguagagcacucuaa

SEQ ID NO: 37406 - RNA, 1623 nt, Artificial Sequence
  derived and/or modified sequence opt11 from major_capsid_protein__Norovirus__AFU92718
augaaaauggccuccaacgaugcaaaccccucagacggaagcaccgccaaccucgugcccgaagucaauaacgaagucauggcccucgaacccgucgucggcgccgcuaucgccgcuccaguggccggacaacaaaacguaauagacccauggauacguaacaacuucguccaagccccuggcggcgaauuuaccgucucaccccgaaacgcccccggcgaaauacuuugguccgcaccccucggccccgaccuaaacccauaccucucacaccucgcccgaauguacaauggcuacgccggcggcuucgaaguccaagucauucucgcuggcaacgcuuucacugccggcaaaauaauuuucgccgcaguaccacccaacuucccuaccgaaggccucagccccucccaagucacaauguucccccacaucaucguagacguccgacaacucgaaccaguccucauuccucucccagauguacgcaacaacuucuaccacuacaaucaauccaaugacccaaccaucaaacucaucgccaugcucuacacaccacuacgagccaacaacgccggcgaugacgucuucaccguuuccugccgcguccuaacccgacccagccuagauuucgacuucaucuuccucgucccacccaccgucgaaucccgcacuaaacccuucagcguccccguccucaccguagaagaaaugacaaacagccgcuuccccaucccacucgaaaaacucuucaccggccccuccucagccuucguaguacaaccccaaaauggccgcugcacgacagacggcguacuacucggaaccacccagcucucaccagucaacaucugcaccuuccgaggagacguuauccacauccccggcucccgcaacuacacuaugaaccucgccucccaaaauuggaacucauacgaccccacagaagaaauacccgcuccccucggcacccccgacuucguaggcaaaauccaagguguccucacccaaaccacacgcaccaacggauccaccagaggacacaaagccacuguauacacaggcucugccgauuucuccccuaaauuaggccgaguccaauucgcaacagacaccgacaacgacuucgaaacgaaucaaaacaccaaauuuaccccagucggcgucauccaagacggauccaccacaccucgcaacgaaccccaacaauggguccucccaucauacuccggccgcaacauccacaauguacaccucgcccccgcaguagcccccaccuuccccggcgaacaacuccucuucuuccgaagcacaaugccaggcugcuccggcuacccaaacauggaccuagacugccuccucccacaagaauggguacaauacuucuaccaggaagccgcgcccgcccagucagacgucgcccuacuucgcuucguuaaucccgacacaggucgcguacuuuuugaaugcaaacuccacaaauccggcuacgugaccguagcccauaccggccaacacgaccuugucauaccgccaaacggcuacuuccgcuucgacuccugggucaaccaguucuauacccuugccccuauggguaacggaacaggccgacgccgagcccucuaa

SEQ ID NO: 37407 - RNA, 1623 nt, Artificial Sequence
  derived and/or modified sequence opt11 from major_capsid_protein__Norovirus__AFU92719
augaaaauggccucaaacgacgcuaaccccucugacggaucugcagccaaccucguacccgaagucaacaacgaagucauggcccuugaacccguaguaggcgcagcgaucgcagcaccagucgcaggacaacagaacgucaucgaccccuggauccgcaacaacuucguccaggccccaggcggcgaguucacugucagcccccgaaacgcccccggagaaauacucuggucggccccacuaggcccagaccuaaaccccuaccucagccaccucgcccgcauguacaacggcuacgccgggggauucgaaguccaagucauacucgcaggcaacgcauucaccgcaggcaaaaucauuuucgcagccguacccccaaauuuccccacagaaggccuaucccccucacaagucaccauguucccacacauaauaguagacgucagacaacuagaaccaguccuaaucccacuaccagaugucagaaacaacuucuaucacuauaaccaauccaacgacuccaccauaaagcucauagccaugcucuacacaccccuccgcgcaaacaacgccggcgaagacgucuucaccgucuccugccgcguccucacacgccccuccccagacuucgauuucauauucuuaguucccccaacaguagaaucccgaaccaaacccuucaccguacccauccucacaguagaagaaaugacaaacucacgauuccccaucccauuagaaaaacuauuuaccggccccuccagcgccuucgucguccaaccacaaaacggccgaugcacaaccgacggaguccuccugggaacaacacaacucagcccugugaacaucugcacauuccgaggcgacgucacacacauagccggaagcagaaacuacacuaugaaccuagcaucacuaaacuggaauaacuaugauccgaccgaagaaaucccagcgccacuaggcacccccgacuucgucggcaaaauccaaggcguccuaacacaaaccaccaaaggcgacggcagcacccgcggccacaaagcaaccguauauacaggcagcgccccauucacacccaaacuagguuccguacaauucucaaccgacaccgaaaacgacuucgaaacccaccaaaacacaaaauucaccccaguaggcgucauccaagacggcggcacaacccaccguaacgaaccucaacaauggguucuccccuccuacagcggccgcaacguccccaauguccaccucgcacccgcagucgcacccaccuuccccggcgaacaacuccuuuucuuccguucaacaaugcccggcugcucuggcuacccaaacauggaccuagacugccuccucccccaagaauggguccaacacuucuaccaagaagccgccccagcucaauccgacgucgcccuacuacgauucguuaaccccgauaccggucguguccuuuucgaaugcaaacuccacaaauccggcuacgucaccgucgcacacacaggccaacacgaccuagucauaccaccaaacggcuacuuccgcuucgauucaugggucaaccaauucuacacccuggcacccaugggaaacggcacuggacgacgcagagcucucuaa

SEQ ID NO: 37408 - RNA, 1623 nt, Artificial Sequence
  derived and/or modified sequence opt11 from major_capsid_protein__Norovirus__AFU92720
augaaaauggcaucuucugacgcucaccccucagacggcucaaccgccaaccuaguccccgaagucaacaacgagguaauggcccucgaacccguagucggagcugcaaucgccgccccaguagcaggccaacaaaacgugaucgacccauggauacguaacaacuucguccaagcccccggaggagaguucaccguaucaccucggaacgcccccggcgaaauacucugguccgcuccucucggccccgaccuuaaccccuaccucucacaccucgcccgcauguacaauggcuacgccggaggauucgaaguccaagucaucuuagccggaaacgcauucaccgccgguaaaaucauauucgccgccguaccacccaacuuccccaccgaaggccuuucuccaucacaagucaccauguucccucacauaauagucgacguacgccagcuagaacccguacucaucccccuucccgacguccgcaacaacuucuaccacuacaaccaauccaacgaccccaccaucaaacugaucgccaugcuauacacaccccuacgcgccaacaacgcaggcgacgacguauucaccgucucaugccgcguccucacccgccccuccccugacuucgacuuuauauuccuaguacccccuaccgucgaaucccguaccaaacccuucuccgucccaguccuaacagucgaagaaaugaccaacucacgauuccccauuccccucgaaaaacucuucaccggucccucauccgccuucgucguccaaccccaaaacggccgcugcaccacagacggcgucuuacuuggaaccacgcaacuuucacccgucaacaucugcaccuuccgaggugacgucacacacaucccaggcucucgcaacuacaccaugaaccucgcgucucagaacuggaacuccuacgacccaaccgaagaaauacccgcaccacucgguacccccgacuucguaggcaaaauccaaggcguacucacacaaacuacccgaacaaacggcuccacccgcggccacaaagcaaccgucuacaccggcuccgcagacuucucccccaaacucggccgcguccaauucgccaccgacaccgacaacgacuucgaaacaaaccaaaacaccaaauucacccccgucggagucauucaagacggcuccaccacccccagaaacgaaccccaacaauggguccucccaucauacuccggccgaaacauacacaacguccaccuagccccugccguagcccccaccuuccccggcgagcaacuacucuucuuccgcucuaccaugcccgggugcucuggcuaccccaacauggaccucgacugucuccuuccacaagaauggguacaauacuucuaccaagaagccgcacccgcucaauccgacguggcacuccuccguuucgucaacccagacaccggucggguccuauucgaaugcaaacuccauaaaucaggcuacgucaccgucgcccacaccggccaacacgaccuggucauacccccaaacggcuauuuccgcuucgacuccugggucaaccaauucuacacccuagcccccaugggcaacgguaccggccgacgacgcgcacuauaa

SEQ ID NO: 37409 - RNA, 1623 nt, Artificial Sequence
  derived and/or modified sequence opt11 from major_capsid_protein__Norovirus__AFU92721
augaaaauggcauccucagacgcucaccccuccgacggaucuaccgcaaauuuagucccagaagucaacaacgaagucauggcacuggaaccagucgucggagcggccaucgccgcuccaguagccggccaacaaaacguaaucgaccccuggauccgaaacaacuucguacaagcccccggaggcgaguucaccguaucuccccgcaacgcacccggcgaaauccucuggucggcaccacuaggccccgaccucaacccauaccucucccaccucgcacgaauguauaacggauacgcaggaggauucgaaguacaagucauccuagcaggcaacgcauucacugcagguaaaaucaucuucgccgcagucccaccgaacuucccaaccgaaggacucagucccucacaaguaaccauguucccacacauagucguagacguccgccaacucgaacccguacuaaucccccuacccgacguacgcaacaacuucuaucacuacaaccaauccaacgaucccacuaucaaacucaucgcaaugcuauacaccccacuccgcgccaacaacgccggcgacgaugucuucacugucucaugccgcguccucacccgccccucacccgacuuugacuucauauuccucguaccacccaccgucgaaucccgcaccaaacccuucucaguccccguccuaacaguagaagaaaugaccaacuccagguucccaaucccacuagagaaacuauucacuggucccagcuccgcauucgucguccaaccccaaaacggucgcuguacaaccgacggcguccuacucggcaccacacaacucucacccguaaacaucugcacauucagaggagacgucacccacauauccggcucccgcaacuacacaaugaaccucgccucacaaaauuggaacucauacgaccccaccgaagaaauacccgcaccccuuggcacacccgacuucgucggcaaaauacaaggcgugcucacccaaacaacccgcacagauggcuccacacgaggccacaaagccacagucuacaccggcucagcagacuucagccccaaacucggccgaguccaauucgcaacagacacagacaacgauuucguaacaaaccaaaacaccaaauucaccccaguaggagucauacaagacggcucuacaacccccagaaacgaaccccaacaauggguccugcccagcuauuccggccgaaacacccacaacguccaccuugcacccgccgucgcacccaccuuccccggagaacaacuccucuuuuuccgcuccacaaugccuggaugcucaggcuaucccaacauggaccucgacugccuccucccacaagaauggguccaauacuuuuaccaagaagcagccccugcccaaucagacguagcauuacuccgcuucgucaaccccgacaccggccgcguacucuucgaauguaaacuccacaaauccggauacgucaccgucgcacacaccggccaacacgaucucgucaucccacccaacggcuacuuccgauucgacucauggguaaaccaauucuacacccucgccccaaugggaaacggcaccggccggcgcagagcccuauaa

SEQ ID NO: 37410 - RNA, 1623 nt, Artificial Sequence
  derived and/or modified sequence opt11 from major_capsid_protein__Norovirus__AFU92722
augaaaauggcauccuccgacgcuaaccccucagacggcuccaccgccaaccuuguacccgaaguaaacaacgaagucauggcucuagaaccagucguaggagcagccaucgccgcaccagucgcuggccaacaaaacgucaucgacccauggaucagaaacaacuucguacaggcccccggcggcgaguucacugucagcccccgcaacgccccaggagaaauacucuggagcgcaccccucggccccgaccugaacccauaccucagccaccuagcacguauguacaacgguuacgccggcggcuucgaaguccaagucauacucgccggcaacgcauucacagcaggaaaaaucauauucgcugccgucccgcccaacuuucccacagaaggacucucaccgucccaggucacaauguucccccacaucaucguugacgucagacaacucgaacccguccucaucccccuuccagacguccguaacaacuucuaccacuacaaccaaucaaacgacccgacaaucaaacuaaucgccaugcucuacacaccccuccgcgcaaauaacgccggggaugacguauuuaccguauccugccgaguccucacacgccccucacccgacuucgacuucaucuuccucgucccacccaccguagaaucacgcaccaaaccauucuccguccccguccucacagucgaagaaaugaccaacagccgcuuccccauuccccucgaaaaacuauucacaggccccucuuccgcguuuauaguccaaccccagaacggucgcuguaccaccgacggaguccuucuaggcacuacacaacucucccccgucaacauaugcaccuuccgcggcgacgucacacacaucuccggcucacgcaacuacacuaugaaccucgccucacagaacuggaacuccuacgacccaacugaagaaaucccagcaccacuaggcaccccugacuucgucggcaaaauucaagguguccucacacaaacuacgcgcacagacgggucaacccgcggucacaaagccaccgucuacaccggaucagccgacuuuucccccaaacucggacgcguacaauucgcaacugacaccgacaacgacuucguaaccaaccagaauacgaaauucacccccgucggcguaauccaagacggauccacaaccccacgcaacgaaccccaacaauggguccuccccuccuacucuggucgcaacacccacaacguccaccucgcacccgccgucgcacccacauucccaggcgaacaacuccucuucuuuagauccaccaugcccggcugcuccggauaccccaauauggaccuagacugccuacucccccaagaauggguccaauacuucuaccaagaagccgcccccgcacaauccgacgucgcccuucuacgauucgucaaccccgacaccggaagaguacucuucgaauguaaacuacacaaaucgggauacguaaccguugcacacaccggccaacaugaccucgucauacccccuaacggcuacuucagauucgauagcugggucaaccaauuuuacacucuggcacccaugggcaauggcaccggccgccgacgcgcucucuaa

SEQ ID NO: 37411 - RNA, 1623 nt, Artificial Sequence
  derived and/or modified sequence opt11 from major_capsid_protein__Norovirus__AFU92723
augaaaauggccuccagcgacgccaaccccuccgacggcucaacagcaaaccuaguccccgaaguaaacaacgaaguaauggcacucgaaccagucgucggcgccgccaucgccgccccagucgcuggccagcaaaauguaaucgacccauggaucaggaauaacuuuguacaagcccccggcggcgaauuuaccguuuccccacgaaacgccccaggagaaauccucuggucagcgccccucggucccgaccucaauccuuaccucucucaccucgcccgcauguacaacggcuaugccggaggcuucgaaguccaaguaauacuagccggaaaugccuucaccgccggaaaaaucauauucgcugccguaccucccaacuuccccaccgaaggccuaucccccucucaagucacaauguucccccacaucgucguugacguacgccaacuagaaccaguccuaaucccccuucccgauguccguaacaacuucuaccacuacaaccaaucuaacgaccccacaauaaaacuuauagccaugcucuacacaccccugcgagcaaacaacgccggagacgacgucuucaccguaagcugucgaguccuaacccgacccucacccgacuuugacuucaucuuccucgucccacccacaguagaaucacgcacaaagcccuucuccgucccuguucuuacaguagaagaaaugaccaauucaagguuccccauuccccucgaaaaacuauucaccggcccaucuucagccuucgucguacaaccacaaaacggcagaugcacaacggacggcguacuccucggcaccacacaacuaucgccagucaacauaugcacauucagaggcgacguaacacacauaucgggcucucgcaacuacaccaugaaccuagccagccaaaacuggaacucauacgaccccacugaagaaauccccgcaccccucggcacaccagacuucgucggaaaaauccagggaguccuaacccaaacaacccggacagacggcucaacccgcggccacaaagccaccgucuacaccggcuccgccgacuucucacccaaacuaggccgaguacaauucgcuacagacacagacaacgacuucgucaccaaccaaaacaccaaauucaccccagucggcguaauccaagacggcucaaccaccccacgcaacgaaccccaacaauggguccugcccucauacagcggccguaacacccacaacguacaccucgcccccgccgucgcccccaccuuuccaggcgaacaacuccuauuuuuccgcuccaccaugccaggcugcuccggcuaccccaacauggaccucgacugccuccuaccacaagaauggguccaauacuuuuaccaagaagcggccccagcccaaucagacgucgcccuccuccgcuucguuaauccagacacaggccgcguucuuuucgaauguaaacuccacaaaucaggauauguaaccgucgcacacaccggacaacacgaccuaguaaucccacccaauggauacuuucgauucgacagcugggucaaccaauucuacacacucgcacccaugggcaacggcaccggccgacgccgcgcccucuaa

SEQ ID NO: 37412 - RNA, 1647 nt, Artificial Sequence
  derived and/or modified sequence opt11 from major_capsid_protein__Norovirus__AGD79474
augaaaauggccuccaacgacgccacacccucuaacgacggagcugcaggacucguucccgaaauaaacaacgaagcaauggcccucgaucccgucgcaggggccgcaaucgcagcaccccuaacagggcaacagaacauuauagaucccuggaucaugaacaacuucguccaagcaccaggcggugaauuuaccgucucacccagaaacucuccaggcgaaguacuacucaaccucgaacuaggcccagagauaaaccccuaccucgcucaccucgcccgcauguacaacggcuacgccggaggcuucgaaguacaaguaguccucgccgguaacgccuucaccgccggcaaaaucaucuucgccgccauaccaccaaacuuccccaucgacaaccucuccgcugcacagauaaccaugugcccccacguaauagucgacguccgacaacucgaacccgucaaccuccccaugcccgacguucguaacaacuucuuccacuacaaccaaggaucagacucccgucuccgccucaucgcaaugcucuacacuccucuacgagccaacaacuccggcgaugacguauuuacaguaucgugccgcguacucacacgacccucacccgauuucuccuucaacuuccucguaccucccaccguagaaucaaaaacgaaacccuucacccuccccauccuaacaauuucggaaaugucaaacucacguuucccaguaccaauugauucccuacacacaagccccaccgaaaacauagucguucaaugucaaaacggucgcgucacccucgacggcgaacuaaugggcaccacccagcuacuccccucccaaauaugcgcauuccgcggcguacucacucgcucaacauccagagccuccgaccaagccgacaccgccacaccccgccucuuuaacuacuacuggcacauccagcuagauaaccuuaacggcaccccauacgaccccgccgaagauaucccaggaccccuaggaacccccgacuuccgcggcaaagucuucggagucgcaucacaacgaaaccccgacuccaccacacgcgcccacgaagcaaaagucgacaccaccgcaggacgauucacccccaaacucgguucccucgaaauaucuaccgaaucggacgacuucgaccaaaaccaaccaacacgauucaccccugucggcaucggcguagaccgagaagccgacuuccaacaauggucccuacccgacuacuccggccaauucacccacaacaugaacuuagcacccgcagucgccccaaacuucccaggcgaacaacuccucuucuuccgaucccaauugcccuccuccggcggccgauccaacggaguccuagacugucucgucccccaagaauggguccaacacuucuaccaagaauccgcacccgcccaaacccaagucgcccuaguacgcuacguaaaccccgacacaggccgcgucuuauucgaagccaaacuacauaaacuaggcuucaugaccaucgccaaaaacggcgacuccccaaucacggucccacccaacggcuacuuccgcuucgaaucaugggucaaccccuucuacacauuagcccccaugggcaccggcaacggccgacgccgcguccaauaa

SEQ ID NO: 37413 - RNA, 1647 nt, Artificial Sequence
  derived and/or modified sequence opt11 from major_capsid_protein__Norovirus__AGD79475
augaaaauggccucaaacgacgccacccccucaaacgacggcgccgccggccuugucccagaaauaaauaaugaagcaauggcucuagacccagucgccggagccgcuaucgcagcaccccucacaggccaacaaaacauaauagaccccuggaucaugaacaacuucguccaagccccaggcggagaauuuaccgucucaccccguaacucccccggagaaguccuccuaaaccuagaacucggcccagaaauaaacccuuaccuggcucaccucgccagaauguacaacggauacgccggcggcuucgaaguacagguaguacucgccgguaacgcauucaccgccggcaaaaucaucuucgccgcaaucccucccaacuuccccaucgacaaccucuccgcagcccagaucaccaugugcccccacguaaucgucgacguccgccaacuagaacccguuauauuacccaugccagacguccgcaacaacuucuuccauuacaaccaaggauccgacucacgacuacgcuuaaucgccaugcucuauaccccacuacgcgcaaacaacagcggcgacgacguauucaccguaucuugccgcguccuaacacgaccuucacccgacuucucauucaacuuccucgucccuccaacugucgaauccaaaacaaagccuuucacacuccccauccucacaaucuccgaaaugagcaacuccagauucccagucccaauagacagccuccacacaucacccaccgaaaacauaguagugcaaugccaaaacggucgaguaacccucgacggagaacucauggguaccacccaacuacugcccucccaaaucugcgccuucagaggcgucuugacccgaucuacuagccgcgccagcgaccaagcggacaccgucacaccccgccucuucaacuacuauuggcacauccagcucgacaaccucaacggaaccccauacgaccccgccgaagacauacccggcccacuaggcacccccgacuuccgcggaaaagucuucggcguugccucacaaagaaacccagauagcaccacccgagcgcacgaagcaaaaguagacaccaccgccggucgcuucaccccuaaacucggaucccucgaaaucuccaccgaauccgacgacuucgaccaaaaccaacccacccgauucaccccaguaggcaucggcguagaccgagaagcagacuuccaacaauggucccuacccgacuacucaggucaauucacccacaauaugaaccucgcacccgccgucgcccccaacuuccccggagaacaacuccuauucuuccgcagucagcucccguccagcggcggcagauccaacggcauacuagacugucucgucccccaggaauggguccaacauuucuaccaagaaucagcccccgcccaaacacaaguugcucuaguacgcuacgucaaccccgacaccggacgcguccuauucgaagcaaaacuacacaaacucggcuuuaugaccauagcgaaaaacggagacucaccaaucacagugccaccaaacggcuacuuccgcuucgaauccugggucaaccccuucuacacauuagccccaaugggcacugguaacggucgacgccgaauacaauaa

SEQ ID NO: 37414 - RNA, 1647 nt, Artificial Sequence
  derived and/or modified sequence opt11 from major_capsid_protein__Norovirus__AGD79476
augaaaauggccucaaacgacgccgcacccucuaaugacggagccgccggacucguccccgaaauuaacaacgaagccauggcccuggaaccagucgccggcgccgcaaucgcagccccgcucaccggccaacaaaacaucauugaccccuggauaaugaacaacuucguucaagcccccggaggcgaguucaccguaucaccccgaaacuccccaggagaagugcuccucaaucucgaacuaggccccgaaaucaauccauaccuugcccaccucgcccgcauguacaauggauacgccggcggcuucgaaguccaagucguccucgcagggaacgcuuucacugccggcaagaucaucuucgcagccaucccacccaauuuucccaucgacaaccucuccgcggcccaaaucacaaugugcccccacguaaucguugacguacgccaacucgaacccgucaaccuacccaugcccgacguacgaaacaacuucuuccacuacaaccaaggcuccgacucccgacuacgccucaucgccaugcucuacaccccucuccgcgcaaacaacuccggcgacgacgucuucaccgucucuugccgaguccuuacaagaccgucccccgauuucucauuuaacuuccucgucccacccaccgucgaauccaaaaccaaaccuuucucccuccccauacucacaaucuccgaaauguccaauucccgcuuccccgucccaaucgauucccugcauaccucuccgacagaaaacaucgucguacaaugccaaaauggccgaguaacccucgacggcgaacuaaugggcaccacccaacuccuucccucucaaauaugcgccuuccgcggcguccucacccgaucaacaucacgugccuccgaccaagccgacaccgcaacaccccgccuauucaauuacuacuggcacauccaacucgauaaccuaaacggcaccccauacgaccccgcagaagacaucccaggaccccucggcacacccgacuuccgugguaaagucuucggagucgcaucacaacguaacccagacaccaccacccgagcgcacgaagcaaaagucgacaccacuucaggcagauucacccccaaacuaggaucccucgaaaucucaacugaauccgaugacuuugaccaaaacaaacccacccgauucacccccgucggcaucggcgucgaccacgaggccgauuuccaacaauggacccuucccgacuacgcugggcaauucacgcauaacaugaaccucgcacccgcaguaguacccaacuucccuggagaacaacuccucuucuuccgcucccaacucccauccuccggaggucgcuccaacggcauccuagacugccuaguuccccaggaauggguccagcacuucuaccaagaauccgcgccaucgcaaucccaagucgcccucguacgcuacauaaaccccgacaccggccgaguccuauucgaagcaaaacuacacaaacuaggcuuuaugaccauugccaaaaacggcgacucccccauaaccguaccacccaauggauacuuccgcuucgaauccuggguaaaccccuucuacacccucgcccccaugggcaccggaaacggucgacgccggauccaauag

SEQ ID NO: 37415 - RNA, 1647 nt, Artificial Sequence
  derived and/or modified sequence opt11 from major_capsid_protein__Norovirus__AGD79477
augaaaauggcauccaacgacgcagcacccuccaacgacggcgccgccggccuuguccccgaaaucaauaacgaagccauggcacucgaaccaguggccggagccgccaucgccgccccucuaaccggacaacagaacauuaucgacccauggaucaugaacaacuucguccaagcccccgguggggaguucaccgucucaccccgaaauucaccaggcgaaguccuccucaaccuugaacucggacccgaaaucaacccuuaccucgcucaccucgcccguauguacaacggcuaugccggaggcuucgaaguucaagucguccucgccggcaacgccuucaccgcaggcaaaaucauauucgccgccaucccacccaacuuccccaucgacaaccucuccgccgcucaaaucacaaugugcccccacgucaucguagacguccgccaacucgaacccguuaaccuccccaugccagacguccguaauaacuucuuccacuauaaccaaggcucggauucccgccuucgucucaucgcaaugcucuacacuccccuccgcgccaacaacuccggcgaugacguuuucaccguauccugccgcguccuuacccgacccucccccgacuucucguucaauuuucucguaccucccacagucgaauccaaaaccaaaccauucucccucccuauccucacaaucucagaaauguccaacucccgauucccaguacccaucgacucacuccacaccucaccuaccgaaaacauaguuguacaaugccaaaacggccgaguaacacucgacggcgaacuuaugggcaccacccaacuccucccaucacaaaucugcgccuucagaggcguucuaacacgcucaaccucucgcgccuccgaccaagcagacaccgcgacuccccgacuuuucaauuacuacuggcacauucaacuagacaaucucaacggcaccccuuacgacccagccgaagacaucccuggcccucuaggcacccccgauuuccgcggcaaaguauucggagucgccucacaacguaaccccgacaccucaacacgcgcucacgaagccaaaaucgauaccaccucaggccgcuuuacccccaagcucggcucccucgagauaucuaccgaauccgacgacuucgaccaaaacaaacccacccgcuucacaccugucggcaucggugucgaccacgaaacagacuuccaacaauggacccuaccagacuacgccggacaacuaacccacaacaugaaccuagcuccugccgucgcccccaacuucccuggagaacaacuccucuucuuccgaucccaacuucccucauccggcggcagaucuaacggcauccucgauugccuuguuccucaagaauggguacaacacuucuaccaagaauccgccccaucccagagccaaguagcccuaguccgauacaucaaccccgacaccggccgcgucuuauuugaagcaaaauuacacaaacucggcuucaugacaauagccaaaaacggugacucucccauaaccgucccacccaacggauacuuccgcuucgaaucuugggucaaccccuucuacacacuugcacccaugggaacaggaaacggccgccgccgcauccaauaa

SEQ ID NO: 37416 - RNA, 1647 nt, Artificial Sequence
  derived and/or modified sequence opt11 from major_capsid_protein__Norovirus__AGD79478
augaaaauggccucaaacgacgccgcacccaguaacgacggugccgccggacucguccccgaaaucaauaaugaagcaauggcccuagaaccugucgccggagccgcaaucgcagcuccccucaccggacagcaaaacaucauagaccccuggaucaugaacaacuucguccaggccccaggcggcgaguucaccguauccccacgaaauuccccuggcgaaguccuucuuaaccucgaacuuggccccgaaauuaaccccuaccuugcacacuuagcccgaauguacaacggcuacgccggcggauucgaaguucaaguaguauuagcaggcaacgccuucaccgccggcaaaauaaucuucgccgccaucccgcccaacuuccccaucgacaaccucucagccgcccaaauaaccaugugcccccacguaauagucgacguccgacaacucgaaccagugaaccuacccaugcccgacguccguaacaacuucuuccacuacaaccagggcuccgacucccgccuccgccucaucgcuaugcucuacacaccccuccgugccaacaauuccggcgacgacgucuucaccgucuccugccguguccucacccgcccgucccccgauuucuccuucaacuuccucguaccaccgacagucgaauccaaaaccaaacccuucucccucccaauccuaacaaucucggaaauguccaacucccgcuuccccguccccauugacucucuccacaccuccccuaccgaaaauaucgucguacaaugucaaaacgggagggucacccucgacggcgaacucaugggaaccacucaacuccuccccucccaaaucugcgccuuccgcggcguacugacccgcuccacuuccagagccucggaccaagccgauaccgcgacaccacgauuauucaacuacuacuggcacauccaacuagacaaccucaacgaaacccccuaugacccugcagaaggcauaccuggcccccucgguacccccgacuuucgcggaaaagucuucggcgucgcaucccaacgcaaccccgacaccaccacccgcgcccacgaagcuaaggucgacaccaccuccggccgauucacacccaaacuaggcagccucgaaaucuccaccgaauccgacgacuucgaccaaaacaaacccacccgcuucacccccgugggaauaggaguagaccacgaagccgacuuccaacaauggacacuuccggacuacgccggccaauucacccauaacaugaaccucgccccagcaguggcccccaacuuccccggcgagcaacucuuauucuuccgcucccaacuccccucaagcggaggccgcuccaacgguauacuagacugccucguaccacaggaauggguccaacacuucuaucaagagucagcacccucccaaucccaaguagcccuaguacgguacaucaaccccgacacaggccgcguccucuucgaagcuaagcuccacaaacucggcuucaucacaaucgcuaaaaacggcgacucccccaucaccgucccacccaacggcuauuuccgcuucgaauccugggucaaccccuucuacacucuagccccuaugggcaccggcaacggccgccgccgcauacaauga

SEQ ID NO: 37417 - RNA, 1647 nt, Artificial Sequence
  derived and/or modified sequence opt11 from major_capsid_protein__Norovirus__AGD79479
augaaaauggccuccaacgacgccgccccaucuaacgacggcgcugccggccuaguacccgagauuaacaacgaagcuauggcccucgaaccggucgccggcgcagccaucgccgccccacucacgggccaacaaaacaucaucgacccauggauaaugaacaauuucguacaagcccccggaggcgaguucacagucuccccucgcaacucccccggagaaguccuacucaaccucgaacucggccccgaaauaaacccauaccucgcccaucuugcccgaauguacaacggauacgcaggcggcuucgaaguccaaguuguacuagccggcaacgccuucaccgccggcaaaaucaucuucgcugccauacccccuaacuuccccaucgacaaccucucagcagcacaaaucaccaugugcccccacgucaucgucgacguccgacaacuagaacccgucaaccuccccaugcccgacguccgaaacaacuucuuccacuacaaccaaggcucugacagccgacuucgccucaucgccaugcucuacacaccccuccgagcaaacaacucuggugacgacguguuuaccgucuccugccgaguacucacucgcccuucccccgacuucuccuuuaauuuccuagucccacccaccguagaaagcaaaacaaaacccuuuucccuucccauccucacaaucucugaaauguccaacucccguuucccuguccccaucgacucccuccacaccagccccaccgaaaacaucguaguccaaugccaaaacggccgcgucacccucgauggcgaacuaaugggcacaacucaacuacuacccucccaaaucugcgccuuuagaggcguccuaacccgcuccacuucccgcgccuccgaccaggccgacacagcaaccccacgccuauucaacuauuacuggcacauucaacuugacaaccuuaacggaacacccuacgacccagccgaagauauccccggcccacucggcacaccugacuuucgcggcaaagucuucggcguagccucacaacgcaacccagauacuaccacucgagcccacgaagcuaaaguagacaccaccuccggccgauucacccccaaacucggcucucucgagaucuccaccgaaagcgacgacuucgaccaaaacaaacccacccgcuucaccccaguugggaucggagucgaucacgaagccgacuuucaacaauggaccuuacccgacuacgcaggucaguucacacacaacaugaaccucgcgccugccgucgcccccaacuucccaggcgagcaacuccucuucuucagaucccaacuccccuccuccggcggccguacaaacggcauccucgacugccuagugccccaagaauggguccaacacuucuaccaagaaucagcacccucccaaucccaaguagcccuuguccgcuacaucaacccugacaccggccguguauuauucgaagcaaagcuccacaaacuuggcuuuaucaccaucgccaaaaacggcgacucacccaucaccgucccacccaauggauacuucagauucgaaucaugggucaaccccuuuuacacacucgcccccaugggcaccggcaacggacgacgccgcauccaauag

SEQ ID NO: 37418 - RNA, 1620 nt, Artificial Sequence
  derived and/or modified sequence opt11 from major_capsid_protein__Norovirus__AGH24750
augaaaauggcauccaacgacacaaucccauccgacggauccacagccaaccucguccccgaagucaacaacgaggucauggcauuagaaccuguggucggcgccgccaucgcagcuccagucgcaggccaacaaaacgucauagaccccuggauccgaaacaacuucguccaggcacccggaggugaguucacugucucuccccgcaacgcacccggcgaaauccucuggucaaugccccuaucucccgaucucaaccccuaccuuagccaccucucacgcauguacaauggcuacgcgggaggcuucgaaguccaagucauccuugccggaaacgcuuucaccgccggcaaaaucaucuucgccgcaauacccccaaacuuuccgaccgacggccucucaccaucccaaguuaccauguucccccacaucauuguagacguucgacaacucgaaccaguccucauaccucuacccgacguccgaaacaauuuuuaccacuacaaccaagucaacgacuccacacucaaacucaucgccaugcuauacacaccccuucgggcuaacaacgccggcgacgacguauucaccguuucaugccgcguacucacccgccccucccccgacuucgauuucaucuuccucguacccccaacagucgaaucccgcacaaaaccuuucaccguccccauccucaccgucgacgaaaugacaaacucccgcuuccccacuccacuugaacgccuacauaccggccccaacaacucccuagucguccaaccucaaaacggaagaugcaccaucgacgguguacuacuaggcacaacucaacucucagcagugaacaucugcucguucagaggagacucgaccacacgcgaaggccaaucccacgcuuacaccaugaaccucgccucccaaaacuggacaaacuacgacccaacagaagacauacccgcaccccuuggaaccccagacuucgucggcaaaaucgucggcaugcucucucaaaccacccgcgaaaacuccuccacccgcgcucacaaagccaccgucuccaccggagacgcccacuucaugccuaaacucggauccguacucuucacuacugacaccgaagaccuacaaaauggucaaaauacacgauucaccccugucggcgucgcccaagacggagaaccacaccaaaacgaaccccaacaauggcgacuccccaacuauucaggcacccccggccauaacguucaccuagcaccaccagucgcacccacauuucccggggaacaacuccucuucuuccgauccacaaugcccggaugcggaggcuaccccaacauggaccuggacugccuccuaccccaagaauggguccgucacuucuaccaagaagccgcccccgcccaaucugacgucgcccuacuacgcuucgucaacccugacaccggucgcguacucuucgaaugcaaacuacacaaagcaggcuacaucaccgucucccacacaggccccuacgaccuagucauacccccuaacggcuacuuuagauuugacucauggguaaaccaguucuacgcccucgcccccaugggcaccggcaccggacgcagacgagcccuauaa

SEQ ID NO: 37419 - RNA, 1623 nt, Artificial Sequence
  derived and/or modified sequence opt11 from major_capsid_protein__Norovirus__AGI37922
augaaaauggcaagcucagacgccaacccaucagacggcuccaccgcgaaccuaguacccgaaguaaacaacgaagucauggcacuggaaccaguugucggugccgccauagcagcccccgucgccggccaacaaaauguuaucgacccauggaucagaaacaacuucguccaagccccaggcggagaauuuaccguaaguccacgaaaugcccccggcgaaauucucuggagcgcaccuuuaggucccgaccuaaaccccuaccucucccacuuagcuagaauguacaacggcuacgccggcggcuucgaaguccaggucauucuagccgguaacgccuucaccgccggcaaaauaauauucgcagccgucccacccaacuuucccaccgagggccuaucccccucccagguaacaauguucccucauaucauugucgacguccgccaacuugaacccguccuaauaccccuuccggacguccgaaauaacuucuaccacuacaaccaauccaacgacccaacaaucaagcucaucgcuaugcuauacacuccccuccgagcaaacaacgccggcgacgacgucuucaccgucucaugucguguccuaacccgaccaucccccgacuucgacuucaucuuccucguucccccuaccguagaaucacgcaccaaaccauucuccguccccauucucaccgucgaagaaaugaccaacagccgauucccaaucccccucgaaaaauuauuuacaggccccuccuccgccuucguaguccaaccccaaaaugggcgcugcaccacugacggcgugcugcuaggcaccacccaacucucccccgucaacaucugcacauuccgcggagacgucacccacaucacaggcucccgcaacuacacaaugaaccucgccacccaaaacuggaacuccuaugauccgaccgaagaaauaccagcuccccuaggcacuccagacuucgucggcaaaauccaaggcguccuaacacagacaacccgcgccgacggcagcacccgaggccacaaagccaccgucuacaccggcuccgccgacuucgccccaaaacucggacgcguccaauucgcaacagauacagacaacgacuucgacgccaaccaaaacaccaaauucacccccguuggcgucauccaggacggagacaccgcccaccgcaacgaaccacaacaaugggucuuacccagcuacuccgggcgcaacucacauaacguacaccucgcacccgccgucgcucccaccuuccccggagaacaacuccucuucuuucgcuccacaaugcccggcugcuccggauaccccaacauggaccuugacugucuccuaccccaagaauggguccaauacuuuuaccaagaagccgcacccgcacaaucagaugucgcccuacuucgauucgucaacccagacacaggccgcguacucuucgaauguaaacuccacaaauccggcuacgucaccgucgcccacaccggccaacacgaccucgucaucccacccaacggcuacuuccgauuugacucuuggguuaaccaauucuacacccucgcucccaugggcaauggaacaggcagacgucgcgcacuauaa

SEQ ID NO: 37420 - RNA, 1623 nt, Artificial Sequence
  derived and/or modified sequence opt11 from major_capsid_protein__Norovirus__AGM46344
augaaaauggccagcaacgacgccaacccauccgacgguucaaccgcaaaccuagucccagaaguaaauaacgaaguaauggcccucgaacccgucgucggagccgcaaucgccgcucccguagccggccagcaaaacgucaucgacccauggauccguaacaacuucguccaagcacccggcggcgaguucaccguaucaccccggaacgcccccggcgaaauccuaugguccgccccacucggaccagaucucaacccauaucuaucccaccucgcucgcauguacaacggcuacgccggcggcuucgaaguucaagucauccuagccggaaacgccuucacagcaggaaaaaucaucuuugccgcaguacccccaaacuuccccaccgaagggcucucccccucccaaguaaccauguucccccacauaaucguagacguccgacaacucgaaccaguacuaaucccccucccagauguccgcaacaacuuuuaccacuacaaccaauccaacgaccccaccaucaagcucaucgccaugcuuuacacaccccuacgcgcaaacaacgccggcgacgacgucuuuaccgucuccugucgcguacuuacccgccccucgccagacuucgacuucaucuuucucguacccccaaccgucgaaucccgcaccaaacccuucuccguccccauccucaccgucgaagaaaugacaaacucacgauuccccaucccccucgaaaaacuauucacaggccccuccuccgcauucgucguccaaccccaaaacggacguuguacuacagacggcguccuacucggcacaacacagcucucccccguuaacaucuguacauucagaggagacguaacacacaucacaggcucgcgaaacuacacaaugaaccuggccacacaaaacuggaacucuuacgaccccaccgaagaaaucccagcgccccuaggcaccccagacuucguaggaaaaauucaaggcguccucacccagaccaccagagccgacggaagcacccgcggacacaaagccacaguuuacaccgguuccgcagacuucgcaccaaagcucggccgcguccaauucgcaacagacaccgacaaugauuucgacgcaaaccaaaacacaaaauucacacccguaggugucauccaagacggggacaccgcucaccgaaacgaaccucagcaauggguacucccuuccuacuccggacguaacucacacaacguacaccucgcacccgccgucgccccaacauuccccggagaacaacuacucuucuuucgcucaacaaugcccggcugcucuggcuaccccaacauggaccucgacugccuccuuccccaagaauggguccaauacuucuaccaagaagccgcccccgcacaaucagacguagcccuccuucgauucgucaaccccgacaccggccgcguccuauucgaauguaaacuccacaaaucaggcuacguaaccguagcccacaccggccagcacgaccuaguuauacccccaaacggauacuuccgauucgacucaugggucaaccaauucuacacccucgccccaaugggcaacggcaccggccgacgccgcgcucucuga

SEQ ID NO: 37421 - RNA, 1623 nt, Artificial Sequence
  derived and/or modified sequence opt11 from major_capsid_protein__Norovirus__AGM46347
augaaaauggccucauccgaugcaaaccccuccgacggcuccacagccaaccucgucccagaagucaacaacgaagucauggcccuagaaccagucgucggagccgcaaucgccgcacccgucgccggccaacaaaacgucauagaccccuggauacgaaacaacuucguucaagcacccggcggagaguucacugucucaccccgcaacgcaccgggagaaauccuauggucagcaccccucgggcccgaccucaacccauaccuaucacaccuagcccgcauguacaacggcuacgccggcggcuucgaaguacaagucauccuagccggcaacgccuucacagcaggaaaaaucaucuucgcagcaguaccacccaacuuccccaccgaaggccucucuccaagccaaguaacaauguucccacacaucaucguggacguacgucaacuagaacccguccugauuccccuucccgacguccgcaacaacuucuaccacuacaaccaauccaacgacccuaccaucaaacuaaucgcaaugcucuacacaccacuacgcgccaacaacgcuggcgacgacgucuucacaguaucaugccgcguccuuacacgccccucccccgacuucgacuucauuuuccuaguucccccaacaguugaaucccgaaccaaacccuucucgguaccaauccucacagucgaagaaaugaccaauucacgcuuccccauaccccuagaaaaacucuucaccggccccuccuccgccuucgugguccaaccccaaaacggccgcugcaccaccgauggcguccuccuaggcacuacccaacuaucacccguaaacaucugcacauuccgcggugacgucacccacaucacagguucucgaaacuacaccaugaaccuugcaacucaaaacuggaacuccuacgaccccaccgaagaaaucccagcaccccuuggcacccccgacuucguaggcaaaauccaaggaguacuaacacaaacaaccagagccgacggcuccacccgcggccauaaagccaccgucuauacuggcuccgcugacuucucccccaaacucggccgcguccaauucgccacagacaccgacaacgacuucgacgccaaucaaaacaccaaauucacgccagucggcgucauccaagacggcgacacagcccaccgaaacgaaccccaacaauggguucucccaucuuacuccggacgaaacucccacaacguacaccucgccccugccguagcacccacauuccccggcgaacaacuccuauucuuucgcucaaccaugcccggcugcagcggcuaccccaacauggacuuagacugccuccucccccaagaauggguccaauacuucuaccaagaagcagccccggcccagucagacguagcacuccuccgauucgucaaccccgacaccggacgcguccuauuugaaugcaagcuccauaaauccggcuacguaacagucgcccacaccggacaacacgaccucgucaucccaccaaacggcuacuuucgauuugacuccugggucaaccaauucuacacauuagccccaaugggcaauggcacuggcagacgacgcgcccuauga

SEQ ID NO: 37422 - RNA, 1623 nt, Artificial Sequence
  derived and/or modified sequence opt11 from major_capsid_protein__Norovirus__AGM46349
augaaaauggcauccuccgacgccaaccccucugacggauccaccgccaaccuagucccagaaguaaacaacgaagucauggcccuagaaccagucguuggugcagccaucgccgcaccagucgcuggucaacaaaacguaaucgaucccuggauacgcaacaacuucguccaagcccccggcggcgaauuuacggucuccccacgcaacgccccaggagaaauccuuuggucagcaccccucgguccugaccucaauccauaccuaucacaccucgcccgcauguacaacggcuacgccggcggcuucgaaguccaagugauacucgcuggaaaugccuucaccgcgggcaaaaucaucuucgcagccguucccccuaacuuccccaccgaaggccucuccccaagccaaguaacaauguucccacacauaaucgucgacguccgccaacucgaacccguucuaaucccccuacccgacguccgaaauaacuucuaccacuacaaccaaucaaacgacccuacgaucaaacucauagccaugcuauacacaccucucagagccaacaacgccggagacgacguauucaccguauccugucgagucuuaacacgccccuccccugacuucgauuucaucuuccuaguacccccuaccgucgaaucccgcaccaaaccauucagcguccccgucuuaaccgucgaagaaaugaccaacucacgcuuccccaucccacucgaaaaacuuuucacgggaccauccuccgccuucgucguccaaccucaaaacggaagauguacaaccgacggcguacuacucggcacaacucaacucuccccagucaacaucugcacauuccgaggcgacgucacccacauccccggcucacgcaacuacacaaugaaucuagccucccaaaacuggaacuccuacgacccaacugaagaaaucccugccccacuugguacacccgauuucguaggaaaaauccaaggcguccucacccaaaccacacgcacuaacggcuccacccgcggccacaaagcgaccgucuacacugggucugccgacuuuucuccaaaacucggccgaguccaauucgccaccgacaccgauaacgacuucgaaaccaaccaaaacaccaaauucacccccgucggcgucauccaagauggcucuaccaccccgagaaacgaaccccaacaauggguccuccccucauacuccggccguaacauccacaacguacaccuugccccagcggucgcucccacauuccccggcgaacaacuccuauucuucagauccaccaugccaggcuguuccggcuaccccaauauggaucuagacugccuccucccucaagaauggguucaguacuucuaucaagaagcagcccccgcccaauccgacgucgcccuccuacgauucgucaaccccgacacaggccgcguacucuucgaaugcaaacuucacaaaucaggcuacgucacagucgcucacacaggacagcacgaccuaguuauucccccaaacggcuauuuccgcuuugacucaugggucaaucaauucuacacacucgcccccaugggaaacggcaccggaagacguagagcccuuuaa

SEQ ID NO: 37423 - RNA, 1623 nt, Artificial Sequence
  derived and/or modified sequence opt11 from major_capsid_protein__Norovirus__AGM46355
augaagauggccagcuccgacgccaaucccuccgacggcucgaccgcaaacuuaguacccgaaguaaacaacgaagugauggcacuagaacccguagucggagcugccaucgcagccccaguagccggccaacaaaacgucauagaccccuggaucagaaauaacuucgugcaagcacccggaggagaguucaccgucucaccccgaaacgccccaggcgaaauacuaugguccgccccgcucggacccgaccucaauccauaccuuucccacuuggcccgcauguauaacggcuacgcuggcggauucgaaguccaagugauccucgccggcaacgccuucacagccggaaaaaucaucuuugcugcagucccacccaacuuccccaccgaaggccucucccccucacaagucaccauguucccacacaucaucguggacguccggcaacucgaacccguccucauaccccuacccgacguccgcaacaacuucuaccacuacaaccaaucaaacgaucccaccaucaaacucaucgcaaugcucuacacuccccuacgcgccaacaacgccggcgacgacgucuucaccgucuccugccgaguccuaacucgccccuccccagacuucgacuucaucuuccucguacccccuacagucgaaucacgcacaaaacccuuuuccgucccaguccucacugucgaagaaaugacaaacucacgcuuccccaucccacucgaaaaacucuucacaggccccuccuccgcauucguaguacagccacaaaacggccgcuguacaaccgacgguguccuacucgguaccacacaacucagccccguaaacaucugcaccuucagaggagacguaacccacauccccggcucacgaaauuacacaaugaaccucgccucacaaaacuggaacucguacgaccccaccgaagaaauucccgcaccccucggaacacccgacuucgucggaaaaauucaaggaguacucacccaaaccacccgaaccaacggcucaaccagaggccacaaagccaccguuuacaccggaagcgccgacuucucacccaaacucggccgcguacaauucgccaccgacaccgacaacgacuucgaaaccaaccaaaacacaaaauucacaccagucggcgucauacaagacggauccacaacaccccgcaaugaaccccaacaauggguccuaccaucauacuccggacgaaacauccacaacgugcacuuagcccccgcaguagcccccacauuccccggcgagcaacuccucuucuuuagguccacaaugcccggcugcuccggcuauccaaauauggaccucgacugccuccucccccaagaauggguccaauauuucuaccaagaggcagcccccgcccaaagcgacgucgcacuccuccgcuucgucaacccagacaccggacgaguccuguucgaaugcaaacuccacaaaucaggcuacgucaccgucgcccacacaggacaacacgaccucguaauaccgcccaacggauauuuccgcuucgacuccuggguaaaccaauucuacacacuggcccccaugggcaacggaacaggucgccgccgcgcccucuaa

SEQ ID NO: 37424 - RNA, 1623 nt, Artificial Sequence
  derived and/or modified sequence opt11 from major_capsid_protein__Norovirus__AGM46359
augaaaauggccuccaacgacgccaacccauccgacggcucaaccgcaaaccucguccccgaaguaaacaaugaaguuauggcccucgaacccgucgucggggcagcaaucgcugcacccgucgccggccaacaaaacguaaucgaccccuggauccgcaacaauuucguccaagcacccggcggcgaguucaccgucaguccccgcaaugcacccggcgaaauccucugguccgcaccccuaggccccgaccuaaacccauaccuaagccaccucgcccgcauguauaacggcuacgcaggaggcuucgaaguccaagucauccucgccggaaacgcuuucacagccggcaaaauaauauucgccgccguacccccuaacuuccccaccgaaggauuauccccuucccaaguuacaauguucccccauaucaucguagacguccgccaacucgaacccguccuuaucccacuuccagauguccggaacaacuucuaccacuacaaccaauccaacgaccccacaauaaaacuuaucgccaugcucuacacaccccuccgugccaacaacgccggcgacgacguauucaccgucuccugccgcguccucacccgcccaucccccgauuucgacuucaucuuccucgucccacccacuguugaaucacgcaccaaacccuuuuccguccccguacuaacaguagaagaaaugacuaacucccgcuuccccauaccccucgaaaaacuauucaccggacccuccucagccuucgucguucaaccccaaaauggccgaugcaccaccgacgguguccuccuaggcaccacccaacucucccccgucaacaucugcaccuuucgcggagacguaacccacauauccucaucacgaaacuacaccaugaaccucgcaucccaaaacugguccuccuaugacccgacagaagaaaucccagccccucuaggaaccccagacuucgucggcaagauacaaggcguacucacccaaaccacaagaaccgacggcucaacucgcggccauaaagccacagucuacaccggaagcgccgacuucucccccaaacuaggacgcguccaauucgacacagauaccgauaacgacuucgaaacgaaccaaaauaccaaauucacccccgucggcguaauccaagacggcuccaccacuuaccgaaaugaaccccaacaauggguccuccccuccuacuccggucgcaacacacacaacguccaccucgcacccgccguugcaccaacauuccccggugaacagcuacuauucuuccgcaguaccaugcccggcugcuccggcuacccaaacauggaccuagauugucuccucccccaagaauggguccaauacuuuuaccaagaagcagcucccgcccaaucugacguugcccuccuccgcuucguaaacccagacacgggcagaguacucuucgaaugcaaacuccauaaauccggcuacguaacugucgcucacaccggccaacacgaccuagucauacccccaaacggcuauuuccguuucgacucaugggucaaccaauucuacacccucgccccaaugggaaacggaaccggacggcgccgcgcccuauag

SEQ ID NO: 37425 - RNA, 1623 nt, Artificial Sequence
  derived and/or modified sequence opt11 from major_capsid_protein__Norovirus__AGM46362
augaagauggcauccuccgacgcaaaccccuccgacggcucaaccgccaaccucguacccgaaguuaacaacgaaguaauggcucuagaacccgucguaggcgccgccaucgccgcacccgucgccggccaacaaaacgucauagaccccuggauccgcaacaacuucguacaagccccaggcggagaguucacugucucaccccgaaacgcccccggcgaaauccucugguccgcaccccucggcccagacuuaaaccccuaccucucacaccuugccagaauguauaacggcuacgccggaggauucgaaguccaagucauccucgccgggaacgccuucacagccggcaaaauuauauucgcugccgucccucccaacuuccccaccgaaggccucucacccucccaaguaaccauguucccacacaucaucguagacguccgacaacuagaacccguccuaaucccacugcccgacguccgcaacaacuucuaccacuacaaccaauccaacgaccccaccaucaaacucaucgccaugcucuacaccccacuacgcgcaaacaacgccggcgaugacguauucaccguuuccugucgaguccucacucgcccuucaccagacuucgacuucaucuuccuaguacccccaaccgucgaaucccgcaccaaaccauuuucagucccgguacugaccguagaagaaaugacaaacucacgcuuccccauuccccucgaaaaacucuuuacaggcccuuccucugcguucgucguacaaccacaaaacggacgcugcaccaccgacggcguccuccucggcaccacucaacuaagccccgucaacaucugcaccuuccgcggcgacgucacccacaucuccucaagccgcaacuauaccaugaaccucgccucccaaaacuggagcucauacgaccccaccgaagaaauccccgccccacuaggcacccccgacuucguaggcaaaauccaaggcguucuuacccaaaccacccgcaccgacggcuccacccgaggccacaaagcuaccgucuacaccggcucagccgauuucucucccaaacuuggacgcguccaauucgacacagacaccgacaacgacuucgaaaccaaccaaaacaccaaauucacccccguaggagucauccaagacggcucaacaaccuaucgaaacgaaccccaacaguggguccucccauccuacuccggacgcaauacccauaacguacaccucgcaccagcaguggcaccaaccuuccccggcgaacaacuccucuucuuccgcucaaccaugcccggcugcuccggcuacccgaacauggaccucgacugcuuacuaccucaagaauggguacaauacuucuaccaagaagccgcccccgcccaaucagacguagcucuccuucgcuucgucaacccagacaccggcagaguccucuucgaaugcaaacuucacaaaucuggcuaugucaccguggcccacaccggucaacacgaccugguaauucccccaaacggcuacuucagauucgacuccuggguaaaccaauucuauacccucgcaccaaugggaaacggcaccggccgucgccgcgcccucuag

SEQ ID NO: 37426 - RNA, 1623 nt, Artificial Sequence
  derived and/or modified sequence opt11 from major_capsid_protein__Norovirus__AGM46366
augaagauggccuccagcgacgccaaccccuccgacggcuccaccgcaaaccucguccccgaagucaacaacgaagucauggcacucgaaccaguagucggagccgccaucgccgcccccgucgcaggccaacaaaacgucaucgacccauggauucgcaauaauuucguccaagcccccggcggugaguucacagucucaccccgaaacgcucccggugaaauccucugguccgccccacuuggccccgaccucaauccuuaccucucccaccuagcucgcauguacaacggauacgccggaggcuucgaagugcaggucauccuugccggcaacgcuuucacagcaggcaaaaucauauucgccgcaguucccccuaacuuccccacagaagggcucucccccucacaagucacuauguucccucacauaaucgucgacguccgccaacucgaacccguacuaauaccccuccccgauguucgaaacaacuucuaccacuacaaucaaucaaaugacccaaccaucaaacucauagccaugcucuacacuccccuacgcgcuaacaacgccggcgacgacgucuucaccgucucaugcagaguccucacccgaccgucccccgacuucgacuucaucuuccuagucccucccacagucgaaucccgcaccaaaccauucuccguccccguccucaccgucgaagaaaugacaaacucccgcuuccccaucccccucgagaaacucuucaccggacccucuuccgccuuugucguccaaccacaaaacggccgcugcacaaccgacggcguucuccuuggaacaacccaacucucuccaguaaacaucugcaccuuccgaggagacgucacccauauccccggcucucgaaacuacacaaugaaucucgccucacaaaacuggaacucauacgacccaaccgaagaaaucccagcaccacuagguacccccgacuucgucgguaaaauucaaggcguacucacccaaaccacccgaacaaauggcuccacccgaggccauaaagccacaguauacaccgguuccgcggacuucucccccaaacucggccgaguccaauucgcgaccgacacagacaaugacuuugaaaccaaccaaaacacaaaauucacccccgucggcgucauccaagacggaucuacuaccccacgcaacgaaccccagcaauggguccucccaucauauuccggacgaaacauccacaacguccaccucgcccccgccgucgcccccaccuuccccggugagcaacuccucuuuuucagauccaccaugccagguugcucaggcuaccccaacauggaccuagacugucuccuaccccaagaauggguccaauacuucuaccaagaagccgcccccgcccaauccgacgucgcacuacuacguuucguaaaccccgacacaggccgcguccucuuugaaugcaaacuccacaaauccggcuaugucacagucgcccacaccggccaacacgaccucgucaucccacccaacggcuacuuccguuuugacuccugggucaaucaauucuacacccuagcacccaugggcaacggcaccggcucccgccgcgcccucuaa

SEQ ID NO: 37427 - RNA, 1623 nt, Artificial Sequence
  derived and/or modified sequence opt11 from major_capsid_protein__Norovirus__AGM46367
augaaaauggcauccuccgacgccaaccccucagacggcuccacagccaaccuaguccccgaaguaaacaacgaagugauggcacucgaacccgucguaggcgcagccauugccgcccccgucgccggacaacaaaacgucauagaccccuggauccgcaacaacuucguccaagccccaggaggcgaguucacagucucuccccguaacgcccccggcgaaauucucugguccgcgccacucggaccagaccuaaaucccuaccucucccaccuugcccgcauguauaacggcuacgccggcgguuucgaaguccaaguaauccucgcaggcaacgccuucaccgcaggcaaaaucaucuucgccgcagucccucccaacuucccuaccgaaggccucucaccuucccaggucaccauguucccccacauuaucgucgacguccgccaacuugaacccguacuaaucccccuccccgacguucguaacaacuucuaccauuauaaccaauccaacgaccccacaaucaaacuaaucgccaugcuauacacaccccuccgagcuaacaacgcuggcgacgacgucuucaccguguccugccgcguccugacccgacccucccccgauuuugacuucaucuuccucguuccacccaccguagaaucaagaaccaagcccuuuucaguccccguccuaaccgucgaagaaaugaccaacucccguuuccccauaccgcuagaaaaacucuucacuggcccaaguuccgccuucgucguccaaccacagaacggccgauguaccacagauggagucuuacucggaaccacacaacuaucccccgucaacauaugcacauuucgcggagacgucacacacauccccgguucucgcaauuacaccaugaaccuagccucacaaaacuggaacagcuacgacccaaccgaagaaauccccgcuccccuuggcaccccugacuuuguaggcaaaauccaaggcguccucacccaaaccacccgcaccaacggauccacacgaggccacaaagccacagucuacaccggauccgccgacuucucccccaaacugggccguguccaauucgccaccgacacagacaacgacuucgaaaccaaccagaacaccaaauucacccccguaggggucauccaggacggcuccaccacaccccgaaacgaaccccaacaauggguccuccccuccuauucuggccguaacauccacaacguccaccucgcccccgccgucgcccccaccuuccccggcgaacaacuccuauucuuccgcucgaccaugccaggaugcuccggcuaucccaacauggaccucgacugccuccuaccgcaagaauggguccaauacuucuaccaggaagcagcccccgcacaauccgacgucgcccuacucagguucgucaaccccgacaccggcagaguccucuucgaaugcaaacuccacaaauccggauauguaacagucgcacauaccggccaacacgaccucgucaucccacccaacggcuauuuccgcuucgacuccuggguaaaccaauuuuacacccuagcccccaugggcaacgguacuggacgacgacgcgcccuguga

SEQ ID NO: 37428 - RNA, 1623 nt, Artificial Sequence
  derived and/or modified sequence opt11 from major_capsid_protein__Norovirus__AGM46370
augaaaauggccuccucagaugccaaccccuccgacggcucuacagccaaccugguucccgaaguaaacaacgaagucauggcucucgaacccgucguaggcgcagccaucgccgccccagucgccggacaacaaaacguaaucgacccauggauccgcaacaacuucguccaagcucccggcggcgaguucacaguaucaccacgcaaugccccaggagaaauccucuggucagcaccccucggaccagaccuaaaccccuaucucucccaucuagcuagaauguacaauggauacgcuggcggcuucgaaguccaagucguacuagccggcaacgcuuucaccgccggaaaaaucauauucgccgccgucccacccaacuuccccacagaaggccucucccccucacaaguaacgauguucccccauauaaucgucgacgugcgccaacuugaacccguccuaaucccccucccagauguccgcaacaauuucuaucacuacaaccaauccaacgacccaaccauaaaacucauagccaugcucuacacgccccuucgcgccaacaacgccggugacgacgucuucaccgugagcugccgcguccucacccgaccaucaccagacuucgacuuuaucuuccucguacccccaaccgucgaaucacgaaccaaaccauuuucuguccccauccucaccgucgaagaaaugacaaacucccgcuuccccauaccccucgaaaaacucuucaccggcccaucauccgcauucgucguccaaccccaaaacggccgcugcaccacugacggcguccugcuaggaaccacccaacucucccccguaaacaucugcaccuuccgcggcgacguaacacacauaaccggcucccgaaacuacaccaugaaccucgccacccaaaacuggaacagcuaugaccccacagaagaaauccccgcuccccucggaacccccgacuucgucggcaaaauccaaggcguccucacccaaacaaccagagccgacggauccacacguggccacaaagccaccgucuacaccggcuccgccgacuucgcacccaaguuaggccggguccaauucgccacagacacugacaacgauuucgacgccaaucaaaacaccaaauucacccccgucggcgucauccaagauggcgacaccgcacaucgaaacgaaccccaacaauggguccuccccuccuacuccggccgaaacucccauaacguacaccucgccccggccguagcccccaccuuccccggagaacaacuccucuucuucagauccacaaugccaggcugcucaggcuacccaaacauggaccucgacugccuacugccccaagaauggguccaauacuucuaccaagaagccgcacccgcccaauccgacguagcacuucuacgcuucgucaaccccgauacaggccguguucucuucgaauguaaacuacacaaauccggauacgucacagucgcacacacaggccaacacgaccucgucauacccccaaaugguuacuuccgcuuugacagcugggucaaccaguucuacacacuagcacccaugggaaacggcaccggccgaagacgagcacucuaa

SEQ ID NO: 37429 - RNA, 1623 nt, Artificial Sequence
  derived and/or modified sequence opt11 from major_capsid_protein__Norovirus__AGM46375
augaaaauggccucuucagacgccaaccccuccgacggaucaaccgccaaccucguacccgaaguaaacaacgaagucauggcucucgaacccgucgucggcgccgccauugcagcuccagucgcuggccaacaaaacgucaucgaccccuggauccgaaacaacuucguacaagccccuggaggagaauucaccgucuccccccgcaacgcccccggcgaaauucuaugguccgccccccucggaccugaccuaaacccauaccucucccaccucgcccgaauguacaauggauacgcaggaggcuucgaaguccaagucguccuagccggcaacgcauucaccgcagggaaaaucaucuucgccgcagucccccccaacuucccaaccgaaggacuaucccccucacagguuaccauguucccccacaucaucguagacguccgccaacuugaacccguccucaucccccucccagacguccguaauaacuucuaccacuauaaccaauccaacgacccaacaaucaaacuaauugccaugcuuuacaccccucuacgagcuaauaacgccggagacgaugucuucaccgucuccugccgaguacucacccgacccucacccgauuucgacuucaucuuccuaguuccaccuacaguugaaucgcgcaccaagcccuucuccguacccauacuaacagucgaagaaaugaccaacucccgcuuccccauaccucuugaaaaacucuucaccggccccuccagcgcuuucgucguccaaccccaaaacggccgcugcacuacugacggaguacuccuaggaacgacccaacucuccccagucaacaucugcaccuuccgcggugaugucacccacauaaccggcucccgcaacuacacaaugaaccucgcaacccaaaacuggaacucuuacgaccccaccgaagaaaucccugcaccacuaggcacucccgacuucguaggcaaaauccaaggcgucuuaacacaaaccacccgcgcugacggcucuaccagaggucauaaagccaccgucuacaccggcucagccgauuucgccccaaaacucggacgaguccaauucgcaaccgacaccgacaacgacuucgaugccaaccaaaacacaaaguucacccccgucggcguuauccaagacggagacacagcccaucgaaacgaaccacaacaauggguacuccccucauacucaggccgaaauagccacaacgugcaccucgccccugcagucgcuccaacauuccccggagaacaacuccuuuucuuccgcucaacaaugcccggcugcucagguuacccaaauauggaccucgacugccuacuaccacaagaauggguccaauacuucuaccaagaagcagcccccgcccaauccgacgucgcucuccuccgauucgucaaccccgacaccgggcgcguccuuuucgaaugcaagcuacacaaaucuggauacgucacagucgcacacaccggacaacacgaccucgucaucccccccaacggcuauuuccgcuucgacucauggguuaaccaauucuacacccucgccccgaugggcaacgggacaggccgaagacgcgcccucuaa

SEQ ID NO: 37430 - RNA, 1623 nt, Artificial Sequence
  derived and/or modified sequence opt11 from major_capsid_protein__Norovirus__AGM46377
augaaaauggcaagcucagacgcaaaccccuccgauggcagcgccgcaaaccucguccccgaagucaacaacgaaguuauggcccucgaacccguuguuggcgcagcuaucgccgccccaguugcaggccaacaaaacgucaucgaccccuggauccgcaacaacuucguacaagcccccggaggagaauuuacugucuccccacgcaacgcccccggcgaaaucuuauggucugcaccccuaggacccgaucugaaccccuauuuaucccaccuagcccgaauguacaacggcuacgcaggcggguucgagguccaagucauacucgccggcaacgcauucaccgccggaaaaaucauauucgcagccguaccacccaacuuccccaccgaagggcucucccccagccaaguuacaauguucccccacauuauagucgacguacgccaacucgaaccaguccucauaccccuccccgacguaagaaacaacuucuaccacuacaaccaauccaacgacccuaccauuaaacucauugcaaugcucuacacuccccuaagggcaaacaacgccggagacgauguauucaccguauccugccguguccucacacgccccucaccagacuucgacuucaucuuccucgucccacccacaguagaaucccgaaccaaacccuucuccguccccauccuaaccgucgaagaaaugacaaacucccgauuccccauaccacucgaaaaacucuucaccgguccuucgagcgcuuucgugguccaaccucaaaacggacgaugcaccacagacggcguccuacuaggcacaacccaacuaucaccagucaacauaugcaccuuccgcggcgacgucacccacaucaccggcucccgcaacuacaccaugaaucuggccacacaaaacuggaacucauacgauccaacagaagaaaucccugcaccccucggcacucccgacuucgucggcaaaauccaagggguccuaacucaaaccacccgcgcagacggcuccaccagaggccacaaagcuacagucuacacaggcucagccgacuucgccccaaagcucggacgcguacaauuugcaacagacaccgacaacgacuuugacgcaaaccaaaauacaaaauucacucccgucggaguaauacaagacggugacaccgcacaccgaaacgaaccacaacaauggguccugccuucuuacuccggccgaaacucccacaacguccaccucgcaccagccgucgcucccacuuuccccggcgaacaacuucucuucuuccgcuccaccaugccuggcugcucaggcuacccaaacauggaccucgacugccuccucccacaagaauggguacaauacuucuaccaggaagcagccccugcccaauccgacgucgcccuccuacgauucgucaaccccgacacaggccgcguacucuucgaaugcaaacuccacaaaucaggauacgugacagucgcccacaccggacaacacgaccuugucauacccccuaacggauacuucagauucgacuccuggguaaaccaauucuacacuuuagcccccaugggaaacggcaccggucggcgccgcgcacucuaa

SEQ ID NO: 37431 - RNA, 1623 nt, Artificial Sequence
  derived and/or modified sequence opt11 from major_capsid_protein__Norovirus__AGM46379
augaaaauggcuucuuccgacgccaacccaucugauggcucuacagcaaaucuaguccccgaagucaacaacgaaguaauggcccuggaaccuguuguaggagcagccauagccgcccccgucgcuggccagcaaaacgucaucgauccguggauccgcaacaacuucguccaagcccccggcggagaguucacagucucaccccgcaacgcuccaggcgagauccucugguccgccccacucggcccagaucuuaaccccuaccucucacaccuugcccgcauguacaacggcuacgccggcggcuucgaaguccaagucguacuagcaggcaacgccuucacagccggcaaaaucaucuucgcugcaguucccccuaacuuccccaccgaaggccucucccccagccaagucaccauguucccccacaucauagucgacguccgucagcucgaacccguccucaucccccugccagacgugcgaaacaacuucuaccacuacaaccaauccaacgaccccaccaucaaacucaucgccaugcucuacacaccccuacgcgcaaacaacgccggagacgacguuuucaccguauccugccgcguccuuacgcgccccagccccgacuucgacuucaucuuccuaguacccccaaccgucgaaucccgaacaaaacccuucuccgucccuauccuaaccgucgaagaaaugaccaauucccgcuucccuaucccacuagaaaaacucuucaccggccccucuucagccuucgucguccaaccccaaaacgguagaugcaccaccgacggaguccuacucggcaccacacaacucucccccguuaacauaugcaccuuccgcggcgacgucacccacauaacuggcucgcgcaacuauacaaugaaccuugccacccaaaacuggaacucauacgaccccaccgaagaaauccccgcaccccuuggaacaccagacuuugucggcaaaauacaaggagucuuaacccaaaccaccagagcugacggcuccacccgcgggcacaaagccacaguuuacaccggcuccgcagacuucgcacccaaacucggccguguccaauuugccaccgacacagauaacgacuuugacgccaaccaaaacaccaaauucaccccagucggcguaauccaagauggcgacaccgcccaccgcaacgaaccucaacaauggguucuccccucauacuccggccgcaacucacacaacguccaccucgcccccgccguugccccaacauuccccggcgaacaauuacucuucuuccgcuccaccaugcccggcugcuccggcuaccccaacauggaccucgacugccuccucccccaagaaugggugcaauacuucuaccaagaagccgcccccgcacaaucagacgucgcccugcucagauucguaaacccagacacaggacgaguccuauucgaaugcaaacuccacaaauccggauacgucacagucgcacacacuggacaacacgaucuagucauacccccaaacgguuacuuccgcuucgauagcugggucaaccaauucuacacauuagccccaauggguaacggcacuggccgccgacgcgcccucuaa

SEQ ID NO: 37432 - RNA, 1623 nt, Artificial Sequence
  derived and/or modified sequence opt11 from major_capsid_protein__Norovirus__AGM46384
augaaaauggcaagcucugacgcgaaucccuccgauggcuccaccgccaauuuaguccccgaagucaacaacgaaguaauggcucuagaacccgucguaggcgccgcuaucgccgcccccgucgcaggccaacagaacgucauagaccccuggauccgcaacaacuuuguccaagcccccggaggugaguucaccgucagcccacgaaacgcccccggagaaauacucugguccgcacccuuaggccccgaucucaaccccuaccucucccaccuagcccgcauguacaacggcuaugccggcggcuucgaaguccaagucguccucgccggaaacgccuucaccgcaggcaaaaucauauucgccgcagucccacccaacuuccccaccgaaggccuaucccccucccaaguuaccauguucccccacaucaucguugacguacgccaacuagagccaguccucaucccacucccugacgucagaaacaacuucuaccacuauaaccaaucuaacgaccccaccaucaagcucaucgcgaugcuauacacaccacucagagccaacaacgccggcgacgacgucuucacugucuccugccgaguccucacacgaccaucacccgacuucgacuuuaucuuucucgucccacccacuguagaaucacgaaccaaacccuucuccguccccauccuaacugucgaagaaaugacuaacucccgcuuccccauaccacucgaaaaacucuucaccggccccagcucagcauucgucguccaaccacaaaacggccgcuguaccacagacggcguccuccucggcaccacacaacuaucaccagucaacaucugcacauuccgcggagacguaacccacauaacaggcucacgcaacuacaccaugaaccucgcaacacaaaacuggaacuccuacgacccaaccgaagaaauccccgcaccccucggaacccccgacuucgucggaaaaauccaaggcguccucacccaaaccacaagagccgacggaucaacacgaggccacaaggccacagucuacaccggcucagccgacuucgcccccaaacuaggucgaguccaauucgccacagacaccgacaacgacuucgacgcaaaccaaaauaccaaguucacucccgucggcguuauccaagacggugauaccgcccaccgcaacgaaccacaacaguggguacuccccagcuacagcggacgcaacucccacaacguacaccucgcccccgccguagccccaaccuucccuggcgaacaacuacucuucuuccgcuccacuaugccaggcugcuccggcuauccaaacauggaccuugacugccuacuaccacaagaauggguacaauacuucuaucaagaagccgcccccgcacaaucugacgucgcacuucuccgguucgucaaucccgacaccggcagaguccucuucgaauguaaacuacacaaaagcggcuacgucaccgucgcccacacaggacaacacgacuuaguaaucccaccuaacggcuacuuccgcuucgauagcugggucaaccaauucuacacccuugcaccaaugggcaacggaacgggacgucgccgagcccuuuga

SEQ ID NO: 37433 - RNA, 1623 nt, Artificial Sequence
  derived and/or modified sequence opt11 from major_capsid_protein__Norovirus__AGM46386
augaaaaugggcuccaacgacgccaaucccucggacggcagcaccgcaaaccucguccccgaagucaacaacgaagucauggcacuugaacccgucgucggagccgccauagccgcaccuguugccggccaacagaacgucaucgacccauggauccguaacaacuucguucaagcccccggcggagaguucaccgucuccccacgaaacgcccccggcgaaauccucuggucagcaccccuuggucccgaccucaacccauaccuuucccaccucgcacgaauguacaacggcuaugccggcggcuucgaaguacaagucauccucgccggcaacgccuuuacagcaggaaaaaucaucuucgcagccgucccaccaaacuuuccuaccgaaggacucucccccucccaaguaaccauguucccucacaucauugucgacguacgccaacucgaacccguccucaucccccuacccgacguccgcaauaacuucuaccacuauaaucaauccaacgacccaaccaucaaacuuaucgccaugcucuacacaccacuacgcgccaacaacgcaggcgacgacgucuucacugucuccugccgcguccucacacgaccauccccggacuuugacuucauauuccuaguacccccuaccgucgaaucacgaacuaaacccuuuuccguccccguacucaccgucgaagaaaugaccaacucacguuucccaaucccacuugaaaaacuauucacaggucccucaucugccuucguaguacaaccccaaaacggacgaugcaccaccgacggcguccuucucggaaccacucaacuaucuccaguuaacauaugcacauuccgcggcgacgucacacacauccccggcucgagaaacuacaccaugaaccuagccucccaaaacuggaacagcuacgacccaaccgaagaaauccccgccccacuaggcaccccagacuucgucggcaaaauccaaggcguccuuacccaaaccacccgaaccaacggcuccacacgcggccauaaagccaccgucuacaccggauccgcugacuucagcccaaaacuaggacgcguccaauucgccaccgacaccgacaacgacuucgaaaccaaccaaaacaccaaauucaccccggucggcgugauccaagacggcucaaccaccccacgcaacgaaccccaacaauggguccucccauccuacucuggucgaaacauacacaacguccaccuugccccagccgucgcccccaccuuccccggugaacaacuccuauucuuucgcucuaccaugccagguugcagcggcuaucccaacauggaccucgacugcuuacucccccaagaauggguccaguauuucuaccaagaggcagcccccgcacaauccgacgucgcccuccuccgcuucgugaacccugacacaggccguguccucuucgagugcaaacuucacaaauccggcuacgucaccgucgcccacaccggacagcacgaucuuguaaucccucccaacggauacuuccgcuuugacuccuggguaaaccaauucuacacccucgcacccaugggcaauggcacgggacgccgccgcgcccucuga

SEQ ID NO: 37434 - RNA, 1623 nt, Artificial Sequence
  derived and/or modified sequence opt11 from major_capsid_protein__Norovirus__AGM46388
augaaaaugggcuccaacgacgccaaccccuccgacggcuccacagccaaccucguuccagaagucaacaacgaggucauggcccuugagcccgucgucggcgccgcaaucgccgcgcccgucgcaggccaacaaaacguaaucgaccccuggauccgcaacaacuucguccaagcccccggcggcgaguucaccguuagcccucgaaacgcaccaggagaaauccuuuggucggcaccccucggccccgacuuaaaucccuaccuuucccaccuagcccgaauguacaacggcuacgccggaggcuucgaaguccaagucauccuugccggaaacgccuucacagccggcaaaauaaucuucgcugccgucccaccaaauuucccuacagagggccuaucucccucacaagucaccauguucccccacaucaucguggacguacgccaacucgaaccuguccuaaucccccuucccgacguccgcaacaacuucuaccacuacaaccaaagcaacgacccuaccaucaaacuuauagccaugcucuacaccccacuucgcgccaauaaugcaggcgaugacgucuucaccgucuccugccgagugcuaacacgcccaucacccgacuucgacuuuaucuuccuaguacccccaaccgucgaaucucgaaccaaacccuucuccguccccauccucaccgucgaagaaaugacaaacucacguuucccaaucccacucgaaaaacucuucaccggucccuccuccgccuucgucguccaaccccaaaacggcagaugcacaaccgacggcguccuacucggaaccacccaacucucccccgucaacauaugcaccuuucgaggcgacgucacacacaucaccgggucacgcaacuacaccaugaaccucgccacacaaaauuggaacuccuacgaccccacagaagagauucccgcaccccuaggcacccccgacuuuguaggcaaaauccaaggcgucuugacccaaacaacccgcgcagacggcuccacccgcggccacaaagccacaguauauaccggcucagcugacuucgcccccaaacuaggacgcguccaguucgcuacagacaccgacaacgauuucgacgcaaaccaaaacaccaaauucacccccgucggcgucauccaagacggcgacaccgcccaccgaaacgaaccccaacaauggguccuuccauccuacuccggacgcaacucacacaacguccaccucgcccccgcaguagcccccaccuuucccggcgaacaacuccuguucuucagauccaccaugcccggcugcuccggcuaccccaacauggaccucgauugccuccuaccccaagaauggguacaauacuucuaccaagaggccgcccccgcccaauccgacgucgcacuucucagauucgucaaccccgacacuggccgcguacucuucgaaugcaaacuacacaaauccggcuacguuacagucgcucacaccggacagcacgaccuaguuauaccacccaacggauacuuccgauucgacucaugggucaaccaauucuacacccuagcucccaugggcaacggcaccggccgccguagggcccucuaa

SEQ ID NO: 37435 - RNA, 1623 nt, Artificial Sequence
  derived and/or modified sequence opt11 from major_capsid_protein__Norovirus__AGM46392
augaaaauggcauccuccgacgccaacccauccgauggaucuaccgccaaccucguaccagaaguuaacaacgaagucauggcccuagaaccaguagucggcgccgccauugccgcuccuguagcaggccaacaaaacgucaucgacccuuggauccgcaacaauuucguccaagcaccagguggagaguucaccgucagcccacgcaacgcccccggcgaaauccuauggucggccccacucggaccagaccuaaacccauaccucucccaccuagcccgaauguacaauggcuacgccggcggcuucgaaguccaaguuauacuagcuggaaacgcauucacagcuggaaaaauuaucuucgccgccguaccacccaacuuuccaaccgaaggccucucaccaucgcagguaacaauguucccccacaucauagucgacguccgccaacucgaacccguccuaaucccacucccagacgucagaaacaacuucuaucacuacaaccaaucaaacgacccaacuaucaaacucaucgccaugcucuacacaccccuacgcgccaacaacgcaggcgacgauguauucaccguuuccugccgaguccuaacccgccccuccccagacuucgacuucauuuuccucguaccacccaccguagaaucacgcaccaaacccuucuccguacccauccuuacagucgaagaaaugaccaacucacgcuucccaauaccgcuugaaaaacucuucaccggccccuccuccgccuucgucguacagccccaaaacggacgcugcaccaucgacggaguauuacucggcaccacccaacucucccccguuaacauaugcacguuccgaggcgacgucacacacaucacaggauccagaaacuacaccaugaaccuagcaacccaaaacuggaacuccuacgacccuaccgaagagaucccugccccacuuggcacccccgacuucgucgguaaaauacaaggcguccucacccaaacgacaagagcagacggcucaacccgaggccacaaagccaccgucuacaccggauccgccgacuucgcccccaaacucggacgaguccaauucgccacagacaccgacaaugacuucgacgccaaccaaaacaccaaauucaccccaguaggcguaauacaagacgguaacacagcccaccgcaacgaaccucaacaauggguccuacccuccuacucaggccgcaacucccacaacguccaccucgcaccagccgucgcccccaccuucccuggagaacaauuccucuucuuccgcuccaccaugcccggcuguuccggauaucccaacauggaccucgacugccuacuaccccaagaauggguacaauacuucuaccaagaagccgcucccgcacaauccgacguugcccugcuccgcuucgucaacccagacacaggacgcguccucuucgaaugcaaacuccacaaauccggcuacgucaccgucgcacacaccggacaacacgaccuugucaucccacccaacggauacuuuagauucgacuccuggguaaaccaauucuauacccuagcccccaugggcaacggaaccggccgccgacgcgcccucuaa

SEQ ID NO: 37436 - RNA, 1623 nt, Artificial Sequence
  derived and/or modified sequence opt11 from major_capsid_protein__Norovirus__AGM46395
augaaaauggccuccuccgacgccaaccccucagacggcuccacagcuaaccucguccccgaaguuaauaaugaaguuauggcacucgaacccgucgucggagcagcuaucgccgcccccgucgccggccaacaaaacguuaucgaucccuggauucguaauaacuucguccaagcccccggcggcgaguucaccguuucaccccgcaacgccccaggagaaauacuaugguccgcaccccuaggccccgaccuaaaccccuaccucucucaccucgcccgaauguauaauggcuacgccggcggcuucgaaguacaagucauacuagccggcaacgccuucacagccggaaaaaucaucuuugcugccguucccccuaacuucccaaccgaaggacuaagcccuucacaagucaccauguucccgcacaucaucgucgacguccgacaacucgaacccguccucauaccuuuaccagacguccgaaacaauuucuaccacuacaaccaauccaacgacccgaccaucaaacucaucgccaugcucuacaccccucuccgcgccaauaaugcuggagacgacguauucaccgucucaugccgaguacucacccgacccuccccggauuucgacuucaucuuccucguucccccaaccgucgaaucccgaaccaaacccuucuccguccccauccuaaccguagaagaaaugacaaacuccagauuccccaucccccucgaaaaacucuucaccggacccuccuccgcguuugucguacaaccccaaaacggccgaugcaccacagacggaguccuacuaggaacaacacagcucuccccaguaaacaucugcaccuuccgcggggacguaacccacaucaccggcucacgcaacuacaccaugaaccuagcaacacaaaacuggaacucuuacgacccuaccgaagaaaucccugcuccccuaggaacucccgacuucgucggaaaaauacaagguguccucacccaaaccacccgcgcagacggcuccacccguggccacaaagccacugucuacaccggcuccgccgacuucgcacccaaacuaggccgcguacaguucgccacugacaccgacaaugacuuugaugcuaaccaaaauaccaaauucaccccugucggcgucauccaagacggcgacaccgcccaccgcaacgaaccccaacaauggguccuacccuccuacuccggccgaaacucccacaacguccaccucgcaccagccgucgcccccaccuuccccggcgaacaacuccuuuucuuccgcucaacuaugcccggaugcucuggcuaccccaauauggacuuagacugccuccucccucaagaauggguacaauacuucuaccaagaagcugcaccagcacaauccgacgucgcgcuccuccgcuucgucaaccccgacaccggccgcguacuauucgaaugcaagcugcacaaauccggcuacgucaccguagcccacacaggccaacacgaucuagucaucccacccaacggcuacuuccgcuucgacuccugggucaaccaauuuuauacccucgcacccaugggcaacgguaccggccgccgccgcgcccuauaa

SEQ ID NO: 37437 - RNA, 1623 nt, Artificial Sequence
  derived and/or modified sequence opt11 from major_capsid_protein__Norovirus__AGM46398
augaaaauggcaagcucggacgcaaacccuucagacggcucaaaagcaaaccuagucccugaaguaaacaacgaagucauggcccucgaaccagucgucggcgccgcaaucgcugcacccgucgcaggccaacaaaacguaaucgaucccuggauccgcaacaacuucguccaagcccccggaggcgaguucaccgucuccccacgaaacgcccccggcgaaauccucuggucugccccgcucggccccgaucucaacccauaccuuucacaccuugcucgcauguacaacggcuacgcaggcggcuucgaaguccaaguaauccucgccggcaacgccuucacagcuggaaaaaucaucuucgccgccgucccaccaaacuucccuaccgaaggucucuccccaucccagguaacaauguucccccacaucaucguagacguacgacaacucgaaccaguccuaaucccccucccugacguccgaaacaacuucuaccacuacaaccaauccaacgacccgaccaucaaacugaucgccaugcucuauacaccccuucgcgccaacaacgccggcgacgacguauucaccgucuccugucgcguccucacccgccccucccccgacuuugacuuuauauuccucguuccacccaccgucgaaucacgcaccaaacccuucuccguccccguccucacugucgaggaaaugaccaacucacguuuccccaucccccuagaaaaacucuucacaggcccaucauccgccuucgucguucaaccccaaaacggucgcugcaccacagacgggguccuccuggguacaacccaauuaagcccuguaaacaucugcaccuucagaggugacgucacccauauacccggaucccgcaacuacaccaugaaccuagccucucaaaacuggaacuccuacgaccccaccgaagaaauucccgcaccccucggaacucccgacuucgucggcaaaauucaaggaguccuuacccagaccacccguaccaacggcucuacccgcggccacaaagccaccguuuacaccggcuccgccgacuucucccccaaacucggccgcguacaauucgccacugacacagacaacgacuucgagaccaaucaaaacaccaaauucacucccgugggcguuauacaagacggcuccaccaccccacgaaacgaaccccaacaauggguacuccccucauacucaggucguaacauccacaacguucaccuagcccccgccguagcccccaccuucccaggcgaacaacuccucuucuuccgaucaaccaugccaggcugcuccggcuaccccaacauggaccuagacugccuccuaccucaggaauggguccaauacuucuaccaagaagccgccccagcccaauccgacguagcccuucuccgcuucgucaaccccgacacaggacguguacucuucgagugcaaacuccauaaauccggcuacguaaccgucgcacacaccggucagcacgaccucgucauacccccaaacggauacuuccgcuucgacucauggguaaaccaguucuauacccucgcaccaaugggcaacggcaccggcucccggcgugcccucuaa

SEQ ID NO: 37438 - RNA, 1623 nt, Artificial Sequence
  derived and/or modified sequence opt11 from major_capsid_protein__Norovirus__AGM46401
augaaaauggcauccucugacgcuaacccuagcgacggcuccaccgccaaccucgucccagaaguaaauaacgaagucauggcacucgaaccagucgucggcgcugcaaucgccgcacccgucgccggccaacaaaacgucaucgacccauggauucgcaauaacuucguccaggcccccggaggagaauuuaccguuuccccucgaaacgcccccggcgaaauacuauggucagcaccccuuggcccggaccucaacccauaccuuucucaccuggcccggauguacaacggcuacgccggcggcuucgaaguccaagucauccucgccggcaaugcauucaccgccggaaaaauaaucuucgcagccguacccccuaacuucccaacggaagggcucucacccucucaagucaccauguucccccacaucaucguugacguacgacaacuugaacccguccucaucccccucccugacguccgcaacaacuucuaccacuacaaccaauccaacgaccccaccaucaaacucaucgccaugcuauacacuccacuccgggccaacaacgccggagacgacgucuucaccgucuccugcagaguccucacacgccccucccccgacuucgacuucaucuuccucguaccacccacgguugaaucccgaacaaaaccguucucgguacccguucuuaccgucgaagaaaugaccaacucccgcuucccaaucccccucgaaaaacucuucacaggccccuccucagcuuucgucguccagccccaaaacggccgcugcacaaccgacggaguccuccuaggcaccacacaacucucucccgucaacaucugcaccuuccguggcgacgucacccacaucccuggcucccguaacuacacuaugaaccucgcaucacaaaacuggaacuccuacgaucccaccgaagaaauuccagccccgcucggcacccccgacuuuguaggaaaaauccaagguguccucacccaaaccacccgcacaaacgguuccaccagaggccacaaagcgaccguauacaccggcuccgccgauuucagcccaaaacucggaagaguucaauucgccaccgacacugauaaugacuucgaaaccaaccaaaacaccaaauucacccccgucggcgucauacaagauggcucuacuacaccccgcaacgaaccacaacaaugggugcuacccucuuacagcggccgaaacauccacaacguccaccucgcccccgccgucgccccuaccuuccccggagaacaacuacucuucuuccgcucaaccaugcccggauguucaggcuaccccaacauggaccucgacugccuacucccucaagaauggguacaauauuucuaccaagaagccgcccccgcccaaucagacgucgcccuacuccgcuucgucaacccagacaccggccgcguccucuucgaaugcaaacuucacaaauccggauacguaaccgucgcacacacuggccaacacgaccucgucaucccacccaacggcuacuuccgcuucgacuccugggucaaucaauucuacacccuagcccccaugggcaauggcacaggccgccgccgagcccuauaa

SEQ ID NO: 37439 - RNA, 1623 nt, Artificial Sequence
  derived and/or modified sequence opt11 from major_capsid_protein__Norovirus__AGM46403
augaaaauggccagcuccgacgccaacccaagcgacggauccaccgccaaccuuguccccgaagugaacaacgaagucauggcacucgaacccguagucggcgcagccauugcagccccuguggccggccaacaaaacgucaucgaucccuggauccgcaacaacuucguccaagcaccaggcggcgaguucaccgucuccccacguaacgcacccggcgaaauacucugguccgcgccgcucggcccugaucucaaccccuaccuaucacaccucgcccguauguacaacggcuacgcaggcgguuucgaaguacaagucauacuagccggaaaugccuucacagcaggcaaaaucaucuucgcagccgucccacccaacuuucccaccgaaggccucucacccucccaaguuaccauguucccccacaucaucguagacguccgacagcucgaacccguccuaaucccucuccccgacguccgcaacaacuucuaccacuacaaccaauccaacgaccccaccaucaaacucaucgccaugcucuacacuccucuccgagccaacaacgcaggagaugacguuuucaccgucuccugcagaguucucacccguccauccccagacuucgacuucaucuuccucguacccccaaccgucgaaagucgcaccaaaccuuucuccguccccguccuaaccguagaagaaaugaccaacucccgauucccaauaccacuagaaaaacucuucacaggccccuccuccgccuucguaguccaaccucaaaacggccgcugcaccaccgacggcguacuccucggcaccacccaacucuccccaguaaacaucugcaccuuccgcggagacgucacccacauccccggcucacgaaacuacacaaugaaccuagcaucacaaaacuggaacucauacgaccccaccgaagaaaucccugcaccucuaggaacccccgacuucguaggcaagauucaaggcguccucacccaaacaacacgcaccaacggaucaacacgcggccacaaagccaccgucuacacugguuccgccgauuucucaccaaaacucggccguguccaauucgcaaccgacacugacaaugacuucgaaaccaaccaaaacaccaaauuuacccccgucggcgucauccaagauggauccaccaccccacgcaacgaaccacaacaauggguccuccccuccuacucuggccgcaacauccacaacguacaccucgcacccgccgucgcaccaacauucccaggagaacaacucuuguucuuucgcuccacaaugcccggcugcuccggauacccaaauauggaccucgacugccuucucccacaagaauggguccaauauuucuaccaagaagcagcccccgcccaaagcgacguagcccuccuacgauucguaaaccccgacaccggcagaguacucuucgaaugcaaacuccacaaaucagguuacguaacaguagcacacaccggacaacacgaccucgucaucccacccaauggauacuuccgguucgacuccugggucaaccaauucuacacccuagcucccaugggcaacggcacaggccgccgccgcgcccucuaa

SEQ ID NO: 37440 - RNA, 1623 nt, Artificial Sequence
  derived and/or modified sequence opt11 from major_capsid_protein__Norovirus__AGM46407
augaaaauggcaagcucagacgccaacccaucugacggcuccaccgccaaccucgucccugaagucaacaacgaaguaauggcgcucgagccugucgucggugcagccaucgcugcccccgucgcgggccaacaaaacgucauugaccccuggauccgcaacaacuucguccaggcccccggcggcgaguucaccgucucgccccgcaacgcccccggcgaaauccucugguccgcaucccucggccccgaccucaacccauaccucagccacuuagcccgcauguauaauggcuacgcagggggauucgaaguccaagucauccuagcaggaaacgccuucacagcuggcaaaaucaucuucgccgccguuccucccaacuuccccaccgaaggacuaucacccucccaaguaacaauguucccccacaucauagucgacguccgccaacucgaacccguccucaucccccuccccgacguccgaaacaacuucuaucacuacaaccaaucaaacgaccccaccaucaaacucaucgccaugcuauacacaccccuccgcgccaacaacgcuggcgacgacgucuucacaguuuccugccguguccuaacccgccccucccccgacuucgacuucaucuuccucguacccccaaccgucgaaucaagaaccaaaccauucuccguccccguccucaccgucgaagaaaugaccaacucccgcuuccccaucccucuagaaaaacucuucaccggcccauccuccgccuucguaguccaaccccaaaacggacgcugcacaaccgacggcguccucuugggaaccacucagcuaucccccguaaacaucugcaccuuccgcggagacgucacccacauacccggaucucguaacuauacaaugaaccucgcaucacaaaacuggaacucauacgaucccacagaagagauucccgcaccccucgggacaccagacuucgucggcaaaauccaaggcguccuaacccaaaccacacgaaccaacggcuccacccgcggccacaaagccaccguauacacaggcagcgccgacuucucccccaaauuaggccgcguacaauucgccaccgacacagacaacgacuucgaaaccaaccaaaacaccaaauucacccccgucggcgucauccaagacgguuccaccaccccgcguaaugaaccacaacaauggguucuccccuccuacucaggacgcaacauacacaacguccaccuugcccccgccguagccccuaccuuccccggcgaacaacuccucuucuuccgcuccacgaugcccggcugcucaggauacccaaacauggaccucgauugccuacuaccacaagaauggguccaauacuucuaccaagaagccgccccugcacaauccgacgucgcccuccucagauucguuaaccccgauaccggacgcguccucuucgagugcaaacugcacaaaucaggcuacgucacagucgcccacacaggucaacacgaccucgucauacccccaaauggcuauuuccgcuucgacucaugggucaaccaauucuacacccucgccccaaugggaaaugguaccggccggagacgagcacucuag

SEQ ID NO: 37441 - RNA, 1623 nt, Artificial Sequence
  derived and/or modified sequence opt11 from major_capsid_protein__Norovirus__AGM46409
augaaaauggccucaaacgacgccaaccccuccgacggcucaacagcuaaccucguccccgaagucaacaacgaagucauggcucucgaacccgucgucggcgcagcaaucgcugccccaguagcaggccaacaaaacguuaucgaccccuggauacgcaacaacuucguucaagccccaggaggugaguucacuguaagcccccgcaacgcccccggagaaauacucugguccgcaccccucggccccgaccuaaaucccuaccucucacaccucgcucggauguacaacggcuacgccgguggcuucgaaguacagguaauccucgcaggcaacgccuucacugccggaaaaaucaucuucgcagccgucccacccaacuuccccacagaaggacuaucuccuucccaggucaccauguucccacacaucaucguugacguccgacaacuagaaccuguccuaaucccccuccccgauguccgcaacaacuucuaucacuacaaccaaucaaacgacuccacaaucaagcuaauugccaugcucuacaccccacuacgcgccaacaacgcaggagaagacgucuucaccgucuccugccgcguacugacccgccccucccccgauuuugacuucaucuuccucgucccacccacagucgaaucccgcaccaaacccuucaccguccccauccucaccguugaagagaugaccaacagccgcuucccgaucccccuagaaaaacucuucacuggccccuccucugccuucgucguccaaccccaaaacggacgcuguacuacagacggaguacuccuaggaaccacccaacuaucacccguaaacaucugcaccuuccgaggcgacguaacccauaucgccggcucacggaacuacacaaugaaccucgccucccuaaacuggaacaacuacgaccccaccgaagagauaccugcaccccucggcacccccgacuuugucggaaaaauccaaggcguccucacccaaacaacaaaaggagacggcucaacccgaggacacaaagccaccguauacaccggcucagcccccuucacccccaagcucggcucuguccaauucuccaccgacaccgaaaacgacuucgaaacccaccaaaacaccaaauucacccccguaggcguaauccaagacggcggcacaacccaccgaaacgaaccccagcaauggguacuccccucguacucuggccgcaaugugcaaaacguccaucucgcacccgccgucgcacccaccuuuccaggugaacagcuacucuucuuuagauccacuaugcccggaugcuccggcuaccccaacauggaccucgacugccuacugccccaagaauggguccaacacuucuaccaagaagccgcaccagcucaauccgacgucgcccuacuccgauucgucaaucccgacacaggccgcguacucuucgaaugcaaacuucacaaguccggauauguaaccguagcccacacaggacaacacgaccuagucaucccucccaacggcuacuucagauucgacuccugggucaaccaauucuacacucucgcucccaugggcaauggcacaggacgcagacgugcacucuaa

SEQ ID NO: 37442 - RNA, 1623 nt, Artificial Sequence
  derived and/or modified sequence opt11 from major_capsid_protein__Norovirus__AGM46413
augaaaauggccuccaacgacgccucaccuuccgacggcuccgccgccaaccucguaccagaagucaacaacgaagucauggcccucgaaccagucgucggggcagcuaucgccgcccccguagcaggucagcaaaacguaauagaucccuggaucagaaacaauuucguccaagcaccuggcggugaguucaccgucucaccccgcaacgcgccaggcgaaauacucugguccgccccucucggacccgaucucaaucccuaccuaucccaccuagccagaauguacaacggcuacgccggcggcuucgaaguacaagucauccucgccgguaacgccuucaccgcugguaagaucaucuucgccgccguaccacccaacuuccccacugaaggccucuccccaucccaaguuacaauguucccccacaucaucgucgacgucagacaacuagaacccguccuaauaccccucccagacguccgaaacaacuucuaccacuacaaccaauccaacgacuccaccaucaaacuaaucgcuaugcucuacacaccacuccgcgcaaacaacgccggcgaagaugucuucaccgucuccuguagaguucucacccgccccucccccgacuucgacuucaucuucuuaguuccacccacagucgaaucacgaacaaaacccuucaccgucccaauccucaccgucgaagagaugaccaauucacgauucccuauaccccucgaaaaacuauucaccggccccuccucagcuuucgucguucaaccccaaaacggcagauguaccaccgacgguguccuccucggaaccacccagcucuccccagucaacaucugcaccuuucgaggagacgucacacacauagcaggcucccgcaacuacacaaugaaccucgcuucccuuaacuggaacaacuacgacccaacggaagaaauccccgccccacuuggaacacccgacuuugucggcaaaauccaaggcguccuaacccaaacaacuaaaggcgacggcucaacccgcggccacaaagcuaccgucuacaccggguccgcccccuucacacccaaacuaggaucgguccaguuuuccaccgacacagagaacgacuucgaaacccaucagaacacaaaauucacuccaguaggcgucauucaagacggcgggaccacccaccgcaacgaaccacaacaauggguccucccauccuacucaggccgaaacguacaaaauguccaccucgccccagccgucgcuccgaccuucccgggcgaacaacuucucuucuuccgcuccacaaugccaggaugcuccggcuaccccaacauggaccuagacugccuccuaccccaagaauggguacagcacuucuaccaagaagccgccccagcacaauccgacgucgcacuccuccgcuucguuaauccagacaccggccgcguacuauucgagugcaaacuacacaaauccggcuacgucaccgucgcccacaccggccagcacgaccucgucauaccacccaacggauacuuucgauucgacucuuggguaaaccaauucuacacccucgcccccaugggcaacggcaccggccgacgacgugcccucuga

SEQ ID NO: 37443 - RNA, 1623 nt, Artificial Sequence
  derived and/or modified sequence opt11 from major_capsid_protein__Norovirus__AGM46415
augaaaauggccucaucagacgccaacccauccgacggcucugccgccaaucucgucccagaagucaacaacgaagucauggcccuagaaccaguggucggcgccgcuaucgccgcuccagucgcaggccaacaaaacgucaucgaccccuggauacgaaacaacuucguccaagccccuggcggagaguucaccguuucaccccgcaacgcacccggagaaauucucugguccgccccacuaggucccgaccucaaccccuaccuaucucaccuugcccgcauguacaacggcuacgcugguggcuucgaaguccaaguuauacucgccggcaacgccuucacagcuggcaaaaucaucuucgcagccgucccgcccaacuuccccacugaaggccuaucccccucucaaguaaccauguuuccacacaucaucgucgauguacgacaacucgaacccguacuaauuccacuccccgacguccgcaacaacuucuaccacuacaaccaaucaaacgacuccaccauuaaacucaucgccaugcucuacacaccccuacgcgccaacaacgccggcgaagacguauucacagucagcugucgcguacuaacccgccccuccccagauuucgacuucaucuuccucguacccccaaccguugaaucucgaaccaaacccuucacuguccccauccucacagucgaagaaaugaccaacucccgcuucccaaucccacuagaaaaacucuuuaccggucccuccuccgcauucgucguccaaccucaaaacggacgcuguaccaccgacggaguccuccuuggcacaacccaauuaucuccugucaacauaugcaccuuccgcggugaugucacacacaucgccggaucccacaacuacaccaugaaccuagcaucccuaaauuggaacaacuaugauccaaccgaagagauccccgcaccccucgguacacccgacuucgucggcaaaauccaaggcguacucacccaaacaacuaagggagacggauccacccgcggccacaaagccaccguauacacagguuccgccccuuuuacccccaaacuaggaucaguccaauucuccacagacaccgagaacgacuucgaaacucaccaaaauacaaaauucacaccaguaggcguaauucaagacggaggcaccacccaccgcaacgaaccccaacaauggguccuaccaagcuacagcggccgcaacgucccuaacguccaucucgccccagccguggcccccaccuuccccggcgaacaacuacucuucuuccgcucaacaaugccaggaugcuccggcuaccccaacauggaccuagacugucuccucccacaagaauggguccaacacuucuaccaagaagccgcccccgcacaaucagacguagcacugcuacguuucguaaaucccgacacaggucgaguccuauucgaaugcaaacuccacaaaagcggcuacgucaccguagcccacaccggccagcaugaccucgucauacccccuaacgguuacuuccgauucgacagcugggucaaccaauucuauacccucgcccccaugggcaacgguacaggccgccgacgcgcccucuaa

SEQ ID NO: 37444 - RNA, 1623 nt, Artificial Sequence
  derived and/or modified sequence opt11 from major_capsid_protein__Norovirus__AGM46419
augaaaauggcuuccaacgacgccucccccuccgauggcuccgccgcaaaccucguccccgaagucaacaacgaaguaauggcccucgagcccgugguuggagccgccaucgccgcccccguagcaggccaacaaaacgucaucgacccauggauccgcaacaacuucguacaagcccccggcggcgaguucacagucucccccagaaaugccccgggcgaaauccuuuggucagcaccccucggccccgaucuuaaccccuaucucagccaccucgcccguauguacaacggguacgccggcggcuuugaaguacaagucauccucgccgguaacgcauuuacagcaggaaaaaucauauucgccgccguuccacccaauuuucccaccgaaggccucucccccucccaagucaccauguucccacacauaauuguugauguccgacagcucgaacccguacucaucccacuaccugacguacgaaauaacuucuaccacuacaaccaguccaacgacucgaccaucaaacucaucgcuaugcuuuacacaccccuaagagcgaacaacgccggagaagacguauucaccgucagcugccgcguccucacccgccccucacccgacuucgacuucaucuuccucgucccacccaccgucgaaagccguaccaaacccuucacaguccccauccuaacagucgaagaaaugaccaacucccgcuuccccaucccucucgaaaaacucuucaccggacccuccggagccuuuguaguccagccccaaaacggccgcuguaccaccgacggcguccuccucggcaccacccaacucucacccgucaacaucugcacauucagaggugaugucacccacaucgccggaagccguaauuacacaaugaaccuagcaucacucaacuggaacaacuacgacccaaccgaagaaauacccgcuccccucggaauccccgacuucgucggaaaaauccaaggcguccuaacucaaacaacaaaaggcgacggcuccacucggggccauaaagccaccgucuacaccggcuccgcccccuucacaccuaaacucggcagcguucaauucuccacagacacagaaaacgacuucgaaacacaccaaaacaccaaauucaccccagucggaguaauccaagacggaggaaccacacaccgcaacgaaccccaacaauggguucucccaucauacuccggccgcaacguccagaacguacaccucgcacccgccgucgcccccaccuuccccggagaacaacuacuauuuuuccgcucaaccaugcccggaugcaguggcuaccccaacauggaccuagacugccuacucccccaagaauggguacaacacuucuaccaagaagccgccccagcacaauccgacgucgcacuacuuagauucgucaaccccgacaccggccgcguacucuucgaaugcaaacuccacaaauccggcuacgucacggucgcgcacacaggccaacacgaccuagucaucccacccaacggcuacuucagguucgacucaugggucaaccaauucuacacacuagcacccaugggcaauggcacaggccgcaggcgugcacucuaa

SEQ ID NO: 37445 - RNA, 1623 nt, Artificial Sequence
  derived and/or modified sequence opt11 from major_capsid_protein__Norovirus__AGM46421
augaaaauggcauccaacgaugcuucccccuccgacgggucagccgccaaccucguacccgaagucaacaacgaaguaauggcgcucgaaccaguuguaggcgccgccauagccgcccccgucgccggccaacaaaacgucauagaccccuggauccgaaacaacuucguccaagcaccaggcggugaguucacagugucccccagaaacgcccccggcgaaauacuaugguccgccccucucggccccgaccuaaacccauacuuaucacaccucgcccgcauguacaacggcuacgccggaggauucgaaguccaggucaucuuagccgggaaugccuucaccgccggcaaaauuaucuucgccgccguucccccaaacuuccccacagaaggacucucucccucccaagucaccauguucccccacaucaucguagacguaagacaacucgaacccguccuuaucccucuacccgacguccgcaacaacuuuuaccacuacaaccagucaaaugacucuacaauaaaacucaucgccauguuauacacaccccuucgcgccaacaacgccggagaagacguauucaccgucucaugccgaguccuaacacgacccagccccgauuucgacuucaucuuccucgucccacccacagucgaaucacgaaccaaacccuucacaguccccauccuuaccgucgaagaaaugaccaacucaagauuccccauaccccucgaaaaacuauucaccggaccauccucagcauucguuguccaaccccaaaacggacgauguaccacagauggcgugcuccucggaaccacacaacucagccccgucaauauaugcaccuuccguggcgacgucacacacaucgcaggaagucgcgacuacaccaugaaccucgcuucacugaacuggaacaacuacgaccccaccgaagaaauacccgccccacucggcacaccagauuucgucggcaaaauccagggcgucuuaacccaaaccacuaaaggcgacggcuccacccgaggccacaaagcaaccgucuacaccggcuccacccccuucacccccaagcuaggcuccguccaguucuccaccgacaccgaaaacgacuucgaaacccaucaaaacacgaaauucaccccagucggcguaauccaagacggcggcaccacucaccgcaacgaaccccaacaauggguccuccccucauacucuggccgcaacguacaaaacguucaccuugcuccugcagucgcccccacuuucccaggcgaacaacuacucuucuuccgcuccacaaugccaggaugcucaggcuacccaaacauggaccucgacugccucuuaccccaagaauggguccaacacuucuaccaagaagccgcgcccgcccaauccgacgucgcccuccucagauucgucaaccccgacaccggacgcguccuauucgaaugcaaacuucacaaaagcggauacgucacaguagcacacaccggccagcacgaccucgucaucccuccaaacgguuacuuccgcuuugacucaugggucaaccaauucuacacacuagcacccaugggcaacggcaccggccgccgccgcgcacucuaa

SEQ ID NO: 37446 - RNA, 1623 nt, Artificial Sequence
  derived and/or modified sequence opt11 from major_capsid_protein__Norovirus__AGM46425
augaaaauggccuccuccgacgcaaaucccagcgacggcucagccgcaaaccucguacccgaagucaacaacgaagucauggccuuagaacccgucgucggagccgcaauugccgccccugucgcaggccaacaaaacgucaucgacccauggauccgcaacaacuucguucaagcccccggaggagaguucaccgucuccccucgcaacgcaccaggagaaauccuuuggucagccccgcuaggccccgaccucaaccccuaucuuucccaucucgccagaauguacaacggcuacgccggcggcuucgaagugcaagucauccucgccggcaacgccuucacagccgguaagaucaucuucgccgcugucccuccaaacuuucccaccgaaggccucucacccucccaaguaaccauguucccacacauuauagucgacgucagacaacucgaacccguucuaaucccucuacccgauguccgcaacaacuucuaccacuacaaccaaucaaacgacucaaccauaaaacucaucgccaugcucuacaccccacuccgcgccaacaacgccggagaagacguauucacugucucuugccgcguacuaacccgaccaucccccgacuucgacuucaucuuccugguacccccuacagucgaaucaagaacaaaaccuuucacaguccccauccucaccguugaagaaaugaccaacucccgcuuccccauaccccuagaaaaacucuucaccggacccuccucagcauucguaguccagccccaaaacgggcgaugcaccaccgacggcguacuccucgguaccacacaacucucacccguaaacaucugcacauuccgcggcgacgucacccacaucgcugguucacgcgucuacacaaugaaccucgccucacuaaauuggaacaacuacgacccaacugaagaaauccccgccccucuaggaacccccgacuucguaggcaagauacaaggcguccucacacaaaccaccaaggaagacggcuccacccgcggccacaaagccaccguauacacaggcucagccccguucacccccaaacucggcuccguacaauucagcacagacacagaaaacgacuucgaaacacaccaaaacacaaaauucaccccagucggcgucauccaagacggcgguaccacacaccgaaacgaaccccaacaauggguccuccccucauacuccggccguaacgcaccaaacguacaccuugcccccgccguugcccccacauuccccggcgaacaacuacuguuuuuccgcucaacaaugcccggcuguucaggcuaccccaacauggaccucgacugccuccucccccaggaauggguccaacacuucuaucaagaagccgcccccgcccaauccgacguagcccuccuaagauucgucaauccugauaccggacgcguccuauucgaaugcaaacuacacaaauccggcuacgucaccguagcccacaccggccaacacgaccuaguaauaccacccaauggcuacuuucgauucgacuccugggucaaccaauucuauacacucgcccccauggggaacggcacaggaagacgacgagcccuguag

SEQ ID NO: 37447 - RNA, 1623 nt, Artificial Sequence
  derived and/or modified sequence opt11 from major_capsid_protein__Norovirus__AGM46427
augaaaauggccuccaaugacgcgucccccagcgacggcuccgccgccaaccuaguccccgaagucaacaacgaagucauggcacucgaacccgucgucggcgccgccaucgccgcccccgucgccggccagcaaaacgucaucgaccccuggauccgaaacaacuucguacaagcucccggcggagaguucaccgucagcccccgaaacgcacccggcgagauccucuggucagcaccccucggcccagaccuaaaccccuaccuuucacaccucgcacgcauguacaacggcuacgccggcggcuucgaaguucaaguaauccuagcaggcaacgccuucaccgccggaaaaaucauuuucgccgcagugccaccgaacuucccaacagagggacucucacccagucaagucacaauguucccccacauuaucgucgacguccgccaacucgagccuguccucaucccccuaccagacguucgaaacaacuucuaccacuacaaccaauccaaugacucaaccaucaaacuaauagccaugcuauacacaccccuacgagcaaacaacgccggagaagacguuuucaccgucucuugucgcguucucacccgccccucccccgacuucgacuuuaucuuccuuguucccccaaccgucgaaucccgaaccaaaccauucaccguccccauacucaccguagaagaaaugacaaacucacgcuuccccaucccccuagaaaaacucuucacaggccccuccagcgcuuucgucguccaaccccaaaacggacgauguaccaccgacgguguccuccucggcacaacccaacuaccgcccguuaauauaugcacauuccgaggcgacgucacacacaucgcuggaucccgcgucuacaccaugaaccucgccucccugaacuggaacaacuaugaucccacagaagaaauccccgccccacuaggcacacccgacuucgucggaaaaauacaaggagucuuaacccaaaccaccaaagaagacggcuccacacgaggacacaaagcaacaguauacaccggcuccgcaccauucacaccuaaacucggauccguacaauucucuaccgacacagaaaacgacuucgagacucaccaaaacaccaaauucacccccguuggcgucauacaagacggcggcaccacccaccgcaacgaaccccaacaaugggugcuaccaagcuacuccggacgaaacgcucccaacguacaccuggcccccgcuguagcgcccaccuuccccggcgaacaacuacucuucuuccgcuccacaaugcccggcugcucaggcuacccuaauauggaccucgacugccuacucccacaggaauggguacaacacuucuaccaagaagcagcccccgcacaauccgacgucgcccuccuacgcuucgucaaccccgauacgggcagaguccuguucgaaugcaaacuucacaaauccggauacguaaccguagcccacaccggucaacacgaccuagucauuccacccaacggcuauuuccgcuucgacucaugggucaaccaauucuacacccucgcccccaugggcaacggaaccggccgccgccgcgcccucuaa

SEQ ID NO: 37448 - RNA, 1623 nt, Artificial Sequence
  derived and/or modified sequence opt11 from major_capsid_protein__Norovirus__AGM46431
augaaaauggccuccaaugacgcaaaccccagcgauggcuccgcagccaaccuaguccccgaaguaaacaacgaaguaauggcacucgaacccgucgucggcgccgccaucgccgcccccgucgccggccagcaaaauguaaucgaccccuggauacgaaacaacuucguacaagccccaggcggagaguucacagucuccccucgaaacgccccaggagaaaucuuaugguccgcaccccuaggcccggaccuaaaccccuaccucucccaccucgcccgaauguacaacgguuacgcgggcgguuucgaaguccaagucauccuugccggcaacgccuuuaccgccgggaaaaucaucuucgcugccgucccaccaaacuuuccuaccgaaggacuaucccccucccaagucacuauguucccacacaucaucguagacguccgccagcuugaaccuguacucaucccccuacccgacguacguaacaacuucuaccauuacaaccaauccaacgauuccacaaucaaacugaucgcuaugcucuacacuccccuacgcgccaacaacgccggagaagacgucuucaccgucuccugccgcguccuuacacgaccuuccccagacuuugacuucaucuuucucgucccacccacagucgaaucccgcaccaaacccuucaccgucccuauccuaacagucgaagaaaugacaaacucccgguuccccaucccacuugaaaaacuguucacaggcccuuccucagccuucgucguacaaccccaaaacggacgcugcacaacagacggcgugcuacucggcaccacccaacuauccccagucaacaucugcacuuuccgaggcgaugucacccacaucgccggcucacgcaacuacacaaugaaccucgccucccuaaacuggaacaacuacgaccccaccgaagaaaucccagcaccacucggcacgccagacuucguuggcaaaauccaagguguccucacgcagaccaccaaaggagauggcuccacacgcggacacaaagccacgguuuacaccggcuccgcccccuucacccccaaacuaggcuccguucaauucuccacagauaccgaaaaugacuucgaaacccaccaaaacaccaaauuuaccccagucggcguaauccaagacggaggaaccacccaccgcaaugagccccaacaauggguacuacccuccuacuccggccgagacguccccaacguccaccucgcccccgccguagccccaacguuccccggagaacaacuucuguucuuccgaaguaccaugccaggcugcuccggcuauccaaacauggaccuagacugccuacuaccccaagaauggguccaacacuucuaccaagaagcagcaccagcccagucagaugucgcccugcuacgcuucgugaaccccgauaccggacgcguucuuuuugaaugcaaacuacauaaaucaggcuacgucaccguggcccacaccggacaacacgaucucgucaucccacccaacggcuauuucagauucgacucaugggucaaccaauucuacacccucgcgcccaugggcaauggcaccggcagacgccgcgcccuguaa

SEQ ID NO: 37449 - RNA, 1671 nt, Artificial Sequence
  derived and/or modified sequence opt11 from major_capsid_protein__Norovirus__AGN11430
augaaaauggcauccagcgacgcagcacccucaacagacggcgccggaaaccuaguccccgaaagccagcaagaaguccugccccucgccccggucgcgggcgcagcccuagcagcaccaguggucggucaaacaaacauaaucgaccccuggaucaaagaaaauuucguccaagcaccccaaggcgaguucacagucucccccaaaaacucacccggcgaaauccuagucaaccuagaacucggccccaaacucaaccccuaccucgaccaccuuucccgcauguacaacucauaugccggcggcaucgacgucauggucguccucgccggcaacgccuucacagccgguaaagugcuaauagccgccauaccucccaacuuccccgucgaagucgucuccgccucacaagcuacacaauucccccacgucauaaucgacguccgaacccucgaccccguccgccuaccccuacccgacguccgcagcacauucuuccauuacacaaacgacacagaacccaaaaugcgccucgugaucuggcucuacaccccacuucguacuaauggcuccggugacgacucauucacaguaucaggccgaauccuaacccgccccucacaagacuucgaguucgccuuccucauaccaccaacagucgaaacaaaaacaacaccauucagcguccccggauucuccguccaagaaaugagcaacagccgguggcccgccgccaucucagcaaugguaguccgcggcaacgaaccccaaguuguacaauuucaaaacggucgcgcccaccucgacggaaugcuacucggcacuacuccagucucacccaacuacauagcuucuuaccgcggaaucuccacuggcaacucaagguccgccucaccggaagccgacgaacgagccguugguucauucgacgucuggguccgccuacaagaacccgacggccagcccuacgacaucuucggcaaacagccagcucccaucggcaccccggacuucaaggccguaaucgucggcuucgccgcccgcccccucaccuccggcucauacgccaacgaagcauacguaaauacaaccgcauccaacuacgcucccgcaaccggcaacaugcgguucaccguccgcaacggaggcaccggacacaccagcgcaaacaaauacugggaguucaaaucuuucggagucgaaggagaacgacacaccgguauccaauaccaggaauacgaacuucccgacuacuccggccaagucgccuccaaccacaaccucgcacccccaguagcaccccgcaugcccggcgaaagccuucuccuauuccaaagcaacaugccuguuugggacgacggccacggcgaaagcacccccaagaaaauccacugccuacucccccaagaguucauaggccacuucuucgacaaacaggcaccaucauuaggcgacgcagcacuccuacgcuacgucaaccaagaaaccaaccgcguccucuucgaaugcaaacuauaccgcgacggcuauauaacaguagccgcuuccucgggccuacucgacuucccacuagacggauucuuccgauucgacuccuggguauccuccuucuacauccucagcccagucggcucaggccaaggcagacguggccgcguccgauuccaauag

SEQ ID NO: 37450 - RNA, 1647 nt, Artificial Sequence
  derived and/or modified sequence opt11 from major_capsid_protein__Norovirus__AGO64038
augaaaauggcauccaacgacgccacucccagcaacgacggugcagcaggacucgucccagaaaucaacaacgaagccauggcccucgaccccgucgcaggcgccgcuaucgcggccccacuaacaggccaacaaaacaucaucgaccccuggaucaugaacaacuucguucaagccccuggcggcgaguucacagucucaccccgaaacuccccaggcgaaguccuccugaaucuagaacuaggccccgaaaucaaucccuaccucgcacaccuagcacgcauguacaacggcuacgcugggggcuucgaaguacaagucguacucgccggaaacgccuucaccgcuggcaaaaucaucuucgcagccauaccacccaacuuccccauagacaaccuauccgccgcccaaaucaccaugugcccccacguaauaguagauguacgccagcuagaaccaguaaaccuuccuaugcccgacgucagaaacaacuucuuccacuacaaucaaggcagcgaccccaaacugcgucuaaucgcuaugcucuacacaccccuacgagcuaacaacuccggagacgacguauucaccgucuccugucgcguccucacccguccuuccccagacuucuccuucaacuuccuugucccaccaaccgucgaauccaaaaccaaaccguucacccuaccuauccugacaaucuccgaaaugucaaacucacgauuccccguccccaucgacucccuacacaccucccccaccgaaaacauagucguccagugccaaaacggccgcguaacccucgacggagaacuaaugggcaccacccaacucuuaccaucacaaaucugcgccuuccgaggaguccucacucgcucgacuucucgcacaucagaccaagcagacaccgccaccccacgccucuucaacuacuauuggcacauccaacuagacaaccuuaacggaacacccuacgaccccgccgaagacauccccggcccacuuggaaccccagacuuccgcggcaagguauucggcgucgccucccaacguaaccccgauaguaccacacgcgcccacgaagcuaaagucgacacaaccgccggccgauucacacccaaacucggaucucuugaaauaucaacagaaucggacgacuucgaccaaaaccagcccacccgguucacccccguaggcaucggcgucgacaaugaagcagacuuucaacaguggucacuacccgacuacucaggccaauuuacccacaacaugaaccucgcacccgccgucgcuccaaacuuccccggcgaacaacuacuuuucuuccguucacaacucccaucauccggaggacgauccaacggcauccucgacugccuaguuccccaagaauggguacaacacuucuaccaagaauccgcacccgcccaaacccaaguugcccuaguucgauacguaaaccccgacaccgguagaguccuauuugaagccaaacuccacaaacuuggcuucaugacgaucgccaagaacggcgacucccccaucaccgucccaccaaacggcuacuuucgcuuugaaucuugggucaaccccuucuacacccucgcaccaauggguacaggcaacggccgucgccgcauacaauaa

SEQ ID NO: 37451 - RNA, 1623 nt, Artificial Sequence
  derived and/or modified sequence opt11 from major_capsid_protein__Norovirus__AGO64040
augaaaauggcauccaacgacgcagcccccuccaacgacggagcagcaggacucguuccagaaaucaacaacgaaguaaugccacuagaacccgucgccggagcaucccccgcuacccccgucguaggucaacagaacauaauugacccuuggauccgcaauaacuucguccaagccccugcaggcgaguucacaguaucaccacgcaacagcccaggcgaaauccuacucgaccuagaauuagggcccgaauuaaacccauaccucgcccaccuagcacgaauguacaacggacacgccggaggcauggaaguccaaaucguacuagcaggcaaugccuucaccgcaggcaaaaucauauucgcagccauaccacccggcuucccccacgaaaaccucucacccucacaaauaaccaugugcccccauguaaucauagacgugcgccaacuugaacccguacuccuccccaugcccgauauucgcaacaacuucuuccacuacaaccaaggcaacgaccccaaacuccgccuaaucgccaugcucuacacaccccugcgcgccaacaacucuggcgacgacgucuucaccguauccugccgcguccucaccaaaccaagcccagacuucgaguucaccuuccugguacccccaacagucgaaucaaagacuaaacaauucacccuucccauacucaaaauaagcgaaaugacaaacucccgcuucccuguccccgucgaaaugauguacaccgcccgcaacgaaaaucaagucguccaaccacaaaacggucgcgucacacucgacggcgaacuacucggaaccacuccccuauuaggcauagacauaugcaaauucaaaggugaagucauagccaaaaaccgcgacgaccgcucguaccgcauggacauggaaaucaccaacaccgacggcacccccauagaccccaccgaagacacucccggacccaucggcuccccagacuuccgaggcauauuauucggagucgccucccaacgcaacaaaaacgaacaaaacccagcaacacgaggccacgaagccaacaucaacaccggcggaaaucaauacgccccuaaacucgcccaagucaaauucuucuccgaaucagacgacuucgacgaacaccaacccaccguauucacccccgucggcguagccggcgaugacagccacccuuuccgccaauggguccucccccguuacgguggacaccuuaccaacaacacacaccuagccccagcugucgcaccccuauuccccggcgaacaaauacuguucuuccgcucccagauccccucaagcggcggcuucgaacucggguacauggauugccucgucccgcaagaaugggugcaacacuucuaccaagaagccgccacagcccaaucggacgucgcauuaauacgauucaucaaccccgacaccggcagaguccucuucgaagcaaaacuacacaaacaaggcuucaucacaguagcccacaccggcgacaaccccaucgucaugccacccaacggauacuuccgcuucgaagccuggguaaaccaauucuacucccucgcaccaguaggcacaggcaacggccgacgacgcguccaauag

SEQ ID NO: 37452 - RNA, 1608 nt, Artificial Sequence
  derived and/or modified sequence opt11 from major_capsid_protein__Norovirus__AGO64042
augaaaauggccucaaacgacgccgcccccuccaacgacggagccgccggccuaguaccagaggcaaauaacgaaaccauggcccucgaaccaguugcaggcgccuccauagccgcaccucucacuggacaaaacaacgucaucgaccccuggauccgacugaacuucguccaagccccuaacggugaguucaccguauccccucgcaacucaccaggcgaaauacuacucaaccucgaacuuggccccgaacuaaaccccuaccuagcccaccucucccgaauguacaauggcuacgccggcggcgucgaaguccaaguccuccucgcaggaaacgccuucaccgccggcaaacuugucuucgcggccgucccuccccauuucccccuagaaaacauaucacccggacaaauaaccauguucccccacgucauaaucgacguccgcacccucgaacccguacuacuuccccuacccgacguccgaaacucguucuuccacuacaaccaacaaaacgaaccccgcaugcgucucgucgcgaugcucuacacaccccuccgauccaacggcuccggcgacgacgucuucaccgucucaugccgcguacucacacgaccaucccccgacuucgacuucaacuaccucguaccacccacagucgaaucaaaaaccaaacccuucacacuacccauacuuaccaugggugaacucaccaacucccguuucccaguccccaucgacgagcucuacaccucccccaacgaaaaccuaguaguucaaccucaaaauggccgcugugcccucgacggcgaacuccaaggcaccacucaauugcuacccaccgccauaugcagcuuccgcggccgcgucaaccaaaaagucuccggcgaaaaccacguauggaacaugcaagucacuaauaucaacggaacccccuucgacccaacagaagacguccccgcaccccuuggaaccccugacuucucuggccgccucuucggcguucuaucacaacgcgaccacgacaacgcaugccgcucccacgacgcgguaauugccacaaacucaaccaaauucacccccaaauuaggcgccauacaaaucggcaccugggaagaagacgacguccacaucaaccaaccaaccaaguucacccccgucggccuauucgacacagacgacuucaaccaaugggcccuacccaacuacuccggcgcccucacccuuaacaugggccucgccccacccgucgcucccaccuucccaggcgaacaaauacuauucuuccgaucacacaucccacucaaagguggcgucgccgauccagucaucgacugccuccucccccaagaauggauccaacaccuauaccaagaaucggcccccucccaauccgacgucgcacucauccgcuuuaccaacccagauaccggccgcguccuauucgaagcuaaacugcaccgcuccggauacauaacagucgcaaacaccggcaaccgaccaaucgucgucccagccaauggcuacuuccgcuucgacucuugggugaaucaauucuauucccucgcccccaugggcacaggcaacgggcguagacgaguccaauaa

SEQ ID NO: 37453 - RNA, 1623 nt, Artificial Sequence
  derived and/or modified sequence opt11 from major_capsid_protein__Norovirus__AGS41450
augaaaauggccuccaacgacgccaaccccucagauggcagcgcagccaaccucguacccgaaguaaacaacgaaguaauggcccucgagcccguagucggcgccgccaucgccgcaccaguugcuggccaacaaaacgucauagauccuuggauccgcaacaacuucguacaagcaccaggcggagaguucacaguaucuccccgcaacgccccaggcgaaauacucugguccgcaccccuaggucccgaccugaacccuuaccucucccaccucgcccgcauguacaacggcuacgccggcggcuucgaaguccaaguaauccucgccggcaacgccuucaccgcaggcaaaaucaucuucgccgccgucccacccaacuuccccaccgagggcuuaagcccaucacaagucaccauguucccacacaucauagucgacguccgccaacucgaacccguccugauaccccuccccgacguucgcaacaacuucuaccacuacaaccaauccaaugacucaacaauaaaacucaucgccaugcucuauacaccacucagagccaacaacgccggcgacgacgucuucacaguuucaugccgcguccugacacgacccucccccgauuucgacuucaucuuccuaguuccaccuaccgucgaaagccguaccaaacccuucaccguucccauccucaccguggaagaaaugaccaacucucgcuuccccaucccacucgaaaaacucuucacaggacccucaucagcauucgucguacagccccaaaacggcagaugcaccaccgacggcguacuccucggcaccacccaacucucccccgucaacauaugcacguuccgaggcgacguaacccacaucgccggcucccguaacuacacaaugaaucucgccucacucaacuggaacaacuacgaccccacggaagaaaucccugcaccccucggcaccccugacuucgucggaaaaauccaaggcguacuaacccagaccaccaaaggcgacggcuccaccaggggccacaaagccaccguauacacuggcuccgccgacuucacacccaaacucggaucaguccaauucgccaccgacacugagaacgacuucgaaacacaccagaacaccaaauucacacccgucggaguaauacaagacggcucgaccacccaccgcaacgaaccccaacaauggguucucccauccuacucaggacgcaacguacacaacguucaccuagccccagcggucgccccaaacuuucccggagaacaacuccuauucuuuagauccaccaugcccggcugcuccggauacccaaacacagaccucgacugccuccuaccccaagaauggguccagcacuucuaccaagaagcagcucccgcccaauccgacguagcccuacuccgauucgucaauccugacaccggccgaguccuguucgaaugcaaacuacacaaaucuggcuacgucacugucgcccacacaggccaacacgaucucguaauacccccuaacggcuacuuccgcuucgacucgugggucaaucaauucuacacccucgcacccaugggaaauggaacaggacgacgccgcgcccuuuaa

SEQ ID NO: 37454 - RNA, 1623 nt, Artificial Sequence
  derived and/or modified sequence opt11 from major_capsid_protein__Norovirus__AGT62521
augaugauggccucuaaagacgccccaaccucgcccgacggugccuccggcgccggacagcucguccccgaagccaacaccgccgaacaaaucuccauggaccccgucgcaggcgcguccacagcagucgccaccgccggccaagucaauaugauugacccauggaucuucaacaacuucguccaagccccucaaggugaauuuaccauaagccccaacaacacacccggagacaucuuauucgaucuccaacucggcccccaccugaacccauuccucgcccaccuaucccaaauguacaacggaugggucggcaacaugcgaguccgcauacuccucgccggaaaugccuucacagcuggaaaaaucaucaucuguugcguaccgccuggcuucgacgcccguauacucacaaucgcacaagcaacccucuucccccaccuuaucgccgacguucgcacccuagaaccugucgaacucccacucgaagacguucgcaacguccuuuaccacaacuccucccaaccccaacccaccaugagacuugucgccaugcucuacacaccccuccgcaccggcggaggcuccggcggcacagacgccuucgucgucgcaggccguguccuaaccugccccgccccagacuucucauuucucuuccucguaccaccaucuguagaacagaaaacacgaguauucuccguacccaacaucccccucaaagaccucuccaauuccagaguucccgucccaguacaaggcauguucaugucccccgaugucaaccaauccguccaauuccaaaacggacgcugccaaaucgacggccaacuacagggcacaaccccagucucccuaucucaacucugcaaaauucgcggcaaaaccuccuccaacgcccguguccuaaaccucucugaagucgacggaacgccauucaucccccuagaaucccccgcacccgucggcuuccccgaccuaggaggcugcgacuggcacguuaacuuuaccuuucaagcacaagaccaagacccaucacaaucaguaacauucgcaaccaaugacgcuucuuucgucccauaccucggauccaucucaccccacaacggcggagauuuccacgccggcgacaucauuggcucccucggcuggauauccgcccccuccggcaacagccagcuaaacgucugggcuaucccaaaauacgguuccucacuucccgaugucacccaccucgcccccgcuguauucccacccgguuucggcgaaguaauccuuuacuucuacucaacuuuccccggauccggccagcccucgcaacuccaaguccccugccuccucccucaagaauuuaucacccacuucuguaaugaacaagccccuauugccggugaagcagcccuacuccacuaugucgaccccgauaccggacgaaaccuaggagaguucaaacuauacccagacggcuucaugaccugcguccccaacuccgucucuuccggaccucaaacccuccccaucaauggcgucuucguauucgucagcugggucucccgauucuaccaacucaaacccguugggacagccuccgccgcccgccgccucggccuacgccgcauauaa

SEQ ID NO: 37455 - RNA, 1629 nt, Artificial Sequence
  derived and/or modified sequence opt11 from major_capsid_protein__Norovirus__AGT62523
augaaaauggcauccaacgaugccgcacccucaaccgacggagccgccggacucguccccgaguccaacaacgaagucauggcccucgaaccagucgcgggagcagcccucgcagccccaguaacgggccaaacaaacaucaucgaccccuggaucaggaccaacuucguacaagccccaaauggcgaauuuacaguaucaccccgcaacgccccuggcgaaguccuccuaaaccuugaacuaggccccgaacucaaccccuaccuagcccaccuugcacgaauguacaacggauacgccggcggaauggaaguccaaguuaugcuagcaggcaacgcauucaccgccggcaaacucguuuucgccgcagucccaccccauuuccccgucgaaaaccucucaccccaacagaucaccauguucccccacgucaucaucgacguccgcacacuggaacccguacuccuaccacuacccgacguccgaaauaacuucuuccacuacaaccagaaagacgacccaaaaaugcgcaucgucgcaaugcuauauacuccacuucgaagcaacggcuccggggacgacguauucaccguuucaugccgaguccucacccgccccucucccgacuucgauuucaccuaccuagucccacccacagucgaauccaaaaccaagcccuucacacuacccauccuaacccuaggcgaaauguccaacucccgauuccccguucccaucgaccaaauguacacaucccccaaugaagucaucuccguccagugccaaaacgggcgcugcacacucgacggagaacuacagggcaccacccaacuccaagucucaggaauaugcgccuucaagggccaagucaccgcccaccuccaagacaacgaacaccucuauaacgucaccaucacaaacuuaaacggcucaccauucgaccccuccgaagacauccccgcaccccuaggcguccccgauuucgaaggccgagucuucggcguaaucucccaacgagacaacuacaacuccgguggccaaaaccaaccagccaaccgaucccaugaugccguagucccuaccuacaccgcccaauauacaccaaaacugggacaaauccaaauaggcacauggcagaccgacgacaucacagucgaccaacccgccaaauucaccccagucggccugucugacaccgaccacuucaaccaaugggucgucccacgcuacgccggcgcccucaaccuaaacaccaaccucgcaccauccgucgccccaguauuccccggcgaacgccuccuauucuuccgauccuacaucccacucaaaggcggcuucgguaaucccgcaaucgacugucucgucccccaagaauggauccaacacuuuuaccaagaagccgcccccagccuuagcgaagucgccuuaguccgcuacaucaaccccgacaccggcagagcccucuuugaagccaaacuacaccgcgccggcuucaugacagucuccagcaacaccucagcaccugucguuguaccagcaaacggcuacuuccguuucgacucaugggucaaccaauucuacucccuagcuccaaugggaacaggcaacggacgccgccgaauccaauaa

SEQ ID NO: 37456 - RNA, 1623 nt, Artificial Sequence
  derived and/or modified sequence opt11 from major_capsid_protein__Norovirus__AGV40221
augaaaauggcuuccuccgacgcaaacccguccgacggauccgcagcaaaccucgucccugaagucaacaacgaagucauggcacuugaaccaguugucggggccgccaucgccgcccccgucgcuggccaacaaaacguuaucgaccccuggaucagaaacaacuuuguacaggcacccggcggcgaauuuaccguuuccccacguaacgcccccggcgaaauacucugguccgccccucuaggccccgaccucaaccccuaccucucucaccuagcacgcauguauaacggcuaugccggcggcuucgaaguccaaguaauccuagcaggcaacgccuucaccgccggcaaagucaucuucgcagccguaccgcccaacuucccaaccgaaggacuaucucccucccaaguaacaauguucccacacaucaucgucgacguucgacaacuagaaccaguccucauaccccuuccugacguacgcaacaacuucuaccacuacaaccaauccaacgacucaacaaucaaacucauagccaugcuauacaccccacuacgagcaaacaacgccggcgacgacgucuucaccguauccugccgcguccuaaccagacccucacccgauuucgacuuuaucuuucucguuccacccaccguagaaucccgcaccaaacccuucucaguacccguacuuaccgucgaagaaaugaccaacucacgcuucccaauaccgcuagaaaaacucuucacuggccccuccagcgccuucguaguacaaccccaaaacggcagaugcaccacagacggaguacuccucggaacuacccaacucucccccguuaacauuugcaccuuccguggagacguuacccauauaaccggcucacgcaacuacaccaugaaccucgccucccagaacuggaauaacuacgaccccaccgaagaaaucccagcaccccucggcacccccgacuuuguaggcaaaauucaaggcaugcuuacccaaaccacccgaaccgacgguuccacccgaggacauaaggccacugucuacaccgguuccgccgacuuugcccccaaacuaggccgaguccaauucgaaacagacacugaucacgacuucgaagccaaccaaaacaccaaguucacaccaguaggagucauacaagacggcucuacuacccaccgcaacgaaccccaacaauggguacuccccucuuacuccggccgaaauacgcacaacguccaccuggcccccgccguagcccccaccuuccccggcgaacaacuccucuucuuccgcagcaccaugcccggcugcuccggcuaccccaacauggaccucgauugccugcuuccacaagaauggguacaauacuucuaccaagaagccgcucccgcccaauccgacgucgcccuccuucgcuucguaaacccagacacaggacgcguccuauucgaaugcaaacuacacaaauccggcuaugucaccguugcccacaccggccaacacgaccucgucauaccuccaaacggauacuuccgauucgauagcugggucaaccaauucuauacucuagccccaaugggcaacggaacaggccgccgacgaguagucuaa

SEQ ID NO: 37457 - RNA, 1623 nt, Artificial Sequence
  derived and/or modified sequence opt11 from major_capsid_protein__Norovirus__AGV76553
augaaaauggccucgucagacgccaaccccuccgacggcucagcagcaaaccuagucccugaagucaacaacgaaguaauggcccucgaacccgucgucggcgccgcaaucgccgcccccgucgccggccaacaaaacguuaucgacccauggaucagaaacaacuucguucaagccccaggcggcgaauuuaccguaucaccccgaaacgcccccggagaaauccucugguccgccccacucggacccgaccuaaaccccuaccucucacaccucgcacgaauguauaacggcuacgccggcggcuucgagguccaagucauccuagccgguaacgccuucacagccggcaaagucaucuuugcagccguacccccuaacuuccccacagaaggacuuucccccucacaagucaccauguucccccacaucgucgucgacguacgccaauuagagccaguccuaaucccucucccugacguacgcaacaauuucuaccacuacaaccaaucaaacgacccaacaaucaaacucaucgccaugcucuacaccccgcuucgcgccaacaacgcaggcgacgacguauucacagucuccugccgaguccucacucgaccuuccccagacuucgacuucaucuuucucgucccacccaccgucgaaucccgcacaaaaccguucagcguacccguucuaacaguagaagagaugaccaacucacgcuuucccauaccccucgaaaagcuauucaccggcccguccuccgccuucguaguccaaccucaaaacggacgcugcaccacagacggcguccuccuaggaaccacacaacugucaccggucaacaucugcaccuuccgaggcgacgucacucacaucacuggcucccgaaacuacaccaugaaccuagcaucucaaaacuggaacaacuacgaccccacagaagaaauacccgcaccccuuggcaccccagacuucgucggcaaaauccaaggcguccuaacccaaaccacacguaccgacggauccacacgcggccacaaagccacagucuacaccggauccgccgacuucgcccccaaacucgguagaguccaauucgaaaccgacacagaccacgacuucgaagccaaucaaaauaccaaauucacaccagucggaguaauccaggacggcggaaccacccaucgcaaugaaccccaacaauggguccuccccagcuacuccggccgaaacacccccaacgugcaccucgcccccgccguagccccaaccuuccccggcgaacaacuccuguucuuccgcagcacaaugccaggaugcucaggauacccaaacauggaccucgacugcuuacuaccacaagaauggguccaauacuucuaccaagaagccgcccccgcccaauccgacgucgcucuccuacgauucgucaacccggauaccggcagaguacucuucgaaugcaaacuacacaaauccggauacgucaccgucgcgcacuccggccagcacgaccuagucauuccacccaacggcuacuuucgauucgacuccuggguaaaucaauucuacacacucgcacccaugggcaacggcacaggccgccgacgcgcucuauaa

SEQ ID NO: 37458 - RNA, 1623 nt, Artificial Sequence
  derived and/or modified sequence opt11 from major_capsid_protein__Norovirus__AGV76554
augaagauggcauccucggacgccaaccccucugacgguuccgccgccaaccucguacccgaaguuaacaacgaagucauggcccucgaacccguaguaggcgccgccaucgccgcccccgucgccggacaacaaaacgucaucgaccccuggauacgaaacaacuuuguacaagcccccgguggagaauuuaccgucagcccccgcaacgcccccggcgaaauccucugguccgcaccccucggccccgaucuaaacccauaucuaucccaccuugcacgaauguacaacggcuaugccggcggauucgaaguccaagucauccucgcugguaacgccuucaccgcgggcaagguaauauucgccgccguacccccaaacuuccccaccgaagggcugucccccucccaagucaccauguucccccacauugucguugacguccgccaacucgaacccguccuuaucccccuacccgacguccgaaacaacuucuaccauuacaaccaaucuaaugacccaacaaucaaacucaucgcuaugcucuacacaccccuccgagccaacaacgcaggagacgacgucuucaccguuuccugccgaguacucacccgccccucuccagacuucgacuucauuuuccugguaccacccaccguagaaucccgcaccaaacccuucuccguacccguucucacggucgaagaaaugaccaacagccgcuuccccaucccgcucgaaaaacucuucaccggccccuccuccgcauucgucguucaaccccaaaacggacgaugcaccacagacggcguacuacucggaaccacacaacuuucacccgucaacaucugcacauuccgaggugacguaacacacaucacaggcucccgaaacuacaccaugaaccuugccucccaaaacuggaacaacuacgaccccaccgaagaaauaccugcccccuuaggaacacccgacuucguaggcaaaauacaaggcguccuaacccagaccacccgcaccgacgggucuacccgcggccacaaagccaccgucuacacgggcuccgccgacuucgcccccaaacuaggccgcguccaauucgaaaccgacacugaccacgacuucgaagcaaaccaaaauacaaaauucacacccgucggcgucauccaagacggcggaacaacccaccgcaacgaaccccagcaauggguacuccccuccuacucaggccgaaacacaccuaacguacaccucgcccccgcagucgccccaaccuucccuggcgaacaacuacucuucuuccgaucaacaaugcccggcugcuccggcuacccgaacauggaccuugacugccuacucccccaagaauggguccaauacuucuaccaagaagcagccccagcacaauccgacgucgcccuccuucguuuugucaaccccgacacaggccgcguuuuauuugaaugcaaacuccacaagucaggauacguaaccgucgcccacaccggccagcacgaccucgucauaccacccaacggcuacuuccgcuucgacuccuggguuaaucaguucuauacacuagcccccaugggcaacggcaccggacgucgccgcgcacucuaa

SEQ ID NO: 37459 - RNA, 1623 nt, Artificial Sequence
  derived and/or modified sequence opt11 from major_capsid_protein__Norovirus__AGV76555
augaaaauggcauccucagacgccaaucccuccgacggauccgcugccaaccucgucccagaagucaacaacgaaguaauggcacucgaacccgucgucggcgccgcaaucgccgcacccgucgccggccaacaaaacgucaucgaccccuggauacgcaacaacuucguacaagcccccgguggcgaguucaccguaucaccgcgaaacgcccccggcgaaauacuauggucagcaccccuuggacccgaucucaauccauaccucucucaccucgcccgcauguauaacggcuacgccggcggcuucgaaguacaaguaauccuugccggaaacgccuucacagccggaaaggucauauucgcugccguaccacccaacuuccccacagaaggccucucccccucccaagucacaauguucccccacaucgucguugacguccgacaacucgaacccguccugaucccccuacccgacguccgaaauaacuucuaccacuacaaucaauccaacgaucccaccauaaaacuaaucgcaaugcucuacaccccacuccgugccaacaacgccggagaugacgucuucaccguguccugccgcguccucacacgaccauccccagacuucgauuucaucuuccucgucccgcccaccguagaaagcagaacaaaaccuuucuccguccccguucucaccgucgaagaaaugacaaacucccgcuucccaauaccccucgaaaaacuauucaccggacccucaucugccuucgucguccaaccacaaaacggccgcuguaccacugacggagugcuacucggcacaacccaacucucccccgucaacaucugcacuuuucgaggagacguaacacacaucacuggcuccagaaacuacacaaugaaccucgcaucacaaaacuggaacaacuacgaccccaccgaagaaauccccgcaccccucggcacccccgacuucgucggcaaaauacaaggaguucugacccaaaccacccgcaccgacggauccacccgcggccacaaagccaccgucuauaccgguuccgccgacuucgccccuaaacucggacgcguccaauuugagaccgacaccgaccacgacuucgaagccaaccaaaauaccaaauucacccccguuggcgucauccaagacggaggcacaacccaccgcaacgaaccacaacaguggguccuccccucauacuccggccgaaacacaccaaacguccaccucgcacccgcggucgcccccacauuccccggugagcaacuacuauucuuccggucgaccaugcccggaugcuccggcuacccuaacauggaccuagacugccuacuaccccaagaauggguccaauacuuuuaccaagaagcugcucccgcccaaucugaugucgcgcuccuacgcuucgucaaccccgacaccggccgcguccucuucgaaugcaaacuacacaaauccggcuacgugaccgucgcccacaccggccaacacgaccucgucaucccaccaaacggauacuuccgcuucgauuccuggguaaaccaauucuacacccuagcccccaugggcaacggcaccggacgccgacgcgcccucuaa

SEQ ID NO: 37460 - RNA, 1623 nt, Artificial Sequence
  derived and/or modified sequence opt11 from major_capsid_protein__Norovirus__AGV76556
augaaaauggcaucgagcgacgcgaauccauccgacggauccgccgccaaucucguacccgaggucaacaaugaagucauggcccucgaacccguagucggcgccgccaucgccgcacccgucgcaggacaacaaaaugucauagaccccuggaucagaaacaacuucguccaggcacccggcggagaguucacagucucaccccgcaacgcccccggagaaauccucugguccgcaccccuaggaccagacuuaaaccccuaccucucccaccuagcccgcauguauaauggcuacgccggcggcuucgaaguacaagucauccuagccggcaacgccuucaccgccgggaaaguaaucuucgccgcugucccucccaacuuucccaccgaaggacuaucacccucucaagucaccauguucccccacauugucgucgauguacgacaacucgaaccaguucuuauuccccuuccagacguucgcaacaacuucuaccacuacaaucaaucaaacgaccccaccauaaaacugauugcaaugcucuacaccccacuacgcgcaaacaaugcaggcgacgacgucuucaccgucuccugccgcguccucacccgcccuucccccgacuucgacuucaucuuccucguaccucccaccguagaaucccgcacaaaacccuucucaguacccguccucaccguagaagaaaugaccaacucacgauuccccaucccacucgaaaaacuauucaccggacccucaucagcauucguaguccaaccccaaaauggcagauguaccaccgacggcguacugcucggcaccacacaacucuccccaguaaacauaugcaccuuccgcggcgacgucacccacaucaccggaucccgcaacuacacaaugaacuuagcaagccaaaacuggaacaacuacgaccccacagaagaaauccccgcuccccucgguacccccgacuucguaggcaaaauccaaggaguccucacacaaacaacacgaacagacggcucuacccgcgggcacaaagccacggucuacaccggcuccgccgacuucgcuccaaaacucggacgcguucaauucgaaaccgacaccgaccaugauuucgaagcuaaucaaaacaccaaauucaccccaguaggugucauacaagacggcggcaccacccaccgcaacgaaccccaacaauggguacuuccaucuuacuccggcagaaacacaccaaacguccaccucgcccccgccgucgcccccaccuuccccggggaacaacuacucuucuuccguuccaccaugcccgguugcucaggcuaccccaacauggaccuagacugucuccucccccaagaauggguacaauacuucuaccaagaagccgcccccgcccaauccgacguagcccuacuccgcuucgucaaccccgacaccggccgaguccucuucgaauguaaacuccauaaaucaggcuacgucaccguugcccacaccggccaacacgaccuaguaaucccaccaaacggcuacuuccgauucgacuccugggucaaccaauucuacacacuugcccccaugggcaacggcaccggccgcagacgcgcccucuag

SEQ ID NO: 37461 - RNA, 1623 nt, Artificial Sequence
  derived and/or modified sequence opt11 from major_capsid_protein__Norovirus__AGV76557
augaaaauggccagcuccgacgcaaaccccuccgacggcuccgccgccaaccugguaccagaaguaaacaacgaagucauggcccucgaacccgucgucggcgccgccaucgccgcccccgucgccggccaacaaaacgucaucgacccauggauccgcaauaacuucguccaagcgccuggcggcgaguucaccguaucaccccgaaacgcccccggugaaauacucugguccgcaccccucggacccgaccuaaacccauaccuuucccaccucgcccgcauguacaauggauacgccgggggauucgaaguucaagucauccucgcaggcaacgcauucaccgcgggcaaagucauauucgccgcugucccacccaacuucccuaccgaaggccugagccccucacaaguuaccauguucccccacaucgucgucgacgucagacaacucgaacccguccucaucccacucccagacguccguaacaacuucuaccacuacaaccaauccaacgaccccaccaucaaacucaucgccaugcuuuacacgccucuccgugccaacaacgccggugacgacgucuucaccgucucaugccgaguacucacccgacccucacccgacuuugacuucaucuuccuugugcccccaacagucgaaucccgaacaaagccguucagcgucccuguccuaaccgucgaagaaaugacaaauucccgcuuccccauaccccucgaaaaacuuuucaccggccccuccuccgcauucgucguccaaccccaaaacggccgcugcaccacggacggcguacuucuaggcaccacucaacuauccccagucaacauaugcaccuucagaggagacgucacucacaucaccggcucccgaaacuacacaaugaaccucgccucccaaaacuggaacaacuacgaccccacggaagaaaucccagccccacucggcacccccgacuucgucggcaaaauacaaggaguucucacccaaacaacccgcaccgacggcuccacucgcggccacaaagcuacaguauacaccggcagcgccgacuucgcccccaaacuuggacgcguccaauucgaaaccgacaccgaccacgacuucgaagcuaaccaaaacaccaaauucacccccgucggcgucauccaggacggcggcacgacccaccgaaacgaaccccaacaaugggugcucccuucuuacuccggccgcaacaccccaaacguccaccucgcccccgccgucgcccccacauuucccggugaacaacugcuuuucuuccgcuccacaaugccaggaugcucaggcuacccaaacauggaccucgacugccuccuuccccaagaauggguccaauacuucuaucaagaagcagcucccgcccaauccgacguugcccuacucagguucguaaacccagacaccggccgaguccucuucgaaugcaaacuacacaaauccggauacgucacugucgcacacaccggacaacacgaccuaguaaucccacccaacggauacuuccgcuucgacuccugggucaaucaauucuacacccucgcccccauggguaacggaaccggcagacgcagagcccuauaa

SEQ ID NO: 37462 - RNA, 1623 nt, Artificial Sequence
  derived and/or modified sequence opt11 from major_capsid_protein__Norovirus__AGV76558
augaaaauggccaguuccgacgcuaaccccucagacggaucagccgccaaccuaguccccgaagucaacaacgaagucauggcccucgaacccguagucggcgccgcuaucgccgcccccgucgcaggucaacaaaacgucauagacccauggauacgcaacaacuucguacaagcccccggaggcgaauuuacuguaucuccccgaaacgccccaggagaaauccucugguccgccccacucggccccgaccuuaaccccuaucuuucccaccuagcaagaauguacaauggcuacgcuggaggcuucgaaguacaaguuauccuagcagguaacgccuucaccgcaggcaagguuaucuucgccgccguacccccaaacuuccccacagaaggccuaucccccucacaagucacaauguucccccacaucgucgucgacguccgccaacuagaacccguucucauacccuugcccgauguccguaacaauuucuaucacuacaaccaauccaacgacccaacaauuaaacucauagccaugcuauacacaccccuccgcgccaauaacgcuggagacgacgucuucacugucuccugccgcguacuaacucgccccucucccgacuucgauuuuaucuuccucgucccacccacagucgaaucccgcacgaaacccuucuccguccccguccucaccgucgaagaaaugaccaauucccgcuuucccaucccccucgaaaaacuuuucacuggccccucauccgcauuuguuguacaaccgcaaaacggucgaugcaccaccgacgguguccuacuaggaacaacacaacuuagccccguaaacauauguacauuccgcggggacgucacccacaucacagguucacgaaacuacaccaugaaccuagccucccagaacuggaacaacuacgaccccaccgaagagaucccagcacccuuaggcacccccgacuucguagggaaaauacaaggcguacuaacucaaaccacccgaaccgacggauccacccgcggacacaaagccaccgucuacaccggaucagccgacuuugcccccaaacucggaagaguccaauucgaaaccgacacugaccacgacuucgaagccaaccaaaacaccaaauucacucccgucggugucauacaagacggcggaacaacccaccgcaacgaaccccaacaauggguacucccaagcuacucagggcgaaacaccccaaacguccaccuagccccagccgucgcccccaccuucccaggagagcaacuccuauucuuuagauccaccaugcccggcugcucagguuaccccaacauggaccucgacugccuccucccccaagaauggguccaauacuucuaccaagaggccgcgcccgcacaauccgacguagcccuacuccgauucguaaaucccgacaccggccgcguccucuucgagugcaagcuccacaaguccggguacgucacugucgcccacaccggucaacacgacuuaguaaucccacccaacggcuacuuccgcuucgacuccugggucaaccaauucuacacacucgcccccaugggaaacggcaccggccgacgacgcgcacucuga

SEQ ID NO: 37463 - RNA, 1623 nt, Artificial Sequence
  derived and/or modified sequence opt11 from major_capsid_protein__Norovirus__AGV76559
augaaaauggcuuccuccgacgccaacccaucagacggcucagccgccaaccucgucccagaagucaacaacgaagucauggcgcuagaaccagucguaggcgcagcaaucgccgcucccgucgccggccaacaaaacgucaucgacccauggauacgaaacaauuucguccaagccccaggcggugaguucaccguaagcccccgaaacgccccuggcgaaauacuaugguccgcaccacucggaccggaccuaaacccguaucuaucccaccuagcccggauguacaacggcuacgccggaggauucgaaguccaagucauacucgcaggcaaugccuuuaccgccggcaaggucaucuucgccgccguacccccaaacuuccccaccgaaggacuuucccccucccaagucacaauguucccccacaucguaguugacguccgccaacuagaaccaguucucauaccccuaccagacguccgcaauaacuucuaccacuacaaccaauccaacgacccaacaaucaaacuuaucgcgaugcucuacacaccccuacgugccaacaacgcaggcgacgacgucuucaccgucucaugccgagugcuaacccgccccucccccgacuucgacuucauauuccucguaccacccaccgucgaaucccggaccaaacccuucuccguacccguccuaaccgucgaagaaaugacaaacuccagauuuccuaucccccucgaaaaacucuuuacaggacccuccagcgccuucguaguccagccccaaaacggacgaugcaccaccgacggaguccuucucggcacaacccaacuuucccccgucaacaucugcaccuuccgcggcgacguaacucacauaaccgggucacgaaauuacacaaugaaccuagccucccaaaacuggaacaauuacgacccaacagaagaaaucccugcaccacuaggcaccccugacuuugucgggaaaauacaaggcguacucacccaaacaacacgaaccgacggaucaacccgcggccacaaagccaccguauacaccggauccgcugacuucgcacccaaacucggcagaguucaauucgaaaccgacaccgaccacgacuucgaagccaaucaaaacacaaaauucacacccgugggggucauccaagacggaggcaccacccaccgcaacgaaccccaacaguggguacuccccuccuacuccggacgaaacaccccaaacguacaccucgcccccgccgucgcccccaccuuccccggagaacaauuacucuucuuucgcuccacuaugcccggaugcucaggcuaucccaacauggaccuagacugccuucucccccaagaauggguucaauacuucuaucaagaagccgcaccagcucaaucugacguagcccucuuacgguucguuaaccccgacaccggacgaguccuauucgaaugcaagcuccacaaauccggauauguuacaguugcccacaccggccagcacgaccucgucaucccaccaaacggcuacuuccgcuucgacucaugggucaaccaauucuacacacuagcccccaugggaaacggcaccggccgccgccgcgcacuguaa

SEQ ID NO: 37464 - RNA, 1623 nt, Artificial Sequence
  derived and/or modified sequence opt11 from major_capsid_protein__Norovirus__AGV76560
augaaaauggcaucuuccgacgccaaccccucagacggauccgccgcaaaccucguacccgaagugaacaacgaaguaauggcccucgagccagucguaggcgccgcaaucgccgcacccguagccggccaacaaaacguaauugaccccuggauccgcaacaacuucguccaagcaccagguggcgaguucaccguaucaccccgcaacgcccccggagaaauccuaugguccgcaccccucggaccagaccuaaaccccuaccuuucccaccucgcccgcauguacaacggauacgccggcggcuucgaaguacaggucauacuagccgguaacgccuucacagcaggcaaaguaauuuucgccgcugucccgcccaacuuccccaccgaaggccucucucccucacaagucacaauguucccacacauagucgucgacguacgccaacuagaacccguacuaauuccccucccugacguccgaaacaacuuuuaccauuacaaccaauccaacgacccuaccauaaaacuuauagcuaugcuuuacaccccgcucagagccaacaacgccggcgacgacguauucaccguuagcugcagaguccuaacacgccccaguccagacuucgacuucauauuccucgucccuccaaccgucgaaucacgcacaaaacccuucagcgucccagucuugacaguagaagaaaugacuaacucacgcuuuccaaucccacucgaaaagcuauucaccggaccgucauccgccuucgucguacaaccccaaaauggacgcugcaccaccgacggcguccuccucgguaccacccaacucuccccagucaacaucugcacauuccgcggcgacgucacccacaucacaggcucccgaaacuacaccaugaaccucgccucacaaaacuggaacaacuacgacccuaccgaagaaauccccgcccccuuaggcacucccgacuuuguaggcaaaauacaaggcguccucacccaaaccacccgcacugacggcuccacccgcgggcacaaggccacagucuacaccgguucagcugacuucgccccaaaacuaggacgaguccaauucgaaaccgacaccgaccacgacuucgaagccaaccaaaacaccaaauucacccccgucggcgugauccaagacggcgggaccacacaucguaacgaaccccaacaauggguccucccauccuacuccggccgcaacacccccaauguccaccucgccccagccgucgccccgaccuuccccggcgaacaacuccucuucuuccgaucaaccaugccgggcugcuccggcuaccccaacauggaccucgacugccuccucccccaagaauggguacaauauuucuaccaagaggccgcacccgcucaauccgacguagcccuacuucgcuuugucaaccccgacaccggccgcguucuauucgaaugcaaauuacacaaauccggcuacgucaccgucgcccacacuggccaacacgaccuagugauaccucccaacggcuacuuccgcuucgacagcugggucaaccaguucuacacccucgcccccaugggaaacggcaccggccgccgccgagcccucuaa

SEQ ID NO: 37465 - RNA, 1623 nt, Artificial Sequence
  derived and/or modified sequence opt11 from major_capsid_protein__Norovirus__AGV76561
augaaaauggcuucauccgacgccaacccuucagacggcucagcagccaaucuaguacccgaaguuaacaacgaagucauggcccuagaacccgucgucggcgccgccauugccgccccagucgccgggcaacaaaacgucaucgacccauggaucagaaacaacuucguccaagcccccggcggcgaguucacugucucaccccguaacgcccccggcgaaauacuaugguccgcaccacucggccccgaccucaacccauacuugucccaccuagcccgaauguacaauggcuacgccgggggauucgaaguacaagucauccuagcaggaaacgccuuuaccgcaggaaaaguaaucuucgccgccgucccacccaacuuccccacagaaggccuaucacccucacaagucacuauguucccccacauugucgucgacgucagacaacucgaacccguccucauaccucuacccgacguacgaaacaauuucuaccacuacaaccaaucaaacgacccaacaaucaaacuaaucgccaugcuauacaccccacuaagagccaacaacgccggcgacgacgucuucaccgucucuugcagaguccucacccgccccuccccagacuucgauuucaucuuccucgucccgcccaccgucgaaucacgcacaaaacccuucuccguccccguccuaaccgucgaagaaaugaccaacucacguuuccccaucccccucgaaaaacucuucaccggacccagcucagcauucgucguucaaccccaaaacggacgaugcacaaccgacggaguucuccuuggcaccacccaacucucaccugucaacauaugcacuuuccgcggcgacgucacacacauaaccggaucccguaauuacaccaugaaccuugccucacaaaacuggaacaacuacgacccaaccgaagaaauacccgcaccccuagguacccccgacuucgucggcaagauccaaggaguccucacccaaacaacccgaacagauggcuccacucgcggccauaaagcaacagucuacaccggcuccgcagacuucgcacccaaacuaggccgcguacaauucgaaacagacaccgaccacgacuucgaagccaaccaaaacaccaaauucacacccguaggagucauccaagacggaggaaccacacaccguaacgaaccccaacaauggguccuacccagcuacuccggacgcaacacccccaacguacaccucgccccggccgucgcucccaccuucccaggagaacaacuacucuucuucagauccaccaugcccggcugcucaggcuacccaaacauggaccuagauugccuacuaccccaagaauggguccaauacuucuaucaagaagcagccccagcccaaucagacguugcacuccuacgauucgucaacccagacaccggccgcguccuauucgaaugcaaacuucacaagucuggauacgucaccgucgcacacacuggacaacacgaccucgucauucccccuaauggguacuuccgauuugacuccugggucaaccaauucuacacacucgccccaaugggaaacggcaccggccgacgacgugcccucuag

SEQ ID NO: 37466 - RNA, 1623 nt, Artificial Sequence
  derived and/or modified sequence opt11 from major_capsid_protein__Norovirus__AGV76562
augaaaauggcaucuucagacgcgaacccaucugacggauccgccgccaaccucguccccgaaguaaauaacgaagucauggcccuagaacccguagucggcgcagccaucgcugcccccgucgccggccaacaaaacgucauugacccuuggauucgcaacaacuucguccaagcacccggcggcgaguucacagucucaccccgcaacgccccaggcgaaauccuaugguccgcaccccucgguccugaccuaaaucccuaccuaucacaccucgcccgaauguacaacggauacgccgguggauucgaaguacaagucauccucgccgguaacgccuucaccgcuggcaaagucauauucgcagccguuccucccaauuucccaacagaaggacuuuccccaucacaaguaacaauguucccacacauuguaguagacguacgucaacuagaaccaguacuaauaccacuccccgauguccgaaacaacuuuuaucacuacaaccagucaaacgaccccacuaucaaacucauagcaaugcuauacacuccacuucgcgccaacaacgcaggagacgaugucuucacggucucgugucguguccucacgcgucccucccccgacuucgacuucaucuuucucguucccccuacagucgaaucacgcacaaaaccauucuccgucccaguccuaacaguugaagaaaugaccaacucccgcuucccaaucccacucgaaaaacucuucacaggccccucgagcgccuucguaguccaaccacaaaacggccgaugcaccaccgacgguguccuucucggcacaacccaacucucacccguuaauauaugcaccuuccgcggcgacguaacccacauaaccggcucccgcaacuacacaaugaaccucgccagccaaaacuggaacaacuacgacccaaccgaagaaauccccgccccucuagguaccccagacuucgucggcaaaauccaaggaguccucacccagacaacccgcaccgacggcucuacccguggacacaaagccaccguauacaccggcucugccgacuuugcccccaaacucggacgaguccaauucgaaaccgacacggaucacgacuucgaagccaaccaaaacaccaaauucacuccagucggcgucauacaagacgggggaaccacccaccgcaacgaaccccaacaauggguccuccccuccuacuccggccgcaacaccccuaacguacaccucgcgccugccgucgcccccacuuuccccggcgaacaacuucucuucuuccgcuccaccaugcccggcugcuccggcuaccccaacauggaucucgacugucucuuaccacaagaauggguccaauauuuuuaccaagaagccgccccugcccaaucugacguugcccuucuacguuucguaaaccccgacaccggccgaguacuuuucgaaugcaaacuacacaaauccggcuacguaaccgucgcucacaccggccagcacgaucuagucaucccacccaacggcuacuuccgcuucgauuccugggucaaccaguucuacacucucgcacccaugggcaacggcaccggccgccgacgcgcucuauaa

SEQ ID NO: 37467 - RNA, 1623 nt, Artificial Sequence
  derived and/or modified sequence opt11 from major_capsid_protein__Norovirus__AGV76563
augaaaauggcaucaucugacgccaaccccucggacggcuccgcagccaaucuaguccccgaagucaacaacgaaguaauggcacucgagccugucgucggagccgccaucgcggcucccguagccggccaacaaaacgucauagaccccuggauccgaaacaacuucguacaagcccccggcggcgaguucaccguaucaccccgcaacgcacccggagaaauacuauggucugcaccccuaggacccgaccuaaaccccuaucucucccaccuagcccgcauguauaacggauaugccggcgguuucgaaguccaagucauacuagcaggcaacgccuucaccgccggcaaagucaucuuugccgcggucccgcccaacuuccccaccgaaggccuuucccccucccaagucacaauguucccccacauagucgucgacguacgucagcucgaacccguccuaaucccccuaccagacguaagaaacaauuucuaccacuacaaccaaucaaacgaccccacaaucaaacucaucgcaaugcucuacacaccacuacgcgcuaauaacgccggcgacgacgucuucaccgucuccugccguguccuaacacgcccaucgcccgacuucgacuuuaucuuccucguaccacccaccgucgaaucccgcaccaaacccuucuccguccccguacucaccguagaagaaaugacaaacucacgcuuccccauccccuuagaaaaacuauucaccggcccauccuccgcauucgucguacaaccacaaaacggcagaugcacaaccgacggcguccuccucggcacaacccagcucucccccgucaacaucugcaccuuccgcggcgacguuacccacaucacgggcucccgcaacuauaccaugaaccucgccucccaaaacuggaacaacuacgauccaacugaagaaauccccgccccacucggcaccccggacuucguaggaaaaauccaaggaguacucacacaaaccacccgcaccgacggaucaacacguggacacaaagcaaccgucuacaccggcuccgcagacuucgcaccaaaacucggccgcguccaauucgaaaccgacaccgaccacgacuucgaagcuaaucaaaacaccaaauucacccccgugggcgucauccaagacggcggcaccacucaccgcaacgaaccccaacaauggguacuccccagcuacagcggucgcaacacacccaacguccaccucgcccccgccguagcccccaccuuccccggagaacaacuccucuucuuccguucaaccaugcccggcugcuccggcuacccgaauauggaccucgacugccuacuaccccaagaauggguccaauacuucuaccaagaagccgcccccgcccaauccgacguagcccuacuacgcuucgugaaccccgacacuggccgcguccuuuucgaaugcaaacuccacaaaucaggcuacgucaccguagcccauaccggacaacacgaccucgucauaccucccaacggauacuuccgauuugacuccugggucaaccaauucuacacccucgcccccaugggaaauggcacaggccgccgccgcgcccuauaa

SEQ ID NO: 37468 - RNA, 1623 nt, Artificial Sequence
  derived and/or modified sequence opt11 from major_capsid_protein__Norovirus__AGV76564
augaaaauggcauccuccgacgcuaaccccagcgacggaucugcagccaaccuuguccccgaagucaacaacgaaguaauggcccucgaacccguaguaggagccgccaucgccgccccagucgccggccaacagaacgucauagaccccuggauacguaacaacuucguacaagcccccggcggagaguucaccgucuccccacgcaacgccccaggcgaaauccuaugguccgcuccccuuggacccgaccucaaccccuaccucucccaccuagcccgaauguacaacggguaugccgguggcuucgaaguccaagucauucucgcaggaaacgccuucaccgcuggcaaggucaucuucgccgccguucccccuaacuucccuaccgaaggccuaucccccucacaagucaccauguuuccacacaucgucgucgacguccgacaauuagaacccguccucauaccccuaccugacguccgcaacaacuucuaccacuacaaccaauccaacgaccccacaauaaaacuaaucgccaugcuauacaccccacuccgcgcaaacaacgccggcgacgacgucuucacaguaucaugccgcguccucacccgccccuccccagauuucgacuucaucuuccucgucccacccaccgucgaaagccgcacaaaacccuucuccguaccuguccucacaguggaagaaaugacaaacagccgauuccccaucccccucgaaaaacucuucaccggaccauccagcgcuuucgucguccaaccucaaaacggaagaugcaccaccgacggcguucucuuaggcacuacccaacucagcccagucaacauaugcaccuuccguggcgacgucacccacaucacaggcagccgcaacuacacuaugaaccucgcaucacagaacuggaacaauuacgaccccaccgaagaaauucccgccccacucggaaccccagacuucgucggcaaaauccaaggcguccuaacccaaacuacccgaaccgacggauccacacgcggccacaaagcaacagucuacacuggcuccgcugacuucgcccccaaacuaggccgaguccaauuugaaacagacaccgaccacgacuucgaggccaaccaaaacacaaaauucacucccguaggagucauccaagauggcggaacaacccaccgcaacgaaccccaacaauggguccuucccuccuacucaggccgcaacacccccaacguccaccucgcacccgccgucgccccaaccuuccccggcgaacagcuccuauucuuccgcuccaccaugcccggcugcucaggauaccccuccauggaccucgacugccucuuaccacaagaauggguacaauacuucuaccaagaagccgccccagcgcaaagcgacguggcccuccuccgcuucguaaaccccgauaccggacgcguacuauucgaaugcaagcuacacaaaucgggauacguaacggucgcccacacaggccaacacgaccucgucauaccacccaauggcuacuuccgcuucgacucaugggucaaccaauuuuauacacucgcucccaugggcaacggcaccggacgccgccgagcccucuaa

SEQ ID NO: 37469 - RNA, 1623 nt, Artificial Sequence
  derived and/or modified sequence opt11 from major_capsid_protein__Norovirus__AGV76565
augaaaauggccucaucugacgcuaacccauccgacgguucagccgccaaccuaguacccgaaguuaacaacgaagucauggcauuagagcccgucgucggagcagccaucgcagccccggucgccggccaacaaaacguaaucgacccguggauccggaacaacuucguccaagcacccggaggugaguucacugugucaccaagaaacgcaccaggcgaaauccucugguccgcccccuuaggcccagaccuaaaucccuaccucucccaccucgcccgcauguacaacggauacgccggcggguucgaaguccaagugauucuggcaggcaaugccuucaccgccgguaaagucaucuucgccgccguaccacccaacuuucccacugaaggacuaucucccucccaagucaccauguucccccacaucgucgucgauguccgccaacucgaacccguccuaaucccacuuccagacguacgaaacaacuucuaccacuacaaccaaucgaacgaccccaccauuaaacucaucgcuaugcucuacacaccccuccgcgccaacaacgccggcgacgacguauucaccguuagcugccgaguccucacccgccccuccccugacuucgacuucauauuccuugucccacccaccguagaaucacgaaccaaacccuucuccguccccguucuaaccgucgaagaaaugaccaacagccgauuccccauaccccucgaaaaacuuuucacaggcccauccagcgccuucguaguacaaccccaaaacggacgaugcaccacagacggaguacuccuaggcaccacccaacucucccccguaaauaucugcacauuccgaggcgacgucacccacaucacaggaucacgcaacuauaccaugaaccuugcaucccaaaacuggaacaacuacgaccccacagaagaaauccccgcaccccuaggcacuccagacuucgucggcaagauacaaggaguacugacacaaaccacccgaacugacggcucuacacgcggacacaaggccaccgucuauacaggaagcgccgacuucgccccaaaacucggccgcguccaauucgagaccgacaccgaccacgacuucgaagccaaccaaaacacgaaauucacacccguaggcgucauccaagacggcggaaccacacacagaaacgaaccccaacaauggguccuccccucauacuccggccgcaacacacccaauguccaccuagcccccgccgucgccccaaccuuccccggcgagcagcuccucuucuuccgcuccaccaugcccggcugcucaggcuacccaaacauggaccuugacugccuccucccccaagaauggguccaauacuucuaccaagaagccgccccagcccaauccgacgucgcgcuccuacgauucgucaacccagacaccggacgcguccucuucgaaugcaaacuccacaaaaguggcuacgucaccgucgcccacaccggccagcacgaccuagucauacccccaaacggcuacuucagguucgacagcuggguaaaccaauucuacacgcucgcccccaugggaaacggcaccggucgacgccgcgcacuuuaa

SEQ ID NO: 37470 - RNA, 1623 nt, Artificial Sequence
  derived and/or modified sequence opt11 from major_capsid_protein__Norovirus__AGV76566
augaagauggcaagcucagacgccaacccuuccgacggcucugcagcaaaccuagucccagaagucaacaacgaaguaauggcccucgaacccgucgucggcgccgccauagccgcccccgucgcaggccaacaaaacguaauagaccccuggauccgcaauaacuucguccaggcccccggaggcgaguucaccguuucuccucgaaacgccccgggcgaaauccuaugguccgcaccacuaggacccgaccucaaccccuaccucucccaccuagcacgcauguacaacggcuaugcgggaggcuucgaaguccaagucauacuagccggcaacgccuucacugcaggcaaagucaucuucgccgcaguacccccaaacuucccuacugaaggccucucccccagccaagucacaauguucccacacauagucgucgacguuagacaacucgaacccgugcuaauaccccucccagacguccgaaauaacuucuaccacuacaaccaaucaaacgaccccacaaucaaacucaucgccaugcucuacacaccccuacgcgccaacaacgcaggcgacgaugucuuuaccguaucgugccgcguccucacccgccccucuccagacuucgacuucauauuccuagucccucccaccgucgaaucccgcacuaaacccuuuuccgucccgguacucacaguagaagaaaugaccaauagccgauucccaauaccacuagaaaaacucuucaccggacccucauccgcauucgucgugcaaccacaaaacggaagaugcacaaccgacggcguccuccucggcaccacacaacucuccccagucaauaucugcacauucagaggcgacguaacccacaucaccggcagucgcaacuacaccaugaaucuggccucacagaacuggaacaacuacgaccccacagaagaaauccccgcuccacucgggacccccgacuucguaggaaaaauacaaggcguccucacacaaaccacccgcaccgaugguucaacacgaggucacaaagcaacagucuacaccggcucagcagacuucgcacccaaauuaggccgcgugcaauucgaaaccgacaccgaccacgacuucgaagccaaccaaaacaccaaauucacaccagucggcgucauacaagacggcggcaccacccaccgcaacgaaccacaacaauggguccuucccuccuacagcggccgcaauaccccaaacguccacuuagccccugccgucgcacccaccuuccccggugaacaacuccuauucuuucgcuccacaaugcccgggugcuccggcuaccccaacauggaccucgacugccuacucccccaagaauggguacaauacuucuaccaagaagcagccccagcacaaucagacguagcauuacucagauucgucaaccccgacacaggacgcguccuauucgagugcaagcuccacaagucagguuacguaaccguggcccacacaggccaacacgaccuagucaucccgcccaacggauacuuccgcuucgacuccuggguaaaccaauucuacacccuggcgccaaugggcaacggcacaggccgccgccgugcccuauaa

SEQ ID NO: 37471 - RNA, 1623 nt, Artificial Sequence
  derived and/or modified sequence opt11 from major_capsid_protein__Norovirus__AGV76567
augaagauggccucaagcgacgccaaccccucugauggcuccgccgccaaccucguaccagaagucaacaaugaaguaauggcccucgaacccgucgucggcgcagccaucgcagcccccgucgcuggccaacagaacguaaucgacccauggauccgcaacaacuucguccaagcccccggaggcgaauuuaccguaaguccacgcaaugcccccggcgaaauccugugguccgcuccucuaggacccgaucuaaacccguaucuuucacaccucgccagaauguacaacggcuacgccggcggcuucgaaguccaagucauccuagcaggcaacgccuucaccgcagguaaagugaucuucgcagccgucccacccaacuuccccaccgaaggccuaucccccucccaggucaccauguucccccacauuguagucgacguccgccaacucgaacccguccucauccccuuacccgacguccgcaacaacuucuaccacuacaaccaaucaaacgaucccaccaucaaacuaaucgccaugcuauacacuccccucagagcaaacaacgccggcgacgacguauucaccgucagcugccgaguccuaacacgccccuccccagacuucgauuucaucuuccuugucccacccaccguagaaucccgcacaaaacccuucucaguccccguccuaaccgucgaagaaaugaccaacucccgcuuccccaucccgcuagaaaaacuauucacaggccccucauccgccuucgucguccaaccccaaaacggccgcugcacuacugauggcguccuccucggaacaacccaacucucaccugucaacaucugcaccuuccgcggcgacgucacccacaucaccggcucccgaaauuacacaaugaaccucgccucccaaaacuggaacaacuacgacccaacugaagaaaucccagcuccccucggcacccccgacuucguuggcaaaauacaagguguacucacacaaaccacccguaccgacggcuccacacgcggccacaaagccaccguauacaccggcuccgcagacuuugcaccaaaacuuggcaggguucaauucggaacagacacagaccacgacuucgaagccaaccaaaacacuaaauucacacccgucggaguaauccaagacggaucuaccacacacagaaacgaaccucagcaauggguccucccauccuacuccggccgaaacacaccaaacguucacuuagccccagccgucgccccaaccuuccccggcgaacagcuccuauucuuucgcucaaccaugcccggcugcucaggcuaucccaauauggaccuagacugccuccucccccaggaauggguacaauacuucuaccaagaagccgcacccgcccaauccgacguagccuuacuccgauucgucaaccccgacaccggacgcguuuuauucgaauguaaacuccacaaauccggcuacgucacaguagcccacaccggccaacacgaccucgucauuccacccaacggcuacuuccgauucgacagcuggguaaaccaauucuacacccucgcacccaugggcaacggcaccggucgccgacgagcccucuaa

SEQ ID NO: 37472 - RNA, 1623 nt, Artificial Sequence
  derived and/or modified sequence opt11 from major_capsid_protein__Norovirus__AGV76568
augaaaauggccucgucagacgccaaccccuccgacggcucugcagcaucccucguaccagaggucaauaacgagguaauggcccuagaacccgucgucggcgccgcaaucgccgccccaguagcaggccaacagaacgucauugaccccuggauccgaaacaacuucguacaagcccccggcggagaguucacugucucccccagaaacgcacccggugaaauacucuggagugcaccccucggccccgaccucaacccauaccucucccaccucgcccgcauguacaacggcuacgccggaggcuucgaaguacaagucauccucgccggaaacgccuucaccgccggcaaaguaauauucgcagcagucccaccaaacuuccccacagaaggccuauccccaucccaaguuaccauguuuccccacaucgucauagauguccgccaacucgaaccaguacuuaucccccucccugacguccgcaacaacuucuaccacuacaaccaaucaaacgacccuacuaucaaacucaucgccaugcuguacacgccacuccgcgcaaacaacgccggcgacgacgucuucaccgucucaugccgcguccucaccagacccucacccgacuucgacuuuauauuccuaguucccccaacagucgaaucccgaacaaaaccauuuuccguccccguccucaccgucgaagaaaugaccaacagccgauuccccaucccacucgaaaaacucuuuaccggaccauccuccgccuucguaguccaaccccaaaacggccgcugcacgacagacggaguacuccucggaaccacacaacuaucacccguaaacauaugcaccuuccgaggagacgucacacacaucaccggcucacgcaacuauaccaugaaucucgcaucgcaaaacuggaacaacuacgacccaaccgaagaaaucccagcaccccuaggcacacccgacuucgucggcaaaauccaaggaguccucacccaaaccacccgcacugacggguccacccgaggacacaaagccacggucuacaccggcuccgccgacuucgccccuaaacucggccgcguacaauucgaaaccgacacagaccacgacuucgaagcuaaucagaacaccaaauucacucccguaggcguaauccaagacggauccaccacucaccgcaacgagccucaacaauggguccuacccucauacuccggacgaaacacaccaaacguccacuuagccccugcagucgcaccaaccuuccccggggaacaacuccuauucuuccgcuccacaaugcccggcugcucuggauaccccaacauggaccucgacugccuccuuccccaagaauggguccaauacuucuaccaagaagccgcucccgcacaauccgacgucgcacuacuacgcuucguaaaccccgacaccggucgaguccucuucgaaugcaaacuacacaaauccggcuacguuacagucgcacacacuggccaacacgaucucgucaucccacccaacggauacuuccgcuucgacuccugggugaaccaauucuacacccuagcucccauggguaacggcacaggcagacgccgcgcgcuuuaa

SEQ ID NO: 37473 - RNA, 1623 nt, Artificial Sequence
  derived and/or modified sequence opt11 from major_capsid_protein__Norovirus__AGV76569
augaaaauggccucguccgacgccaaccccagcgacggcuccgccgcuaaccuagucccagaagucaacaacgagguaauggcccucgaaccagucgucggugccgcaauagcagcccccguagcaggccaacaaaacguaauagacccuuggauccgcaacaauuucguacaagcacccggcggcgaguucaccguauccccacgcaacgccccaggcgaaauccuaugguccgcaccccuaggccccgaccucaaccccuaccucucucaccuagcccguauguacaacggcuacgccgguggcuucgaaguccaaguaauccucgccggaaacgccuucaccgccggaaaggucaucuucgccgccgucccaccuaacuuccccaccgaaggccuaagucccucccaagucacuauguucccccacauaguaguagacguaagacaacucgaacccgucuuaaucccccuccccgacguccgcaacaacuucuaccacuacaaccaaucuaacgacccaacaaucaaacuaaucgccaugcucuacaccccacuacgcgccaacaacgccggcgacgacgucuuuacugucuccugcaggguccucaccagaccaucacccgacuucgacuucaucuuccucgucccacccacagucgaauccaggaccaaacccuucuccguccccguccuaacagucgaagagaugaccaauucccgcuuucccaucccauuagaaaaacucuucaccggccccucauccgccuucgucguccaaccccaaaacggacgcugcaccaccgacggcguacuccuaggaaccacucaacucucuccuguuaacauuugcaccuuccgcggagacgugacacacauaaccggaucccgcaacuacaccaugaaccucgcuucacaaaacuggaacaauuacgaucccacagaagaaauccccgcaccccuuggcacgcccgacuucgucggaaaaauccaaggaguucuaacgcaaaccacaagaaccgacgguucaacacgaggacacaaggccaccguauauaccggcuccgccgacuucgcacccaaacuaggacguguacaauucgaaacugacaccgaccacgacuucgaagccaaccaaaacaccaaauucacacccguaggagucauacaagacggcggcaccacacaccgaaacgaaccacaacaaugggugcuucccuccuacucaggccgcaacacaccaaacguccaccucgccccagcugucgcccccaccuuccccggcgaacaacuccuauuuuucagguccaccaugcccggaugcuccggcuaucccaacauggaccuugacugccuccuaccccaggaauggguacaauacuuuuaccaagaagcagcucccgcccaauccgacguggcacuccuccgcuucgucaacccagacaccggccgaguccuuuucgaaugcaaacuccacaaaucaggcuacgucaccgucgcucacacaggccaacacgacuuagucauacccccaaacgguuacuuccgcuucgacuccugggucaaccaauuuuacaccuuagcucccaugggcaacggcaccggccgccgccgcgcucucuaa

SEQ ID NO: 37474 - RNA, 1623 nt, Artificial Sequence
  derived and/or modified sequence opt11 from major_capsid_protein__Norovirus__AGV76570
augaaaauggccucauccgacgccaacccuucugacggcuccgcagccaaccucgucccagaagucaacaacgaagucauggcccucgagccagucguuggugcagcgaucgcagcacccgucgcaggucaacaaaacgucaucgacccauggauccguaacaacuucguacaagcccccgguggcgaguucaccguaucaccccgcaacgccccaggcgaaauccuauggucggcaccacucgguccugaccuuaacccauauuuaucacaccucgcacgcauguacaauggcuacgccggcggcuucgaaguccaagucauccucgccgggaacgcauucacagccggaaaaguaauuuucgcugccgucccucccaacuuccccaccgaaggacuaucccccucucaagucaccauguucccacacaucgucguagaugugcgccaacuagaacccguacucauaccccucccagaugucaggaacaacuucuaccacuacaaccaauccaaugaucccaccaucaaacucaucgccaugcucuacacccccuuacgcgccaacaacgccggcgaugacgucuucaccguuucaugccgcguccucacccgccccucacccgacuucgacuucaucuuccucgucccacccaccgucgaaucucguaccaaacccuuuuccguacccguacuaaccgucgaagaaaugaccaacagcagauuccccaucccacuugaaaaacucuucaccggacccucauccgcauucguaguccaaccacaaaacggacgaugcaccaccgacggcguacuccucgguaccacacaacucucccccgucaacaucugcacuuuucgcggcgacgucacccacaucacuggcucacgaaacuacaccaugaaccuagccucacaaaacuggaacaacuacgacccgaccgaggaaaucccugcaccccucggcacccccgacuucgucggaaaaauacaaggcguccugacccaaaccacccguacagacggcuccacccgcggccacaaagcaaccgucuauaccggcucagcagacuucgcucccaagcucggcagaguccaauuugaaaccgacaccgaccacgauuucgaagcaaaccaaaacaccaaauucacccccguaggcgucauccaagauggaggcaccacacaccgcaacgaaccucaacaauggguacuccccucuuacuccggccgcaacaccccaaacguacaccucgcaccagcugucgcccccaccuuccccggcgagcaauuacucuucuucagaucgaccaugccaggcugcuccggcuaccccaacauggaccucgacugccuccuaccacaagaauggguucaauacuuuuaccaagaagcagcccccgcccaaucugacgucgcccuucuacgcuucgucaacccagacaccggacgcguucuuuucgaaugcaaacuccacaaauccggcuacgucaccgucgcccacacaggccaacacgaccucguaauacccccaaacggcuacuuccgcuucgacuccugggucaaccaauucuacacccucgcaccaauggggaacggcaccggccgccgccgcgcccucuag

SEQ ID NO: 37475 - RNA, 1623 nt, Artificial Sequence
  derived and/or modified sequence opt11 from major_capsid_protein__Norovirus__AGV76571
augaaaauggcgagcuccgacgcaaaccccagcgacggauccgccgcaaaccucguccccgaaguaaacaacgaaguaauggcacucgaacccgucgucggagccgccaucgccgcccccgucgccggccaacaaaacguaaucgaccccuggauucguaacaacuucguccaagcacccggcggagaauuuaccgucucaccccgcaacgcccccggagagauacucuggucagccccucuaggaccagaccucaaccccuaccucucacaccuagccagaauguacaacggcuacgcaggcggcuucgaaguccaggucauccucgccggcaacgcauuuaccgcaggaaaaguaaucuucgccgcagucccaccuaacuucccaaccgaaggacucuccccuucacaaguaacaauguucccccacauuguaguagacguccgacaacucgaacccgugcuuaucccccucccagacguacgcaauaacuuuuaccacuacaaccaguccaacgacccuacaauaaaacuuaucgcaaugcuauacacuccacuccgagcgaacaacgccggagacgacgucuucacagucagcugcagaguccucacccgccccuccccagacuucgacuucaucuuccucguacccccaaccgucgaaucccgcacaaaacccuucucaguaccaguauuaacaguagaggaaaugaccaacucccgcuuucccaucccgcucgaaaaacuauucacaggccccucuuccgcauucguagugcaaccucaaaacggucgcugcaccaccgacggaguccuccucggcacuacccaacuuuccccagucaacauaugcaccuuccgaggcgacgucacccacauaacaggaucgcguaacuacaucaugaaucucgcaucccagaacugguccaacuacgaccccaccgaagaaauaccagcaccccuuggcacacccgacuucguaggaaaaauccaaggcguccuaacccagaccacacgaacagacggcuccacccgcggccauaaagccaccgucuacaccggcuccgccgacuucgcacccaaacucggcagaguacaauucgagacagauacagaccacgacuucgaagccaaccaaaacaccaaauucaccccagucggcguuauccaagacggauccaccacacaccguaacgagccacaacaauggguccucccauccuacuccggccgcaauacaccaaacguccaccuagcccccgcugucgccccgaccuuccccggagaacaacugcuguuuuuccguucaaccaugccagguugcucuggcuaccccaacauggaucuagacugccuccuaccacaagaauggguacaauacuucuaucaagaagccgcacccgcgcaaucagacguugcacuccuacgcuucguaaacccagacaccggaagaguacucuucgaaugcaaacuccacaaaagcggcuacguaacagucgcccacaccggccaacacgaccuugucaucccucccaacggcuacuuccgauucgauuccugggucaaccaauucuacacccucgcccccaugggaaacggaaccggacgccgccgcgcacuuuga

SEQ ID NO: 37476 - RNA, 1623 nt, Artificial Sequence
  derived and/or modified sequence opt11 from major_capsid_protein__Norovirus__AGV76572
augaaaauggcuuccucugacgccaacccaucagacggcucugcagcaaaccucguccccgaagucaauaacgaagucauggcacucgaaccagucgucggcgccgcuaucgccgcacccgucgccggucaacaaaacgucaucgaccccuggauacgcaauaacuucguucaagccccuggcggcgaguucaccguaucuccacgcaacgcccccggagaaauacuauggagcgccccacucggccccgaccuaaaccccuaccucucccaccucgcccgaauguacaacggcuacgcaggaggcuucgaaguacaaguaauccuagcaggcaacgcauucacagcuggaaaaguaauuuuugccgccgugcccccaaacuuccccaccgaaggccucuccccuucacaagucaccauguucccccacaucgucgucgacguccgacaacucgaaccaguucucaucccucuccccgacguccgcaacaacuucuaccacuacaaccaauccucggaccccaccaucaaacucauagcuaugcuauacacaccccuucgagccaacaacgcaggcgacgacgucuucaccguaucaugucgcguccucacacgaccaagcccugacuucgacuucaucuuccuagucccaccaaccguagaaucccgaaccaaacccuucuccgucccaguccucacagucgaagaaaugaccaacagccgauuccccaucccacucgaaaaacuuuucaccggucccuccuccgcauucgucguacaaccccaaaacggucgcugcaccaccgacggugugcuccucggaaccacacaacucucacccguaaacaucugcaccuuccgcggcgacguaacccacaucacaggcagcagaaacuacaccaugaaucucgcaagccaaaacuggaacaacuacgacccaacagaagaaaucccagcaccccucggcacacccgacuucguuggcaaaauacaaggaguacucacccaaacaacacgaacagacgggucaacccgcggccacaaggccacugucuacacuggcucugccgacuucgcgccaaaacuaggacgcguacaauucgaaaccgacaccgaccacgauuucgaagcaaaccaaaacacaaaauucacuccaguaggggugauucaggacggauccaccacccaccgcaaugaaccccaacaauggguccuacccucauacuccggccgcaacacccacaacguccaccucgcaccagccgucgcaccaaccuucccuggugaacaacuucuuuucuuucgcucuaccaugccaggcugcucaggcuacccuaacauggaucuagacugccuacuaccccaagaaugggugcaauacuucuaccaagaagccgccccagcccaaagcgaugucgcccuacuacgcuucgucaacccagacacuggccguguccucuucgaaugcaaacuccacaaaucuggcuacguaaccgucgcccacacaggccagcacgaccuagucaucccacccaacggcuacuuccgcuucgauucauggguaaaccaauucuacaccuuagcacccaugggcaacggcacaggccgccgccgagccguauaa

SEQ ID NO: 37477 - RNA, 1623 nt, Artificial Sequence
  derived and/or modified sequence opt11 from major_capsid_protein__Norovirus__AGV76573
augaaaauggccuccucagacgccaaccccagcgauggcucagcagcaaaccucguaccagagguaaacaacgaagucauggcacucgaacccguuguuggagccgccaucgccgccccaguagccggccaacaaaacgucaucgaccccuggauccgcaacaacuucguccaagcucccggaggcgaguucacuguauccccacgcaacgccccaggcgaaauacucuggucggcuccccugggccccgaccuaaacccauaccucucacaccuugccagaauguacaacggcuacgccggaggcuucgaaguccaagucauccuagccggcaacgccuucacagccggcaaaguaauauuugcagccguucccccaaacuuccccaccgaaggcuuaucgcccucccaagucacuauguucccccacaucgucgucgacguccgacaacuagaaccagucuuaaucccccuacccgacguacgaaauaacuuuuaccacuacaaccaauccaacgaccccaccaucaaacucaucgccauguuauacacaccccuacgcgcaaacaacgccggugacgacgucuucaccguaagcugccguguccucacccgccccuccccagacuucgacuuuaucuuccucgucccacccaccgucgaaucccgcaccaaacccuucucaguccccguacucacugucgaagaaaugaccaacucccgauuccccaucccacuagaaaaacucuucaccggccccuccuccgcauucguaguacaaccccaaaauggccgaugcacaacugacggaguucuccucggcaccacccaacuaucaccagucaacauaugcacauuccgaggcgacguaacacacauaacagguucacgcaacuauacuaugaaccucgccucccaaaacuggaacaauuacgacccaacagaagaaauccccgccccacucggaacccccgacuucgucggcaaaauccaaggcguucuaacucaaaccacccgaaccgacggcuccacacgaggccacaaagcaacagucuacaccggauccgcagacuucgcccccaaacuaggccgaguccaauucgaaaccgacaccgaccacgacuucgaagccaaucaaaacacgaaauucaccccgguagguguaauccaagacggcggaaccacacacagaaacgaaccccaacaauggguccuccccucuuacuccggccgaaacacacacaacguccaccucgcccccgcaguugcuccaaccuuucccggugaacaacucuuauucuuucgcuccacuaugcccggaugcucaggcuacccuaacauggaccucgacugccuacucccacaagaguggguccaauacuucuaccaagaagccgcccccgcccagagcgacgucgccuuacuacgcuucguaaacccagacacgggccgcgucuuauucgaaugcaaacuccacaaauccggcuacgucaccguagcacacaccggccaacacgaccucgugauaccaccaaacgguuacuuccgcuucgacagcugggucaaccaauucuacacccuagcgcccaugggcaacggcaccggccguagacgcgccgucuaa

SEQ ID NO: 37478 - RNA, 1623 nt, Artificial Sequence
  derived and/or modified sequence opt11 from major_capsid_protein__Norovirus__AGV76574
augaaaauggccuccucagacgcuaauccauccgauggcuccgccgccaauuuaguacccgaagucaacaacgaagucauggcccucgaaccagucgucggcgccgcaauagcggcccccguagcaggacagcaaaauguaaucgacccauggauucgcaacaacuucguccaagcccccggcggcgaauuuacagucucuccccgaaacgcaccaggcgaaauccucugguccgcuccccucggacccgacuuaaacccauaccucucucaccuagcccgcauguacaacggcuacgccggcggauucgaaguccaagucauucucgccggaaacgccuuuaccgccggcaaggucaucuuugccgcaguacccccaaacuucccaaccgaaggccucucccccucccaagucacaauguucccccacauagucgucgacguccgccaacucgaacccguacucaucccacugcccgacguccgcaacaauuucuaccauuacaaccaauccaacgaccccacgaucaaacugaucgcaauguuauacaccccucuucgcgcuaacaacgccggcgacgaugucuucacagucucuugucgcguucucacccgacccagccccgacuucgauuucaucuuccuaguacccccaaccgucgagucccgcaccaaaccauucucaguccccguacuuaccguagaagaaaugaccaacucacgauucccaaucccccucgaaaaacuuuucacuggccccucuagcgcauucgucguacaaccacaaaacggacgcuguacaaccgacggaguccuccucggaacuacacaacucucacccguaaauauaugcaccuuccgcggcgaugucacccacaucacaggcucccgcaacuacacaaugaaccuagcuucccaaaacuggaacaacuacgaucccacugaagaaauccccgccccucuaggcaccccagacuucguaggcaaaauccaaggcguacuaacccaaaccacccgaaccgacggaucaacccgcggccacaaagccaccgucuacacaggcucugcagacuucgcccccaaacucggccgaguccaauuugaaaccgacaccgaucacgacuucgaggcaaaccaaaacacuaaauucacccccgucggaguaauacaagacggcgguaccacacaccgcaacgaaccccagcaauggguccucccaucauacucaggacgcaacacacacaacguucaccucgccccagccgucgcccccacauuccccggcgaacaacuacucuucuuccgcucaacaaugcccggcugcagcggcuaccccaacauggaccucgacugucucaucccacaagaauggguacaauacuucuaccaggaagcagccccagcccaaagcgauguagcccuacuacgcuucguaaacccagauacaggccgaguacuauucgaaugcaaacuccauaaauccgguuacgucacugucgcccacacgggccaacacgaccucgucaucccacccaauggauacuuccgcuucgacucaugggucaaucaauucuacacccuagccccuaugggaaauggcaccggccgacgccgcgccguauaa

SEQ ID NO: 37479 - RNA, 1623 nt, Artificial Sequence
  derived and/or modified sequence opt11 from major_capsid_protein__Norovirus__AGV76575
augaaaauggcaagcagcgacgccaaucccucugacggaucagcagcaaaccuaguaccagaaguaaacaaugaagucauggcccuagaaccagucgucggagccgccauagccgcccccgucgcaggacaacaaaacgucaucgacccauggauccgaaauaauuucguucaagcacccggcggggaguucaccguaagcccacgaaacgcacccggcgaaaucuuauggucagcuccccuuggcccagaccuaaacccauaccucucccaucucgcccgaauguacaacgguuacgccgguggcuucgaaguccaggucauacuggccggcaacgcauucacagcaggaaaagucaucuucgccgcagucccacccaacuucccaacagaaggccucucccccucccaagucaccauguucccccacauaguaguugacguaagacaacuagaacccguccuaauuccccucccagacguccgcaacaacuucuaccacuacaaccaguccaacgaucccaccauaaaacuaaucgccaugcuauacacccccuuacgcgcuaacaacgccggagaugacgucuucaccgucagcugccgcguccucacucgccccucccccgacuuugacuuuaucuuccucgucccaccaaccgucgaaucccgcacaaaacccuucuccguccccguccuuaccgucgaagaaaugaccaacucacgcuucccaaucccacuagaaaaacuguucaccggacccuccagcgccuucgucguccaaccccaaaacggacgcuguaccaccgacggaguccuccuaggcaccacccaacucucccccguaaacauuugcaccuuuagaggagaugucacccacaucacagguucccgcaacuacacuaugaaccucgcuucccaaaacuggaacaacuacgacccuaccgaagaaauaccugcaccccuaggaacccccgacuucgucggaaaaauccaagguguacucacccaaacuacccgcacagacggcucaacacgcggucacaaagccaccguauacaccggaucagccgacuucgccccgaaacucggccgaguccaauucgaaaccgacacagacaacgacuucgaagccaaucaaaacaccaaauuuacccccgucgguguaauccaagacggcggaaccacacaccgaaaugaaccccaacaauggguacuacccuccuacuccgggcgaaacacacacaacguccaccucgcucccgccguagcccccaccuuccccggcgaacaacuccucuucuuucgcucaacaaugccuggaugcucaggauacccuaacauggaccucgacugccuuaucccccaagaauggguccaguacuucuaucaagaagccgcaccagcacaauccgacgucgcccuccuacgauuugucaacccugacaccggccguguacuuuucgagugcaaacuccacaaaucaggcuacgucaccgucgcccacacaggccaacacgaccuagucaucccacccaacggauacuuccgauucgacuccuggguaaaccaauucuacacccuagcccccaugggaaacggcaccggccgccgacgcgcagucuaa

SEQ ID NO: 37480 - RNA, 1623 nt, Artificial Sequence
  derived and/or modified sequence opt11 from major_capsid_protein__Norovirus__AHA44844
augaaaauggccucauccgacgcaaacccauccgacggaucagccgccaaccucgucccugaaguaaacaacgaagucauggcccucgagcccgucguaggagccgccaucgccgcuccaguagccggccaacaaaacguaaucgaccccuggauccguaacaacuucguacaagccccaggcggagaauuuaccguaucgccccgaaaugcccccggagaaauccuaugguccgcaccccuaggcccagaccucaaccccuaccucucccaccuggcucgcauguacaacggauacgccggaggauucgaaguccaagucauucucgcaggcaacgccuucacagccggcaaagucaucuucgccgcuguaccaccgaacuuccccaccgaaggccucucuccaucccaagucaccauguucccccacaucgucguggacguaagacaacucgagccaguccucaucccccuacccgacguccguaacaacuucuaucacuacaaucaaucaaacgaccccacaauaaaacucauagcuaugcucuacacaccacuccgcgcaaacaacgcaggcgacgacgucuucacggucuccugcagaguucuaacccgucccucccccgacuucgacuucauauuccuagucccacccacaguagaaucccgaaccaaaccuuucuccguacccguccucaccgucgaagaaaugacuaacucgagguuuccaaucccccuagaaaaacucuucaccggcccauccuccgccuuugucguccaaccacaaaacggccgaugcaccaccgacggcguucuacuaggcaccacccaacugucuccagucaacaucugcaccuuccguggagacgugacccacauuacaggcagccgcaacuacacaaugaaccucgcuucacaaaacuggaacaacuacgaccccacagaagaaauccccgccccacucggaacacccgacuucgucggcaaaauccaaggcguccuaacucaaaccacccgcaccgacggcuccacccgcgggcacaaagcuaccgucuacaccggcucugcagacuucgcccccaaacuaggccguguccaauucgaaaccgauacagaccacgacuucgaagcaaaccaaaacaccaaauucacccccguagggguuauacaagacggcggcaccacacaccgcaacgagccucaacaauggguccucccaucauacucuggccgcaauacccacaacguccaccuugcccccgcagucgcccccaccuucccaggcgaacaacuccuauucuuucgcuccaccaugcccggcugcucuggcuaccccaauauggaccuagacugccuccucccccaagaauggguccaauauuucuaccaagaagcggcccccgcccaaucugacgucgcccuacuaagauucgucaaccccgauacaggacgcguccucuuugaaugcaaacuccacaaaucaggcuacgucaccguagcccacacuggccaacacgaccucguaauacccccaaacggcuacuuccgcuucgacucaugggucaaccaauucuacacacuugcccccaugggcaauggcaccggccgccgccgcgccgucuaa

SEQ ID NO: 37481 - RNA, 1623 nt, Artificial Sequence
  derived and/or modified sequence opt11 from major_capsid_protein__Norovirus__AHA44847
augaaaauggcaucaucagacgcaaaccccuccgacggauccgccgccaacuugguccccgaagucaacaacgaagucauggcucuagagcccgucgucggcgcagccauagcagcacccgucgccggccaacagaacguaauagacccauggauccgaaacaacuucguacaagcaccaggcggcgaguucaccgucucaccccgcaacgccccaggagaaauccucuggucagcuccccucggccccgaucucaaccccuaccucucccaccuagcccggauguacaacgguuaugccggcggcuucgaaguacaaguuauccuugccggaaacgccuucaccgcagguaaaauaauauucgcagccguacccccaaacuucccuaccgaagggcucuccccaucacaagucaccauguucccacacaucaucgucgacguccgacagcuagaacccguccucaucccccucccagacguuagaaacaacuucuaccacuacaaccaauccaaugacccgacaaucaaacugauagccaugcucuacacgccacuccgagcaaacaacgccggggacgacgucuucacugucuccugccgcguucucacccgacccucccccgacuucgacuucauauuccucguuccucccacaguugaaucccgaaccaaacccuucucugucccgauccuuacagucgaagaaaugacgaacucccgcuuccccauaccccuagaaaaacuauucaccggccccucauccgcauucguaguccaaccccaaaacggacgaugcaccacagacggaguccuccucggcaccacucaacucuccccagucaacauauguaccuuucgcggcgacauaacacacaucacaggcucccgcaacuacacuaugaaccucgccucccaaaacuggaacaacuaugaccccaccgaagaaauacccgccccucucggaaccccagacuucguaggcaaaauccaaggaguccuaacccaaaccacccgcgcagacggauccacacgcggccacaaagccaucgucuacacaggcucagcagacuucgcaccgaaacucggccgcguccaauucgaaacugacaccgaucacgacuucgaagccaaccaaaacaccaaauucacuccagucggcgucacccaagauggcuccaccacccaccgcaacgaaccacaacaauggguccucccaucuuacagcggccgcaacacccacaacguacaucucgccccagccguagcaccaacauuccccggugaacaacuccuuuucuuucgauccacaaugccuggcugcagcggauaccccaauauggaucucgacugccuccuuccccaggaauggguacaauacuuuuaccaagaagccgcccccgcccaaucugauguagcccugcuccgauucguaaaccccgacaccggccgaguccuauucgaaugcaaacuccacaaaucaggauaugucacagucgcccacaccggccaacacgaccucgucaucccacccaacggcuacuuccgcuucgacuccuggguaaaccaauucuacacacuggccccuaugggcaacggcaccggacgucgcagagucgucuaa

SEQ ID NO: 37482 - RNA, 1623 nt, Artificial Sequence
  derived and/or modified sequence opt11 from major_capsid_protein__Norovirus__AHB62404
augaaaauggcaucauccgacgcaaacccaucagacggcuccacagccaaccuaguacccgagguaaacaacgaagucauggcccucgaacccguagucggagccgccaucgccgccccugucgcgggccagcaaaacguaauagaccccuggauccguaacaacuucguacaagcacccggcggcgaguucacaguuucaccccguaacgcucccggagaaauccucugguccgcaccccucggacccgaccuaaacccuuaccucucccaccucgccagaauguacaacggcuacgccggcggcuucgaaguacaagugauacuagccggcaacgccuucaccgccggcaaaaucauauucgccgccguuccacccaauuuucccaccgaaggccucucaccuucucaaguaacaauguucccacauauaauaguagacguacgucaacucgaacccguccucaucccccucccagauguccguaacaacuuuuaccacuacaaccaauccaacgacagcaccauaaaacucaucgccaugcucuauacaccccuacgcgccaacaacgccggagacgacgucuucaccguaucuugucguguccuaacccgcccgagccccgauuucgacuucaucuuccucgucccacccaccguugaaucgcgcaccaaacccuucuccgugcccguccuuaccgucgaagaaaugaccaacucccgauuccccauaccccucgaaaaacucuucacaggccccucauccgcauuugucguccaaccccaaaacggaagaugcacaaccgacggaguccugcuuggcacaacacaauuaucaccggucaauaucuguacauuccgaggcgacguaacacacaucucggguuccucuaacuacaccaugaaccucgccucccaaaacuggaacucuuacgauccaacagaagaaauacccgccccacuaggcacccccgacuucgucggaaaaauccaaggcguucuaacccaaacaacccgaacagacggcucuacccgcggccacaaagccacugucuacaccggcagcgccgacuucucccccaaacuaggccguguacaauucgccaccgacaccgauaacgacuucgaaaccaaccaaaacaccaaauucaccccaguaggcguuauccaagacggcgcuaccacucaccgcaacgaaccacaacaauggguacugcccuccuacuccggaagaaacacccacaacguccaccucgcccccgcaguagcccccacuuuccccggagaacaacuccucuucuuccgcuccacuaugcccgggugcuccggcuacccaaacauggaccucgacugccuccucccacaagaauggguucaauacuucuaccaagaagcagccccagcccaaucagacgucgcccuccuccguuucgucaacccugauaccggccgaguccucuuugaaugcaaacuccacaagucagguuacgucacagucgcacacaccggacaacacgaccucgucaucccacccaacggcuacuuccgcuucgacuccugggucaaccaguucuacacccuagcccccaugggaaacggaaccggccgccgacgcgcccuuuaa

SEQ ID NO: 37483 - RNA, 1623 nt, Artificial Sequence
  derived and/or modified sequence opt11 from major_capsid_protein__Norovirus__AHB62406
augaaaauggcauccucagacgccaaucccagugacggcucggccgccaaccucguacccgaagucaacaacgaagucauggcccuagaaccugucguaggcgccgccaucgcagcaccaguagcuggccaacaaaacgucaucgaccccuggauccgcaacaacuucguccaagcccccggcggcgaguucacaguuagcccacguaaugcccccggcgaaauacucugguccgcaccucucggccccgaccucaacccauaccuaucacaccuugcccgaauguacaacggcuacgcuggcggguucgaaguacaagucauccucgcaggaaaugccuucacagcuggcaaagucaucuucgccgcagucccacccaacuuccccaccgaaggucuaucacccucacaagucaccauguucccccacaucgucgucgacguccgccaacuagaaccaguccuaauaccccuucccgauguccgcaacaacuucuaucacuacaaccaauccaacgacccaaccauaaaacucauugcaaugcucuacacaccccuacgcgccaacaacgccggugaugacgucuucaccguaucuugccgaguccuaacucgcccuuccccagauuucgacuucauauuccuuguaccucccaccgucgaaucccgcacaaaaccauucucaguaccgguccucaccgucgaagaaaugacuaacuccagauuccccaucccacucgaaaaacucuuuaccggacccuccuccgcauucguaguccagccccagaacggccgaugcacaaccgacggcguucuucucggaacaacacagcucagccccguaaacaucugcaccuuccgaggcgacgucacccacaucacaggcucacgcaauuacaccaugaaccucgccagccaaaacuggaacaacuacgacccuacagaagaaauccccgccccgcuaggaacccccgacuucguuggcaaaauccaaggaguccucacacaaaccacacgcaccgacggcagcaccagaggccacaaagcaacagucuacacaggcucagccgacuucgccccaaaacucggccgcguccaauucgaaaccgacacugaccaugacuucgaagccaaccaaaauaccaaauucaccccggucggcgucauccaggacggcgguaccacccaccgaaacgaaccacaacaauggguccucccauccuacuccggccgcaauaccccaaacguccaucuagccccagcugucgcccccacauuccccggcgaacaacuacucuucuuccgcuccacaaugcccgguugcuccggauaucccaauauggaccucgacugccuauuaccacaagaauggguacaauacuucuaccaagaagcagcaccagcccaauccgacgucgcccuccuaagauucgucaaccccgacacuggccgcguccucuucgaaugcaaacuccacaaauccggcuacguaaccguugcccacacuggucaacacgaccucguuaucccucccaacggcuacuuccgcuucgauuccugggucaaccaauuuuacacacucgcccccaugggcaacggcacaggccgccgccgcgcccucuaa

SEQ ID NO: 37484 - RNA, 1623 nt, Artificial Sequence
  derived and/or modified sequence opt11 from major_capsid_protein__Norovirus__AID51515
augaaaauggcauccagcgacgcaaaccccucagacggauccgccgccaaccucgucccugaagucaacaacgaagucauggcccuugaaccagucgucggcgccgccauagccgcccccgucgcaggccaacaaaacgucauugaucccuggauacgcaacaacuucguccaagcccccggcggcgaguucacaguaucgccccggaacgcaccaggugaaauacucugguccgccccacucggccccgaccucaaccccuaccucucccaccuagcacguauguacaacggcuacgccggcggcuucgaaguccaagucauccuggccggcaacgccuucacagccggaaaagucaucuucgccgcagucccucccaacuucccaaccgaaggccuaucacccucccaagucacuauguucccacacaucguaguagauguacgucaacucgaacccgucuuaauaccccucccagacguccgcaacaacuucuaccacuacaaccaaucuaacgaccccacaaucaaacuuauagcaauguuauauacaccccuucgcgccaacaacgccggagacgacgucuucaccgucuccugccgcgucuuaaccagacccucuccagacuucgacuucaucuuccucguucccccaaccgucgaaucccgcaccaagccauucucaguccccguccuaacagucgaagaaaugaccaacucucgcuuccccauaccccucgaaaaguuauucacugguccaucauccgccuucgucguccaaccccaaaacggccgcugcacuaccgacggaguccuccccggaaccacccaacuaucucccgucaacaucugcacauuccgaggcgacguaacccacauaaccggcucaagaaacuacacaaugaaccucgccucccaaaauuggaacaacuacgaccccacugaagaaauccccgcuccccucgguacccccgauuucgugggcaaaauacaaggcguccucacacaaaccaccagauccgacggcuccacacgcggacacaaagccacagucuacaccggcuccgcagauuucgcucccaaacuaggacgaguccaauucgaaacugacaccgaccgcgacuucgaggccaaccaaaacaccaaguucacacccgucggcguaauacaagacggcggcacuacccaccgcaacgagccccaacaauggguccuaccauccuacuccggacgcaacaccccaaacguccaccuagcuccagccgucgccccaacauuucccggcgaacaacuacuuuucuuccgcuccacuaugcccggcugcagcggcuaccccaacauggaccucgauugccuacucccccaggaauggguucaauauuucuaccaagaagccgcgcccgcccaauccgacgucgcucuuuuacgauucguaaacccagacaccggccgcgugcuauucgagugcaaacuccacaaauccggauacguaaccguagcacacaccggacagcacgaccuagucauaccucccaacggcuacuuccgcuuugacucguggguuaaccaauucuacacccucgccccuaugggcaacggaaccggccgccgccgcgcccucuaa

SEQ ID NO: 37485 - RNA, 1623 nt, Artificial Sequence
  derived and/or modified sequence opt11 from major_capsid_protein__Norovirus__AID51517
augaagauggccuccuccgacgccaaccccuccgacggaucagcagccaaccuaguuccugaaguuaacaaugaaguaauggccuuagaaccaguaguaggugccgcuaucgccgccccuguagccggacaacaaaacguaauagaccccuggauccgaaacaacuucguccaagcucccggcggagaauuuacugucucaccccgcaacgcuccaggagaaauacucugguccgcuccacugggccccgaccucaaucccuaucuaucccaccucgcccgcauguacaacggcuacgccgguggcuucgaaguccaagucauccucgccggaaacgcauucaccgcaggcaaaguaaucuucgcugccgucccacccaacuuccccaccgagggccucuccccaucccaagucaccauguucccacacaucguaguagacguccgccaacucgaacccguacuuaucccacuucccgacguccgcaauaacuucuaccacuacaaccaauccaacgaucccaccaucaaacuuaucgccaugcuuuacacuccccuacgagcaaacaacgccggugacgacgucuucaccgucucaugccgaguccucacccgaccuucacccgacuucgacuucauauuccucgucccgccaaccguugaaucacgcacuaaaccauucucagucccgguacucaccguagaagagaugacaaauucccgauucccaaucccccucgaaaaacucuucacagggcccuccucagcauucgucguacaaccacaaaacggacgcugcacaaccgauggcguacuccucggcaccacccaacucucccccgucaauauuugcacauuccgcggcgacgucacccacaucaccggcucccgaaacuauaccaugaaccuagcaucccaaaacuggucuaacuacgaccccacagaagaaaucccagccccucucggcacucccgacuucgucggaaaaauccaagggguccuaacccaaacaacacgaacagacggaucuacccgaggccauaaagccaccguauacaccggcucagccgacuucgcccccaaacucggccgcguccaauuugaaacagacacagaccacgacuucgaagccaaccaaaacaccaaauucaccccaguaggcguaauacaagacggaucuaccacacaccgaaacgagccucaacaauggguccuaccuucauacucaggccgaaacacacccaacguacaccuugccccagccguggcccccaccuuccccggcgaacaacuacucuucuuccgcucaaccaugcccgguugcagcggcuacccaaacauggaucucgacugccuacucccccaagaauggguccaauacuucuaccaagaagccgccccagcucaauccgacgucgcccuccuccgauucgucaacccagacaccggcagagucuuauucgaaugcaagcuccacaaauccggcuacguuacagucgcccacacuggccaacacgaccuaguaauucccccaaacggcuacuuccgcuucgacuccugggucaaccaauucuacacccuagcucccaugggaaacggcaccggccgccgacgcgcccucuaa

SEQ ID NO: 37486 - RNA, 1623 nt, Artificial Sequence
  derived and/or modified sequence opt11 from major_capsid_protein__Norovirus__AID51519
augaaaauggccucaucagacgccaaccccuccgacggcuccgccgccaaccucguccccgaagucaacaacgaagucauggcgcucgaacccgucgucggcgccgccaucgcugcaccagucgccggacaacagaacgucaucgaccccuggauccgcaacaacuucguccaagcacccggcggagaguucacagucucacccagaaacgcaccgggcgaaauccuaugguccgcuccccugggccccgaccuuaaccccuaccuaucccaccucgccagaauguacaacggauacgccggaggcuucgaaguccaagucauccucgcaggcaacgccuucaccgcaggcaagguaauauucgccgccguacccccaaacuucccuacagaaggacuaucaccaucccaggucaccauguucccacacauugucguagacguccgccaacucgaacccguccucaucccacucccagacguacgaaacaacuucuaccacuacaaccaaucaaacgacccaaccaucaaacugauagcaaugcucuacacaccccuccgcgccaacaacgcaggcgacgacgucuuuaccgucagcugccgcguacuuacccgccccuccccagacuuugauuucauuuuccucguaccaccuaccguggaaagccgcacuaaacccuucucuguccccguccucaccguagaagaaaugaccaacucucgcuuccccauuccccucgaaaaauuauucacuggacccucaucagcguucgucguccaaccccaaaacggccgcugcacaacagacggaguccuccuaggcacaacacaacuuucaccagucaacaucugcaccuucagaggagauguaacccacaucaccgggucccggaacuacacaaugaaccuagcaucccaaaauuggagcaacuacgaccccacagaagaaauacccgcuccccucggaaccccagauuucguagguaaaauccagggaguauuaacacaaacaacccguaccgauggaucaacacgaggacacaaagccacaguauacaccggauccgccgacuucgcuccaaaacugggacgcguccaauucgaaacagacacagaccacgacuucgaagccaaccaaaacaccaaguucacccccgucggcguaauccaagacggauccaccacccaucgcaacgaaccucaacaauggguucuacccucuuacuccggccgcaauacacccaacguacaccucgcccccgccgucgccccaacauuccccggagaacaacuccuauucuuccgauccacaaugcccggcuguucuggcuaccccaacauggaccucgacugucucuuaccccaagaauggguccaauacuucuaccaagaagccgcccccgcccaauccgacgucgccuuacuccgcuucguaaacccugacacaggccgcguccuguucgaaugcaaacuucacaaaucccgcuacgucaccgucgcccacaccggccaacacgaccucguuauacccccaaacggcuacuuccgcuucgauuccugggucaaucaauuuuacacccucgccccgaugggcaacggcaccggccgacgccgcgcccucuaa

SEQ ID NO: 37487 - RNA, 1623 nt, Artificial Sequence
  derived and/or modified sequence opt11 from major_capsid_protein__Norovirus__AID51522
augaaaauggccuccucagaugccucccccucagacggaucagccgcaaaccuaguccccgaagucaacaacgagguaauggcccucgaacccguagucggagccgcaaucgccgcccccgucgcaggccaacaaaaugucaucgacccauggauccgcaacaacuucguacaagcaccaggcggagaguucacagucucaccccgcaacgccccaggagaaaucuuaugguccgccccacuaggccccgaccucaaccccuaccuaucccaccuagcccgcauguacaacggcuacgcaggcggauucgaaguccaagucauccucgccggcaacgcuuuuacagcagguaaagucaucuucgccgccgucccucccaacuuccccacugaaggccucucccccucccaagucacaauguucccacacaucguggucgacguccgacaacucgaaccaguacucauaccacuaccugacguccgaaacaauuucuaccacuacaaccaauccaacgacccaaccauaaaacucauugccaugcuuuacacccccuuacgugccaacaacgccggggaugacgucuuuacaguuuccugccgaguccucacacgacccuccccagacuucgacuuuaucuuccuggucccgcccacagucgaaucgagaaccaaacccuucuccguuccaguccuaaccguagaagaaaugaccaacucccgcuuccccaucccccucgaaaaacuauucacuggccccuccuccgcguucgucguccaaccacaaaacggccgaugcaccaccgacggcguacugcuaggaaccacccaacuaucccccgucaacauaugcaccuuccgcggcgacgucacacacaucaccgguucacgcaacuacacaaugaaucuagccucacaaaacugguccaacuacgaccccaccgaagaaauaccggccccacuaggaacucccgauuucgucggaaaaauccagggcguucucacccaaacaacacgcaccgacggauccaccagaggccacaaggccaccguauacacaggcuccgcagacuucgcacccaaacuaggccgcguccaauucgaaacagacacagauagagacuucgaggccaaccaaaacacaaaauucaccccagucggugucauacaagacggcuccacaacccaccguaacgaaccccaacaaugggucuuacccucuuacagcggaagaaacacccccaacguccaccuagcaccagccgucgccccaaccuucccuggagaacaacuccucuucuuccgcuccacaaugcccggauguuccggauacccuaauauggaccuagacugccuccuuccccaagaauggguccaauacuucuaccaagaggccgcacccgcacaaucagacgucgcccuacuccgauucguaaaccccgacaccggccgcguccucuucgagugcaaacuccacaaaucaggcuaugucaccgucgcccacaccggccaacacgaccuaguaauucccccuaacggcuauuuccgcuucgacuccugggucaaucaauucuacacacuagcaccaaugggaaacggaaccggccgccgccgagcacuauaa

SEQ ID NO: 37488 - RNA, 1623 nt, Artificial Sequence
  derived and/or modified sequence opt11 from major_capsid_protein__Norovirus__AID51531
augaagauggcauccuccgacgcuaaccccagcgacggcucagccgccaaucucguccccgaaguuaacaacgaagucauggcacuagagcccgucgucggagcugccauagcagcccccgucgcaggacaacaaaacgucaucgaccccuggauacgaaacaacuuuguccaagcaccaggcggagaauuuaccgucagccccagaaacgcccccggcgagauccucuggucagcaccccuaggcccagaccuaaauccuuaccuuucccaccucgcacgcauguacaacggguacgccggaggcuuugaaguccaagucauccuagcaggcaacgccuucacagccggcaaagucaucuucgcagcaguacccccaaacuucccgaccgaaggucucuccccaucccaagucaccauguucccccacauagucguagacguccgccaacuagaacccguacuuauaccccuccccgacguccgaaacaacuucuaccacuacaaccaguccaacgaccccaccaucaagcuaaucgccaugcuuuauacuccccuccgcgcaaacaacgcaggcgacgacgucuucaccgucuccugccgcguucucacccgaccuuccccagacuucgacuucauauuccucguaccacccaccgucgaaucacgcaccaaacccuucuccguccccguccuaacagucgaagaaaugaccaacagccgcuucccaaucccccuagagaaacuuuucacaggaccuagcuccgccuucgucguccaaccacaaaacggucggugcacuaccgacggcguccuucucggaacaacacaacucucccccgucaacaucugcaccuuccgcggcgacgucacccacaucacaggcucccgaaacuacaccaugaaccuagccagccaaaacuggaauaacuacgaccccacugaagaaaucccagccccacucggcacacccgacuucgucggcaaaauacaaggcguacucacccaaaccacccggacugacggcucaacccgcggacacaaagccaccguauacacaggauccgcagacuuugcccccaaacuaggacgaguccaauucgaaaccgauaccgaccacgauuucgaagccaaccaaaacaccaaauucacaccaguaggaguaauccaagacggcgguaccacucaccgaaacgaaccacaacaguggguccuccccuccuacuccggacguaacacccacaacguccaucuugccccagccguagccccaaccuuccccggcgaacaacuccucuucuuccgguccacaaugccuggcugcuccggauacccuaacauggaccuagacugccuccucccccaagaauggguucaauacuucuaccaagaagccgcccccgcacaauccgacguggcacuccuaagauuugucaaccccgacaccggccgaguacuauucgaaugcaaacuacacaaaucaggauacgucacagucgcccacacaggccagcacgaccucgucauaccgcccaacggcuacuuccgcuucgacagcuggguuaaccaauucuacacacucgcccccaugggcaacggaaccggacgcagacgagcagucuaa

SEQ ID NO: 37489 - RNA, 1623 nt, Artificial Sequence
  derived and/or modified sequence opt11 from major_capsid_protein__Norovirus__AID51534
augaaaauggcaagcuccgacgccaacccuagcgacgguagcgccgccaaccucguccccgaagucaacaacgaaguaauggcccuagaacccgucguaggcgcugccauagcagcuccaguagcuggccaacagaacgucauagaccccuggauccgaaacaacuucguccaagccccuggcggcgaguucaccguauccccacgcaacgccccaggcgaaauacuaugguccgcaccccucggccccgaccucaaccccuaccucagccaucuugcccgcauguacaaugguuacgccgggggcuucgaaguccaaguaauccucgccggcaacgccuucaccgccggcaaaguaauauucgccgccguacccccaaacuuccccaccgaaggccucucccccucccaagucaccauguuuccacauaucgucguugacguccgacaacuugaacccguacuuauaccccuccccgacguucgaaacaacuucuaccacuacaaccaauccaacgaccccaccaucaaacuaauagcaaugcuauacaccccacuccgcgccaacaacgcaggagacgacguauucaccgucuccugcagaguccucaccagaccaucucccgacuucgauuucaucuuccuagucccacccaccgucgaaucucgaacaaaacccuucucagucccuguacucacagucgaagaaaugaccaacuccagauuccccaucccccuagaaaaacucuucacaggccccucuucugccuucgucguccaaccccaaaacggccgcugcacaacagacggcguccuccuaggaaccacacaacucuccccagucaacaucugcaccuuccgcggcgacgucacacacauaaccggaucccgaaacuauaccaugaaccuagcaucccaaaacuggucaaacuacgaccccaccgaagaaauaccagcaccccucggcacucccgacuuugucggcaagauacaaggaguccuaacccaaaccacccgcacugacggcuccacacgcggacacaaagccaccguauacacuggcucagcagauuucgcccccaaacucggaagaguccaauuugaaaccgacaccgaccgcgacuuugaggccaaccaaaacaccaaauucacuccaguaggcgucauacaagacggauccacaacucaccgcaacgaaccccaacaauggguucuucccuccuauagcggacgaaacaccccaaacguacaccucgcaccagccguggcacccacauuccccggcgagcaacuacuauuuuuccgcuccaccaugcccggcugcuccggcuacccuaacauggaccucgacugccucuuaccccaagaauggguacaauacuucuaccaagaagccgcucccgcccaaucagacgucgcccuccuccgcuucgucaaccccgacacuggccgaguucuauucgaaugcaaacuacacaaaucaggcuacguaaccguagcacacaccggucaacacgaccucguaauaccucccaacggauacuuccgcuucgacucguggguaaaccaauucuacacacucgccccaauggggaacggcaccgggcgccgucgcgcucuauaa

SEQ ID NO: 37490 - RNA, 1623 nt, Artificial Sequence
  derived and/or modified sequence opt11 from major_capsid_protein__Norovirus__AIL49840
augaaaauggccagcucugacgccaacccaucugacggcuccgccgccaaccucgucccagaagucaacaaugaagucauggcccuagaacccguagucggcgccgccaucgccgccccaguagccggccaacaaaacgucaucgaccccuggauacgcaacaacuucguccaagcucccggaggcgaguucacugucuccccucgcaacgcacccggagaaauccucugguccgccccacucggccccgaccucaaucccuaccucucucaccuugcccgcauguacaacggcuacgcaggcggauucgaaguccaggucauccuugccggaaacgcauucaccgccggcaaaguaaucuucgccgcaguucccccaaacuucccaacagaaggccuaucccccucccaagucacgauguucccacacaucgucgucgacguccgccaacuugaacccguucucaucccccuacccgauguccgcaacaacuucuaccacuacaaccaaucaaacgaccccacaauaaaacugaucgcaaugcuauacaccccacuccgagccaacaacgccggcgacgacguauucaccgucucaugcagaguacuaacucgccccucccccgacuuugacuucauauuccuagucccacccacaguagaaucccgaaccaaacccuucucaguccccguccucaccgucgaagaaaugacuaacucacgauucccaaucccacucgaaaaacuuuucaccggaccaucaucugccuucgucguccaaccacaaaacggccgauguacuaccgacggcguccuccuaggcacaacccaacucucaccagucaacaucugcacauuccgcggcgacguuacccacauaaccggaucucgcaacuacaccaugaaccucgccucucaaaacugguccaacuaugacccaaccgaagaaaucccagcuccccucggaaccccagacuucguaggaaaaauucaaggaguccucacccaaaccacccgcaccgacggcuccacaagaggacacaaagccaccguauacaccggauccgccgacuucgccccuaaacuaggacguguccaauucgaaaccgacaccgaucgcgacuucgaagcaaaccaaaacaccaaauucacccccgucggcguuauccaggacggcuccaccacccaccggaaugaaccacaacaauggguccuacccucuuacucuggccgaaacacccccaacguacaccuugcccccgccguagcuccuaccuuccccggagaacaacuccucuucuuccgauccaccaugcccggaugcucaggcuacccgaacauggacuuggacugcuugcuaccucaagaauggguacaauacuucuaccaagaagcagcccccgcacaauccgacguugcccuacuacgcuucgucaaccccgacacaggccgaguccucuucgaaugcaaguuacauaaauccggcuacgucaccguugcucacaccggacaacacgaccucgucaucccaccaaauggcuacuuccgauucgauuccugggucaaucaauucuacacccucgcccccaugggaaacggcacuggccgacgacgagcacucuaa

SEQ ID NO: 37491 - RNA, 1623 nt, Artificial Sequence
  derived and/or modified sequence opt11 from major_capsid_protein__Norovirus__AIL49843
augaaaauggccuccuccgacgccaaccccagcgacggauccgccgccaaccucguccccgaagucaacaacgaagucauggcacuagaacccuuugucggcgccgccaucgccgcacccgucgccggacaacaaaacgucauugacccauggauccgaaacaacuucguacaagccccaggcggagaauuuaccguguccccacguaacgcaccaggugaaauucuauggucagcaccccucggcccagaccucaauccauaccuuucacaccuagcccgaauguacaacggcuacgccggcggauucgaaguccaaguaauccucgccggcaaugccuucaccgcaggcaaaguaaucuucgcagccgucccucccaacuuccccaccgaaggauuaucccccucacaagucacaauguucccccacauaguuguagacguccgacaacucgaacccguccucaucccacuaccagacguccgcaacaacuucuaccacuauaaccaguccaaugaccccaccaucaaacuaaucgccaugcuauacacaccccuacgagccaacaacgccggcgacgacgucuucaccgucuccugccgcguccucacccgccccuccccagacuucgacuucaucuuucucguacccccuaccgucgaauccagaaccaaacccuucuccgucccuguccucaccgucgaagaaaugaccaacucccgauucccuaucccccucgaaaaacucuucacaggaccauccuccgccuucgucguccaaccccaaaacggccgaugcacuaccgacggcguccuccugggcacaacacaacucagcccagucaauauaugcacauuccgcggagacgucacccacaucaccggaucacgaaacuacacgaugaaucuagccucacaaaacuggaacaacuacgaccucaccgaagaaauacccgccccacucggcacuccugacuucgucggaaaaauccaaggaguacuuacccaaaccacacgaaccgacggcuccacccgcggacacaaagccacagucuacaccggcucagccgacuucgccccaaaacucggccgaguccaauucgaaaccgacacggaccacgacuucgaagccaaccaaaacacgaaauucacccccgucggagucauccaagacggaggcaccacccaccgaucagaaccgcaacaauggguacuaccaaguuacagcggccgcaacacaccaaacguccaccucgcccccgccgucgcccccacuuuccccggugaacaacuccucuuuuuccgcuccaccaugccuggcugcucgggcuaccccaauauggaccuugacugccuacugccccaagaauggguacaauacuucuaucaggaagcagcaccggcccaaucagacgucgcccuucuacgcuucguaaaccccgacaccggccgcguacucuucgaaugcaaacuccacaaauccggcuacguaaccgucgcccacacaggccaacacgaccucgucauaccaccaaacggcuacuuccguuucgacuccugggucaaccaauucuacacccucgcccccaugggcaauggcacaggcagaagacgagcccucuaa

SEQ ID NO: 37492 - RNA, 1623 nt, Artificial Sequence
  derived and/or modified sequence opt11 from major_capsid_protein__Norovirus__AIV99914
augaaaauggccuccucagacgcaaacccaagcgacggcuccgccgccaaccucgucccagaaguaaacaacgaaguaauggcucucgaacccgucgucggagcagccaucgccgcaccagucgcaggccaacagaacgucauagacccuuggaucagaaacaacuucguacaagccccaggcggcgaguucaccgucuccccucgcaacgcaccaggcgaaauccucugguccgccccacuaggucccgaccucaaccccuaccucucccaccuagcacggacauacaacggauacgcuggcggauucgaaguccaaguuauccuagccggcaacgcguucaccgccggcaaagucaucuuugccgcaguucccccaaacuuccccacggaaggacuaucaccaucccaaguaaccauguucccccacauaguagucgacgcccgccaacucgaacccguacuaauaccccuacccgacguccgcaacaacuucuaucacuacaaccaaucaaacgacccgacaaucaaacucauugcaaugcuuuacacaccacuccgcgccaacaacgccggcgaugacguauucaccgucuccugccgaguccuaacccgucccuccccugauuuugauuucaucuuccucguacccccaaccguugaaucacgaacuaaaccauucuccgucccaguccucacagucgaagaaaugaccaauuccagauuccccaucccccucgaaaaacuauucaccggacccagcuccgccuucgucguacaaccacaaaacucccgcugcacaacagacggcguacuccucggcacaacccagcucucucccgucaacauaugcaccuuccgcggcgaugucacgcacauaaccggcucucgcaacuacaccaugaaccuugcaucacaaaacuggaacaacuacgaccccacugaagaaauccccgucccccucggaaccccugacuucgucggaaaaauccaaggcguccuaacccaaacaaccagaaccgacggguccacccgcggucacaaagcuaccgucuacacagguagcgccgacuucgcaccuaagcucggccgcguacaauucgaaacagacacugaccacgacuucgaagcaaaccaaaacaccaaauucacccccguuggaguaauccaagacgguggcacaacccaccgcaacgaaccccaacaauggguccuccccucauacagcggccgcaacacccacaauguacaccuagcccccgccgucgccccaacuuuuccaggcgagcaacuauuauucuuccgauccaccaugcccggcuguuccgguuaccccaacauggaccuagacugucuucucccccaagaauggguccaauacuucuaccaaggcgccgcacccgcacaauccgacguagcacuccuccgcuucgucaacccagacacaggacgcguucucuucgaauguaaacuccacaaaagcggcuacgucaccguagcccacacgggccaacacgaccuagucaucccuccaaacggcuacuuccgcuucgauuccugggucaaccaauucuacacacucgcacccaugggcaacggaaccggacgacgccgagcaguuuaa

SEQ ID NO: 37493 - RNA, 1635 nt, Artificial Sequence
  derived and/or modified sequence opt11 from major_capsid_protein__Norovirus__AJP13619
auggcauccaaagacgccccacaaucggccgacggagccucaggagcuggacagcuaguaccugaagucaacacagcagacccccucccaauggaaccagucgccggccccacaaccgccgucgccaccgcaggacaggucaacaugauugacccauggaucguaaacaacuucguacaaucgccccaaggcgaauuuacaaucuccccuaacaacacacccggcgacauccuauucgaccuacaacuaggcccccaccucaaccccuuccucucacaccucucucaaauguacaacggcuggguuggaaacaugcgaguccgaauccuccuagcuggcaacgcguucucagccggaaaaaucaucgugugcugcguacccccaggauucacguccagcagccuuacuauagcccaagccacacuuuucccacaugucauagccgacguccgcacccucgaacccaucgaaaugccacuagaagacguacgaaacguacuguaccacaccaacgacaaucaaccgaccaugcgucucgucugcaugcucuacacuccucuccgcacuggcggaggauccgguaacucagacuccuucgucgucgccggacgcguccuaacugcaccgagcucagauuucucauuccucuuccucgucccgccaaccauagaacagaaaacacgcgcauucacgguccccaacaucccucuccaaacacuuuccaauucacgcuucccaucgcugauccaaggaaugauccucucaccagaugccucccaaguaguccaauuccaaaauggccgcugccuaaucgacggacaacuccucggcaccacacccgcaacuagcggccaacucuuccgcgugcgcggcaaaaucaaccaaggcgcccgaacccucaaccugacagaaguugacggcaaacccuucauggcauucgacucaccagcacccgucggcuuccccgacuucggcaaaugcgacuggcacaugcgaauuuccaaaacaccaaacaacacuucuucaggagaccccaugcgcucugucuccguccaaacuaauguacaaggcuucgucccccaccucggcuccauacaauucgacgaagucuucaaccaccccaccggcgacuacauuggcaccaucgaauggaucagccaaccaucaacucccccaggaaccgacaucaaccucugggaaauaccugacuacggaucaucccuuucccaagccgcaaaccuagccccacccgucuucccuccaggcuucggugaagcacucguuuacuucguauccgccuuccccggccccaacaaccguuccgcacccaacgacguccccugccuccuuccccaagaauacauaacacacuucgucagcgaacaagccccgaccaugggcgacgcagcccuccuccacuacguagaccccgacacuaaccgaaaccuaggcgaauuuaaacuauacccaggcggcuaucuuaccugcgucccuaacggcguaggagccggcccccaacaacucccacuaaacggaguauuccucuucgucuccugggucucccgcuucuaccaacucaaacccgucgguaccgccucaacugcccgcggucgccucggcguacgacgcaucuag

SEQ ID NO: 37494 - RNA, 1632 nt, Artificial Sequence
  derived and/or modified sequence opt11 from major_capsid_protein__Norovirus__AJP13620
auggcauccaaagaugcaccaaccaauauggacggcaccuccggugccgggcaauuaguccccgaagccaacaccgccgaacccaucuccauggaaccagucgccggugcggucaccgccgccgccaccgccggacaagucaacaugaucgaucccuggauaaugaacaacuacguccaagcaccccaaggugaguucaccaucucccccaacaacacccccggagacauccuauucgaccuccaacucggcccacaccuaaaucccuuccucucccacuuagcccaaauguacaacggcugggucggcaacaugaaaguccgaguccuacuugccggaaacgccuucacagcaggcaaaaucauaaucuccuguauaccacccgguuucguugcucaaaacaucuccaucgcccaggccacaauguuuccucacgucauugccgacguccgaguccuagaaccaauugaagucccccucgaagacguccgcaacguccucuuccacaacaacgacaacacacccaccaugcgccuagucugcauccuauacaccccacuacgagcauccgguuccuccuccggcacagaccccuucgucauagccggaaggguccucacaugucccucccccgacuucagcuuccucuuccuaguaccacccaacguugaacaaaagacaaaacccuucucaguucccaaccucccucuaaacacucucuccaauucaagagucccaucacucauaaaaucaaugaugguaucccgcgaucacggucaaaugguccaauuccaaaauggacgcgucacccucgauggccaacuacaaggcaccacaccuaccuccgcaucccagcucugcaaaauacgagggagcgucuuccacgcaaacggcggcaacggcuacaaccucacagaacucgacgggucccccuaucacgccuucgaaucgcccgcacccaucggcuuccccgaccucggcgaaugcgacuggcacauggaagccucacccaccacucaauucaacacuggagacgucaucaaacaaauaaauguaaaacaagaguccgcguucgcaccccaccucggcaccauccaagcagacggccucucggacguaagcgucaacaccaacaugaucgccaaacucggaugggucucuccugucuccgacggacacaaacgcgacgucgacccuugggucaucccacgcuauggcuccacccucaccgaagccgcccaacucgccccucccaucuaucccccaggcuucggagaagccauagucuuuuucaugucugacuucccaaucgcccacggcacaaacgggcuaagcguacccugcacaauaccccaagaauuugucacccacuucgucaacgaacaagcacccacccgaggcgaagccgcccuacuccauuaccuugaccccgacacccaccguaaccucggcgaauuuaaacuauaccccgacggauucaugaccugcguaccaaacaccucaggaacaggcccacaaacacuccccauaaacggagucuucguuuucguuucauggguaagccgcuucuaccaacuuaaacccgucggcaccgccggccccgcccguagacucggcauacgccgcucauaa

SEQ ID NO: 37495 - RNA, 1647 nt, Artificial Sequence
  derived and/or modified sequence opt11 from major_capsid_protein__Norovirus__AJP13621
augaaaauggcauccaacgacgccgcacccuccaacgauggcgcagccggccucgucccagaaauaaacaacgaagccauggcccucgaacccgucgccggcgccgccauugccgcaccccuaaccggccaacaaaacaucaucgaccccuggauaaugaacaacuucguccaagcccccggcggagaauuuaccguaucgccccgaaacucccccggcgaaguccuucucaaucuagaacuaggaccagaaaucaaccccuaccucgcccaccucgcccguauguauaauggcuacgccggcggauucgaaguccaaguaguccuagcaggaaacgcauucacggccggcaaaaucauauucgcagccaucccacccaacuuccccauagacaaccucuccgccgcccaaauaacaaugugcccccacgucauagucgacguacgccagcucgaaccaguaaaucuucccaugcccgauguacgaaauaacuucuuucacuacaaccaaggcuccgacucccgccucagacucauagccaugcucuauacuccccuaagagccaacaacuccggcgacgacgucuucaccgucuccugccgaguccuaacacgcccaucccccgauuucuccuucaacuuucucgucccacccacagucgaauccaaaaccaaaccauucucccuacccauucucacuauuuccgaaauguccaacucucgauuccccguccccaucgacucccuacacacauccccaaccgaaaacaucgucguccaaugccaaaacggccgcguaacccucgacggcgaacuaaugggcaccacccaacuccucccaucucaaaucuguacauuccgagguguccucaccagauccacaagccgagcauccgaccaagcugauaccgccacaccacgccuuuucaacuacuauuggcauauccaacucgacaaccucaaugguacucccuacgaccccgcagaagacauccccggcccccugggaacaccugacuuccgcggaaaagucuucggaguugccucccagcgaaaccccgauagcacaacccgcgcacacgaagcaaaaauagacaccacauccgguagauucaccccaaaacuaggcucgcucgaaaucucaaccgaaucagacgacuucgaccaaaacaaacccacaagauucacccccgucggcaucggaguugaccaugaagcagacuuccagcaaugggcacuccccgacuacgcaggccaauucacccacaacaugaaccuugcaccagccgucgcccccaacuuccccggcgaacaacuccuauucuuccgcagccaacuacccucgucaggaggccgauccaacggaauccuagacugccuagucccacaagaauggguccaacacuucuaccaagaaucagcccccucccaaucccaaguugcccuaguaagauacauaaacccagacaccggccgaguccucuucgaagccaaauuacacaaacugggcuucaucacuaucgcgaaaaacggcgacagccccaucaccguaccaccuaacggcuacuuccgauucgaaucaugggucaaccccuucuacaccuuagcacccaugggcaccggcaacggucgacgccgcauacaauag

SEQ ID NO: 37496 - RNA, 1653 nt, Artificial Sequence
  derived and/or modified sequence opt11 from major_capsid_protein__Norovirus__AJP13622
augaaaauggcuuccaaugacgccgcccccuccaacgacggcgcagcaaaccuugucccagaagcaaacaacgaagucauggcccuugaacccguagucggcgcaucaaucgccgcccccgucgucggccaacaaaacaucaucgaccccuggauacgagagaacuucguucaagcaccccagggcgaguucaccguguccccacgcaacucccccggcgaaaugcuccucaaccucgaacucgggcccgaacucaaccccuaccuaucccaucuuucccguauguacaacggauacgcaggaggcaugcaaguacaaguaguucucgcagguaacgccuucacagcaggaaaaauuauauucgcagccguaccaccacacuuccccgucgacaacaucuccgcagcccaaaucaccaugugcccccacguaaucgucgacguccgacaacuagaacccguccuacugccccucccagacauccguaaccgcuucuuccauuacaaccaagaaaacaccccacgcaugcgccuaguagccaugcucuauacaccccuacgcgcuaacucgggugaagacgucuuuacugucucuugccgcguacucaccaggcccgcccccgacuucgaguucacauuccucgucccacccacagucgaaucaaaaaccaaaccauucacccuaccaauccuuacccuaggcgaacuauccaacucacgauucccggccgcaaucgacaugcucuacacagacccaaaugaauccauagucgugcaaccccaaaacggccgcugcacccuagacggcacacuacaaggaaccacccagcuaguaccaacccaaauaugugcuuuccgcggcacacuaaucucucaaaccgcccgcgccgcagacucaacugacagcccccaacgugcucgcgaccacccgcuccacguccaagucaaaaaccucgacggaacccaauacgaccccacagacgacauccccgcgguccuaggcgccauagacuucaaaggcacaguauucggagucgcaagccaacgcgacguaucaggcacacaagaacaaggacacuaugccacccgcgcacacgaagcccauaucgacacaaccgacccgaaauacgcacccaagcucggcaccauccucauaaaauccgaauccacugacuucacaacaaaccagcccauacguuucacacccgucggaaugggcgacaauaacuggcgucaaugggaacuccccgacuacagcggccgccuuacccuaaacaugaaccuagcccccgccguaagccccagcuucccaggcgaacgaauccuauucuuccgcuccauaguccccuccgccggaggcuucggauccggcuacauagacugccuaaucccacaagaauggguccaacacuucuaccaagaagcagccccaagccaauccgcaguugcccucguaagauacguaaaccccgacaccggccgcaacauauucgaagccaaacuccaccgcgaaggcuuccucacaguugcaaacucaggaaacaacccaauaguaguuccacccaacgguuacuuccgcuucgaagccuggguaaaccaauucuacacacuagcuccaaugggcucggggcaaggccgacgccgcgcccaauaa

SEQ ID NO: 37497 - RNA, 1614 nt, Artificial Sequence
  derived and/or modified sequence opt11 from major_capsid_protein__Norovirus__AJP13623
augaaaauggccuccaaugacgcagcccccuccaacgacggcgccgccggccuagucccagaagucaauaacgaaaccauggcacucgaacccguagccggcgcaagcaucgccgccccucucaccggacaaaauaacguuaucgaccccuggauaagacuaaacuucguccaagccccaaacggagaguucaccgucucuccccgcaauuccccgggagaagugcuccucaaccuagaacucggccccgaacucaacccauaccuugcacaucucucccgcauguacaacggauaugcaggaggcgucgaaguccaaguccuacuagccggaaacgccuuuaccgccggcaaacucgucuucgccgcagucccuccccacuucccccuugaaaacauaucccccggccaaaucaccauguucccccacgucauuauagacguacgaacccucgaacccguccuccuaccccuacccgacguccgaaauaacuuuuuccauuacaaucaacaaaacgaaccccgaaugcgccucgucgccaugcucuacacacccuuaagauccaacggcuccggcgacgacguguucacagucuccugccgaguccucacgcgccccagcccagacuucgacuucaacuaccucgucccacccacaguagaaucaaaaacaaaaccauucacccuaccgauucucaccauaggcgaacuaaccaauucccguuucccagucccaaucgacgaacucuacaccuccccaaacgaaucccuagucguccaaccccaaaacggccgaugcgcacucgacggagaacuccaaggcaccacccaacuacugcccaccgccauaugcuccuuccgcggcagaaucaaccaaaaagucucaggcgacaaucacgucuggaacaugcaagucacaaacauaaacggaacccccuucgaccccaccgaagacguacccgcaccccuaggaacccccgacuucuccggcaaacucuucggcguacucucacagcgagaccacgacaaugccugccgcucccacgaugccgucaucgcaaccgacucagcaaaauucaccccaaaacuuggagcaauucaaauaggaaccugggaggaagacgacguccacaucaaccaacccacuaaauucacccccguaggucucuucgaacgcgaaggcuucaaucaauggacccuccccaacuauuccggagcccucacccucaacaugggacucgcucccccagucgcccccaccuuccccggcgagcaaauccuuuucuuccgcucccacaucccccucaaaggaggcgucgccgaucccgucaucgauugucuacucccgcaagaauggauacaacaucuauaccaagaauccgccccaucccaaacagacguugcccuaauccgcuucaccaaccccgacaccggacgcguccuauuugaagccaaacuccacagauccggcuacaucacagucgcaaacacaggcucacgccccauaguagucccagccaacgguuacuuccgcuucgacucaugggucaaccaauucuauucccucgcccccaugggaaccgguaacggccgccgccgaguccaaaaaggcuaa

SEQ ID NO: 37498 - RNA, 1623 nt, Artificial Sequence
  derived and/or modified sequence opt11 from major_capsid_protein__Norovirus__AJW67354
augaugauggccucgaaggacgcccccaccucccccgacggcgccuccggcgcaggacaacuuguucccgaagcaaacaccgcagagcaaaucucuauggacccugucgccggagccucaaccgcgguagcuaccgcaggccaaguaaacaugauagacccauggauauucaacaacuucguccaagcaccccaaggugaauuuaccaucucucccaacaacacaccaggcgacauacucuucgaccuacaacucggcccccaccuuaacccauuccucgcccaccugucccagauguauaacggcuggguaggcaacaugagaguucgaauacuccuugccgguaacgcauucaccgccggcaaaaucaucaucugcugcgucccacccggcuucgacgcacgaauacucacgaucgcccaagccacacuauucccccaccucaucgccgacguccguacucuugaaccagucgaacuaccccucgaagacguacgaaacguccucuaccacaacagcucccaaccucaacccacaaugcgcuugguagcgaugcuauacacaccccuccgaacaggcggcggcuccggaggaaccgacgcauucgucgucgccgguagaguacuaaccugccccgcccccgacuucuccuuccucuuccugguacccccauccguagaacagaaaacucgcgucuucucaguccccaacaucccccuaaaggaccucuccaacucccgcguacccguaccuguacaaggcauguucgucucacccgacgucaaccaauccguccaauuccaaaacggccgaugccaaaucgacggccaacuacaaggcacuacccccgucagccucucccaacucugcaagauccgcggaaaaaccuccuccaacgcccgcguccuaaaucuauccgaaguagacggaaccccuuucaucccccuagaaucccccgccccaguuggcuucccagaccucggcggcugugacuggcacgucaacuucaccuuccaaacccaagaccgcgaccccucccaaucagucacauucgcaaccaacgacgcauccuucgucccauaucuaggcucuguaucaccacauaacggcgaagguuuccaagccggagacaucauaggcucucuagguuggaucuccgcccccuccgacaacucccaauucaacguaugggccaucccaaaauacggcuccucauuaccugacgucacccaucucgcccccgcugucuucccacccggcuuuggcgaaguaauccucuacuucuacucaacauuucccggcuccggccaacccucccaacuucagguccccugccuucucccccaagaauuuaucacccacuucugcaacgaacaagccccaaucgccggugaagccgcauuacuccacuacgucgacccagauacuggccgaaaccucggcgaguucaaacucuaccccgauggcuucaugaccugcguacccaacuccguauccagcggaccgcaaacauuaccaauaaacggagucuucguuuucgucucaugggucucacgcuucuaccaacuuaaacccgucggcaccgccucagccgcccgccgacuaggauuacgaagaaucuaa

SEQ ID NO: 37499 - RNA, 1644 nt, Artificial Sequence
  derived and/or modified sequence opt11 from major_capsid_protein__Norovirus__AJW67357
augaagauggccucuaacgacgccgcaccaucaaacgacggcgccgccaaccuagucccugaagcaaccaacgaaguaauggcccuugaacccguaguaggagcauccauagcggcccccgucguaggccagcaaaacaucaucgaccccuggauacgcgaaaacuucguccaagccccgcaaggagaauuuaccgucucaccccgcaacucccccggcgaaauguugcucaaccuagaacuaggaccagaacucaaccccuaccucucacaccucucaagaauguacaacggauacgccggaggaaugcaaguccaagucguccucgccggaaacgcauucaccgccgguaaaauaaucuucgcggccgucccaccccacuuccccguugaaaacauauccgccgcccaaaucaccaugugcccccacgucauaguugacguacgccaacucgaacccguucuccuuccccuccccgacauccggaaccgauucuuccacuacaaccaagaaaacacaccccgcaugcguuuagucgcaaugcuauacacgccccugagagccaacucuggagaagacgucuucaccgucuccugccgaguccucacccgucccgcccccgacuucgaguucaccuuucucguuccacccaccgucgaaucaaaaaccaaacccuucacccuaccuauccuuacccuaggcgaacucuccaacuccagauuccccgcccccauagacaugcuuuacacugaucccaacgaagccaucgucguccaaccccaaaacggccgcuguacccucgacggcacacuccaaggaaccacccaguuagucccaacccaaaucugcucauuccgaggcacccuaauaucccaaaccucucgaagcgccgauuccacagacucggcaccccgcgucagaaaccacccccuccauguccaacucaaaaaccucgacggaacccccuaugaccccacagacgaagucccagccguacucggcgccauugacuucaaaggcacagucuucggcgucgccucacaacguaacacaaccggcaacuccaucggggcaacacgugcccacgaaguacacauagacaccaccaacccccgcuacacacccaaacucggcagcguccucauguacuccgaaucaucugacuucgacgacggacaacccacccgauucaccccaaucggaaugggcgccgacgacuggcaccaaugggaacuccccgaauacuccggacaccucacucucaacaugaaccuugcacccgccgucgcacccgccuuuccaggagaacgaauccucuucuuccgcuccgucguaccaucagcaggcggcuacgguuccggccacaucgacugccuuauuccccaagaauggguucaacacuuuuaccaggaagccgcaccuucccaaagcgccguugcacuaauccgcuacgucaaccccgacaccggacgcaacaucuucgaagccaaacuccaccgcgaaggauucguaaccgucgccaauuccggcaacaacccaaucgucgucccucccaacggcuacuuucgcuuugaagccuggguuaaccaauucuauacacuaacccccaugggcaccggccaaggccggagacguauccaauaa

SEQ ID NO: 37500 - RNA, 1644 nt, Artificial Sequence
  derived and/or modified sequence opt11 from major_capsid_protein__Norovirus__AJW67359
augaaaauggcguccaaugacgcagcgcccucaaacgacggagcagccaaccuuguccccgaagccaccaacgaagucauggcacuugaaccugucguaggcgccuccaucgccgcccccguaguaggucaacaaaacaucauugaccccuggauucgcgaaaacuucguccaagcaccccaaggcgaguucaccguuucaccacgaaacuccccaggagaaaugcucuuaaaccuugaacucgggcccgaauuaaaccccuaccuuucgcaccucucccgcauguacaacggcuacgcaggcggcaugcaaguccaagucguccuugccggaaacgccuucaccgcaggcaaaaucauuuucgccgcaguacccccacacuuccccgucgaaaacaucuccgccgcacaaaucacaaugugcccucacgucaucgucgacguacgccaacucgaacccguacuacuuccccuccccgacauccgcaaccgcuucuuccacuauaaccaagaaaacaccccacguaugcgucuagucgccaugcuauacacuccccuccgagccaacuccggcgaggacgucuucaccgucucaugucgcguccuuacccgccccgcgcccgacuucgaguucaccuuccucgucccucccaccgucgaauccaaaaccaaacccuucacccuacccauccucacacuaggugaacucuccaacuccagauuucccgcuccaaucgacaugcuauauaccgacccaaacgaagccauaguuguacaaccccaaaacggccgcugcacccucgacggaacccuccaaggaaccacccaacucguccccacacaaauuugcuccuuccggggaacccuaauuucccaagccucucgcuccgccgacuccaccgacuccgcaccccguguccgcaaccauccacuacacguccaacucaaaaaucuagacggaaccccauacgaccccaccgacgaagucccagccguacucggagccauagacuuuaaaggcaccguauuuggcgucgccucccaacgcaacacgaccggcaacuccaucggcgccacccgcgcccacgaggcccauaucgacaccaccaacccccguuacacccccaaacucggcagcguccuuauguacuccgaauccucagacuucgacgacggccaacccaccagauucacccccaucggcaugggagccgacgacuggcaccaaugggaauuacccgaauacucaggccaccuaacccucaacaugaaccucgccccagcagucgccccugccuuuccgggcgaacgcauacuuuucuuccggagcgucgucccuucagccggcggcuacggauccggacacaucgacugccucaucccucaagaauggguucaacacuucuaccaagaagccgcucccucucaauccgccguagcacucauccgcuacgucaaucccgacaccggacgcaacauauucgaagccaaacuccaccgagaaggauucaucaccgucgccaacucaggaaauaacccuaucguaguacccccaaacggcuacuuccgcuucgaagccugggucaaccaguucuauacccucacacccaugggaacaggccaaggcagacgccgcguccaauga

SEQ ID NO: 37501 - RNA, 1644 nt, Artificial Sequence
  derived and/or modified sequence opt11 from major_capsid_protein__Norovirus__AJW67362
augaaaauggcaagcaacgaugcugccccaucaaacgacggcgcagccaaccuuguccccgaagccacaaacgaaguaauggcccucgaaccagucgucggugccuccaucgccgcccccgucgucggacaacaaaacaucauagaccccuggaucagagaaaacuucguacaagcaccccaaggagaauuuaccgucuccccacgcaacucccccggcgaaaugcuccucaaccucgaacucggcccugaacuaaaccccuaccucucccaccucucccguauguacaacgguuacgccgguggaaugcaaguacaagucguccuagcaggcaacgccuucaccgcaggcaaaaucauauucgccgccguaccuccccacuuccccgucgaaaacauaucugccgcccaaauaacaaugugcccccacgucauuguugacguuaggcaacucgaaccaguucuacucccccuccccgauauccgaaaccgcuucuuccacuacaaccaagaaaacacccccagaaugcgccuugucgccaugcucuacaccccacuccgagcaaacagcggcgaagacgucuucacagucuccugccgcguuuuaacucgaccagcgccagacuuugaauuuaccuuccuagucccaccaacaguggaaagcaaaacaaaacccuucacccuacccauacuuacccucggagaacuauccaacucccgcuucccggccccaaucgacaugcuauacacggaccccaacgaagcuauugucguccaaccccaaaacggccgcugcacacuugacggcacucuccagggcacaacccaacucguccccacacaaaucugcuccuuccgcggaacccuuaucucccagacaucucgcuccgccgacuccacagacucagcaccucgcguacgcaaccacccccuccacguccaacucaaaaaccuugacggcacccccuacgacccuacagacgaaguccccgcaguccucggcgccauagacuucaaaggaaccguauucggaguagcaucccaacggaacacaacaggcaacucaaucggcgcaacccgagcgcacgaaguccauaucgauaccaccaacccacgauauaccccuaaacucggcuccgugcucauguacucugaaagcacagacuucgacgacggccaacccaccagauucacuccuauaggaaugggcgcagacgacuggcaccaaugggaacuucccgaauacucuggccaccuaacacucaacaugaaccucgcuccugccguagcccccgccuuccccggcgaacgcauccucuucuuccgcagcgucguccccagcgcaggaggauacggaucaggccacaucgacugccuuaucccccaagaauggguacaacacuucuaccaagaagccgcucccucucaauccgccgucgcccucauccgcuacguaaaccccgacaccggccgcaacaucuucgaagcgaaacuccaccgagaaggcuucauuacaguagcaaacagcggcaacaacccaaucgucguucccccgaacggcuacuuccgcuucgaagcaugggucaaccaauucuacaccuuaacaccaaugggcaccggccaaggcagaagacgaguacaauaa

SEQ ID NO: 37502 - RNA, 1617 nt, Artificial Sequence
  derived and/or modified sequence opt11 from major_capsid_protein__Norovirus__AJW67368
auggccuccaacgacgcuacccccucaaacgacggugccgcaggccucguacccgaaucaaacaacgaagccauggcccuugaacccgucgucggggccucacuagccgcccccguaaccggccaaacuaauauaauagaccccuggauccgcacaaacuuuguacaagcccccaacggcgaguucaccguaucaccccgcaacucaccaggcgaaauccuuguaaaccucgaacucggaccagaacucaaucccuaccucgcccaccuagcccgcauguacaacggcuacgcaggcggcauggaaguacaagucaugcucgccggcaacgcauucacagcaggaaaaaucaucuucgcagcgguaccacccuacuuccccgucgaaaaccucucacccucccaaaucacgauguucccccacguaauaaucgacguacgcacacuugaacccguucuccuacccaugccggacguccgcuccacccucuuccauuucaaccaaaaggacgaacccaagaugcgccucgucgcaaugcuauacaccccucuccgauccaacggcuccggcgacgacgucuucacagucucuugccgcauccuaacccgaccuuccccagaguucgacuucacauacuuaguacccccaaccgucgaauccaaaaccaaaccauucacccuaccaguccugacccucggcgaacucuccaacagccgcuucccccucucaauagacgaaauggucacauccccaaaugaauccauagucguccaaccccaaaacggccgagucacccuagacggcgaacuccucggcaccacgcaacuucaagcaugcaacaucugcuccauaagaggcaaggucacgggccaaguacccaacgaacagcacauguggaaccucgaaauaaccaaucuaaacggcacccaauucgaccccaccgaugacguacccgccccgcuaggcguacccgacuuugccggggaaguauucggcguccucucgcagagaaacaggggagaaucaaacccagccaaccgcgcacaugaugccguagucgccaccuacuccgacaaauacaccccgaaacucggcuuaguccaaaucggcacuuggaacaccaacgacgucgagaaccaacccaccaaauucacccccaucggccucaacgaagucgccaacggacaccgauucgaacaauggacccucccacgauacaguggcgcccuaacucucaacaugaaccucgccccagcaguagccccacucuuucccggagaacgacuccucuucuucagaagcuacguaccacucaaaggaggauucggaaacccggccauagacugccuagucccccaagaauggguucaacacuucuaccaagaauccgccccaucccuaggggacguugcccucguacgcuacguuaacccagacaccggccguguacucuucgaagccaaacuccacaaaggcggcuuccucacagucuccuccaccucgaccggccccgucgucguaccggccaacggauacuuccgauucgacuccuggguaaaccaauuuuacucccuagccccgaugggaacuggaaacggacgucgccgauuccaauaa

SEQ ID NO: 37503 - RNA, 1617 nt, Artificial Sequence
  derived and/or modified sequence opt11 from major_capsid_protein__Norovirus__AJW67371
auggcauccaaugacgcaaccccauccaacgauggcgcagcgggccuaguacccgaaucaaacaacgaagccauggcacucgaacccguggucggagcaagccuagcagcccccguaaccggccaaacaaacaucaucgaccccuggauccgcacaaacuucguccaagcaccgaacggcgaguucaccguuucaccccgcaacuccccaggcgaaauccucgucaaccuagaacuaggccccgaacuaaaccccuaccucgcacaccuagcgcgaauguacaacggauacgccgguggcauggaaguccaagucaugcucgcaggcaacgcuuucacugcaggcaagaucaucuucgccgccguacccccauacuucccggucgaaaaccucucccccucccaaauaacaauguucccccacgucaucaucgacguccguacccucgaaccaguccuacuccccaugcccgacgucagauccacccuauuccacuucaaucaaaaagacgaacccaaaaugcgccucgucgccaugcuauacacuccccuacgauccaacggguccggcgacgacguauucaccgucucaugccguauccuaacccgcccaucacccgaguucgacuucaccuaccucgucccacccaccguagaaucaaaaaccaaacccuucacgcucccaguccucacacucggcgaacucuccaacucccgauucccccucuccaucgacgaaauggucaccucacccaacgaauccaucgucguacagccccaaaacggccgagugacacucgacggagaacuucuaggaaccacccaacuccaagccugcaauauuugcuccauccgcggcaaagugaccggccaaguacccaacgaacaacacauguggaaccuagaaauuaccaaccucaacggcacgcaauucgaccccaccgaugacguacccgccccacucggaguacccgacuucgccggagaagucuucggcguccucucccaacgaaaccgaggcgaauccaacccagccaaccgagcacacgacgccguagucgccaccuacuccgacaaauacacccccaaacucggccuaguccaaauaggcacauggaacacuaaugacgucgaaaaccaacccacaaaauucacaccaauaggcuuaaacgaagucgcaaauggacaccgguucgaacaauggacauuaccccgcuacuccggagcacuaacacuaaacaugaaccuagcacccgccgucgcaccccucuuccccggugaaagacuacuauucuuccgcucuuacguaccccucaaaggcgguuucggcaaccccgccaucgacugccucguaccacaagaauggguacagcacuucuaccaagaaucagcaccaucccucggcgacguagcacucguccgauacguaaaccccgacacaggccgcgugcuauucgaagcgaaacuccacaaaggcggcuuucuaacaguuuccuccaccucaaccggccccgucgucguccccgcaaacggcuacuuccgauucgacagcugggucaaccaguuuuacucacuagcaccaaugggaaccggaaacggccgacgccgcuuccaauaa

SEQ ID NO: 37504 - RNA, 1623 nt, Artificial Sequence
  derived and/or modified sequence opt11 from major_capsid_protein__Norovirus__AJW67374
auggccucaaacgacgcagcccccagcaacgacggcgccgcaucccucguccccgaagcgaucaaugaaaccaugccccucgaaccagucgccggagcauccaucgcugccccaguggcaggccaaaccaacaucaucgaccccuggauccgaacaaauuucguccaagcccccaacggcgaguucacaguaagcccccguaacucccccggagaaauacuccugaaccucgaacuaggcccugaccucaaucccuaccuagcccaccucagccgcauguacaacggcuacgccggaggagucgaaguccagguccuccucgcuggcaacgccuucacagcuggaaaaauacucuucgccgccaucccacccaauuucccuguugacaugaucucccccgcucaaaucaccaugcucccccaccucauugucgacguccgcacccuagaacccaucaugaucccccugcccgacgucagaaacguuuucuaccacuucaacaaccaaccccaaccgcgcaugcgccuaguggccaugcuuuacacaccccuccgauccaacggaagcggagacgacgucuucaccgucuccugccgaguacuaacccgaccaacccccgauuucgaguucaucuaucucguacccccaucagucgaaucaaagaccaaaccauuuaccuuacccauccuaacuaucuccgaacucaccaacucccgauuucccauccccauugaacaacucuacacagcaccuaacgaaaacaaugucgugcaaugccagaacggccgcugcacccucgacggcgaacuccaaggcaccacccaacuucuaucauccgccguuugcuccuaccgcggccgcaccguugcuaacuccggcgacaacugggaccaaaaucuccuccaacucacuuaccccucaggagcauccuacgaccccacagacgaaguccccgcaccccuaggaacccaggacuuuuccggcauccuuuacggcguccuaacccaagacaacgucuccgaaggaaccggcgaagcuaaaaacgcaaaaggaguauacaucagcacaacuuccggcagauucacccccaaaaucggcaccaucggccuacacucuauaaccgaaaacguccaccccaaccaacaaagccguuucacccccgucggagucgcacaaaaugaaaacaccccauuccaacaauggguucucccccacuacgccggcgcccucgcccucaacaccaaccuagcucccgccguagcacccaccuuccccggcgaacaacuccucuucuuccgcucccgaguacccugcguccaaggccuucgcggacaagacgcauucauagacugccuccucccacaagaaugggucaaccacuucuaccaagaagccgcacccucccaagccgacgucgcacucaucagauacguuaaccccgacaccggacgcaccuuauuugaagcuaaacuccaccgcuccggauucauaacagucucucacaccggcaacuacccccucguaguaccacccaauggccacuuccgguucgacuccugggucaaccaauucuauagccuagcccccaugggcacuggcaauggccgacgacgcguacaauaa

SEQ ID NO: 37505 - RNA, 1635 nt, Artificial Sequence
  derived and/or modified sequence opt11 from major_capsid_protein__Norovirus__AJW67377
augaugauggcaucaaaagacgccacccccuccgccgacggcgcaacaggggcaggccaacucguccccgaaguaaacacagcugaccccauccccaucgaccccgucgccggcuccucaaccgcccucgccaccgccggccaaguaaaucucaucgacccauggauaauaaacaacuucguccaagccccucaaggcgaauuuaccauaucccccaauaacacccccggugacguccucuucgaccuccaacucggaccccaucucaaccccuuccucucccacuuaucccaaauguacaauggaugggucgguaauaugcgcguccgagucguccucgcuggaaacgccuucaccgccggcaaggucaucauuuguugcguaccucccggcuuccaaucucgaacacucuccauagcccaagcaacccucuucccccacguaauagccgacguucgaacccuagaccccgucgaagucccccuggaagauguccgaaacguacuauaccacaacaacgacacccaacccacuaugcgccuacucugcaugcucuacacaccccuaagaacaggcggcgccuccgguggcacagacuccuucguagucgccggucgcguacuaaccugccccggccccgacuucaacuuccucuuccucguuccacccacagucgaacagaaaacccgacccuucacuguccccaacaucccccucaaauaccucucuaacucccgaaucccaaaccccaucgaaggcaugucacuaucccccgaccaaacacaaaacguucaauuccaaaacggccgcugcacaaucgacggucaaccccucggcacaacgccagucuccguaucacaacucugcaaauuccguggccgcauaaccuccggacaaaaaguccucaaccuaaccgaacucgacggcuccccguucauggccuucgccgccccagcucccgcuggauuccccgaccucggaucaugcgacuggcacaucgaaauguccaaaauccccaauuccucgaccgaaagcaaccccaucguaguaaacucagucaagcccaacucccaacaguucguuccacaccuaaguucaauaacucucgaugacaacgucucauccggaggcgacuacaucggcaccauucaauggaccuccccgcccuccgauuccggcggcgccaacaccaacuucuggaaaauccccaacuacggcuccagccuagccgaagccagccaacuugcacccgcaguguacccacccggauucaaugaagucaucguauauuucauggccucaauucccggccccaaccaaucaggcucccccaacuuaguccccugccuacucccccaagaauacauaacccacuucaucucugaacaagcacccauccaaggcgaagccgccuuacuacacuacguagaccccgacaccaacagaaaccucggcgaauuuaaacucuaccccggaggcuacuuaaccugcguccccaacucauccucuacaggaccucaacaacuuccccucgacgguguauucgucuucgccuccugggucucccgcuucuaccagcucaaacccgucggcacagccggaccagcacgagggcggcucggcguccgccgcuaa

SEQ ID NO: 37506 - RNA, 1617 nt, Artificial Sequence
  derived and/or modified sequence opt11 from major_capsid_protein__Norovirus__AJX18190
auggccuccaacgacgccacacccucaaacgacggagccgcuggccucgucccugaauccaacaacgaggccauggcacuugaaccagucgucggcgccagcuuagcagcccccgucacaggccagacaaauaucauugacccuuggauccgcaccaacuucguacaggcccccaacggcgaguucaccgucuccccaagaaacagcccaggugaaauccucgugaaucuagaacucggcccagaacucaaccccuaccucgcccaccucgcacgcauguacaacggcuacgccgguggcauggaaguacaagucaugcuagcaggcaacgcauucacugccggaaaaaucaucuucgccgccgucccacccuacuuccccgucgaaaaccucucuccaccccagaucaccauguucccccacgucaucaucgacgucagaacccuugaacccguacuucuccccaugcccgacguacgcuccacccucuuccacuucaaccaaaaggacgaacccaaaaugcgacucguagcaaugcucuacaccccacuccgauccaacgguuccggcgaugacgucuucacaguguccugucgcauccuaacacgacccuccccagaguucgacuucaccuaucuuguuccacccaccguagaaagcaagaccaaacccuucacccugcccguccucacgcuaggcgaacuauccaacucccguuucccacucucaaucgacgaaaugguaacaucuccuaacgaaucaauagucguacaaccacaaaacggccgcgucacacuagacggugaacuccuuggcacaacccaauuacaagcaugcaacaucugcucaauccgcggcaagguuacgggacaaguccccaacgaacaacacauguggaaccuugaaaucaccaaccucaauggcacccaauucgaccccaccgacgacguccccgcuccccucggaguaccagacuuugccggcgaagucuucggcguccuaucacaacgcaaccgaggagaguccaaccccgccaaccgugcccacgacgccgucguagccacauacucagacaaauacacacccaaacuaggccuaguccaaaucggcacauggaacaccaacgacgucgaaaaccaacccacaaaauucacaccaaucggacuaaacgaagucgcaaacggccacagauucgaacaauggacccucccccgguauucaggugcucuaacacucaacaugaaccucgcccccgcagucgcuccccucuuucccggagaacgccuccucuucuuccgauccuacgucccacucaaagguggauucggaaaccccgccaucgacugccuagucccacaagaauggguacaacacuucuaccaggaauccgcacccucucucggcgacguugcccucguucgcuacgucaaccccgacaccggccgcguacuuuucgaagccaaacuccacaaaggcggguuccucaccguuuccuccaccuccaccggcccagucgucguccccgccaacggauacuuccgcuucgacucaugggucaaccaauucuauucgcuugcccccaugggcaccgguaacggacgucgacgauuccaauag

SEQ ID NO: 37507 - RNA, 1617 nt, Artificial Sequence
  derived and/or modified sequence opt11 from major_capsid_protein__Norovirus__AJX18193
auggcuuccaacgacgccacccccuccaacgacggcgcagccggacucgucccagaauccaacaacgaagcaauggcccuggaaccagucgucggcgcgucccuggccgcaccagucacaggccaaaccaacauaaucgacccuuggauccgcaccaacuucguucaagcuccuaauggugaguucacagucuccccacgaaacucccccggcgaaauccucguaaaccucgaacucgggcccgaacucaacccauaucucgcccaccucgcccgaauguacaacggauacgcuggaggcauggaaguccaaguaauguuagcaggcaacgccuucacugccgguaaaaucaucuucgccgccguaccacccuacuuccccguagaaaaccuguccccuucccaaaucaccauguucccucacgucaucaucgacguccgcacccucgaacccguccuccuccccaugccagacguacgaucaacacucuuccacuucaaccaaaaagacgaaccaaaaaugcgacucguagccaugcuauacacuccacuucgcagcaacggauccggagacgacgucuucacagucuccugccguauacuaacccgcccauccccagaguucgacuucaccuaccuuguacccccaacagucgaaucaaagaccaaacccuucacccugcccguccucacccuuggagaacuuuccaacucucgcuucccacucuccaucgacgaaauggucacaagcccaaacgaaucgaucguaguccaaccccaaaacggccgcgucacccucgacggcgaacuccucggcacaacccaacuacaggcgugcaacaucugcucaauacgagguaaaguaacaggacagguccccaacgaacaacacauguggaaccucgaaaucaccaacuuaaacgggacgcaauuugaccccaccgacgacguaccagcaccccuagguguacccgacuuugccggagaagucuucggcguccucagccaacgaaaccgcggcgaauccaaccccgccaaccgagcccacgacgcagucguagccacuuacucggacaaauacacucccaaacucggccuaguccagauaggaacauggaacaccaacgacgucgaaaaccaacccacuaaauuuacacccaucggccuaaacgaagucgccaacgggcaccgcuucgaacaauggacccuaccacgcuacuccggcgcccucacacucaacaugaaccucgcuccugcagucgcaccccucuucccaggcgaaagacuccucuucuuccgaucauacgucccacucaaaggcggcuucggaaauccagccaucgauugucucgucccacaagaauggguccaacacuucuaccaagaaucagccccuucccucggcgacguagcccugguccgcuacgucaaccccgacaccggccgcguacucuucgaagccaaacuacacaaaggcggcuuucucaccgucucuuccaccagcaccggacccguagucguccccgccaacggauauuuccguuucgauuccuggguaaaccaauuuuacucacucgcccccaugggcaccggcaacggccguagacgcuuccaauaa

SEQ ID NO: 37508 - RNA, 1623 nt, Artificial Sequence
  derived and/or modified sequence opt11 from major_capsid_protein__Norovirus__AJZ77004
augaaaauggcauccuccgacgccaaccccucagacggcuccaccgccaaccuaguacccgaaguaaacaacgaagucauggcccucgaacccgucgucggcgccgccaucgccgccccaguugcaggccaacaaaacgucauagacccauggauccgaaacaacuucguacaagcccccggaggagaauuuaccgucucaccaagaaacgcccccggagaaauacuaugguccgccccacucggaccugaccuaaacccauaccucagccaccucgcccgcauguacaacuccuacgcugggggcuucgaaguccaagugauauuagccggcaacgccuucacugcaggcaaaaucaucuucgccgcagucccaccaaauuucccaacagaaggccucagccccucgcaggucacuauguucccccacaucaucguagacguccgucaacuugaaccuguccuuauaccccuucccgacgucagaaacaacuucuaucauuacaaccaauccaacgaucccaccauaaaacucaucgccaugcucuacaccccgcuacgcgcaaacaacgcaggagacgacgucuucacaguuuccugccgcguucuuacccgacccucccccgacuucgacuucauauuccucgucccaccuacaguagaaucccgcacaaaacccuucucgguccccauccucaccgucgaggaaaugacuaacagccgcuucccaauaccccuagaaaaacucuucaccgggcccagcucagccuucgucguccaaccccaaaacggccgcugcaccacugacggcguccuucuuggcaccacccaacucuccccagucaacauaugcaccuuccgaggcgacgucacccacaucgccagcacucaagaauacacuaugaaccuagcaucacaaaacuggaacaacuacgacccuacagaagagauacccgcaccccucggcacacccgauuucgucggaaaaauucaagguguacuaacacaaaccacccgccgcgacggauccacacgcggacacaaagccacugucuccacggguuccguccacuucacccccaaauuaggccgcauccaauucagcaccgacaccuccaacgacuucgaaaccggccagaacacacgguucacaccagucggcgucguacaagacgggucaacuacccaccaaaacgaaccccaacaauggguccuccccaacuacuccggccgagacucacacaacgugcaccuagccccugcagucgcccccagcuuccccggcgaacaacuccucuucuuccgcuccaccaugccaggcugcucaggcuaccccaacaugaaccucgacugccuccuuccccaagaauggguccaacacuucuaccaagaagccgcccccgcacaaucagacguagcccuccuccguuucgucaaccccgacaccggccgcguacuuuuugaaugcaaacuccacaaauccggcuacgucacaguugcccauacaggccaacacgaccuagucaucccaccaaacggcuacuuccgcuuugauuccugggucaaccaauucuacacacuagcaccuaugggcaacggaaccggcagacgccgcgcauuauaa

SEQ ID NO: 37509 - RNA, 1623 nt, Artificial Sequence
  derived and/or modified sequence opt11 from major_capsid_protein__Norovirus__AJZ77010
augaaaauggccuccaacgacgccucaccaucagacgguagcgccgcaaaucuuguccccgaagucaacaacgaagucauggcgcuagaacccguaguaggggcugcuaucgcagcccccguagccggacaacaaaacgucauugaccccuggauccgaaacaacuuuguccaagcuccaggaggcgaguucacaguaucgccccgcaacgcacccggcgaaauacucugguccgcaccccucggacccgaccugaaccccuaccuaucucaccuagcccgcauguauaacgguuacgccggcggauucgaaguacaaguaauccucgccggcaacgccuucacagccggcaagaucauuuucgcagccgucccuccuaacuuccccaccgaagggcuaucacccagccaagucacaauguucccccacaucaucguagacguccgccaacuagaaccaguccucaucccacucccagacguccgaaacaacuucuaccacuacaaccaguccaacgauuccacaaucaaacuuauagccaugcucuauacuccccuccgcgcaaacaacgcuggcgaagacgucuucaccguaucaugccgagugcucacccgccccucccccgacuucgacuuuaucuuccucgucccacccacagucgaaucccguacaaaaccauucacagucccaauacucaccgucgaagaaaugacaaacucccgcuuccccaucccccuagaaaaacucuucaccggcccaagcggcgcauucgucguccaaccccaaaacggccggugcacaaccgacggcguccuccuaggaacaacccaacucuccccggucaacauaugcaccuuccgcggcgacgucacccacaucgccggaucccgcaacuauaccaugaaccucgccgcccuaaacuggaacaacuacgaucccaccgaagaaauacccgccccacucgguaccccagacuucgucggaaaaauccaaggcguccucacccaaaccaccaaagcagacggauccacucgcggccacaaggcuacagucuacaccggcuccgcugacuucaccccaaaacucggcuccguccaauucucuacagacaccgaaaaugauuucgaaacacaccaaaacacaaaauucacccccguaggagucauccaagacgguucaacaacccaccgcaacgaaccacaacaauggguacucccauccuacuccggucgcaauguccacaacguccaucucgcccccgccgucgcaccaaccuuccccggcgaacaacuccucuucuuccgcuccaccaugcccgggugcucaggcuaccccaacauggaccucgauugccuccucccccaagaauggguccaacacuucuaccaagaggcagccccagcacaaucagacgucgcccuccuccgcuucguaaacccagacaccggccgaguacuauucgaaugcaaacuccacaaaucaggcuacgucacaguggcccacaccggccaacacgaucucguaauuccacccaacgguuacuuucgauucgacuccugggucaaccaauucuacaccuuagcucccaugggcaaugguacaggucgccgccgagcccuauaa

SEQ ID NO: 37510 - RNA, 1623 nt, Artificial Sequence
  derived and/or modified sequence opt11 from major_capsid_protein__Norovirus__AJZ77013
augaaaauggccuccuccgacgccaaccccucagacggcucaaccgccaaccucguccccgaagucaacaacgaagucauggcacuggaaccagucguuggagcagccaucgccgcacccgucgccggacaacaaaacguaaucgaccccuggauccgauccaacuuuguccaagcacccggcggcgaauuuaccgucucaccccgcaacgcccccggggaaauccucugguccgcaccccucggacccgaccucaacccauaccugucccaucucgcccgcauguacaacggcuacgccggaggauucgaaguacaagucauacuagcaggcaacgcauucacagccggcaaaauaaucuucgccgcaguaccacccaacuuccccacagaaggucucucacccucucaaguaaccauguucccccacauaaucgucgacguacgccaacuagaacccguccucaucccacuacccgacguacgcaauaacuucuaccacuauaaccaauccaaugaccccaccaucaaacuuaucgccaugcucuacacaccccuccgcgcaaacaacgccggagacgacguauucaccgucuccugccgaguacucacccgucccuccccagacuucgauuucaucuuucuuguaccacccaccgucgaaucccgaacgaaacccuucuccguccccauucucaccgucgaagaaaugaccaacucacgcuuccccaucccccucgaaaaacuuuucaccgggcccuccucagccuuugucguccaaccccaaaacggccgcuguacaaccgacgguguacuccuaggcaccacccaauuaucaccaguuaacaucuguacauuccgcggagacgucacccacauaaccggaucacgcaacuacacuaugaaucuagccacacaaaacuggaacucguacgacccaaccgaagaaauccccgccccacucggaacgccagacuucguaggcaaaauccaaggaguccucacccaaaccacccgcgccgacggcucaacccgcggccauaaagcuacaguuuacaccggaagcgcagacuuugcaccaaaacuaggaagaguccaauucgcaacagacacagacaacgacuucgacgccaaccaaaacaccaaauucacccccgucggagucauccaagacggcgacaccgcccacagaaacgaaccacagcaauggguccuaccuucauauuccggacgaaacagccacaacguucaccuagcccccgccgucgcccccacuuuccccggcgaacaacuccuauucuucagaucaaccaugcccggcuguucgggcuaucccaauauggaccuagacugccuacuaccccaagaauggguccaguacuucuaccaagaagccgcaccagcccaaucggacgucgcacuccuccgcuucgucaacccagacacgggacgaguacuguucgaaugcaaacuccacaaauccggauauguaacuguagcucacaccggccaacacgaucuugucaucccacccaacggcuacuuccgauucgacucaugggucaaccaauucuacacccucgcccccaugggcaacggaaccggccgaagacgugcccuauga

SEQ ID NO: 37511 - RNA, 1623 nt, Artificial Sequence
  derived and/or modified sequence opt11 from major_capsid_protein__Norovirus__AJZ77015
augaaaauggcaucauccgacgcaaaccccuccgacggcuccacagccaaccucguccccgaggucaacaacgaagucauggcacucgaacccgucgucggagcagccaucgcagcccccgucgcaggccaacaaaacguaaucgacccuuggauccgaaacaacuucguccaagcacccggcggagaguucaccgucuccccacgaaacgcaccaggcgaaauacugugguccgccccacuaggccccgaucucaaccccuaccucucacaccucgcccggauguacaacggauacgccggaggauucgagguccaaguaauacuugccggcaacgcauucaccgcaggaaaaaucaucuucgcagccgucccucccaacuuccccacagaaggacucucacccucccaagucacaauguucccccaccuaauagucgacguacgacaacucgaacccguucucauaccccuuccagacguucgaaacaauuuuuaccacuauaaccaauccaacgacuccaccaucaaacucaucgccaugcucuacacaccccucagagccaacaacgccggagacgacgucuucaccgucuccugcagaguccucacccgccccucuccagauuucgacuucaucuuccucguaccacccaccguagaaucacgcaccaaacccuucagcguccccguccuaaccgucgaagaaaugacaaacuccagauuccccaucccccucgaaaaauuauuuacaggacccuccuccgccuucgucguccaaccccagaacgggcgcugcaccacugacggaguccuccuaggcaccacccaacucuccccagucaacauaugcacauuccgaggcgacgucacccacauucccggaucccgcaacuacaccaugaaccucgcuucccaaaacuggaacucguacgaccccaccgaagaaaucccugcacccuuaggcaccccagacuucguaggcaaaauccaaggcguccucacgcaaaccacccgcaccaacggaucaacccgcggacacaaagcaacagucuacaccggaucagcagacuucucccccaaacucggacguguccaauucgccaccgauaccgacaacgauuucgagaccaaccaaaacaccaaauucacccccgucggagucauccaagacggaagcaccaccccacgcaacgaaccccaacaauggguauuaccaucuuacucgggucgcaacauccacaacguccaccucgcccccgccguagcaccaaccuuccccggcgaacaacuccucuucuuccgcucaaccaugcccgguugcucaggauaccccaauauggaccuagacugccuucucccccaagaauggguccaauacuucuaucaagaagcagcacccgcccaaucggacgucgccuuacuacgguucgucaacccagacacgggacgaguccucuuugaaugcaaacuacacaaauccggcuacgucaccgucgcccacaccggccaacaugaccuggucauaccacccaaugguuacuuccgauucgacagcuggguaaaccaauucuacacccucgccccgaugggaaacggaaccggccgccgccgcgcccuuuaa

SEQ ID NO: 37512 - RNA, 1623 nt, Artificial Sequence
  derived and/or modified sequence opt11 from major_capsid_protein__Norovirus__AJZ77019
augaaaauggccagcaaugacgccaaccccucggacggaucugcagcgaaccucgucccugaagucaacaacgaaguaauggcccuagagcccguagucggcgccgcuaucgccgccccagucgccggccaacaaaacgucaucgacccauggauccguaauaauuucguccaagccccaggcggagaguucaccgucucaccccgcaacgccccaggagaaauacuauggucagcaccccucggccccgaccucaaccccuaccucucccaccucgcccgcauguacaacggcuacgcuggaggauucgaaguccaagucauacuagcagguaaugcauuuacugcaggcaaaauuauuuucgccgcaguaccacccaacuuccccaccgaaggacucucccccucccaaguaaccauguucccccacauaaucguagacguacgccaacucgaacccguacugaucccccuacccgacguccgcaacaacuucuaccauuacaaccaauccaacgacuccacaaucaaacucaucgccaugcucuacacuccucuccgcgcaaauaacgccggagacgacgucuucaccgucuccugccgcguacucacccgaccuucccccgacuucgacuucaucuuccuaguucccccaaccgucgaaucccgcacaaagccauuuacgguccccauacuuaccgucgaagaaaugacaaacucacgauucccaaucccucucgaaaaacucuucaccgguccuuccucugcguucgucguccaaccccaaaacggccgcugcaccaccgacggcguccuucucggaacaacccagcuaucacccgucaauauaugcaccuuucgcggcgacguaacccacauagccggcucccgcaauuacaccaugaaccucgccucccucaacuggaacaacuaugaccccaccgaagaaauacccgcuccccucggcacacccgacuucgucgguaaaauccaaggcguccuaacccagacaacuaaaggcgacggauccacacgcggccacaaagccaccguauacaccggaucugccgacuucacccccaaacucggcucaguccaauucgcuacagacacagaaaacgauuuugaaacgcaccaaaacaccaaauucaccccaguuggcguaauccaagacggcuccaccacccacagaaaugaaccccaacaaugggugcuccccuccuacagcggccguaacguccauaacguccaccuagcccccgccgucgcacccaacuuuccaggcgaacaacuccucuucuuccgaucaaccaugcccggcugcuccggcuaccccaacauggacuuagacugccuccucccccaagaauggguccaacacuucuaccaagaagccgcccccgcccaauccgaugucgcccuccuacgcuucguaaacccugacaccggaagaguccuauucgaaugcaaacuacacaaauccgguuacgucaccguagcccacacaggacaacacgaucucgucaucccacccaacggcuauuuccgcuucgacuccugggucaaccaauucuacacccucgcaccaaugggcaacggcaccggaagacggcgagcccuuuaa

SEQ ID NO: 37513 - RNA, 1623 nt, Artificial Sequence
  derived and/or modified sequence opt11 from major_capsid_protein__Norovirus__AJZ77022
augaaaauggccucaucugacgccaaccccuccgacggcucugccgcaaaccucgucccagaagucaacaaugaagucauggcccucgaaccggucgugggagcagcaaucgccgccccugucgccggacaacagaacgucaucgacccauggauaagaaacaacuucguacaagccccaggcggcgaguucaccguuuccccacgcaaugcccccggcgaaauauuauggucagcaccccucggacccgaccuaaacccauaccucucacaccucgcaagaauguacaacggauacgcuggcgguuuugagguacaagucauccucgccggcaacgccuucacagcaggcaaagucauuuucgccgcagucccucccaacuuccccaccgaaggccuaucccccucucaagucaccauguucccccacaucgucguagacguacgacagcuugaaccaguccucaucccacuccccgacguccgcaacaacuucuaccacuacaaccaaagcaacgacccaaccauaaaacugauagccaugcucuacaccccacuccgagccaacaacgccggcgacgacgucuucacaguuuccugcagaguccuaacacgccccucacccgacuucgacuucauauuccucguucccccaacagucgagucacgcaccaaacccuucuccguccccguccucaccgucgaagaaaugacuaauucccgcuucccaaucccccucgaaaaacucuucacaggccccucuagcgccuucgucguccaaccccaaaauggucgcugcacuaccgacggcguccuacucggcacaacccaacucucacccgucaacaucugcacauuccgcggagacgucacacacauaaccggaucacgcaacuacaccaugaacuuagcaucccaaaacuggucgaauuacgaucccaccgaagaaauacccgcaccacuaggaaccccagacuucgucgggaagauacaaggcguacuaacacaaaccacacgcaccgacggcucaacccgaggccacaaagccaccgucuacaccggcucagccgacuucgcccccaaacucggccgcguccaauucgaaaccgacacagaccgugacuucgaagccaaccaaaacaccaaauucacccccguaggaguuauacaagacggcuccacaacucaccgaaacgaaccgcaacaauggguccuacccucauacucaggucgaaacacacccaauguccaucuugcacccgcagucgcacccaccuuccccggcgaacaacuucucuucuuccgaucuacgaugccuggcugcucaggcuacccaaacauggaccucgacugccuacucccccaagaauggguacaguacuucuaccaagaagcugccccugcccaauccgacgucgcacuacuccgcuucguuaaccccgacacaggccguguccuauucgaaugcaaacuacacaaauccggcuacguaacagucgcccacacaggccagcacgaccucguuauacccccaaacggguacuuccgcuucgacuccuggguaaaccaauuuuacacccucgcacccaugggaaacggaaccggcagacgccgagcacuauaa

SEQ ID NO: 37514 - RNA, 1623 nt, Artificial Sequence
  derived and/or modified sequence opt11 from major_capsid_protein__Norovirus__AJZ77027
augaaaauggccuccagcgacgcaaaccccucagacggcuccgccgccaaccucguccccgaaguaaauaacgaagucauggcccuagaacccguagucggcgccgccaucgcugcccccguagcaggccaacaaaaugucaucgaccccuggauccgaaacaacuucgugcaagcccccggcggugaguucaccgucucuccacgaaacgccccuggcgaaauacucugguccgcaccccucggccccgaccucaaccccuacuuaucccaucucgcucgcauguauaacggcuacgcuggaggauuugaaguccaagucauucucgccggcaacgcauucaccgcaggcaaagucauauucgcggccguacccccaaacuuccccaccgaaggccucucccccucacaagucacaauguucccccauaucgucguagacguacgccaacucgaaccaguccucaucccccuccccgacguacggaacaacuucuaccacuacaaccaaucuaacgaccccacuaucaaacucauagcuaugcucuacacaccccuccgggccaacaacgccggagacgacgucuucaccgucagcugccgcguccucacccggcccucccccgacuuugacuucauauuccuagucccucccaccguagaaucuagaaccaagcccuucuccguccccguccuuacagucgaagagaugaccaacuccagauuccccaucccccuagagaaacucuucaccggccccagcuccgccuucgucguccaaccccaaaacggacgcugcaccaccgacggcguacuccucggcaccacccaacuaagccccguaaacaucuguaccuuccgcggcgacgucacccacaucacaggaagucgaaacuacaccaugaaccucgccucccaaaacuggaacaacuaugaccccaccgaagaaaucccagccccacucggcacacccgacuucguaggcaaaauccaaggcguucuaacccaaacaacccgaacagacggcucaacacgaggacacaaagcaacaguauacaccggcucagcagauuucgccccaaaacuaggccgcguccaguucgaaacagauaccgaccacgacuucgaagcaaaccaaaacacaaaauucacaccagucggcgucauccaagacggcgguacaacacacagaaacgaaccccaacaauggguccuccccagcuacuccggucgaaacacacauaacguccaucuagcacccgccguagcaccgacauuccccggagaacaacuacuauuuuuccgcucaaccaugccaggcugcucuggcuaucccaacauggaccuagacugccuccuaccacaagaauggguacaguacuucuaccaagaagccgcucccgcacaauccgacguagcccuccuccgauucgucaaccccgacacaggccgcguccuuuucgaaugcaaacuccacaagucagguuacgugaccguagcccacacaggccaauacgaucucgucaucccucccaacggcuacuuccgcuucgacuccugggucaaucaauucuacacacuagcacccaugggcaacggaaccggccgacgacgagcagucuaa

SEQ ID NO: 37515 - RNA, 1623 nt, Artificial Sequence
  derived and/or modified sequence opt11 from major_capsid_protein__Norovirus__AJZ77030
augaaaauggccucauccgacgcaaaccccucagacggcucugccgccaaccuaguccccgaaguaaacaacgaagucauggcccucgagcccgucgucggcgccgccaucgccgcccccgucgcaggccaacaaaacguuauagaccccuggauccgcaacaacuucguccaagcccccggaggagaguucacaguaucaccccgcaacgcuccaggagaaauccuauggucagcaccacucggucccgaccucaauccauaccuuucccaccuggcacgaauguacaacgguuacgccggcgguuucgaaguccaggucauacucgcaggcaacgccuucaccgcaggcaaagucauuuucgccgccguacccccgaauuuucccaccgaaggccucucacccucgcaagucaccauguucccccacauagucgucgacguucgccaauuagaacccguccucaucccccuccccgacguccgaaacaacuucuaccacuauaaccaguccaacgacccaaccaucaaacuuauagcaaugcuauacacaccccuccgcgccaacaaugccggcgacgacguuuuuaccgucucuugucgcguacucacccgcccaagcccugacuucgacuuuaucuuuuuagugccacccaccgucgaauccagaaccaagcccuucucaguccccguccuuacagucgaagaaaugaccaacuccagauuccccauaccacucgaaaaacucuucaccggccccuccucagccuucguaguacaaccccaaaacggccgaugcaccaccgacggcguccuacucggcaccacgcaacucucccccguuaacauaugcaccuuccgcggugacgucacccacauaacuggcucccgcaacuacacaaugaacuuagccucccaaaacuggaacaacuacgaccccaccgaagaaaucccugcaccccucggaaccccagacuucgucggcaagauccaaggaguccucacacaaaccacccgcaccgacggguccacccgcgggcacaaagccacaguauauacaggcucagcggacuucgcccccaaacuuggccgcguccaauucgagaccgacacagaccaugacuucgaggccaaccaaaacacaaaauucacgcccgucggaguaauccaagacggagguaccacccaccgcaacgaaccucaacaauggguccuucccagcuacuccggccgaaacacacacaauguccaccucgcccccgccguagcccccaccuuucccggcgaacaacuccuauucuuccgcuccacaaugccaggaugcucaggcuaccccaacauggaucuagacugccuccucccccaagaguggguccaauacuucuaccaagaagccgcccccgcccagucagacgucgcucuccuccgcuucguaaacccagacacaggccgaguccuuuucgaaugcaaacuccacaaaucaggauacguuacagucgcacacaccggccagcacgaccucgucauaccacccaacggcuacuuccgauucgacucauggguaaaccaguucuacacacucgcccccaugggcaacgguacuggaagacgacgcgcagucuag

SEQ ID NO: 37516 - RNA, 1623 nt, Artificial Sequence
  derived and/or modified sequence opt11 from major_capsid_protein__Norovirus__AJZ77033
augaaaauggccucauccgaugccaaccccuccgacggcuccaccgccaaucuaguacccgaaguuaacaacgaagucauggcccucgaaccagucguuggcgcggccaucgccgcaccugucgccggacaacaaaacgucaucgaucccuggauccgcaacaacuucguacaggcaccaggcggcgaauuuaccgucucaccccgaaacgccccuggcgaaauccuaugguccgccccacucggccccgaccucaaccccuaccuaucccaccucgcacgcauguacaacggcuacgccggcggcuucgaaguucaagucauucucgccggcaacgccuuuaccgccggcaagaucaucuuugccgccgucccucccaauuuccccacagaaggccucucccccucccaagucaccauguucccccacaucaucguagacguccgucaacucgaacccguacuuauaccccuacccgacguacgcaacaacuucuaucacuacaaccagucaaaugacucgacaaucaaacucaucgccaugcucuacacaccccuccgcgccaacaacgccggcgacgacgucuuuaccgucucuugccguguccuaacacgucccucccccgacuucgacuucauauuccucguuccacccacagucgaaucacgcaccaaaccauucucaguccccguacucacaguagaagaaaugaccaacuccagauucccaauaccccucgaaaaacucuucaccggcccaucauccgccuuuguuguccaaccacaaaacggucgcugcacaacagauggaguccuacucggcaccacccaacuaucccccgucaacauuugcacauuccgaggagacgucacccauauccccggcucacgcaacuacacaaugaaccuugccucccaaaacuggaacucauacgaccccaccgaagaaaucccagcaccacucggcacacccgacuucguagguaaaauacaaggcguccuaacccagaccacccgcacuaacggcuccaccagaggucacaaagcaacugucuacaccgggucagccgacuucucgcccaaacucggacgaguccaauucgccaccgacacugacaacgacuucgagacaaaccaaaacaccaaauucacacccgucggagucauccaggauggauccacaacaccccgcaacgaaccccaacaauggguacuccccuccuacagcggacgcaacauacauaacguacaccucgccccagccgucgcccccaccuuccccggcgagcaacuccuguucuuccgcuccaccaugccuggaugcuccggauacccaaauauggaccuagacugccuccucccacaagaauggguccaauacuucuaccaagaggcagcacccgcccaaucagacgucgcccuccuccgauucgucaaccccgauaccggacgaguccuuuucgagugcaaauuacacaaaucaggcuacgucaccgucgcccauaccggccaacacgaccucguaaucccacccaacggauacuuucgauucgacucaugggucaaccaauucuacacacuagcacccaugggcaacggcacaggccggcgccgagcccucuag

SEQ ID NO: 37517 - RNA, 1623 nt, Artificial Sequence
  derived and/or modified sequence opt11 from major_capsid_protein__Norovirus__AJZ77036
augaaaauggccuccuccgacgcaaaccccuccgacggcuccaccgcaaaccucgucccagaagucaacaaugaaguuauggcacucgaaccagucgucggcgcagcuaucgccgcacccguagccggccaacaaaacguaaucgacccauggauccgcaacaacuucguacaagcccccggcggcgaguucacggucaguccacguaacgcaccuggcgaaauacucugguccgccccgcucggucccgaucucaaccccuaccucucccaccucgcccgcauguacaacggcuacgccgggggcuucgaaguccaaguaauccuagccggaaaugccuucaccgccggcaaaaucaucuucgccgccgucccacccaacuuccccaccgaaggccucucccccucucaagucaccauguucccacacauaaucgucgacguccgccaacuagaaccaguccuaaucccccuacccgacguccgcaauaacuuuuaccacuacaaccaaagcaacgacucuaccauaaaacucaucgcuaugcuauauacaccccuacgcgccaacaacgccggagacgacguuuucaccgucagcugucguguccucacccgccccucucccgacuucgacuucaucuuccuagucccacccaccgucgaaucacgcacaaaacccuucuccguccccguucucacagucgaagaaaugaccaauagcagauuccccauaccauuagaaaaacucuucaccggaccauccuccgccuucgucgugcagccccaaaacggccgcuguacaacagacggcguccuacucggcaccacacaacuaucuccagucaacaucugcaccuuccgcggcgacguaacacacauacccggcucccgcaacuacaccaugaaccucgcaucucaaaacuggaacuccuacgacccaaccgaagaaaucccugcaccacucggcaccccagacuucguagguaaaauucaaggagucuuaacccaaaccacccgaacaaacggcuccacuagaggucacaaagccaccgucuacacaggcagcgccgacuucucacccaaauuaggucgugugcaguuugccaccgacaccgauaaugacuucgaaaccaaucaaaacaccaaauucacccccgugggaguuauccaggacgggucaacaacaccacgcaacgaaccccaacaauggguacuccccucauacucaggacguaacauccacaacguucaccucgcccccgccgucgcccccacuuuccccggcgaacaacuccucuucuucagaucaaccaugcccggcugcuccggcuaccccaacauggaccucgauugccugcucccccaagaguggguacaauacuucuaccaagaagccgcgcccgcccaauccgacgucgcacuccuccgcuucguaaacccagauaccggccgaguccucuucgaaugcaaacuccauaaauccggcuacgucacagucgcacacacaggccaacaugaucucgucauaccacccaacggcuacuuucguuucgacuccugggucaaccaauuuuacacacucgcccccauggguaacggaaccggcaggcgacgugcacucuaa

SEQ ID NO: 37518 - RNA, 1623 nt, Artificial Sequence
  derived and/or modified sequence opt11 from major_capsid_protein__Norovirus__AKE31849
augaaaauggccucauccgacgccaaccccuccgacggcuccaccgcaaaccucgucccugaagucaacaacgaaguaauggcccucgaacccguagucggcgcagccaucgccgcacccgucgccggccaacaaaacgucaucgaccccuggauccgcaauaacuucguccaagcccccggaggcgaauuuaccgucagcccaagaaacgcacccggcgaaauacuaugguccgcaccucuuggccccgaccucaacccauaccucucccaucuggcacgcauguacaacggcuacgccggcggauucgaaguccaaguaauccucgccgguaacgcauucaccgccggcaaaauaaucuucgccgccgucccacccaacuuccccacagaaggacucucccccucccaaguaaccauguucccucauauaauaguugacguccgccaacuugaacccguccucaucccccuaccagacgucagaaacaacuuuuaccacuauaaccaauccaacgacuccaccaucaaacucaucgccaugcucuacacaccccuccgcgccaauaacgcaggcgacgauguauucacagucucuugccgcguccucacccgacccucaccagacuucgacuucauauuccucguacccccaaccgucgaaucaagaaccaaacccuucucagucccaguccuuaccgucgaagaaaugacaaauucccgguucccaaucccacuagaaaaacucuucacaggccccuccucagccuucguuguacaaccccaaaacggcagaugcacaaccgacggcguucuccucggcacaacacaacugucucccguaaacaucugcaccuuccguggcgauguaacacacaucucaggcucacgcaauuacaccaugaaccuagcuucacaaaacuggaacuccuacgaccccaccgaagaaaucccagccccgcucggcaccccggacuucgucggcaagauacaaggcguucucacgcaagccacacgaaccaacggcuccacacgcggccacaaggcuaccguuuacaccggaagcgcugacuucucccccaaacuaggccgaguacaauucgcaaccgauaccgauaacgacuuugaaacaaaccaaaacacuaaauucacacccgucggcgucauacaagacggcuccaccacaccccgcaacgaaccccagcaauggguccuacccuccuacucaggccgaaacauccacaacguccaccuagccccagccgucgccccgaccuuccccggagaacagcuacuauucuuccgaucuacaaugccgggcugcucaggauacccaaacauggaccucgacugucuucucccucaagaauggguccaauacuucuaccaagaggccgcaccagcccaaucugacgucgcauuacuccgcuucgucaaccccgauacuggacgaguacuauucgagugcaaacuccacaaaagcggcuacgucacuguagcacacaccggccaacacgaccuagucauaccacccaacggauacuuccgcuucgacuccugggucaaccaauucuacacucuagcccccaugggcaacggcaccggccgccgacgcgcccuauaa

SEQ ID NO: 37519 - RNA, 1623 nt, Artificial Sequence
  derived and/or modified sequence opt11 from major_capsid_protein__Norovirus__AKE31852
augaaaauggccuccuccgaugcaaaucccucggauggcuccaccgcaaaccuugucccugaagucaacaaugaaguaauggcacuagaacccguagucggcgccgccauagccgcccccguagccggccagcaaaacguaaucgaccccuggauacgcaacaacuucguccaagcccccggaggcgaguucacgguuucaccacgcaacgcccccggagaaauccucuggucagcaccccucggcccagaccuaaacccuuaucuaucccaccucgcccgaauguacaacggcuacguaggaggcuucgaaguccaaguaauccucgccggcaacgccuucaccgccggcaaaaucaucuucgccgccguuccucccaacuuucccacagaagggcuauccccaucccaagucaccauguucccccacaucaucgucgacguucgccagcucgaacccguacucauaccccucccugacguccgcaacaacuuccaccacuacaaccaauccaacgaccccaccauuaaacucauagcaaugcucuacacuccccuacgcgccaacaaugccggugacgacgucuucacagucuccugucgcguccucaccagacccuccccugacuucgacuucaucuuccuagucccaccuacugucgaaucccgcacuaaacccuucuccgucccgguucuaacaguugaagaaaugaccaacucccgcuuccccaucccucucgaaaaacucuucaccgguccuuccucggcauuugucguacaaccacagaacggacggugcacaaccgacggcguucuccucggcaccacccaacucucccccgucaacaucugcaccuuccgcggagacgucacccacauccccggcucccgcaacuacaccaugaaucuagcaucccaaaacuggaacuccuacgaccccacggaagaaaucccagcaccccuaggcacccccgacuucguuggaaaaauccaaggcguacuuacccaaaccacccgcaccaacggcagcacccgcggccacaaagccacaguauacaccggauccgccgacuucucccccaaacuaggacgcauacaguucgcaaccgacacagacaacgauuuugaaaccaaccagaacacuaaauucacacccgucggcgucauccaagacgguuccacaacaccccguaacgaaccacaacaauggguccuccccucauauuccggccgcaauacccacaacguccaccucgcacccgccgucgcacccaccuuucccggagaacaacuacuauucuuccgcucgacaaugccagggugcuccggauaccccaacauggaccucgauugccuucucccccaagaguggguucaauacuuuuaccaagaagcagcacccgcccaaucugacgucgcacuacuacgauucgucaacccagacacaggccgcguacuauucgaauguaaacuccacaaaucuggcuaugucacagucgcccacacuggacaacacgaccuaguaauaccacccaacggcuacuuccgauucgacucaugggucaaccaauuuuacacccuagcccccaugggcaacggcaccggccgacgccgagcucucuaa

SEQ ID NO: 37520 - RNA, 1623 nt, Artificial Sequence
  derived and/or modified sequence opt11 from major_capsid_protein__Norovirus__AKE31855
augaaaauggcauccuccgacgccaaccccagcgacggcucuaccgccaaccucgucccagaagucaacaacgaagucauggcucucgaacccguugucggugcagccaucgcagcccccgucgcaggccaacaaaacgucauagaccccuggauccgaagcaacuucguucaagcccccggcggagaguucaccgucucaccccguaacgccccaggcgaaauccuuuggucugcaccccucggucccgaucuaaaccccuaccucucccaccuagcaagaauguacaacggcuacgcuggaggcuucgucguucaagucauccuagccggaaacgcauuuacugcagguaaaaucaucuucgccgccgucccacccaacuuccccacagaaggacuaucacccucccaaguuaccauguucccccacaucaucguagacgcccgccaacuagaacccguucuaauuccccuccccgacguacgaaacaauuucuaccacuacaaccaauccaacgaccccacaaucaaacuuaucgccaugcucuacacaccacuccgcgccaacaacgcaggagacgacgucuucaccguauccugccgcguccuaacccgccccuccccggacuucgacuucauauuccucgucccaccaacagucgaaucccgaacaaaacccuucucaguccccguccuuacagucgaagagaugaccaacuccagauuuccaauccccuuagaaaaacucuucaccggacccuccucagccuucguaguacaaccccaaaacggccguugcaccacagacggaguccuucucgguaccacgcagcucucccccguaaacaucugcacauuccgcggcgacgucacccacauuucuggcucccguaacuacaccaugaaccucgcuagccaaaacuggaacuccuacgaccccaccgaagaaauacccgcaccacucggcaccccggacuuugucggcaaaauccaaggugucuuaacccaaacaaccaaaaccgacgguagcacacgcggacacaaagccacagucuacacaggcagcgccgacuucagcccgaagcucggacgcguacaauuugccacagacaccgacaacgacuucgaaacaaaccaaaacaccaaauucacccccgucgguguuauccaagacggcagcaccaccccacgcaacgaaccccaacaauggguccuccccucauacucuggacgaaacacccacaauguacaccucgcaccagccgucgccccaacuuuuccuggcgaacaacuccucuucuuccgauccacuaugccagguugcucuggauacccaaacauggaucuagauugccuccucccccaggaauggguacaauacuucuaccaagaggccgcaccagcacaauccgacgucgcccuauuacguuucgugaaccccgacaccggccgcguccucuucgaaugcaaacuacacaaauccggcuaugucaccguugcccacaccggacagcacgaccucgucaucccacccaacggauacuuccgcuucgacuccuggguuaaucaauucuacaccuuagcccccaugggcaacggaaccggaagacgccgcgcccuauaa

SEQ ID NO: 37521 - RNA, 1623 nt, Artificial Sequence
  derived and/or modified sequence opt11 from major_capsid_protein__Norovirus__AKE31858
augaaaauggccucuucugacgcaaaccccagcgacggcuccaccgccaaccucgucccagaagucaacaaugaaguuauggcacucgaacccguagucggagccgccauugccgcccccguagcaggccaacaaaacguaauagaccccuggauccgcuccaacuucguccaggcuccaggcggcgaguucaccgucucaccccgcaacgcacccggcgaaauacucugguccgcaccccucggccccgaccugaacccauaccuaucccacuuagcccgcauguacaauggcuacgccggcgguuucgaaguccaagucauccucgccggcaaugccuucacagccggaaaaaucauauucgccgccgucccacccaacuuccccacagaaggacucagccccucccaagucacuauguucccccauauuaucgucgauguccgccaacucgaacccguacuuaucccccuccccgacgucagaaacaacuucuaccacuacaaccaaucaaacgacccaaccauaaaacuaaucgccaugcuauacacuccccuccgcgcaaacaacgcaggagacgacgucuucaccgucuccugcagaguccuaacccgcccaucaccagacuucgauuucaucuuccucguacccccgacagucgaaagccgcaccaaaccauucuccguccccguccucaccgucgaagaaaugaccaacucacgcuucccaaucccccucgaaaaacuuuucacaggacccucaucagccuucgucguccagccacaaaacggccgcugcaccacggacggcguccuccuuggaaccacacaacucucccccgucaacauaugcaccuucagaggagacgucacccacaucuccggaucacgaaacuacacaaugaaccucgccucgcaaaacuggaacucuuacgaccccaccgaggaaauccccgcuccccucgguacccccgacuucgucggcaagacccaaggaguccuaacgcaaaccaccaaaaccaauggcucaacccgcggccacaaagccaccguauacacaggcuccgccgacuucagccccaaacucggucgcguccaguucgccacugacacagacaacgacuucgagaccaaccaaaacaccaaauucacacccgucggagucauccaagauggcucaacuacaccccgcgacgaaccccaacaauggguccucccgucauacuccggacgcaauacccacaacguacaccucgcccccgcugucgcccccaccuucccaggcgaacaacuacuauucuuccgaucuaccaugccuggcugcucaggcuaccccaacauggaucucgaccgucuucucccacaagagugggugcaauacuucuaccaagaacccgcgccugcucaauccgacguagcccuucuccguuucgucaaccccgacacaggccgcguacucuucgaaugcaaacuccauaaauccggcuacgucaccgucgcccacaccggacaacacgaccucguaauaccucccaacggauacuuccgcuucgacucauggguaaaccaauucuacacccuagcucccaugggcaacggaaccggcagacgucgcgcccucuaa

SEQ ID NO: 37522 - RNA, 1623 nt, Artificial Sequence
  derived and/or modified sequence opt11 from major_capsid_protein__Norovirus__AKE31861
augaaaauggccucauccgacgccaaccccucagacggcucaaccgccaaccuaguucccgaagucaacaacgaaguuauggcccucgaacccguaguaggcgccgccaucgcagcacccgucgccggccaacaaaacgucaucgacccauggaucagauccaacuucguacaagcaccaggcggcgaguucacaguaucacccagaaacgcccccggcgaaauccucugguccgcaccccucggacccgaccuaaaccccuaccucucccaccucgcccgcauguauaauggauacgccggaggauucgaaguucaagucauccucgccggcaacgccuucaccgcaggcaaaaucaucuucgccgcaguaccacccaacuucccaaccgaaggccuauccccaucccaagucacgauguucccacacauuaucguagacguccgccaacucgaacccguccucaucccccuaccagacguccgcaacaacuucuaccacuacaaccaauccaacgaccccaccauaaaacuuauagcacgccuauacacaccccuccgcgcaaacaacgccggagacgacgucuuuaccgucuccugccgcguccucacacgacccucacccgacuucgacuucauauuccuugucccucccaccgucgaaucccgcacuaaacccuucuccguccccguccuaaccguagaagaaaugaccaacagccgauuccccauuccccuagaaaaacucuucaccggcccauccucagcauucguaguccagccccaaaauggccgaugcaccaccgacggcguacuccucggcaccacccaacuaucacccguuaauaucugcacauuccgcggugacgucacucacauuuccggcucccgaaacuacacuaugaaccucgccagccaaaacuggaacuccuacgaccccaccgaagaaauccccgcuccccucggcacacccgacuucguaggcaaaauccaaggcguacucacacaaaccacaaaaaccaaugguuccacacgcggccacaaagccaccguauacacuggcagcgccgauuucucaccaaaacucggccgaguccaauuugccacagacaccgauaacgauuucgaaaccaaccagaauacgaaauucacuccagucggcgucauccaagacggaucaacaacuccccgcaaugaaccccaacaauggguccuaccaucauacucaggacgcaacacccacaacguccaccuugccccagccgucgcacccaccuuccccggcgaacaacuuuuauucuucagaucgacaaugccaggaugcucuggcuaccccaacauggaccucgacugccuccucccacaagaauggguccaauacuucuaucaagaagcagcccccgcacaauccgacguagcucuccuucgcuucguuaaccccgacacuggacgcguucuauucgaaugcaaacuucacaaguccggcuacguaaccgucgcacacaccggccaacaugaccucguaaucccacccaacggcuacuuccgcuucgauuccuggguaaaccaauuccacacacuugcucccaugggcaacggcaccggaagacgacgugcacuauaa

SEQ ID NO: 37523 - RNA, 1623 nt, Artificial Sequence
  derived and/or modified sequence opt11 from major_capsid_protein__Norovirus__AKE31864
augaaaauggcgucauccgaugccaaccccagcgacggaucgaccgccaaccucguccccgaagucaacaacgaagucauggcacucgaacccgucgucggugccgccaucgccgcccccgucgccgggcaacaaaacgucauugaccccuggauacgcaacaacuucguccaagcacccggaggagaauuuaccguaucuccacguaacgcucccggcgaaauccucugguccgcaccccucggccccgaccuaaaccccuaccucucacaucucgcccgcauguacaacgguuacgccggcggcuucgaaguacaagucauacucgcgggcaaugcauucaccgccggaaaaauaaucuucgcagccguuccacccaacuuccccaccgaaggccuaucccccucccaaguuaccauguucccacacaucaucgucgacguacgccaacucgaacccguccuaauaccacuaccagauguccgcaacaacuucuaccacuacaaccaguccaacgaccccacaaucaaacucaucgccaugcuauacacaccccuucgagccaacaaugccggcgacgacguauucaccgucuccugcagaguccuuacccgcccauccccagacuucgauuucauauuccuagucccacccaccgucgaaucccguacaaaacccuucucaguucccguucuaacaguagaagaaaugaccaacucccgcuuccccaucccccucgaaaaacucuucaccggccccucuuccgccuucgucguccaaccccaaaacggccgcugcaccaccgacggcguucuuuuaggaaccacccaacuaucacccgucaauauccgcaccuuccgcggagacgucacccacauccccggaucaagaaacuacacaaugaacagcgccucacaaaauuggaacuccuacgaccccaccgaagaaaucccagcaccccuaggaaccccagacuucguaggaaaaauacaaggcguccugacucaaacuacucgagccaacgggucaacccggggccacaaggccaccguauacacaggcagcgccgacuucuccccaaaacucggacgcguucaauucgccacagacacagacaacgacuucgaaacuaaccaaaacaccaaauucacacccgucggcgucauacaagauggcucgacaacaccccgcaacgaaccccaacaauggguccucccauccuacucaggacgcaacauucauaauguccaccucgcacccgcagucgccccaacauucccaggugaacaacuccucuucuuccgcucaaccaugcccgggugcucaggcuaccccaacauggaccuagacugccuacuuccacaagaauggguccaauacuucuaucaagaagccgcaccagcccaauccgacguagcacuccuacgcuucguaaauccagacaccggccgaguccucuuugaaugcaaacuccacaaaucgggcuacgucaccgucgcccacaccggccaacacgaccuuguaaucccacccaacggcuacuuccgcuuugacucauggguaaaccaauucuacacacucgcaccgaugggaaacggcaccggacgccgucgugcccucuaa

SEQ ID NO: 37524 - RNA, 1623 nt, Artificial Sequence
  derived and/or modified sequence opt11 from major_capsid_protein__Norovirus__AKE31867
augaaaauggccuccuccgacgccaaccccuccgacggaucaaccgccaaccucguccccgaagucaacaacgaagucauggcccucgaacccguaguuggagccgccaucgcagcucccguagcaggacaacaaaacgucaucgacccauggauccgcaauaacuucguccaggcccccggcggcgaguucaccgucucaccccgaaacgcacccggugaaauacuaugguccgcaccucucggacccgaccucaaccccuaccuaagucaccuugcacgcauguauaacggcuacgccggcgguuucgaagugcagguaauccuagccggcaacgccuucaccgcuggcaaaaucaucuucgcugccguucccccuaauuuccccaccgaaggccucucccccucccaagucaccauguucccacacaucaucgucgacguccgucaacucgaacccgucuccaucccacuaccugacguucggaacaacuucuaccacuacaaccaaagcaacgaccccacaauaaaacucaucgcaaugcucuacacuccccuccgagccaacaacgccggcgacgacgucuucaccgucuccugccguguacuuacccgccccuccccugacuucgacuucaucuuccucgucccacccaccgucgaaucccgaaccaaacccuucucagucccaguucuaaccgucgaagaaaugaccaacucccgcuuucccaucccucuagaaaaauuauucaccggccccuccuccgccuucgucguccaaccccaaaacggucgauguaccacugacggcguccuccucggcacaacccaacuuagccccgucaacaucugcacauuccgaggcgacgucacccacaucccuggaucacgaaacuacacaaugaaccucgcaucccagaacuggaacucauacgacccaaccgaagaaauccccgcaccgcuaggaaccccagacuucguaggaaaaauacaaggaguccucacccaaaccacccgagccaacggcuccacccgcggccacaaggccaccguuuauaccggaucugccgacuucagccccaaauuaggccguguccaauucgccaccgacaccgacaacgacuucgaaacuaaccaaaacaccaaauucaccccagucggagucauccaagacggaucaaccacaccccgcaaugaaccccaacaauggguccucccaagcuacuccggucgcaacauccacaacguccaccucgcuccagcagucgcaccaaccuuucccggcgaacaacuccucuucuuccgcucaacaaugccaggcugcucaggauaucccaacauggaccucgacugucuccuaccccaagaauggguccaauacuucuaccaagaagccgcccccgcacaauccgacgucgcccuccuccgcuucgucaaccccgacacaggccgcguccuauucgaaugcaaacuccacaaauccggcuacgucaccguagcacauaccggccaacacgaccuaguaauaccacccaauggcuacuucagauucgacuccugggucaaucaauucuacacccucgcucccaugggaaauggaaccggucgacgccgagccuuauaa

SEQ ID NO: 37525 - RNA, 1623 nt, Artificial Sequence
  derived and/or modified sequence opt11 from major_capsid_protein__Norovirus__AKE31870
augaaaauggccuccuccgacgccaaccccuccgacggcuccacugcaaacuuaguccccgaaguaaauaacgaagucauggcucucgaaccagucgucggcgccucaauagccgcccccguagcaggccaacaaaacgucaucgaccccuggauccgcaacaacuucguccaagcacccggaggcgaauuuaccgucucaccccgcaacgccccaggcgaaauccuaugguccgcaccacucggacccgaccuuaaccccuaccucccacaccucgcuagaauguacaacggcuacgccggaggcuucgaaguacaaguaaucuuggccggaaacgcuuucaccgcugguaaaauuaucuucgcagccguaccacccaacuucccaaccgaaggacucucccccagccaggucaccauguucccccacaucaucguagacguacgccaacucgaacccguccucaucccacuacccgacguccgaaacaacuucuaccacuacuaccaguccaacgaccccaccauaaaacucauugcaaugcucuacacaccccuccgugccaacaaugccggcgacgacgucuucaccguaagcugccgcguccucacccgccccuccccagacuucgacuuuaucuuccucgucccacccaccguugaaucacgcacuaaacccuucucgguccccguccucacuguugaagaaaugacuaacucacgauucccaauuccacucgaaaaacuauucacaggcccauccuccgccuucgucguccaaccccaaaauggacgaugcaccaccgacggaguauuacucggcaccacccaacuuuccccagucaacauaugcacuuuccgcggcgacguaacccauauuucaggcagccgcaacuauaccaugaaccucgccucacaaaacuggaacucuuacgaccccaccgaagaaaucccagcaccccucggcacccccgacuucgucggcaaaauccaaggcguacucacccaaaccacccgcacaaacggcucaacacgcggccacaaagccaccguauauacuggaucagccgacuuuucucccaaacuaggacggguccaguucgcgacugacacugauaacgacuucgaaacaaaccaaaacacuaaauucaccccugugggcgucauacaagacgguucaaccacaccaagaaacgaaucacaacaguggguccuacccuccuauucaggacgcaacacacacaacguccaucuagcacccgcaguugccccaacauuccccggugaacaacucuuauucuuccgcucuacaaugcccgguugcucuggcuacccaaacauggaccucgacugccuacucccccaggaauggguccaauacuucuaccaagaagccgcccccgcccaaucagacguugcacuccuacgcuucgucaaccccgacacaggccgcguacuauucgaaugcaaacuucacaaauccggauacguuaccgucgcccauaccggccaacacgaccucguuaucccacccaauggcuacuuccgcuucgacuccugggucaaccaauucuacacacucgcccccaugggcaacggcaccggacgccgccgcgcacuauaa

SEQ ID NO: 37526 - RNA, 1623 nt, Artificial Sequence
  derived and/or modified sequence opt11 from major_capsid_protein__Norovirus__AKE31873
augaaaauggccucuucagacgccaaccccucagaugguuccaccgcaaaccuaguacccgaagucaacaacgaaguaauggcccucgaacccgucgucggagccgccaucgccgcccccgucgccggccaacaaaacgucauagacccuuggauccgcaacaacuucguccaagcaccaggcggcgaguucaccgucuccccgcgaaacgcccccggcgaaauucuauggucugccccucuuggcccugaccuuaaccccuaccuaucccacuuagcccgaauguacaacggcuacgcgggaggauucgaaguccaagucauacucgccggaaacgccuucaccgcuggaaaaauaaucuuugccgccgucccacccaacuuucccaccgaaggccuaucacccucccaaguaaccauguucccccacaucauaguagacguacgccaacucgaacccguccucaucccacuucccgacguacgcaacaacuucuaccacuacaaucaauccaacgaucccaccaucaaacugauagccaugcucuacacaccccuccgcgccaacaacgccggugacgacgucuucaccgucuccugccgaguucucacccgucccagccccgacuuugauuuuaucuuccucgucccacccaccguggaaagccgaaccaaacccuuuuccguuccaguccucacaguugaagaaaugaccaacucaagauuccccaucccacuagaaaaacucuucaccggccccucauccgcauucgucguccaaccccaaaacggucgcugcaccaccgacggcguccuucugggcaccacccaacucuccccugucaacauaugcacuuuccguggcgacguaacccacaucuccggcucccgaaauuacacgaugaaccucgccagccaaaacuggaacuccuacgacccuacagaagaaauacccgcaccgcucggaacccccgacuucgucggcaagauacagggcguccucacucaaaccacucguaccaacggauccacccgcggccacaaagccaccgucuauacuggcuccgccgauuucuccccaaaauuagggagaguacaauuugcuacugacacagacaacgacuucgaaacuaaccaaaacaccaaauucaccccagucggcgucauacaagacggcucaaccaccccucgaaacgaaccucaacaauggauguuacccucauacagcggccgaaacacccacaauguccaccuugcccccgcagucgccccuaccuuccccggagaacagcuccucuucuuccguuccaccaugccuggcugcucuggcuacccuaacauggaccuugacugucuccucccccaagaauggguccaauacuucuaccaagaagccgcucccgcccaauccgacgucgcccuucucagauucgucaacccagacaccggccgaguccuuuucgaauguaaacuccauaaauccggcuacgucaccgucgcccauaccggacaacacgaucucgucaucccaccaaacggcuauuuccgauucgauuccugggucaaccaauucuacacccuagcacccaugggcaauggcacaggacgacgcagagcacuauaa

SEQ ID NO: 37527 - RNA, 1623 nt, Artificial Sequence
  derived and/or modified sequence opt11 from major_capsid_protein__Norovirus__AKE31876
augaaaauggccagcucagacgccaaccccagcgacggcuccaccgcaaaccucguacccgaaguaaacaacgaagucauggcccuagaacccgucgucggagcagccaucgccgccccugucgccggccaacaaaacgucauagaccccuggauccgcaacaacuucguccaagcccccggaggugaauuuaccgucucuccacgcaacgcccccggagaaauccucugguccgcaccccugggccccgaccucaauccauaccuaucccaccuugcccgaauguauaacggcuacgccggcggcuucgaaguccaagucauacucgccggcaacgcauucacggccgguaaaaucaucuucgccgcagucccaccaaacuuccccaccgaaggccucucccccucccaagucacgauguucccccacauaaucguagacguccgccaacuagaacccguauuaaucccccugcccgacguccgaaacaauuucuaccacuauaaccaauccaacgaccccacuauaaaacucaucgcaaugcucuacacaccccucagagccaacaaugcacgcgacgaugucuucaccgucuccugccgaguccucacccgaccaucccccgauuucgacuucaucuuccucguaccacccacagucgaaucacgaacaaaacccuucucaguccccguccucaccgucgaagaaaugaccaacuccagauucccaaucccccucgaaaaacucuuuaccggcccuuccucagccuucguaguccaaccacaaaacggccgcugcaccaccgacggcguccucuuaggcaccacacaacucucucccgucaacauaugcaccuuccgaggcgacgucacccacaucuccggcucccgcaacuacaccaugaaccuagcaucccagaauuggaacuccuacgaccccaccgaagaaauaccugcaccacucggcacaccugacuucguagguaaaauccaaggaguccuaacacagacaacucgaaccgacggcucgacccgcggccacaaagcaacagucuacaccggauccgccgacuucagcccaaaacucggccguguccaauucgcuaccgacaccgacaacgauuucgaaacaaaucaaaauaccaaauucacccccgucggcguaauccaggacggaggaacgacccaucgcaacgaaccccaacaguggguccuucccaacuacuccggccgcaauacacacaacguccaccuagccccugccgucgcccccaccuuccccggcgaacagcuacucuucuuccgcucaaccaugcccggauguucuggauaccccaacauggaccucgacugccuccucccccaagaauggguacaauacuucuaccaagaagccgcccccgcccaauccgacguugcccuccuccgcuucguaaacccugacacuggacgcguccuauuugaaugcaaacuccacaaauccggauauguuacagucgcccacacuggccaacacgaccuagucaucccacccaacggcuacuucagauucgacuccuggguaaaccaauucuacacccucgcacccaugggcaacgggacaggccgaagacgggcacucuga

SEQ ID NO: 37528 - RNA, 1632 nt, Artificial Sequence
  derived and/or modified sequence opt11 from major_capsid_protein__Norovirus__AKF02368
augaaaauggccuccaaugacgcagcccccagcaacgacggcgccgcgggccuaguaccagagauaaacaacgaaaccauggccuuggaaccaguggcaggaggagccaucgccgcuccucucaccgggcaaaccaacuucaucgacccauggauccgcggaaacuacguccaggccccuaacggugaguucaccgucagcccccggaacagccccggagaaauccuccucaaccucgaacucggccccgaauuaaaccccuuccucucccaccuaucccgcauguacaacggcuacgcaggcggcauagacguacaggucauuauggccgguaaugccuucaccgcaggcaaaaucauuuucgccgccauaccaccccacuuccccgucgaaaaccucuccccaccccaaauuacaauguucccccacaucauagucgacguccgcacccucgaaccaaucaacauccccgucccagacguaaggaacaacuucuuccacuacaaucaaaacaacgaaucuagaaugcgccuaguugccaugcuauacacaccccuucgcucaaacggcuccgcagaagacgucuucaccgucucaugccgcguacucacaaaacccagcgccgacuucgaguucaacuaccuagucccaccaaccguagaaucacgaaccaaaccauucacaauccccauccucaccaucggcgaaaugacaaacucccgcuuccccguaccaaucgacaugcuccauacauccccaaccgaaaacaucgucguucaaccccagaacggcagaugcacaauagacggcgaauuacuaggaacaacgcaacugaucaccuccaacaucugcagcuucagaggcagcaucuccggccacgaaggcaaugacgaccaacaucucuggcacuucaacaucaccaaccccaacggcacacccuucgacccaaccgaagacgucccagcaccccuugguacacccgacuuccgcggacaacucuacggcgucaucucacaacgagaccgcgaaggaacacccucagaaaacaaccaaaaagccaaccgcucacacgaaggcgugaucuccacaaucucaccaaaauuugucccaaaacucggcuccgucaugaucggcaccuggaccaccgacgacaucaaaaaccaaccauccaaguucacccccauaggccuaaacgacgacgacaauuucaaacaaugggaacugccaaauuauucgggcgcacuuacucuuaacaugggccucgcccccuccguauucccaacauaccccggcgagcaaguccucuucuuccgcuccuaccuccccaugaaaggaggcuacggaagcccauucaucgacugccucgucccucaggaguggguagcccacuucuaccaggaauccgcccccgcucaaacagacguugcccuaauccguuacguaaaccccgaaaccggccgcguccuuuuugaagccaaacuccaucgccaaggcuucaucacagucgcaaaauccggcgacucccccauaaacguaccugcaaacggcuacuucagauucgacuccugggucaaccaguucuacucacuagccccuaugggcacaggcaacggccgccgccgaauccaauaa

SEQ ID NO: 37529 - RNA, 1644 nt, Artificial Sequence
  derived and/or modified sequence opt11 from major_capsid_protein__Norovirus__AKF42429
augaaaauggcuuccaacgacgcagcacccucaaacgauggcgccgccaaccucguacccgaggccaccaacgaagucauggccuuagaacccgucguaggagccucaaucgcugccccaguggucggccaacaaaauaucaucgacccauggauccgagaaaacuucguccaagcaccccaaggagaguucacagucucaccccgcaacucacccggcgaaaugcuacucaaccucgaacuaggccccgaauuaaaucccuaccuaucccaccucucgcgcauguacaauggauacgccggcggaaugcaaguacaagucguucuggccggcaacgccuucaccgcaggcaaaaucauauucgccgccgucccaccccacuuccccguagaaaacauaucagcugcccaaauaacaaugugcccccacgucaucguagacguucgacaacuugaacccguucuucuuccccuacccgacauccgcaaccgcuuuuuccacuauaaucaagaaaacacuccccgcaugcgccuagucgcaaugcucuacacaccccuccgcgccaacuccggcgaagacgucuucaccguuuccugccgcguccuaacccgucccgcccccgacuuugaguucaccuuccucgucccacccaccgucgaaucuaaaaccaaacccuuuacccugcccauccuaacccuaggcgaacuaucgaacucacgcuucccagcuccaaucgauaugcucuauaccgaucccaacgaagccaucgucguccaaccccaaaacggccgcugcacucucgacggcacacuccaaggcaccacucaacuuguaccaacucaaauuugcuccuuccgcggcacccuaauaucccaaaccucccgcagcgccgacuccaccgacagcgcaccccgcguccguaaucacccacuccacguccaacuuaaaaaccuugacggcacacccuacgauccuaccgacgaaguccccgccguccuuggugccauagacuucaaaggcaccguauucggagucgccagccaacgcaacaccaccggcaauuccauaggcgccaccagagcacacgaaguccacauagacaccaccaacccacgauacaccccaaaacuaggauccguccucauguacucagaaucuaccgacuucgacgacggccaacccacccgcuucacccccauuggcaugggugccgacgacuggcaccaaugggaacuccccgaauacuccggccaccuaacccucuccaugagccucgcacccgccgucgcacccgcauuccccggcgaacgaauacucuucuuccgcuccguggucccauccgccggagguuacggauccggccacauagacugccucaucccccaagaauggguccagcacuucuaccaagaagccgccccaucccaaucagccguagcccuaauccgcuacgucaacccugacacaggccgaaauaucuucgaagcuaaacuacaccgcgaaggauucaucaccgucgccaacuccggcaacaaccccauaguuguacccccaaacggcuauuuccguuucgaagcaugggucaaccaauucuacaccuuaacccccaugggcacuggccaaggccgccgacguguacaauaa

SEQ ID NO: 37530 - RNA, 1644 nt, Artificial Sequence
  derived and/or modified sequence opt11 from major_capsid_protein__Norovirus__AKF42434
augaaaauggcauccaacgacgcagccccauccaacgacggagccgccaaccucguccccgaagccaccaaugaagucauggcgcucgaacccguugucggcgcuucaaucgccgcccccgucguaggccaacaaaacaucaucgacccauggauccgcgaaaacuuuguccaagccccacaaggagaguucaccgucuccccacgcaacucccccggcgaaauguuacucaaucucgaacuuggccccgaacucaacccauaccuaucccaccucucacgaauguacaacggauacgccggcggaaugcaaguccaagucguccucgcaggcaacgcauucacagccggaaaaaucaucuucgccgcuguacccccacacuuccccgucgaaaacaucagugccgcccaaaucacaaugugcccacacguaaucgucgauguccgacaacucgaacccguccuccuacccuugcccgacauacgaaaccgcuucuuccacuacaaccaagaaaauacaccccgcaugcgucuagucgccaugcucuacacaccccuccgcgccaacuccggcgaagaugucuucaccguguccugccgcguccuuacccgacccgcucccgacuucgaguucaccuuccucgucccacccaccgucgaauccaaaaccaaaccauucacccucccaauccuaacacucggcgaacucagcaacucccguuucccggcacccaucgacaugcucuacaccgacccaaacgaagccaucguaguccaaccccaaaacggccgcugcacacuggacggcacacuccaaggcacgacgcagcucguaccgacucaaauauguuccuuucgcggcacccuaauaucccaaaccucccgcuccgccgacagcacagacuccgcgccacgaguccgaaaucacccccuacacguccaacucaaaaaucuagacggcacccccuacgaccccaccgacgaagucccagcaguccucggggcuaucgacuucaaaggaaccguauucggcguugccucccaacgcaauaccaccggcaacucaaucggagccacccgagcccacgaaguccacaucgacacaaccaacccccgcuacacaccaaaacuuggcuccguacucauguacagcgaaucauccgacuucgacgacggccaacccacuagauucacaccaaucggcaugggagccgacgauuggcaccaaugggaacuccccgaauacucaggccaccucacacuaaacaugaacuuagcacccgcagucgcgcccgccuuccccggagaacgcauccucuucuucagauccgugguccccuccgccggaggcuacgguuccggccacauagacugccucaucccacaagaauggguucagcacuucuaccaagaagccgcccccagccaaucagccgucgcccuaauccgcuauguaaaccccgacaccggccgcaacaucuucgaagccaaacuccaccgagaaggcuuuaucaccgucgcaaauuccggaaacaacccuaucgucgucccaccaaacggauacuuccgcuuugaagccuggguaaaccaguucuacacacuaacccccauggguacuggacaaggcagacgacguguacaauag

SEQ ID NO: 37531 - RNA, 1650 nt, Artificial Sequence
  derived and/or modified sequence opt11 from major_capsid_protein__Norovirus__AKF42437
augaaaauggccuccaccgacgccgccccaucaaacgacggcgccgccaaccuugucccggaagccaacaacgaagucauggcccuugaacccgucgucggcgccuccaucgccgccccagucgucggacaacaaaacaucaucgaccccuggauccgugaaaacuuuguccaagccccacagggcgaguuuaccgucagcccccgaaacucccccggagagaugcuucucaaccucgaacucggccccgaacucaaccccuaccucucacacuuaucgcgcauguacaacggcuacgcaggcggcaugcaaguccaagucguccucgcaggcaacgccuucacagcuggcaaaauaauauucgcagccgucccgccccacuuccccgucaaaaacaucuccgcggcccaaaucaccaugugcccacacgucaucgucgacguccgccaacucgaaccuguacuccucccacuccccgauauccgcaacagauucuuccacuacaaccaagaagacacucccagaaugcgccuagucgccaugcuauacacgccacuacgagcaaacucuggcgaggacgucuuuacagucuccugcagaguacucacccgccccgccccggacuucgaauuuacauuccuagucccucccacaguagaauccaaaaccaaacccuucacacugcccauccucacccucggcgaacuauccaacucccgguucccagccccaaucgacauguuauacaccgaccccaacgaaggagucguaguccaaccccaaaacggacgcuguacccuugacggcacccuacaaggaacaacacagcuagucccaacacaaaucugcgccuuccgcggaaaacucauaggucaaaccuccagaucaccugacuccgacagcaccgauuccgcaccccgccgccgcgaccacccccuacauguccaacucgaaaacuuagacggaacacaauacgaccccaccgacgaaguccccgccacccucggcgccgucgacuucaaagguacaaucuucggggucgccucucaacgagacaccuccggcucacaagucggcgccacuagagcccacgaaguccacaucaacaccacugacccucgauacacccccaaacuaggauccauccucauguacuccgaaucccuagacuucgaaacuggccaacccgucagauucaccccaaucggcaugggcgaaaacgacuggcaccaaugggaacuaccugacuacuccggccgccuaacccucaauaugaaccucgccccagccguagcccccgccuuccccggcgaacgcauccuauucuucagauccaucgucccaucagccggcggguacggaucuggccaaaucgacugccuuauaccccaagaauggguccaacacuucuaccaagaagccgcacccucccaaucugcggucgcgcuuauccgauacgucaaccccgacaccggacgaaacauauucgaagcgaaacuacaccgcgaaggcuucaucacaguagcuaauagcggcaacaaucccaucguuguacccccuaacggauacuuccgcuuugaagccugggucaaccaauucuauacccucacacccaugggcacaggccaaggccgccgccgcaaccaauaa

SEQ ID NO: 37532 - RNA, 1623 nt, Artificial Sequence
  derived and/or modified sequence opt11 from major_capsid_protein__Norovirus__ALA27427
augaaaauggccuccaacgacgccaaccccucagacggauccgccgcaaaccucguccccgaagucaacaacgaagucauggcccuagaacccgucguaggagccgccaucgccgcacccgucgccggccaacaaaacgugaucgacccguggauccgcaacaacuuuguacaagcucccggcggagaauuuaccgucucuccccgcaacgcccccggagaaauccuuuggucugcuccccucggcccagaccuaaacccguaccucucccaccucgcccgcauguauaacggcuacgcaggaggcuucgaaguccaagucauauuagccggaaacgccuucacagccggaaaaauaauuuucgccgcagucccaccaaacuucccuaccgaaggccucucccccagccaaguaaccauguucccacacaucaucgucgacguacgccaacuugaacccguauuaaucccccuacccgacgucagaaacaacuucuaccacuacaaccaauccaacgacucaacaaucaaacuaauugccaugcucuacacaccccuccgcgcaaacaacgccggugaagacgucuucaccgucucuugccgagugcucaccaggcccucucccgacuucgacuucaucuuccucguucccccaaccgucgaaucccgcaccaaacccuucaccguccccauucuaacugucgaagaaaugacuaacucccgcuucccaaucccccuggaaaaacucuucaccggacccagcggcgccuucguaguccaaccccaaaacggcagaugcaccacugacggaguccuccucggaacaacccaacuuucacccgucaacaucugcaccuuccgaggcgacgucacacacaucgccggcucccgaaacuacaccaugaauuuagccucacuaaacuggaacaacuacgaucccaccgaagaaaucccagcuccccucggcaccccagacuucguagguaaaauccaaggcguccucacccagaccaccaaaggcgauggcucaacccgcggccacaaagccaccgucuacacaggaucugcaccuuucacccccaaacuaggaagcguccaauucuccacagacacagaaaacgacuucgaaacccaccaaaacaccaaauucacccccgucggaguaauccaagacgguagcaccacucaccgcaacgaaccacaacaauggguacuaccuuccuacuccggccgcaacguccauaacguacaccuagcccccgccgucgccccaaccuuccccggcgaacaacuucucuucuuccgaucaacaaugcccggcugcagcggcuacccaaacauggaccucgacugccuccucccccaagaauggguucaacacuucuaccaagaagccgccccggcccaaucagacgucgcccuccuccgcuucgucaaccccgacaccggacguguccucuucgaauguaaacuccacaaauccggcuacgucacagucgcccacaccggccaacacgaccuagucauaccacccaacggguauuucagguucgacucaugggucaaucaguucuacacccuagcaccaaugggcaacggcaccggacgccgccgcgcacuauaa

SEQ ID NO: 37533 - RNA, 1623 nt, Artificial Sequence
  derived and/or modified sequence opt11 from major_capsid_protein__Norovirus__ALD09618
augaaaauggcauccaacgacgccgccccaucaaaugacggcgcagcaggccucguccccgaaggaaacaacgaaacucuaccccucgaaccugucgcuggcgccgccaucgcugcucccgucaccggccaaaacaacaucauagaccccuggauccgcacaaacuucguacaagcccccaacggcgaauuuaccgucucgccccguaacuccccaggagaaauucuccuaaaccucgaauuaggccccgaccucaaucccuaccucgcccaccuuucccgcauguacaacggcuacgcaggaggugucgaaguccaaguccuacucgccggcaacgccuucacagccggcaaaauccucuucgcagccguaccacccaacuucccaguugaguuccuaucccccgcccaaaucaccaugcuaccccaucuaaucgucgacguccgcacccucgaaccaauuaugaucccacugcccgacgcccguaacaccuucuuccacuacuccaaccaacccaacucccgcaugcgacucgucgccaugcuauacacaccacuccguucaaacggcucgggagacgacgucuucaccgucagcugccgcguacuuacccgcccaacccccgauuucgaguucacuuaccugguuccucccucaguugaauccaaaaccaaaccguucagccucccaauccucacacucuccgaacuuaccaacucacgauuccccguccccaucgacucccuauucaccgcccaaaauaauguccuucaaguccaaugccaaaacggcagaugcacgcucgacggcgaacuacagggaaccacucaacuccuacccucaggcauuugcgccuuccgaggucgcgucacggcccaaauaaaucaaagagaccgcuggcacaugcaacuacaaaaccuaaacggcacuaccuacgaccccaccgacgacguacccgcuccccucggcacccccgacuuuaaaggcguagucuucggaauggucucccaaagaaacguugguaacgacgccccaggcucaacucgagcccaacaagcaugggucuccacguacucgccccaguucguucccaaacucggcuccguaaaucuucgcaucuccgacaacgacgacuuccaauuccaacccacaaaauucacccccguaggaguuaacgacgacgacgacggccacccauuccgccaaugggaacuccccaacuacucaggagaacucacacucaacaugaaucuugcucccccagucgcacccaacuuccccggcgaacaacuccucuucuuccgcuccuuuguacccugcuccgguggcuacaaccaaggcauaauagacugccuaauuccccaagaauggauacaacacuucuaccaagaauccgcccccucccaauccgacgucgcccucauccgcuaugucaacccagacaccggccguacacucuucgaagccaaacuacaccgcuccggcuacauaaccguggcacacuccggagacuacccacucgucguccccgcaaacggccacuucagauucgacuccugggucaaccaauuuuacucacucgcacccaugggcaccggcaacggcagacgccgagcucaauaa

SEQ ID NO: 37534 - RNA, 1623 nt, Artificial Sequence
  derived and/or modified sequence opt11 from major_capsid_protein__Norovirus__ALM96644
augaaaauggcaucauccgacgccaacccuagcgacggcagcacagccaaccuaaucccggaaguaaacaacgaagucauggcccuugaacccgucgucggagccgcaaucgcagccccagucgccgggcaacaaaacguaauagaccccuggauccgcaacaauuucguccaagccccaggcggagaguucacuguaucgccccgcaacgcacccggggaaauacucuggucugccccucucggcccagaccuuaaccccuaccucucacaccuagcaagaauguacaacggcuacgccggaggguucgaaguccaagucauacucgcgggaaacgccuucacagcaggaaaaaucaucuucgcugcaguuccacccaacuucccaaccgaaggccuuucccccucacaagugaccauguucccacacaucaucguggauguacgucaacucgaaccaguccucaucccccugccagacguaagaaacaauuucuaccacuacaaccaaagcaacgacuccaccaucaagcucaucgcuaugcucuacacaccccuucgcgcaaacaacgccggagacgacaucuucaccgucagcugccgcguacuaacacgaccauccccagacuucgacuucauuuuccucgucccacccaccgucgaaucucgcacuaaacccuucuccguacccguccucaccgucgaagaaaugacuaacucccgcuuccccaucccccucgaaaaacucuucacaggacccuccucagcccucguaguccaaccccagaacggacgaugcacaaccgacggaguccuacucggcaccacccaacuuuccccagucaacauaugcacauuccgcggcgacgucacccacauccccggcucccgcaacuacacaaugaacuuagccucccaaaacuggaacucuuacgaccccaccgaagaaauaccagcaccccucggcaccccagacuucgucgguaaaauacaaggaguccuaacccaaaccacccgaaccaauggcagcacccgcggacacaaagccaccguuuauacaggcucagcagacuucucccccaaacucggccgcguccaauucgccaccgacacagacaacgacuucgaaaccaaccaaaacacaaaauucacccccguaggcgucauccaagacggcagcaccacaccccgcaacgaaccccaacaguggguccuccccuccuacuccggacgcaacauccacaacguccaccuagcccccgcaguagcccccaccuucccuggagaacaacuccuuuucuuccgauccaccaugccaggcugcucugguuaccccaacauggaccucgauugccucuuaccucaagaauggguccaauacuucuaccaagaagccgcaccagcacaaucagacgucgcacuauuaagauucguaaaucccgacaccggccgcguccuauuugaaugcaaacuacauaaaucgggcuaugucaccgucgcccacaccggccaacaugaucuaguaaucccgcccaacggcuacuuccgcuucgacuccuggguaaaccaauucuacacccucgcccccauggguaacggcaccggucgccgacgcgcccucuaa

SEQ ID NO: 37535 - RNA, 1623 nt, Artificial Sequence
  derived and/or modified sequence opt11 from major_capsid_protein__Norovirus__ALM96645
augaagauggcaucaucugaugcaaaccccuccgacgguuccaccgccaaccucguacccgaagucaacaacgaaguaauggcacucgaacccgucgucggcgcagcaaucgcagccccaguagcaggccaacagaacguuauagaccccuggauccguaacaacuucguccaggcccccggaggagaauuuaccgucucuccccgcaacgcucccggagaaauccucugguccgccccucuuggcccugaccucaaccccuaccuaucucaccuagcccgcauguacaacggcuacgccggcggcuucgaaguccaaguaauccucgcaggcaacgccuucaccgccgguaaaaucaucuuugccgccguaccacccaacuuccccaccgagggucugagucccucacaagucacuauguucccccacaucauaguagacguccgccagcucgaacccguacucaucccccuucccgacguccgaaacaacuucuaccacuacaaccaauccaacgacuccaccaucaagcucaucgccaugcuuuacacuccccuacgcgccaacaacgccggcggagacgucuuuaccgucuccugccgcgucuuaacccgccccuccccagacuucgacuucaucuuucuaguucccccaaccgucgaaucucgaaccaaacccuucuccgucccuguccucaccguagaagaaaugaccaauucgcgcuuccccaucccccuugaaaagcuauucacaggcccauccagcgccuucgucguccaaccccaaaacggcagaugcaccaccgauggaguccuacuaggcaccacccaacucuccccagucaacaucugcacguuccgcggugacguaacucacauccccggcucccgcaacuacaccaugaaccucgccucccaaaacuggaacuccuacgaccccaccgaagaaaucccagcaccacucggcacucccgacuucguaggcaaaguucagggugucuuaacacaaacaacccgcacaaacggcagcacucgaggucacaaagccaccgucuauaccggcuccgcagacuucucacccaagcuaggccgaguucaauuugcaacagauacagacaacgacuucgagacaaaccaaaacaccaaauuuaccccugucggcgucauccaagacggcagcacaaccccacgcaacgaaccacagcaguggguccuucccucauacucaggucgaaacauucacaacguucaccucgcccccgcagucgcccccaccuuccccggcgaacaacuccuauucuuccgauccaccaugccagguugcuccggcuaccccaacauggaccucgacugucuccuaccacaagaauggguccaauacuucuaccaagaagcagcccccgcacaauccgauguagcacuccuccgcuucguuaaccccgacaccguucgcguacucuucgaaugcaaacuccacaaauccggcuacguaaccgucgcccacaccggccagcacgaccucgucauacccccaaacggcuacuuccguuucgauucaugggucaaucaauucuacacacuagccccuaugggaaacgggacgggacgccgccgcgcccucuaa

SEQ ID NO: 37536 - RNA, 1623 nt, Artificial Sequence
  derived and/or modified sequence opt11 from major_capsid_protein__Norovirus__ALM96646
augaaaauggccucaaaugacgcuaaccccuccgacggcucagccgccaaccucguacccaaagucaacaacgaaguuauggcccucgaacccgucgucggcgccgccauugccgccccugucgccggccaacaaaacguuaucgaccccuggaucaaaaacaacuucguucaagccccuggcggaaaauucacagucucccccaaaaacgccccaggugaaauacuauggucagcuccccugggaccagaucuuaaccccuaccucucccaccucgcccguauguacaaaggccacgcuggcggcuucgagguccaagucauccucgccggcaacgccuucacagcaggcaaaaucaucuucgccgccgugcccccaaacuuuccaaccgaaggccuauccccuagccaagucacaauguuuccacacauaaucgucgacguacgacaacucgaacccguccucaucccccuaccugacguccgaaacaacuucuaccacuacaaccaaagcaacgacuccaccauaaagcuaaucgccaugcucuacacaccccuacgagccaacaacgccggcgaagacgucuucaccguauccugccgcguccucacacgacccagccccgauuucgacuucauauuccucgucccacccaccguagaaucucgaaccaaaccguucacaguacccauccuaaccguugaagaaaugacaaacucccgguuccccaucccacucgaaaaauuauucacuggcccauccuccgcauucgucguacaaccacaaaacggccgcugcaccacugacggaguccuccucggaaccacccaauuaucccccguuaacauaugcacauuccgcggagacgucacccauaucgcaggaucccggaacuauacaaugaaccuagcaucucucaacuggaacaacuacgacccaaccgaagaaauccccgcaccccucggaacacccgauuucguaggcaaaauccaaggcguacucacacaaaccacaaaaggcgacggcuccacccgcggacacaaagcaaccgucuacacaggaucugcccccuucacccccaaacucgguuccguccaauucucaaccgacaccgaaaacgacuuugaaacacaccaaaauacaaaguucaccccaguaggcguuauccaagacggaggaacaacccaccgaaacgagccccaacaauggguccuccccuccuacucaggucgcaacguaccaaauguccaccuugcacccgccgucgcaccaaccuuucccggcgagcaacuacucuucuuccgcucaacaaugcccggcugcucaggcuacccgaacauggaccuagacugccuacuuccccaggaauggguacaacacuuuuaccaagaagccgcccccgcacaaucagacgucgcccuccuucgauucgucaacccggacaccggccgaguccucuucgaaugcaaauuacacaaauccggcuacgugacagucgcgcacaccggccaacacgaccuagucaucccacccaacggauacuucagauucgacagcugggucaaccaauucuacacacucgccccaaugggcaacggcacaggacgccgccgcgcccucuaa

SEQ ID NO: 37537 - RNA, 1623 nt, Artificial Sequence
  derived and/or modified sequence opt11 from major_capsid_protein__Norovirus__ALM96647
augaagauggcaagcaaugacgccaaccccucagacggcucugcagccaaccucgucccuaaagucaauaacgaagucauggcccucgaaccagucguaggugccgcaaucgcagcacccgucgccggccaacaaaacgucaucgaccccuggauccgcaacaacuuuguacaagcaccaggaggaaaauucaccguauccccacgcaacgcacccggagaaaucuuaugguccgcuccccucggacccgaucuuaaccccuaccucucccaccucgcccgcauguacaacggcuacgccggcggcuucgaaguccaaguuauccucgccggcaaugccuucaccgcgggcaaaauaauauucgcugccguaccacccaacuuccccacagaaggccucucccccucacaaguaacaauguucccccacaucaucgucgacgucagacaacuagaaccaguccuaaucccccuccccgauguccguaacaacuucuaccacuacaaucaaagcaaugacuccaccauaaaacucaucgccaugcuuuacacaccccuccgcgcaaacaacgcaggcgaagacgucuucaccgucuccugccgcguacuaacccgcccaagucccgacuucgacuucaucuuccuaguaccacccaccgucgaaucccgcacaaaacccuucacagucccuauccucaccgucgaagagaugacaaacuccagguuccccaucccccucgaaaaacucuucaccggacccucgggagccuucgucguccaaccccaaaacggccggugcacaacagacgggguacuccucggaacaacacaacucucaccugucaacaucugcaccuuucgcggcgacgugacccacaucgccggcuccagaaacuacaccaugaaccucgccucacucaacuggaacaacuacgacccaaccgaagaaaucccagcaccacuuggcacucccgacuucguuggcaaaauacaaggcguccucacucaaacuaccaaaggcgacggcucaacacguggccauaaagccaccgucuacaccggaucagcccccuucacacccaaacucggcuccguacaauucuccaccgacaccgaaaacgacuucgaaacacaccaaaauacaaaauucacccccgucggagugauccaagacggcggcaccacccaucguaacgaaccccaacaauggguccuaccuuccuacuccggccgcaacguccauaacguucaccucgcccccgccgucgcccccacauuccccggagaacaacucuuauucuuccgaucaaccaugccaggcugcucaggcuaccccaacauggaucuagacugucuacucccacaagaauggguccaacacuucuaccaagaagcugcaccagcccaauccgacgucgcccuacuccguuucgucaacccagacacaggacguguacucuuugaaugcaaacuacacaaguccggcuacguaacuguugcacacaccggucaacacgaucucgucaucccaccaaacgguuacuuccgcuucgacagcugggucaaccaauucuacacacucgcccccaugggaaacggaacaggccgccgccgagcccuauaa

SEQ ID NO: 37538 - RNA, 1623 nt, Artificial Sequence
  derived and/or modified sequence opt11 from major_capsid_protein__Norovirus__ALM98891
augaaaauggccucuaacgacgcagcucccuccaacgacggcgccgccggccuaguacccgaaggaaacaacgaaacacucccccucgagcccguagccggcgcugcaaucgccgcaccagucaccggccaaaacaacauuaucgaccccuggauccgcacaaacuucguccaggcaccaaacggcgaauuuaccgucucgccccgaaacucccccggcgagauccugcuaaaccucgaacuaggcccagaccucaaucccuaccuagcccaccucagccgaauguacaacggcuacgccggaggcguagaaguccaaguacuacuugcaggcaacgccuucacagccggaaaaauccuuuucgccgccgucccucccaacuuccccguagaguuccucucccccgcccagauuacaaugcucccgcaccuuaucgucgacguacgcacccucgaacccauaaugauaccccuacccgacguccgcaacaccuucuuccacuacuccaaccaacccaacuccagaaugcgccugguagcaaugcuguacacaccccuccgcucuaacggcuccggcgaugacgucuucaccguaagcugccguguccucaccagaccaacccccgacuucgaguucaccuaccuagucccucccuccgucgaauccaaaaccaaacccuucucccuaccaauccucacccucucagaacucaccaacucccgcuucccuguccccaucgacucucuauucacagcccagaacaacguccuccaaguccaaugccaaaacggccgcuguaccuuagacggcgaacuccaaggcaccacccaacuacucccauccggcauaugcgccuuccgcggacgugucaccgcccaaaucaaccaacgagaucgcuggcacaugcaacuccaaaaucucaacggcacaaccuacgaccccacagaugacguacccgcuccucucggaacccccgacuucaaaggcguagucuucggcauggucucccaacgcaaugucgguaacgacgcucccggauccacccgagcccaacaagccugggucagcaccuauucaccacaauucguaccaaaacucggcucagucaaccuccgcaucuccgacaacgacgacuuccaauuccagcccacaaaauucaccccuguaggaguuaacgacgacgacgacggccaccccuuccgacaaugggaacuaccaaacuacuccggcgaacuuacacucaacaugaaccuagccccgcccgucgcacccaauuuccccggcgaacaacuccuauucuuucgcuccuucguccccugcucaggcggcuacaaccaaggcaucauugacugccucaucccccaagaauggauccaacacuucuaccaagaaagcgcacccucacaaucagacgucgcccuuauccgauauguuaaccccgacaccggucgcacccucuucgaagccaaacuacaccgcucaggcuauaucaccguagcccacucaggcgacuacccccuagucguucccgccaacggccacuuccgauucgacucgugggucaaccaauucuacucgcucgccccuaugggcaccggaaacggcagacgccgugcacaauga

SEQ ID NO: 37539 - RNA, 1623 nt, Artificial Sequence
  derived and/or modified sequence opt11 from major_capsid_protein__Norovirus__ALM98892
augaaaauggcauccaacgacgccgccccauccaacgacggcgcagccggccuaguccccgaaggaaacaacgaaacucuaccccuagaacccgucgcuggcgcagcaaucgccgcacccgucacaggucaaaacaacaucauagacccuuggauucgcaccaacuucguccaagcccccaacggagaauuuaccgucagcccccgcaacucccccggcgaaauccuucucaaucucgaacucggcccagaccugaaucccuacuuagcacaucucuccagaauguacaacgguuacgcaggcggugucgaaguccaaguacuccuagcaggcaacgcauucaccgcuggcaaaauccucuucgcagccguaccacccaacuuccccgucgaauuucucucccccgcgcaaaucaccauguuaccgcaccucauaguagacguuagaacucucgaacccaucaugaucccacuccccgacguccgcaacaccuucuuccauuacuccaaucaacccaacucucgcaugcgacuugucgccaugcucuacacaccacuccgcuccaacggaucaggcgacgacguauucaccgucaguugcagaguccucacccgccccaccccggacuucgaauuuaccuaccucguaccacccuccgucgaauccaaaaccaaaccauucucucuccccauccucacccucuccgaacucacgaacucucgcuuccccguccccaucgacucacuauucacagcccaaaacaacguccuccaaguccaaugccaaaacggccgcugcacacuggacggcgaacuccaagggaccacccaacuccuaccauccgguaucugugcauucagaggucgcgucaccgcccaaaucaaccaacgcgaccgauggcacaugcagcuccaaaaucuaaacggcacuaccuacgaccccacagacgacguacccgcuccacucgggacccccgacuucaaaggcguaguauucggcauggucucccaacgcaacguaggcaacgacgcccccggauccacccgagcacaacaagccugggucucaaccuacagcccccaguucguccccaaacucggcuccguaaaucuacggaucuccgacaacgacgauuuccaauuccaacccaccaaauucaccccaguaggcguaaacgacgaugacgacggccaccccuucagacaaugggaacucccaaacuacuccggagaacugacccucaacaugaaucucgccccucccguagcccccaauuuccccggcgaacaacuacucuucuuccgcucuuucguccccugcaguggaggcuacaaccaagguauuaucgacugccucaucccacaagaauggauucaacauuucuaccaagaauccgcccccucccaaucagacgucgcacucauccgcuacguaaaccccgacacaggccgcacccuauucgaagcuaaacuacaccgaucaggcuacaucaccgucgcccacuccggcgacuauccccuagucguccccgccaacggccacuuccgauucgacucuugggucaaccaauucuacucccucgccccuaugggaaccggaaacggccggagacgcgcacaauaa

SEQ ID NO: 37540 - RNA, 1623 nt, Artificial Sequence
  derived and/or modified sequence opt11 from major_capsid_protein__Norovirus__ALM98893
augaaaauggccuccaacgacgccgcccccagcaacgacggcgccgcaggccuugucccagaaggcaacaacgaaacccucccccucgaacccgucgcaggcgccgccaucgcagcccccgucaccggccaaaacaacaucaucgaccccuggauccgcaccaacuucguacaagcccccaacggcgaauuuaccgucuccccucgcaacucccccggcgaaauccuccucaaccuugaacucggaccagaccucaaucccuaccuugcccaccuaucccgaauguacaacggauacgccggcggagucgaaguccaaguacugcuugccggaaacgccuucacagcgggcaaaauacucuucgccgccgucccucccaacuuccccguagaauuucuaucacccgcccaaaucacuaugcucccccaccugaucguagacguacgcacacuagaaccaauaaugaucccccuuccagacguccgcaacacauucuuccacuacuccaaccaaccaaacucccgaaugcgcuuagucgcaaugcuauacacaccacuccgcuccaacggcuccggagacgaugucuucacaguuucaugccgaguccuaaccagacccaccccagacuucgaauuuacuuaccucguacccccuucaguggaaucaaaaaccaagcccuucagccuacccauccuaacccucucagaacucacaaacucccgcuuccccgucccaauagauucccuauucacagcucaaaauaacguacuccaaguccaaugucaaaauggccgcugcacacucgacggagaacuacaaggcaccacccaacuccuccccagcggaaucugcgccuucagaggccggguuaccgcccaaauaaaccaacgagaccgauggcacaugcagcuacaaaaccuaaauggcaccacguacgacccaacagacgacguaccagcaccacucggaacccccgacuucaaaggagucgucuucggaauggucucacaacguaacgucggaaacgacgcccccggcagcacucgagcucaacaagccugggucucaaccuacaguccccaauucguccccaaacucggcuccgucaaccuccgaaucuccgacaacgacgacuuccaauuccaaccaacuaaauucacacccgucggaguaaaugacgacgaugauggacaccccuuccgccaaugggaacucccaaacuacucaggcgaacuaacccuuaacaugaaccucgcacccccgguagcccccaauuuucccggcgaacaacuacuauucuuccgcuccuucguccccugcucaggcggauacaaccaaggcaucauugacugccucaucccacaagaauggauccaacacuucuaccaagaaucugccccaucucaauccgacgucgcccucaucagauacgucaacccugacaccggccgcacucuauucgaagccaaacuccaucgcucuggauacaucacagucgcgcacuccggugacuacccccuagucguaccugccaacggccauuuccgcuucgacagcugggucaaccaauucuauucacuagcaccuaugggaaccggcaacggacgacgccgcgcacaauaa

SEQ ID NO: 37541 - RNA, 1623 nt, Artificial Sequence
  derived and/or modified sequence opt11 from major_capsid_protein__Norovirus__ALM98894
augaagauggccuccaacgacgcagcacccagcaacgacggagcugccggccuaguccccgaagggaauaaugaaacacucccccuagaaccagucgccggcgcagccaucgcagccccuguuacuggccaaaacaacaucaucgacccauggauccgaaccaacuucguucaagcgcccaauggcgaauuuacagucucuccccgaaacucccccggcgaaauccuccucaaccucgaacucggccccgaccucaacccauaccucgcacaccucucccgcauguacaacggcuacgcuggcggcguugaaguacaaguacuacucgccggcaaugcuuucacagcaggaaaaaucuuauucgcagccgucccucccaacuuccccguagaauuucucucccccgcccaaaucaccaugcuuccucaccucaucgucgacguacgaacccucgaacccaucaugaucccacuccccgacguccgcaacaccuucuuccacuacuccaaccaacccaacucacgcaugagacuugucgccaugcucuacacaccccuccgaucaaacggcuccggcgacgacguuuucaccgucucaugccgcguacuaacacgcccaacacccgacuucgaguucaccuaccucguacccccaucugucgaaucgaaaaccaaacccuucucccuccccauccucacgcucuccgaacuaaccaacucccgauuccccguuccuaucgacagccuauucaccgcccaaaacaacguccuccaaguacaaugccaaaacggacgcugcacccuugacggcgaacuccaaggcaccacccaacuucuaccauccggcaucugcgccuuccgcggacgagucacggcacaaaucaaccaacgcgaucguuggcacaugcaacuucaaaaccucaacggcaccaccuacgacccuaccgacgacguccccgcuccacuaggcacccccgacuucaaaggagucguuuucgggauggucucacaacgcaacguuggaaacgacgcccccggcuccacccgcgcucaacaagccugggucagcaccuacagcccucaauucguacccaaacucgguucagucaaccucagaaucuccgacaacgacgacuuccaauuccaaccuacuaaauucaccccugucggagucaacgacgacgacgacggccacccauuccgacaaugggaacucccaaacuacagcggcgaacuaacccucaauaugaaccuagccccacccgucgcccccaacuuccccggcgaacaacuauuauuuuuccgcuccuucgucccaugcuccggcggauacaaccagggcaucaucgacugucuaaucccacaagaauggauacaacacuucuaccaagaauccgcuccaucccaauccgacguagcccucauccgcuacgucaaccccgauacaggcagaacccuauucgaagccaagcuacaccgauccggauacaucacagucgcccacuccggcgacuauccccuaguagucccagccaacggccacuuccgauucgacuccugggucaaccaauucuacucccucgccccaaugggaaccggaaacggacgacgucgcgcucaauaa

SEQ ID NO: 37542 - RNA, 1623 nt, Artificial Sequence
  derived and/or modified sequence opt11 from major_capsid_protein__Norovirus__ALM98895
augaaaauggccucuaacgacgcagcccccuccaacgacggagcagcaggacucguccccgaaggcaacaacgaaacccucccacucgaaccagucgcaggagcagccaucgcggcccccgucacuggacaaaacaacauaauagacccauggauccgcacaaacuucguccaagcccccaacggagaauuuaccguaucuccccguaacagcccaggcgaaauccuacuaaaccuagaacucggccccgaccucaacccuuaccucgcacaccucucccgaauguauaacggcuacgccgguggcgucgaaguucaaguccuacuugcaggcaacgccuucaccgccggaaaaauccuauucgccgccguacccccaaacuuccccgucgaauuucucagccccgcccagauaacaaugcucccacaccucauagucgacguccgcacccucgaacccaucaugaucccacucccagauguccgcaacacuuucuuccacuacucuaaccaacccaacucacgcaugagacucgucgccaugcuuuacacaccccuacgauccaacggaagcggcgaugacgucuucaccgucagcugccgaguccucaccagacccacacccgacuucgaguucaccuaccucgucccacccucagucgaaucaaaaaccaaacccuucucacuccccauccuaacucucucagaacuuacaaacucccgcuuccccguccccaucgacucacucuucaccgcacaaaacaacguucuacaaguccaaugccaaaacggacgaugcacccuagacggagaacugcaaggcacaacacaacuccuccccuccggaauuugcgccuuccgcggcagagucaccgcucagauuaaccaacgcgacagauggcauaugcaacuucaaaaucucaacggcacuacguacgacccaacagaugacgucccagccccauuagggacaccagacuucaaaggagucgucuucggcauggucucacagcgaaacgucgguaaugacgcucccggauccacucgagcucaacaggcuugggucucaaccuacucaccccaauucgucccaaaacuaggcuccgucaaccugagaaucagcgacaacgaugauuuccaauuccaacccacuaaauucacccccgucggcgucaacgacgacgacgacggacacccuuuccgucaaugggaacucccgaacuacuccggagaacuaacccucaacaugaaccuagcacccccugucgccccuaacuucccuggagaacagcuccucuucuuccgcucuuucguccccugcagcggcggcuacaaucaagguaucaucgacugccucaucccacaagaauggauccaacacuucuaccaagaauccgcccccucacaaucugacgucgcccucauccgcuacgucaaccccgacacaggacgcacccucuucgaagccaagcuccaccgcuccggcuacaucaccguugcccacuccggugauuacccccuagucguacccgcgaacggccacuuccgcuucgacucaugggucaaccaauucuacucccucgcccccaugggcaccggcaauggucgccgccgagcccaauaa

SEQ ID NO: 37543 - RNA, 1623 nt, Artificial Sequence
  derived and/or modified sequence opt11 from major_capsid_protein__Norovirus__ALM98896
augaagauggccuccaaugacgcggccccuucaaacgacggcgcagccggccuaguccccgaaggcaacaacgaaacccucccacuagaaccaguugccggagccgcuauagccgccccagucacuggccaaaacaacaucaucgaccccuggauccgcacaaacuucguacaggcacccaacggcgaauuuacaguaucaccccgcaacucccccggugagauucuccucaaucuagaacucggcccagacuuaaacccauaccuagcacaccucucacgaauguacaacggcuacgccggaggcguagaaguccaaguacuucuagccgguaacgccuucaccgccggcaaaauccuauucgccgcaguaccacccaacuuccccgucgaguuccucucccccgcucaaauaaccaugcucccccaccucaucgucgauguccgcacacucgaaccaaucaugauuccccuacccgacguccguaacacauucuuccacuacuccaaccaacccaacuccagaaugcgccuggucgcaaugcuauacacaccccuucgaucuaacggcucaggcgacgacgucuucaccguaagcugucgcguccucacccgaccaacccccgauuucgaguucaccuacuuagucccacccucaguggaauccaaaacuaaacccuucucucuuccaauccuaacccucagcgaacuuaccaacucccgcuuccccguccccaucgacucccucuucaccgcccaaaacaacguccuucaaguacaaugccaaaacgggcgcugcacccucgacggcgaacuacaaggcaccacacaauugcucccuaccggcauuugcgccuuccgcggccgcgucacugcucaaaucaaccaacgcgaccgcuggcacaugcaacuccaaaaccucaacggcaccacauacgacccaacagacgacguccccgccccacuaggcacgccagacuucaaagguguaguauuuggaauggucagccaacgaaacgucggcaacgaugcccccggauccacccgagcacaacaagccugggucuccaccuauuccccacaauuuguccccaaacucggcuccgucaaccuccgcaucagcgacaacgacgacuuccaauuccaaccaaccaaauucacccccgucggcgucaacgacgaugacgacggccaccccuuccgccagugggaacuccccaacuauuccggagaacucacacucaacaugaaccucgcaccucccgucgcuccaaacuucccaggugaacagcuccuauucuuccgauccuucguacccugcucaggaggauacaaccaaggaaucaucgacugccucauaccccaagaauggauccaacacuuuuaccaagaaagcgcuccaucccaauccgacgucgcacuaauccgcuacgucaacccagacacaggccgcacccucuuugaagccaaacuacaccgcuccggcuacaucaccgucgcccacucaggcgacuacccccucgucguacccgccaacggccacuuccgauuugacucauggguaaaccaauucuacucacucgcccccaugggcacuggcaacggccgccgccgcgcucaauaa

SEQ ID NO: 37544 - RNA, 1623 nt, Artificial Sequence
  derived and/or modified sequence opt11 from major_capsid_protein__Norovirus__ALM98897
augaaaauggccuccaacgacgccgcacccucuaacgacggcgccgcuggccuaguacccgaaggcaacaacgaaacacuaccccuugaacccguagccggcgccgccaucgccgcccccgucaccgggcagaacaacaucaucgaccccuggauccgcacuaacuucguccaagcccccaacggcgaauuuacagucucacccaggaacucccccggagaaauccuccucaaccuugaacuaggcccagaccugaaccccuacuuagcccaccucucccgcauguacaacggcuacgcgggaggaguagaaguccaaguccuccuagcuggcaacgccuucaccgcgggaaaaauacucuucgcagcugucccuccuaacuuccccguagaguuccuaucacccgcucaaaucaccaugcucccccacuuaaucgucgacguacgcacacucgaacccaucaugaucccccuccccgacguccgcaauaccuucuuccacuacuccaaccaacccaacucccgcaugcgccucgucgccaugcucuacacuccucuccgaucaaacggcagcggagacgacgucuucaccguauccugccgcguccuaacgcgcccaacacccgacuucgaauuuaccuaccucguuccuccauccguugaaucuaaaacuaaaccauucucacucccuauccucacccuuucagaacuaaccaacucccgauuccccguucccaucgacucccucuucacugcccaaaacaacguccuccaaguccaaugccaaaacggucgcugcacccuugacggcgaacuccaaggcacaacacaacuccuccccuccggcauaugcgcauuccgcggucgcgucaccgcucaaaucaaccaacgcgaccguuggcacaugcaacuccaaaaccucaacggcacaaccuacgaccccaccgacgacguacccgcaccccucggcacccccgacuucaaaggcguagucuucggaauggucucucaacgcaacgucggcaacgacgccccaggcucuaccagagcccaacaggcauggguuucuacauacuccccucaauucguccccaaacucgguucagucaaccuccgaaucucagacaacgacgacuuucaauuccaaccaacaaaauucacccccgucggcgucaacgacgacgacgacggccacccauuccgccaaugggaacuccccaacuacucuggcgaacucacccuuaacaugaaccucgccccucccgucgccccaaacuuccccggcgaacaacuacucuucuuccgcagcuucguacccuguucuggaggcuacaaccaaggcaucaucgacugccuaaucccacaagaauggauccaacacuucuaccaagaaucagcacccucccaaagcgacguagcccuaauccgauacguuaaccccgacaccggucgcacccuauucgaagcaaaacuccaccgauccggauacaucacagucgcccacuccggcgacuacccacuugucgucccagccaacggacacuuccgauucgacucauggguaaaccaauucuacucacucgcucccaugggcacaggcaacggccgccgccgagcccaauaa

SEQ ID NO: 37545 - RNA, 1623 nt, Artificial Sequence
  derived and/or modified sequence opt11 from major_capsid_protein__Norovirus__ALM98899
augaaaauggccucaaacgacgccgcacccucuaacgauggagccgcuggccucguacccgaaggcaacaacgaaacccuaccacuagaacccguugcaggagccgcaaucgcagcccccgucacuggacaaaauaacauaauugacccauggauacgcaccaacuucguccaagccccuaauggagaguucaccgucuccccacgaaacuccccaggagaaauccuccucaaccuugaacucggucccgaccuuaaccccuaccuagcccaccucagccgcauguacaauggcuacgccggaggggucgaaguccagguccuacucgcaggaaaugcauucacugcaggcaaaauccucuucgcagccguacccccgaacuuccccgucgaguuccucuccccggcccaaaucaccaugcucccacaucucaucgucgacguccgaacccucgaacccaucaugaucccccuaccagacguacgaaacaccuucuuccacuacuccaaccaacccaacagccgcaugcgacuugucgcaaugcucuacacaccacuccggucuaacggcuccggcgacgacguuuuuaccgucuccugccgaguccuuaccagacccacacccgacuuugaguucacauacuuaguuccacccucaguagaauccaaaacaaaacccuucucucuucccauauuaacccucucagaacucaccaacucccguuuccccguccccaucgacucccucuucaccgcacaaaacaacguccugcaaguccaaugccaaaacggacgaugcacccuagacggcgaacuccaaggcacaacucaacuccuaccaucuggcaucugcgccuuucgaggcagagucacagcccaaaucaaccaacgcgaccguuggcacaugcaacuccaaaaccucaacggaacaaccuacgacccaacagacgauguccccgcuccccuuggaaccccagacuucaaaggagucguauucggcauggucagccaacguaacguaggcaacgacgccccaggcucaacccgagcacaacaagccugggucagcaccuacuccccucaauucguccccaaacuuggcuccgucaaccuccgcauuuccgacaacgacgacuuucaauuccaacccaccaaauucacucccguaggcgucaacgacgacgacgacggccacccuuuccgccaaugggaacuccccaacuacucaggcgaacuuaccuuaaacaugaaccucgcaccacccgucgcaccaaacuucccaggcgaacaacuccucuuuuuccguuccuucguacccugcuccggcggcuacaaccaagguauaauagacugccucaucccccaagaauggauccaacauuucuaccaagaaucugcccccucucaauccgaugucgccuuaauacgcuacgucaaccccgacaccggaaggacccuuuucgaagccaaacuucaccgauccggcuacaucaccgucgcucacucaggcgacuacccccucguugucccagccaacggccacuuccgauucgacucauggguaaaccaauucuacucccucgcaccaaugggcaccggaaacggucgccgacgagcccaauaa

SEQ ID NO: 37546 - RNA, 1623 nt, Artificial Sequence
  derived and/or modified sequence opt11 from major_capsid_protein__Norovirus__ALM98901
augaaaauggccuccuccgacgcaaacccuuccgacggcucagcggcaaaccucgucccugaagucaacaacgaagucauggcacucgaaccugucgucggcgccgccaucgccgcaccggucgcaggccaacaaaacgucaucgacccauggauccgcaacaacuucguccaagcaccaggaggcgaauuuacugucucaccccgcaacgcacccggcgaaauccucugguccgccccucugggacccgaccucaacccauaccuuucacaccuagcacgaauguauaacggcuacgccggaggcuucgaaguccaagucauccucgcuggcaacgccuucacugcaggaaaaguuauauucgcagccguacccccaaacuucccaacugaaggacuuucgccaucucaagucacaauguucccacacaucguaguagacguccgacaacucgaacccguacucauccccuuacccgacguccguaacaacuucuaccacuacaaccaauccaacgacccaacaaucaaacucaucgccaugcuuuacaccccacuccgagccaacaacgcuggagacgacguuuucacaguauccugccgaguccuaacacgccccuccccugacuucgacuucaucuuccuagucccacccaccgucgaaucccgcacaaaacccuucuccguccccguacuaacuguagaagaaaugaccaacucacgcuuccccaucccccucgaaaaacuguucacaggacccuccuccgccuucgucguccaaccccaaaacggccguugcaccaccgacggcguucugcucggaaccacacaacuaucaccugucaauauaugcaccuuccguggcgacgucacacacaucacagguucacgaaacuacaccaugaaccucgcaucccaaaacuggagcaacuacgauccaacagaagagauaccagcaccccucggcacaccggacuucguaggcaaaauacaagguguacucacucaaaccacacgcacagacggcuccacgcgcggucacaaagccacagucuacacaggcuccgccgacuucgcccccaaacuaggccggguccaauucgaaaccgacaccgacagagacuucgaagcaaaccaaaacacaaaauucacacccguugguguaauccaagauggcggaacaacccaccgaaacgaaccgcaacaauggguucuccccuccuacucaggucgcaacacccccaacguccaccuggcccccgcaguagcacccaccuuccccggcgaacaacuacucuucuuucguucgaccaugcccggcugcuccggcuacccaaacauggaccucgacugccuucucccccaagaauggguacaauacuucuaccaagaagcagcccccgcccaauccgacgucgcgcuccuccgcuuugucaaccccgacaccggacguguccucuucgaaugcaaacuccacaaaucaggcuacgucaccguagcccauaccggacagcacgaccuggucauaccacccaauggauacuucagauucgauucuuggguaaaccaauucuacacccucgcccccaugggcaacggcacuggccgacgacgugcccuauaa

SEQ ID NO: 37547 - RNA, 1623 nt, Artificial Sequence
  derived and/or modified sequence opt11 from major_capsid_protein__Norovirus__ALM98907
augaaaauggccuccuccgacgcaaaccccucagacggcuccgcagccaaccucguacccgaagucaacaacgaagucauggcccucgagccagucgucggagccgcaaucgcagcccccguagcaggacaacaaaaugucaucgaccccuggauccgcaacaacuucguacaagccccugggggagaguucaccgucuccccacgaaacgccccuggcgaaauacuaugguccgcaccccuuggccccgaccucaauccauaccucucccaccucgcacggauguacaacggcuacgccggcggcuucgaaguucaaguaauccuagccggaaacgccuucaccgccggcaaagucaucuucgccgccguaccacccaacuuccccacggaaggccuaucacccucccaagucacaauguucccccauauaguaguugacguacgacaacuagaaccaguccuaaucccacuaccagacguacgcaacaacuuuuaccacuacaaccaauccaacgacccaaccaucaaacuaaucgcaaugcucuacaccccacuacgcgcgaacaacgccggcgacgauguauucacagucuccugucguguauuaacacgccccagcccugacuuugacuuuaucuuccuaguuccaccuacggucgaaucccgcaccaaacccuucucagucccaguccucacagucgaagaaaugacaaacagccgcuucccuaucccucucgaaaaauuauucaccggccccuccuccgccuucgucguccaaccacaaaacggccgcugcaccaccgacggaguccuacuaggcaccacccaacuauccccagucaacauaugcacauuccgcggcgacgucacccauaucacuggaucccgaaacuauacaaugaaccucgccucacaaaacuggucgaacuacgacccaaccgaagaaauccccgccccacuuggcacccccgacuucguaggaaaaauucaaggcguacucacccaaaccacacgcacagacggauccacccgcggccacaaagccacugucuacaccggcuccgcagacuucgcccccaaacuuggcagaguacaauucgaaaccgacacagaccgugacuucgaagcuaaccaaaacaccaaauucacacccguaggcguaauccaagacggaggcaccacacaucgcaacgaaccucaacaauggguacuccccucauauucaggcagaaacaucccuaacguccaucuagccccagccgucgcuccaaccuucccgggcgaacaacuacuauucuuucguucaaccaugccaggaugcucaggcuaccccaacauggaucuagacugccuccucccccaagaauggguccaauacuucuaccaagaagccgcacccgcucaauccgacguagcacuacuacgcuucgucaaccccgacaccggacgcguucuauucgaaugcaaacuccacaaauccggauacguaaccgucgcucauaccggccaacacgaccucgucauacccccuaauggcuacuuccgguuugacuccuggguaaaccaauucuacacucuugcccccaugggcaacggcaccggccgccgccgcgcacucuga

SEQ ID NO: 37548 - RNA, 1623 nt, Artificial Sequence
  derived and/or modified sequence opt11 from major_capsid_protein__Norovirus__ALM98910
augaaaauggccuccucagacgccaaccccucagacggcuccgcagccaaccucguccccgaagucaacaacgaagucauggcccuagaacccgucguuggcgcagccaucgccgccccagucgccggacaacaaaacguuaucgaccccuggauacgcaacaacuucguccaagccccagguggcgaguucacagucagcccccgcaacgccccaggagaaauccucuggucagcaccccuaggccccgaccucaacccauaccucucccaccuagcccgcauguacaacggauacgccggaggauucgaaguccaagucauccuagccggcaacgccuucaccgcaggcaaaguaaucuucgccgccguucccccuaacuuccccacagaaggcuuaucccccucccaagucacaauguucccacacauagucgucgacguccgccaacucgaaccaguccuuaucccccucccagacguacgaaacaacuuuuaccacuacaaccaauccaacgaccccaccaucaaacuaauagcaaugcucuauaccccgcugcgcgccaauaacgcaggagacgacgucuucacaguaucaugcagagugcucacacgcccaagcccagacuuugacuucaucuuccucguacccccaaccguagaaucacgcacuaaaccguuuucggucccuguccucaccgucgaagaaaugacaaacucccgcuuucccaucccccucgaaaaacucuucaccggccccagcuccgcguucguaguacaaccccaaaacggccgcugcacaaccgacggcguccuccucggcaccacccagcuaucacccgucaacaucuguaccuuccgcggcgacguaacccauauaaccggaucacgaaacuacaccaugaaccuggccucccaaaacugguccaacuacgacccuacagaagaaauacccgcaccccucggcaccccagacuucgucggcaaaauacaaggaguucuaacccaaacaacgcgcaccgauggauccacccgcggacacaaagccaccgucuacaccgguuccgcagacuucgccccaaaacuaggacgagugcaguucgaaacugacaccgaccaugacuucgaagccaaccaaaacacaaaauucacccccguaggcgucauacaagacggcggcaccacccaccgcaacgaaccacaacaauggguccucccaucuuacuccggccguaacaccccaaauguccaccuagcucccgcggucgcucccaccuucccaggcgaacaauuacuguucuuccgaucuaccaugccaggcuguucaggcuaccccaacauggaucucgacugcuuacucccacaagaauggguacaauacuucuaccaagacgcugcccccgcccaauccgacgucgcacuacuccgcuucguuaaccccgacaccggccggguccucuucgaaugcaaacuccacaaauccggauacgucaccgucgcccacacaggucaacacgaucucguaauacccccaaacggcuacuuccgcuuugacucaugggucaaccaauucuacacccucgccccuaugggaaacggaacaggacgaagacgagcacuuuaa

SEQ ID NO: 37549 - RNA, 1623 nt, Artificial Sequence
  derived and/or modified sequence opt11 from major_capsid_protein__Norovirus__ALM98913
augaaaauggccucuuccgacgcaaaccccagugacggaagcgcugccaaccugguacccgaaguaaacaacgaagucauggcccucgaaccagucguaggcgcagccaucgccgcccccgucgcuggacaacaaaauguaauagacccuuggaucagaaacaacuucguccaagcccccggcggcgaguucaccguuagcccccgaaacgcaccaggagaaauacucuggagcgcaccccucggcccugaccucaaccccuacuuaucacaccucgcacgcauguacaacggcuacgcuggcggauuugaaguccaagucauccuagcgggcaacgcauucaccgccggaaaagucauauucgccgcugucccuccuaacuuccccacagaaggccucucccccucucaagucaccauguucccccacauagucgucgauguacgccagcucgaaccaguccuuauaccccuaccagacguacgaaacaacuucuaccacuacaaccaaucaaacgacccgaccaucaaacucauagcuaugcuuuacacccccuuacgagccaacaacgccggugacgacguauucaccgucuccugucgcguccucacccgacccuccccagauuucgacuucauauuccuagucccacccaccgucgaaucacgaaccaaacccuucucaguccccguccucaccguagaagaaaugaccaacucacgcuuccccauuccacuugaaaaauuauucaccggccccucuuccgcguucgucguccaaccacaaaacggccgcugcaccacagacggcguccuacuaggaacaacucaacucucacccgucaacauaugcacguuccgaggagacgucacacacaucaccggaucccacaacuacacaaugaacuuagccagccaaaacugguccaacuacgaccccaccgaagaaauccccgcaccccucggcacccccgacuuugucggaaaaauccaagguguacucacccaaacuacacgcacggacgguuccacccgcggccacaaagccaccgucuacaccggcucagccgacuucgccccaaaacucggacgaguucaauucgaaacagacaccgaccgcgacuucgaagcaaaccaaaacaccaaauucaccccagucggaguaauacaagacggcggaaccacccaccgcaacgaaccccagcaguggguccuacccuccuacuccggccgcuccacccccaacguccaucuagcucccgcagucgccccaaccuucccaggagaacaacuacuauucuuuagauccacaaugccggguugcuccgguuaccccaacauggaccuagacugccuccuuccacaagaauggguccaauacuucuaccaagaagccgcuccagcacaauccgacguagcccuccuacgcuucgucaaccccgacaccggccgcguccucuucgaaugcaaacuucacaaguccggcuacgucaccguagcccauaccggacagcaugaccuaguuaucccucccaacggauacuuccgcuucgacagcugggucaaccaauucuacacacuagcacccaugggaaacggcaccggccgccgacgcgcacucuaa

SEQ ID NO: 37550 - RNA, 1623 nt, Artificial Sequence
  derived and/or modified sequence opt11 from major_capsid_protein__Norovirus__ALM98916
augaaaauggcuuccagcgacgcuaaucccuccgacggcuccgccgccaaccucgucccagaaguaaacaacgaagucauggcccuagaaccagucguaggcgccgcaaucgcugcaccagucgcaggucaacaaaacguuauugacccuuggauacgaaauaacuucguacaagcucccggcggcgaauuuacugucucaccccgcaacgcccccggcgaaauucuuugguccgcaccccucggccccgaccuaaacccauaccucucccaccucgcacgcauguacaacggauacgccggaggauucgaaguccaagucauccuggccggaaacgccuucaccgccggcaaaguaaucuucgcugccguacccccaaacuucccuaccgaaggccuuucaccaucacaagucacaauguucccccacauuguagucgacguccgacaacuagaaccaguacucaucccccuccccgacguucguaauaacuucuaccacuacaaucaauccaacgacccuaccauaaaacucauagcaaugcucuacacaccccuccgcgccaacaacgccggcgacgauguauuuaccguaucaugcagaguacuaacucgacccucgcccgacuucgacuucauauuccucguaccgccaaccgucgaaucacgcaccaaaccuuucuccguacccguccucacagucgaagaaaugaccaacucccgcuucccgaucccccucgaaaaacuauucacugggcccucguccgccuucgucguccaaccucaaaacggacgcugcacaaccgacggcguccuccuaggaacaacccaacugucgcccgucaacaucugcaccuuccgaggcgacguaacccacauaaccggauccagaaacuacaccaugaaccuagccucacaaaacuggucgaacuacgacccaaccgaagaaaucccagcaccccucggcacacccgacuuugucggcaaaauucaaggcguccucacccaaacaacacgcaccgacggcuccacgcgaggccacaaagccacagucuacaccggcucagccgacuucgcccccaaacucggacgcguacaauucgaaaccgacacugaccacgacuucgaagcaaaccaaaacacaaaguucacccccguaggcgucauacaagacggcggaaccacacaccgaaacgaaccacaacaauggguacucccaagcuacucaggccgcaacacaccaaacguacaccucgcccccgccgucgcccccacuuuccccggcgaacaacuccucuucuucagauccacaaugcccggaugcaguggcuaccccaacauggaccuagacugccuccucccccaagaauggguacaauacuucuaccaagaagccgcccccgcccaaagcgacgucgcccuucucagauucguuaaccccgacaccggccgcguacucuucgaauguaaacuccacaagucgggauacguaaccguagcccacaccggacaacacgaccucgucaucccucccaacggcuacuuccgcuucgacuccugggucaaccaauucuacacccucgcccccaugggcaacggcaccggucgcagacgagcccucuaa

SEQ ID NO: 37551 - RNA, 1623 nt, Artificial Sequence
  derived and/or modified sequence opt11 from major_capsid_protein__Norovirus__ALT54478
augaagauggccuccuccgacgcaaaccccuccgacggauccgcugcaaaccucguuccggaagucaacaacgaaguuauggcacuagaaccagucgucggagccgcaaucgccgcacccgucgcuggccaacaaaacgucaucgaccccuggauccgaaacaacuucguacaagccccgggaggcgaguucaccguuucacccagaaacgcacccggcgaaauccucugguccgcuccccucggcccagaccuuaaccccuaccucucccaccucgcccgaauguacaacggguacgccggcggcuucgaaguucaagucauacucgccggaaaugccuucacagcaggcaaaguaaucuucgcugccgucccuccgaacuucccaaccgaaggacucucccccucacaagucaccauguucccccacauugucgucgacguucgacaacucgaacccguccuaaucccacuccccgacguccgcaacaacuucuaccacuacaaccaauccaacgacccuaccauaaaacucaucgcaaugcucuacacaccccuccgcgccaacaacgccggagacgaugucuuuaccgucaguugccguguacucacccgcccauccccugauuucgacuucauuuuccuaguaccgccaacaguagaaucccgaaccaagccauucuccguccccguccucaccgucgaagaaaugaccaacucccgauuccccaucccacuagaaaaacuauucacgggccccuccuccgcuuucguaguacaaccccaaaacggccgcugcaccaccgacgguguccuccucggcaccacacaacuaagccccgucaacaucugcacauuucgcggcgacgucacccauauuaccggaucccgcaauuacacgaugaaccucgcuucacaaaacugguccaacuacgaccccacugaagaaaucccagcaccacuaggaacacccgacuucguaggcaaaauccaaggaguccucacccaaaccacaagagccgacggaucuacccgcggacauaaggcuaccgucuacaccggaucugccgauuucgcccccaaauuagggcgcguacaauuugaaaccgacaccgaccacgacuucgaagccaaccaaaacaccaaauuuacacccgucggagucauccaagauggcggaacgacccaucgcaacgaaccccaacaauggguacuccccuccuacucuggucgcaacacuccaaacguccaccuugcaccagccgucgcacccaccuuucccggagaacaacuccuauucuuccgcucaaccaugcccgguugcucaggcuaccccaacauggaccuagacugccuuuuaccccaagaauggguccaauacuucuaccaggaggcagcccccgcccaaucggacguagcacuccuccgcuucgucaaccccgacaccggucgcguccucuucgaaugcaaacuccacaaauccggcuacguuaccguagcccacaccggccaacacgaccuagugauaccacccaacggcuacuuucgcuucgacuccuggguaaaccaauucuacacccucgcucccaugggcaacggaacaggcagaagacgagcccucuaa

SEQ ID NO: 37552 - RNA, 1617 nt, Artificial Sequence
  derived and/or modified sequence opt11 from major_capsid_protein__Norovirus__ALT54488
augaugauggcauccaaagacgccccguccaacauggacggcaccuccggcgccggacaacucgucccagaagucaacgccgcagaaccccuaccucuagaacccgucgucggcgcagccacugcagcggcaacagccggacaagucaauaugaucgacccauggauaaugaauaacuucguacaagcaccggaaggcgaguucacaaucucaccaaacaacacaccaggcgacauccucuucgaccuccgccucggcccacaccucaaccccuucuuacuccaccucucccaaauguacaacgguugggucggaaacaugcgcgugcgcgucaugcuugccggcaaugccuucucagccggcaaaaucauuauaugcugcguacccccaggauucgaaucacaaaauauauccaucgggcaagccacaauguucccccaugucaucgccgacguccgaguccuagaaccaaucgaagucccacuagacgacguccgaaacguucucuuccacacuaacgaaaaucgaccaacuaugcgauuacuaugcaugcucuacacgcccuuacgcgcaggaggcgccuccuccggcaccgacccauucgucauugcaggccgcguacucacuugcccagcccccgacuucaacuuccucuuccucgucccaccauccgucgaacagaaaacccgccaacucaccauccccaacauaccccucaacaaccuagcaaacucucgcguacccgcaaugauaaacaaaaugacggugucugccgaccaaaaccaagucguucaauuccaaaacggcagauguacccucgaaggccagcuccucggcaccaccccagucuccgccaaccaagucgcccgaauacgaggcaaggucuucucaaccaacagcggaaccggccucaaccucaccgaaguugacggcacucccuaccacgccuucgaaucccccgcgccccuaggcuuccccgacauaggcaacugcgacuggcacguauacgccuucaaagucaaccaaaacacaggugaccccauguaccgccucgacauaacacaaggaaacuccuucgccccacaccucggcuccauagaauuuuccucugaaaaccaccccagcggcgaccaacuaggcacacucaccuggaucucaccccucaacaacgccucccgaguagaccccuggaaaauacccaccuauggcucaacccucacagaauccacaaaccucgcaccacccauauucccacccggcuucggcgagagcaucgucuacuucauguccgacuuccccaucgucucuggcaauacagcccaaauccccugcacacucccccaagaauuuguauccucuuucguagaacaacaagcccccauccgcggagaagccgcccuccuacacuauguagacccggauacccacagaaaccucggcgaauuuaaacucuaccccgacggcuucauaacaugcguaccaaacacaggcggcggaccccaaaaccuaccaucaaacggcgucuucgucuucuccuccugggucucccgcuauuaccaacuuaaacccgucggaaccacaggccccguacgacgcuuaggcgucagacgcgucuaa

SEQ ID NO: 37553 - RNA, 1620 nt, Artificial Sequence
  derived and/or modified sequence opt11 from major_capsid_protein__Norovirus__ALT54491
augaaaauggccucaaacgacgccaaccccuccgacggcuccgccgcgaaccucguacccgaagucaacaacgaaguaauggcacuagaaccugucguaggcgcagcaauagcagcuccggucgccggucaacaaaaugucaucgacccauggauccgauccaacuucguccaagcccccggaggagaguucaccgucucaccccggaacgccccaggcgaaauccuaugguccgcuccacucggcccagaccuaaacccuuaccuuagccaccuagcacguauguacaauggcuacgccggaggauucgaaguccaagucauacuagcagggaacgcauucaccgcuggaaaaaucauauucgcagccgucccacccaacuuccccaccgaaggccuaucacccucccaaguuaccauguucccccauaucauaguagacguccgacaacucgaacccguacucauaccccuuccagacguccgcaacaacuucuaccauuacaaccagucuaaagacucaaccaucaaacucauugcaaugcucuacacaccccuaagagccaacaacgccggcgacgacguauucaccgucucaugccgcguccucaccagacccagccccgacuucgacuucaucuuccucgucccucccaccgucgaaucacggaccaaacccuucaccguccccauucucaccgucgaagaaaugaccaacucccgcuuccccaucccauuagaaaaacuguucaccggucccucuaacgccuucguuguacaaccccaaaacgguagguguacuaccgacggcguccuccuuggcaccacccaacucucccccguaaacaucugcaccuuuagaggcgacgucacccagauagccagcacccaaaccuacacaaugaaccuagcuagccucaacuggaauaacuacgaccccaccgaagaaauccccgcccccuuaggagccccagacuucaugggcaaaauccaagguguacuaacccaaaccacccgucaaggcgguuccaccagaggacauaaagccacugucuccacaggcuccguucacuucacccccaaacuaggcuccguccgcuucgacacagacaccaacaacgaccugcaaccucaucaauccacacgauuuacccccgucggagucauccaagacggcgacacccaccaaaacgaaccacaacaaugggcacuuccguguuacucugggcgagacgucaacaauguccaccucgcccccgccgucgcccccucauuccccggcgaacaacuauuauucuuccgaucaaccaugcccggcugcuccggcuaccccaacauggaccuggacugccuccucccacaagaguggguccaacacuucuaccaagaagccgcacccgcccaauccgacgucgcucuccuccgauuugucaaccccgacacaggccgcguccucuucgaaugcaaacuccacaaauccggcuacguuacugucgcccacaccggccaacacaaccucgucauaccucccaacggcuacuuccgcuucgacucaugggucaaccaauucuacacucuagcccccaugggcaacggcaccggccgacgccgaguacucuag

SEQ ID NO: 37554 - RNA, 1620 nt, Artificial Sequence
  derived and/or modified sequence opt11 from major_capsid_protein__Norovirus__ALT54494
augaaaauggccuccaacgacgccaaccccuccgacggaucagccgccaaccucguacccgaagucaacaacgaagugauggcacucgaacccgucgucggagccgcaauagcggcccccgucgcaggccagcaaaacgucaucgaccccuggauacgcuccaauuucguccaagcccccggcggcgaguucaccgucucgccccgcaacgcccccggcgaaauccucuggucagcuccccucggcccagaccucaaccccuaccucucacaccucgcacgcauguacaacggauacgccgggggcuucgaagugcaaguaauccucgccggcaacgcauucacugcaggcaaaauaaucuucgccgccguaccacccaacuuccccacagaaggccucucccccucucaagucaccauguucccccacauuaucguugacguacgccagcuagaacccguacuaaucccccuacccgacguacgcaacaacuucuaccacuacaaccaaucgaaagacuccaccaucaaacuuauagccaugcucuacacgccccuccgugccaacaacgcaggcgacgacgucuucacagucuccugccgcguauuaacccgccccaguccagacuuugacuucaucuuucuaguaccacccacagucgaaucacgcaccaaacccuucaccguacccauccucacaguugaagaaaugaccaacagccgcuuccccaucccccuugaaaaacucuucaccggacccucuaacgcauucgucguccaaccccaaaacggccgcugcaccacagacggaguccucuuaggcacaacacaacuaucccccguaaacaucugcaccuucagaggcgacguuacccaaauagcguccacccaaacuuauaccaugaaccuagccucgcuaaacuggaauaacuacgaccccacggaagaaauccccgccccacuaggagcccccgacuucaugggcaaaauccaaggcguucuaacacaaacaacccgucaagacggcagcacccgcggccacaaagccacagucuccaccggcucaguccacuucacccccaaacucggcuccguaagauuugacacagacaccaacaacaaccuccaaccccaccaaagcacacgcuucacccccguaggcgucauccaagacggcgacacccaccaaaacgaaccccaacaauggguccuacccugcuacuccggacgcgacgucaacaacguccaccucgcucccgcagucgcccccuccuuuccaggagaacaacuccuuuucuuccgcuccacuaugccaggaugcucaggcuacccaaacauggaccucgacugccuccucccccaggaauggguacaacauuucuaccaagaagccgcuccagcucaaucagacgucgcccuacuuagauucgucaaccccgacacgggccgaguccucuucgaaugcaaacuacauaaauccggauacgucacugucgcccacaccggacaacacaaccucgucauaccacccaauggcuacuucagauucgauucaugggucaaccaauuuuacacccuagccccaaugggcaacgggaccggcagacgccgcguucucuaa

SEQ ID NO: 37555 - RNA, 1620 nt, Artificial Sequence
  derived and/or modified sequence opt11 from major_capsid_protein__Norovirus__BAM65003
augaugauggccucaaaagacgccccauccaacauggacgguaccucuggugccggccaacuaguccccgaagucaacgcugcagaaccccucccccucgaacccgucgucggugccgcuaccgcagcagccaccgccggccaaguaaaccucaucgacccauggaucaugaacaacuucguccaagcaccggaaggcgaauucacuaucuccccaaauaacacacccggcgacauccucuucgaucuucaacuuggcccccaccuaaaccccuucuuacaacaccuaucccaaauguacaauggauggguuggcaacaugcgcguacgcguaaugcucgccggaaacgcuuucaccgcuggaaagaucaucaucugcugcgucccuccaggauucgccucacaaaacaucucaaucggccaagccaccauguuuccccacgucaucgccgacguccgcguccuugaaccaaucgaaaucccccuagaugacguaagaaacguacuauuccacaccaacgaaaaccgccccacaaugcgacuccuuugcaugcuauauacaccccuccgcgccggaggcgccucauccggaacugaucccuuugucaucgccggucgaguccucaccugucccucccccgacuucaacuucuuguuccucguaccccccagcgucgaacagaaaacccgccaacucaccguccccaacaucccacucaacaaccuggccaacucccgcguccccgccaugaucaacaaaaugaccgucuccacagaccaaaaucaaguaguccaauuccaaaacggacgcugcacccucgaaggacaacucuuaggcacaaccccagucuccgccucgcaagucgccagaauccgcggcaaaguuuuuuccaccgcuuccggaaaaggccucaaccucacugaacucgacggaacccccuaccacgcauucgaauccccagccccccuaggauucccagauaucggcgccugcgacuggcacgucuccaccuucaaaguagaccaaaaccucucuggcgaccccaugucacgccucgacauaaaacaaaacgcccccuucgccccccaccucggaucaauugaauucaccuccgaccaagaaccuaccggcgaccaacuaggcacucucgccugggucucucccuccaccuccggagcgcgcguugacccauggaaaauccccucauacggcuccacagucacggaaucuacacaccucgccccccccauauuccccccagguuucggcgaagccaucguauacuucauguccgacuuccccauaguaucuggcaacaccgcgcaagucccaugcacccuuccccaagaauucgucucccauuucgucgaacaacaagccccaauccgcggcgaagcagcccuccuacacuauguagaccccgacacucaccguaaccugggagaauucaaacuauaccccgacgguuucaucacuugcguccccaacaccggcggaggaccccaaaaccucccuauaaacggcguuuucgucuucucauccugggucuccagauacuaccaacucaaacccgucggcaccgcgggcccagcucgccgauuaggcguccgccgagucuga

SEQ ID NO: 37556 - RNA, 1647 nt, Artificial Sequence
  derived and/or modified sequence opt11 from major_capsid_protein__Norovirus__BAM65005
augaaaauggccucaaacgacgccgccccaucaaacgacggagcagccgggcuugucccagaaauaaacaacgaagccauggcccucgacccagucgccggcgccgcuaucgccgccccacuaaccggacaacaaaacauuaucgaucccuggaucaugaacaacuucguccaggccccaggcggagaguucaccguuucaccccgcaacucacccggcgaaguccuccuaaaccuggaacuaggcccagaaaucaacccauaccuugcccaccuagcacgcauguacaacggcuacgccggcggcuucgaaguacaggucguacuagccggcaacgccuucaccgccggcaaaauaaucuucgccgcaaucccacccaacuucccaauagauaaccuaagcgccgcccaaaucacaaugugcccacacguaauuguagacguccgccagcuugaacccgucaaccuccccaugcccgauguacgaaacaacuucuuccacuacaaccaaggcuccgacucccgccuccgccuaauugccaugcuauacaccccacugcgagccaacaauucuggcgacgacguauucacgguaucuuguagaguccuaaccagacccucgcccgacuucucauucaacuuccucgucccaccaacaguagaauccaaaaccaagccguucacccucccaauccucaccauuagcgaaaugucaaacucuagauucccuguacccaucgacucccuacacaccucccccaccgaaaacauagucguacaaugucaaaacggacgcgucacccuagacggagaacucauggguaccacccaacuacuuccaucccaaaucugugcguuccgcgguguccuuacacgcuccaccucccgagccagcgaucaagccgacaccgcaaccccgcgccuauucaacuacuacuggcacauccaacuagacaaccucaacggcacccccuacgaccccgccgaggacauacccggcccacugggaacacccgacuuccgcggaaaagucuucggagucgccucccaacgaaaccccgacuccaccacccgagcacacgaagcuaaaguagacacaacauccggucgcuucaccccaaaacuuggaucccucgaaaucucaaccgaauccggagacuucgaccaaaaucaaccaacacgcuucacacccgucggcaucggaguagacaacgaagccgacuuccaacaauggucccuccccgacuacuccggccaauucacccacaacaugaaccuagcucccgccguagccccuaacuucccaggcgaacaacuccucuucuuccgcucacaacuacccuccuccggaggacgauccaacggcauccucgacugccucgucccacaggaauggguacaacacuucuaccaagaaucagcccccgcccaaacccaaguagcccuaguccgcuacgucaaucccgacaccggacgcguucucuucgaagcaaaacuccacaagcucggcuucaugaccaucgccaaaucaggcgauucaccaauaaccgucccacccaacggguauuuccgcuucgaaucaugggucaauccguucuacacccuagcaccaaugggcaccggaaauggccgccgccgcauacaauag

SEQ ID NO: 37557 - RNA, 1644 nt, Artificial Sequence
  derived and/or modified sequence opt11 from major_capsid_protein__Norovirus__BAM65007
augaaaauggcuucaaacgacgcagccccuagcaacgacggagcagcaaaccuaguacccgaggccaacaacgaggucauggcacucgaaccaguuguaggcgcauccauagcagcccccgucguaggccaacagaauaucauagaccccuggauacgcgaaaacuuuguacaggcgccccaaggcgaguucacagucucaccccgcaacuccccaggagaaauguuacucaaccucgaacuuggccccgaacuuaaccccuacuuaucccaccucuccagaauguacaacggauacgccggcggcaugcaaguacaagucguucuagccggcaacgccuucaccgcuggaaaaaucauauucgccgccgugccaccccacuuccccgucgaaaauaucuccgccgcccaaauuacaauguguccacacgucaucguugacguccgucaacuugaacccguccuccuaccccuucccgacaucaggaacagauucuuccacuacaaccaggaaaacaccccacgcaugcgccuagucgccaugcuauacaccccacuacgcgccaacucaggcgaagacgucuucacaguaucaugcagaguccuaacccgcccagcccccgacuucgaguucaccuuccucguucccccuaccgucgaauccaaaaccaaacccuucacucucccaauccuuacacucggcgaacucuccaacucccgcuucccagcccccaucgacaugcucuacaccgaccccaacgaaggcauagucguccaaccccaaaauggucggugcacccuugacggaacccuacaaggcaccacccaacucgucccaacccaaaucugcgccuuucgcggaacccucaucggccagacaucccgauccucggacuccacugacucugccccacgccggcgcgaccacccccuccauguacaacuuaagaaccucgacggcacacaauacgaccccacagacgaagucccagccguacuuggcgccauagacuucaaagggaccguauucggagucgcaucccaacgcgaugucucaggacaacaagucggagcaaccagagcccacgaaguucauaucaacaccaccgacccccgcuacacccccaaacuaggcuccauccucaugcacuccgaaucagaugacuucgucaccggacaaccaguucgcuucacacccauaggaaugggcgacaacgacuggcaccaaugggaacucccagacuacuccggccaccuaacacuuaacaugaaccuagcccccgccgucgcacccgccuuccccggcgaacgcauacuauucuuccguuccaucguacccagcgcaggggguuacgguuccggccaaaucgauugccucauaccucaagaaugggugcagcacuucuaccaagaagcugccccaucacagagcgcaguagcccucauucgcuacguuaaccccgacaccggccgaaacauauucgaagcuaaacuacacagagaaggauucauuaccguagccaauuccggaaacaacccuaucgucgucccaccaaacggauacuucagauucgaagcauggguuaaccaauucuacacccuaacccccaugggcacaggacaaggucgccgccgcaaccaauaa

SEQ ID NO: 37558 - RNA, 1623 nt, Artificial Sequence
  derived and/or modified sequence opt11 from major_capsid_protein__Norovirus__CCX28604
augaagauggcuucgucugacgcaaaccccuccgacggcuccaccgccaacuuagucccagaaguaaacaacgaagucauggcccucgaaccagucgucggcgccgccauagcagcccccguagccggacaacagaaugucaucgaccccuggauacgaaacaacuucguacaagcuccuggaggcgaguucaccguuucaccucgcaaugcccccggugaaauccuauggucggcaccccuuggaccagaccucaaccccuaccuaucacaccucgcccgaauguacaacggcuacgccggaggcuucgaaguccaaguuauucucgccggcaacgccuucaccgccggcaaaauaauauucgccgcagugccacccaacuuccccaccgaaggccuaucccccucucaagucaccauguucccccacaucaucguagacguccgccaacucgaacccguccuaaucccccuacccgacguucgcaacaacuucuaccacuauaaccagagcaacgacuccaccauaaaacuaaucgcaaugcucuacacaccccuccgcgccaacaaugccggagacgacgucuucaccgucuccugccgaguccucacccgacccucccccgacuucgacuuuaucuuccucguaccucccacagucgaaucccgaaccaagcccuucagcguccccguacucaccgucgaagaaaugaccaacucccgauuccccauuccccuagaaaaacuauucaccggccccuccucagcauucguaguccaaccacaaaacggccgcugcaccaccgacggaguucuacuaggcaccacacaacuauccccugucaacaucugcacauuccgcggagacguaacccacaucccaggaucucguaacuacacaaugaaccucgcaucccaaaacuggaacucuuacgaccccaccgaagaaauacccgccccacuaggcaccccagacuuugucggcaaaauccaaggcguccucacccaaacgacccgcacaaacggcucaacccgcggccacaaggcaacagucuacacaggcagcgcugacuuuuccccaaaacucggucgcguacaauucgcaaccgauaccgacaacgacuucgaaacuaaccaaaacacaaaguucacccccguaggcgucauacaagacggauccaccacaccccguaacgaaccccaacaauggguacuccccuccuacuccggccgcaacauccacaacguccacuuagcccccgcaguagcacccaccuuccccggcgaacaacuccucuucuucagauccaccaugccaggcugcuccggcuaucccaacauggaccuagacugccuccugccucaagaauggguacaauacuucuaccaagaagccgcccccgcccaauccgacgucgcccugcuuagauucguaaaccccgauacuggccgaguccucuucgaaugcaaacuccacaaaucaggcuacgucaccgucgcccacaccggccaacacgaccucgucauaccaccuaacggcuacuuccguuucgacucaugggucaaccaguucuacacucuagcaccuaugggcaacggcaccggcagacgucgcgcccucuaa

SEQ ID NO: 37559 - RNA, 1623 nt, Artificial Sequence
  derived and/or modified sequence opt11 from major_capsid_protein__Norovirus__CCX28607
augaaaauggccagcucugacgcaaaccccucagacggcuccacagccaaccuagucccagaagucaacaacgaggugauggcccucgaaccuguuguaggugccgccaucgccgcccccgucgccggucaacaaaauaucauagaucccuggauccgcaacaacuucguacaagcaccaggcggagaauuuacugucucaccccgcaacgcaccaggcgaaauccucugguccgcuccccucggucccgaccucaaccccuaccucucacaccuagcccguauguacaacggcuacgcaggcggcuucgaaguccaaguaauccucgccggcaacgccuucacagccggaaaaaucaucuucgccgcgguaccucccaacuuccccaccgaaggccucagccccucccaggucaccauguucccucacauuauagucgacguccgccaacuagaaccaguccuaguaccccuccccgacguccgaaacaauuuuuaccacuacaaccaaucaaacgauccaacuaucaaacucauagcaaugcucuacaccccacuacgugcaaacaacgccggcgacgacguauucacagucagcugccgcguccucacccgcccaucuccagacuucgauuucaucuuccucgucccacccacuguagaaucacguaccaaacccuucuccguccccauccuaacaguugaggaaaugacuaacucccgauuccccaucccacucgaaaaacuauucaccggcccaucaagugccuucgucguccaaccucaaaacggacgcugcacuaccgacggaguacuccuaggaacaacacaauuaucaccuguuaacaucugcacauuccgaggagacgucacacacaucgcuggcucccgcaauuacaccaugaaccucgccucccaaaacuggaacucauacgaccccaccgaggaaauccccgccccucuuggcacccccgacuucgucggcaaaauacaagguguacucacacaaaccacccgcaccgacggcagcacccgcggccacaaagccacugucuacaccggcucagcagacuucucacccaaacucggacgcguacaauuugccaccgacacagacaacgacuucgaagccaaccagaacaccaaauucacuccggucggagucauacaagacggcuccaccgcccaccgcaacgaaccccaacaauggguccuuccauccuacuccggccgcaacauacacaacgugcaccucgcacccgcaguagccccaaccuucccuggcgaacaacuccuauucuuucgcucaacuaugccagguugcuccgguuacccaaacauggaccuagauugccuacuaccacaagaauggguccaauacuucuaccaagaagcugcccccgcccagucugacgucgcccuccuccgguucgucaaccccgacaccggacgaguccuauucgaaugcaaacuccacaaaccgggauaugucaccgucgcacacacaggacaacacgaccuagucauaccacccaacggauacuuccgauucgacuccugggucaaccaauucuacacacuagcccccaugggaaacggaaccggccgacgacgcgcucucuaa

SEQ ID NO: 37560 - RNA, 1623 nt, Artificial Sequence
  derived and/or modified sequence opt11 from major_capsid_protein__Norovirus__CCX28619
augaaaauggccucaucagacgccaaccccuccgacggcucaaccgcuaaucuagucccagaaguuaacaacgaagucauggcccucgaacccguaguaggcgccgcaaucgccgccccugucgccggccagcagaacguuaucgaccccuggauccgcaacaauuucguccaagcccccgguggcgaguucaccgucagccccagaaaugcccccggcgaaauccuuugguccgcaccacucggacccgaucucaaccccuaccucucucaccucgcccgcauguauaacggcuacgccggugguuucgaaguccaaguuauccuugccggcaacgcauucaccgccggaaaaauaaucuucgccgccgucccacccaacuuccccacagaaggccucuccccaucccaagucaccauguucccucacaucaucgucgacguccgccaacuagaacccguacucaucccccuccccgauguccgcaacaacuucuaccacuacaaccaauccaacgacccaacaaucaaacucauagcaaugcuauacacuccccuccgcgccaacaacgccggugacgacguauucaccgucuccugccgaguccuaacccgaccaucccccgauuucgacuucauauuccucgucccacccaccgucgaaucacgcaccaaacccuucucuguacccauccuuacugucgaagaaaugaccaacucacgcuuucccaucccccucgaaaaacuauucaccggcccuaguucagccuucgucguacaaccccaaaacggcagaugcaccaccgacggcguacuccugggcacgacgcaacucuccccuguuaacauaugcaccuuccgcggugacgucacacacaucccaggcucccacaacuacacaaugaaccucgccucacaaaacuggaacucauacgaucccaccgaagaaaucccagcaccucuaggaacaccagacuucguuggcaaaauacaaggaguucucacccaaaccaccagaaccaauggcuccacacgaggccacaaggccaccguauacaccggaagcgcagacuuuuccccaaaacucggccguguccaauucgccaccgacacagacaacgacuucgaaacaaaccaaaacaccaaauucacccccguuggcguuauacaagaugguucuaccacuccccguaacgaaccacaacaauggguccucccaucauacucaggcagaaacauccacaacguccaccuagcacccgccgucgccccaaccuucccuggcgaacaacuacucuucuuccgauccaccaugccaggaugcucaggcuacccaaauauggaccucgacugccucuuaccccaagaauggguacaauacuucuaccaagaagcagcucccgcccaauccgacgucgcccuacuccgauucgucaacccagacaccggccgcguccuauucgaaugcaaacuccacaaauccggcuacgucacagucgcccacaccggccaacacgaccucguaaucccucccaacggcuacuuccgcuucgacuccuggguaaaccaguucuacacccuugcccccaugggaaacggaaccggcagacgcagagcccucuaa

SEQ ID NO: 37561 - RNA, 1623 nt, Artificial Sequence
  derived and/or modified sequence opt11 from major_capsid_protein__Norovirus__CCX28622
augaaaauggcaucaucagacgccaaccccucugacggcucuacagccaaccucguacccgaagucaacaaugaagucauggcacucgaacccgucgucggagcugcuaucgccgccccggucgcaggacaacaaaacgucaucgaccccuggauacgcuccaacuucguccaagcccccggcggcgaguucaccguaucgccccgcaaugcaccaggcgaaauccucugguccgcuccccucggacccgaucuaaaccccuaccucucccaccuagcccgcauguacaauggcuacgccggcggcuuugaaguacaggucauacucgccggcaacgccuuuacagcaggcaaaauaaucuucgcugcuguacccccaaacuucccaaccgaaggccucagccccucacaagucaccauguucccccacaucaucguugauguccgccagcucgaacccguccucaucccccuccccgacguccgcaauaacuucuaccacuacaaccaauccaacgacccaacaaucaaacuuaucgcaaugcuuuacaccccucuacgagcaaacaacgcaggcgacgacguauucaccgucuccugucgcguccuaacccgccccucucccgacuuugacuucauauuccugguaccucccaccgucgaaucacgcaccaaacccuucucuguucccguacuaaccgucgaagaaaugacaaacucccgcuuucccaucccacuagaaaaacucuucacaggccccucuagcgcauucguaguccaaccccaaaacggacgaugcaccaccgacggcguuuuacuuggcaccacccaacucucccccgucaacauaugcacauuccgaggcgacgucacccauaucuccggcucacgcaacuacacgaugaaucucgcagcccaaaacuggaacucuuacgaccccacggaagaaauccccgccccacucggaacacccgacuucgucggcaaaauccaaggcguacuaacucaaaccaccaaaacaaacggcuccacacgcggucacaaagccacugucuacacaggauccgcggacuucucccccaaacucggcagaguccaauucgccaccgauaccgacaacgacuucgaaacaaaucaaaacaccaaauucaccccaguugguguuauccaagacggauccaccacaccccgcaaugaaccccaacaaugggugcuccccuccuacuccggucgcaacacccacaacguucaccucgcucccgccgucgcacccaccuucccaggggaacaacuacucuucuuccggagcaccaugccaggaugcagcggauaccccaacauggaccuagacugccuccuaccacaagaauggguccaauacuucuaccaagaggcugcgcccgcucaaagugacgucgcccuccuccgcuucgucaaccccgacaccggaagaguccucuucgaaugcaaacuucacaaaucaggauaugucacaguagcccacaccggucaacacgaccucgucaucccacccaacggcuacuuccgauucgacagcugggucaaccaauucuacacgcuagcaccuaugggcaacggaaccggccgacgccgagcccuauaa

SEQ ID NO: 37562 - RNA, 1623 nt, Artificial Sequence
  derived and/or modified sequence opt11 from major_capsid_protein__Norovirus__CCX28625
augaaaauggccuccucagacgccaaccccucggacgguucuacagccaaccucguccccgagguaaacaacgaagucauggcacucgaacccgucgucggagccgccaucgcagcccccguagccggccaacaaaacgucaucgaccccuggauucgcaacaacuucguccaggcaccaggcggcgaguucaccgucucaccccgcaacgcccccggcgaaauccuuugguccgccccucucggucccgaucuaaacccauaccuaucccaccucgcccgcauguacaacggauacgcaggaggcuucgaaguacaagucauccucgcaggcaacgccuucaccgcaggcaaaauuaucuucgccgccgucccaccaaacuuuccaaccgaaggucuaucccccucacaagucaccauguucccccacaucauuguagacgucagacaacucgaacccguacuaaucccccuacccgacguacgcaacaacuucuaccacuacaaccaauccaacgacccaaccaucaaacucaucgccaugcucuacacaccacuccgcgccaauaacgcaggagacgacguuuucaccguaucaugccgcguccucacacgcccaucaccugauuucgacuucaucuuccuuguaccacccaccgucgaaucccguacuaaacccuucuccgucccaauacuuaccguagaagaaaugacuaauucccgauucccaauaccccucgaaaaacucuucaccggccccucgucagccuucgucguccaaccccaaaacggacgcuguacaaccgacggcguccuucuaggaaccacacaacuaucaccugucaacaucugcacuuuccgcggcgacgucacacacauccccggaucccauaacuacacaaugaaccuagccucgcaaaacuggaacuccuacgacccaaccgaagagaucccugccccgcuaggcacccccgauuucgucggcaagauccaaggcguccucacccaaaccacccgcacuaacggaucuacccgcggccauaaagccaccgucuacacaggcucagccgacuucuccccaaaacucggccgcguacaguucgccacagacaccgacaacgacuucgaaaccaaccaaaacacuaaauucaccccagucggcgucauccaagacggcucaacuaccccaagaaacgagccccagcaauggguccuacccucauacagcggacgcaauauccacaacguacaccuugcacccgcuguugcaccuaccuuccccggcgaacaacuccuauucuuccgcuccacaaugccaggcugcucaggcuacccgaacauggaccucgacugucuccuaccccaagaauggguccaauacuucuaccaagaggccgcccccgcccaauccgacguugcccugcuccgcuuugucaacccggauaccggacggguacuuuucgaaugcaaacuucacaaauccggcuacguuaccgucgcccauaccggucaacacgaccuuguaaucccacccaacggauacuucagauucgacuccuggguaaaccaauucuacacacucgcccccaugggcaauggcacuggccgccgccgcgcccucuaa

SEQ ID NO: 37563 - RNA, 1623 nt, Artificial Sequence
  derived and/or modified sequence opt11 from major_capsid_protein__Norovirus__CCX28628
augaaaauggccuccagcgacgccaaccccucagacgguucaaccgcuaaccuaguccccgaaguaaacaacgaaguuauggcacuugaacccgucgucggcgccgccaucgcugcccccguagccggacaacaaaacgucauagauccguggauucguuccaacuucguccaagcccccggaggcgaguucaccguaucgccgcgcaacgcucccggagaaauccuuugguccgccccacucggcccagaccucaaccccuaccuaucccaccuagccagaauguacaacggauacgccggaggauucgaaguccaagucauccuagccggaaacgccuucaccgcaggcaaaaucaucuucgcagccgucccucccaauuuccccaccgaaggucucucccccucccaagucaccauguucccacacauaauaguagauguccgccaacucgaaccaguccucaucccgcuccccgauguccguaacaauuucuaucacuacaaccaaucuaacgaccccaccauaaaacucaucgccaugcuauacacaccacuucgcgcuaacaacgccggcgacgacgucuuuaccguauccugucgcguccuuacccgccccuccccagacuucgacuuuauuuuccucguaccacccaccgucgaaucccgcacaaaacccuuuucaguccccguccucacagucgaagaaaugacgaacucacgauuccccaucccccucgaaaaacucuucaccggacccucaagcgccuucguaguacaaccucaaaacggacgaugcaccacagacggcguacuccucggcaccacccaacuaucaccggucaacauuugcaccuuccgcggagacgucacacacaucuccggcucacgcaacuacaccaugaaccuagccgcccaaaacuggaacucguacgaccccaccgaagaaauacccgcuccccuuggcacgcccgacuucguuggaaaaauccaaggcguacucacucaaaccaccaaaacaaacggcuccacccgcggacacaaagccaccguauacacaggaucugccgacuucagcccuaaacuaggccgcguccaauucgccacagacacagacaacgacuucgaaaccaaccaaaacacaaaauucacaccagucggcgugauacaagacggcuccaccaccccacguaaugaaccucaacaauggguacuccccuccuacuccggccgcaacacccacaacguucaucuagccccggccgucgcucccaccuuccccggcgaacaacuccuauucuuccgcaguacuaugccaggcugcuccggcuacccaaacauggaucucgacugccuccucccacaagaauggguucaauacuucuaccaagaagcagcaccagcacaauccgacguagcacuacuacgcuucgucaacccagacaccggccgcguccuauucgaaugcaaacuacacaaauccggauacguaacagucgcccauaccggccaacacgaccucgucaucccucccaacggcuacuuccgcuucgacuccugggucaaccaauucuacacccucgcccccaugggcaacgguaccggccgcagacgcgcacuauaa

SEQ ID NO: 37564 - RNA, 1623 nt, Artificial Sequence
  derived and/or modified sequence opt11 from major_capsid_protein__Norovirus__CCX28631
augaaaauggccuccucagacgcaaaccccuccgacggcuccacggcaaaccucgucccagaagucaacaacgaagucauggcccucgagcccguagucggcgccgccaucgccgcccccguugcaggacaacaaaacgucaucgaccccuggauccgcaacaacuucguccaggcaccagggggagaguucacagucucaccacgcaacgcacccggagaaauccuaugguccgccccacuaggucccgaccuaaaccccuaccucucccaccucgcacgcauguacaacggauacgccggugguuucgaaguccaagucauacucgccggaaacgcauucaccgcaggcaaaaucaucuucgccgccguaccacccaacuuccccacggaaggccugucccccucccaagucaccauguuuccacacaucauaguagacgucagacaacucgaaccaguucucaucccccuccccgacgucagaaacaacuuuuaucacuacaaccaaagcaacgacucaaccauaaagcucauagcaaugcuauacacaccccugcgggccaacaacgccggggaugacguauucaccgucuccugcagaguacucacacgcccuagccccgacuucgacuucaucuuucuaguaccacccaccgucgaauccagaaccaaaccauucucagucccaguucucacagucgaagaaaugacaaauucacgcuuccccauaccccucgaaaaacuuuucaccggacccucauccgcauucgucguccaaccccagaacggccgcugcaccacagacggcguacuucuuggcaccacacaacuauccccagucaacaucugcaccuuccgcggcgacguaacacacauccccggcuccaggaacuacaccaugaaccucgcaucacaaaacuggaacuccuacgacccaaccgaggaaaucccagcuccccucggcacacccgacuucgucggaaaaauccaaggcguacuaacccaaaccacccgcaccaacggauccacaagaggccacaaagccaccguauauaccggaucagccgacuuuucacccaaacugggccgcguccaauucgcaaccgacaccgacaacgacuucgaaaccaaucaaaacacuaaauuuacccccgucggcgucauacaagacggcuccaccacaccccgcaacgaaccccaacaaugggugcucccaucuuacuccggacgaaacauccacaacguacaccuagcccccgccguagcccccaccuuccccggcgaacaacuucuauucuucagaucaaccaugcccggcugcuccggauaccccaacauggaccuugacugccuacucccccaagaguggguacaauacuucuaccaagaagccgcccccgcccaaagcgaugucgcccuccuccgauucguaaacccagacacaggccgaguccuauuugaaugcaaacuacacaaaucuggauacgucacagucgcacacaccggacaacacgaccuuguaauaccacccaacggauacuuccgauucgacuccugggucaaccaauucuacacgcucgccccaaugggcaauggcaccggccggcgccgagcucuguaa

SEQ ID NO: 37565 - RNA, 1623 nt, Artificial Sequence
  derived and/or modified sequence opt11 from major_capsid_protein__Norovirus__CCX28634
augaaaauggccucauccgacgcaaaccccagcgacggcuccaccgccaaccucguucccgaagucaacaacgaagucauggcacucgaacccgucguuggagccgccaucgccgcuccagucgccggccaacaaaacgucauagaccccuggauacgcaauaacuucguacaagcuccaggcggcgaguucaccgucuccccacguaaugcccccggcgaaauacucugguccgcaccccucggaccugaccucaaccccuaccucucacaccucgcccgaauguacaacgguuacgcuggcggcuucgaaguccaaguaauacucgcagguaacgccuucaccgccgguaaaaucaucuucgcagcuguuccaccaaauuucccaaccgaaggacuaucucccucccaggucaccauguucccacacaucaucguagacguccgacaacucgaacccguccucaucccccuacccgacguccgcaacaacuucuaucacuacaaccaaucgaacgacccaaccauaaaacuaaucgccaugcucuauaccccacuacgcgccaacaacgccggggacgacgucuucaccgucucuugccgaguccucacccguccuucccccgacuucgacuucauauuccuagucccucccacugucgaaucccgcaccaaacccuuuucaguccccauacuaaccguagaagaaaugacuaacucucgcuuccccaucccccucgaaaaacuguuuaccgguccaucuuccgccuucguuguccaaccccaaaacggccgcugcacaaccgacggaguccuccugggcacaacucaacucuccccagucaacaucuguaccuuccgcggcgacgucacacacauccccggaucccacaacuacacaaugaaccuagccucccaaaacuggaacucuuacgaccccacagaagaaauacccgcuccccucggcaccccagacuucguuggaaaaauccaggguguccuuacacaaaccacacgcaccaacgguuccacacgaggccacaaagccacugucuacacaggcuccgccgacuucucaccaaaacucggccgaguacaauucgccacagacaccgacaaugacuucgaaacaaaucaaaacaccaaauuuacacccgucggagucauccaagacggauccacuacaccccgcaacgaaccccaacaaugggucuuacccuccuacuccggacgaaacauccacaacguacaccucgcccccgccgucgcccccaccuucccaggagaacagcuccuauucuuccgcuccacaaugccagguugcuccggauacccaaacauggaccucgacugccuccucccccaagaauggguccaguacuucuaccaagaggcugcccccgcucaauccgacguagcccuccuccgcuucgucaaccccgacaccggucgcguccucuucgaaugcaaacuacauaaaucgggauaugucacagucgcccacacaggccaacacgaccucgucauucccccaaacggcuacuucagauuugacuccugggucaaccaauuuuauacccuagcacccaugggaaacggcaccggacgccgacgagccuuguaa

SEQ ID NO: 37566 - RNA, 1623 nt, Artificial Sequence
  derived and/or modified sequence opt11 from major_capsid_protein__Norovirus__CCX28637
augaaaauggccucauccgacgcaaaccccuccgacggcucgaccgccaaucucguacccgaagucaacaacgaaguaauggcccuugaacccguuguaggugccgcuaucgccgccccugucgcgggccaacaaaaugucaucgaccccuggauccgcuccaauuucguccaagccccaggcggcgaauuuaccguuucaccccgaaacgccccuggcgaaauccucugguccgcuccccucggacccgaccuaaaccccuaccuaucccaccuugcccgaauguacaacggcuacgccgguggcuucgaaguccaagucauccuagccggaaacgcuuucaccgccggaaaaauaauuuucgccgcggucccacccaacuuccccaccgaaggccucucccccucccaaguaaccauguucccccacaucaucgucgacguccgucaacucgaaccaguccucauaccccuccccgacgugagaaauaacuucuaucacuacaaccaauccaacgacuccacaauaaaacucaucgccaugcuguacacaccacuccgcgcaaacaacgccggcgacgacgucuucaccgucucaugccgcguccucacaagacccucccccgacuucgacuucaucuuccuaguaccgcccaccgucgaaagccguacuaaacccuucucaguacccguucuuacuguagaagaaaugaccaacucccgcuuccccauaccccuagaaaaacucuucacuggccccucauccgccuucgucguccaaccacaaaauggccgcugcacaaccgacggcguacuacuaggaacaacccaauuaucccccgucaauaucugcacauuccguggcgacgucacccacaucucuggaucccgcaacuacaccaugaaccuagccucucaaaacuggaauaguuacgacccaacugaagaaauacccgcaccccucggcacccccgacuucgucggcaaaauccaaggcguccucacccaaaccaccaaaaccaauggcuccacccguggacacaaagcaaccgucuacacaggauccgcagacuucuccccaaaacucggccgcguccaauucgcaacagacaccgacaacgacuucgaaaccaaccaaaacaccaaauucacacccguaggcgucauccaagauggcuccaccacuccacgcaacgaaccucaacaaugggucuuaccuucauacuccggccgaaacacucacaacguccaucuagcacccgccgucgccccaaccuuuccuggcgaacaacuacucuucuucagauccacaaugcccgggugcuccggcuacccaaacauggaccucgacugccuccucccccaagaauggguacaauacuucuaccaagaagcagccccugcccaauccgacguugcacuacuccgauucgucaacccugacaccggccgcguccucuucgaaugcaaacuacacaaaucuggguacguaaccgucgcccacaccggccaacacgaccucgucaucccacccaacggauacuuccgcuucgauuccugggucaaccaauuuuacacccucgcacccaugggcaacgguaccggacgcagacgagcccuguag

SEQ ID NO: 37567 - RNA, 1623 nt, Artificial Sequence
  derived and/or modified sequence opt11 from major_capsid_protein__Norovirus__CCX28640
augaaaauggccucaucagacgccaaucccuccgacggcuccacagccaaccuagugccugaagucaauaaugaagucauggcccucgaaccuguuguaggcgcagcaaucgccgcgcccgucgccggccaacaaaacgucaucgaccccuggauccgcaacaacuucguccaagcccccggaggcgaauuuaccguaagcccccguaacgcccccggcgaaaucuuaugguccgcaccccucgguccagaccuaaacccauaccuuucucaccucgcacgcauguacaacggcuacgccggcggcuucgaaguucaagucauacuagccggcaaugccuucacugccggcaaaaucaucuucgcagcagucccaccgaacuuccccaccgaaggccugucccccucccaagucaccauguuuccccacaucaucguugacgugagacaacucgaacccguccuaaucccacuacccgacgucaggaacaacuucuaccacuacaaccaaucaaacgacucgaccaucaaacucauugcaaugcucuacacuccucuccgcgccaacaacgccggcgacgacguauucaccgucuccugccgaguacuaacccgccccucccccgacuucgacuucaucuuccuaguaccgcccaccgucgaaucacgcaccaaacccuucuccguccccguucucaccgucgaagaaaugaccaacucccgauuucccauaccccucgaaaaacuauucacaggccccuccuccgccuucgucguacaaccccaaaacggccgaugcaccaccgacggaguccuacucggcaccacccaacucagcccaguaaacaucugcaccuuccgcggcgacguaacccacauaccgggcucacggaacuacaccaugaaccucgcuucccaaaacuggaacuccuacgaccccaccgaagaaauccccgcaccccucggaacacccgacuucgucggcaaaauccaaggcguccuaacccaaaccaccagaaccaacggcuccacacgcggccacaaagccacugucuacacaggcuccgccgacuucuccccaaaacucggacgaguccaauucgcaaccgauaccgacaacgacuucgaaaccaaucaaaacaccaaauucacgccaguuggcguuauccaagacggcucaaccacaccacgaaacgaaccccaacaaugggugcuccccucguacuccggacgcaacauucauaacguccaccucgccccagccgucgcccccaccuuccccggcgaacaacuccucuucuuccgcagcaccaugccuggaugcagcggauaccccaacauggaccucgauugccuucuuccacaagaauggguccaauacuucuaccaagaagccgcccccgcgcaauccgacguagcccuccuccgcuuuguaaacccagacaccggacgcguacucuucgaaugcaaacuccacaaaucuggcuacgucaccguugcccacacaggccaacacgaccucgucauacccccaaacggauacuuccgauucgacaguugggucaaccaauucuacacacucgcccccauggguaacggcaccggccgacgccgcgcccuauaa

SEQ ID NO: 37568 - RNA, 1623 nt, Artificial Sequence
  derived and/or modified sequence opt11 from major_capsid_protein__Norovirus__CCX28643
augaaaauggccucaucugaugcaaaccccuccgacggcuccacagccaaccuagucccagaaguuaacaacgaaguaauggcccucgaaccaguaguaggagccgcaauugccgccccagucgcuggacaacaaaacgucaucgacccuuggauucgcaacaacuucguccaagcaccuggaggcgaguucacagucagcccucgcaacgcccccggcgaaauccucugguccgcaccccucggccccgaccuaaaccccuaccucucacaccucgcccgaauguacaacggcuacgccggaggcuucgaaguucaagucauccucgccggaaacgccuucaccgcaggcaaaaucaucuucgcagccgucccaccaaacuucccuaccgaaggccucucccccucucaagucacuauguucccucacaucaucgucgauguccgccaauuagaaccuguacugaucccacuccccgacguucguaacaacuuuuaccacuacaaccaauccaacgacccaaccaucaaacucaucgccaugcucuacaccccacucagagccaacaacgcaggcgacgacgucuucaccguaucaugccguguccuaacccgucccuccccggacuucgacuucaucuuucucguacccccuacugucgaaucacgaacuaaacccuucucuguaccaauacucaccguugaagaaaugacaaacucccgcuucccaaucccacucgaaaaacuauuuacuggcccauccucagccuucgucguccaaccccaaaacggccgcugcacaaccgacggcguacuccucggcaccacccaacuuucccccguaaacaucuguacuuuccguggcgacguaacccacauccccggaucacacaacuacaccaugaaccucgccucccagaacuggaacuccuacgacccaaccgaagaaauaccagcaccccucggaacuccggacuucguuggaaaaauccaaggcguccucacacaaaccacucgcaccaacggcuccaccagaggccacaaagcaaccgucuacacaggcucagccgacuucucacccaaacuaggacgcguccaauucgcaaccgacaccgacaacgacuuugaaaccaaucaaaacaccaaauucacacccgucggcguaauacaagacggcuccaccacuccccgcaacgaaccacaacaauggguccucccauccuacuccggacgcaacauccacaacguacaccucgccccugccguagccccuaccuucccuggcgaacaacuccucuucuuccgcucgaccaugcccggcuguuccggauaccccaacauggaucucgacugucuccuuccccaagaauggguacaauauuucuaccaggaagccgccccagcccaauccgacguagcucuacuacgcuucgucaaccccgauacaggccgcguacucuucgaaugcaaacuacacaaauccggcuacguaaccgucgcucacaccggccagcacgaccucgugauaccacccaacggauacuuccgcuucgauuccugggucaaccaauucuauacacucgcccccaugggaaacggcaccggccgccgacgcgccuuauaa

SEQ ID NO: 37569 - RNA, 1623 nt, Artificial Sequence
  derived and/or modified sequence opt11 from major_capsid_protein__Norovirus__CCX28646
augaaaauggcauccuccgaugccaaccccagcgacggauccaccgcgaaccucguccccgaagucaacaacgaaguaauggcccuagaacccguagucggugccgccauagccgcccccguugcaggccaacaaaacgucaucgaccccuggauccgcaauaacuucguccaagcaccaggcggagaguucaccguuucaccccgaaacgcccccggcgaaauccuuuggucugcaccccucggacccgaccucaaccccuaccuaucucaccucgcccgcauguacaacgguuacgccgguggcuuugaaguccaaguaauacuggccggcaaugccuucaccgcaggcaaaauaaucuuugcagccgucccacccaacuuccccaccgaaggucucagccccucgcaagucaccauguucccccacaucauagucgacguccgccaacuugaacccguacuaauuccccuccccgacgucagaaacaacuucuaccacuacaaccaaucaaacgacuccaccaucaaacucaucgcaaugcucuacacaccccuccgugccaacaacgcaggcgacgacgucuucaccgucuccugccgcguacuaacccgacccuccccagauuuugacuucaucuuccucguucccccaacagucgaaucccgcacaaaaccauucucagucccaguccugaccgucgaagaaaugacaaacucacgcuuccccauaccccuugaaaaacucuucaccggccccucauccgcauucgucguccaaccccagaauggccguugcaccaccgauggcguccuucuaggcaccacgcaacuuuccccagucaacauaugcaccuuccgcggcgacguuacacacauccccggaucccggaacuacaccaugaaccucgcaucccaaaacuggaacuccuacgaccccacagaagaaaucccagcuccccucggaaccccagacuuugucggcaaaauacaaggcguucuaacccaaacuacccgaacgaauggcuccacccgcggccacaaagccaccgucuacacaggaagcgccgacuucagcccaaaacuaggccgaguccaguucgcuaccgacacagauaacgacuucgaaacaaaccaaaacaccaaauucacccccgucggaguaauccaagacggcagcaccacuccccggaaugaaccacaacaauggguccuccccuccuacuccggacgcaacauccauaacguucaccucgccccagccgucgcuccuaccuuccccggcgaacaacuccucuucuuccgaucaaccaugcccggcugcucaggcuacccuaacauggaccucgacugccuccuaccccaagaauggguccaauacuucuaccaagaagcagcccccgcccaauccgacguagcccuccuacguuucguaaaucccgacaccggccgcguucuuuucgaaugcaaacuccacaaauccggcuacgucacugucgcccacacgggacaacaugaccuugucauaccacccaacggcuacuuccguuucgacucaugggucaaccaauucuacacccuagcccccaugggcaacggcacaggccgacgccgagcgcucuaa

SEQ ID NO: 37570 - RNA, 1623 nt, Artificial Sequence
  derived and/or modified sequence opt11 from major_capsid_protein__Norovirus__CCX28649
augaaaauggccuccuccgacgccaaccccuccgacggaucaaccgccaaccuaguacccgaaguaaacaacgagguaauggcccucgagcccguagucggagccgccaucgcagccccuguugcugggcaacaaaacgucauagacccauggauccgcaacaauuucguccaagccccaggcggagaguucaccgucucaccccgcaaugcaccuggcgaaauccucugguccgcaccccucggccccgaccucaaccccuaccucucacaccuagcccgcauguacaacggcuacgcaggaggcuuugaaguccaaguaauacucgcuggcaacgcauucaccgcagguaagaucauauucgcagcgguacccccaaacuucccaacagaaggccucagcccaucccaagucacuauguucccccacaucaucgucgacguacgccaacucgaaccaguccucauccccuuaccagacguccgcaacaacuucuaccacuacaaccaaagcaacgaccccaccauuaaacuaauagcaaugcucuacaccccacuccgcgcaaacaacgccggagaugacgucuucaccgucucaugccgaguccucacccgcccaucacccgacuuugacuucauuuuccuagucccacccaccguagaaagccgcacaaaacccuucucaguccccguccugaccgucgaagaaaugaccaacucacgcuuccccaucccccuugaaaaacucuucaccggacccucaucagccuucguaguccagccccagaacggccgaugcacaaccgacggcguccuacuaggaaccacccaacuaucccccgucaacaucugcaccuuccgaggcgacgucacacacaucuccggcucccgcaauuauacuaugaaccuagccucccaaaacuggaacucauacgacccaaccgaagaaauacccgcaccucucggaaccccagauuucguaggcaaaauucaaggcguccucacccagacaacccgcaccgacggcuccacccgcggccacaaagccaccgucuacaccggcucugcugacuucucucccaaacucggacgcguccaauucgcuaccgacaccgacaacgacuuuguaacuaaccaaaacaccaaauucaccccugucggagucauacaagacggcuccacuacaccacgcaacgaaccccaacaauggguacuacccuccuauagcggccgaaacacccacaacguucaccucgcccccgccgucgcaccaaccuucccaggcgaacagcuccucuucuuccgcuccaccaugcccggcugcuccggcuacccaaauauggaccucgacugccuccucccccaagaauggguacaauacuucuaccaagaagccgcccccgcccaauccgacguagcccuucuaagauuugucaacccagacaccggacgcguccucuucgaaugcaaacuccacaaaucaggcuacgucacagucgcacacaccggucaacacgaccucguuaucccacccaacggauacuuccgcuucgacagcuggguaaaccaauucuacacccuagcucccauggguaacgguacaggccgucgccgcgcacucuga

SEQ ID NO: 37571 - RNA, 1623 nt, Artificial Sequence
  derived and/or modified sequence opt11 from major_capsid_protein__Norovirus__CCX28652
augaaaauggccuccuccgacgccaaccccuccgacggcuccacagccaaccucguacccgaggucaacaacgaaguaauggcccucgaacccguaguaggcgccgccaucgccgcacccgucgccggacaacaaaaugucaucgaccccuggauccgcuccaacuucguccaagcccccggcggugaguucaccguaucaccccgcaacgcccccggcgaaauccucuggucagccccacucggacccgaccuuaacccauaccucucccaccuagcaagaauguacaacggauacgccggcggcuuugaaguacaagucauccuagcuggcaacgcauucaccgccggcaaaauuauauucgccgcggucccaccaaacuuccccaccgaaggccucucccccucccaaguaacaauguucccgcacauaaucguugacguccgccaacuagaaccaguccuaaucccucuucccgacguccgaaacaacuucuaccacuacaaccaaucaaacgacccaaccauaaaacucaucgccaugcuguacacaccccuccgcgcaaacaacgccggcgacgacgucuucacaguaagcugccgcguccuaacacgacccucacccgacuuugauuuuaucuuccuuguuccucccacagucgaaucucgaacaaaacccuucuccguccccguccucaccguagaagaaaugacuaacucaagauuccccaucccacucgaaaaacuauucaccggacccucauccgcauucgucguccaaccccaaaacggccgcugcacaaccgacggcguccuccuaggcaccacccaacucucucccgugaacaucugcacauucagaggcgacguuacgcauauaucgggcucacgcaacuacaccaugaaccucgccgcccaaaacuggaacaguuacgacccaacagaagaaaucccagccccacucggcacaccagauuucgucggcaaaauccaaggaguacucacccaaacaaccaaaaccaacggcuccaccagaggucacaaagccacugucuacaccggcucagccgacuucucacccaagcuaggacgcguucaauucgccacagacaccgacaacgacuucgaaacuaaucaaaacaccaaauucaccccagucggcgucauccaagacggcucgacaaccccacgcaacgaaccccaacaauggguucuccccuccuacucaggccgaaauacacacaacguccaucuagcccccgccguagcaccaacauucccuggagaacaacuccucuucuuccguucaaccaugccaggcugcuccgguuacccaaacauggaccucgacugccuccucccccaagaauggguccaauacuucuaccaagaagccgccccugcccagucagauguagcccugcuccgauucgucaaccccgacacuggacgaguucuguucgaaugcaaacuacacaaauccggauaugucacagucgcccacacuggccaacacgaccucguaauaccaccuaacggauacuuccgguucgacagcuggguaaaucaauucuauacccuagcccccaugggcaacggaaccggccgacgccgcgcccucuga

SEQ ID NO: 37572 - RNA, 1626 nt, Artificial Sequence
  derived and/or modified sequence opt11 from major_capsid_protein_VP1__Norovirus__AEE10000
augcgcauguccgacggggccgcuccaaaagcgaauggcagcgaagccucuggccaagaucucgucccaaccgccguagaacaagccguaccaauccaacccgucgcaggcgccgcccuugccgcccccgcugcgggccaaaucaaccaaaucgacccauggauauuccaaaacuucguacaaugcccccucggcgaguucagcauuagcccccgaaacacccccggagaaauacucuucgaucuagcccuuggacccggccuaaaccccuaccucgcccaccucuccgccauguacaccggcuggguuggcaacauggaaguccaacucguccuagccggaaacgccuucaccgccggaaaagucguagucgcucucgucccgcccuacuuccccaagggcucccucaccacugcacaaauaaccugcuucccccacgucaugugcgaugucagaacucuagaacccauccaacuaccacuccucgacguccgcagaguacucuggcacgccacccaagaccaagaagaauccaugcgccuagucugcaugcucuauacgccccuccgaaccaacuccccuggcgacgaaucuuucguagucuccggacgccuccucuccaaaccagccgccgacuucaacuuugucuaccuaaccccacccaucgaacgcaccaucuaccgaaugguagaucuacccgucauccaaccccgccucugcacccacgcucgcuggccugcucccguguacggccuacucgucgaccccuccuuaccaucuaacccacaauggcagaacggacgcguucgagucgacggaacccuccucggaaccaccccagucuccggcuccugggucuccugcuuugccgccgaagcagcauacgaauuucaaagcggcaccggagaagucgcaaccuucacacuaauagaacaagacggcucagccuauguaccuggagaccgagcagcacccuuaggauacccagacuucagcggccaacuugaaaucgaaguacaaacugaaaccacaaaaaccggcgauaaacucaaagucaccaccuucgaaaugguccuuggacccgaaacaaacgucgaccaagccccauaucaagguagagucuacgcgucagucaacgcagcggccucacucgaccuaguagacggucgaguccgcgcagucccccguuccgucuacuccuuccaagacgucauccccgaauacaacgacggccuccucgucccccuugcgcccccgauaggccccuuccucccgggagaaguacuucuccgauuccgcaccuacaugcgccaaaucgacacuaccgaugccgcggccgaagccauagacugcgcacucccccaagaguucauauccugguucgcauccaacgccuuuacgguacaauccgaagcccuacuucuccgcuaucguaacacacucaccggucaacuacucuucgaaugcaaacucuacucugaaggauauauagcccuaagcuacucaggcagcggcgcccuuaccuuucccaccgacggcuucuucgaagucguauccugggucccccgacucuaccaacuugccuccguaggcagccucgccacuggccgaacacucaaacaauaa

SEQ ID NO: 37573 - RNA, 1626 nt, Artificial Sequence
  derived and/or modified sequence opt11 from major_capsid_protein_VP1__Norovirus__AEE10012
augcgaaugagcgacggcgcugcccccaaggcaaacggcuccgaagccuccggccaagaucucguccccaccgccgucgaacaagcagucccaauccaacccgucgcaggcgccgcacucgccgcccccgccgcaggucaaauaaaccaaauagauccauggaucuuccaaaacuuuguccaaugcccucucggcgaauuuuccaucucacccaggaacacacccggagaaauacucuucgacuuagcccucggcccaggucuaaacccauaccucgcccaccucucagccauguacaccggcugggucggcaacauggaaguacaacucguccuagccggcaacgcauucaccgcaggaaaagucgucguagcucuagucccacccuacuuccccaaaggaagccucacuacagcacagauaaccugcuucccccacguaaugugcgacguccgaacacucgaaccuauccagcucccacuccuggacguccgccgaguccuauggcacgccacccaagaccaagaagaauccaugcgacucguaugcaugcuauacacaccccuccgaaccaauucccccggcgacgagagcuucgucgucuccggccgccuacucucuaaaccagccgccgacuucaacuucgucuaccuaaccccacccaucgaaagaaccaucuaccguauggucgaccuaccagucauucagccccgccuauguacccacgcacgcuggccagccccugucuacggccuccuaguagauccaucccuaccaucaaacccccaguggcaaaacggccgcguccgaguugacggcacccuccucggaaccacccccgucucuggauccuggguauccugcuucgccgccgaagccgccuacgaguuccaaagcggcaccggagaaguugccaccuucacguuaaucgaacaagacggcagcgcauacguccccggcgaccgcgcugcaccccuaggcuacccagacuucuccggccaacucgaaaucgaaguccaaaccgaaacaacuaaaacaggcgacaaacucaaaguuacaaccuucgaaaugguacucggccccgaaacaaacguggaccaggcaccauaccaaggacgaguuuacgcauccguaaacgccgccgccagucucgaccuugucgacggucgcguacgcgcugucccaagaucaguuuacuccuuccaagacgucauccccgaauacaacgauggccuacucguaccgcuagccccaccaauaggccccuucuuacccggagaaguccuccuacgcuuccgcacguauaugagacaaaucgacacaaccgacgcagcagcagaagccaucgacugcgcacucccucaagaauuuguauccugguucgccuccaaugccuucaccguacaaucagaagcccuacuucuacgguaccgaaacacccuaaccggccaacuccucuucgaaugcaaacuauauuccgaagguuacaucgcacucagcuacuccggcuccggagcgcucacauuccccaccgacggauucuuugaaguaguuagcugggucccacgccucuaucaacucgcauccguaggcucccucgcaaccggccgcacacucaaacaauaa

SEQ ID NO: 37574 - RNA, 1623 nt, Artificial Sequence
  derived and/or modified sequence opt11 from major_capsid_protein_VP1__Norovirus__AGJ52172
augaaaauggcauccuccgacgccaauccaucagacggcuccgccgccaaccuagucccagaagucaauaacgaaguuauggcacuagaacccguaguuggggccgccaucgcagcaccagucgcaggacaacaaaacgucaucgaccccuggauccgaaacaacuucguccaagcgcccgguggagaauuuacaguuucaccacguaacgcaccuggcgaaauccuuuggucagcaccccucggccccgaccuaaaccccuaccuaucccaccuagcccgaauguacaacggcuacgccggaggcuucgaaguccaggucaucuuagccggaaacgccuucaccgccgguaaagucaucuucgccgccgucccacccaacuucccuaccgaaggacucuccccaucccaagucaccauguucccacacaucgucgucgacguacgccaacuggaacccguccucauaccccuccccgacguccgaaauaauuucuaccauuauaaccaaucaaacgaccccacaauuaaacucaucgccaugcucuacaccccacugcgcgcaaacaacgcgggcgacgacgucuucaccgucuccugccgcguacuaaccagacccucucccgacuucgauuucauauuccuaguuccacccacagucgaauccagaaccaaacccuucucuguccccguacuaacagucgaagaaaugaccaacagccgcuuccccauaccccucgaaaaauuauucaccggccccuccuccgcuuucgugguccagccccaaaacggccgaugcaccacggacgggguacuccugggcaccacacaacucucuccagucaacaucugcacuuuccgaggcgacguuacccacaucaccggcucacgaaacuacacuaugaaccucgcaucacagaauuggaacaacuacgacccuacagaagaaaucccugcaccccucggcacaccagacuucguuggaaaaauccaaggcguauuaacccaaacaacccgaacagacggauccacccgcggucacaaagccaccguuuacacuggaucagccgacuucgcacccaaacuaggccgcguccaguucgaaaccgacaccgaccacgacuucgaagcaaaccaaaauacaaaauucacccccguaggcgucauacaagacggcuccaccacccaccgcaacgaaccucaacaauggguacucccaucauacuccggccgcaacacccccaacguucaccucgcccccgcagucgcccccaccuucccgggcgaacaacuccucuucuuccgcucaacaaugcccggcugcucaggguaccccaacauggaccucgacugccuccuaccucaagaauggguccaguacuuuuaccaagaagcagcccccgcacaauccgacguagcccuucuacgcuucguuaaccccgacacuggccgcguccucuucgaaugcaaacuccacaaaucaggcuacguaacagucgcacacaccggccaacaugaccuaguaauaccacccaacggcuacuuuagauucgacuccuggguaaaccaauucuacacccucgcucccauggguaacggcaccggccgccgccgagcccuauaa

SEQ ID NO: 37575 - RNA, 1623 nt, Artificial Sequence
  derived and/or modified sequence opt11 from major_capsid_protein_VP1__Norovirus__AGJ52173
augaagauggcuagcucagacgcaaacccaucagacgguuccgccgcaaaccucgucccagaaguaaacaacgaagucauggcccucgaacccgucguaggagccgcuauagccgcccccguagccggccagcaaaaugugauagauccauggauacgcaacaauuucguucaggccccaggcggagaguucacaguuucaccccgcaaugcaccaggcgaaauccucugguccgcaccccucggccccgaccucaauccauaccucucccaccucgcccgcauguacaacggauacgccggaggauuugaaguccaagucauacucgcaggcaacgcuuucacagccggcaaagucauuuucgccgccgucccacccaacuuucccaccgaaggccucucacccucacaaguaacaauguucccccacaucguagucgacguccggcaauuggaacccguacucaucccucuaccagacguaagaaacaacuuuuaucacuacaaccaauccaacgaccccaccauaaaacuaaucgcuaugcuauacacaccccuacgcgccaacaacgccggggacgacgucuucaccgucuccugccgcguacuaacccgaccaagccccgacuucgacuucaucuuccucguuccucccacuguggaaucccgaaccaaacccuucuccguccccguccuaaccguagaagaaaugacaaacagccgcuuccccaucccucucgaaaaacuuuucacaggccccuccuccgccuucgugguccaaccacaaaacggacgcugcacaacagacggcguccuacuaggcaccacccaacucucgccaguaaacauaugcaccuuccgcggcgaugucacccacauaacgggcucacgcaacuacaccaugaaccucgcaucucaaaacuggaacaacuacgaccccacagaagaaauacccgcuccccuaggaacucccgacuucgucggcaaaauccaaggcguccucacccagacaacccgcaccgacggcucaacucgaggacacaaagccaccguauacacaggcuccgccgacuucgccccaaaacucggacgaguccaauucgaaacagacaccgaccacgacuuugaagccaaccaaaauaccaaauucacacccguagguguaauucaagauggcuccaccacccaccgcaacgaaccccaacaauggguccucccuucuuauuccggucgcaacacucacaacguccaccuugccccagccguagcacccaccuuccccggcgaacaacuacuauucuuccgcuccacuaugccaggcugcuccggcuaccccaacauggaccuagacugccuccuaccccaagaauggguacaauauuucuaccaagaagccgccccagcacaaagcgacgucgcucuccuccgauucgucaaccccgacacaggcagaguccuuuucgaaugcaaauuacauaaauccggcuacguaaccgucgcacacacaggccaacacgaccuagucaucccucccaacggauacuuccgcuucgacuccuggguaaaccaauucuacacucuugcacccaugggaaacggaaccggacgacgacgagccguauaa

SEQ ID NO: 37576 - RNA, 1623 nt, Artificial Sequence
  derived and/or modified sequence opt11 from major_capsid_protein_VP1__Norovirus__AGJ52174
augaaaauggccuccuccgacgccaaucccuccgacggauccgccgccaaccuugucccagaaguuaacaaugaggucauggcccucgaacccgucguuggagccgccaucgcagcaccagucgcgggacaacaaaaugucauugaccccuggauccgaaacaauuucguccaggcccccggcggagaguucacuguaucaccccgcaacgcccccggagaaauccucugguccgcaccccucggccccgaccucaaccccuaccucucacaccucgcccgaauguacaauggcuacgcaggcggguucgaaguccaagucauucucgccggaaacgccuucaccgccggaaaagucaucuucgccgccgucccacccaacuuccccacagaaggccucucacccucccaagucacaauguucccccacaucgucgucgacgucagacagcucgaacccguccucaucccccuucccgacgugcgcaauaauuucuaccacuacaaccaaucaaacgacccaaccaucaaacucauagccaugcuauacacaccacuccgagccaacaacgccggggacgacguauucacaguuucaugucgaguccucacacgaccuuccccagacuucgacuucauauuccucguacccccaaccgucgaaucccgaaccaaacccuucuccguccccguccucaccgucgaagaaaugacuaacucucguuuccccauaccccucgaaaaacuauucacaggccccuccagcgcauucguuguccaaccacaaaauggaagaugcaccacagacggcguucuucucggcaccacccaacuaucccccgucaacaucugcacauuucgcggcgacguuacacacauuaccggaucucgaaacuauacuaugaaccuagccucccaaaacuggaacaacuacgaccccaccgaagaaauaccagcuccccuagguaccccugauuucgucggcaaaauccaaggcguacuaacccaaaccacccgaacagacggcucaacacgcggccacaaagccaccgucuacaccggcagcgccgacuucgccccaaaacucggccgcguucaauuugaaaccgacacagaccacgacuucgaagccaaccaaaacaccaaauucacccccgucggcguaauccaagacggcggcaccacccaccgaaacgaaccccaacaauggguccuacccucauacucaggacgaaacacaccuaacguacacuuagccccagccguagcuccaacauucccuggagaacaacuccuauucuuccgauccacaaugcccggcuguuccggcuaccccaacauggaucuagacugcuuacucccccaagaauggguccaauacuucuaccaagaagccgcaccagcacaauccgacguagcccuccuacguuucgucaacccagacaccggacggguccuauucgagugcaaacuccacaaaucgggauacgucaccgucgcccacacuggacaacacgaucuaguaaucccaccaaacggauacuuccgauucgacuccugggucaaccaauuuuacacacuagcccccaugggcaauggcacuggacgccgccgcgcacuauaa

SEQ ID NO: 37577 - RNA, 1632 nt, Artificial Sequence
  derived and/or modified sequence opt11 from major_capsid_protein_VP1__Norovirus__AGJ52176
augaugauggcgucaaaagacgccccaaccaacauggacggcaccucgggagcaggacaacucguacccgaagccaauaccgccgaaccacuccccauuaaacccgucgccggcgccgcaaccgcagucgcaacggccggccaagucaacaugauagaccccuggaucaugaacaauuucguccaagccccacaaggcgaauuuaccaucuccccaaacaacacccccggcgacauccuauucgaccugcaacucgguccacaccucaacccauuccuagcacaccuaucccggauguacaauggcuggguaggaaacaugcaaguacgcaucaugcuugccggcaacgccuucuccgcaggaaagauaauagucugcugcaucccacccggcuucucaucacaauccaucagcaucgcucaagccaccauguucccccacguaaucgccgacgucagaguccucgaacccaucgacguaccccuagacgacguacgcaacguccucuuccauaacaacgacaauccacaaacuaugcgccuacucugcaugcuguacacccccuuacgcuccggcggcaccucaucuggcaccgaccccuucguuaucgcgggccgaguccuuaccugcccaacccccgacuuuagcuuccuuuuccucguaccucccgacaucgaacaacgcaccaaacccuuuuccguacccaauaucccaaugaaccugaugucuaacagccgcgucuccaugcucaucgacggcaugaugguauccaacgaccaaaaccaagucccccaauuucaaaacggccgcguuacccuagacggccaacuccaaggaacaacaaccgucucugcagccugcgucgcgcgaaugcgcggucgaauuuucaacaacaacgggaacuauggcgugaaccucaccgaacuagacggaaaccccuaccacgcuuucgauuccccagccccacuaggcuucccagacuucggcaauugcgaccuacacaugacauucgucaaaauaaaccccaacgaacucuccuccggcgaccccuccggcaaagucgucauacgcuccuaugacgccacguucgcaccucaccucggcacagucaagcucgaaaacgacgacgaacuagcccgauucgucggcaaagaaguaguccuagaacuaacgugggucucaaaccgggaaggcgccacccucaaccuaugggccgucccgaacuacggaagcucacucacgcaagccucccaacucgcucccccaaucuacccacccggcuucggcgaagcaauagucuacuucaccuccacauuccccacagucagcaacccaaaagucccauguacccuuccccaagaguucgucucacacuucgucaaugaacaagcccccacccgcggcgacgccgcccuccuccauuacgucgaccccgacacacaccgaaaccucggugaguucaaaauguaccccgaaggcuacaugaccugcguccccaacgccggcggaggcccacaaacccucccuaucaacggcgucuuuguuuucauaucauggguaucacguuacuaccaacucaaacccgucggcaccgcaggcgcugccagaagacucggccuacgccgcuccuag

SEQ ID NO: 37578 - RNA, 1608 nt, Artificial Sequence
  derived and/or modified sequence opt11 from major_capsid_region__Norovirus__ADO85555
augaaaauggcaucaaacgacgcggccccauccaaugacggagcagccggccuaguaccggaagucaacaacgaaacaauggcccuagaacccgucgccggcgcaucuaucgccgccccacucaccggacaaaacaacguaauagacccauggauacgacucaacuucguccaagcccccaacggcgaguucaccgucucccccagaaacagccccggcgaaguacuacuaaacuuagaacuaggccccgaacucaacccauaccuagcucaucuuagccgaauguacaacggcuacgccggcggugucgaaguccaaguacuucuagccggaaacgccuucaccgccggaaaacucguguucgccgccguaccuccccacuucccccucgaaaacauauccccaggccagaucacaauguucccccacgucauaaucgacgucagaacccucgaacccguccuacucccacuuccugacgucagaaacaacuuuuuccacuauaaccaacaaaacgaacccuggaugcgccuaguagccaugcucuauacaccccuccggagcaacggaucuggcgacgacgucuuuaccguaucuugcagaguccucacccgccccucccccgauuucgacuucaacuaccuaguuccucccaccgucgaauccaaaaccaaacccuucacacuacccauccucaccauaggcgaacucacaaacucccgcuucccagucccaaucgacgaacuauacaccuccccuaacgaaucccucguaguccaaccccaaaacggccgcugcgcccuagacggagaacuccaaggcacaacccagcuacuacccaccgccauuugcuccuuccgcggccgaaucaaccaaaaagucucaggugaaaaccacguauggaacaugcaggucacuaacauaaacggaacucccuucgaccccaccgaagacguaccugccccacuuggcacccccgacuucucgggcaaacuauucggcguccuuucccagcgcgaccacgacaacgccugccgaucccacgacgccgucaucgccaccaacagcgcaaaauucaccccaaaacucggagcaauacaaaucggaacaugggaagaaaacgacguccacaucaaccaacccacaaaguucacaccagucggccuauuugaauccgaaggcuucaaucaauggacccuccccaacuacuccggcgcccucacccuaaacaugggacucgcacccccagucgcaccaacguuccccggcgaacaaauacucuucuuccgaucccacauaccccucaaaggcggcgucgcugaccccgucaucgauugccuccucccccaagaauggauccaacaccucuaccaagaaucugcaccaucucaaaccgacgucgcccuaauucgaaucaccaaccccgauacaggccgaguccucuucgaagccaaacuccauagaucaggcuacauaaccguggccaacaccggcucccguccaaucguaguccccgcgaacggcuacuuccgcuucgacucauggguaaaccaauucuacucccuugcccccaugggcaccgguaacggucgacggcgcguccaauaa

SEQ ID NO: 37579 - RNA, 1626 nt, Artificial Sequence
  derived and/or modified sequence opt11 from majore_capsid_protein__Norovirus__AFO84035
augcgcaugucagacggggccgcccccaaagccaacggcuccgaagccuccggacaagaccuaguccccaccgccgucgaacaagccguacccauacaaccagucgcaggcgccgcccuagccgcuccagccgcuggacaaauaaaccaaaucgacccuuggaucuuccaaaacuucguccaaugcccucucggcgaguucuccauuagcccccgcaacacccccggcgaaauacucuucgaccucgcacuaggaccaggacucaaccccuaccuugcgcaucucuccgcuauguacacaggaugggucgguaacauggaaguccagcuaguccucgccggcaacgcauucacagccgguaaggucgucgucgcucucguaccaccauacuuccccaaaggcucccuaaccacugcccaaaucacaugcuucccccacgucaugugcgaugucagagcacucgaaccaauccaauuaccucuucucgacguccgccgcguacuauggcacgccacucaagaccaagaagaaagcaugcgccucgucugcaugcuauacacaccccuucgaaccaacucucccggcgacgaaucauucguagucagcggccgacuacucuccaaacccgccgcagacuucaauuucgucuaccuuaccccacccaucgaacgaaccaucuaccgcauggucgaccuccccgugcuccaaccccgccucugcacccacgcccgcuggcccgcucccgucuauggccuacucgucgaccccucacucccauccaacccccaauggcaaaacggucguguccaugucgacggcacccugcucggaaccacacccgucuccgguuccuggguaagcugcuucgccgcagaagccgccuaugaauaucaauccgaagucggcgaagucgccaccuucacccuuauagaacaagacggcucagccuacguccccggcgaccgagcagcuccccucgguuacccagauuacuccggacaacucgaaaucgaaguccaaaccgaaaccaccaaaaccggagacaaacugaaaguuaccaccuucgauaugauccuaggacccacaaccaacgucgaccaaguacccuaucaaggcaaaguauacgccucgcucacaaccgccagcucccucgaccucgucgacggacgagcaagagccguaccccgcucaguauacuccuuccaagacguccuccccgaauacaacgauggucuccuagucccauuagcaccaccccucggccccuaccuacccggcgaaguacuacuacgauuccgcaccuacaugagacaacucgacacugccgacgcagccgcccagccaaucgacugcgcccucccccaagaauuuauaucaugguucgcauccaacaacuucacaguccaauccgaugcccuccuaauccgauaccgaaauaccuuaaccggacaacuacuauucgaagcaaaacucuacagcgaaggcuacauagccgucuccuacuccggauccggaccucucaccuuccccaccgacggcuuuuucgaaguugucucuugggugccccgccuauuccaacucgcaucugucggaucccuagucaccggacgaacucucaaacaauaa

SEQ ID NO: 37580 - RNA, 1623 nt, Artificial Sequence
  derived and/or modified sequence opt11 from major_viral_capsid_protein__Norovirus__AFN09918
augaaaauggccuccaacgacgcuacccccucagauggauccaccgcuaaccucguccccgaagucaauaacgaagucauggcucuagaaccagucguuggcgccgccauagcagccccugucgcaggacaacaaaacgucaucgaccccuggauacgcaacaacuucguucaagcaccaggcggugaauuuaccguaagcccccgcaacgcucccggagaaauccucugguccgcuccacuaggaccggaccucaaccccuaccuuucccaccucgcacgaauguacaacggcuacgccggaggcuucgaaguccaagucauccuagccggcaacgcguucaccgccggaaaaaucaucuucgccgcaguaccucccaacuucccaacagaaggccuaucccccucacaagucacaauguucccucacaucauagucgacguccgccaacucgaacccguccucaucccacuccccgacguuagaaacaacuucuaccacuacaaccaauccaacgacccaaccaucaaacuaaucgccaugcucuacaccccucuacgcgccaacaacgcuggagaugacguauucaccgucuccugccgcguccugacccgccccuccccugacuucgacuucaucuuccucguuccacccaccguugaaucgcgcacaaaaccauucucaguccccauccucaccgucgaagaaaugaccaacucccgcuuccccaucccccucgaaaaacucuucacaggccccucauccgccuucgucguacaaccccaaaauggccgcuguacuacagacggcguccuacucggcacgacccaacucuccccaguaaacaucugcacguucagaggagacgucacccacaucgccggcacccaaaacuacaccaugaaccucgcaucccaaaacuggaacaacuacgacccaaccgaagaaaucccagcaccacuaggcacaccagacuuugucggcaaaauccaagggguccucacacaaaccacuucccgcgacggcuccacccgcggacacaaagcaacugucucaacaggauccguccacuuuacaccaaaacucggcuccguccaauucagcaccgacaccuccaaugacuucgaaaccggccaaaacacccgauucacccccgucgggguaguccaggacggaucaaccacucaccaaaacgaaccccaacaauggguccucccgaacuacagcggccgagauucccacaacguccaccucgcccccgccgucgcacccaccuuccccggagaacaacucuuauucuuccgaagcaccaugcccggaugcuccggcuauccaaacaugaaccucgacugccuucucccucaagaauggguacaacacuucuaccaagaaucagccccagcccaauccgacgucgcucuccuccgcuuuguaaaccccgacacuggacguguccuauucgaaugcaaacuacacaaacccggauacgucaccgucgcccacaccggccaacacgaccucgucauaccacccaauggauacuucagauucgacucaugggucaaccaauucuacacccucgcacccaugggcaacggcgccggccgacgcagagcccuuuaa

SEQ ID NO: 37581 - RNA, 1623 nt, Artificial Sequence
  derived and/or modified sequence opt11 from major_viral_capsid_protein__Norovirus__AFN09921
augaaaauggccucaaacgacgcaaaccccucagacgguuccgccgccaaccucgucccagaagucaacaacgaagucauggcccucgaacccgucguuggagccgccaucgccgcgcccguagcuggccaacaaaacgucaucgauccauggauccgcaacaacuucguccaagcccccggaggugaguucaccgucagcccccgcaacgcccccggugaaauacuauggucagcuccucucggccccgaccuaaacccauaucuaucacaccuagcacggauguacaacggauacgcaggcggcuucgaaguccaaguaauccucgccggcaacgccuuuacagccggcaagaucaucuucgccgcaguacccccaaacuuccccacggaaggacucucacccagucaagucaccauguucccacacaucauaguugacguucgacaacuagaaccaguacuaaucccucuacccgacguaagaaacaacuucuaccacuacaaccaauccaacgacuccaccaucaaacuaauugccaugcuuuacacaccccuccgcgccaacaaugcaggagaagacguuuucaccguuuccugccgcguccugacuagacccucaccagacuucgacuucaucuuccucguaccacccacuguugaaucccgcaccaaacccuucacaguccccauacucacaguagaagaaaugaccaacucccguuuccccaucccucucgaaaaacucuucaccgggcccuccggcgccuucgucguccaaccccaaaacggacgaugcaccacagacggcguccuccucggcaccacccaacuuucaccagucaauaucugcacuuuccgcggagacgucacccacauagcaggaucucgcaacuacaccaugaaccuagccagccucaacuggaacaauuacgaccccaccgaagaaauacccgcaccccucggaacaccagacuuugucggaaagauccaaggcgugcuaacccaaacaaccaaaggugacggcuccacccgaggccacaaagccacaguauauacaggauccgcccccuuuacccccaaacuaggaucuguccaauucucuaccgacaccgaaaacgacuucgaaacccaccaaaauaccaaauucacccccgucggcgucauccaggacggauccaccacacaccgcaacgaaccccaacaauggguccuacccagcuacucaggccgcaacguccacaacguccaccuagcccccgcagucgcccccaccuucccaggcgaacaacuccucuucuucagauccaccaugccagguugcucaggcuaccccaacauggaccucgacugucuccucccacaagaauggguucaacacuucuaucaagaagccgccccugcacaaucagacgucgcacuccuccgcuucguuaaccccgacacgggccguguccuauucgaaugcaaacuccacaaguccggauacgucaccgucgcccacaccggccaacacgaccucgucaucccacccaacggcuacuuccgauucgacucauggguaaaccaauucuauacacucgcccccaugggcaacggcaccggccgucgccgagcacucuaa

SEQ ID NO: 37582 - RNA, 1623 nt, Artificial Sequence
  derived and/or modified sequence opt11 from major_viral_capsid_protein__Norovirus__AFN09924
augaaaauggccuccaacgacgcaaaucccuccgacggaucagcugcaaaccucguacccgaaguaaacaacgaaguaauggcucucgaacccgucgucggcgcugccaucgcagcccccguagccggccagcaaaacgucauagaccccuggaucagaaacaacuucguccaagcacccggaggugaguucaccgucagcccccgcaacgcccccggcgaaauacuuugguccgcgccccuaggcccagacuuaaaccccuaccucucccaccucgcccgcauguacaacggcuacgccggaggcuucgaaguccaggucauacuagccggcaacgccuucaccgcuggaaaaaucaucuucgccgcagucccacccaacuuucccacugaaggacuuucccccucacaaguuacuauguucccccacaucaucguugacguccgccaacuagaaccuguucucaucccacuaccagacguccgcaacaauuucuaccacuacaaccaauccaaugacuccacaaucaaacuaaucgccaugcucuacacuccccuacgcgccaacaacgccggugaagacgucuucacagucuccugucgcguccuaacccgcccgucacccgacuucgacuucaucuuucuaguucccccuaccgucgaaucccgcaccaaacccuucacaguccccauucuaaccguagaagaaaugacuaacucucgcuuucccaucccccucgaaaaacuauucaccggccccucaggcgcauucguaguccaaccccaaaacggccgaugcacgaccgacggcguccuccuaggcacaacacaacucucacccgucaacaucuguacauuccgcggcgacgucacccacauagcuggcucacgcgacuacaccaugaacuuagcaucccuaaacuggaacaacuacgacccuaccgaagaaauccccgccccacucggcacacccgauuucgucggcaaaauccaagguguccucacccaaaccacuaagggcaacggcagcacucgcggccacaaagcuaccgucuacacaggcuccgcucccuucaccccuaaacucggaucuguacaauuuucaaccgacaccgaaaacgacuucgaaacacaccaaaacaccaaauuuaccccagucggcguuauccaagacggcuccaccacccacagaaacgaaccacaacaauggguccucccuuccuacuccggccguaacguacacaacguacaccucgccccggccgucgccccaaccuuccccggcgaacagcuccuauucuucagaucgacuaugcccggcugcucuggcuacccgaacauggaccuagacugccuacuaccgcaagaauggguccaacauuucuaucaagaagccgcacccgcccaauccgacguagcacuacuccgcuucgucaaccccgacaccggccgcguccucuucgaaugcaaacuccacaaauccggauacaucacagucgcccacaccggucaacacgaccucgucauaccacccaauggcuacuuccgcuucgauuccugggucaaccaauuuuacacacucgcccccaugggcaacggaacaggccgucgacgugcccuauaa

SEQ ID NO: 37583 - RNA, 1623 nt, Artificial Sequence
  derived and/or modified sequence opt11 from major_viral_capsid_protein__Norovirus__AFN09927
augaaaauggccucaaacgacgcaaaccccuccgauggcuccgccgccaaccuaguacccgagguaaacaacgaagucauggcccuggaaccaguaguaggcgccgccaucgccgcccccgucgccggccaacaaaacguaauugaccccuggauacgcaacaacuuuguacaagcccccgguggcgaguucacagucagcccccgaaacgcgcccggcgaaauucucuggagcgcaccccuuggccccgaccuuaacccuuaccucucacaucucgcccgaauguacaacggcuacgccggcggcuucgaaguucaaguuauucuagcaggaaacgcauucaccgccggcaaaaucauauucgccgccgucccacccaacuuccccacagaaggccucucccccucacaagucaccauguucccccacaucauaguugacguccgccagcuagaacccguccucaucccacuccccgacguccguaacaacuucuaccauuacaaccaguccaaugacucaacuaucaaacuaaucgccaugcucuacacuccccuacgagcaaauaaugccggagaagacgucuucaccguauccugccgcguacucacccgcccaucccccgacuucgacuucaucuuccucguuccucccacgguagaaucccgaaccaaacccuucacaguccccauccucacugucgaagaaaugaccaacagccguuucccuaucccccuagaaaaacucuucaccggaccauccggcgccuucgucguccaaccccaaaacggacgcugcaccaccgacggaguccuccuaggcaccacccaacuuucaccuguaaauaucugcaccuuccgaggcgacgucacccacaucgccgggucccgcaacuacacaaugaaccuagccucacucaacuggaacaacuacgacccaaccgaagaaaucccagcuccccucggcaccccagacuucguaggcaaaauccaaggcguccuuacacaaaccacuaaaggcgauggaucaacacgcggccacaaagcaacagucuacacaggcucagcccccuucacccccaaacucggcagcguccaauucagcaccgacacagaaaacgacuuugaaacacaccaaaacacaaaauucaccccagucggcgucauacaagacggcuccacaacccaccgcaacgaaccccaacaauggguacugccaagcuacuccgggcgaaacguacauaauguucaccucgcccccgccguggcuccaaccuuucccggcgaacaacuccucuucuuccgcucaaccaugcccggaugcagcggcuaccccaauauggaccucgacugccuccuaccccaagaauggguccagcacuucuaccaggaagcagcccccgcccaaucagacgucgcacuucuccgcuucgucaaccccgauaccggccgcguacuuuucgaaugcaaacuccacaaaucaggcuacgucacagucgcccacaccggacaacacgaccucgucaucccacccaacggauacuuucgcuucgacucauggguaaaccaauuuuacacccuagcccccaugggcaacggcacaggucgacgacgcgcccucuaa

SEQ ID NO: 37584 - RNA, 1623 nt, Artificial Sequence
  derived and/or modified sequence opt11 from major_viral_capsid_protein__Norovirus__AFN09930
augaaaauggcaucgaaugacgccaacccuucagacggcuccgcagccaaccuaguuccggaagucaacaacgaaguaauggcccuugaaccaguaguaggugcagccaucgcugccccuguagcaggccaacaaaacguuaucgaccccuggauccgcaacaacuucguacaagcacccggcggcgaguucacagucuccccucgaaacgcccccggcgaaauccuaugguccgcgccccucggccccgaccuaaacccauaucuuucccaccuugcccgcauguacaacggauacgcuggaggauucgaaguccaagucauccucgccggcaacgccuucacagccggcaaaaucaucuucgcagccgucccaccaaacuuccccaccgaaggacucucacccagccaggucacuauguucccacacaucauaguagacguacgccaacucgaacccguccucauaccacuacccgauguccgcaacaacuucuaccauuacaaccaauccaaugacuccacuaucaaacucaucgccaugcuauacacaccccuccgugccaacaacgcaggcgaagauguauucaccgucucaugccgcguacucacaagaccauccccagacuucgacuucaucuuccucgugcccccaaccgucgaaucacgaaccaaaccguucaccguuccaauccucaccguagaagaaaugacaaacucccgcuucccaauuccacucgaaaaacucuucaccggaccaagcuccgccuucguaguucaaccccaaaacggacgcugcacaaccgacggcguccugcucggcaccacacaacuuucuccaguaaacaucugcaccuuuagaggagacgucacccacaucgcaggaagccguaacuacaccaugaaccucgcaucccuuaacuggaacaacuacgaccccacugaagaaauccccgcaccccuaggcacaccagacuuuguaggaaaaauccaaggaguucucacccaaaucacuaaaggcgacgguuccaccagaggccacaaagccacaguuuauaccggcggcgcccccuucacacccaaacuuggcuccguucaauucuccacagacacagaaaacgacuucgaaacucaccaaaauaccaaauuuaccccaguuggcgucauacaagacggcuccaccacacacagaaacgaaccucaacaauggguccuccccuccuauucuggccgcaauguccacaauguacaccuagcccccgccguagcaccaaccuucccaggagaacaacuccuauucuuccgaucgacaaugccaggcugcuccggcuaccccaacauggaccucgacugccuacucccacaagaauggguccaacacuucuaccaagaagcugccccagcccaaucagacgucgcccuacuccgcuucguaaacccggacacuggccgcguccucuucgaaugcaaacuccacaaauccggauacguaacugucgcacacaccggccaacacgaucucgucaucccacccaacggcuacuuccgcuucgacuccugggucaaccaauucuacacacuagcccccaugggcaacggcaccggccgccgccgagcccucuga

SEQ ID NO: 37585 - RNA, 1623 nt, Artificial Sequence
  derived and/or modified sequence opt11 from major_viral_capsid_protein__Norovirus__AFN09933
augaagauggccagcaacgacgccaacccaucugacggaucggccgccaaccuugugccagaagucaacaacgaaguaauggccuuagagcccguagucggugcagccaucgccgcacccgucgcuggccaacaaaacgucauagaccccuggaucagaaacaacuucguccaagccccaggaggcgaguucacagucucaccccgaaacgcccccggagaaauccucuggagcgcaccccucggcccugaucucaaccccuaccucucucaccucgcccgcauguacaacggauacgccggcggcuucgaaguccaaguaauccuagcaggaaacgcauucaccgccggaaaaauuaucuucgcagccguacccccgaacuucccaacagaaggccuaucccccucccaagucaccauguucccccacauuauugucgacguccgacaacucgaacccguccuaauaccacuacccgacguccgcaacaacuucuaucacuacaaccaauccaacgacucaaccaucaaacucaucgccaugcucuacaccccacuacgcgcaaauaacgccggugaagacgucuucaccguaucaugccgaguucuaaccagacccucccccgacuucgacuucaucuuccucguacccccaacugucgaaucacgcacaaaacccuucaccgucccaauccuaacggucgaagaaaugaccaacucuagauuccccaucccccucgagaaacucuucaccggaccauccggugcuuucgucguccaaccacaaaacggccgaugcaccaccgacggcguacuccuaggcacuacccaacucuccccugucaacaucugcaccuuccgcggcgacgucacacacaucgcuggcucccgcaacuauaccaugaaucuagccucacucaacuggaauaacuaugacccuaccgaagaaauccccgcaccccuaggcacacccgacuucgucggaaagauucaaggaguccuuacccagaccaccaaaggcgacggcuccacacgcggccacaaagccaccgucuacaccggaucugccccauucacuccuaaacucggauccguccaauuuucaacagacaccgaaaaugacuucgaaacacaccaaaacaccaaauucacccccgucggcgucauacaagacggaucaaccacccaccguaacgagccacaacaauggguccuucccagcuauucuggccgaaacguccacaacguccaccucgcccccgccguagccccuaccuuccccggcgaacaacuccuauucuuucgcucaaccaugccaggcugcuccggcuaccccaacauggaccucgacugccuccucccacaagaguggguccaacacuucuaccaagaagccgcaccagcccaauccgacguagcccuacuucguuuugucaaucccgacaccggacgcguccuauucgaaugcaaacuccauaaauccggcuacguaacagucgcacacaccggacaacacgaccucguuauuccacccaacggauacuuccgauucgauucaugggucaaucaauucuacacucucgcucccaugggaaacggcaccggccgacgccgugcccucuga

SEQ ID NO: 37586 - RNA, 1623 nt, Artificial Sequence
  derived and/or modified sequence opt11 from major_viral_capsid_protein__Norovirus__AFN09936
augaaaauggcauccaacgacgccaaccccuccgacggcucagcagccaaccucguccccgaaguaaacaacgaagucauggcacucgaaccagucgucggagccgcaaucgcagcucccgucgccggacaacaaaacguaaucgaccccuggauccgcaacaacuuuguacaagcccccggcggcgaguucaccgucucuccccgcaacgcccccggagaaauccuaugguccgcgccacucggccccgaccuuaacccauaccucucccaccuagcacgaauguacaacggauacgccggcggauucgaaguccaagucauucuagccggcaacgccuuuacagccggcaaaaucaucuucgccgccgucccacccaauuuccccaccgaaggacuaucacccucucaggucaccauguuuccccauaucaucguugauguccgucaacuagaaccaguccucauuccccucccagacguccgcaacaacuucuaucacuacaaccaauccaacgacucaacaaucaaacucauagccaugcuuuacaccccacuacgagcaaacaacgccggagaagacgucuucaccguuuccugccgaguucucacacgacccagcccagacuucgacuucaucuuccucgucccucccacugucgaaucacgaacaaaacccuucaccguccccauccucacagucgaagaaaugaccaacucacgauuccccaucccacuagaaaaacucuucacaggaccaucaggagccuucguaguccaaccccaaaacggccgcuguaccaccgacggaguacuccucgggaccacccaacuaucacccgucaacaucugcacuuuccgcggcgacgucacccacaucgcagguucucgcaacuacaccaugaaccucgcuagccucaacuggaacaacuacgaccccaccgaagaaauccccgcaccccuaggcacccccgacuucgucggcaaaauccaaggaguccuaacccaaaccaccaaaggcgacggcuccacacggggacacaaagcaacagucuacaccggcuccgcccccuucacccccaaacucgguucuguacaauucuccaccgauaccgaaaacgauuuugaaacacaccagaacacaaaauucacacccguuggaguaauccaagauggaucaaccacacaccgaaacgaaccacaacaguggguccuaccaucguauucaggccgaaacguccacaacguccaccucgcacccgcagucgcucccaccuuccccggagaacaacucuuguucuuccgcucaaccaugccaggcugcucaggauaccccaacauggaccuagacugccuccuaccccaagaauggguccaacacuucuaccaagaagccgcacccgcccaauccgacguagcacuccuacgauucgucaaccccgacacaggccgaguccucuucgaaugcaaacuacacaaauccggcuacguaacggucgcacacacaggucaacacgaccucgucaucccacccaacggcuacuuccgcuucgacagcuggguaaaccaguucuacacccucgcccccaugggcaacggcacaggucgccgacgagcccuuuag

SEQ ID NO: 37587 - RNA, 1623 nt, Artificial Sequence
  derived and/or modified sequence opt11 from major_viral_capsid_protein__Norovirus__AFN09939
augaaaauggccucuaacgacgcaaacccuuccgacggcuccgcagccaaccuaguccccgaagucaacaaugaaguaauggcacucgaaccuguagucggcgcagccaucgcagcccccguagccggacagcaaaaugucaucgacccuuggauccggaacaacuucguccaggccccaggcggcgaauuuacugucucaccccgaaaugcucccggugaaauauuaugguccgccccucucggacccgaccucaacccauaccuaucccaccucgcucgcauguacaacggauacgcaggcgguuucgaaguccaggucauccucgcagguaacgcauucaccgccggcaaaaucauuuucgccgccgucccucccaacuuccccaccgaaggccucucccccucccaaguaaccauguucccacacaucaucguagacguccgccaacucgaacccguccucauaccccuccccgacguccgaaauaauuucuaccacuacaaccaauccaacgacucaacaaucaaacuaaucgccaugcuuuacaccccacuccgcgccaacaacgcuggcgaagacguauuuaccgucucaugccgcguccuaacacgacccucacccgacuucgacuucaucuuccuagucccacccaccguagaaucccgcacaaaacccuucaccguccccauccuaacagucgaagaaaugaccaacagccgcuuccccauaccacucgaaaaacucuuuaccggcccuucauccgccuucguuguacaaccccaaaacggacgaugcaccaccgauggaguacuccucggaaccacccaacucucccccgucaacauaugcaccuuccgcggcgacgucacccacaucgccggcucacguaacuacaccaugaaucucgccucccucaacuggaacaauuacgaccccaccgaagaaaucccagcuccccuaggcacccccgacuucgucgguaaaauccaaggcguccuaacacaaaccacaaaaggagacggcagcacccgcggccacaaagccacagucuacacaggcggcgccccauucaccccaaaacuaggcucugugcaauuuucaaccgacaccgaaaacgacuuugaaacacaccaaaacaccaaauuuacacccguaggcgucauacaagacggaucaaccacacaccgcaacgaaccacaacaauggguccuccccagcuacucaggccgaaacguccacaacguucaccucgcccccgcagucgcccccaccuuccccggagaacaacuccuauucuuccgcucaacaaugcccggcugcucgggguaucccaacauggaccuggacugccuucuaccgcaagaauggguccaacacuucuaccaggaagcagcucccgcccaaucagacgucgcccuccuccgcuucguaaaccccgacaccggccgcguacucuucgaaugcaaacuccacaaauccggcuacgucaccguagcccacaccggccaacacgaucuggucauacccccaaacggauacuuccgauucgacucaugggucaaccaauucuacacacucgccccuaugggcaacgguacaggccgaagacgagcccuuuaa

SEQ ID NO: 37588 - RNA, 1623 nt, Artificial Sequence
  derived and/or modified sequence opt11 from major_viral_capsid_protein__Norovirus__AFN09942
augaaaauggccuccaacgacgccaacccauccgacggcuccgccgccaacuuaguccccgaagucaacaaugaagucauggcacuagaacccgucgucggcgcugccaucgccgccccagucgcaggccaacaaaacguuaucgauccauggaucagaaacaacuuuguacaagcccccgguggcgaguucaccguaucaccccgaaacgccccaggagaaauccuuugguccgcaccccucggccccgaccucaaccccuaccucucccaucuugccagaauguacaacgguuacgccggaggcuucgaaguccaagucauacucgccggcaacgccuucacugccggcaaaaucaucuucgcugccguaccaccaaacuucccaacagaaggccucucacccucccaagucaccauguucccccauauaaucgucgacguccgucaacucgaacccguacucauuccccucccugauguccgcaacaacuucuaccacuauaaccaaucuaaugacuccacgauaaaacuuauagccaugcuguacacuccccucagagccaacaacgcuggcgaagacgucuucacagucuccugccgaguccucacacgccccucacccgacuucgacuucaucuuccuaguaccaccaaccguagaaucccgcaccaaaccauucaccguucccauucucacaguagaggagaugaccaacucacgcuuccccauaccccucgaaaaacucuuuacaggccccuccggagccuucguaguccaaccccaaaacggacgcugcacuaccgacggaguccuccucggaaccacccaacuuucacccgucaacaucugcaccuuccgcggugacgucacacacaucgccggaucaaggaacuauaccaugaaccuugcaucacucaacuggaacaacuacgaccccaccgaagaaauccccgccccacuagguaccccagauuucgucggcaaaauccaggguguccucacccaaacaacaaaaggcgacggcuccacccgcggccacaaggcuaccgucuauaccggcucagcccccuuuacacccaaacuagguucaguccaguucucuaccgacaccgaaaacgacuucgaaacccaccaaaacacaaaauucaccccagucggcgucauccaagacggcucaacaacccaccgcaacgaaccccaacaauggguccuccccuccuacuccggccgcaacguccacaacguccaccucgcccccgccguagccccaacauuccccggcgaacaacuccucuucuuccgcuccaccaugcccggcugcucuggcuaccccaacauggaccucgauugccuccuaccacaagaauggguccaacacuucuaccaagaagccgcccccgcucaaucagacguagcccuccuccgcuucgucaacccggacacuggccgcguucuuuucgaaugcaaacuccacaaaucaggcuacguaaccgucgcccacaccgggcaacacgaccucgucaucccuccaaacggcuacuuccgauuugacagcugggucaaccaauucuacacacucgccccaaugggcaacggcaccggucgccgccgagcgcuauaa

SEQ ID NO: 37589 - RNA, 1623 nt, Artificial Sequence
  derived and/or modified sequence opt11 from major_viral_capsid_protein__Norovirus__AFN09945
augaaaauggccucaaacgaugcaaaccccagcgacggcuccgcugcuaaccucguccccgaaguaaacaacgaaguaauggcccucgaacccguaguaggagcagccaucgccgcaccuguagccggccaacaaaaugucauagaccccuggauccguaauaacuucguucaagccccgggcggugaguucaccgucucgccacgcaaugcccccggugaaauccucugguccgcaccccucggcccugaccuaaacccauaccucucucaccuagcccguauguacaacgguuacgccggaggcuucgaaguucaaguaauucucgccggcaacgccuucaccgccggcaaaaucaucuucgccgccguacccccaaacuuccccaccgaaggucucucccccucccaagucaccauguuuccccacaucauagucgacguccgccaacucgaaccuguccucaucccacuccccgacguccgcaauaacuucuaucauuacaaccaauccaacgacuccaccaucaaacucauagcaaugcuguacacgccccuccgugccaacaaugcaggcgaagacgucuucaccgucucaugccgcguccuuacccgacccucccccgauuuugauuucaucuuccucgucccuccgaccgucgaaucaaggacaaaaccauuuaccguccccauccuaaccguagaagaaaugacuaacuccagauuccccauaccccucgaaaaacucuucaccggccccuccuccgccuucguaguccaaccacagaacggccgcuguaccacugacggcguccuacucggcacuacacaacuuucccccgucaacaucugcaccuuccgcggcgacgucacccacaucgcgggcucccacaacuacacuaugaaccucgccagccucaacuggaacaacuacgacccaaccgaagaaauccccgcaccccuuggcacccccgacuuuguuggaaaaauucaaggagugcucacccaaaccacuaaaggcgacggcucuacacgcggccacaaagcaaccgucuacacaggcuccgcccccuucacccccaaacucggcuccguucaauucucaacagacacugagaacgauuucgaaacccaccaaaacaccaaauucacacccgucggcgucauccaagacggcagcacuacccaccgaaacgaaccccaacaauggguccucccaagcuacuccggcggcaacguccacaacguccaccuagcccccgccguggcacccaccuuccccggcgaacaacuccuuuucuuccgcucaaccaugccaggcugcagcggcuacccgaacauggaccuugacugcuuacucccccaagaauggguacaacacuucuaccaagaagccgccccagcccaauccgacgucgcacuccuaagauucgucaauccagacaccggccguguccucuucgaaugcaaacuacacaaaagcggcuacguaacaguagcccacaccggccaacacgaccucguaaucccacccaacgguuacuuccgcuucgacucaugggucaaucaauuuuacacccucgcccccaugggcaacggaaccggacgccggcgagcccucuaa

SEQ ID NO: 37590 - RNA, 1623 nt, Artificial Sequence
  derived and/or modified sequence opt11 from major_viral_capsid_protein__Norovirus__AFN09948
augaaaauggccagcaacgacgcgaaccccucugacgguuccgcagccaaccuagucccagaagucaacaacgaaguaauggcccucgaacccguaguaggagccgccaucgccgccccagucgccggccagcaaaacgucaucgacccauggauccgcaacaacuuuguucaagccccuggaggcgaguucaccguauccccacgaaacgcccccggcgagauacucugguccgcaccccucggccccgaccucaauccuuaccucucccaccucgcacgaauguacaacggauacgcuggcggcuucgaaguccaagucauccucgccggcaacgcuuucacagccggcaaaaucauauucgcagccguacccccuaacuuuccuaccgaaggccucggacccucccaagucaccauguuuccacacauuauuguagacguccgacaacucgaaccaguccucaucccccuacccgacgucaggaacaacuucuaccacuacaaccaaagcaacgacuccacuaucaaacucaucgcaaugcuuuacaccccgcuacgagccaacaacgccggugaagauguauucacagucucaugccgcguucucacccgccccucacccgacuucgacuucaucuuccuaguaccacccaccgucgaaucacgcacaaaacccuucaccguccccauccucaccgucgaagaaaugaccaacucccgauucccaauuccccucgaaaaacucuucaccggccccucgggcgcauucgucguccaaccacaaaacggucgaugcacgaccgacggaguacuccugggaaccacccaacucagccccgucaacaucuguacuuuccgcggcgacguaacccauaucgcaggaucucgaaauuacacaaugaaccucgccucgcuaaacuggaacaacuacgaccccaccgaagaaauccccgcaccccuaggcacccccgacuucgucggaaaaauacaaggcguccucacacaaacaacaaaaggagacggcuccacccgcggccacaaagccacgguauacaccggcggggcccccuucacacccaaacucggauccguccaguucuccacagacaccgaaaacgacuucgagacccaccaaaacaccaaauuuacccccguaggcguaauccaagacggcucgaccacacaucgcaacgaaccgcaacaguggguccuacccucuuacucaggucgaaacguacacaacguccaccucgcccccgcagucgcccccaccuuucccggagaacaacuccucuucuuccgcuccaccaugcccgguugcuccggguaccccaacauggaccucgacugccuacuaccccaggaauggguccagcacuucuaucaagaagccgcccccgcccaaucugacgucgcacuccuccgcuuuguuaaccccgacaccggcagaguccuuuucgagugcaaacuacacaaaucaggcuacgucacaguagcgcacaccggccaacaugaccuuguaauacccccaaacggcuacuucagauucgacucgugggucaaccaauucuacacccucgcacccaugggaaacggcaccggacgccgacgagcccuuuaa

SEQ ID NO: 37591 - RNA, 1623 nt, Artificial Sequence
  derived and/or modified sequence opt11 from major_viral_capsid_protein__Norovirus__AFN09951
augaagauggccuccaacgacgccaacccaagcgacggcucugcagcaaaccuuguccccgaagucaacaacgaagucauggcccucgaacccguagucggcgcugcaaucgccgcccccgucgccggccagcaaaacguuaucgacccauggauucgcaacaacuucguccaagcacccggcggcgaguucaccguauccccacgcaacgcacccggagaaauccuaugguccgcaccccucggcccugaccucaacccauaccucucccacuuagcccgcauguacaacggcuacgccggcgguuuugaaguucaggucauacucgccggcaacgccuucaccgccggcaaaauaauauucgccgccguaccacccaacuuccccaccgaaggacuaagccccagccaagucacaauguuuccccauaucauugucgacguccgccaguuagaacccgugcucaucccacucccagacguacgcaacaacuucuaccacuacaaccaauccaacgacucaaccaucaaacugaucgccaugcuauacacuccccuccgcgccaacaacgccggugaagacguuuucaccguaagcugccgcguccucacccgccccucccccgacuucgacuucaucuuccucguaccacccaccgucgaaucccgcacaaaacccuucaccguacccauccucaccgucgaagaaaugacuaauagccgauuccccauuccucucgaaaaacucuuuacaggccccucaggcgccuucgucguccaaccccaaaauggaagaugcacaacagacggaguccuacucggaaccacccaacucucacccgucaacaucugcaccuuccgaggugacguaacccacaucgccggcucucgaaacuauaccaugaaccucgccucccucaacuggaacaacuacgaucccacugaggaaaucccagcuccccucggcacacccgacuucgucggcaagauacaaggcguucucacccaaaccacuaaaggcgacggcucaacccgcggccacaaagcuaccguuuacaccggauccgcacccuucaccccuaaacuuggcuccguccaauucuccaccgacaccgaaaacgacuucgaaacacaccaaaacacaaaguucacucccgucggagucauccaagacggauccaccacccaccgcaacgaaccccaacaauggguacuaccaucguacuccggccgaaacguccacaacguacaccuagcacccgccgucgccccuacauuucccggcgagcaacuccucuucuuccgguccacaaugcccggcugcuccggcuacccuaacauggaccuugacugccuacucccccaagaauggguacaacacuucuaccaagaagccgcccccgcccaaucugacguagcccuacuccgcuucgucaaccccgacaccggccguguucuuuucgaaugcaaacuacacaaauccggcuacgucaccguugcacacaccggacaacacgacuuagucauacccccaaacggauacuuccgguucgacuccugggucaaccaguucuacacccucgcacccaugggcaacggcacaggcagacgccgugcacuauaa

SEQ ID NO: 37592 - RNA, 1623 nt, Artificial Sequence
  derived and/or modified sequence opt11 from major_viral_capsid_protein__Norovirus__AFN09954
augaaaauggcauccaacgacgcaaaccccuccgacggaucagcagcaaaccucguacccgaggucaacaacgaaguaauggcccucgaacccguagucggagccgccaucgccgccccagucgccggacagcaaaacgucaucgaccccuggauacgcaacaauuucguacaagccccaggcggagaguucacggucucgccccgcaaugcccccggcgaaauccucuggucagcaccacucggccccgaccucaaucccuaccucucccaccuggcacgcauguauaauggauacgccggaggauucgaaguacaagucauacucgccgggaacgccuucacugccgguaaaaucaucuucgcugccguaccacccaacuuucccaccgaaggccucagccccucccaagucaccauguuuccccacaucauaguagacguccgccaacuugaacccgugcuaaucccccuccccgacguaaggaacaacuucuaccacuacaaccaauccaacgacuccacaaucaaacucauagcuaugcuuuacacccccuuacgcgcuaacaacgccggcgaagacgucuucaccgucagcugccggguacucacacgcccaucacccgacuucgaccucaucuuccucguuccacccacugucgaaucccguacaaaacccuucaccguccccauccucacagucgaagaaaugacaaauucccgcuuccccauuccccucgagaagcucuuuaccggacccagcggcgccuucgucguccaaccacaaaacggacguugcaccaccgacggcguccuacucggaaccacucaacucucccccgucaacaucugcaccuuccgaggcgacgugacccacaucgcagguuccagaaacuacacaaugaaccucgccucccucaacuggaacaacuacgaccccacugaagaaauccccgcaccgcucggcacacccgacuucguaggcaaaauccaaggcguacuuacccaaaccaccaaaggagacggaucaacacgaggccacaaagccacagucuauaccggaggcgcucccuucacccccaaacucggcuccguacaauucuccacagacacagaaaacgacuucgaaacacaccaaaacacuaaguucacaccaguaggcguaauccaggauggcuccaccacccaccgcaacgaaccccagcaguggguacucccauccuauuccggucgaaacguccacaacguccaccucgccccagcagucgcacccaccuucccaggcgaacaacuacucuucuuccgcucaaccaugcccggaugcuccggcuaccccaacauggaccucgacugccuucuaccacaagaauggguccaacacuucuaccaagaagccgccccagcccaauccgacgucgcacuacuaagauucguuaacccugacacgggccgcguacuauucgagugcaaacuacacaaauccggauacguaaccgucgcccacaccggccaacacgaccucgucauacccccaaacggauauuuccgguucgacuccugggucaaccaauucuacacccucgcacccaugggcaacggcacaggaagaagacgagcccucuaa

SEQ ID NO: 37593 - RNA, 1623 nt, Artificial Sequence
  derived and/or modified sequence opt11 from major_viral_capsid_protein__Norovirus__AFN09957
augaaaauggccucaaacgacgccaaucccuccgacgguuccgccgccaaccucguacccgaagucaacaacgaagucauggcccuagaaccaguaguuggcgccgccaucgcugcaccggucgcaggccagcaaaacgucauugaccccuggauuagaaacaacuucguccaagcccccgguggcgaguucaccgucucuccccgaaacgccccaggagaaauccucugguccgcuccccuuggcccagaccucaaccccuaccuaucccaccucgcccgcauguacaacggcuacgccggaggcuucgaaguucaaguuauccucgccggcaacgccuucaccgcaggcaaaauaauauuugccgcaguucccccaaacuuuccaacagaaggucucucgcccucacaagucaccauguucccccacauaaucguagacguacgccaacucgaacccgucuuaauuccacuaccagacguccgcaacaacuucuaccacuacaaccaauccaaugacucuaccauaaaacucauagccaugcucuauacaccccuccgcgccaacaacgccggugaagacgucuucacagucuccugccguguccucacucguccaucccccgacuuugacuucaucuuccuaguacccccuacugucgaaucacggacaaaacccuucaccgucccaauacuaaccgucgaagaaaugacaaauucccgauuccccauuccccucgaaaaauuauuuaccggccccuccggcgcauucgucguccaaccacaaaacgggcgcugcaccaccgacggcguccuucuaggaaccacacaacuaagcccggucaacaucuguaccuuucgaggagacgucacccacaucgccggaucacgaaauuacaccaugaaccuugccucacucaacuggaacaacuacgaccccacugaagaaauccccgcaccacucggaacacccgacuucguaggaaaaauccaaggcguccucacccaaacaacaaaaggcgacggauccacccgcggacacaaagccaccgucuacaccgguggagccccauucacccccaaacuaggcuccguacaauucuccaccgacaccgaaaacgacuucgaaacccaccaaaacaccaaauucacacccguaggcguuauacaagacggauccaccacccaccgcaaugaaccacaacaauggguccuccccuccuacuccggucgcaacguccacaacguccaccuugccccggccguagcaccuaccuucccaggcgaacaacuccuauucuuccguuccaccaugccaggcugcuccggcuacccaaauauggaccuagacugccuccucccacaagaauggguccaacacuucuaccaagaagccgcccccgcacaauccgacgucgcucuauuacgcuuugucaaccccgacaccggacgaguacucuucgaaugcaaacuccacaaaucaggauacgucaccgucgcccacacaggccaacaugaccucgucaucccgccaaacggauauuuccgcuucgacucaugggucaaccaauucuacacauuagccccgaugggcaacggcaccggacgccgcagagcccucuaa

SEQ ID NO: 37594 - RNA, 1623 nt, Artificial Sequence
  derived and/or modified sequence opt11 from major_viral_capsid_protein__Norovirus__AFN09960
augaaaauggccuccaacgacgcaaaccccucugacggaucugcagccaaccucguuccagaagucaacaacgaaguaauggcccucgaacccgucgucggagccgccaucgcugcaccagucgcaggccaacaaaacgucauugaccccuggauacgcaacaacuucguccaagcacccggaggcgaguucaccguaucaccuagaaacgccccgggagaaauccuuugguccgccccacuuggacccgaccuaaaucccuaccuuucacaccucgcccgaauguacaacgguuacgcgggcggcuucgaaguccaagucauccucgccggaaacgccuuuaccgcaggaaaaaucaucuucgcagccgucccaccaaacuucccuaccgaaggccuuucccccucacaagucacaauguucccacacaucaucguagacguacgccagcuagaaccuguacuaauaccccuccccgacguacgcaacaauuucuaccacuacaaccaauccaacgacucaaccaucaaacuaaucgccaugcucuacacaccacuuagagccaacaacgccggagaagacgucuucaccguauccugccgaguacucacacgacccuccccugacuucgacuucaucuuccuagucccaccgaccgucgaaucccgcaccaaacccuuuaccguacccauacugacagucgaagaaaugaccaacucccguuucccaaucccacuggaaaaacuauuucgcggccgauccuccgcccuagucguccacccucaaaacggacgcugcaccacugacggaguacuacucggcaccacccaacucagccccgucaacaucugcaccuuccgcggugacguaacacacaucgccggcucucauaacuacacaaugaaccuugcuucacucaacuggaacaauuacgacccaacagaagaaauccccgcaccccucggaacccccgacuucguuggcaagauucaaggcguccucacccaaaccaccaagggagacggcucaacccgaggccacaaagccacaguauacaccggcucugccccauucacuccuaaacucggaagcguccaauucucaaccgacacagaaaacgacuucgaaacacaccaaaacaccaaauucacaccugucggcguaauccaagacggcucaacaacccaccgcaacgaaccccaacaauggguacucccuuccuacuccggaggcaacguucacaacguccaccucgccccagccgucgcccccacguucccaggcgaacaacuucucuucuuccgaucaacaaugcccggcugcagcggcuaccccaauauggaccucgacugccuacucccccaagaauggguacaacacuucuaccaagaagccgcacccgcgcaauccgacgucgcacuucuucgauucgucaaccccgacaccggccgcguccuauucgaguacaaacuccacaaauccgacuacguaacagucgcccacaccggccaacacgaccuagucauaccuccaaacggauacuucagguucgacucaugggucaaccaauucuacacccuagccgcaaugggcaacggaaccggccgccgacgcgcacucuaa

SEQ ID NO: 37595 - RNA, 1623 nt, Artificial Sequence
  derived and/or modified sequence opt11 from major_viral_capsid_protein__Norovirus__AFN09963
augaaaauggccuccaacgacgccaaccccuccgacggcuccgcagcuaaccucguacccgaaguaaauaacgaagucauggcccucgagcccgucgucggcgccgccaucgccgccccagucgccggacaacaaaacgucaucgaccccuggauucgcaacaacuuuguccaggcuccaggaggagaguucaccguaucaccucgaaaugcacccggcgaaauccuaugguccgcaccacucggccccgaucucaacccauaccuaucacaccuagcaagaauguacaacggauaugccggcggguucgaaguccaggucauccucgcaggaaacgccuucacugcggggaaaaucauauucgcagccguucccccaaacuuucccacagaaggccucucucccucccaagucaccauguucccccacaucaucgucgacguccgacaacucgaacccguauuaaucccacuccccgacguccgcaacaacuucuaccacuacaaccagucuaacgacuccaccauaaaauuaauugccaugcuauacacaccucuacgcgcgaacaacgcuggugacgacgucuucacaguuagcugccgcguacuaacacgacccucccccgacuucgacuucaucuuucuagucccaccaaccgucgaauccagaacuaaacccuucaccguacccauccugaccgucgaagagaugacuaacucccgcuucccaaucccccucgaaaaacuuuucaccggccccucuucagcauucguaguccaaccccaaaacggccgcuguacaacagauggcguccuccuaggcacaacccaacucucgcccguuaacaucugcaccuuccgcggugacgugacccacaucgccggcucccgcaacuacaccaugaacuuagccucacuaaacuggaacaacuacgaccccacagaggaaauccccgccccacucggcacacccgauuucgucggcaaaauccaaggcguucucacccaaaccaccaagggcgacggauccacucggggccacaaagccacagucuacacaggcucagcaucauucacccccaaacuuggcuccguccaauucucaaccgacaccgaaaacgacuuugaaacccaccaaaacaccaaauucaccccaguaggcguuauacaagacggcucgaccacacaucguaacgaaccccaacaauggguacuaccgucauacucaggacgaaauguccacaacguccaccucgcaccagccgucgcaccaaccuuucccggcgaacagcuccucuucuuccgcuccaccaugcccggcugcucaggcuaccccaacauggaccucgacugcuugcucccucaagaauggguccagcacuucuaccaggaagcugcccccgcccaauccgacgucgcacuccuccgcuucgucaaccccgacaccggccguguccucuucgaaugcaaacuccacaaauccggcuacgucacaguagcucacaccggacaacacgaccucguaaucccacccaauggcuacuuccgcuucgacucauggguuaaccaguucuacacccuagcacccaugggcaacggcacaggccgcagacgagcccuauaa

SEQ ID NO: 37596 - RNA, 1623 nt, Artificial Sequence
  derived and/or modified sequence opt11 from major_viral_capsid_protein__Norovirus__AFN09966
augaaaauggccuccaacgacgccaaccccucagacgguucagccgcaaaccuaguccccgaaguaaacaacgaagucauggcccucgaaccagucgucggcgccgccaucgccgcccccgucgcaggccaacaaaaugucaucgacccauggauacgcaacaacuucguccaagcuccaggcggagaguucaccgucucuccccgcaacgcccccggagaaauccucugguccgccccacucgggccagaccucaacccauaccucucucaccucgcccgcauguacaacggcuacgccggcggcuucgaaguccaaguaauccuagccggcaacgcauucacagccggcaaaaucauuuucgcugccgucccacccaauuuccccaccgaaggccucuccccaucccaagucaccauguucccacauauaauaguagacguccgccaacucgaacccguccucauaccucuccccgauguccgcaacaacuucuaccacuacaaccaaucgaaugacucaaccauuaaacucaucgcaauguuauacacaccccuacgcgcuaacaacgccggggaagacgucuucaccguaucaugccgaguccuuacacgacccucccccgacuucgacuucaucuuccucgucccacccaccgucgaaucucgcaccaaacccuucaccguccccauacucacagucgaggaaaugaccaacucccgauucccuaucccccucgaaaaacuuuucacaggacccucaggcgccuucguaguccaaccacaaaacggcagaugcaccaccgacggcguccuccuaggcaccacccagcuuagcccagucaauaucugcaccuucagaggcgacgucacccacauagccggcucccguaacuacaccaugaaccuagccucccucaauuggaacaacuacgacccaaccgaagaaauacccgcaccccuaggaacccccgacuucgucggcaagauccaagguguccuaacucaaacaacgaaaggagacgggucaacccgcggacacaaagccaccgucuacaccggaucagcccccuucacccccaaacucggauccguucaauucuccaccgacaccgaaaacgauuucgaaacccaccaaaacacaaaauucaccccgguuggcgucauccaagacggaagcaccacccaccgcaacgaaccacaacaauggguucuacccuccuacuccggcagaaacguacacaauguccaccuagcacccgccguagccccaaccuuccccggcgaacaacuccuauucuuccgcucgaccaugcccggaugcuccggcuaccccaacauggaccuagacugccuccuaccccaagaguggguccaacauuucuaccaagaagccgcacccgcccaaagcgacgucgcccuccuccgauucgucaaccccgauaccggucguguucucuucgaaugcaaacuacacaaaucuggcuacgucacaguugcccacacaggucaacacgaucuagucaucccaccaaacggcuacuuccgauucgacagcuggguaaaccaauucuacacccucgccccaaugggaaaugguaccggccgacgacgcgcccucuga

SEQ ID NO: 37597 - RNA, 1623 nt, Artificial Sequence
  derived and/or modified sequence opt11 from major_viral_capsid_protein__Norovirus__AFN09969
augaaaauggcaagcaacgacgccaacccaucagacggauccgcagccaaccuggucccugaaguaaacaacgaaguaauggcccuugaacccguggucggagcagccaucgccgcacccgucgccggccaacaaaacguuaucgacccauggauaagaaacaacuucguacaggcccccggcggagaguucaccgucucaccccgcaacgccccuggcgaaauccuaugguccgcgccacucggacccgaccucaacccuuaccuaucccaccucgcccgaauguacaacgguuacgcuggcgguuucgaaguacaggucauccuagccggcaacgcauucacagccggcaaaauaauauucgccgccguuccacccaacuucccaacagaaggacuauccccaucccagguuacgauguucccacacaucaucgucgacguacgccaacuagaaccagugcuaaucccccuucccgauguacgaaacaacuucuaccacuacaaccaauccaacgacuccacaauaaaacuaaucgccaugcuauacacaccacuacgcgcaaacaacgcaggcgaagacguauucacuguaagcugccgcguccuaacccgacccucgcccgacuucgacuucauuuuccucguaccaccgacaguagaaucccgcaccaaaccauuuaccgugcccauacucacagucgaagaaaugacaaacagccgcuucccaaucccccucgaaaaacucuuuacuggcccaucauccgcauuugucguccaaccccaaaacggacgcugcaccaccgacggaguccuacuaggcacaacccaacucucucccguaaauaucugcacauuccgcggagacgucacccacaucgccggcucacgcaacuauaccaugaaccucgccucccucaacuggaacaacuacgaccccaccgaagaaauaccggcaccccuaggcaccccagacuucgucggaaaaauccaaggcguccuaacccaaaccaccaaaggagacggcucaacucgcggccacaaagccacugucuacaccggcuccgccccguucacacccaaacucggaucaguccaauucucaaccgacaccgaaaacgacuucgaaacccaccaaaacacuaaauucaccccgguaggcgucauacaagacggagggaccacccaccgcaacgaaccacaacaauggguccuaccauccuacuccgggcgagacgucccaaacguccaccucgcacccgccguagcccccaccuucccaggagaacaacuacuauucuuccgauccaccaugccagguugcuccggcuaccccaacauggaucuggacugccuacucccacaagaauggguacaacauuucuaccaagaagccgcucccgcccaauccgacguagcucuccuccgcuucgucaaccccgacaccggccgugugcuuuucgaauguaaacuccacaagucuggauacguaaccgucgcccacaccggacagcacgaccucgucauaccaccaaacggguacuuccgcuucgacagcugggucaaccaauucuacacgcuagcccccaugggcaacggcacuggacgccgacgcgcccucuaa

SEQ ID NO: 37598 - RNA, 1623 nt, Artificial Sequence
  derived and/or modified sequence opt11 from major_viral_capsid_protein__Norovirus__AFN09972
augaaaauggccucuaacgacgccucccccagcgacggauccgccgcuaaccucguacccgaagucaacaacgaaguaauggcccuugagccagucgucggcgccgccaucgcagcaccagucgccggccaacaaaacgugauagaccccuggauccgcaacaacuucguccaagccccugguggugaguucacaguaagcccacgcaacgcaccaggagaaauccucuggagcgcaccccucggcccagaccucaacccauaccucucacaccuagcccggauguacaauggcuacgccggaggauucgaaguccaagucauacucgccggcaacgccuucacagccggcaagaucaucuucgccgccgucccaccaaacuuccccacagaaggcuuaucucccucccaaguaacgauguucccccacaucauaguagacguacgccagcuugaaccaguccuaauaccacucccagacgugagaaacaacuucuaccacuauaaucaaucaaaugacucuacaaucaaacucaucgcaaugcucuacaccccgcuccgcgccaacaacgcaggagaagacguauucacugucuccugccgcguccuuacacgccccucccccgacuucgacuuuaucuuccucgucccgcccaccgucgaaucccgcacuaaacccuucaccguaccaauccugacuguugaagaaaugacaaacucuagauuuccuaucccccucgaaaaacucuucaccggcccauccggagccuucgucguccaaccccaaaauggccgcugcaccaccgauggcguacuccucggcaccacacaacucucccccgucaacauauguacuuuccgcggagacgucacccacaucgccggcucccguaacuauacaaugaaccucgcagcucucaacuggaacaacuaugaccccaccgaagaaauacccgccccacucggcacccccgacuucgucggcaaaauucaaggcguccuaacccaaaccacgaaggccgacggaagcacccgcggacacaaagccacaguauacaccggcuccgcagacuuuacaccuaaacuagggucaguccaauucuccacagacacagaaaacgacuucgagacccaccaaaacacaaaauucacaccuguaggaguaauccaagacggcucuacaacccaccgcaacgaaccacagcaauggguacucccuuccuauucaggccgaaacguacaaaacguccaccucgccccagccgucgcucccaccuuccccggcgaacaacuccuuuucuuccgcuccaccaugcccggcugcaguggcuacccaaacauggaccuagacugccuacuaccccaagaauggguccaacacuucuaccaagaagccgccccagcccaaucagacgucgcccuccuccgcuucguuaacccagacaccggccggguccuauucgaaugcaaacuccacaaauccggcuacgucacugucgcccacaccgggcaacaugacuuaguaaucccacccaauggcuacuuccgauucgauucauggguaaaccaauucuacacccucgcaccuaugggcaacggcaccggccgccgccgcgcccucuga

SEQ ID NO: 37599 - RNA, 1593 nt, Artificial Sequence
  derived and/or modified sequence opt11 from major_viral_capsid_protein__Norovirus__AFN09975
augaaaauggcauccuccgacgccaaccccuccgacggcucuaccgccaaccucguccccgaagucaacaacgaaguaauggcacucgaacccguaguaggagcugcuauagcagcacccguugccggccaacaaaacguuauugaccccuggauccggaacaacuucguacaagcccccggaggcgaauuuaccgucucuccccgaaacgccccuggcgaaauacucuggucagcuccccucggccccgaccucaaucccuaccucucacaccuugcccgcauguacaacggcuacgccgguggcuucgaagugcaagucauucuagcaggcaacgccuucaccgccggcaaaauaauauucgccgccgucccucccaacuuccccaccgaaggccucagcccaucacaagucacaauguucccccacaucauagucgacguacgacaacucgaacccguacucauuccucuccccgacguccgcaacaacuucuaccacuacaaccaaucaaacgacucaaccauuaaacuuaucgcuaugcuuuacacuccccuccgcgccaacaacgccggcgacgacguuuuuaccguauccugccgugucuuaacccgaccaucaccucgcuucgaaucgagaaccaaaccauucuccguaccuguccuaaccguagaggaaaugaccaauucccgauuccccaucccccuagaaaaacuuuuuaccggcccauccuccgcuuucguaguccaaccccaaaacggccgaugcacuaccgacggcguucuucuugguacaacccaacucucaccagucaacaucugcacauuccgcggcgacgucacccacauccccggcucccgcaacuacaccaugaaccuagccucccaaaauuggaacucuuacgggccaaccgaggaaaucccagcaccacucggaacaccagauuucgucgguaaaauccagggaguucucacacaaaccaccagaaccaacggauccacucgaggccacaaagccaccguuuacaccggcuccgcagacuucucccccaaacucggccguguccaauucgccaccgacaccgacaaugacuucgaaaccaaccaaaauacgaaauucacacccgucggaguaauccaagacggcucaaccacaccucgcaacgaaccccaacaauggguacuccccuccuacucaggacgcaacauccacaauguccaccucgcacccgcagucgcccccaccuuccccggugaacaacuccuuuucuuccgcucaacaaugcccggcugcucuggauaccccaacauggaccucgacugccuucucccacaagaauggguccaauauuucuaccaagaagcggcccccgcccaaucagacguugcacucuuacgauucguaaaucccgacaccggacgcguccuauucgaaugcaaacuccacaaauccggcuacguaaccguagcccacaccggccaacacgaccucgucaucccacccaacggcuacuuccgauucgacucaugggucaaccaauucuacacccuagcccccaugggcaacggcacaggacgccgccgcgcgcucuga

SEQ ID NO: 37600 - RNA, 1623 nt, Artificial Sequence
  derived and/or modified sequence opt11 from major_viral_capsid_protein__Norovirus__AFN09978
augaaaauggcuagcagcgacgcaaacccauccgacggcagcaccgccaaucucgucccugaggucaacaacgaagucauggcucuagaaccaguagucggugccgccaucgcagcccccguugccggacaacaaaauguuauagacccauggaucagaaauaacuucguacaagcacccugcggugaguucaccgucucuccccgcaacgcuccaggagaaauccuuuggucagccccacuaggaccagaccucaauccauaucucagccaccuagcccgcauguacaauggauaugccggaggcuucgaaguccaaguaauccuugccggcaacgccuucacagccggcaaaaucaucuucgccgccgucccacccaacuucccaacagaaggccucuccccaucacaaguaaccauguucccacacaucauagucgauguacgccaacucgaacccguacucaucccccuacccgacguccguaauaacuucuaccacuacaaccaauccaacgacuccaccaucaaacucaucgcaauguuauauaccccucuccgcgccaacaacgcaggagacgacgucuucacggucagcugccgcguacucacccgcccuagccccgacuucgacuuuauuuuucucguacccccaacagucgaaucccgcaccaaaccguucagcguacccguccucacagucgaagaaaugacaaacagccgauuccccaucccccucgaaaaacucuucaccggaccauccucugccuucgucguccaaccccaaaacggccggugcaccaccgacggaguccuccuaggcacaacacaacuaucacccgucaacauuugcacauuccgcggagacguaacccacauccccggaucacgcaacuacaccaugaaucucgccucccaaaacuggaacuccuacgaucccaccgaagaaauaccagcccccuuaggcacccccgacuuugucggaaaaauccaaggaguacuaacccaaacaacacgcacaaacggaucaacccgaggccacaaagccaccgucuauacagguuccgcagacuucuccccaaaacucggacgcguacaauucgccacagacaccgacaacgacuucgaaacaaaccaaaacaccaaauucacacccgucggcguaauccaagacggaucuacuacaccuagaaacgaaccacagcaauggguacuacccuccuacucaggccgcaacauccacaacguucaccucgcccccgccgucgcacccaccuucccaggagaacagcuacucuucuuccgcuccaccaugccaggaugcuccggcuaccccaacauggaccuagacugccuccuaccgcaagaauggguccaauacuucuaucaagaagccgccccggcacaaucugacguagcccugcuccgauucgucaaccccgacacaggccgcguccucuucgaaugcaaacuccacaaauccgguuacgucaccguagcacacacaggacaacacgaccucguaauacccccaaacggcuacuuuagguucgacucaugggucaaccaauucuacacccucgcccccaugggcaacggcaccggacgccgcagagcccucuaa

SEQ ID NO: 37601 - RNA, 1623 nt, Artificial Sequence
  derived and/or modified sequence opt11 from major_viral_capsid_protein__Norovirus__AFN09981
augaaaauggcauccaacgacgucaaccccuccgacggcuccgcagccaaccucguccccgaagucaacaacgaagucauggcucucgaacccguggucggcgcugccaucgccgcccccgucgccggacaacagaacgucaucgaccccuggauacgcaacaacuucguccaagcuccagguggagaguucacagucuccccucgaaacgcacccggagaaauacuuugguccgcaccccucggcccagaccuaaaccccuaccuuucccaccucgcccgaauguacaacggcuacgcaggcggcuucgaaguccaagucauacuagccggcaaugcuuucaccgcaggaaaaaucaucuucgccgcgguaccacccaacuuccccacugaaggccuauccccaucacaagucaccauguucccccacaucaucgucgacguacgacaacuagaacccguccucauaccucuccccgacguccgcaacaacuucuaccacuacaaccaauccaacgacuccaccauaaaacucauugccauguuauauaccccacugcgagccaacaacgccggcgaagacgucuucacugucucaugccgcguucucacacguccauccccagacuuugauuucaucuuccuaguaccaccuaccgucgaaucgcgaaccaaacccuucaccguccccauacucaccgucgaagaaaugacaaacucccgauuccccaucccccucgaaaaacuuuucacaggaccuucguccgccuucgucguccaaccccaaaacggcagaugcaccaccgacggaguacugcuaggaaccacacaacuaucccccgucaacaucugcacuuuucgaggagacgucacccacaucgcaggaucccgcaauuacaccaugaaccucgcaucacuaaacuggaacaauuacgaccccacugaagaaaucccagcuccccuaggcaccccagacuucguaggcaagauccaaggcguccucacccaaaccacuaaaggcgacgguuccacccgcggccacaaagccacagucuacaccggauccgcccccuucacaccaaaacucggcucaguacaauucucaaccgacacagaaaacgacuucgaaacccaccaaaacaccaaauucaccccagucggcgucauccaagacggcggaacaacccaccgcaacgaaccccaacaauggguccuccccagcuacucaggccgagacguccccaacguccaccucgcccccgccgucgcaccaacauucccuggagaacaacuccucuucuuccggucaacaaugcccggaugcuccggauacccaaacauggaccuagacugccuacucccucaggaauggguucaacacuucuaccaagaagccgcacccgcccaauccgacguagcccuccuccguuucgucaaucccgacaccggucgcguacuuuucgaauguaaacuccacaaaucaggauacgucacagucgcccacaccgggcaacacgaccucguaauuccacccaacgguuacuuccgcuucgacuccuggguaaaccaauucuauacccuagcccccaugggcaacggaaccggccgccgccgagcacucuaa

SEQ ID NO: 37602 - RNA, 1623 nt, Artificial Sequence
  derived and/or modified sequence opt11 from major_viral_capsid_protein__Norovirus__AFN09984
augaaaauggccagcuccgacgccaacccuagcgacgguagcaccgcuaaccuaguccccgaagucaacaacgaagucauggcccuagaacccgucguaggcgcagccaucgccgcccccgucgccggccaacaaaacgucaucgaccccuggauccgcaacaauuucguccaagcaccaggcggagaauuuaccgucucaccccgaaacgcccccggggaaauacucugguccgcaccccucggccccgaccucaacccauaccugucccaccucgcccgcauguacaacggauacgccggaggcuucgaaguccaaguaauccuugccggcaacgccuucacagccggcaaaaucaucuucgccgccguuccacccaauuuccccaccgaaggacucucccccucccaaguuacaauguucccccauaucaucgucgacguacgccaacuagaacccgugcucaucccccuccccgacguuagaaauaacuucuaucacuacaaccaaucaaacgacucgaccauaaaacucaucgccaugcucuacaccccucuucgcgcaaacaacgccggugacgacguauucacagucucaugccgaguccuuacucgccccuccccugacuucgacuucaucuucuuaguuccacccaccgucgaaucccgaaccaaacccuucuccguccccguccucaccguagaagaaaugacaaacucccguuucccuaucccccucgaaaaacuauucaccgguccaucauccgccuuugucguccaaccccaaaacggccgcugcaccaccgacggcguauuacucgguacaacccaacuaucaccaguaaacaucugcaccuuuagaggagacgucacacacauacccggcucccgcaacuacaccaugaaccuugccucccaaaacuggaacuccuacgacccaaccgaagaaauccccgcaccccuaggcaccccagacuucguaggcaaaauacaaggcguccuaacccaaacaaccagaacgaacggauccacccgcggccacaaagccaccgucuauaccggcucagccgacuuuucacccaaacucggacgaguccaauucgccaccgacaccgauaacgacuucgaaaccaaccaaaacaccaaauucaccccaguaggcgucauccaagacggaucaaccacaccccgcaacgaaccccaacaauggguccucccauccuacuccggccgcaacauccacaacguccaccucgcucccgccguugccccgaccuuccccggagaacaacuacuguucuuccgcuccaccaugccuggcugcuccggcuacccuaacauggaccucgauugccuucuaccacaagaauggguacaguacuucuaccaagaagccgcacccgcucaaagcgacguagcccuucuccguuucgucaaucccgacaccggucgcgucauguucgaaugcaaacuucacaaaucaggauaugucaccgucgcccacacaggccaacacgaccucgucauaccaccaaacggcuacuuccguuucgacuccuggguuaaucaauucuacacacucgccccaaugggaaacgguacaggaagacgccgcgcacuauaa

SEQ ID NO: 37603 - RNA, 1623 nt, Artificial Sequence
  derived and/or modified sequence opt11 from major_viral_capsid_protein__Norovirus__AFN09987
augaagauggccagcucagaugccaacccauccgacggaucuacugcgaaccuagucccagaaguaaacaacgaagucauggcacuagaacccguaguaggcgcugcuaucgcggcccccgucgcaggacaacaaaacguuaucgaccccuggauccgcaacaacuucguccaagcccccggcggcgaauuuaccgucucaccacgaaacgcccccggcgaaauccuguggucagccccauuaggccccgaccucaaccccuaccucagccauuuagcccguauguacaacggcuacgcugguggcuucgagguccaaguaauccucgcaggaaaugcauucaccgcuggcaaaauaaucuucgccgccgucccacccaacuuccccaccgaaggccucucccccucacaagucaccauguucccacacaucauagucgacguacgacaacucgaacccguccucauaccccuccccgacguccguaacaauuucuaccacuacaaucaaagcaacgacccgaccaucaaauuaaucgccaugcucuacacuccccuccgagcaaacaacgcaggcgacgacguauucacaguaucgugccgaguccucacccgcccuucccccgacuucgacuucaucuuucucgucccucccaccgucgaaucccguacaaaacccuuuuccgucccaguccuuaccgucgaagaaaugaccaacucccgcuucccaauccccuuagaaaaacucuucacaggcccauccuccgccuucgucguccaaccccaaaacggccgcugcaccaccgacggcguccuccuggguacaacacaacuuuccccagucaacaucugcaccuuccgcggugacguuacacacauccccggcaguagaaacuacacaaugaaccucgcaucacaaaauuggaacuccuacgaccccaccgaagaaauccccgccccucucggcacccccgacuucgucgguaaaauccaaggcguacucacccaaaccacccgcaccaacggcuccacccgaggccacaaggccacagucuacacaggcucagccgauuucucaccuaaacucggccgcguccaauucgccaccgauaccgacaacgacuuugaaacuaaccaaaacacaaaauucacccccgucggcgucauccaagacggcuccacaacaccccgaaacgaaccccaacaauggguccuuccaagcuacuccggccgcaacauccacaauguccaccuugcacccgccgucgcccccaccuuccccggagaacaacuucucuuuuuccgcucaacgaugcccggauguagcggcuacccaaacauggaccuugacugccuccucccacaagaauggguccaauacuucuaccaagaagcagcgcccgcacaauccgacgucgcgcuccuccgcuucgucaacccugacacgggacgcguacuauucgaaugcaaacuccacaaauccggguaugucaccguagcccacacaggucaacacgaccucgucaucccaccuaacggguacuuccguuucgacucaugggucaaccaauucuacacccuagccccaaugggcaauggaaccggccgccgccgcgcucucuga

SEQ ID NO: 37604 - RNA, 1623 nt, Artificial Sequence
  derived and/or modified sequence opt11 from major_viral_capsid_protein__Norovirus__AFN09990
augaaaauggccuccucugaugccaacccaucugacggauccaccgcuaaccuuguccccgaagucaacaaugaaguaauggcccucgaacccgucguaggcgcugcaaucgcggcaccagucgcuggacaacaaaaugucaucgaccccuggauccgcaacaacuucguccaagccccaggaggcgaguucaccguauccccacgcaacgcccccggugaaauccuuuggucugcuccccugggucccgaccucaaccccuaccucucccaccuggcccguauguacaacggcuacgccggcggauucgaaguccaagucauccucgcaggcaacgccuuuaccgcuggaaaaaucauauucgccgccgucccacccaacuuccccacugaaggccuaucacccucccaagucacaauguucccccacauaaucguagacguccgccaacucgaacccguccucaucccccuacccgacguccgcaacaauuucuaccacuacaaccaaucaaacgaccccaccauaaaacucaucgccaugcuauacacaccccuccgcgccaacaacgccggcgacgacgucuucaccguaagcugccgagugcucacccgcccuucccccgacuucgauuucauauuccuaguaccaccaaccguagaaucccgcaccaaacccuucucaguaccaguacucaccgucgaagagaugaccaacagccguuuccccauaccccucgagaaguuauucacaggccccucaagcgccuucgucguccagccacaaaacggccgcuguaccaccgacggaguccuccucggaacaacucaacucuccccaguaaacauaugcaccuuccgcggcgacguaacccacauacccggaucuagaaacuacacaaugaaccuagcaucccaaaacuggaacuccuacgaccccacagaagaaauacccgcgccccucggaacccccgacuucgucggcaaaauccaaggaguccucacccaaaccacccgcaccaacggauccaccaggggucacaaagccaccgucuauaccggcuccgccgacuuuuccccuaaacucggccgaguucaauucgcaaccgauaccgacaacgacuucgaaacaaaccaaaacacaaaauuuacccccgucggcguaauacaagacggcuccaccaccccacgcaacgagccccaacaauggguccuucccuccuacuccggccgcaacauccacaacguucaccucgcccccgcagucgccccaaccuucccuggcgagcaacuacucuucuucagauccaccaugccuggcugcucaggauacccaaacauggaccuagacugucuacuaccccaagaauggguucaauauuucuaccaagaagcagccccagcacagagcgacgucgcccuccuccgcuucgucaaccccgauacuggccgcguccuauucgaaugcaaauuacacaaauccggcuacguaacagucgcccacacuggccaacacgaccuaguuauaccacccaacggcuauuuccgcuucgauagcugggucaaccaauucuacacucucgcacccaugggcaauggcaccgggcggcgacgagcccucuaa

SEQ ID NO: 37605 - RNA, 1623 nt, Artificial Sequence
  derived and/or modified sequence opt11 from major_viral_capsid_protein__Norovirus__AFN09993
augaaaauggccucaucagacgccaacccauccgacgguuccacagccaaucucgucccagaaguuaacaacgaggucauggcccuugagcccgucgucggagccgccauagcagcacccguagccggccaacaaaacgucaucgaccccuggauacgaaacaacuucguacaagcuccaggcggcgaguucaccguauccccacgcaacgcccccggcgaaauccucuggucagcaccccucggccccgaucuaaacccauaccugucccaccucgcccgcauguacaacggcuacgccggcggcuucgaaguccaaguaauacucgccggcaaugcauucacagccgguaaaaucauauucgccgccgucccaccuaauuucccaacugaaggacucucacccucccaggucaccauguucccacacaucauaguggacguccgacaauuagaaccaguacuaauaccccucccagacguacgaaacaacuucuaccauuacaaccaaucgaaugaccccacaaucaaacucaucgccaugcucuacacaccccuacgagcaaacaacgccggcgacgacgucuucaccgucuccugccgaguacuaacacgccccucaccagacuucgacuuuaucuuccucguacccccaaccgucgaaucaagaacaaaacccuucucaguacccguacuaacugucgaagaaaugaccaacucccgguucccaaucccucuagaaaaguuauucaccggacccucauccgccuucgucguacaaccucaaaacgaucgcugcacuacugacggcguacuccucggaacaacccaacucucccccgucaacaucugcacauuccgaggagacgucacucacauuccaggcucccguaacuacaccaugaaccuagcaucccaaaacuggaacuccuacgaccccacugaagaaauccccgcaccccucggaacuccagacuucgucggcaaaauccagggcguucuaacccaaaccacccgcaccaacggcagcaccagaggccacaaagccaccgucuacaccggcuccgcagacuucucccccaaauuaggacgaguacaauucgcaaccgacacagacaacgauuucgaaacaaaccaaaacaccaaguucacacccgucggcguaauccaagacggauccaccacaccacgcaaugaaccacaacaauggguccuacccuccuauagcggucgcaacauacacuccguccaccucgccccagccgucgcuccaaccuuccccggugaacaacuacucuucuuucgcagcaccaugcccggaugcucuggcuacccaaacauggaccuagacugccuccucccccaagaauggguucaauacuucuaccaagaagcagccccugcccaauccgacgucgcccuccuccgcuuugucaacccggacaccggccgaguccucuucgaaugcaaacuccacaaauccggauacguaaccgucgcacacacaggccaacacgaccucgucaucccacccaacggauacuuccgcuucgacuccuggguuaaccaauucuacacccucgcacccaugggcaacggaaccggccgccgccgcgcccucuaa

SEQ ID NO: 37606 - RNA, 1623 nt, Artificial Sequence
  derived and/or modified sequence opt11 from major_viral_capsid_protein__Norovirus__AFN09996
augaaaauggccucaucagacgcaaaccccuccgacggcuccacugccaaccuaguccccgaagucaacaacgaagucauggcacucgaaccugucgucggcgcggcaaucgccgccccggucgccggccaacaaaacgucaucgacccguggauccgcaacaauuucguccaagcccccggcggcgaguucacagucucaccacgcaacgcccccggcgaaauccuuuggagcgcaccccuaggccccgaucuuaaccccuaccuaucccaccucgcccgcauguacaacggcuaugccggcggauucgaaguccaaguuauccuagcaggaaacgccuuuaccgcaggcaagaucauauucgccgcaguaccucccaacuucccaaccgaaggacuaagccccagccaaguaaccauguucccacacauaaucgucgacguccgccaacucgagccaguccuaauaccccuccccgacguccguaacaacuuuuaccacuacaaccaauccaacgacccaaccaucaaacucaucgcaaugcucuauacuccccuccgcgcaaauaacgcuggagacgauguuuucaccgucuccugccgcguucucacacgcccaucacccgacuucgacuucauauuccuugucccacccaccgucgaaucacgaacaaaacccuucuccguccccguccucacagucgaagaaaugaccaacucacgcuuccccauaccacucgaaaagcuauucacaggcccauccucugcauucgucguacaaccccagaacggccguugcaccacagacggaguccuccuaggcaccacccagcucuccccugucaacaucugcacuuucagaggagaugucacccacauccccggcucccgcaacuacacgaugaaucuugcuucccaaaacuggaacuccuacgaucccacagaagaaauccccgcuccccucggcacccccgacuucguuggaaaaauccaagguguccuuacucaaacaacacguaccaacggcuccacccgcggacacaaagccaccgucuacacuggcuccgccgacuucagccccaaacuuggcagaguacaguucgccaccgacaccgacaacgacuuugaaacaaaccaaaacacaaaguuuacccccgucgguguuauacaagaugguucaaccacaccccgcaacgaaccccaacaguggguccucccaucauauuccggaagaaacauacacaacguacaccuagccccagcugucgccccaaccuuccccggcgaacaacuccucuucuuccgcagcaccaugcccggcugcucaggcuaccccaauauggaucucgacugccuccucccucaagaauggguccaauacuucuaccaagaagccgccccagcccaauccgacguugcccuccucagauucguuaaccccgacaccggcagagucuuauucgaaugcaaacuucacaaaucaggcuacgucaccgucgcucacaccggccaacacgaucuugucauaccacccaacggcuacuuccguuucgacucauggguaaaccaauucuacacucucgcccccaugggcaacggcacaggccgccgacgcgcccuuuaa

SEQ ID NO: 37607 - RNA, 1623 nt, Artificial Sequence
  derived and/or modified sequence opt11 from major_viral_capsid_protein__Norovirus__AFN09999
augaagauggccucaaacgacgccaaccccuccgacggcucagccgcaaaccucguccccgaagucaacaacgaaguaauggcacucgagccagucgucggagccgccaucgcagcccccguagcaggccaacaaaacguaauagacccauggauacgaaacaauuucguucaagcccccgguggcgaguucaccgucagcccacgcaacgcuccaggagaaauccucugguccgcaccccucggcccagaccucaaccccuaccucucacaccuggcccgaauguacaacggauacgccgguggcuuugaaguccaagucauccucgccggaaacgcuuucaccgccggcaaaaucaucuucgccgccgucccacccaacuuccccaccgaaggccucucacccucccaagucaccauguucccccacaucaucguagacguccgccaacuagaacccguccucaucccccuccccgacguccgcaacaacuucuaccacuacaaccagagcaacgacucuacaauaaaacucaucgcaauguuauacacuccccuccgagccaacaacgccggagaagacgucuucaccgucuccugccgaguccuuacccgccccucacccgacuucgacuuuauauuccucguacccccuaccgucgaaucccgcacuaaacccuucaccguacccauccuaaccguagaagaaaugacuaacucacgcuucccaauaccccuagaaaaacucuucaccggccccucauccgccuuugugguccagccccaaaacggccgaugcacuaccgacggaguucuacucggaaccacucaacucucccccgucaacauaugcacauuucgcggcgacguaacccacaucgcaggcucccgcaacuacaccaugaaccuagcuucgcucaacuggaacaacuaugacccaaccgaagaaauaccugccccacucggaacccccgacuucgucggcaaaauacaaggaguccucacccaaacaaccaaaggagacggcuccacccgcggacacaaagcaaccguauauaccggcuccgcccccuucacucccaaacucggcucaguccaauucagcacagauaccgagaaugacuucgaaacccaccaaaacaccaaauucacccccguaggcgucauccaagacggcggcacgacccaccgcaaugaaccccaacaauggguccucccuucauacucaggacgcgacguccccaacguccaccuugcccccgcaguugcacccaccuuccccggagaacaacuccucuucuuucguucaacaaugccuggcugcucuggcuaucccaacauggaccuugacugccuccuaccccaggaauggguccaacacuucuaccaagaagccgcacccgcacaauccgacgucgcccuacuacgcuucguuaaccccgacaccggacgaguccuauucgaauguaaacuccacaagucaggcuacguaaccgucgcucacaccggacaacacgaccuaguuaucccgcccaacggcuacuuccgcuuugacuccugggucaaccaauucuacacacucgcccccaugggcaacggcaccggccggcgccgcgcacuauag

SEQ ID NO: 37608 - RNA, 1623 nt, Artificial Sequence
  derived and/or modified sequence opt11 from major_viral_capsid_protein__Norovirus__AGC96529
augaaaauggcauccaacgacgcaaacccauccgacggcucggccgcaaaccuaguacccgagguuaacaacgaggucauggcacuagaaccaguugucggcgccgcaauugccgcccccgucgcaggucaacaaaacgucauagacccuuggauccgcaacaacuucguacaagccccaggcggcgaguucaccguauccccacgcaacgcccccggugaaauccucuggucagccccacucggacccgaccucaaccccuaccucucacaccucgcacgcauguacaacggguacgcggguggcuuugaaguccaagucauccucgcaggaaacgccuucacagccggcaaaauaaucuucgcagcuguaccacccaacuuccccacagaaggccuuucacccucccaagucacaauguucccccacaucaucgucgacgucagacaacucgaacccguccucauaccccuucccgacguccgaaacaacuucuaccacuacaaccaaucaaacgacucaaccauaaagcuaauugcuauguuauacacaccccuacgagcaaacaacgcuggcgaagacgucuucacaguuuccugccgcguccucacucgcccgagccccgacuucgacuucauuuuccucguacccccuaccgucgaaucccgcaccaaacccuucaccguccccauccuaaccguagaagaaaugacaaacucccguuucccaaucccccuagaaaaacucuucaccggcccaucauccgcuuucguaguacaaccccaaaacggccguugcacaaccgacggaguccuacuugggacaacccaacucagcccagucaacaucugcaccuuucgcggcgaugucacccacaucgcuggaagccgcaauuacaccaugaaucucgcaucccucaacuggaacaacuacgacccaaccgaagaaauccccgcaccccucggcacacccgacuucguaggcaaaauccaagggaugcuaacacaaaccaccaaaggagacggcuccacccguggccacaaagcaacagucuacaccggaucugcucccuucacucccaaacucggcuccguccaauucuccacugacaccgaaaaugacuucgaaacccaccagaacacaaaauucacuccagucgguguaauccaagacggcuccaccacacaccgcaacgaaccacaacaauggguccuccccuccuacucaggacgggacauacccaauguacaccuagcucccgccgucgcacccacauuccccggcgaacaacuccucuuuuuccgauccacuaugcccggaugcucaggauaccccaacauggaccucgacugccucuuaccccaagaauggguacaacacuucuaccaagaagcagcacccgcccaauccgacgucgcacuccucagauucgucaaccccgacaccggacgcguccuuuucgaaugcaaacuucacaaguccggcuacguaacggucgcucacaccggccaacacgaccuagucaucccaccaaauggcuacuuccgauucgauuccuggguaaaccaauucuacaccuuagcccccaugggcaacggcaccggcagacgccgcgcucuuuaa

SEQ ID NO: 37609 - RNA, 1623 nt, Artificial Sequence
  derived and/or modified sequence opt11 from major_viral_capsid_protein__Norovirus__AGC96532
augaaaauggcauccuccgacgccaacccaagcgacggcuccacagcuaacuuagucccugaagucaacaacgaagucauggcccuagaacccgucgucggcgcagccaucgccgcccccguagccggccagcaaaacgucaucgaccccuggauccgcaacaauuucguacaagcccccggcggagaguucaccguuucuccccgcaacgcacccggcgaaauccucuggucugccccucuuggcccagaccucaaccccuaccucucccaccuagccagaauguacaacggcuacgcagggggauucgaaguccagguaauacuagcaggcaacgcuuucaccgccggaaaaaucaucuucgcugccgucccacccaacuuccccaccgaaggacugucucccucacaagucaccauguucccgcacaucaucgucgacguacgucaacucgaaccuguccuaaucccccuccccgauguccgaaacaauuucuaccacuacaaccaauccaacgacuccacgauaaaacucauagcgaugcuuuacacaccccuacgagcuaacaacgccggagaugacguauucaccguauccugccgcguacucacccgccccuccccagacuucgacuucauuuuccucguaccucccaccgucgaaucccgcaccaaacccuucuccguacccguccuaacagucgaagaaaugaccaacucacgauuccccaucccccuagaaaaauuauucacaggccccucauccgccuucguaguccaaccccaaaacggaagaugcaccacagacggcguucuacuaggaaccacccaacuaucccccgucaacaucugcaccuuccgcggugaugucacccauauacccgguucccgcaacuacaccaugaaccucgccucccaaaacuggaacuccuacgaccccaccgaagaaaccccugccccacucggaacacccgacuucgucgguaaaauacaaggaguacucacacaaaccacccgaaccaacggaagcacacgcggucacaaagccacaguauacaccggaucugccgacuucucccccaaacuaggccgaguacaauucgccaccgacacagacaacgacuucgaaacuaaccaaaacacaaaauucacccccguuggcguuauccaagacggcuccacaacaccccgaaaugaaccucaacaauggguacucccuuccuauucugggagaaacauccacaacguucaucucgcacccgccgucgccccuaccuucccuggcgaacaacuccuauucuuccgaucaaccaugcccggcugcucggguuaccccaacauggaccuggacugccuccucccacaagaauggguccaguacuuuuaccaagaagccgcaccagcacaaucugacgucgcacuccuucgcuucgucaaccccgacaccggccgaguccuuuucgaaugcaagcuccacaaauccggauacguaaccguugcccacacaggccagcacgaccucguaaucccaccaaacggauacuuccgauucgacucauggguaaaccaauucuacacccucgcccccaugggcaacggcaccggccgccgacgcgcucucuga

SEQ ID NO: 37610 - RNA, 1644 nt, Artificial Sequence
  derived and/or modified sequence opt11 from major_viral_capsid_protein__Norovirus__AGC96535
augaaaauggccagcaacgacgccgcaccguccaaugacggcgccgccaaccuaguccccgaagccaacaacgaagucauggcccuugaacccguaguaggcgccucaaucgcagccccaguaguaggccaacaaaacauaaucgaccccuggauccgcgaaaacuucguucaggcaccccaaggcgaauuuaccgucaguccccgcaauuccccaggcgaaauguugcucaaccucgaacucggucccgaacuaaaccccuaccuaucgcaccucuccagaauguacaacggauacgccggaggaaugcaaguacaaguaguucucgccggaaacgccuucaccgccggcaaaaucauauucgcagccguucccccacacuucccagucgaaaacauaucggccgcacaaaucaccaugugcccccacguuauaguagacguccgccaacucgaacccguccuacugccccuccccgacauccgcaaccgguucuuccacuacaaccaagaagacaccccacgcaugcgucuagucgccaugcuauacacaccccuucgcgccaacuccggugaagacgucuucaccgucucaugccggguccugacccgacccgcaccugacuucgaguucaccuuccuuguaccaccaaccgucgaguccaagaccaaaccguucacccucccaauccucacacucggcgaacucucaaacucccgcuuccccgcacccaucgacaugcuauacaccgacccaaacgaaaccaucgucguccagccccaaaacggccggugcacacucgacggaacacuccaaggcacaacacagcuaguccccacacaaaucugcuccuuccgaggcacacuaauaucccaaaccagccgauccgccgacuccacagacuccgcaccccgaguacgcaaccacccucuucacguccaacucaaaaacuuagacgguacccccuacgauccaaccgacgagguccccgccguccuuggagccauagauuucaaaggaaccgucuucggagucgccucccaacgcaacacaaccggaucaucagucggcgccacacgagcccacgaaguacacaucgacacaacgaacccccgcuacacccccaaacuugguucaguucucaugcacucggaaucaagcgacuucgacgacggccaacccacccgauucaccccaaucggcaugggagccgacgacuggcaccaaugggaacuccccgaauacucuggacaccuuacacuaaacaugaaccucgcccccgccguagcccccgccuuccccggagaacgaauccuauucuuccgauccguagucccauccgccggcggauacggcucaggccaaauagacugccucauaccccaagaauggguccaacacuucuaccaagaggccgccccaagucagucagccguugcacucauccgcuacgucaaccccgacacuggucgaaacauauucgaagcaaaacuccaccgcgaaggcuucauaacagucgccaacucaggaaacaaccccaucgucguaccacccaacggcuacuuccgcuucgaagccugggucaaccaguuuuacacacuaaccccaaugggcacuggacaaggccgucgccgcguccaauga

SEQ ID NO: 37611 - RNA, 1623 nt, Artificial Sequence
  derived and/or modified sequence opt11 from major_viral_capsid_protein__Norovirus__AGS16690
augaaaauggccuccaacgacgccaaccccuccgacggcucagcagccaaccucgucccagaaguaaacaacgaaguaauggcauuagaacccguugucggagcugccaucgcugcaccugucgccggccaacaaaacgucaucgaccccuggauccguaacaacuucguucaggccccaggcggcgaguucaccgucucaccccgcaacgccccaggagaaauccuaugguccgcaccccucggcccagaccuaaacccuuaccucucccaccuugcccgcauguacaacggauacgccggaggcuuugaaguccagguaauccuagcugguaacgcuuucaccgccggaaaaaucaucuucgcagccgucccacccaacuuccccaccgaaggccuaucccccucccaagucaccauguucccccacaucaucgucgacguccgacaacuugaacccguccuuaucccccuccccgacguccguaacaauuucuaccacuacaaccaaucaaacgacuccacaaucaaacucaucgccaugcuauacacaccccugcgugcaaacaacgccggcgaagacgucuucaccgucucaugccgaguccuaacucgaccgucaccagacuucgacuuuaucuuccucguaccucccacagucgaaucccguaccaaacccuucacagucccaauccucaccguugaagaaaugacaaacucccgcuuccccauccccuuagaaaaacuauucacuggacccucauccgccuucguaguacagccacaaaacggccgaugcaccaccgacggcguacuccucggaaccacacaacucucaccugucaacaucugcacauuccgcggagacgucacccauaucgcgggaucucgcaacuacacaaugaaccuagccucccucaacuggaacaauuacgaccccacagaagaaauccccgcaccccuagguaccccggacuucgucggaaaaauccaaggaguacuaacgcaaacuaccaaaggagacggcuccacucgcggccacaaagccacugucuauacuggcucugccccauucacaccaaaacuaggauccguccaauucucaaccgacaccgaaaacgacuucgaaacccaucaaaacaccaaauucaccccagucggcguaauccaagacggaggcaccacccaccgcaacgaaccccaacaauggguccucccaaacuacucagguuccgacguacccaacguacaccuugccccagcagucgcgccuaacuuucccggagaacaacucuuauucuuccgaucaaccaugcccggaugcuccggcuacccuaacauggaccuagacugccuguugccccaagaauggguucaacauuucuaccaagaagccgcacccgcccagucugacgucgcccuacucagauuugucaaccccgacaccggccgaguccucuuugaauguaaacuccacaaauccggauacguuacaguagcacacaccggucagcacgaccuaguaauacccccaaacggauacuuccgcuucgacucuuggguuaaccaauucuacacccucgcccccauggguaacggcacaggacgacgccgagcacuauaa

SEQ ID NO: 37612 - RNA, 1623 nt, Artificial Sequence
  derived and/or modified sequence opt11 from major_viral_capsid_protein__Norovirus__AGS16693
augaaaauggccagcaacgacgccaaccccuccgacgguucagcggcaaaccucguccccgaagucaacaacgaagucauggcacucgaaccagucgucggagccgccauagcagccccagucgcuggacaacaaaacgucaucgacccuuggauccgaaacaacuuuguacaagcccccgggggcgaguucaccgucucaccccgcaacgccccaggagaaauccucugguccgcuccccuaggacccgaccuuaaccccuaccuaucccacuuagcccgcauguauaacggcuacgccggcggcuucgaaguccaaguaauccucgccggcaacgccuucacugccggcaagaucaucuucgccgcagucccacccaacuuccccaccgaaggacucucccccucacaagucacaauguucccccacaucaucgucgacguccgccaacucgaacccguccucaucccccuaccagaugucagaaacaacuucuaccacuacaaccaauccaacgacagcacaaucaaacucaucgcaaugcuauacacuccccuccgugcuaacaacgccggcgaagacguuuucaccguaucaugucgaguccuaacaagacccuccccagacuucgacuucauauuccuaguaccaccaacuguagaaucccgcaccaaacccuuuaccguaccaauccuaacagucgaagaaaugaccaacucccgcuuccccaucccucuggaaaaacucuucacaggccccucuucagcuuucgucguccagccucaaaacggccgcuguaccacugacggcguccuccucggcaccacccaacuauccccgguaaacauuugcaccuuccgaggcgacgucacccacaucgccggaucccguaacuacaccaugaaccucgccucacucaacuggaacaacuacgaccccacugaagaaaucccagcgccccucggcacacccgacuucgucggaaagauacaaggcguacuaacacaaaccacaaaaggagacgguuccacccgcggacacaaggccacaguauacaccggcagcgccccauucaccccaaaacucggcuccguacaauucuccaccgauaccgaaaacgacuucgaaacccaucaaaacacaaaauucacaccugucggaguaauccaagacggaggcaccacccaccgcaacgaaccccaacaguggguccuccccaacuacucaggcucugacguuccaaacguccaccucgcaccagccguagcccccaacuucccuggcgaacaacuccuauucuuccgcuccacaaugcccggcugcuccggauaccccaacauggaccucgacugccuccucccacaggaauggguccaacacuuuuaucaagaagccgcaccagcacaaagcgacguugcacugcuccgcuucguaaaccccgacaccggccgaguacuauucgaaugcaaacuccacaaauccggauacgucacagucgcacacaccggccaacacgaccuuguaauaccacccaauggauacuuccguuucgauuccuggguaaaccaauuuuacacacucgccccaaugggaaacggcaccggacgccgacgcgcccuuuaa

SEQ ID NO: 37613 - RNA, 1623 nt, Artificial Sequence
  derived and/or modified sequence opt11 from major_viral_capsid_protein__Norovirus__ALM98919
augaaaauggcguccaacgacgccgcccccuccaacgacggggcugcaggccucguacccgaaggcaauaacgaaacccucccacuagaacccguagccggcgccgccauagccgccccuguaaccggccaaaacaacaucauagaccccuggauccgcacuaacuucguucaagcccccaacggcgaguucaccgucucaccccgaaacucccccggcgaaauccuacuuaaccuagaacucggccccgaccuuaaccccuaccucgcccaccucucccgaauguacaacggauacgccggcggcgucgaaguccaaguccuacuagccggcaacgccuuuacagccgguaaaauccucuucgccgcagugccucccaacuuccccgucgaauuucuaucccccgcccaaauuaccaugcucccccaccucaucgucgacguccgcacacuagaacccaucaugaucccccuccccgacguacgcaacacauucuuucacuacuccaaccaacccaacucaagaaugagacucgucgcuaugcucuacacaccacuccgcagcaacgguuccggcgacgacgucuucaccguaucaugucgcgugcucacccgucccacucccgacuucgaguucacauaccucgucccuccauccgucgaaucuaaaaccaaaccauucucccuacccauccucacccuaagcgaacuaaccaacucacgcuuccccguccccauagacucacuuuuuaccgcccaaaacaauguacuacaaguccaaugccaaaacggccguugcacccucgacggugaacuacaggggacaacccaacuacuaccaucuggaaucugugcuuuccgaggacgcgucaccgcucaaaucaaccagcgcgaccgcuggcacaugcaacuucagaaccucaacggcaccacauaugaucccaccgacgacguaccagcuccccucggaacccccgacuucaaaggagucguauucggcauggucucacaacgaaacgucggcaaugacgcucccgguuccacacgcgcucaacaagccugggucucuaccuauagcccccaauucguacccaaacucggcuccgucaaccuccgcaucucugacaacgacgacuuccaauuccaaccaacaaaauuuacuccaguaggcguaaacgacgaugacgacggucaccccuuccgccaaugggaacuaccuaacuacucaggcgaacucacacucaacaugaaccucgcacccccgguugcccccaacuuccccggcgaacaacuacuauucuuccgcucguucguaccaugcuccggcggcuauaaccagggcaucaucgacugccucaucccccaagaguggauccaacacuucuaccaagaaucagccccaucacaaucagacguugcccugauccgcuacgucaacccagacaccggacgcacacuauucgaagccaaacuccaccguucagguuacaucaccgucgcucauucaggcgacuacccccucgucguucccgccaacggacacuuucgcuucgacuccugggucaaccaauucuacucacuugccccaaugggcaccgguaacggacgccgccgcgcccaauaa
